United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 39

SEQ ID NO: 1737757 - RNA, 14 nt, Human
gaaacccugucucu

SEQ ID NO: 1737758 - RNA, 23 nt, Human
gaaacccagcucugguccauaga

SEQ ID NO: 1737759 - RNA, 19 nt, Human
gaaaccccuguaggccuca

SEQ ID NO: 1737760 - RNA, 19 nt, Human
gaaacccagcucuggucca

SEQ ID NO: 1737761 - RNA, 18 nt, Human
gaaacccagcucuggucc

SEQ ID NO: 1737762 - RNA, 16 nt, Human
gaaacccagcucuggu

SEQ ID NO: 1737763 - RNA, 15 nt, Human
gaaacccagcucugg

SEQ ID NO: 1737764 - RNA, 14 nt, Human
gaaacccagcucug

SEQ ID NO: 1737765 - RNA, 13 nt, Human
gaaacccagcucu

SEQ ID NO: 1737766 - RNA, 21 nt, Human
gaaagcuugcccuggugccuc

SEQ ID NO: 1737767 - RNA, 14 nt, Human
gaaagcagggacuu

SEQ ID NO: 1737768 - RNA, 22 nt, Human
gaaagcccugagcuuucugcua

SEQ ID NO: 1737769 - RNA, 21 nt, Human
gaaagcccugagcuuucugcu

SEQ ID NO: 1737770 - RNA, 17 nt, Human
gaaagcccugagcuuuc

SEQ ID NO: 1737771 - RNA, 22 nt, Human
gaaagcagaacagugauuacca

SEQ ID NO: 1737772 - RNA, 17 nt, Human
gaaagcagaacagugau

SEQ ID NO: 1737773 - RNA, 16 nt, Human
gaaagaguaggaagac

SEQ ID NO: 1737774 - RNA, 15 nt, Human
gaaagaguaggaaga

SEQ ID NO: 1737775 - RNA, 21 nt, Human
gaaagaguacucuuguuuccu

SEQ ID NO: 1737776 - RNA, 21 nt, Human
gaaagaggaaugaaguacuca

SEQ ID NO: 1737777 - RNA, 19 nt, Human
gaaagacuuuuccaacccu

SEQ ID NO: 1737778 - RNA, 13 nt, Human
ccuguagcccuaa

SEQ ID NO: 1737779 - RNA, 16 nt, Human
ccuguagagugggagc

SEQ ID NO: 1737780 - RNA, 15 nt, Human
ccuguagagugggag

SEQ ID NO: 1737781 - RNA, 19 nt, Human
ccuguagagugggagcuga

SEQ ID NO: 1737782 - RNA, 14 nt, Human
ccugguggcagugg

SEQ ID NO: 1737783 - RNA, 13 nt, Human
ccugguggcagug

SEQ ID NO: 1737784 - RNA, 15 nt, Human
ccugguggcaguggg

SEQ ID NO: 1737785 - RNA, 10 nt, Human
ccuguaccuc

SEQ ID NO: 1737786 - RNA, 12 nt, Human
ccuguaccucuu

SEQ ID NO: 1737787 - RNA, 16 nt, Human
ccugucccccugacaa

SEQ ID NO: 1737788 - RNA, 15 nt, Human
ccugucccccugaca

SEQ ID NO: 1737789 - RNA, 14 nt, Human
ccugucccccugac

SEQ ID NO: 1737790 - RNA, 13 nt, Human
ccugucccccuga

SEQ ID NO: 1737791 - RNA, 12 nt, Human
ccugucccccug

SEQ ID NO: 1737792 - RNA, 18 nt, Human
ccugguggcagcugcggu

SEQ ID NO: 1737793 - RNA, 17 nt, Human
ccugguggcagcugcgg

SEQ ID NO: 1737794 - RNA, 16 nt, Human
ccugguggcagcugcg

SEQ ID NO: 1737795 - RNA, 15 nt, Human
ccugguggcagcugc

SEQ ID NO: 1737796 - RNA, 14 nt, Human
ccugguggcagcug

SEQ ID NO: 1737797 - RNA, 22 nt, Human
ccugguggcagcucaccucucc

SEQ ID NO: 1737798 - RNA, 21 nt, Human
ccugguggcagcucaccucuc

SEQ ID NO: 1737799 - RNA, 19 nt, Human
ccugguggcagcucaccuc

SEQ ID NO: 1737800 - RNA, 19 nt, Human
ccugggggcugggcagagg

SEQ ID NO: 1737801 - RNA, 21 nt, Human
ccugggggcugggcagaggaa

SEQ ID NO: 1737802 - RNA, 20 nt, Human
ccugggggcugggcagagga

SEQ ID NO: 1737803 - RNA, 16 nt, Human
ccugggcagaaggaag

SEQ ID NO: 1737804 - RNA, 18 nt, Human
ccugggagugagcugguu

SEQ ID NO: 1737805 - RNA, 16 nt, Human
ccugggagugagcugg

SEQ ID NO: 1737806 - RNA, 22 nt, Human
ccugggaggucaaggcugcagu

SEQ ID NO: 1737807 - RNA, 16 nt, Human
ccuggcccacugcauc

SEQ ID NO: 1737808 - RNA, 16 nt, Human
ccuggcuuuucacugc

SEQ ID NO: 1737809 - RNA, 18 nt, Human
ccuggcuuuucacugcug

SEQ ID NO: 1737810 - RNA, 17 nt, Human
ccuggcuuuucacugcu

SEQ ID NO: 1737811 - RNA, 23 nt, Human
ccuggccagaugcaccagcccuu

SEQ ID NO: 1737812 - RNA, 21 nt, Human
ccuggccagaugcaccagccc

SEQ ID NO: 1737813 - RNA, 14 nt, Human
ccuggcccacugca

SEQ ID NO: 1737814 - RNA, 13 nt, Human
ccuggcccacugc

SEQ ID NO: 1737815 - RNA, 13 nt, Human
ccuggccacgccc

SEQ ID NO: 1737816 - RNA, 13 nt, Human
ccuggcaugggaa

SEQ ID NO: 1737817 - RNA, 16 nt, Human
ccuggcacugcuucca

SEQ ID NO: 1737818 - RNA, 13 nt, Human
ccuggcacugcuu

SEQ ID NO: 1737819 - RNA, 12 nt, Human
ccuggcacugcu

SEQ ID NO: 1737820 - RNA, 21 nt, Human
ccuggcacccggccccugcug

SEQ ID NO: 1737821 - RNA, 20 nt, Human
ccuggcacccggccccugcu

SEQ ID NO: 1737822 - RNA, 19 nt, Human
ccuggcacccggccccugc

SEQ ID NO: 1737823 - RNA, 16 nt, Human
ccuggagaacuagaga

SEQ ID NO: 1737824 - RNA, 13 nt, Human
ccuggagaacuag

SEQ ID NO: 1737825 - RNA, 12 nt, Human
ccuggagaacua

SEQ ID NO: 1737826 - RNA, 21 nt, Human
ccugcuaauuccccagauugc

SEQ ID NO: 1737827 - RNA, 20 nt, Human
ccugccuguugggccaggag

SEQ ID NO: 1737828 - RNA, 19 nt, Human
ccugccuguugggccagga

SEQ ID NO: 1737829 - RNA, 18 nt, Human
ccugccuguugggccagg

SEQ ID NO: 1737830 - RNA, 14 nt, Human
ccuggcaugggaau

SEQ ID NO: 1737831 - RNA, 11 nt, Human
ccucuuccuga

SEQ ID NO: 1737832 - RNA, 13 nt, Human
ccugaaagaggaa

SEQ ID NO: 1737833 - RNA, 14 nt, Human
ccugaaagcccuga

SEQ ID NO: 1737834 - RNA, 13 nt, Human
ccugaaagcccug

SEQ ID NO: 1737835 - RNA, 18 nt, Human
ccugaaagcccugagcuu

SEQ ID NO: 1737836 - RNA, 21 nt, Human
ccugaaggccccgcccaggcu

SEQ ID NO: 1737837 - RNA, 20 nt, Human
ccugaaggccccgcccaggc

SEQ ID NO: 1737838 - RNA, 22 nt, Human
ccugaaggccccgcccaggcuu

SEQ ID NO: 1737839 - RNA, 19 nt, Human
ccugaaggccccgcccagg

SEQ ID NO: 1737840 - RNA, 18 nt, Human
ccugaaggccccgcccag

SEQ ID NO: 1737841 - RNA, 14 nt, Human
ccugaaggccccgc

SEQ ID NO: 1737842 - RNA, 15 nt, Human
ccugagcugggauga

SEQ ID NO: 1737843 - RNA, 17 nt, Human
ccugaggcuccacuugg

SEQ ID NO: 1737844 - RNA, 13 nt, Human
ccugaggcuccac

SEQ ID NO: 1737845 - RNA, 14 nt, Human
ccugaggcuccacu

SEQ ID NO: 1737846 - RNA, 16 nt, Human
ccugaggcugggcucc

SEQ ID NO: 1737847 - RNA, 15 nt, Human
ccugaggcugggcuc

SEQ ID NO: 1737848 - RNA, 14 nt, Human
ccugaggcugggcu

SEQ ID NO: 1737849 - RNA, 13 nt, Human
ccugaggcugggc

SEQ ID NO: 1737850 - RNA, 18 nt, Human
ccugaggcccagagggcc

SEQ ID NO: 1737851 - RNA, 17 nt, Human
ccugaggcccagagggc

SEQ ID NO: 1737852 - RNA, 16 nt, Human
ccugaggcccagaggg

SEQ ID NO: 1737853 - RNA, 15 nt, Human
ccugaggcccagagg

SEQ ID NO: 1737854 - RNA, 12 nt, Human
ccugagcuggga

SEQ ID NO: 1737855 - RNA, 18 nt, Human
ccugagccagauuucacu

SEQ ID NO: 1737856 - RNA, 16 nt, Human
ccugagccagauuuca

SEQ ID NO: 1737857 - RNA, 15 nt, Human
ccugagccagauuuc

SEQ ID NO: 1737858 - RNA, 20 nt, Human
ccugaagucacacagugagu

SEQ ID NO: 1737859 - RNA, 22 nt, Human
ccugaagucuuuguacagacaa

SEQ ID NO: 1737860 - RNA, 19 nt, Human
ccugaaguaagcaaagacu

SEQ ID NO: 1737861 - RNA, 20 nt, Human
ccugagccagauuucacucu

SEQ ID NO: 1737862 - RNA, 19 nt, Human
ccugccaauggacuaacuu

SEQ ID NO: 1737863 - RNA, 19 nt, Human
ccugccaccacgcccggcu

SEQ ID NO: 1737864 - RNA, 15 nt, Human
ccugccaccacgccc

SEQ ID NO: 1737865 - RNA, 23 nt, Human
ccugcauuugugaaaugauggug

SEQ ID NO: 1737866 - RNA, 13 nt, Human
ccugccacccugg

SEQ ID NO: 1737867 - RNA, 12 nt, Human
ccugccacccug

SEQ ID NO: 1737868 - RNA, 14 nt, Human
ccugccacccuggg

SEQ ID NO: 1737869 - RNA, 22 nt, Human
ccugccacccuggggagaaagu

SEQ ID NO: 1737870 - RNA, 16 nt, Human
ccugccacccugggga

SEQ ID NO: 1737871 - RNA, 21 nt, Human
ccugcacacgcuccuuccucu

SEQ ID NO: 1737872 - RNA, 19 nt, Human
ccugcaaagcccagcuuga

SEQ ID NO: 1737873 - RNA, 23 nt, Human
ccugcacaaagcccuuccauguc

SEQ ID NO: 1737874 - RNA, 14 nt, Human
ccugcaaagcccag

SEQ ID NO: 1737875 - RNA, 16 nt, Human
ccugcaaagcccagcu

SEQ ID NO: 1737876 - RNA, 15 nt, Human
ccugcaaagcccagc

SEQ ID NO: 1737877 - RNA, 20 nt, Human
ccugcacaaagcccuuccau

SEQ ID NO: 1737878 - RNA, 22 nt, Human
ccugcacaaagcccuuccaugu

SEQ ID NO: 1737879 - RNA, 18 nt, Human
ccugcaaagcccagcuug

SEQ ID NO: 1737880 - RNA, 17 nt, Human
ccugcaaagcccagcuu

SEQ ID NO: 1737881 - RNA, 17 nt, Human
ccugccccugagcccau

SEQ ID NO: 1737882 - RNA, 22 nt, Human
ccugccccuccucucugcccua

SEQ ID NO: 1737883 - RNA, 21 nt, Human
ccugccccuccucucugcccu

SEQ ID NO: 1737884 - RNA, 20 nt, Human
ccugccccuccucucugccc

SEQ ID NO: 1737885 - RNA, 19 nt, Human
ccugccccuccucucugcc

SEQ ID NO: 1737886 - RNA, 14 nt, Human
ccugccccucccuu

SEQ ID NO: 1737887 - RNA, 18 nt, Human
ccugccccuccucucugc

SEQ ID NO: 1737888 - RNA, 18 nt, Human
ccugccccucccuucaac

SEQ ID NO: 1737889 - RNA, 16 nt, Human
ccugccccucccuuca

SEQ ID NO: 1737890 - RNA, 15 nt, Human
ccugccccucccuuc

SEQ ID NO: 1737891 - RNA, 16 nt, Human
ccugcccggcugcgga

SEQ ID NO: 1737892 - RNA, 14 nt, Human
ccugcccggcugcg

SEQ ID NO: 1737893 - RNA, 14 nt, Human
ccugccccccagcc

SEQ ID NO: 1737894 - RNA, 15 nt, Human
ccugccaggcauggu

SEQ ID NO: 1737895 - RNA, 12 nt, Human
ccugccaggcau

SEQ ID NO: 1737896 - RNA, 14 nt, Human
ccugccuguugggc

SEQ ID NO: 1737897 - RNA, 22 nt, Human
ccugccuguucccauucuugca

SEQ ID NO: 1737898 - RNA, 14 nt, Human
ccugccucagccuc

SEQ ID NO: 1737899 - RNA, 13 nt, Human
ccugccucagccu

SEQ ID NO: 1737900 - RNA, 12 nt, Human
ccugccucagcc

SEQ ID NO: 1737901 - RNA, 22 nt, Human
ccugcccuuaccugccaggaag

SEQ ID NO: 1737902 - RNA, 21 nt, Human
ccugcccuuaccugccaggaa

SEQ ID NO: 1737903 - RNA, 19 nt, Human
ccugcccuuaccugccagg

SEQ ID NO: 1737904 - RNA, 15 nt, Human
ccugcccugugggcc

SEQ ID NO: 1737905 - RNA, 14 nt, Human
ccugcccugugggc

SEQ ID NO: 1737906 - RNA, 12 nt, Human
ccugcccugugg

SEQ ID NO: 1737907 - RNA, 11 nt, Human
ccugcccugug

SEQ ID NO: 1737908 - RNA, 23 nt, Human
ccugcccugguuuccugcccugg

SEQ ID NO: 1737909 - RNA, 22 nt, Human
ccugcccugguuuccugcccug

SEQ ID NO: 1737910 - RNA, 21 nt, Human
ccugcccugguuuccugcccu

SEQ ID NO: 1737911 - RNA, 20 nt, Human
ccugcccugguuuccugccc

SEQ ID NO: 1737912 - RNA, 19 nt, Human
ccugcccugguuuccugcc

SEQ ID NO: 1737913 - RNA, 14 nt, Human
ccugcccugguuuc

SEQ ID NO: 1737914 - RNA, 22 nt, Human
ccugcccugggaggcagugaug

SEQ ID NO: 1737915 - RNA, 20 nt, Human
ccugcccugggaggcaguga

SEQ ID NO: 1737916 - RNA, 15 nt, Human
ccugcccugggaggc

SEQ ID NO: 1737917 - RNA, 14 nt, Human
ccugcccugggagg

SEQ ID NO: 1737918 - RNA, 12 nt, Human
ccugcccuggga

SEQ ID NO: 1737919 - RNA, 10 nt, Human
ccugcccugg

SEQ ID NO: 1737920 - RNA, 22 nt, Human
ccugccuguugggccaggagcc

SEQ ID NO: 1737921 - RNA, 14 nt, Human
ccuuugugaggaag

SEQ ID NO: 1737922 - RNA, 23 nt, Human
ccuuuguccccaccgcagacagg

SEQ ID NO: 1737923 - RNA, 22 nt, Human
ccuuuguccccaccgcagacag

SEQ ID NO: 1737924 - RNA, 23 nt, Human
ccuuugugaggaagccgcugggg

SEQ ID NO: 1737925 - RNA, 17 nt, Human
ccuuugugaggaagccg

SEQ ID NO: 1737926 - RNA, 16 nt, Human
ccuuugugaggaagcc

SEQ ID NO: 1737927 - RNA, 15 nt, Human
ccuuugugaggaagc

SEQ ID NO: 1737928 - RNA, 15 nt, Human
ccuuuuuuggcugcu

SEQ ID NO: 1737929 - RNA, 14 nt, Human
ccuuuguccccacc

SEQ ID NO: 1737930 - RNA, 18 nt, Human
ccuuuguccccaccgcag

SEQ ID NO: 1737931 - RNA, 16 nt, Human
ccuuuguccccaccgc

SEQ ID NO: 1737932 - RNA, 24 nt, Human
ccuuuguauucucuccuguaccuc

SEQ ID NO: 1737933 - RNA, 23 nt, Human
ccuuuguaaauugucagaugcug

SEQ ID NO: 1737934 - RNA, 22 nt, Human
ccuuuguauucucuccuguacc

SEQ ID NO: 1737935 - RNA, 23 nt, Human
ccuuuguauucucuccuguaccu

SEQ ID NO: 1737936 - RNA, 21 nt, Human
ccuuuguaaauugucagaugc

SEQ ID NO: 1737937 - RNA, 23 nt, Human
cgaacauguuuuucuucucccuc

SEQ ID NO: 1737938 - RNA, 21 nt, Human
cgaacauguuuuucuucuccc

SEQ ID NO: 1737939 - RNA, 22 nt, Human
ccuuuuuuggcugcugaaggcu

SEQ ID NO: 1737940 - RNA, 20 nt, Human
ccuuuuuuggcugcugaagg

SEQ ID NO: 1737941 - RNA, 18 nt, Human
ccuuuuuuggcugcugaa

SEQ ID NO: 1737942 - RNA, 17 nt, Human
ccuuuuuuggcugcuga

SEQ ID NO: 1737943 - RNA, 23 nt, Human
cgaaagggacuuggaagcuccgc

SEQ ID NO: 1737944 - RNA, 14 nt, Human
cgaauauugcugau

SEQ ID NO: 1737945 - RNA, 12 nt, Human
cgaauauugcug

SEQ ID NO: 1737946 - RNA, 11 nt, Human
cgaauauugcu

SEQ ID NO: 1737947 - RNA, 16 nt, Human
cgaauagcugggacua

SEQ ID NO: 1737948 - RNA, 17 nt, Human
cgaauauugcugauggu

SEQ ID NO: 1737949 - RNA, 15 nt, Human
cgaauauugcugaug

SEQ ID NO: 1737950 - RNA, 17 nt, Human
ccuucggccuccauccu

SEQ ID NO: 1737951 - RNA, 18 nt, Human
ccuucggccuccauccug

SEQ ID NO: 1737952 - RNA, 13 nt, Human
ccuuccaggggug

SEQ ID NO: 1737953 - RNA, 18 nt, Human
ccuuccaugucgccucug

SEQ ID NO: 1737954 - RNA, 17 nt, Human
ccuuccauggacuuugu

SEQ ID NO: 1737955 - RNA, 16 nt, Human
ccuucucuccagcccc

SEQ ID NO: 1737956 - RNA, 15 nt, Human
ccuucucuccagccc

SEQ ID NO: 1737957 - RNA, 13 nt, Human
ccuucucuccagc

SEQ ID NO: 1737958 - RNA, 12 nt, Human
ccuucucuccag

SEQ ID NO: 1737959 - RNA, 20 nt, Human
ccugugccucugggacugga

SEQ ID NO: 1737960 - RNA, 20 nt, Human
ccugugggcccccaaaugga

SEQ ID NO: 1737961 - RNA, 20 nt, Human
ccuguggaugauaaaacaca

SEQ ID NO: 1737962 - RNA, 18 nt, Human
ccuguggaucaaauccag

SEQ ID NO: 1737963 - RNA, 15 nt, Human
ccuuggauugucccc

SEQ ID NO: 1737964 - RNA, 22 nt, Human
ccuuggcucaaguccucuuuuc

SEQ ID NO: 1737965 - RNA, 19 nt, Human
ccuuggauuguccccgacc

SEQ ID NO: 1737966 - RNA, 21 nt, Human
ccuugacagggcacaccgggc

SEQ ID NO: 1737967 - RNA, 18 nt, Human
ccuugacagggcacaccg

SEQ ID NO: 1737968 - RNA, 18 nt, Human
ccuucucuccagccccug

SEQ ID NO: 1737969 - RNA, 17 nt, Human
ccuucucuccagccccu

SEQ ID NO: 1737970 - RNA, 23 nt, Human
ccuugacauuguagagcuucugg

SEQ ID NO: 1737971 - RNA, 16 nt, Human
ccuuggcugcagggag

SEQ ID NO: 1737972 - RNA, 14 nt, Human
ccuuggggagcagg

SEQ ID NO: 1737973 - RNA, 20 nt, Human
ccuuggugucgggcaugaca

SEQ ID NO: 1737974 - RNA, 19 nt, Human
ccuuggugucgggcaugac

SEQ ID NO: 1737975 - RNA, 21 nt, Human
ccuuggugucgggcaugacac

SEQ ID NO: 1737976 - RNA, 19 nt, Human
ccuucucuccagccccugg

SEQ ID NO: 1737977 - RNA, 24 nt, Human
cgcuacccgggaagggggcuggga

SEQ ID NO: 1737978 - RNA, 21 nt, Human
cgcuacccgggaagggggcug

SEQ ID NO: 1737979 - RNA, 18 nt, Human
cgcuacccgggaaggggg

SEQ ID NO: 1737980 - RNA, 14 nt, Human
cgcgacaaugcaaa

SEQ ID NO: 1737981 - RNA, 15 nt, Human
cgcgacaaugcaaac

SEQ ID NO: 1737982 - RNA, 19 nt, Human
cgcgguggcucacgccugu

SEQ ID NO: 1737983 - RNA, 21 nt, Human
cgcccagucuggaaugcagug

SEQ ID NO: 1737984 - RNA, 18 nt, Human
cgcccggcuaauuuuugu

SEQ ID NO: 1737985 - RNA, 19 nt, Human
cgcccagucuggaaugcag

SEQ ID NO: 1737986 - RNA, 13 nt, Human
cgcccagucugga

SEQ ID NO: 1737987 - RNA, 18 nt, Human
cgcccaacuaauuuuugu

SEQ ID NO: 1737988 - RNA, 19 nt, Human
cgcagcccugcagagggca

SEQ ID NO: 1737989 - RNA, 18 nt, Human
cgcagcccugcagagggc

SEQ ID NO: 1737990 - RNA, 24 nt, Human
cgcagcccugcuuugggcugcccu

SEQ ID NO: 1737991 - RNA, 15 nt, Human
cgcagcccugcuuug

SEQ ID NO: 1737992 - RNA, 13 nt, Human
cgcagcccugcuu

SEQ ID NO: 1737993 - RNA, 19 nt, Human
cgcugugcugcccugccca

SEQ ID NO: 1737994 - RNA, 23 nt, Human
cgcugugcugcccugcccaccug

SEQ ID NO: 1737995 - RNA, 21 nt, Human
cgcugugcugcccugcccacc

SEQ ID NO: 1737996 - RNA, 14 nt, Human
cgcugugcugcccu

SEQ ID NO: 1737997 - RNA, 13 nt, Human
cgcugugcugccc

SEQ ID NO: 1737998 - RNA, 11 nt, Human
cgcugugcugc

SEQ ID NO: 1737999 - RNA, 17 nt, Human
cggaauaguuggcuagg

SEQ ID NO: 1738000 - RNA, 16 nt, Human
cggaauaguuggcuag

SEQ ID NO: 1738001 - RNA, 14 nt, Human
cgcuuucuacccag

SEQ ID NO: 1738002 - RNA, 16 nt, Human
cgcuuucuacccagcg

SEQ ID NO: 1738003 - RNA, 17 nt, Human
cggagaaaggaagggcu

SEQ ID NO: 1738004 - RNA, 15 nt, Human
cggagaaaggaaggg

SEQ ID NO: 1738005 - RNA, 17 nt, Human
cggacuuagcugggaga

SEQ ID NO: 1738006 - RNA, 22 nt, Human
cggacagccacggccaggccag

SEQ ID NO: 1738007 - RNA, 21 nt, Human
cggacagccacggccaggcca

SEQ ID NO: 1738008 - RNA, 16 nt, Human
cggacuuagcugggag

SEQ ID NO: 1738009 - RNA, 20 nt, Human
cggccaggccagagggagug

SEQ ID NO: 1738010 - RNA, 12 nt, Human
cggccaggccag

SEQ ID NO: 1738011 - RNA, 11 nt, Human
cggccaggcca

SEQ ID NO: 1738012 - RNA, 14 nt, Human
cggcuggcagccca

SEQ ID NO: 1738013 - RNA, 13 nt, Human
cggcuggccuggc

SEQ ID NO: 1738014 - RNA, 23 nt, Human
cggcuggcagcccaccccucaac

SEQ ID NO: 1738015 - RNA, 14 nt, Human
cggcuggccuggcc

SEQ ID NO: 1738016 - RNA, 20 nt, Human
cgggaagggggcugggacau

SEQ ID NO: 1738017 - RNA, 19 nt, Human
cgggaagggggcugggaca

SEQ ID NO: 1738018 - RNA, 16 nt, Human
cgggaagggggcuggg

SEQ ID NO: 1738019 - RNA, 18 nt, Human
cgggaauuuucaucuagg

SEQ ID NO: 1738020 - RNA, 20 nt, Human
cgggaauuuucaucuaggau

SEQ ID NO: 1738021 - RNA, 16 nt, Human
cgaggacagggaggug

SEQ ID NO: 1738022 - RNA, 19 nt, Human
cgagcccugguggcagugg

SEQ ID NO: 1738023 - RNA, 13 nt, Human
cgagccuggcucc

SEQ ID NO: 1738024 - RNA, 17 nt, Human
cgcagcccugcagaggg

SEQ ID NO: 1738025 - RNA, 15 nt, Human
cgcagcccugcagag

SEQ ID NO: 1738026 - RNA, 20 nt, Human
cgcagcauauucaggaagcu

SEQ ID NO: 1738027 - RNA, 19 nt, Human
cgcagcauauucaggaagc

SEQ ID NO: 1738028 - RNA, 17 nt, Human
cgcacugggcuugggga

SEQ ID NO: 1738029 - RNA, 23 nt, Human
cgcacuucgggaggucgaggcag

SEQ ID NO: 1738030 - RNA, 13 nt, Human
cgcacugggcuug

SEQ ID NO: 1738031 - RNA, 23 nt, Human
cucagcggggacagcuccuucug

SEQ ID NO: 1738032 - RNA, 15 nt, Human
cucagcucccaaggc

SEQ ID NO: 1738033 - RNA, 19 nt, Human
cucagcucccaaggcucug

SEQ ID NO: 1738034 - RNA, 21 nt, Human
cucagcggggacagcuccuuc

SEQ ID NO: 1738035 - RNA, 20 nt, Human
cucagcggggacagcuccuu

SEQ ID NO: 1738036 - RNA, 19 nt, Human
cucagcggggacagcuccu

SEQ ID NO: 1738037 - RNA, 18 nt, Human
cucagcggggacagcucc

SEQ ID NO: 1738038 - RNA, 16 nt, Human
cucagcggggacagcu

SEQ ID NO: 1738039 - RNA, 15 nt, Human
cucagcggggacagc

SEQ ID NO: 1738040 - RNA, 14 nt, Human
cucagcggggacag

SEQ ID NO: 1738041 - RNA, 21 nt, Human
cucagcaaaagaugcuucuca

SEQ ID NO: 1738042 - RNA, 16 nt, Human
cucagcaggggagggu

SEQ ID NO: 1738043 - RNA, 20 nt, Human
cucagcaaaagaugcuucuc

SEQ ID NO: 1738044 - RNA, 19 nt, Human
cucagcaaaagaugcuucu

SEQ ID NO: 1738045 - RNA, 22 nt, Human
cucagcauccuggcacccggcc

SEQ ID NO: 1738046 - RNA, 21 nt, Human
cucagcauccuggcacccggc

SEQ ID NO: 1738047 - RNA, 13 nt, Human
cucagcauccugg

SEQ ID NO: 1738048 - RNA, 15 nt, Human
cucagcauccuggca

SEQ ID NO: 1738049 - RNA, 21 nt, Human
cucagcccucccugccccucc

SEQ ID NO: 1738050 - RNA, 20 nt, Human
cucagcccucccugccccuc

SEQ ID NO: 1738051 - RNA, 19 nt, Human
cucagcccucccugccccu

SEQ ID NO: 1738052 - RNA, 14 nt, Human
cucagcccucccug

SEQ ID NO: 1738053 - RNA, 16 nt, Human
cucagaucuucugugg

SEQ ID NO: 1738054 - RNA, 19 nt, Human
cucacuguugcccaggcug

SEQ ID NO: 1738055 - RNA, 18 nt, Human
cucacuguugcccaggcu

SEQ ID NO: 1738056 - RNA, 17 nt, Human
cucacuguugcccaggc

SEQ ID NO: 1738057 - RNA, 16 nt, Human
cucacuguugcccagg

SEQ ID NO: 1738058 - RNA, 19 nt, Human
cucagagagggugggagug

SEQ ID NO: 1738059 - RNA, 23 nt, Human
cucagagagggugggagugggcc

SEQ ID NO: 1738060 - RNA, 15 nt, Human
cucagagccaccccu

SEQ ID NO: 1738061 - RNA, 16 nt, Human
cucacugcagccucaa

SEQ ID NO: 1738062 - RNA, 15 nt, Human
cucacugcagccuca

SEQ ID NO: 1738063 - RNA, 20 nt, Human
cucacugcauccuccgccuc

SEQ ID NO: 1738064 - RNA, 15 nt, Human
cucacuguugcccag

SEQ ID NO: 1738065 - RNA, 14 nt, Human
cucacuguugccca

SEQ ID NO: 1738066 - RNA, 18 nt, Human
cucagcugucaaggcuca

SEQ ID NO: 1738067 - RNA, 19 nt, Human
cucagcugucaaggcucag

SEQ ID NO: 1738068 - RNA, 23 nt, Human
cucaggagcccugggaggcucug

SEQ ID NO: 1738069 - RNA, 22 nt, Human
cucaggagcccugggaggcucu

SEQ ID NO: 1738070 - RNA, 21 nt, Human
cucaggagcccugggaggcuc

SEQ ID NO: 1738071 - RNA, 20 nt, Human
cucaggagcccugggaggcu

SEQ ID NO: 1738072 - RNA, 17 nt, Human
cucaggagcccugggag

SEQ ID NO: 1738073 - RNA, 16 nt, Human
cucaggagcccuggga

SEQ ID NO: 1738074 - RNA, 15 nt, Human
cucaggagcccuggg

SEQ ID NO: 1738075 - RNA, 14 nt, Human
cucaggagcccugg

SEQ ID NO: 1738076 - RNA, 13 nt, Human
cucaggagcccug

SEQ ID NO: 1738077 - RNA, 12 nt, Human
cucaggagcccu

SEQ ID NO: 1738078 - RNA, 24 nt, Human
cucaggagcccugggaggcucugg

SEQ ID NO: 1738079 - RNA, 18 nt, Human
cucaggcaggugggaugg

SEQ ID NO: 1738080 - RNA, 15 nt, Human
cucaggcagguggga

SEQ ID NO: 1738081 - RNA, 20 nt, Human
cucagggccuggcucaggug

SEQ ID NO: 1738082 - RNA, 19 nt, Human
cucagggccuggcucaggu

SEQ ID NO: 1738083 - RNA, 18 nt, Human
cucagggccuggcucagg

SEQ ID NO: 1738084 - RNA, 22 nt, Human
cucagggucccugguggcagcu

SEQ ID NO: 1738085 - RNA, 21 nt, Human
cucagggucccugguggcagc

SEQ ID NO: 1738086 - RNA, 20 nt, Human
cucagggucccugguggcag

SEQ ID NO: 1738087 - RNA, 14 nt, Human
cucagggccugguc

SEQ ID NO: 1738088 - RNA, 24 nt, Human
cucagggucccugguggcagcuca

SEQ ID NO: 1738089 - RNA, 24 nt, Human
cucagguaaucgaccugccucggc

SEQ ID NO: 1738090 - RNA, 22 nt, Human
cucagguaaucgaccugccucg

SEQ ID NO: 1738091 - RNA, 20 nt, Human
cucagguaaucgaccugccu

SEQ ID NO: 1738092 - RNA, 21 nt, Human
cucagguggggucacucuggc

SEQ ID NO: 1738093 - RNA, 20 nt, Human
cucagguggggucacucugg

SEQ ID NO: 1738094 - RNA, 19 nt, Human
cucagguggggucacucug

SEQ ID NO: 1738095 - RNA, 23 nt, Human
cucaggugauccacccaccucag

SEQ ID NO: 1738096 - RNA, 16 nt, Human
cucccaucacuucccu

SEQ ID NO: 1738097 - RNA, 22 nt, Human
cucccaggcgccccuucccccu

SEQ ID NO: 1738098 - RNA, 20 nt, Human
cucccaggcgccccuucccc

SEQ ID NO: 1738099 - RNA, 19 nt, Human
cucccaggcgccccuuccc

SEQ ID NO: 1738100 - RNA, 17 nt, Human
cucccaggcgccccuuc

SEQ ID NO: 1738101 - RNA, 23 nt, Human
cucccaaagugcugggauuacag

SEQ ID NO: 1738102 - RNA, 16 nt, Human
cucccaaagugcuggg

SEQ ID NO: 1738103 - RNA, 15 nt, Human
cucccaacucacccc

SEQ ID NO: 1738104 - RNA, 14 nt, Human
cucccaacucaccc

SEQ ID NO: 1738105 - RNA, 15 nt, Human
cucccacaaaggaga

SEQ ID NO: 1738106 - RNA, 16 nt, Human
cucccaacucacccca

SEQ ID NO: 1738107 - RNA, 17 nt, Human
cuccaugcugccuccag

SEQ ID NO: 1738108 - RNA, 16 nt, Human
cuccaugcugccucca

SEQ ID NO: 1738109 - RNA, 15 nt, Human
cuccaugcugccucc

SEQ ID NO: 1738110 - RNA, 14 nt, Human
cuccaugcugccuc

SEQ ID NO: 1738111 - RNA, 13 nt, Human
cuccaugcugccu

SEQ ID NO: 1738112 - RNA, 23 nt, Human
cuccagcuggccgggagccugau

SEQ ID NO: 1738113 - RNA, 22 nt, Human
cuccagcuggccgggagccuga

SEQ ID NO: 1738114 - RNA, 23 nt, Human
cucccgaauagcugggacuacag

SEQ ID NO: 1738115 - RNA, 20 nt, Human
cucccgaauagcugggacua

SEQ ID NO: 1738116 - RNA, 18 nt, Human
cucccucagucuggcccu

SEQ ID NO: 1738117 - RNA, 15 nt, Human
cucccuucauccuuc

SEQ ID NO: 1738118 - RNA, 23 nt, Human
cucccuucaaccauuccccaugg

SEQ ID NO: 1738119 - RNA, 22 nt, Human
cucccuucaaccauuccccaug

SEQ ID NO: 1738120 - RNA, 21 nt, Human
cucccuucaaccauuccccau

SEQ ID NO: 1738121 - RNA, 20 nt, Human
cuccccagccccaucccaaa

SEQ ID NO: 1738122 - RNA, 23 nt, Human
cuccccugcuggguguggcgcag

SEQ ID NO: 1738123 - RNA, 21 nt, Human
cuccccugcuggguguggcgc

SEQ ID NO: 1738124 - RNA, 21 nt, Human
cucauuugucacacacuuugg

SEQ ID NO: 1738125 - RNA, 17 nt, Human
cuccaaacccucgaggc

SEQ ID NO: 1738126 - RNA, 15 nt, Human
cuccaaacccucgag

SEQ ID NO: 1738127 - RNA, 21 nt, Human
cuccaaacccucgaggcggau

SEQ ID NO: 1738128 - RNA, 21 nt, Human
cucauugaccugaggcccuuc

SEQ ID NO: 1738129 - RNA, 19 nt, Human
cucauugaccugaggcccu

SEQ ID NO: 1738130 - RNA, 17 nt, Human
cucauugaccugaggcc

SEQ ID NO: 1738131 - RNA, 12 nt, Human
cucauucuucug

SEQ ID NO: 1738132 - RNA, 18 nt, Human
cucauucuccuuguguua

SEQ ID NO: 1738133 - RNA, 22 nt, Human
cucauucuccuuguguuacuaa

SEQ ID NO: 1738134 - RNA, 16 nt, Human
cuccagagucagaagu

SEQ ID NO: 1738135 - RNA, 14 nt, Human
cuccacuggaugga

SEQ ID NO: 1738136 - RNA, 21 nt, Human
cuccagaccccuggcuuuuca

SEQ ID NO: 1738137 - RNA, 18 nt, Human
cuccagcucaccagcccc

SEQ ID NO: 1738138 - RNA, 16 nt, Human
cuccagcucaccagcc

SEQ ID NO: 1738139 - RNA, 15 nt, Human
cuccagcucaccagc

SEQ ID NO: 1738140 - RNA, 14 nt, Human
cuccagccccugga

SEQ ID NO: 1738141 - RNA, 13 nt, Human
cuccagccccugg

SEQ ID NO: 1738142 - RNA, 11 nt, Human
cuccagccccu

SEQ ID NO: 1738143 - RNA, 13 nt, Human
cuccacugccuuc

SEQ ID NO: 1738144 - RNA, 13 nt, Human
cuccacuggaugg

SEQ ID NO: 1738145 - RNA, 16 nt, Human
cuccacugccuucgau

SEQ ID NO: 1738146 - RNA, 15 nt, Human
cuccacugccuucga

SEQ ID NO: 1738147 - RNA, 14 nt, Human
cuccacugccuucg

SEQ ID NO: 1738148 - RNA, 23 nt, Human
cuccaaguccacaguggaaccag

SEQ ID NO: 1738149 - RNA, 22 nt, Human
cuccaaguccacaguggaacca

SEQ ID NO: 1738150 - RNA, 12 nt, Human
cuauaauuuaaa

SEQ ID NO: 1738151 - RNA, 13 nt, Human
cuauaauuuaaau

SEQ ID NO: 1738152 - RNA, 17 nt, Human
cuaggaagacuuuggaa

SEQ ID NO: 1738153 - RNA, 15 nt, Human
cuaggaagacuuugg

SEQ ID NO: 1738154 - RNA, 20 nt, Human
cuaggaacacuccuucacag

SEQ ID NO: 1738155 - RNA, 21 nt, Human
cuauagccuaggugacagagu

SEQ ID NO: 1738156 - RNA, 20 nt, Human
cuauagccuaggugacagag

SEQ ID NO: 1738157 - RNA, 18 nt, Human
cuauagccuaggugacag

SEQ ID NO: 1738158 - RNA, 19 nt, Human
cuauagccuaggugacaga

SEQ ID NO: 1738159 - RNA, 22 nt, Human
cuaugaaguuuuuuuuauacag

SEQ ID NO: 1738160 - RNA, 15 nt, Human
cuaugauuuggaaaa

SEQ ID NO: 1738161 - RNA, 19 nt, Human
cuaugauuuaauuugaaau

SEQ ID NO: 1738162 - RNA, 20 nt, Human
cuaugauuuaauuugaaaua

SEQ ID NO: 1738163 - RNA, 19 nt, Human
cuaugauuuggaaaauaaa

SEQ ID NO: 1738164 - RNA, 19 nt, Human
cuaugggggcacugaggac

SEQ ID NO: 1738165 - RNA, 17 nt, Human
cuauucaguaauaacuc

SEQ ID NO: 1738166 - RNA, 16 nt, Human
cuauguaucaaugagu

SEQ ID NO: 1738167 - RNA, 13 nt, Human
cuauguaucaaug

SEQ ID NO: 1738168 - RNA, 23 nt, Human
cuauucaguaauaacucuacccu

SEQ ID NO: 1738169 - RNA, 14 nt, Human
cucaacucuccucc

SEQ ID NO: 1738170 - RNA, 15 nt, Human
cucaaauuucuaaau

SEQ ID NO: 1738171 - RNA, 17 nt, Human
cucaaauuucuaaaucu

SEQ ID NO: 1738172 - RNA, 14 nt, Human
cucaaauuucuaaa

SEQ ID NO: 1738173 - RNA, 18 nt, Human
cucaacucuccuccagag

SEQ ID NO: 1738174 - RNA, 16 nt, Human
cucaacucuccuccag

SEQ ID NO: 1738175 - RNA, 19 nt, Human
cucaacucuccuccagagu

SEQ ID NO: 1738176 - RNA, 23 nt, Human
cucacacggacacucaaaagcug

SEQ ID NO: 1738177 - RNA, 14 nt, Human
cucaaguccucuuu

SEQ ID NO: 1738178 - RNA, 17 nt, Human
cucacagaacccuugga

SEQ ID NO: 1738179 - RNA, 16 nt, Human
cuauugcugcuugagg

SEQ ID NO: 1738180 - RNA, 11 nt, Human
cuauugguaaa

SEQ ID NO: 1738181 - RNA, 23 nt, Human
cuagaaaugauccccagcuguuu

SEQ ID NO: 1738182 - RNA, 20 nt, Human
cuacuguccuacccacccuc

SEQ ID NO: 1738183 - RNA, 22 nt, Human
cuacuuagcaugucccuaccga

SEQ ID NO: 1738184 - RNA, 17 nt, Human
cuacuuagcaugucccu

SEQ ID NO: 1738185 - RNA, 17 nt, Human
cuagagguucaaagaua

SEQ ID NO: 1738186 - RNA, 18 nt, Human
cuagagguucaaagauau

SEQ ID NO: 1738187 - RNA, 21 nt, Human
cuagagguucaaagauauuuu

SEQ ID NO: 1738188 - RNA, 19 nt, Human
cuacucgaguuacagacaa

SEQ ID NO: 1738189 - RNA, 16 nt, Human
cuacucgaguuacaga

SEQ ID NO: 1738190 - RNA, 15 nt, Human
cuacucgaguuacag

SEQ ID NO: 1738191 - RNA, 19 nt, Human
cuaccgagucucuucucca

SEQ ID NO: 1738192 - RNA, 17 nt, Human
cuaccgagucucuucuc

SEQ ID NO: 1738193 - RNA, 23 nt, Human
cuaccgagucucuucuccacugg

SEQ ID NO: 1738194 - RNA, 22 nt, Human
cuaccgagucucuucuccacug

SEQ ID NO: 1738195 - RNA, 21 nt, Human
cuaccgagucucuucuccacu

SEQ ID NO: 1738196 - RNA, 19 nt, Human
cuacuguccuacccacccu

SEQ ID NO: 1738197 - RNA, 13 nt, Human
cuacucuguguca

SEQ ID NO: 1738198 - RNA, 12 nt, Human
cuacucuguguc

SEQ ID NO: 1738199 - RNA, 23 nt, Human
cuagccuuagaagucacacagua

SEQ ID NO: 1738200 - RNA, 22 nt, Human
cuagccuuagaagucacacagu

SEQ ID NO: 1738201 - RNA, 21 nt, Human
cuagccuuagaagucacacag

SEQ ID NO: 1738202 - RNA, 22 nt, Human
cuagccugugccucugggacug

SEQ ID NO: 1738203 - RNA, 19 nt, Human
cuagccugugccucuggga

SEQ ID NO: 1738204 - RNA, 21 nt, Human
cuagccugugccucugggacu

SEQ ID NO: 1738205 - RNA, 24 nt, Human
cuagauacuguaucaugacaaaga

SEQ ID NO: 1738206 - RNA, 13 nt, Human
cuagauacuguau

SEQ ID NO: 1738207 - RNA, 16 nt, Human
cuagauacuguaucau

SEQ ID NO: 1738208 - RNA, 13 nt, Human
cuacauucuguua

SEQ ID NO: 1738209 - RNA, 14 nt, Human
cuacauucuguuaa

SEQ ID NO: 1738210 - RNA, 22 nt, Human
cuacauuauaaaugucucuuua

SEQ ID NO: 1738211 - RNA, 17 nt, Human
cuacccagcgagcccug

SEQ ID NO: 1738212 - RNA, 15 nt, Human
cuacccagcgagccc

SEQ ID NO: 1738213 - RNA, 13 nt, Human
cuacccacccucc

SEQ ID NO: 1738214 - RNA, 13 nt, Human
cuacccaggugcu

SEQ ID NO: 1738215 - RNA, 18 nt, Human
cuacccagcgagcccugg

SEQ ID NO: 1738216 - RNA, 17 nt, Human
cuacccucuuagaaaaa

SEQ ID NO: 1738217 - RNA, 17 nt, Human
cuacacugugcugaguc

SEQ ID NO: 1738218 - RNA, 14 nt, Human
cuacacugugcuga

SEQ ID NO: 1738219 - RNA, 13 nt, Human
cuacacugugcug

SEQ ID NO: 1738220 - RNA, 20 nt, Human
cuacagaggccaugggccuc

SEQ ID NO: 1738221 - RNA, 18 nt, Human
cuacagaggccaugggcc

SEQ ID NO: 1738222 - RNA, 22 nt, Human
cuacagaggccaugggccuccu

SEQ ID NO: 1738223 - RNA, 22 nt, Human
cuacagcuugaccgugaggcca

SEQ ID NO: 1738224 - RNA, 19 nt, Human
cuacagcuugaccgugagg

SEQ ID NO: 1738225 - RNA, 23 nt, Human
cuacagcuugaccgugaggccag

SEQ ID NO: 1738226 - RNA, 19 nt, Human
cuacagcuaaucagcauuc

SEQ ID NO: 1738227 - RNA, 18 nt, Human
cuacagcuaaucagcauu

SEQ ID NO: 1738228 - RNA, 22 nt, Human
cuacagcuaaucagcauucuca

SEQ ID NO: 1738229 - RNA, 21 nt, Human
cuacagcuaaucagcauucuc

SEQ ID NO: 1738230 - RNA, 20 nt, Human
cuacauggaguauaugucaa

SEQ ID NO: 1738231 - RNA, 18 nt, Human
cuacauggaguauauguc

SEQ ID NO: 1738232 - RNA, 13 nt, Human
cuacaguccuccc

SEQ ID NO: 1738233 - RNA, 16 nt, Human
cuacaggugugaguca

SEQ ID NO: 1738234 - RNA, 14 nt, Human
cuacaggugugagu

SEQ ID NO: 1738235 - RNA, 16 nt, Human
cuacaggagugagcac

SEQ ID NO: 1738236 - RNA, 15 nt, Human
cuacaggagugagca

SEQ ID NO: 1738237 - RNA, 14 nt, Human
cuacaggagugagc

SEQ ID NO: 1738238 - RNA, 17 nt, Human
cuacaggcacccaccau

SEQ ID NO: 1738239 - RNA, 15 nt, Human
cuacaggcacccacc

SEQ ID NO: 1738240 - RNA, 23 nt, Human
cuacacgagauacagaauuuuau

SEQ ID NO: 1738241 - RNA, 21 nt, Human
cuacacaggggaaaagaggag

SEQ ID NO: 1738242 - RNA, 14 nt, Human
cuaauuccacagcu

SEQ ID NO: 1738243 - RNA, 16 nt, Human
cuaauuccacagcugc

SEQ ID NO: 1738244 - RNA, 15 nt, Human
cuaauuccacagcug

SEQ ID NO: 1738245 - RNA, 18 nt, Human
cuaauauguaacaagcca

SEQ ID NO: 1738246 - RNA, 21 nt, Human
cuaaucagcauucucacuccu

SEQ ID NO: 1738247 - RNA, 20 nt, Human
cuaaucagcauucucacucc

SEQ ID NO: 1738248 - RNA, 20 nt, Human
cuaaugcgcaggcuggcccu

SEQ ID NO: 1738249 - RNA, 19 nt, Human
cuaaugcgcaggcuggccc

SEQ ID NO: 1738250 - RNA, 16 nt, Human
cuaaugcgcaggcugg

SEQ ID NO: 1738251 - RNA, 15 nt, Human
cuaaugcgcaggcug

SEQ ID NO: 1738252 - RNA, 13 nt, Human
cuaaugggacacu

SEQ ID NO: 1738253 - RNA, 12 nt, Human
cuaaugggacac

SEQ ID NO: 1738254 - RNA, 23 nt, Human
cuaaugcgcaggcuggcccugcc

SEQ ID NO: 1738255 - RNA, 22 nt, Human
cuaaugcgcaggcuggcccugc

SEQ ID NO: 1738256 - RNA, 22 nt, Human
cuaauuauacccccugcaaagc

SEQ ID NO: 1738257 - RNA, 17 nt, Human
cuaauagacaauuuauu

SEQ ID NO: 1738258 - RNA, 19 nt, Human
cuaauagacaauuuauuau

SEQ ID NO: 1738259 - RNA, 23 nt, Human
cuaauagacaauuuauuauggca

SEQ ID NO: 1738260 - RNA, 14 nt, Human
cuaauaaagcugug

SEQ ID NO: 1738261 - RNA, 17 nt, Human
cuaauaacaugugaaaa

SEQ ID NO: 1738262 - RNA, 21 nt, Human
cuaagcuucacuguaaaauaa

SEQ ID NO: 1738263 - RNA, 22 nt, Human
cuaagcuauucaguaauaacuc

SEQ ID NO: 1738264 - RNA, 13 nt, Human
cuaaacugccccc

SEQ ID NO: 1738265 - RNA, 12 nt, Human
cuaaacugcccc

SEQ ID NO: 1738266 - RNA, 22 nt, Human
cuaaaugaaaaucgugacaaca

SEQ ID NO: 1738267 - RNA, 21 nt, Human
cuaaaucuccaaaauaaaacu

SEQ ID NO: 1738268 - RNA, 17 nt, Human
cuaaauauauuuuaaga

SEQ ID NO: 1738269 - RNA, 21 nt, Human
cuaaacugcccccucugcccu

SEQ ID NO: 1738270 - RNA, 20 nt, Human
cgggaggcagagguugcagu

SEQ ID NO: 1738271 - RNA, 23 nt, Human
cgggaccccgagccuggcuccaa

SEQ ID NO: 1738272 - RNA, 23 nt, Human
cgggaggauguucugggacacag

SEQ ID NO: 1738273 - RNA, 20 nt, Human
cguuuguuccccaagacauu

SEQ ID NO: 1738274 - RNA, 15 nt, Human
cuaaaauaauuuugu

SEQ ID NO: 1738275 - RNA, 17 nt, Human
cuaaaauaauuuuguaa

SEQ ID NO: 1738276 - RNA, 18 nt, Human
cuaaaauaauuuuguaau

SEQ ID NO: 1738277 - RNA, 19 nt, Human
cuaaauugacacuuaaaaa

SEQ ID NO: 1738278 - RNA, 16 nt, Human
cuaaauucaugcugcu

SEQ ID NO: 1738279 - RNA, 20 nt, Human
cuaacaacauuguagccuca

SEQ ID NO: 1738280 - RNA, 14 nt, Human
cuaaccacgcugga

SEQ ID NO: 1738281 - RNA, 12 nt, Human
cuaaccacgcug

SEQ ID NO: 1738282 - RNA, 23 nt, Human
cuaagagggagggagggcuccag

SEQ ID NO: 1738283 - RNA, 22 nt, Human
cuaagagggagggagggcucca

SEQ ID NO: 1738284 - RNA, 15 nt, Human
cuaagagggagggag

SEQ ID NO: 1738285 - RNA, 13 nt, Human
cuaagagggaggg

SEQ ID NO: 1738286 - RNA, 13 nt, Human
cguuuucaaaauu

SEQ ID NO: 1738287 - RNA, 19 nt, Human
cccuguuuguuucugaaag

SEQ ID NO: 1738288 - RNA, 23 nt, Human
cccuuaccugccaggaagccagc

SEQ ID NO: 1738289 - RNA, 20 nt, Human
cccuuaccugccaggaagcc

SEQ ID NO: 1738290 - RNA, 17 nt, Human
cccuuaccugccaggaa

SEQ ID NO: 1738291 - RNA, 14 nt, Human
cccuguucuggcag

SEQ ID NO: 1738292 - RNA, 13 nt, Human
cccuguucuggca

SEQ ID NO: 1738293 - RNA, 15 nt, Human
cccuggugcugccac

SEQ ID NO: 1738294 - RNA, 14 nt, Human
cccuguaggccuca

SEQ ID NO: 1738295 - RNA, 15 nt, Human
cccuguaggccucag

SEQ ID NO: 1738296 - RNA, 15 nt, Human
cccugguggcagugg

SEQ ID NO: 1738297 - RNA, 14 nt, Human
cccugguggcagug

SEQ ID NO: 1738298 - RNA, 13 nt, Human
cccugguggcagu

SEQ ID NO: 1738299 - RNA, 21 nt, Human
cccugguggcagcucaccucu

SEQ ID NO: 1738300 - RNA, 14 nt, Human
cccuggugcugcca

SEQ ID NO: 1738301 - RNA, 13 nt, Human
cccuggugcugcc

SEQ ID NO: 1738302 - RNA, 21 nt, Human
cccuggugaccagcaccaucu

SEQ ID NO: 1738303 - RNA, 17 nt, Human
cccuuacgugaguccug

SEQ ID NO: 1738304 - RNA, 15 nt, Human
cccuuacgugagucc

SEQ ID NO: 1738305 - RNA, 14 nt, Human
cccuuagcagggaa

SEQ ID NO: 1738306 - RNA, 20 nt, Human
cccuuagaaguuuguuguga

SEQ ID NO: 1738307 - RNA, 23 nt, Human
cccuuagcagggaaacagcuaau

SEQ ID NO: 1738308 - RNA, 12 nt, Human
cccuuccaugga

SEQ ID NO: 1738309 - RNA, 20 nt, Human
cccuuccaugucgccucugc

SEQ ID NO: 1738310 - RNA, 18 nt, Human
cccuucaaccauucccca

SEQ ID NO: 1738311 - RNA, 14 nt, Human
cccuucaaccauuc

SEQ ID NO: 1738312 - RNA, 21 nt, Human
cccugcucuccgaccagacac

SEQ ID NO: 1738313 - RNA, 22 nt, Human
cccugcucuccgaccagacacc

SEQ ID NO: 1738314 - RNA, 21 nt, Human
cccugcugagucccaggcuga

SEQ ID NO: 1738315 - RNA, 23 nt, Human
cccugcugagucccaggcugagc

SEQ ID NO: 1738316 - RNA, 15 nt, Human
cccugccucucugca

SEQ ID NO: 1738317 - RNA, 21 nt, Human
cccugcgggucacaggaggga

SEQ ID NO: 1738318 - RNA, 19 nt, Human
cccugcgggucacaggagg

SEQ ID NO: 1738319 - RNA, 12 nt, Human
cccugaggccca

SEQ ID NO: 1738320 - RNA, 11 nt, Human
cccugccuccu

SEQ ID NO: 1738321 - RNA, 14 nt, Human
cccugccucucugc

SEQ ID NO: 1738322 - RNA, 13 nt, Human
cccugccucucug

SEQ ID NO: 1738323 - RNA, 16 nt, Human
cccuggugcugccaca

SEQ ID NO: 1738324 - RNA, 11 nt, Human
cccucugccca

SEQ ID NO: 1738325 - RNA, 18 nt, Human
cccucugcccacucccug

SEQ ID NO: 1738326 - RNA, 15 nt, Human
cccucugcccacucc

SEQ ID NO: 1738327 - RNA, 19 nt, Human
cccucugcccacucccugc

SEQ ID NO: 1738328 - RNA, 14 nt, Human
cccucugcccugcg

SEQ ID NO: 1738329 - RNA, 13 nt, Human
cccucugcccugc

SEQ ID NO: 1738330 - RNA, 12 nt, Human
cccucugcccug

SEQ ID NO: 1738331 - RNA, 12 nt, Human
cccucuggggcu

SEQ ID NO: 1738332 - RNA, 21 nt, Human
cccucuguucugcacacagca

SEQ ID NO: 1738333 - RNA, 20 nt, Human
cccucuguucugcacacagc

SEQ ID NO: 1738334 - RNA, 22 nt, Human
cccucuggcuccagcuggccgg

SEQ ID NO: 1738335 - RNA, 17 nt, Human
cccucuggcuccagcug

SEQ ID NO: 1738336 - RNA, 16 nt, Human
cccucuggcuccagcu

SEQ ID NO: 1738337 - RNA, 12 nt, Human
cccucuggcucc

SEQ ID NO: 1738338 - RNA, 20 nt, Human
cccucuuucccucccuuccu

SEQ ID NO: 1738339 - RNA, 17 nt, Human
cccucuuucccucccuu

SEQ ID NO: 1738340 - RNA, 12 nt, Human
cccucuuucccu

SEQ ID NO: 1738341 - RNA, 14 nt, Human
cccucccugccccu

SEQ ID NO: 1738342 - RNA, 23 nt, Human
cccucccucuuucccucccuucc

SEQ ID NO: 1738343 - RNA, 14 nt, Human
cccgcucagcccuc

SEQ ID NO: 1738344 - RNA, 12 nt, Human
cccucccacagc

SEQ ID NO: 1738345 - RNA, 13 nt, Human
cccgcucagcccu

SEQ ID NO: 1738346 - RNA, 12 nt, Human
cccgcucagccc

SEQ ID NO: 1738347 - RNA, 14 nt, Human
cccucccacagcgc

SEQ ID NO: 1738348 - RNA, 15 nt, Human
cccgcucagcccucc

SEQ ID NO: 1738349 - RNA, 15 nt, Human
ccuaacgaaguaucc

SEQ ID NO: 1738350 - RNA, 15 nt, Human
ccuacaguguacagu

SEQ ID NO: 1738351 - RNA, 11 nt, Human
ccguggcuucc

SEQ ID NO: 1738352 - RNA, 21 nt, Human
ccuacaguugaaaaacagcug

SEQ ID NO: 1738353 - RNA, 16 nt, Human
ccuacaguguacaguc

SEQ ID NO: 1738354 - RNA, 20 nt, Human
ccuacaguguacagucuugu

SEQ ID NO: 1738355 - RNA, 17 nt, Human
ccuaccgagucucuucu

SEQ ID NO: 1738356 - RNA, 16 nt, Human
ccuaccgagucucuuc

SEQ ID NO: 1738357 - RNA, 21 nt, Human
ccuaccgagucucuucuccac

SEQ ID NO: 1738358 - RNA, 20 nt, Human
ccuaccgagucucuucucca

SEQ ID NO: 1738359 - RNA, 19 nt, Human
ccuaccgagucucuucucc

SEQ ID NO: 1738360 - RNA, 18 nt, Human
ccuaggugacagagugag

SEQ ID NO: 1738361 - RNA, 14 nt, Human
ccguggcuucccgc

SEQ ID NO: 1738362 - RNA, 13 nt, Human
ccgggccacagag

SEQ ID NO: 1738363 - RNA, 22 nt, Human
ccgggcacucagaagacacuga

SEQ ID NO: 1738364 - RNA, 21 nt, Human
ccggcuccaggcuccuuuagc

SEQ ID NO: 1738365 - RNA, 16 nt, Human
ccggcuccaggcuccu

SEQ ID NO: 1738366 - RNA, 15 nt, Human
ccgggcucugccucc

SEQ ID NO: 1738367 - RNA, 14 nt, Human
ccgggcucugccuc

SEQ ID NO: 1738368 - RNA, 18 nt, Human
ccgggcucugccucccau

SEQ ID NO: 1738369 - RNA, 18 nt, Human
ccgugaggccagagacac

SEQ ID NO: 1738370 - RNA, 11 nt, Human
ccgcuggggcc

SEQ ID NO: 1738371 - RNA, 14 nt, Human
ccgcuggggccagu

SEQ ID NO: 1738372 - RNA, 14 nt, Human
ccggaggggccugg

SEQ ID NO: 1738373 - RNA, 16 nt, Human
ccggaggggccuggca

SEQ ID NO: 1738374 - RNA, 15 nt, Human
ccggaggggccuggc

SEQ ID NO: 1738375 - RNA, 16 nt, Human
ccgaguagcugggacu

SEQ ID NO: 1738376 - RNA, 14 nt, Human
ccgaguagcuggga

SEQ ID NO: 1738377 - RNA, 18 nt, Human
ccgagucucuucuccacu

SEQ ID NO: 1738378 - RNA, 16 nt, Human
ccgagucucuucucca

SEQ ID NO: 1738379 - RNA, 14 nt, Human
ccgagucucuucuc

SEQ ID NO: 1738380 - RNA, 20 nt, Human
ccgaguagcugagauuauag

SEQ ID NO: 1738381 - RNA, 19 nt, Human
ccgagcuuugaaaauucag

SEQ ID NO: 1738382 - RNA, 23 nt, Human
ccgcacugggcuuggggaccaga

SEQ ID NO: 1738383 - RNA, 21 nt, Human
ccgagucucuucuccacugga

SEQ ID NO: 1738384 - RNA, 20 nt, Human
ccgagucucuucuccacugg

SEQ ID NO: 1738385 - RNA, 19 nt, Human
ccgagucucuucuccacug

SEQ ID NO: 1738386 - RNA, 15 nt, Human
ccgcagacaggacca

SEQ ID NO: 1738387 - RNA, 19 nt, Human
ccgagauugcaccacugca

SEQ ID NO: 1738388 - RNA, 15 nt, Human
ccgagauugcaccac

SEQ ID NO: 1738389 - RNA, 21 nt, Human
ccgagauugcaccacugcacu

SEQ ID NO: 1738390 - RNA, 18 nt, Human
ccgagauagccaaggcca

SEQ ID NO: 1738391 - RNA, 14 nt, Human
cccaugagccucag

SEQ ID NO: 1738392 - RNA, 12 nt, Human
cccaucugugaa

SEQ ID NO: 1738393 - RNA, 19 nt, Human
cccaucucuacaaaaagca

SEQ ID NO: 1738394 - RNA, 14 nt, Human
cccaguugggugga

SEQ ID NO: 1738395 - RNA, 14 nt, Human
cccaucucuucugg

SEQ ID NO: 1738396 - RNA, 19 nt, Human
ccccaccgcagacaggacc

SEQ ID NO: 1738397 - RNA, 15 nt, Human
ccccaccgcagacag

SEQ ID NO: 1738398 - RNA, 17 nt, Human
ccccuccucucugcccu

SEQ ID NO: 1738399 - RNA, 15 nt, Human
ccccuccucucugcc

SEQ ID NO: 1738400 - RNA, 18 nt, Human
ccccuccuccuggacucc

SEQ ID NO: 1738401 - RNA, 22 nt, Human
ccccuccuccuggacuccugca

SEQ ID NO: 1738402 - RNA, 12 nt, Human
ccccuccaugug

SEQ ID NO: 1738403 - RNA, 15 nt, Human
ccccucccuucaacc

SEQ ID NO: 1738404 - RNA, 16 nt, Human
ccccucagggucccug

SEQ ID NO: 1738405 - RNA, 23 nt, Human
ccccuccaaucccaccaacccuc

SEQ ID NO: 1738406 - RNA, 20 nt, Human
ccccucauagcccucacccu

SEQ ID NO: 1738407 - RNA, 19 nt, Human
cccccugacaacacucauu

SEQ ID NO: 1738408 - RNA, 19 nt, Human
cccccugcaaagcccagcu

SEQ ID NO: 1738409 - RNA, 18 nt, Human
cccccugcaaagcccagc

SEQ ID NO: 1738410 - RNA, 21 nt, Human
cccccugcaaagcccagcuug

SEQ ID NO: 1738411 - RNA, 17 nt, Human
cccccugacaacacuca

SEQ ID NO: 1738412 - RNA, 21 nt, Human
cccccucuggcuccagcuggc

SEQ ID NO: 1738413 - RNA, 19 nt, Human
cccccucuggcuccagcug

SEQ ID NO: 1738414 - RNA, 12 nt, Human
cccccucuggcu

SEQ ID NO: 1738415 - RNA, 12 nt, Human
cccccagccugc

SEQ ID NO: 1738416 - RNA, 23 nt, Human
ccccucaacucuccuccagaguc

SEQ ID NO: 1738417 - RNA, 16 nt, Human
ccccucaacaccucug

SEQ ID NO: 1738418 - RNA, 15 nt, Human
ccccucaacaccucu

SEQ ID NO: 1738419 - RNA, 20 nt, Human
ccccagugcccacaggauca

SEQ ID NO: 1738420 - RNA, 16 nt, Human
ccccagugcccacagg

SEQ ID NO: 1738421 - RNA, 15 nt, Human
ccccagugcccacag

SEQ ID NO: 1738422 - RNA, 14 nt, Human
ccccagugcccaca

SEQ ID NO: 1738423 - RNA, 22 nt, Human
ccccauaauuuuuuuuuuccuu

SEQ ID NO: 1738424 - RNA, 13 nt, Human
cccccacccaagg

SEQ ID NO: 1738425 - RNA, 24 nt, Human
cccccacccaagggccuggccuga

SEQ ID NO: 1738426 - RNA, 14 nt, Human
ccccauccucugua

SEQ ID NO: 1738427 - RNA, 17 nt, Human
ccccaucauugguaccc

SEQ ID NO: 1738428 - RNA, 13 nt, Human
cccccacugguga

SEQ ID NO: 1738429 - RNA, 11 nt, Human
cccccacuggu

SEQ ID NO: 1738430 - RNA, 15 nt, Human
cccccacuggugaca

SEQ ID NO: 1738431 - RNA, 19 nt, Human
ccccuggaugcagccucac

SEQ ID NO: 1738432 - RNA, 18 nt, Human
ccccuggaugcagccuca

SEQ ID NO: 1738433 - RNA, 15 nt, Human
ccccuggaugcagcc

SEQ ID NO: 1738434 - RNA, 20 nt, Human
ccccugcugguucaggguug

SEQ ID NO: 1738435 - RNA, 15 nt, Human
ccccugcugguucag

SEQ ID NO: 1738436 - RNA, 13 nt, Human
ccccugcugguuc

SEQ ID NO: 1738437 - RNA, 11 nt, Human
ccccugcuggu

SEQ ID NO: 1738438 - RNA, 17 nt, Human
ccccugcuggguguggc

SEQ ID NO: 1738439 - RNA, 14 nt, Human
ccccugcugggugu

SEQ ID NO: 1738440 - RNA, 19 nt, Human
ccccugcccggcugcggaa

SEQ ID NO: 1738441 - RNA, 17 nt, Human
ccccugcccggcugcgg

SEQ ID NO: 1738442 - RNA, 12 nt, Human
ccccucugcccu

SEQ ID NO: 1738443 - RNA, 14 nt, Human
ccccucugcccugc

SEQ ID NO: 1738444 - RNA, 13 nt, Human
ccccucugcccug

SEQ ID NO: 1738445 - RNA, 19 nt, Human
ccccugccucucugcaggu

SEQ ID NO: 1738446 - RNA, 17 nt, Human
ccccugccucucugcag

SEQ ID NO: 1738447 - RNA, 16 nt, Human
ccccugccucucugca

SEQ ID NO: 1738448 - RNA, 15 nt, Human
ccccugccucucugc

SEQ ID NO: 1738449 - RNA, 14 nt, Human
ccccugccucucug

SEQ ID NO: 1738450 - RNA, 23 nt, Human
cccgcuaagagggagggagggcu

SEQ ID NO: 1738451 - RNA, 22 nt, Human
cccgcccaggcuuagucacuga

SEQ ID NO: 1738452 - RNA, 20 nt, Human
cccgcccaggcuuagucacu

SEQ ID NO: 1738453 - RNA, 18 nt, Human
cccgacagccuggcacag

SEQ ID NO: 1738454 - RNA, 15 nt, Human
cccgacagccuggca

SEQ ID NO: 1738455 - RNA, 15 nt, Human
cccgagccuggcucc

SEQ ID NO: 1738456 - RNA, 13 nt, Human
cccgagccuggcu

SEQ ID NO: 1738457 - RNA, 20 nt, Human
ccccuuccauggacuuuguu

SEQ ID NO: 1738458 - RNA, 13 nt, Human
ccccuuccaugga

SEQ ID NO: 1738459 - RNA, 14 nt, Human
cccgacagccuggc

SEQ ID NO: 1738460 - RNA, 15 nt, Human
ccccuguucacucua

SEQ ID NO: 1738461 - RNA, 18 nt, Human
ccccuggcuuuucacugc

SEQ ID NO: 1738462 - RNA, 22 nt, Human
ccccuggcuuuucacugcuggc

SEQ ID NO: 1738463 - RNA, 20 nt, Human
ccccuggcuuuucacugcug

SEQ ID NO: 1738464 - RNA, 18 nt, Human
ccagcaccaucucuccuc

SEQ ID NO: 1738465 - RNA, 17 nt, Human
ccagcaccaucucuccu

SEQ ID NO: 1738466 - RNA, 18 nt, Human
ccagcaggcucucaggcc

SEQ ID NO: 1738467 - RNA, 17 nt, Human
ccagcaggcucucaggc

SEQ ID NO: 1738468 - RNA, 16 nt, Human
ccagcaggcucucagg

SEQ ID NO: 1738469 - RNA, 19 nt, Human
ccagcaagugagagcuggg

SEQ ID NO: 1738470 - RNA, 18 nt, Human
ccagcaagugagagcugg

SEQ ID NO: 1738471 - RNA, 17 nt, Human
ccagcaagugagagcug

SEQ ID NO: 1738472 - RNA, 24 nt, Human
ccagauuuuuuacagcugccugca

SEQ ID NO: 1738473 - RNA, 15 nt, Human
ccagauuucacucuc

SEQ ID NO: 1738474 - RNA, 19 nt, Human
ccagauuucacucuccuug

SEQ ID NO: 1738475 - RNA, 18 nt, Human
ccagauuucacucuccuu

SEQ ID NO: 1738476 - RNA, 22 nt, Human
ccagauugcaacaggcugggcu

SEQ ID NO: 1738477 - RNA, 18 nt, Human
ccagauugcaacaggcug

SEQ ID NO: 1738478 - RNA, 23 nt, Human
ccagauugcaacaggcugggcuu

SEQ ID NO: 1738479 - RNA, 16 nt, Human
ccagauugcaacaggc

SEQ ID NO: 1738480 - RNA, 14 nt, Human
ccagauugcaacag

SEQ ID NO: 1738481 - RNA, 14 nt, Human
ccagagcccaccuu

SEQ ID NO: 1738482 - RNA, 20 nt, Human
ccagagccucaaaugagaaa

SEQ ID NO: 1738483 - RNA, 23 nt, Human
ccagagccucaaaugagaaaaug

SEQ ID NO: 1738484 - RNA, 19 nt, Human
ccagccugagcgacaguga

SEQ ID NO: 1738485 - RNA, 13 nt, Human
ccagccuggguga

SEQ ID NO: 1738486 - RNA, 13 nt, Human
ccagcgagcccug

SEQ ID NO: 1738487 - RNA, 23 nt, Human
ccagccuugaccauucuccaccu

SEQ ID NO: 1738488 - RNA, 19 nt, Human
ccagccccaaaacucuccu

SEQ ID NO: 1738489 - RNA, 23 nt, Human
ccagccgagauagccaaggccaa

SEQ ID NO: 1738490 - RNA, 22 nt, Human
ccagccgagauagccaaggcca

SEQ ID NO: 1738491 - RNA, 20 nt, Human
ccagccgagauagccaaggc

SEQ ID NO: 1738492 - RNA, 17 nt, Human
ccagccgagauagccaa

SEQ ID NO: 1738493 - RNA, 17 nt, Human
ccagcccacuucugcca

SEQ ID NO: 1738494 - RNA, 16 nt, Human
ccagcccacuucugcc

SEQ ID NO: 1738495 - RNA, 23 nt, Human
ccagcaggcucucaggccagcug

SEQ ID NO: 1738496 - RNA, 21 nt, Human
ccagcaggcucucaggccagc

SEQ ID NO: 1738497 - RNA, 20 nt, Human
ccagcaggcucucaggccag

SEQ ID NO: 1738498 - RNA, 19 nt, Human
ccagcaggcucucaggcca

SEQ ID NO: 1738499 - RNA, 14 nt, Human
ccagacaucaacag

SEQ ID NO: 1738500 - RNA, 24 nt, Human
ccagaccccuggcuuuucacugcu

SEQ ID NO: 1738501 - RNA, 20 nt, Human
ccagacacauguccaagaag

SEQ ID NO: 1738502 - RNA, 17 nt, Human
ccagacacauguccaag

SEQ ID NO: 1738503 - RNA, 22 nt, Human
ccagacacauguccaagaagcc

SEQ ID NO: 1738504 - RNA, 15 nt, Human
ccagacccggcugcg

SEQ ID NO: 1738505 - RNA, 14 nt, Human
ccagacccggcugc

SEQ ID NO: 1738506 - RNA, 16 nt, Human
ccagacccggcugcgu

SEQ ID NO: 1738507 - RNA, 14 nt, Human
ccagagaguggcuc

SEQ ID NO: 1738508 - RNA, 16 nt, Human
ccagagaguggcuccu

SEQ ID NO: 1738509 - RNA, 15 nt, Human
ccagagaguggcucc

SEQ ID NO: 1738510 - RNA, 22 nt, Human
ccagagaguggcuccucccggu

SEQ ID NO: 1738511 - RNA, 18 nt, Human
ccagagaguggcuccucc

SEQ ID NO: 1738512 - RNA, 15 nt, Human
ccacugguucuucuu

SEQ ID NO: 1738513 - RNA, 23 nt, Human
ccacuggugacaugucuuuucuu

SEQ ID NO: 1738514 - RNA, 15 nt, Human
ccacugugaagagaa

SEQ ID NO: 1738515 - RNA, 14 nt, Human
ccacugugaagaga

SEQ ID NO: 1738516 - RNA, 15 nt, Human
ccacugcucugguua

SEQ ID NO: 1738517 - RNA, 13 nt, Human
ccacugcucuggu

SEQ ID NO: 1738518 - RNA, 12 nt, Human
ccacugcucugg

SEQ ID NO: 1738519 - RNA, 20 nt, Human
ccacugcuuuuggucugugu

SEQ ID NO: 1738520 - RNA, 21 nt, Human
ccacugccuucgauacaccgg

SEQ ID NO: 1738521 - RNA, 22 nt, Human
ccacugcuuuuggucuguguga

SEQ ID NO: 1738522 - RNA, 23 nt, Human
ccacugcaucguuucaucuucca

SEQ ID NO: 1738523 - RNA, 21 nt, Human
ccacugcaucguuucaucuuc

SEQ ID NO: 1738524 - RNA, 14 nt, Human
ccaccuucccaugc

SEQ ID NO: 1738525 - RNA, 16 nt, Human
ccacugccucuuccuc

SEQ ID NO: 1738526 - RNA, 13 nt, Human
ccacugccucuuc

SEQ ID NO: 1738527 - RNA, 16 nt, Human
ccacugugccaugugc

SEQ ID NO: 1738528 - RNA, 15 nt, Human
ccacugugccaugug

SEQ ID NO: 1738529 - RNA, 19 nt, Human
ccacugugccaugugccag

SEQ ID NO: 1738530 - RNA, 22 nt, Human
ccagaagaaaauagugguguga

SEQ ID NO: 1738531 - RNA, 18 nt, Human
ccagaaaccuuuguuugc

SEQ ID NO: 1738532 - RNA, 12 nt, Human
ccacccugcucu

SEQ ID NO: 1738533 - RNA, 11 nt, Human
ccacccugcuc

SEQ ID NO: 1738534 - RNA, 20 nt, Human
ccaccucucucacuccuuga

SEQ ID NO: 1738535 - RNA, 19 nt, Human
ccaccucucucacuccuug

SEQ ID NO: 1738536 - RNA, 16 nt, Human
ccaccucucucacucc

SEQ ID NO: 1738537 - RNA, 14 nt, Human
ccaccucucucacu

SEQ ID NO: 1738538 - RNA, 16 nt, Human
ccaccugccagggaca

SEQ ID NO: 1738539 - RNA, 15 nt, Human
ccaccugccagggac

SEQ ID NO: 1738540 - RNA, 14 nt, Human
ccaccugccaggga

SEQ ID NO: 1738541 - RNA, 13 nt, Human
ccaccugccaggg

SEQ ID NO: 1738542 - RNA, 20 nt, Human
ccaccuggccucugcacucc

SEQ ID NO: 1738543 - RNA, 18 nt, Human
ccaccuggccucugcacu

SEQ ID NO: 1738544 - RNA, 13 nt, Human
ccaccuggccucu

SEQ ID NO: 1738545 - RNA, 14 nt, Human
ccaccuggccucug

SEQ ID NO: 1738546 - RNA, 19 nt, Human
ccacccccacccaagggcc

SEQ ID NO: 1738547 - RNA, 14 nt, Human
ccacccuccuuuca

SEQ ID NO: 1738548 - RNA, 13 nt, Human
ccaccuuggcuca

SEQ ID NO: 1738549 - RNA, 15 nt, Human
ccauaugccugggca

SEQ ID NO: 1738550 - RNA, 12 nt, Human
ccaucaagccac

SEQ ID NO: 1738551 - RNA, 23 nt, Human
ccagugugacaaggauugcuacu

SEQ ID NO: 1738552 - RNA, 14 nt, Human
ccagugugacaagg

SEQ ID NO: 1738553 - RNA, 13 nt, Human
ccauaugccuggg

SEQ ID NO: 1738554 - RNA, 12 nt, Human
ccaucauugaaa

SEQ ID NO: 1738555 - RNA, 13 nt, Human
ccaucaugucugg

SEQ ID NO: 1738556 - RNA, 12 nt, Human
ccaucaugucug

SEQ ID NO: 1738557 - RNA, 14 nt, Human
ccaucaagccacca

SEQ ID NO: 1738558 - RNA, 13 nt, Human
ccaucaagccacc

SEQ ID NO: 1738559 - RNA, 16 nt, Human
ccaucaagccaccaac

SEQ ID NO: 1738560 - RNA, 19 nt, Human
ccauauuaccacagacaua

SEQ ID NO: 1738561 - RNA, 20 nt, Human
ccauccugaggcuccacuug

SEQ ID NO: 1738562 - RNA, 18 nt, Human
ccauccugaggcuccacu

SEQ ID NO: 1738563 - RNA, 17 nt, Human
ccaucauugaaaucuuu

SEQ ID NO: 1738564 - RNA, 16 nt, Human
ccaucauugaaaucuu

SEQ ID NO: 1738565 - RNA, 14 nt, Human
ccaucauugaaauc

SEQ ID NO: 1738566 - RNA, 15 nt, Human
ccaucucuccuccuu

SEQ ID NO: 1738567 - RNA, 21 nt, Human
ccaucucacacaugagcauca

SEQ ID NO: 1738568 - RNA, 20 nt, Human
ccaucucacacaugagcauc

SEQ ID NO: 1738569 - RNA, 18 nt, Human
ccaucucacacaugagca

SEQ ID NO: 1738570 - RNA, 17 nt, Human
ccaucucacacaugagc

SEQ ID NO: 1738571 - RNA, 15 nt, Human
ccaucucacacauga

SEQ ID NO: 1738572 - RNA, 14 nt, Human
ccaucucacacaug

SEQ ID NO: 1738573 - RNA, 23 nt, Human
ccaguaaaugggggugcauuuga

SEQ ID NO: 1738574 - RNA, 13 nt, Human
ccagugaggcucu

SEQ ID NO: 1738575 - RNA, 21 nt, Human
ccagguggccacuccagaccc

SEQ ID NO: 1738576 - RNA, 16 nt, Human
ccagguggccacucca

SEQ ID NO: 1738577 - RNA, 16 nt, Human
ccagguuucuaugugu

SEQ ID NO: 1738578 - RNA, 13 nt, Human
ccagguuuaagcu

SEQ ID NO: 1738579 - RNA, 20 nt, Human
ccaguaaaugggggugcauu

SEQ ID NO: 1738580 - RNA, 21 nt, Human
ccaguaaaugggggugcauuu

SEQ ID NO: 1738581 - RNA, 22 nt, Human
ccaguaaaugggggugcauuug

SEQ ID NO: 1738582 - RNA, 23 nt, Human
ccagugcccacaggaucagucug

SEQ ID NO: 1738583 - RNA, 20 nt, Human
ccaggaggccagccuugacc

SEQ ID NO: 1738584 - RNA, 18 nt, Human
ccaggaggccagccuuga

SEQ ID NO: 1738585 - RNA, 15 nt, Human
ccaggaggccagccu

SEQ ID NO: 1738586 - RNA, 16 nt, Human
ccaggccccugccacc

SEQ ID NO: 1738587 - RNA, 15 nt, Human
ccaggccccugccac

SEQ ID NO: 1738588 - RNA, 14 nt, Human
ccaggccccugcca

SEQ ID NO: 1738589 - RNA, 12 nt, Human
ccaggccagagg

SEQ ID NO: 1738590 - RNA, 14 nt, Human
ccaggcccucugcc

SEQ ID NO: 1738591 - RNA, 13 nt, Human
ccaggcccucugc

SEQ ID NO: 1738592 - RNA, 19 nt, Human
ccaggccccugccacccug

SEQ ID NO: 1738593 - RNA, 23 nt, Human
ccaggcuuagucacugagacagc

SEQ ID NO: 1738594 - RNA, 22 nt, Human
ccaggcuuagucacugagacag

SEQ ID NO: 1738595 - RNA, 21 nt, Human
ccaggcuuagucacugagaca

SEQ ID NO: 1738596 - RNA, 14 nt, Human
ccaggcuggucuca

SEQ ID NO: 1738597 - RNA, 16 nt, Human
ccaggcccucugccca

SEQ ID NO: 1738598 - RNA, 15 nt, Human
ccaggcccucugccc

SEQ ID NO: 1738599 - RNA, 16 nt, Human
ccaggcugggucgccc

SEQ ID NO: 1738600 - RNA, 12 nt, Human
ccaggcuggguc

SEQ ID NO: 1738601 - RNA, 24 nt, Human
ccaggcugggucgcccuggacugu

SEQ ID NO: 1738602 - RNA, 23 nt, Human
ccaggcugggucgcccuggacug

SEQ ID NO: 1738603 - RNA, 22 nt, Human
ccaggcugggucgcccuggacu

SEQ ID NO: 1738604 - RNA, 21 nt, Human
ccaggcugggucgcccuggac

SEQ ID NO: 1738605 - RNA, 18 nt, Human
ccauguuuuguuuacggu

SEQ ID NO: 1738606 - RNA, 15 nt, Human
ccauucugccugccc

SEQ ID NO: 1738607 - RNA, 16 nt, Human
ccauucugccugccca

SEQ ID NO: 1738608 - RNA, 13 nt, Human
ccauuugcuccuu

SEQ ID NO: 1738609 - RNA, 14 nt, Human
ccauucuccaccug

SEQ ID NO: 1738610 - RNA, 13 nt, Human
cccacaggaucag

SEQ ID NO: 1738611 - RNA, 17 nt, Human
cccacaggaucagucug

SEQ ID NO: 1738612 - RNA, 13 nt, Human
cccacagcgcugg

SEQ ID NO: 1738613 - RNA, 18 nt, Human
cccacaggcccuuccucu

SEQ ID NO: 1738614 - RNA, 16 nt, Human
cccacaggcccuuccu

SEQ ID NO: 1738615 - RNA, 19 nt, Human
cccacauagugaugguucc

SEQ ID NO: 1738616 - RNA, 16 nt, Human
cccaagggccuggccu

SEQ ID NO: 1738617 - RNA, 17 nt, Human
cccaagggccuggccug

SEQ ID NO: 1738618 - RNA, 14 nt, Human
cccaagggccuggc

SEQ ID NO: 1738619 - RNA, 12 nt, Human
cccaagggccug

SEQ ID NO: 1738620 - RNA, 21 nt, Human
ccauuuuguauuuuacuaaua

SEQ ID NO: 1738621 - RNA, 20 nt, Human
ccauuuugcugucccuuuuc

SEQ ID NO: 1738622 - RNA, 17 nt, Human
cccaccucucucacucc

SEQ ID NO: 1738623 - RNA, 14 nt, Human
cccaccucucucac

SEQ ID NO: 1738624 - RNA, 13 nt, Human
cccaccucucuca

SEQ ID NO: 1738625 - RNA, 21 nt, Human
cccaccucagccucccaaagu

SEQ ID NO: 1738626 - RNA, 12 nt, Human
cccaccuuggcu

SEQ ID NO: 1738627 - RNA, 19 nt, Human
cccaccucucucacuccuu

SEQ ID NO: 1738628 - RNA, 17 nt, Human
cccaccucagccucccg

SEQ ID NO: 1738629 - RNA, 15 nt, Human
cccaccucagccucc

SEQ ID NO: 1738630 - RNA, 14 nt, Human
cccaccucagccuc

SEQ ID NO: 1738631 - RNA, 12 nt, Human
cccaccucagcc

SEQ ID NO: 1738632 - RNA, 15 nt, Human
cccaccuuggcugca

SEQ ID NO: 1738633 - RNA, 14 nt, Human
cccaccuuggcugc

SEQ ID NO: 1738634 - RNA, 22 nt, Human
cccaccuuggcucaaguccucu

SEQ ID NO: 1738635 - RNA, 15 nt, Human
cccaccuuggcucaa

SEQ ID NO: 1738636 - RNA, 19 nt, Human
cccacgcccccacugguga

SEQ ID NO: 1738637 - RNA, 17 nt, Human
cccacgcccccacuggu

SEQ ID NO: 1738638 - RNA, 16 nt, Human
cccaccuuggcugcag

SEQ ID NO: 1738639 - RNA, 14 nt, Human
cccacgcuggagug

SEQ ID NO: 1738640 - RNA, 12 nt, Human
caaaauaaaacu

SEQ ID NO: 1738641 - RNA, 14 nt, Human
caaaauaaaacuuu

SEQ ID NO: 1738642 - RNA, 15 nt, Human
caaaauguaggguua

SEQ ID NO: 1738643 - RNA, 16 nt, Human
caaaauuguuacaaau

SEQ ID NO: 1738644 - RNA, 15 nt, Human
caaacacauacagga

SEQ ID NO: 1738645 - RNA, 20 nt, Human
caaacccuucagugccaaaa

SEQ ID NO: 1738646 - RNA, 13 nt, Human
caaaggaagcaca

SEQ ID NO: 1738647 - RNA, 12 nt, Human
caaaggaagcac

SEQ ID NO: 1738648 - RNA, 15 nt, Human
caaagcuaggccugg

SEQ ID NO: 1738649 - RNA, 19 nt, Human
caaagcuaggccuggccag

SEQ ID NO: 1738650 - RNA, 14 nt, Human
caaagcuaggccug

SEQ ID NO: 1738651 - RNA, 13 nt, Human
caaagcuaggccu

SEQ ID NO: 1738652 - RNA, 18 nt, Human
caaaggguaucaggugcu

SEQ ID NO: 1738653 - RNA, 16 nt, Human
caaaggguaucaggug

SEQ ID NO: 1738654 - RNA, 23 nt, Human
caaaggccuaauucuaugccugu

SEQ ID NO: 1738655 - RNA, 14 nt, Human
caaaggaagcacau

SEQ ID NO: 1738656 - RNA, 17 nt, Human
caaacucaccugccccu

SEQ ID NO: 1738657 - RNA, 18 nt, Human
caaagccuccuccagccg

SEQ ID NO: 1738658 - RNA, 17 nt, Human
caaagccuccuccagcc

SEQ ID NO: 1738659 - RNA, 21 nt, Human
caaauuguaagcaugcacaaa

SEQ ID NO: 1738660 - RNA, 11 nt, Human
caaauuucuaa

SEQ ID NO: 1738661 - RNA, 12 nt, Human
caaauuucuaaa

SEQ ID NO: 1738662 - RNA, 14 nt, Human
caaauuucuaaauc

SEQ ID NO: 1738663 - RNA, 19 nt, Human
caaaggguaucaggugcug

SEQ ID NO: 1738664 - RNA, 19 nt, Human
caaagugcugggauuacag

SEQ ID NO: 1738665 - RNA, 23 nt, Human
caaagugcugggauuacaggugu

SEQ ID NO: 1738666 - RNA, 20 nt, Human
caaagugcugggauuacagg

SEQ ID NO: 1738667 - RNA, 23 nt, Human
caaaacuucagacauagaauuaa

SEQ ID NO: 1738668 - RNA, 17 nt, Human
caaaauaaaaaugaggu

SEQ ID NO: 1738669 - RNA, 21 nt, Human
caaaacucuccucugcugcug

SEQ ID NO: 1738670 - RNA, 20 nt, Human
caaaacucuccucugcugcu

SEQ ID NO: 1738671 - RNA, 22 nt, Human
caaaacucuccucugcugcugg

SEQ ID NO: 1738672 - RNA, 23 nt, Human
caaaacucuccucugcugcuggc

SEQ ID NO: 1738673 - RNA, 22 nt, Human
caaaacaaaggccuaauucuau

SEQ ID NO: 1738674 - RNA, 12 nt, Human
caaaacaaaggc

SEQ ID NO: 1738675 - RNA, 15 nt, Human
caaaacaaaggccua

SEQ ID NO: 1738676 - RNA, 16 nt, Human
caaaacaaaggccuaa

SEQ ID NO: 1738677 - RNA, 13 nt, Human
caaaaaggcagga

SEQ ID NO: 1738678 - RNA, 20 nt, Human
caaaaacauggccuuugcuu

SEQ ID NO: 1738679 - RNA, 21 nt, Human
auuuugggguacccacugcuc

SEQ ID NO: 1738680 - RNA, 16 nt, Human
caaaaaaugcuugcuu

SEQ ID NO: 1738681 - RNA, 23 nt, Human
auuuugggguacccacugcucug

SEQ ID NO: 1738682 - RNA, 22 nt, Human
auuuugggguacccacugcucu

SEQ ID NO: 1738683 - RNA, 14 nt, Human
caaguuaaauaaau

SEQ ID NO: 1738684 - RNA, 19 nt, Human
caaguggcucccacacccu

SEQ ID NO: 1738685 - RNA, 17 nt, Human
caagugagagcugggug

SEQ ID NO: 1738686 - RNA, 15 nt, Human
caagugagagcuggg

SEQ ID NO: 1738687 - RNA, 14 nt, Human
caagugagagcugg

SEQ ID NO: 1738688 - RNA, 21 nt, Human
caaguccucuuuucugagagg

SEQ ID NO: 1738689 - RNA, 18 nt, Human
caagugagagcugggugu

SEQ ID NO: 1738690 - RNA, 21 nt, Human
caagugauucucaugccucag

SEQ ID NO: 1738691 - RNA, 20 nt, Human
caagugauucucaugccuca

SEQ ID NO: 1738692 - RNA, 18 nt, Human
caagugauucucaugccu

SEQ ID NO: 1738693 - RNA, 17 nt, Human
caagugauucucaugcc

SEQ ID NO: 1738694 - RNA, 23 nt, Human
caaggcugucaauuacaggaagu

SEQ ID NO: 1738695 - RNA, 15 nt, Human
caaggcugcagugag

SEQ ID NO: 1738696 - RNA, 12 nt, Human
caaggcugcagu

SEQ ID NO: 1738697 - RNA, 17 nt, Human
caaggggcccaaauucu

SEQ ID NO: 1738698 - RNA, 18 nt, Human
caaggggcccaaauucuu

SEQ ID NO: 1738699 - RNA, 14 nt, Human
caaggucauuuuuu

SEQ ID NO: 1738700 - RNA, 20 nt, Human
caaggucauuuuuuuuaaga

SEQ ID NO: 1738701 - RNA, 18 nt, Human
caaggguagggugggccu

SEQ ID NO: 1738702 - RNA, 14 nt, Human
caaguccucuuuuc

SEQ ID NO: 1738703 - RNA, 14 nt, Human
caagccagcuggag

SEQ ID NO: 1738704 - RNA, 18 nt, Human
caagcaggacauggacaa

SEQ ID NO: 1738705 - RNA, 14 nt, Human
caagcaggacaugg

SEQ ID NO: 1738706 - RNA, 22 nt, Human
caagcgauucuucugcuucagc

SEQ ID NO: 1738707 - RNA, 20 nt, Human
caagcgauucuucugcuuca

SEQ ID NO: 1738708 - RNA, 14 nt, Human
caagccuggcaagg

SEQ ID NO: 1738709 - RNA, 19 nt, Human
caagcgauucuucugcuuc

SEQ ID NO: 1738710 - RNA, 18 nt, Human
caagccguggcuucccgc

SEQ ID NO: 1738711 - RNA, 17 nt, Human
caaggcugauuaaacca

SEQ ID NO: 1738712 - RNA, 22 nt, Human
caaggacugcagggacugccag

SEQ ID NO: 1738713 - RNA, 14 nt, Human
caaggagccaaaca

SEQ ID NO: 1738714 - RNA, 19 nt, Human
caagcuggucccacucagu

SEQ ID NO: 1738715 - RNA, 17 nt, Human
caagcuggucccacuca

SEQ ID NO: 1738716 - RNA, 15 nt, Human
caaggacugcaggga

SEQ ID NO: 1738717 - RNA, 18 nt, Human
caaggacagccccuccuc

SEQ ID NO: 1738718 - RNA, 18 nt, Human
caagacucuuuggacacu

SEQ ID NO: 1738719 - RNA, 15 nt, Human
caagagcccaggccu

SEQ ID NO: 1738720 - RNA, 14 nt, Human
caagagcccaggcc

SEQ ID NO: 1738721 - RNA, 18 nt, Human
caagacgcugugcugccc

SEQ ID NO: 1738722 - RNA, 19 nt, Human
caagacgcugugcugcccu

SEQ ID NO: 1738723 - RNA, 17 nt, Human
caagcaccuccugccuc

SEQ ID NO: 1738724 - RNA, 16 nt, Human
caagcaccuccugccu

SEQ ID NO: 1738725 - RNA, 15 nt, Human
caagcaccuccugcc

SEQ ID NO: 1738726 - RNA, 15 nt, Human
caagagggcacuggu

SEQ ID NO: 1738727 - RNA, 14 nt, Human
caagagggcacugg

SEQ ID NO: 1738728 - RNA, 17 nt, Human
caagagcccaggccucc

SEQ ID NO: 1738729 - RNA, 16 nt, Human
caagagcccaggccuc

SEQ ID NO: 1738730 - RNA, 13 nt, Human
caagagggcacug

SEQ ID NO: 1738731 - RNA, 19 nt, Human
caacugaccagccuccaug

SEQ ID NO: 1738732 - RNA, 17 nt, Human
caagacgcugugcugcc

SEQ ID NO: 1738733 - RNA, 16 nt, Human
caagacgcugugcugc

SEQ ID NO: 1738734 - RNA, 18 nt, Human
caagaccuucuccuucac

SEQ ID NO: 1738735 - RNA, 17 nt, Human
caagaccuucuccuuca

SEQ ID NO: 1738736 - RNA, 16 nt, Human
caagaccuucuccuuc

SEQ ID NO: 1738737 - RNA, 14 nt, Human
caagaccuucuccu

SEQ ID NO: 1738738 - RNA, 20 nt, Human
caagaacuuuccaggaaggc

SEQ ID NO: 1738739 - RNA, 22 nt, Human
caacacucauugaccugaggcc

SEQ ID NO: 1738740 - RNA, 20 nt, Human
caacacucauugaccugagg

SEQ ID NO: 1738741 - RNA, 18 nt, Human
caacacucauugaccuga

SEQ ID NO: 1738742 - RNA, 22 nt, Human
caaccccuucgcuccugugucu

SEQ ID NO: 1738743 - RNA, 18 nt, Human
caacccucagagccaccc

SEQ ID NO: 1738744 - RNA, 13 nt, Human
caacccucagagc

SEQ ID NO: 1738745 - RNA, 17 nt, Human
caacccuggcacccagg

SEQ ID NO: 1738746 - RNA, 14 nt, Human
caacgucugugcca

SEQ ID NO: 1738747 - RNA, 13 nt, Human
caacgucugugcc

SEQ ID NO: 1738748 - RNA, 17 nt, Human
caacugaccagccucca

SEQ ID NO: 1738749 - RNA, 15 nt, Human
caacugaccagccuc

SEQ ID NO: 1738750 - RNA, 19 nt, Human
caaccuucgccaccugggu

SEQ ID NO: 1738751 - RNA, 20 nt, Human
caaccuguucugcuuuccuc

SEQ ID NO: 1738752 - RNA, 14 nt, Human
caaccuccugggcu

SEQ ID NO: 1738753 - RNA, 15 nt, Human
caaccuccugggcua

SEQ ID NO: 1738754 - RNA, 13 nt, Human
caauaggaaaaac

SEQ ID NO: 1738755 - RNA, 12 nt, Human
caauaggaaaaa

SEQ ID NO: 1738756 - RNA, 17 nt, Human
caauauucgcuguguca

SEQ ID NO: 1738757 - RNA, 14 nt, Human
caauauuguacagu

SEQ ID NO: 1738758 - RNA, 15 nt, Human
caauauuguacaguu

SEQ ID NO: 1738759 - RNA, 15 nt, Human
caaugacuuacugua

SEQ ID NO: 1738760 - RNA, 17 nt, Human
caaugacuuacuguaca

SEQ ID NO: 1738761 - RNA, 18 nt, Human
caaugacuuacuguacau

SEQ ID NO: 1738762 - RNA, 23 nt, Human
caaugaccuuucaauaggaaaaa

SEQ ID NO: 1738763 - RNA, 16 nt, Human
caauucuccugccuca

SEQ ID NO: 1738764 - RNA, 15 nt, Human
caauucuccugccuc

SEQ ID NO: 1738765 - RNA, 14 nt, Human
caauucuccugccu

SEQ ID NO: 1738766 - RNA, 23 nt, Human
caauucucauuugucacacacuu

SEQ ID NO: 1738767 - RNA, 13 nt, Human
caauucuccugcc

SEQ ID NO: 1738768 - RNA, 16 nt, Human
caauuacaggaaguac

SEQ ID NO: 1738769 - RNA, 17 nt, Human
caaugugauaaaacccc

SEQ ID NO: 1738770 - RNA, 15 nt, Human
caaugugauaaaacc

SEQ ID NO: 1738771 - RNA, 21 nt, Human
caaugcacuuuguucuggcuc

SEQ ID NO: 1738772 - RNA, 20 nt, Human
caaugcacuuuguucuggcu

SEQ ID NO: 1738773 - RNA, 22 nt, Human
caaugcacuuuguucuggcucu

SEQ ID NO: 1738774 - RNA, 17 nt, Human
caaugcacuuuguucug

SEQ ID NO: 1738775 - RNA, 14 nt, Human
caauguucucucuu

SEQ ID NO: 1738776 - RNA, 14 nt, Human
caauaggaaaaacu

SEQ ID NO: 1738777 - RNA, 21 nt, Human
cacauagugaugguuccccug

SEQ ID NO: 1738778 - RNA, 23 nt, Human
cacagcugggguggggaccucag

SEQ ID NO: 1738779 - RNA, 22 nt, Human
cacagcugggguggggaccuca

SEQ ID NO: 1738780 - RNA, 22 nt, Human
cacagcuucauuuccugugucu

SEQ ID NO: 1738781 - RNA, 21 nt, Human
cacagcuucauuuccuguguc

SEQ ID NO: 1738782 - RNA, 15 nt, Human
cacaggcagguccag

SEQ ID NO: 1738783 - RNA, 14 nt, Human
cacaggcaggucca

SEQ ID NO: 1738784 - RNA, 11 nt, Human
cacaggcaggu

SEQ ID NO: 1738785 - RNA, 14 nt, Human
cacaggagggaggg

SEQ ID NO: 1738786 - RNA, 21 nt, Human
cacaggagggagggggaaggc

SEQ ID NO: 1738787 - RNA, 19 nt, Human
cacaggagggagggggaag

SEQ ID NO: 1738788 - RNA, 15 nt, Human
cacaguucucuccuu

SEQ ID NO: 1738789 - RNA, 14 nt, Human
cacaguucucuccu

SEQ ID NO: 1738790 - RNA, 17 nt, Human
cacagugcaucucagcc

SEQ ID NO: 1738791 - RNA, 22 nt, Human
cacaguccuuaccagcagagca

SEQ ID NO: 1738792 - RNA, 21 nt, Human
cacaguccuuaccagcagagc

SEQ ID NO: 1738793 - RNA, 15 nt, Human
cacaguccuuaccag

SEQ ID NO: 1738794 - RNA, 13 nt, Human
cacaguccuuacc

SEQ ID NO: 1738795 - RNA, 22 nt, Human
cacagugagucgaggacaggga

SEQ ID NO: 1738796 - RNA, 19 nt, Human
cacaggcagguccaggguu

SEQ ID NO: 1738797 - RNA, 14 nt, Human
cacagugcaucuca

SEQ ID NO: 1738798 - RNA, 22 nt, Human
uuuuuagacagagucucacugu

SEQ ID NO: 1738799 - RNA, 11 nt, Human
uuuuuacuaau

SEQ ID NO: 1738800 - RNA, 23 nt, Human
uuuuuauacauaaacaagaccac

SEQ ID NO: 1738801 - RNA, 12 nt, Human
uuuuuauggcuu

SEQ ID NO: 1738802 - RNA, 20 nt, Human
uuuuuaucgucacugcuuaa

SEQ ID NO: 1738803 - RNA, 12 nt, Human
uuuuuaucaugu

SEQ ID NO: 1738804 - RNA, 21 nt, Human
uuuuguuccacaaguuaaaua

SEQ ID NO: 1738805 - RNA, 15 nt, Human
uuuuguuccacaagu

SEQ ID NO: 1738806 - RNA, 12 nt, Human
uuuuguuucaua

SEQ ID NO: 1738807 - RNA, 19 nt, Human
uuuuguuucauauugaugu

SEQ ID NO: 1738808 - RNA, 23 nt, Human
uuuugugcauuaucuagauacug

SEQ ID NO: 1738809 - RNA, 17 nt, Human
uuuugugcauuaucuag

SEQ ID NO: 1738810 - RNA, 20 nt, Human
uuuugugcauuaucuagaua

SEQ ID NO: 1738811 - RNA, 21 nt, Human
uuuugugaugucccaacuugu

SEQ ID NO: 1738812 - RNA, 13 nt, Human
uuuugcuguagaa

SEQ ID NO: 1738813 - RNA, 14 nt, Human
uuuugcuguagaag

SEQ ID NO: 1738814 - RNA, 17 nt, Human
uuuugauccaagcuggu

SEQ ID NO: 1738815 - RNA, 17 nt, Human
uuuugagugccuuacac

SEQ ID NO: 1738816 - RNA, 23 nt, Human
uuuugccauguuggccaggcugg

SEQ ID NO: 1738817 - RNA, 16 nt, Human
uuuugauguaaagaug

SEQ ID NO: 1738818 - RNA, 18 nt, Human
uuuugauguaaagauguu

SEQ ID NO: 1738819 - RNA, 12 nt, Human
auuacuucugcu

SEQ ID NO: 1738820 - RNA, 19 nt, Human
uuuuugugaaaagcuccau

SEQ ID NO: 1738821 - RNA, 20 nt, Human
uuuuuguagagccagggucu

SEQ ID NO: 1738822 - RNA, 19 nt, Human
uuuuuguagagccaggguc

SEQ ID NO: 1738823 - RNA, 20 nt, Human
uuuuuauggcuuuugugcau

SEQ ID NO: 1738824 - RNA, 21 nt, Human
uuuuuauggcuuuugugcauu

SEQ ID NO: 1738825 - RNA, 22 nt, Human
uuuuuauggcuuuugugcauua

SEQ ID NO: 1738826 - RNA, 16 nt, Human
auuaaguacuauguau

SEQ ID NO: 1738827 - RNA, 14 nt, Human
auuaaguuguuaau

SEQ ID NO: 1738828 - RNA, 14 nt, Human
auuaaguacuaugu

SEQ ID NO: 1738829 - RNA, 19 nt, Human
auuaaguuguuaauaaaag

SEQ ID NO: 1738830 - RNA, 20 nt, Human
auuaaguuguuaauaaaagu

SEQ ID NO: 1738831 - RNA, 15 nt, Human
auuaaaaaucucaaa

SEQ ID NO: 1738832 - RNA, 19 nt, Human
auuaaaaaucucaaauuuc

SEQ ID NO: 1738833 - RNA, 20 nt, Human
auuaaaaaucucaaauuucu

SEQ ID NO: 1738834 - RNA, 22 nt, Human
auuaaaaaucucaaauuucuaa

SEQ ID NO: 1738835 - RNA, 23 nt, Human
auuaaaacacaacaucuuuuucu

SEQ ID NO: 1738836 - RNA, 17 nt, Human
auguuuaguaaucauau

SEQ ID NO: 1738837 - RNA, 11 nt, Human
uuuuauuuuau

SEQ ID NO: 1738838 - RNA, 12 nt, Human
uuuucaguuuuc

SEQ ID NO: 1738839 - RNA, 14 nt, Human
uuuucaguuuucag

SEQ ID NO: 1738840 - RNA, 13 nt, Human
uuuuauuaugcau

SEQ ID NO: 1738841 - RNA, 20 nt, Human
uuuuaggccaaaaaaaugua

SEQ ID NO: 1738842 - RNA, 20 nt, Human
uuuucauuuaggugaggaag

SEQ ID NO: 1738843 - RNA, 21 nt, Human
auguuaaacuuacuuaguguu

SEQ ID NO: 1738844 - RNA, 18 nt, Human
auguucaucaaugaauga

SEQ ID NO: 1738845 - RNA, 18 nt, Human
auguugcauagaauaaaa

SEQ ID NO: 1738846 - RNA, 17 nt, Human
auguugcauagaauaaa

SEQ ID NO: 1738847 - RNA, 12 nt, Human
auguugcccagg

SEQ ID NO: 1738848 - RNA, 17 nt, Human
auguugcccaggcaggu

SEQ ID NO: 1738849 - RNA, 20 nt, Human
auguugcccaggcaggucuu

SEQ ID NO: 1738850 - RNA, 20 nt, Human
auguugcccuguugcugccu

SEQ ID NO: 1738851 - RNA, 22 nt, Human
augugccagguuuuuggucuga

SEQ ID NO: 1738852 - RNA, 12 nt, Human
auggggcugcac

SEQ ID NO: 1738853 - RNA, 20 nt, Human
auggggcccugccuccuuug

SEQ ID NO: 1738854 - RNA, 14 nt, Human
uuuuaauaaacacu

SEQ ID NO: 1738855 - RNA, 20 nt, Human
auguggaguucaucuugaau

SEQ ID NO: 1738856 - RNA, 24 nt, Human
auguggaguucaucuugaauugua

SEQ ID NO: 1738857 - RNA, 23 nt, Human
auguguguuuuaaaaugagaaau

SEQ ID NO: 1738858 - RNA, 12 nt, Human
augugugugugc

SEQ ID NO: 1738859 - RNA, 15 nt, Human
auucccaagcucugc

SEQ ID NO: 1738860 - RNA, 14 nt, Human
auucccaagcucug

SEQ ID NO: 1738861 - RNA, 16 nt, Human
auucccaagcucugcu

SEQ ID NO: 1738862 - RNA, 14 nt, Human
auucaggaagcuca

SEQ ID NO: 1738863 - RNA, 17 nt, Human
auucagaguugaugguu

SEQ ID NO: 1738864 - RNA, 19 nt, Human
auucaguaauaacucuacc

SEQ ID NO: 1738865 - RNA, 15 nt, Human
auucaguaauaacuc

SEQ ID NO: 1738866 - RNA, 19 nt, Human
auucaggaagcucagggcc

SEQ ID NO: 1738867 - RNA, 17 nt, Human
auucaggaagcucaggg

SEQ ID NO: 1738868 - RNA, 20 nt, Human
auucaggaagcucagggccu

SEQ ID NO: 1738869 - RNA, 21 nt, Human
auucuccaccugccagggaca

SEQ ID NO: 1738870 - RNA, 13 nt, Human
auucuccugccuc

SEQ ID NO: 1738871 - RNA, 14 nt, Human
auucuccugccuca

SEQ ID NO: 1738872 - RNA, 11 nt, Human
auucuccugcc

SEQ ID NO: 1738873 - RNA, 12 nt, Human
auucuccugccu

SEQ ID NO: 1738874 - RNA, 16 nt, Human
auucuccuuguguuac

SEQ ID NO: 1738875 - RNA, 18 nt, Human
auucuccugccucagccu

SEQ ID NO: 1738876 - RNA, 17 nt, Human
auucuccugccucagcc

SEQ ID NO: 1738877 - RNA, 15 nt, Human
auucuccugccucag

SEQ ID NO: 1738878 - RNA, 19 nt, Human
auucuccugccucagccuc

SEQ ID NO: 1738879 - RNA, 20 nt, Human
auucuccugccucagccucc

SEQ ID NO: 1738880 - RNA, 20 nt, Human
auucuccaccugccagggac

SEQ ID NO: 1738881 - RNA, 19 nt, Human
auucuccaccugccaggga

SEQ ID NO: 1738882 - RNA, 15 nt, Human
auucucaugccucag

SEQ ID NO: 1738883 - RNA, 14 nt, Human
auucucaugccuca

SEQ ID NO: 1738884 - RNA, 12 nt, Human
auugaaaucuuu

SEQ ID NO: 1738885 - RNA, 17 nt, Human
auuuccagccaaagccu

SEQ ID NO: 1738886 - RNA, 22 nt, Human
auuucauuugugccagaaugcu

SEQ ID NO: 1738887 - RNA, 20 nt, Human
auuuccagugaaaucaguua

SEQ ID NO: 1738888 - RNA, 16 nt, Human
auuucaaacggccuca

SEQ ID NO: 1738889 - RNA, 15 nt, Human
auuugaaaauuuuga

SEQ ID NO: 1738890 - RNA, 14 nt, Human
auuugaaaauuuug

SEQ ID NO: 1738891 - RNA, 15 nt, Human
auuuccguuaaaaua

SEQ ID NO: 1738892 - RNA, 16 nt, Human
auuuccguuaaaauac

SEQ ID NO: 1738893 - RNA, 13 nt, Human
auuuauucugcuc

SEQ ID NO: 1738894 - RNA, 20 nt, Human
auuuaguaucuuuuuauuca

SEQ ID NO: 1738895 - RNA, 13 nt, Human
auuuaguguucau

SEQ ID NO: 1738896 - RNA, 22 nt, Human
auuuauaaaaauaaaaaacacu

SEQ ID NO: 1738897 - RNA, 17 nt, Human
auuuauaaaaauaaaaa

SEQ ID NO: 1738898 - RNA, 15 nt, Human
auuuagaaauauaau

SEQ ID NO: 1738899 - RNA, 16 nt, Human
auuuacuucuuauaca

SEQ ID NO: 1738900 - RNA, 14 nt, Human
auuuacuucuuaua

SEQ ID NO: 1738901 - RNA, 17 nt, Human
auuuacuucuuauacau

SEQ ID NO: 1738902 - RNA, 14 nt, Human
auuuaacagaaaug

SEQ ID NO: 1738903 - RNA, 12 nt, Human
auuuaacagaaa

SEQ ID NO: 1738904 - RNA, 14 nt, Human
auuuauucugcuca

SEQ ID NO: 1738905 - RNA, 14 nt, Human
auugugucucuugg

SEQ ID NO: 1738906 - RNA, 18 nt, Human
auugugucucuugguccu

SEQ ID NO: 1738907 - RNA, 19 nt, Human
auugguguaagguacuuuc

SEQ ID NO: 1738908 - RNA, 13 nt, Human
auuguauucagag

SEQ ID NO: 1738909 - RNA, 20 nt, Human
auuguccccgacccuugccg

SEQ ID NO: 1738910 - RNA, 19 nt, Human
auuguccccgacccuugcc

SEQ ID NO: 1738911 - RNA, 17 nt, Human
auuguccccgacccuug

SEQ ID NO: 1738912 - RNA, 18 nt, Human
auucuuauuuaaugaaag

SEQ ID NO: 1738913 - RNA, 14 nt, Human
auucuuauuuaaug

SEQ ID NO: 1738914 - RNA, 13 nt, Human
auucuuauuuaau

SEQ ID NO: 1738915 - RNA, 13 nt, Human
auucuucuccacu

SEQ ID NO: 1738916 - RNA, 22 nt, Human
auucuuccucccucccucuuuc

SEQ ID NO: 1738917 - RNA, 24 nt, Human
auucugucucuggauuauauuaug

SEQ ID NO: 1738918 - RNA, 17 nt, Human
auucuccuuguguuacu

SEQ ID NO: 1738919 - RNA, 18 nt, Human
auugacccacaagaaaug

SEQ ID NO: 1738920 - RNA, 20 nt, Human
auuuucaacgcagcccugcu

SEQ ID NO: 1738921 - RNA, 18 nt, Human
auuuucaacgcagcccug

SEQ ID NO: 1738922 - RNA, 21 nt, Human
auuuuauuuuuuucugaauua

SEQ ID NO: 1738923 - RNA, 22 nt, Human
auuuucaguuauuauauuuaca

SEQ ID NO: 1738924 - RNA, 15 nt, Human
auuuuaaacagagga

SEQ ID NO: 1738925 - RNA, 15 nt, Human
auuuuaauucaguug

SEQ ID NO: 1738926 - RNA, 17 nt, Human
auuuuaccuuugacaaa

SEQ ID NO: 1738927 - RNA, 17 nt, Human
auuuuacuuuuuccugg

SEQ ID NO: 1738928 - RNA, 16 nt, Human
auuuuacuuuuuccug

SEQ ID NO: 1738929 - RNA, 23 nt, Human
auuugugaagguggaaauaaacu

SEQ ID NO: 1738930 - RNA, 14 nt, Human
auuugugauacaau

SEQ ID NO: 1738931 - RNA, 15 nt, Human
auuugugauacaaug

SEQ ID NO: 1738932 - RNA, 18 nt, Human
uugcugauggugcaauga

SEQ ID NO: 1738933 - RNA, 17 nt, Human
uugcugauggugcaaug

SEQ ID NO: 1738934 - RNA, 19 nt, Human
uugcugauggugcaaugac

SEQ ID NO: 1738935 - RNA, 17 nt, Human
uuggaaagaguaggaag

SEQ ID NO: 1738936 - RNA, 19 nt, Human
uugcugaauacagaggcaa

SEQ ID NO: 1738937 - RNA, 20 nt, Human
uugcuaagugaggaugaaaa

SEQ ID NO: 1738938 - RNA, 14 nt, Human
augaaaugagguca

SEQ ID NO: 1738939 - RNA, 20 nt, Human
augaaagacuguacaaagua

SEQ ID NO: 1738940 - RNA, 23 nt, Human
augaaagauggcugugccucugc

SEQ ID NO: 1738941 - RNA, 20 nt, Human
augaaagauggcugugccuc

SEQ ID NO: 1738942 - RNA, 19 nt, Human
augaaagauggcugugccu

SEQ ID NO: 1738943 - RNA, 16 nt, Human
uuggcugcugaaggcu

SEQ ID NO: 1738944 - RNA, 22 nt, Human
uuggcgcugccccuggcagccc

SEQ ID NO: 1738945 - RNA, 13 nt, Human
aucuuucugcaga

SEQ ID NO: 1738946 - RNA, 15 nt, Human
uuggcugcugaaggc

SEQ ID NO: 1738947 - RNA, 11 nt, Human
uuggcugcuga

SEQ ID NO: 1738948 - RNA, 14 nt, Human
uuggcugcagggag

SEQ ID NO: 1738949 - RNA, 23 nt, Human
uuggcuauuagagaucaaccccu

SEQ ID NO: 1738950 - RNA, 21 nt, Human
uuggcuagagguucaaagaua

SEQ ID NO: 1738951 - RNA, 22 nt, Human
uuggcuaggaccccuccaugug

SEQ ID NO: 1738952 - RNA, 22 nt, Human
uuggcuagagguucaaagauau

SEQ ID NO: 1738953 - RNA, 23 nt, Human
uuggaaagaguaggaagacuuug

SEQ ID NO: 1738954 - RNA, 18 nt, Human
uuggaaagaguaggaaga

SEQ ID NO: 1738955 - RNA, 15 nt, Human
augacaggccugucc

SEQ ID NO: 1738956 - RNA, 19 nt, Human
augacacgaauauugcuga

SEQ ID NO: 1738957 - RNA, 20 nt, Human
augacacgaauauugcugau

SEQ ID NO: 1738958 - RNA, 20 nt, Human
uuguaaggaaugauuaauua

SEQ ID NO: 1738959 - RNA, 13 nt, Human
uuguaaugaaaac

SEQ ID NO: 1738960 - RNA, 22 nt, Human
uugggguacccacugcucuggu

SEQ ID NO: 1738961 - RNA, 19 nt, Human
uugguuaggcauuguggga

SEQ ID NO: 1738962 - RNA, 14 nt, Human
uuguaaggaaugau

SEQ ID NO: 1738963 - RNA, 22 nt, Human
uuguaacuaaaauaauuuugua

SEQ ID NO: 1738964 - RNA, 23 nt, Human
uuguaacuaaaauaauuuuguaa

SEQ ID NO: 1738965 - RNA, 17 nt, Human
uuguaacuaaaauaauu

SEQ ID NO: 1738966 - RNA, 18 nt, Human
uuguaacuaaaauaauuu

SEQ ID NO: 1738967 - RNA, 21 nt, Human
uuguaacuaaaauaauuuugu

SEQ ID NO: 1738968 - RNA, 13 nt, Human
augaaccacaucu

SEQ ID NO: 1738969 - RNA, 22 nt, Human
augaaccacaucuugcucugcu

SEQ ID NO: 1738970 - RNA, 20 nt, Human
augaaccacaucuugcucug

SEQ ID NO: 1738971 - RNA, 17 nt, Human
uugggguacccacugcu

SEQ ID NO: 1738972 - RNA, 19 nt, Human
uuggggaagaacgaagcca

SEQ ID NO: 1738973 - RNA, 15 nt, Human
augaucacggcucac

SEQ ID NO: 1738974 - RNA, 19 nt, Human
augaucacggcucacugca

SEQ ID NO: 1738975 - RNA, 18 nt, Human
augaucacggcucacugc

SEQ ID NO: 1738976 - RNA, 14 nt, Human
augaucuucuuuau

SEQ ID NO: 1738977 - RNA, 15 nt, Human
augauccuaaugaau

SEQ ID NO: 1738978 - RNA, 15 nt, Human
augaucuaggaagac

SEQ ID NO: 1738979 - RNA, 16 nt, Human
augauccuaggcauuu

SEQ ID NO: 1738980 - RNA, 23 nt, Human
augaucacggcucacugcagccu

SEQ ID NO: 1738981 - RNA, 18 nt, Human
uugugaagguggaaauaa

SEQ ID NO: 1738982 - RNA, 17 nt, Human
uugugaagguggaaaua

SEQ ID NO: 1738983 - RNA, 19 nt, Human
uuguuuuuuuuuuccacuu

SEQ ID NO: 1738984 - RNA, 17 nt, Human
uuuaaaaaauuaaucug

SEQ ID NO: 1738985 - RNA, 19 nt, Human
augcaccuggaauauauaa

SEQ ID NO: 1738986 - RNA, 18 nt, Human
uuguuuuuuuuuuccacu

SEQ ID NO: 1738987 - RNA, 22 nt, Human
augcaaaccaucauugaaaucu

SEQ ID NO: 1738988 - RNA, 21 nt, Human
augcaaaccaucauugaaauc

SEQ ID NO: 1738989 - RNA, 20 nt, Human
augcaaaccaucauugaaau

SEQ ID NO: 1738990 - RNA, 19 nt, Human
augcaaaccaucauugaaa

SEQ ID NO: 1738991 - RNA, 18 nt, Human
augcaaaccaucauugaa

SEQ ID NO: 1738992 - RNA, 16 nt, Human
augcaaaccaucauug

SEQ ID NO: 1738993 - RNA, 18 nt, Human
augaucuucuuuauaauu

SEQ ID NO: 1738994 - RNA, 15 nt, Human
augaucuucuuuaua

SEQ ID NO: 1738995 - RNA, 22 nt, Human
augcaaggucauuuuuuuuaag

SEQ ID NO: 1738996 - RNA, 16 nt, Human
augcaccuggaauaua

SEQ ID NO: 1738997 - RNA, 14 nt, Human
augcaccuggaaua

SEQ ID NO: 1738998 - RNA, 14 nt, Human
augcaaggucauuu

SEQ ID NO: 1738999 - RNA, 16 nt, Human
augcaaggucauuuuu

SEQ ID NO: 1739000 - RNA, 22 nt, Human
augcaaacuuuauuuuguguuu

SEQ ID NO: 1739001 - RNA, 18 nt, Human
uugucacacacuuuggcu

SEQ ID NO: 1739002 - RNA, 15 nt, Human
augauaaaacacaaa

SEQ ID NO: 1739003 - RNA, 19 nt, Human
augagccucagcauccugg

SEQ ID NO: 1739004 - RNA, 18 nt, Human
augagccucagcauccug

SEQ ID NO: 1739005 - RNA, 17 nt, Human
augagccucagcauccu

SEQ ID NO: 1739006 - RNA, 13 nt, Human
augagaggaaauc

SEQ ID NO: 1739007 - RNA, 12 nt, Human
augagaggaaau

SEQ ID NO: 1739008 - RNA, 15 nt, Human
augagaggaaaucac

SEQ ID NO: 1739009 - RNA, 14 nt, Human
augagaggaaauca

SEQ ID NO: 1739010 - RNA, 16 nt, Human
augagaggaaaucacc

SEQ ID NO: 1739011 - RNA, 16 nt, Human
augagccucagcaucc

SEQ ID NO: 1739012 - RNA, 15 nt, Human
augagccucagcauc

SEQ ID NO: 1739013 - RNA, 12 nt, Human
augagccucagc

SEQ ID NO: 1739014 - RNA, 22 nt, Human
augagcaucaggccaggcccuc

SEQ ID NO: 1739015 - RNA, 18 nt, Human
augagccaccgcgcccag

SEQ ID NO: 1739016 - RNA, 21 nt, Human
augagccaccgcgcccagccu

SEQ ID NO: 1739017 - RNA, 21 nt, Human
augagcaucaggccaggcccu

SEQ ID NO: 1739018 - RNA, 20 nt, Human
augagcaucaggccaggccc

SEQ ID NO: 1739019 - RNA, 19 nt, Human
augagcaucaggccaggcc

SEQ ID NO: 1739020 - RNA, 18 nt, Human
augagcaucaggccaggc

SEQ ID NO: 1739021 - RNA, 17 nt, Human
augagcaucaggccagg

SEQ ID NO: 1739022 - RNA, 16 nt, Human
augagcaucaggccag

SEQ ID NO: 1739023 - RNA, 15 nt, Human
augagcaucaggcca

SEQ ID NO: 1739024 - RNA, 16 nt, Human
uuucugccgcagcccu

SEQ ID NO: 1739025 - RNA, 14 nt, Human
uuucugccgcagcc

SEQ ID NO: 1739026 - RNA, 22 nt, Human
uuucucauuugccaauaauaau

SEQ ID NO: 1739027 - RNA, 14 nt, Human
uuucucaaagaaau

SEQ ID NO: 1739028 - RNA, 15 nt, Human
uuucucaaagaaauu

SEQ ID NO: 1739029 - RNA, 16 nt, Human
uuucucaaagaaauuu

SEQ ID NO: 1739030 - RNA, 15 nt, Human
uuucuaugacacaug

SEQ ID NO: 1739031 - RNA, 21 nt, Human
uuucuaugacacaugcaaggu

SEQ ID NO: 1739032 - RNA, 23 nt, Human
augggcuggguucuacccaggug

SEQ ID NO: 1739033 - RNA, 16 nt, Human
uuugaaauauggucuu

SEQ ID NO: 1739034 - RNA, 13 nt, Human
auggggcccugcc

SEQ ID NO: 1739035 - RNA, 14 nt, Human
auggggcccugccu

SEQ ID NO: 1739036 - RNA, 13 nt, Human
auggggaggacaa

SEQ ID NO: 1739037 - RNA, 17 nt, Human
auggggaggacaaaaug

SEQ ID NO: 1739038 - RNA, 19 nt, Human
uuugaaacacuuugcauaa

SEQ ID NO: 1739039 - RNA, 17 nt, Human
uuugaaacacuuugcau

SEQ ID NO: 1739040 - RNA, 22 nt, Human
uuugaaaccccuguaggccuca

SEQ ID NO: 1739041 - RNA, 13 nt, Human
uuucuuuguggcu

SEQ ID NO: 1739042 - RNA, 21 nt, Human
uuucuuuaguuuuugugaagu

SEQ ID NO: 1739043 - RNA, 18 nt, Human
auggccucuucagaucuc

SEQ ID NO: 1739044 - RNA, 21 nt, Human
auggacccaauauuuaccaga

SEQ ID NO: 1739045 - RNA, 15 nt, Human
augggccuccugugu

SEQ ID NO: 1739046 - RNA, 14 nt, Human
augggcagagcaga

SEQ ID NO: 1739047 - RNA, 13 nt, Human
augggcagagcag

SEQ ID NO: 1739048 - RNA, 15 nt, Human
augggcagagcagag

SEQ ID NO: 1739049 - RNA, 21 nt, Human
augggcaacccccagccugcu

SEQ ID NO: 1739050 - RNA, 19 nt, Human
augggcaacccccagccug

SEQ ID NO: 1739051 - RNA, 13 nt, Human
augggagcucaug

SEQ ID NO: 1739052 - RNA, 15 nt, Human
augggacuggccucu

SEQ ID NO: 1739053 - RNA, 18 nt, Human
uuucgcaggauucuuccu

SEQ ID NO: 1739054 - RNA, 22 nt, Human
uuucgcaggauucuuccucccu

SEQ ID NO: 1739055 - RNA, 21 nt, Human
uuuccuuuuaaaacacuucca

SEQ ID NO: 1739056 - RNA, 21 nt, Human
uuuccuucauucaacccaccu

SEQ ID NO: 1739057 - RNA, 22 nt, Human
uuuccuucagugccuuauggaa

SEQ ID NO: 1739058 - RNA, 21 nt, Human
uuuccuucagugccuuaugga

SEQ ID NO: 1739059 - RNA, 18 nt, Human
uuuccuucagugccuuau

SEQ ID NO: 1739060 - RNA, 23 nt, Human
uuuccuucauucaacccaccugc

SEQ ID NO: 1739061 - RNA, 12 nt, Human
uuuccugugucu

SEQ ID NO: 1739062 - RNA, 17 nt, Human
augggccuccugugugu

SEQ ID NO: 1739063 - RNA, 19 nt, Human
uuuccuuaaauuaucuaaa

SEQ ID NO: 1739064 - RNA, 15 nt, Human
uuuccuucagugccu

SEQ ID NO: 1739065 - RNA, 12 nt, Human
uuuccuucagug

SEQ ID NO: 1739066 - RNA, 11 nt, Human
uuuccuucagu

SEQ ID NO: 1739067 - RNA, 15 nt, Human
uuuaguagagacagg

SEQ ID NO: 1739068 - RNA, 15 nt, Human
uuuagauaauacacc

SEQ ID NO: 1739069 - RNA, 18 nt, Human
uuuagaguugauacuaca

SEQ ID NO: 1739070 - RNA, 13 nt, Human
uuuagauaauaca

SEQ ID NO: 1739071 - RNA, 19 nt, Human
uuuauuaaaugcccagccc

SEQ ID NO: 1739072 - RNA, 19 nt, Human
uuuauuaaauguagaaagu

SEQ ID NO: 1739073 - RNA, 15 nt, Human
uuuaugugaaacaug

SEQ ID NO: 1739074 - RNA, 14 nt, Human
uuuaugugaaacau

SEQ ID NO: 1739075 - RNA, 21 nt, Human
uuuaccuuuuuuauacauaaa

SEQ ID NO: 1739076 - RNA, 14 nt, Human
uuuacuaauagaca

SEQ ID NO: 1739077 - RNA, 17 nt, Human
uuuacuaauagacaauu

SEQ ID NO: 1739078 - RNA, 18 nt, Human
uuuacuaauagacaauuu

SEQ ID NO: 1739079 - RNA, 14 nt, Human
uuuaccuuuuuuau

SEQ ID NO: 1739080 - RNA, 19 nt, Human
uuuaccuuuuuuauacaua

SEQ ID NO: 1739081 - RNA, 20 nt, Human
uuuaccuuuuuuauacauaa

SEQ ID NO: 1739082 - RNA, 17 nt, Human
augcuacacacugcaug

SEQ ID NO: 1739083 - RNA, 18 nt, Human
augcuacacacugcaugu

SEQ ID NO: 1739084 - RNA, 13 nt, Human
augcuaagugaaa

SEQ ID NO: 1739085 - RNA, 23 nt, Human
augcgcaggcuggcccugcccug

SEQ ID NO: 1739086 - RNA, 21 nt, Human
uuuaaagaaaaguuuuguaaa

SEQ ID NO: 1739087 - RNA, 13 nt, Human
uuuaaagaaaagu

SEQ ID NO: 1739088 - RNA, 15 nt, Human
uuuaaagaaaaguuu

SEQ ID NO: 1739089 - RNA, 17 nt, Human
uuuaaagaaaaguuuug

SEQ ID NO: 1739090 - RNA, 17 nt, Human
auggaacacucugagac

SEQ ID NO: 1739091 - RNA, 18 nt, Human
auggaacacucugagacu

SEQ ID NO: 1739092 - RNA, 21 nt, Human
auggaaguacuauaauuuacc

SEQ ID NO: 1739093 - RNA, 15 nt, Human
auggaauaacaugua

SEQ ID NO: 1739094 - RNA, 14 nt, Human
auggaauaacaugu

SEQ ID NO: 1739095 - RNA, 13 nt, Human
uuuauuuuuuggg

SEQ ID NO: 1739096 - RNA, 22 nt, Human
augcuggcuguuggcugggggc

SEQ ID NO: 1739097 - RNA, 14 nt, Human
augcuguauauguu

SEQ ID NO: 1739098 - RNA, 19 nt, Human
augcugugcccuaaagugu

SEQ ID NO: 1739099 - RNA, 19 nt, Human
uuuccagguuuaagcuguu

SEQ ID NO: 1739100 - RNA, 12 nt, Human
uuucauaaagca

SEQ ID NO: 1739101 - RNA, 15 nt, Human
uuucaguuuucagga

SEQ ID NO: 1739102 - RNA, 24 nt, Human
uuucacucuuauugcccacgcugg

SEQ ID NO: 1739103 - RNA, 15 nt, Human
uuucacucuccuugg

SEQ ID NO: 1739104 - RNA, 24 nt, Human
uuucacugcuggcugccuuagaac

SEQ ID NO: 1739105 - RNA, 14 nt, Human
uuucacucuccuug

SEQ ID NO: 1739106 - RNA, 17 nt, Human
uuuauuuuuuucugaau

SEQ ID NO: 1739107 - RNA, 16 nt, Human
uuuauuuuuugggaaa

SEQ ID NO: 1739108 - RNA, 22 nt, Human
uucauauuuuaaacagaggaua

SEQ ID NO: 1739109 - RNA, 20 nt, Human
uucauaucuauuuauuaaau

SEQ ID NO: 1739110 - RNA, 14 nt, Human
uucaguaagccgug

SEQ ID NO: 1739111 - RNA, 17 nt, Human
uucagguaacaggcaga

SEQ ID NO: 1739112 - RNA, 13 nt, Human
auauaugcuaagu

SEQ ID NO: 1739113 - RNA, 15 nt, Human
uucaucaaugaauga

SEQ ID NO: 1739114 - RNA, 22 nt, Human
auauauguuuuaagaggcaggg

SEQ ID NO: 1739115 - RNA, 21 nt, Human
auauauguuuuaagaggcagg

SEQ ID NO: 1739116 - RNA, 15 nt, Human
auauauuuuaagacg

SEQ ID NO: 1739117 - RNA, 16 nt, Human
uucagaaauguguuau

SEQ ID NO: 1739118 - RNA, 22 nt, Human
uucagauauaaaagacugacca

SEQ ID NO: 1739119 - RNA, 14 nt, Human
uucagccaagaauu

SEQ ID NO: 1739120 - RNA, 16 nt, Human
uucagguaacaggcag

SEQ ID NO: 1739121 - RNA, 15 nt, Human
uucagguaacaggca

SEQ ID NO: 1739122 - RNA, 22 nt, Human
uucaggguuggccccugcccgg

SEQ ID NO: 1739123 - RNA, 19 nt, Human
uucaggguuggccccugcc

SEQ ID NO: 1739124 - RNA, 17 nt, Human
uucaggguuggccccug

SEQ ID NO: 1739125 - RNA, 16 nt, Human
uucaggguuggccccu

SEQ ID NO: 1739126 - RNA, 14 nt, Human
uucaggguuggccc

SEQ ID NO: 1739127 - RNA, 22 nt, Human
uuccaauuuacauacucugcuu

SEQ ID NO: 1739128 - RNA, 21 nt, Human
uuccacaagagcccaggccuc

SEQ ID NO: 1739129 - RNA, 14 nt, Human
uuccacagaggaca

SEQ ID NO: 1739130 - RNA, 22 nt, Human
uuccacagaggacacagagaag

SEQ ID NO: 1739131 - RNA, 18 nt, Human
uuccaccaucaagccacc

SEQ ID NO: 1739132 - RNA, 15 nt, Human
uuccaccuucccaug

SEQ ID NO: 1739133 - RNA, 17 nt, Human
uuccagguuuaagcugu

SEQ ID NO: 1739134 - RNA, 18 nt, Human
uuccagguuuaagcuguu

SEQ ID NO: 1739135 - RNA, 17 nt, Human
uuccaggcugggagagc

SEQ ID NO: 1739136 - RNA, 15 nt, Human
uuccaggcugggaga

SEQ ID NO: 1739137 - RNA, 23 nt, Human
auauguaccuaacgaaguauccu

SEQ ID NO: 1739138 - RNA, 21 nt, Human
auauguggaguucaucuugaa

SEQ ID NO: 1739139 - RNA, 20 nt, Human
auauguggaguucaucuuga

SEQ ID NO: 1739140 - RNA, 13 nt, Human
uucccuacuuccu

SEQ ID NO: 1739141 - RNA, 15 nt, Human
uucccuuuuuuuaag

SEQ ID NO: 1739142 - RNA, 12 nt, Human
uucccgcucagc

SEQ ID NO: 1739143 - RNA, 15 nt, Human
uucccgcucagcccu

SEQ ID NO: 1739144 - RNA, 14 nt, Human
uucccgcucagccc

SEQ ID NO: 1739145 - RNA, 22 nt, Human
uuccuggcacugcuuccaguga

SEQ ID NO: 1739146 - RNA, 20 nt, Human
uuccuggcacugcuuccagu

SEQ ID NO: 1739147 - RNA, 22 nt, Human
uuccucuuuuuauuuaguuccu

SEQ ID NO: 1739148 - RNA, 19 nt, Human
uuccuggcacugcuuccag

SEQ ID NO: 1739149 - RNA, 21 nt, Human
uuccuaaauauauuuuaagac

SEQ ID NO: 1739150 - RNA, 18 nt, Human
uuccucuccacugccuuc

SEQ ID NO: 1739151 - RNA, 19 nt, Human
uuccucuccacugccuucg

SEQ ID NO: 1739152 - RNA, 13 nt, Human
uuccucugagccu

SEQ ID NO: 1739153 - RNA, 21 nt, Human
aucaacugcaucaagauguga

SEQ ID NO: 1739154 - RNA, 13 nt, Human
aucaauuuaaaaa

SEQ ID NO: 1739155 - RNA, 16 nt, Human
aucaauucauaucuau

SEQ ID NO: 1739156 - RNA, 17 nt, Human
aucacgccacugcacua

SEQ ID NO: 1739157 - RNA, 15 nt, Human
aucacgccacugcac

SEQ ID NO: 1739158 - RNA, 13 nt, Human
auauuuacaaaug

SEQ ID NO: 1739159 - RNA, 17 nt, Human
auauuguuuucagugua

SEQ ID NO: 1739160 - RNA, 13 nt, Human
auauuguuuucag

SEQ ID NO: 1739161 - RNA, 13 nt, Human
auauuguacaguu

SEQ ID NO: 1739162 - RNA, 14 nt, Human
auauuguacaguuu

SEQ ID NO: 1739163 - RNA, 22 nt, Human
auauugcugauggugcaaugac

SEQ ID NO: 1739164 - RNA, 12 nt, Human
auauuguacagu

SEQ ID NO: 1739165 - RNA, 15 nt, Human
auauugauaugcuua

SEQ ID NO: 1739166 - RNA, 19 nt, Human
auauuaccacagacauacu

SEQ ID NO: 1739167 - RNA, 21 nt, Human
auauuccugcauuugugaaau

SEQ ID NO: 1739168 - RNA, 17 nt, Human
auauuaccacagacaua

SEQ ID NO: 1739169 - RNA, 22 nt, Human
auauuaagaaagacuaucuaaa

SEQ ID NO: 1739170 - RNA, 17 nt, Human
auauuaagaaagacuau

SEQ ID NO: 1739171 - RNA, 15 nt, Human
auauuaagaaagacu

SEQ ID NO: 1739172 - RNA, 16 nt, Human
auauuaagaaagacua

SEQ ID NO: 1739173 - RNA, 16 nt, Human
auauguucugacauaa

SEQ ID NO: 1739174 - RNA, 16 nt, Human
uuccagugaggcucug

SEQ ID NO: 1739175 - RNA, 15 nt, Human
uuccagugaggcucu

SEQ ID NO: 1739176 - RNA, 22 nt, Human
uuccagugaaaucaguuacucu

SEQ ID NO: 1739177 - RNA, 17 nt, Human
aucguaaaauuaagaaa

SEQ ID NO: 1739178 - RNA, 14 nt, Human
aucguaaaauuaag

SEQ ID NO: 1739179 - RNA, 13 nt, Human
aucguaaaauuaa

SEQ ID NO: 1739180 - RNA, 12 nt, Human
aucguaaaauua

SEQ ID NO: 1739181 - RNA, 23 nt, Human
auccuggcacccggccccugcug

SEQ ID NO: 1739182 - RNA, 22 nt, Human
auccuggcacccggccccugcu

SEQ ID NO: 1739183 - RNA, 21 nt, Human
auccuggcacccggccccugc

SEQ ID NO: 1739184 - RNA, 20 nt, Human
auccuggcacccggccccug

SEQ ID NO: 1739185 - RNA, 19 nt, Human
auccuggcacccggccccu

SEQ ID NO: 1739186 - RNA, 17 nt, Human
auccuggcacccggccc

SEQ ID NO: 1739187 - RNA, 15 nt, Human
auccuggaguucugg

SEQ ID NO: 1739188 - RNA, 19 nt, Human
auccugcuucugauaugca

SEQ ID NO: 1739189 - RNA, 21 nt, Human
auccugcuucugauaugcagu

SEQ ID NO: 1739190 - RNA, 20 nt, Human
auccucuguacagagcccac

SEQ ID NO: 1739191 - RNA, 18 nt, Human
auccucuguacagagccc

SEQ ID NO: 1739192 - RNA, 20 nt, Human
uucuuuugccguuauuaaaa

SEQ ID NO: 1739193 - RNA, 13 nt, Human
auccugagccaga

SEQ ID NO: 1739194 - RNA, 12 nt, Human
auccugagccag

SEQ ID NO: 1739195 - RNA, 11 nt, Human
auccugagcca

SEQ ID NO: 1739196 - RNA, 17 nt, Human
auccucuuugagugaag

SEQ ID NO: 1739197 - RNA, 16 nt, Human
auccugcaauuccacu

SEQ ID NO: 1739198 - RNA, 22 nt, Human
auccugaggcuccacuuggucu

SEQ ID NO: 1739199 - RNA, 13 nt, Human
auccugccccuga

SEQ ID NO: 1739200 - RNA, 11 nt, Human
auccugaggcu

SEQ ID NO: 1739201 - RNA, 13 nt, Human
auccugaggcucc

SEQ ID NO: 1739202 - RNA, 16 nt, Human
auccugaggcuccacu

SEQ ID NO: 1739203 - RNA, 18 nt, Human
auccugaggcuccacuug

SEQ ID NO: 1739204 - RNA, 21 nt, Human
auccugagccagauuucacuc

SEQ ID NO: 1739205 - RNA, 17 nt, Human
auccugagccagauuuc

SEQ ID NO: 1739206 - RNA, 15 nt, Human
auccugagccagauu

SEQ ID NO: 1739207 - RNA, 14 nt, Human
auccugagccagau

SEQ ID NO: 1739208 - RNA, 24 nt, Human
uugaccauucuccaccugccaggg

SEQ ID NO: 1739209 - RNA, 19 nt, Human
uugacacuuaaaaaugguu

SEQ ID NO: 1739210 - RNA, 13 nt, Human
uugacaucaacug

SEQ ID NO: 1739211 - RNA, 19 nt, Human
uugaccauucuccaccugc

SEQ ID NO: 1739212 - RNA, 18 nt, Human
uugaccauucuccaccug

SEQ ID NO: 1739213 - RNA, 16 nt, Human
uugaggucuguucuuu

SEQ ID NO: 1739214 - RNA, 15 nt, Human
uugaggucuguucuu

SEQ ID NO: 1739215 - RNA, 12 nt, Human
uugauaaaguaa

SEQ ID NO: 1739216 - RNA, 17 nt, Human
uugacacuuaaaaaugg

SEQ ID NO: 1739217 - RNA, 15 nt, Human
aucuaaauguugaaa

SEQ ID NO: 1739218 - RNA, 15 nt, Human
aucuaaacugccccc

SEQ ID NO: 1739219 - RNA, 15 nt, Human
aucgugacaacacuu

SEQ ID NO: 1739220 - RNA, 14 nt, Human
aucgugacaacacu

SEQ ID NO: 1739221 - RNA, 18 nt, Human
aucgucacugcuuaacuu

SEQ ID NO: 1739222 - RNA, 14 nt, Human
aucgucacugcuua

SEQ ID NO: 1739223 - RNA, 15 nt, Human
aucauaaaacuugau

SEQ ID NO: 1739224 - RNA, 23 nt, Human
aucauccacugugccaugugcca

SEQ ID NO: 1739225 - RNA, 21 nt, Human
aucauccacugugccaugugc

SEQ ID NO: 1739226 - RNA, 16 nt, Human
aucauuaggugugacu

SEQ ID NO: 1739227 - RNA, 19 nt, Human
aucagucugauucccaagc

SEQ ID NO: 1739228 - RNA, 17 nt, Human
aucagugcccuccagga

SEQ ID NO: 1739229 - RNA, 15 nt, Human
aucagugcccuccag

SEQ ID NO: 1739230 - RNA, 13 nt, Human
aucagugcccucc

SEQ ID NO: 1739231 - RNA, 23 nt, Human
aucacuugaacccgggaggcaga

SEQ ID NO: 1739232 - RNA, 15 nt, Human
aucaggugcugccau

SEQ ID NO: 1739233 - RNA, 19 nt, Human
aucaggugcugccauccag

SEQ ID NO: 1739234 - RNA, 17 nt, Human
aucaggugcugccaucc

SEQ ID NO: 1739235 - RNA, 21 nt, Human
uucucuaguuugauuaaauuc

SEQ ID NO: 1739236 - RNA, 22 nt, Human
uucuccuuucacaaccuucugu

SEQ ID NO: 1739237 - RNA, 18 nt, Human
uucuccuuucacaaccuu

SEQ ID NO: 1739238 - RNA, 12 nt, Human
aucauugaaauc

SEQ ID NO: 1739239 - RNA, 13 nt, Human
aucauugaaaucu

SEQ ID NO: 1739240 - RNA, 19 nt, Human
aucauugugaaauuauuca

SEQ ID NO: 1739241 - RNA, 15 nt, Human
aucauugugaaauua

SEQ ID NO: 1739242 - RNA, 13 nt, Human
aucauugugaaau

SEQ ID NO: 1739243 - RNA, 18 nt, Human
auccaagcaaaugugaau

SEQ ID NO: 1739244 - RNA, 16 nt, Human
auccaagcaaauguga

SEQ ID NO: 1739245 - RNA, 16 nt, Human
uucugccugcccaggc

SEQ ID NO: 1739246 - RNA, 15 nt, Human
uucugccugcccagg

SEQ ID NO: 1739247 - RNA, 13 nt, Human
auccaauuggaua

SEQ ID NO: 1739248 - RNA, 17 nt, Human
auccagguucagcuugu

SEQ ID NO: 1739249 - RNA, 15 nt, Human
auccaguaucuugaa

SEQ ID NO: 1739250 - RNA, 14 nt, Human
auccaguaucuuga

SEQ ID NO: 1739251 - RNA, 18 nt, Human
aucccaugagccucagca

SEQ ID NO: 1739252 - RNA, 17 nt, Human
aucccaugagccucagc

SEQ ID NO: 1739253 - RNA, 17 nt, Human
aucccugaaggccccgc

SEQ ID NO: 1739254 - RNA, 22 nt, Human
aucccugaaggccccgcccagg

SEQ ID NO: 1739255 - RNA, 16 nt, Human
aucccaugagccucag

SEQ ID NO: 1739256 - RNA, 12 nt, Human
aucccagcccca

SEQ ID NO: 1739257 - RNA, 11 nt, Human
aucccagcccc

SEQ ID NO: 1739258 - RNA, 11 nt, Human
uucuucucccu

SEQ ID NO: 1739259 - RNA, 22 nt, Human
uucuucuccacuuucuagccag

SEQ ID NO: 1739260 - RNA, 17 nt, Human
uucuuucuggcuaugca

SEQ ID NO: 1739261 - RNA, 20 nt, Human
uucuuucuggcuaugcauuu

SEQ ID NO: 1739262 - RNA, 12 nt, Human
uucuuucuggcu

SEQ ID NO: 1739263 - RNA, 23 nt, Human
uucuuaaccagaucauugugaaa

SEQ ID NO: 1739264 - RNA, 22 nt, Human
uucuuaaccagaucauugugaa

SEQ ID NO: 1739265 - RNA, 13 nt, Human
uucuguuuagaua

SEQ ID NO: 1739266 - RNA, 18 nt, Human
uucuguuuagauaauaca

SEQ ID NO: 1739267 - RNA, 14 nt, Human
aggcugggagagcc

SEQ ID NO: 1739268 - RNA, 22 nt, Human
uggcuagagguucaaagauauu

SEQ ID NO: 1739269 - RNA, 20 nt, Human
aggcuggcgugcaguggugc

SEQ ID NO: 1739270 - RNA, 18 nt, Human
aggcuggcgugcaguggu

SEQ ID NO: 1739271 - RNA, 15 nt, Human
uggcuaugcauuuga

SEQ ID NO: 1739272 - RNA, 17 nt, Human
uggcuaugcauuugaaa

SEQ ID NO: 1739273 - RNA, 14 nt, Human
uggcuaugcauuug

SEQ ID NO: 1739274 - RNA, 19 nt, Human
uggcuaugcauuugaaaau

SEQ ID NO: 1739275 - RNA, 22 nt, Human
uggcuauuagagaucaaccccu

SEQ ID NO: 1739276 - RNA, 21 nt, Human
uggcucuuccaggcugggaga

SEQ ID NO: 1739277 - RNA, 20 nt, Human
uggcucuuccaggcugggag

SEQ ID NO: 1739278 - RNA, 18 nt, Human
uggcucaaguccucuuuu

SEQ ID NO: 1739279 - RNA, 19 nt, Human
uggcucuuccaggcuggga

SEQ ID NO: 1739280 - RNA, 12 nt, Human
uggcugcaaagg

SEQ ID NO: 1739281 - RNA, 14 nt, Human
uggcugcagggagu

SEQ ID NO: 1739282 - RNA, 13 nt, Human
uggcugcagggag

SEQ ID NO: 1739283 - RNA, 15 nt, Human
uggcugcagggaguc

SEQ ID NO: 1739284 - RNA, 20 nt, Human
uggcugccaaugggagcuca

SEQ ID NO: 1739285 - RNA, 18 nt, Human
uggcugccaaugggagcu

SEQ ID NO: 1739286 - RNA, 11 nt, Human
uggcugcugaa

SEQ ID NO: 1739287 - RNA, 17 nt, Human
uggcuuaaaacaacacu

SEQ ID NO: 1739288 - RNA, 15 nt, Human
uggcuguuggcuggg

SEQ ID NO: 1739289 - RNA, 13 nt, Human
uggcuguuggcug

SEQ ID NO: 1739290 - RNA, 14 nt, Human
uggcugugucuccc

SEQ ID NO: 1739291 - RNA, 23 nt, Human
uggcuucacggaagagccuugcg

SEQ ID NO: 1739292 - RNA, 16 nt, Human
ugggaaaggggaaguu

SEQ ID NO: 1739293 - RNA, 16 nt, Human
uggcuucccgcucagc

SEQ ID NO: 1739294 - RNA, 15 nt, Human
uggcuucccgcucag

SEQ ID NO: 1739295 - RNA, 17 nt, Human
uggcuucccgcucagcc

SEQ ID NO: 1739296 - RNA, 13 nt, Human
ugggaacuagacu

SEQ ID NO: 1739297 - RNA, 23 nt, Human
aggcugcucuugaacuccugacc

SEQ ID NO: 1739298 - RNA, 16 nt, Human
aggcucugcccuuggu

SEQ ID NO: 1739299 - RNA, 13 nt, Human
aggcucuggagcc

SEQ ID NO: 1739300 - RNA, 15 nt, Human
aggcucuggagccca

SEQ ID NO: 1739301 - RNA, 14 nt, Human
aggcucuggagccc

SEQ ID NO: 1739302 - RNA, 19 nt, Human
aggcucuggagcccacugu

SEQ ID NO: 1739303 - RNA, 18 nt, Human
aggcucuggagcccacug

SEQ ID NO: 1739304 - RNA, 17 nt, Human
aggcuggcgugcagugg

SEQ ID NO: 1739305 - RNA, 13 nt, Human
aggcuggcgugca

SEQ ID NO: 1739306 - RNA, 19 nt, Human
aggcuggcccugcccuggu

SEQ ID NO: 1739307 - RNA, 14 nt, Human
aggcuggcccugcc

SEQ ID NO: 1739308 - RNA, 12 nt, Human
aggcuggcccug

SEQ ID NO: 1739309 - RNA, 18 nt, Human
aggcuggcccugcccugg

SEQ ID NO: 1739310 - RNA, 17 nt, Human
aggcuggcccugcccug

SEQ ID NO: 1739311 - RNA, 16 nt, Human
aggcuggcccugcccu

SEQ ID NO: 1739312 - RNA, 15 nt, Human
aggcuggcccugccc

SEQ ID NO: 1739313 - RNA, 20 nt, Human
aggcucucaggccagcugcu

SEQ ID NO: 1739314 - RNA, 19 nt, Human
aggcucucaggccagcugc

SEQ ID NO: 1739315 - RNA, 18 nt, Human
aggcucucaggccagcug

SEQ ID NO: 1739316 - RNA, 16 nt, Human
aggcucucaggccagc

SEQ ID NO: 1739317 - RNA, 15 nt, Human
aggcucucaggccag

SEQ ID NO: 1739318 - RNA, 14 nt, Human
aggcucucaggcca

SEQ ID NO: 1739319 - RNA, 12 nt, Human
aggcucucaggc

SEQ ID NO: 1739320 - RNA, 11 nt, Human
aggcucucagg

SEQ ID NO: 1739321 - RNA, 15 nt, Human
aggcucugcccuugg

SEQ ID NO: 1739322 - RNA, 14 nt, Human
aggcucugcccuug

SEQ ID NO: 1739323 - RNA, 13 nt, Human
aggcucugcccuu

SEQ ID NO: 1739324 - RNA, 12 nt, Human
aggcucugcccu

SEQ ID NO: 1739325 - RNA, 11 nt, Human
aggcucugccc

SEQ ID NO: 1739326 - RNA, 21 nt, Human
aggcucucaggccagcugcuu

SEQ ID NO: 1739327 - RNA, 19 nt, Human
aggcucgagcaugccugga

SEQ ID NO: 1739328 - RNA, 18 nt, Human
aggcucgagcaugccugg

SEQ ID NO: 1739329 - RNA, 17 nt, Human
aggcucgagcaugccug

SEQ ID NO: 1739330 - RNA, 15 nt, Human
aggcucgagcaugcc

SEQ ID NO: 1739331 - RNA, 21 nt, Human
aggcucgagcaugccuggaug

SEQ ID NO: 1739332 - RNA, 12 nt, Human
aggcucgagcau

SEQ ID NO: 1739333 - RNA, 19 nt, Human
aggcuccuuuagcgcccag

SEQ ID NO: 1739334 - RNA, 20 nt, Human
aggcuccugccaccacgccc

SEQ ID NO: 1739335 - RNA, 14 nt, Human
aggcuccugccacc

SEQ ID NO: 1739336 - RNA, 18 nt, Human
uggacgagaaaacaauaa

SEQ ID NO: 1739337 - RNA, 18 nt, Human
aggcauuuguuugaacug

SEQ ID NO: 1739338 - RNA, 16 nt, Human
aggccaaacucaccug

SEQ ID NO: 1739339 - RNA, 13 nt, Human
aggccaaaaaaau

SEQ ID NO: 1739340 - RNA, 15 nt, Human
aggccaaaggaagca

SEQ ID NO: 1739341 - RNA, 14 nt, Human
aggccaaaggaagc

SEQ ID NO: 1739342 - RNA, 20 nt, Human
aggccaaacucaccugcccc

SEQ ID NO: 1739343 - RNA, 18 nt, Human
aggccaaggugggaggau

SEQ ID NO: 1739344 - RNA, 22 nt, Human
aggccaacccaaaauaagcagg

SEQ ID NO: 1739345 - RNA, 23 nt, Human
aggccaaaggaagcacaugccuc

SEQ ID NO: 1739346 - RNA, 20 nt, Human
uggaguucaucuugaauugu

SEQ ID NO: 1739347 - RNA, 17 nt, Human
uggaguucaucuugaau

SEQ ID NO: 1739348 - RNA, 16 nt, Human
uggaguucaucuugaa

SEQ ID NO: 1739349 - RNA, 19 nt, Human
uggaugccugguggcagcu

SEQ ID NO: 1739350 - RNA, 18 nt, Human
uggaugccugguggcagc

SEQ ID NO: 1739351 - RNA, 20 nt, Human
uggaugccugguggcagcug

SEQ ID NO: 1739352 - RNA, 15 nt, Human
aggccacaagacccu

SEQ ID NO: 1739353 - RNA, 19 nt, Human
uggagucagacagaugugg

SEQ ID NO: 1739354 - RNA, 20 nt, Human
uggcacaucagcacgauuuc

SEQ ID NO: 1739355 - RNA, 12 nt, Human
uggauguucuga

SEQ ID NO: 1739356 - RNA, 22 nt, Human
uggauuaaacuuaaucuaaaug

SEQ ID NO: 1739357 - RNA, 22 nt, Human
uggcagaguugaagacagagcu

SEQ ID NO: 1739358 - RNA, 21 nt, Human
uggcagaguugaagacagagc

SEQ ID NO: 1739359 - RNA, 16 nt, Human
uggcacccggccccug

SEQ ID NO: 1739360 - RNA, 15 nt, Human
uggcacccggccccu

SEQ ID NO: 1739361 - RNA, 21 nt, Human
uggcacaucagcacgauuucu

SEQ ID NO: 1739362 - RNA, 12 nt, Human
uggcagccccug

SEQ ID NO: 1739363 - RNA, 16 nt, Human
uggcagccgugccuuc

SEQ ID NO: 1739364 - RNA, 20 nt, Human
aggccacaagacccuugugg

SEQ ID NO: 1739365 - RNA, 16 nt, Human
uggcagccucuucaaa

SEQ ID NO: 1739366 - RNA, 15 nt, Human
uggcagccucuucaa

SEQ ID NO: 1739367 - RNA, 23 nt, Human
uggcagccgugccuucagcucua

SEQ ID NO: 1739368 - RNA, 13 nt, Human
uggcagccuuggc

SEQ ID NO: 1739369 - RNA, 12 nt, Human
aggccagagaca

SEQ ID NO: 1739370 - RNA, 15 nt, Human
uggccgggagccuga

SEQ ID NO: 1739371 - RNA, 23 nt, Human
uggccgggaccccgagccuggcu

SEQ ID NO: 1739372 - RNA, 17 nt, Human
uggccgggaccccgagc

SEQ ID NO: 1739373 - RNA, 15 nt, Human
uggccgggaccccga

SEQ ID NO: 1739374 - RNA, 21 nt, Human
uggccccugcccggcugcgga

SEQ ID NO: 1739375 - RNA, 19 nt, Human
uggcccgacagccuggcac

SEQ ID NO: 1739376 - RNA, 18 nt, Human
uggcccgacagccuggca

SEQ ID NO: 1739377 - RNA, 17 nt, Human
uggcccgacagccuggc

SEQ ID NO: 1739378 - RNA, 16 nt, Human
uggcccgacagccugg

SEQ ID NO: 1739379 - RNA, 15 nt, Human
uggcccgacagccug

SEQ ID NO: 1739380 - RNA, 14 nt, Human
uggcccgacagccu

SEQ ID NO: 1739381 - RNA, 21 nt, Human
aggccuggccagaugcaccag

SEQ ID NO: 1739382 - RNA, 17 nt, Human
aggccuggccagaugca

SEQ ID NO: 1739383 - RNA, 16 nt, Human
aggccuggccagaugc

SEQ ID NO: 1739384 - RNA, 15 nt, Human
aggccuggccagaug

SEQ ID NO: 1739385 - RNA, 23 nt, Human
aggccuggccagaugcaccagcc

SEQ ID NO: 1739386 - RNA, 22 nt, Human
aggccuggccagaugcaccagc

SEQ ID NO: 1739387 - RNA, 23 nt, Human
aggccugggggcugggcagagga

SEQ ID NO: 1739388 - RNA, 12 nt, Human
uggccuggcccc

SEQ ID NO: 1739389 - RNA, 18 nt, Human
uggccucugcacuccccu

SEQ ID NO: 1739390 - RNA, 17 nt, Human
uggccucugcacucccc

SEQ ID NO: 1739391 - RNA, 15 nt, Human
uggccucugcacucc

SEQ ID NO: 1739392 - RNA, 14 nt, Human
uggccucugcacuc

SEQ ID NO: 1739393 - RNA, 15 nt, Human
aggcccucugcccac

SEQ ID NO: 1739394 - RNA, 14 nt, Human
aggcccucugccca

SEQ ID NO: 1739395 - RNA, 13 nt, Human
aggcccucugccc

SEQ ID NO: 1739396 - RNA, 13 nt, Human
aggccugccuguu

SEQ ID NO: 1739397 - RNA, 15 nt, Human
uggcaugggaaugaa

SEQ ID NO: 1739398 - RNA, 12 nt, Human
uggcaugggaau

SEQ ID NO: 1739399 - RNA, 17 nt, Human
uggccaggcuggucuca

SEQ ID NO: 1739400 - RNA, 15 nt, Human
uggccaggcuggucu

SEQ ID NO: 1739401 - RNA, 20 nt, Human
uggccaggcuggucucgaac

SEQ ID NO: 1739402 - RNA, 16 nt, Human
uggccaaguucuuagu

SEQ ID NO: 1739403 - RNA, 13 nt, Human
ugcuuauacacuu

SEQ ID NO: 1739404 - RNA, 14 nt, Human
ugcuucagccuccc

SEQ ID NO: 1739405 - RNA, 13 nt, Human
ugcuucagccucc

SEQ ID NO: 1739406 - RNA, 19 nt, Human
ugcuucaaggauccugagc

SEQ ID NO: 1739407 - RNA, 18 nt, Human
ugcuucaaggauccugag

SEQ ID NO: 1739408 - RNA, 16 nt, Human
ugcuucaaggauccug

SEQ ID NO: 1739409 - RNA, 14 nt, Human
ugcuucaucccuuu

SEQ ID NO: 1739410 - RNA, 23 nt, Human
aggacacuaaccacgcuggaccu

SEQ ID NO: 1739411 - RNA, 22 nt, Human
aggacagggaggugaccccagg

SEQ ID NO: 1739412 - RNA, 13 nt, Human
ugcuggagcucug

SEQ ID NO: 1739413 - RNA, 14 nt, Human
ugcuggagcucugc

SEQ ID NO: 1739414 - RNA, 15 nt, Human
ugcugcccugugagu

SEQ ID NO: 1739415 - RNA, 20 nt, Human
aggaauuuuauuuuuuucug

SEQ ID NO: 1739416 - RNA, 14 nt, Human
ugcugcccugugag

SEQ ID NO: 1739417 - RNA, 13 nt, Human
ugcugcccuguga

SEQ ID NO: 1739418 - RNA, 12 nt, Human
ugcugcccugug

SEQ ID NO: 1739419 - RNA, 18 nt, Human
ugcuggcuguuggcuggg

SEQ ID NO: 1739420 - RNA, 16 nt, Human
ugcuggcugguuagag

SEQ ID NO: 1739421 - RNA, 21 nt, Human
ugcuggcugccuuagaaccuu

SEQ ID NO: 1739422 - RNA, 14 nt, Human
ugcuggcugccuua

SEQ ID NO: 1739423 - RNA, 15 nt, Human
ugcuggcugccuuag

SEQ ID NO: 1739424 - RNA, 11 nt, Human
aggaauuuaaa

SEQ ID NO: 1739425 - RNA, 23 nt, Human
aggaauugacccacaagaaauga

SEQ ID NO: 1739426 - RNA, 23 nt, Human
aggaauuguguuuauaauuuuaa

SEQ ID NO: 1739427 - RNA, 18 nt, Human
aggaagccagcaggcucu

SEQ ID NO: 1739428 - RNA, 17 nt, Human
aggaagccagcaggcuc

SEQ ID NO: 1739429 - RNA, 18 nt, Human
aggaaggaaacccagcuc

SEQ ID NO: 1739430 - RNA, 15 nt, Human
aggaaggagaggaga

SEQ ID NO: 1739431 - RNA, 19 nt, Human
aggaaggaaacccagcucu

SEQ ID NO: 1739432 - RNA, 19 nt, Human
aggaagacuucaucccucu

SEQ ID NO: 1739433 - RNA, 13 nt, Human
aggaagacuucau

SEQ ID NO: 1739434 - RNA, 23 nt, Human
ugcugagucugaaggcuggguuc

SEQ ID NO: 1739435 - RNA, 22 nt, Human
ugcugagucugaaggcuggguu

SEQ ID NO: 1739436 - RNA, 21 nt, Human
ugcugagucugaaggcugggu

SEQ ID NO: 1739437 - RNA, 18 nt, Human
ugcugagucugaaggcug

SEQ ID NO: 1739438 - RNA, 17 nt, Human
ugcugagucugaaggcu

SEQ ID NO: 1739439 - RNA, 16 nt, Human
ugcugagucugaaggc

SEQ ID NO: 1739440 - RNA, 24 nt, Human
aggaagcacaugccucucucaggc

SEQ ID NO: 1739441 - RNA, 23 nt, Human
aggaagcacaugccucucucagg

SEQ ID NO: 1739442 - RNA, 14 nt, Human
aggaagacuuugga

SEQ ID NO: 1739443 - RNA, 13 nt, Human
aggaagacuuugg

SEQ ID NO: 1739444 - RNA, 15 nt, Human
aggaagccagcaggc

SEQ ID NO: 1739445 - RNA, 14 nt, Human
aggaagccagcagg

SEQ ID NO: 1739446 - RNA, 18 nt, Human
agcugggacuacaggcac

SEQ ID NO: 1739447 - RNA, 16 nt, Human
agcugggacuacaggc

SEQ ID NO: 1739448 - RNA, 19 nt, Human
agcugggacuacaggcacc

SEQ ID NO: 1739449 - RNA, 20 nt, Human
ugcuccagcuguucagcugg

SEQ ID NO: 1739450 - RNA, 19 nt, Human
ugcuccagcuguucagcug

SEQ ID NO: 1739451 - RNA, 16 nt, Human
ugcuccagcuguucag

SEQ ID NO: 1739452 - RNA, 14 nt, Human
ugcugagucugaag

SEQ ID NO: 1739453 - RNA, 15 nt, Human
ugcugagucugaagg

SEQ ID NO: 1739454 - RNA, 14 nt, Human
ugcugacuguacuc

SEQ ID NO: 1739455 - RNA, 22 nt, Human
ugcucugcugacagacacaggc

SEQ ID NO: 1739456 - RNA, 21 nt, Human
ugcucugcugacagacacagg

SEQ ID NO: 1739457 - RNA, 19 nt, Human
aggauuuugauccaagcug

SEQ ID NO: 1739458 - RNA, 17 nt, Human
aggaugccccguccccc

SEQ ID NO: 1739459 - RNA, 14 nt, Human
aggaugcccaaaga

SEQ ID NO: 1739460 - RNA, 20 nt, Human
aggaugaucuaggaagacuu

SEQ ID NO: 1739461 - RNA, 19 nt, Human
aggaugcccaaagaugcag

SEQ ID NO: 1739462 - RNA, 19 nt, Human
aggcaacugcauuggcuuu

SEQ ID NO: 1739463 - RNA, 17 nt, Human
aggcaacucaucuuagg

SEQ ID NO: 1739464 - RNA, 13 nt, Human
uggacccugaggc

SEQ ID NO: 1739465 - RNA, 12 nt, Human
uggacccugagg

SEQ ID NO: 1739466 - RNA, 14 nt, Human
uggacccugaggcc

SEQ ID NO: 1739467 - RNA, 15 nt, Human
uggacccugaggccc

SEQ ID NO: 1739468 - RNA, 21 nt, Human
uggacacagcucuucuccagg

SEQ ID NO: 1739469 - RNA, 18 nt, Human
uggacacagcucuucucc

SEQ ID NO: 1739470 - RNA, 16 nt, Human
uggacacagcucuucu

SEQ ID NO: 1739471 - RNA, 15 nt, Human
uggacacagcucuuc

SEQ ID NO: 1739472 - RNA, 21 nt, Human
aggagggagcaucagugcccu

SEQ ID NO: 1739473 - RNA, 14 nt, Human
aggagggaggggga

SEQ ID NO: 1739474 - RNA, 16 nt, Human
aggauccugagccaga

SEQ ID NO: 1739475 - RNA, 15 nt, Human
aggauccugagccag

SEQ ID NO: 1739476 - RNA, 21 nt, Human
aggauacaaaagcaugugaga

SEQ ID NO: 1739477 - RNA, 17 nt, Human
aggaugaucuaggaaga

SEQ ID NO: 1739478 - RNA, 16 nt, Human
aggaugaucuaggaag

SEQ ID NO: 1739479 - RNA, 22 nt, Human
aggaucucuugagccugggagg

SEQ ID NO: 1739480 - RNA, 21 nt, Human
aggaucucuugagccugggag

SEQ ID NO: 1739481 - RNA, 18 nt, Human
aggauccugagccagauu

SEQ ID NO: 1739482 - RNA, 17 nt, Human
aggauccugagccagau

SEQ ID NO: 1739483 - RNA, 23 nt, Human
uggaaaugggcagagcagagacc

SEQ ID NO: 1739484 - RNA, 20 nt, Human
uggaaauauuaagaaagacu

SEQ ID NO: 1739485 - RNA, 11 nt, Human
aggagaaacug

SEQ ID NO: 1739486 - RNA, 17 nt, Human
aggagaaacuggaacuc

SEQ ID NO: 1739487 - RNA, 17 nt, Human
aggagauuggaaggaac

SEQ ID NO: 1739488 - RNA, 22 nt, Human
aggagccccgaggccuucucug

SEQ ID NO: 1739489 - RNA, 18 nt, Human
aggagcccugggaggcuc

SEQ ID NO: 1739490 - RNA, 14 nt, Human
aggagcagccacau

SEQ ID NO: 1739491 - RNA, 18 nt, Human
aggacauugcggacagcc

SEQ ID NO: 1739492 - RNA, 17 nt, Human
aggacauugcggacagc

SEQ ID NO: 1739493 - RNA, 15 nt, Human
aggacauugcggaca

SEQ ID NO: 1739494 - RNA, 23 nt, Human
aggacauugcggacagccacggc

SEQ ID NO: 1739495 - RNA, 19 nt, Human
aggacauugcggacagcca

SEQ ID NO: 1739496 - RNA, 15 nt, Human
uggaaauauuaagaa

SEQ ID NO: 1739497 - RNA, 19 nt, Human
ugcuugggcuucauccucc

SEQ ID NO: 1739498 - RNA, 21 nt, Human
ugcuuugggcugcccuggugc

SEQ ID NO: 1739499 - RNA, 20 nt, Human
ugcuuugggcugcccuggug

SEQ ID NO: 1739500 - RNA, 19 nt, Human
ugcuuugggcugcccuggu

SEQ ID NO: 1739501 - RNA, 18 nt, Human
ugcuuugggcugcccugg

SEQ ID NO: 1739502 - RNA, 19 nt, Human
aggagcccugggaggcucu

SEQ ID NO: 1739503 - RNA, 16 nt, Human
ugcuugggcuucaucc

SEQ ID NO: 1739504 - RNA, 12 nt, Human
ugcuugggcuuc

SEQ ID NO: 1739505 - RNA, 21 nt, Human
ugcuuggaggaaggaaaccca

SEQ ID NO: 1739506 - RNA, 22 nt, Human
agcgcuggccgggaccccgagc

SEQ ID NO: 1739507 - RNA, 16 nt, Human
agcgcuggccgggacc

SEQ ID NO: 1739508 - RNA, 20 nt, Human
ugcauuuaaaagauacaguu

SEQ ID NO: 1739509 - RNA, 19 nt, Human
ugcauuugaggucuguucu

SEQ ID NO: 1739510 - RNA, 18 nt, Human
ugcauuugaggucuguuc

SEQ ID NO: 1739511 - RNA, 18 nt, Human
agccuuccagggguggga

SEQ ID NO: 1739512 - RNA, 15 nt, Human
agccuugaacuuuga

SEQ ID NO: 1739513 - RNA, 22 nt, Human
agccuugaccauucuccaccug

SEQ ID NO: 1739514 - RNA, 23 nt, Human
agccuugaacuuugaccucugca

SEQ ID NO: 1739515 - RNA, 16 nt, Human
agccuugaacuuugac

SEQ ID NO: 1739516 - RNA, 22 nt, Human
agccuugaacuuugaccucugc

SEQ ID NO: 1739517 - RNA, 22 nt, Human
agcgauucuucugcuucagccu

SEQ ID NO: 1739518 - RNA, 23 nt, Human
agccuugaccauucuccaccugc

SEQ ID NO: 1739519 - RNA, 18 nt, Human
ugccagcuuaucucaggg

SEQ ID NO: 1739520 - RNA, 13 nt, Human
agcggcuggcagc

SEQ ID NO: 1739521 - RNA, 20 nt, Human
agcggggacagcuccuucug

SEQ ID NO: 1739522 - RNA, 19 nt, Human
agcggggacagcuccuucu

SEQ ID NO: 1739523 - RNA, 23 nt, Human
agcggcuggcagcccaccccuca

SEQ ID NO: 1739524 - RNA, 22 nt, Human
agcggggacagcuccuucuguc

SEQ ID NO: 1739525 - RNA, 20 nt, Human
ugcauuugaggucuguucuu

SEQ ID NO: 1739526 - RNA, 21 nt, Human
ugcauuugaggucuguucuuu

SEQ ID NO: 1739527 - RNA, 17 nt, Human
ugccacugccucuuccu

SEQ ID NO: 1739528 - RNA, 13 nt, Human
ugccacugccucu

SEQ ID NO: 1739529 - RNA, 20 nt, Human
ugccacugccucuuccuccc

SEQ ID NO: 1739530 - RNA, 19 nt, Human
ugccacugccucuuccucc

SEQ ID NO: 1739531 - RNA, 18 nt, Human
ugccacugccucuuccuc

SEQ ID NO: 1739532 - RNA, 23 nt, Human
ugccccgaacauguuuuucuucu

SEQ ID NO: 1739533 - RNA, 20 nt, Human
ugcccuaaaguguauuuuuu

SEQ ID NO: 1739534 - RNA, 18 nt, Human
ugcccccucugcccugcg

SEQ ID NO: 1739535 - RNA, 17 nt, Human
ugcccccucugcccugc

SEQ ID NO: 1739536 - RNA, 16 nt, Human
ugcccccucugcccug

SEQ ID NO: 1739537 - RNA, 15 nt, Human
ugcccccucugcccu

SEQ ID NO: 1739538 - RNA, 14 nt, Human
ugcccccucugccc

SEQ ID NO: 1739539 - RNA, 18 nt, Human
ugcccaggccccugccac

SEQ ID NO: 1739540 - RNA, 17 nt, Human
ugcccaggccccugcca

SEQ ID NO: 1739541 - RNA, 15 nt, Human
ugcccaggccccugc

SEQ ID NO: 1739542 - RNA, 17 nt, Human
ugcccagccccuucuga

SEQ ID NO: 1739543 - RNA, 16 nt, Human
ugcccagccccuucug

SEQ ID NO: 1739544 - RNA, 13 nt, Human
ugcccagccccuu

SEQ ID NO: 1739545 - RNA, 20 nt, Human
ugcccaaagaugcagccggu

SEQ ID NO: 1739546 - RNA, 17 nt, Human
ugcccaaagaugcagcc

SEQ ID NO: 1739547 - RNA, 16 nt, Human
agcuccaagcucccag

SEQ ID NO: 1739548 - RNA, 15 nt, Human
agcuccaagcuccca

SEQ ID NO: 1739549 - RNA, 17 nt, Human
agcucaggugucccugc

SEQ ID NO: 1739550 - RNA, 13 nt, Human
agcucagggccug

SEQ ID NO: 1739551 - RNA, 12 nt, Human
agcucagggccu

SEQ ID NO: 1739552 - RNA, 19 nt, Human
agcuauucaguaauaacuc

SEQ ID NO: 1739553 - RNA, 19 nt, Human
agcucagggccuggcucag

SEQ ID NO: 1739554 - RNA, 14 nt, Human
agcucagggccugg

SEQ ID NO: 1739555 - RNA, 20 nt, Human
agcucagggccuggcucagg

SEQ ID NO: 1739556 - RNA, 13 nt, Human
agcgugagccacu

SEQ ID NO: 1739557 - RNA, 21 nt, Human
agcuaggccuggccagaugca

SEQ ID NO: 1739558 - RNA, 17 nt, Human
agcuaucguaaaauuaa

SEQ ID NO: 1739559 - RNA, 21 nt, Human
agcuccaucuccacuccagau

SEQ ID NO: 1739560 - RNA, 19 nt, Human
agcuccagcucaccagccc

SEQ ID NO: 1739561 - RNA, 18 nt, Human
agcuccagcucaccagcc

SEQ ID NO: 1739562 - RNA, 21 nt, Human
agcuccagcucaccagcccca

SEQ ID NO: 1739563 - RNA, 23 nt, Human
agcuccuucuguccuacucugug

SEQ ID NO: 1739564 - RNA, 22 nt, Human
agcuccuucuguccuacucugu

SEQ ID NO: 1739565 - RNA, 23 nt, Human
agcucugcccauccugccccuga

SEQ ID NO: 1739566 - RNA, 21 nt, Human
agcucugcagagcaggaaaca

SEQ ID NO: 1739567 - RNA, 20 nt, Human
ugcccuaaugcgcaggcugg

SEQ ID NO: 1739568 - RNA, 23 nt, Human
ugcccuaaugcgcaggcuggccc

SEQ ID NO: 1739569 - RNA, 19 nt, Human
agcuccaagcucccaggca

SEQ ID NO: 1739570 - RNA, 18 nt, Human
agcuccaagcucccaggc

SEQ ID NO: 1739571 - RNA, 17 nt, Human
agcuccaagcucccagg

SEQ ID NO: 1739572 - RNA, 14 nt, Human
ugcccugcccaccu

SEQ ID NO: 1739573 - RNA, 17 nt, Human
agcuccagcucaccagc

SEQ ID NO: 1739574 - RNA, 13 nt, Human
agcuccagcucac

SEQ ID NO: 1739575 - RNA, 15 nt, Human
ugccucagccucccg

SEQ ID NO: 1739576 - RNA, 15 nt, Human
ugccucagccuccug

SEQ ID NO: 1739577 - RNA, 17 nt, Human
ugccucagccuccugag

SEQ ID NO: 1739578 - RNA, 22 nt, Human
ugccucccaucacccgcuaaga

SEQ ID NO: 1739579 - RNA, 17 nt, Human
ugccucucucaggccaa

SEQ ID NO: 1739580 - RNA, 12 nt, Human
ugccucucugca

SEQ ID NO: 1739581 - RNA, 11 nt, Human
ugccucucugc

SEQ ID NO: 1739582 - RNA, 15 nt, Human
ugccucaccccuugc

SEQ ID NO: 1739583 - RNA, 20 nt, Human
ugccgcagcccugcagaggg

SEQ ID NO: 1739584 - RNA, 22 nt, Human
ugcccuuaccugccaggaagcc

SEQ ID NO: 1739585 - RNA, 18 nt, Human
ugcccugugggcccccaa

SEQ ID NO: 1739586 - RNA, 15 nt, Human
ugcccugugggcccc

SEQ ID NO: 1739587 - RNA, 17 nt, Human
agcucuucuccaggcug

SEQ ID NO: 1739588 - RNA, 16 nt, Human
agcucuucuccaggcu

SEQ ID NO: 1739589 - RNA, 15 nt, Human
agcucuucuccaggc

SEQ ID NO: 1739590 - RNA, 13 nt, Human
agcugccuguuca

SEQ ID NO: 1739591 - RNA, 24 nt, Human
agcugcuuuugucuaugggacuca

SEQ ID NO: 1739592 - RNA, 23 nt, Human
agcugcuuuugucuaugggacuc

SEQ ID NO: 1739593 - RNA, 19 nt, Human
ugccugcccaggccccugc

SEQ ID NO: 1739594 - RNA, 18 nt, Human
ugccugcccaggccccug

SEQ ID NO: 1739595 - RNA, 17 nt, Human
ugccugcccaggccccu

SEQ ID NO: 1739596 - RNA, 12 nt, Human
ugccucugccuc

SEQ ID NO: 1739597 - RNA, 20 nt, Human
ugccugcccaggccccugcc

SEQ ID NO: 1739598 - RNA, 11 nt, Human
ugccucugccu

SEQ ID NO: 1739599 - RNA, 16 nt, Human
ugccucugacacacag

SEQ ID NO: 1739600 - RNA, 14 nt, Human
ugccucugacacac

SEQ ID NO: 1739601 - RNA, 23 nt, Human
ugccucucugcaggucccuaaua

SEQ ID NO: 1739602 - RNA, 15 nt, Human
ugccucucugcaggu

SEQ ID NO: 1739603 - RNA, 21 nt, Human
ugcaaaccaucauugaaaucu

SEQ ID NO: 1739604 - RNA, 22 nt, Human
agccccauucugccugcccagg

SEQ ID NO: 1739605 - RNA, 21 nt, Human
agccccauucugccugcccag

SEQ ID NO: 1739606 - RNA, 18 nt, Human
agccccaaaacucuccuc

SEQ ID NO: 1739607 - RNA, 17 nt, Human
agccccaaaacucuccu

SEQ ID NO: 1739608 - RNA, 16 nt, Human
agccccaaaacucucc

SEQ ID NO: 1739609 - RNA, 23 nt, Human
agccccauucugccugcccaggc

SEQ ID NO: 1739610 - RNA, 16 nt, Human
agcccugguggcagug

SEQ ID NO: 1739611 - RNA, 15 nt, Human
agcccugguggcagu

SEQ ID NO: 1739612 - RNA, 14 nt, Human
agcccugguggcag

SEQ ID NO: 1739613 - RNA, 18 nt, Human
ugcacacaccagagccca

SEQ ID NO: 1739614 - RNA, 17 nt, Human
ugcacacaccagagccc

SEQ ID NO: 1739615 - RNA, 21 nt, Human
ugcacacaccagagcccaccu

SEQ ID NO: 1739616 - RNA, 22 nt, Human
ugcacacaccagagcccaccuu

SEQ ID NO: 1739617 - RNA, 17 nt, Human
agcccugcuuugggcug

SEQ ID NO: 1739618 - RNA, 20 nt, Human
agcccugcuuugggcugccc

SEQ ID NO: 1739619 - RNA, 19 nt, Human
agcccugcuuugggcugcc

SEQ ID NO: 1739620 - RNA, 14 nt, Human
ugcagaagacagua

SEQ ID NO: 1739621 - RNA, 15 nt, Human
ugcagaagacaguau

SEQ ID NO: 1739622 - RNA, 22 nt, Human
ugcagacaggcaagcaccuccu

SEQ ID NO: 1739623 - RNA, 11 nt, Human
ugcacacauuu

SEQ ID NO: 1739624 - RNA, 12 nt, Human
ugcacacauuuu

SEQ ID NO: 1739625 - RNA, 13 nt, Human
ugcacacauuuuu

SEQ ID NO: 1739626 - RNA, 15 nt, Human
ugcacacauuuuuua

SEQ ID NO: 1739627 - RNA, 17 nt, Human
ugcacuccccugcuggg

SEQ ID NO: 1739628 - RNA, 16 nt, Human
ugcacuccccugcugg

SEQ ID NO: 1739629 - RNA, 19 nt, Human
ugcacuccccugcugggug

SEQ ID NO: 1739630 - RNA, 17 nt, Human
agccgagaucacgccac

SEQ ID NO: 1739631 - RNA, 21 nt, Human
agccgagauagccaaggccaa

SEQ ID NO: 1739632 - RNA, 20 nt, Human
agccgagauagccaaggcca

SEQ ID NO: 1739633 - RNA, 21 nt, Human
agcccuuagcagggaaacagc

SEQ ID NO: 1739634 - RNA, 16 nt, Human
agcccuuagcagggaa

SEQ ID NO: 1739635 - RNA, 17 nt, Human
ugcagacucuacagagg

SEQ ID NO: 1739636 - RNA, 16 nt, Human
ugcagacucuacagag

SEQ ID NO: 1739637 - RNA, 18 nt, Human
ugcagacucuacagaggc

SEQ ID NO: 1739638 - RNA, 23 nt, Human
agccucugaaaaccaauguucuc

SEQ ID NO: 1739639 - RNA, 21 nt, Human
agccuccaagcuccaucucca

SEQ ID NO: 1739640 - RNA, 14 nt, Human
agccuccaauuuuu

SEQ ID NO: 1739641 - RNA, 17 nt, Human
agccuccaugcugccuc

SEQ ID NO: 1739642 - RNA, 23 nt, Human
ugcagccucaaccuccugggcua

SEQ ID NO: 1739643 - RNA, 22 nt, Human
ugcagccucaaccuccugggcu

SEQ ID NO: 1739644 - RNA, 21 nt, Human
ugcagccucaaccuccugggc

SEQ ID NO: 1739645 - RNA, 18 nt, Human
agccgagaucacgccacu

SEQ ID NO: 1739646 - RNA, 20 nt, Human
agccucaaccuccugggcua

SEQ ID NO: 1739647 - RNA, 18 nt, Human
agccucacaguccuuacc

SEQ ID NO: 1739648 - RNA, 17 nt, Human
agccucacaguccuuac

SEQ ID NO: 1739649 - RNA, 22 nt, Human
agccucagucucccucccuugg

SEQ ID NO: 1739650 - RNA, 20 nt, Human
agccucagucucccucccuu

SEQ ID NO: 1739651 - RNA, 19 nt, Human
agccucagucucccucccu

SEQ ID NO: 1739652 - RNA, 16 nt, Human
agccucagucucccuc

SEQ ID NO: 1739653 - RNA, 13 nt, Human
agccucagucucc

SEQ ID NO: 1739654 - RNA, 22 nt, Human
ugauuuccguuaaaauaccagc

SEQ ID NO: 1739655 - RNA, 17 nt, Human
ugauuucagcucacugc

SEQ ID NO: 1739656 - RNA, 21 nt, Human
ugauuucagcaccuacagugu

SEQ ID NO: 1739657 - RNA, 17 nt, Human
ugauuuggggauauuuu

SEQ ID NO: 1739658 - RNA, 16 nt, Human
ugauucauaaugacuu

SEQ ID NO: 1739659 - RNA, 18 nt, Human
agcccaggaaaggcucca

SEQ ID NO: 1739660 - RNA, 21 nt, Human
ugauucauaaugacuuaagca

SEQ ID NO: 1739661 - RNA, 14 nt, Human
agcccaggaaaggc

SEQ ID NO: 1739662 - RNA, 23 nt, Human
agcccagcuugaaaccuucacuu

SEQ ID NO: 1739663 - RNA, 13 nt, Human
ugauucuccugcc

SEQ ID NO: 1739664 - RNA, 16 nt, Human
ugauucucaugccuca

SEQ ID NO: 1739665 - RNA, 15 nt, Human
ugauucucaugccuc

SEQ ID NO: 1739666 - RNA, 14 nt, Human
ugauucucaugccu

SEQ ID NO: 1739667 - RNA, 13 nt, Human
ugauucucaugcc

SEQ ID NO: 1739668 - RNA, 23 nt, Human
ugauucccaagcucugcuccucu

SEQ ID NO: 1739669 - RNA, 22 nt, Human
ugauucccaagcucugcuccuc

SEQ ID NO: 1739670 - RNA, 13 nt, Human
agccaguaaaugg

SEQ ID NO: 1739671 - RNA, 18 nt, Human
agccagguuccacagagg

SEQ ID NO: 1739672 - RNA, 22 nt, Human
agccaguaaaugggggugcauu

SEQ ID NO: 1739673 - RNA, 21 nt, Human
agccaguaaaugggggugcau

SEQ ID NO: 1739674 - RNA, 22 nt, Human
agcccacuucugccauauucug

SEQ ID NO: 1739675 - RNA, 15 nt, Human
agcccacuucugcca

SEQ ID NO: 1739676 - RNA, 14 nt, Human
agcccacuucugcc

SEQ ID NO: 1739677 - RNA, 13 nt, Human
agcccacuucugc

SEQ ID NO: 1739678 - RNA, 16 nt, Human
agcccacuguacuugc

SEQ ID NO: 1739679 - RNA, 14 nt, Human
agcccacuguacuu

SEQ ID NO: 1739680 - RNA, 21 nt, Human
ugauccucccaccucagccuc

SEQ ID NO: 1739681 - RNA, 16 nt, Human
ugauccucccaccuca

SEQ ID NO: 1739682 - RNA, 22 nt, Human
ugauccucccaccucagccucc

SEQ ID NO: 1739683 - RNA, 22 nt, Human
ugauccuaaugaaugcauaaaa

SEQ ID NO: 1739684 - RNA, 15 nt, Human
ugauccucccaccuc

SEQ ID NO: 1739685 - RNA, 16 nt, Human
ugauccuaguuccacc

SEQ ID NO: 1739686 - RNA, 21 nt, Human
ugaugggcaacccccagccug

SEQ ID NO: 1739687 - RNA, 14 nt, Human
ugaugggauuuggu

SEQ ID NO: 1739688 - RNA, 19 nt, Human
ugauggggcccugccuccu

SEQ ID NO: 1739689 - RNA, 16 nt, Human
ugauggggcccugccu

SEQ ID NO: 1739690 - RNA, 15 nt, Human
ugauggggcccugcc

SEQ ID NO: 1739691 - RNA, 14 nt, Human
ugauggggcccugc

SEQ ID NO: 1739692 - RNA, 16 nt, Human
ugaugagaggaaauca

SEQ ID NO: 1739693 - RNA, 15 nt, Human
ugaugagaggaaauc

SEQ ID NO: 1739694 - RNA, 14 nt, Human
ugaugagaggaaau

SEQ ID NO: 1739695 - RNA, 13 nt, Human
ugaugagaggaaa

SEQ ID NO: 1739696 - RNA, 20 nt, Human
ugauuaaccacuucagcuga

SEQ ID NO: 1739697 - RNA, 15 nt, Human
agccacgguguucug

SEQ ID NO: 1739698 - RNA, 17 nt, Human
ugauuaauggaaauguu

SEQ ID NO: 1739699 - RNA, 16 nt, Human
agccacugcaccgggc

SEQ ID NO: 1739700 - RNA, 19 nt, Human
ugauuaaccacuucagcug

SEQ ID NO: 1739701 - RNA, 20 nt, Human
ugauuaaauucuugcaaagu

SEQ ID NO: 1739702 - RNA, 17 nt, Human
ugauggugaugaaaugu

SEQ ID NO: 1739703 - RNA, 13 nt, Human
ugauggugcaaug

SEQ ID NO: 1739704 - RNA, 16 nt, Human
ugauggugaugaaaug

SEQ ID NO: 1739705 - RNA, 15 nt, Human
ugauggugaugaaau

SEQ ID NO: 1739706 - RNA, 15 nt, Human
ugauggugcaaugac

SEQ ID NO: 1739707 - RNA, 19 nt, Human
ugauuaaauucuugcaaag

SEQ ID NO: 1739708 - RNA, 11 nt, Human
agccagaggag

SEQ ID NO: 1739709 - RNA, 10 nt, Human
agccagagga

SEQ ID NO: 1739710 - RNA, 19 nt, Human
agccacugcaccgggccac

SEQ ID NO: 1739711 - RNA, 18 nt, Human
agccacugcaccgggcca

SEQ ID NO: 1739712 - RNA, 20 nt, Human
agccacugcaccgggccaca

SEQ ID NO: 1739713 - RNA, 14 nt, Human
agccagcaucggaa

SEQ ID NO: 1739714 - RNA, 22 nt, Human
aguugcauagguuuaauaauuu

SEQ ID NO: 1739715 - RNA, 20 nt, Human
aguugccagucaccccggcc

SEQ ID NO: 1739716 - RNA, 20 nt, Human
uuaaaaaugguuuaaauggu

SEQ ID NO: 1739717 - RNA, 17 nt, Human
uuaaaacaacacucaca

SEQ ID NO: 1739718 - RNA, 18 nt, Human
uuaaaaaguggaaaaaua

SEQ ID NO: 1739719 - RNA, 17 nt, Human
uuaaaccgccaaggcug

SEQ ID NO: 1739720 - RNA, 19 nt, Human
uuaaaauauuccugcauuu

SEQ ID NO: 1739721 - RNA, 16 nt, Human
uuaaaauauuccugca

SEQ ID NO: 1739722 - RNA, 12 nt, Human
uuaaaauauaau

SEQ ID NO: 1739723 - RNA, 15 nt, Human
uuaaauaaaucauaa

SEQ ID NO: 1739724 - RNA, 13 nt, Human
uuaaauaaaucau

SEQ ID NO: 1739725 - RNA, 20 nt, Human
uuaaauaaugugaaacugga

SEQ ID NO: 1739726 - RNA, 21 nt, Human
uuaaauaaugugaaacuggau

SEQ ID NO: 1739727 - RNA, 22 nt, Human
uuaaauaaugugaaacuggauu

SEQ ID NO: 1739728 - RNA, 22 nt, Human
aguuuucacucuuauugcccac

SEQ ID NO: 1739729 - RNA, 13 nt, Human
uuaaauucuugca

SEQ ID NO: 1739730 - RNA, 16 nt, Human
uuaaauucuugcaaag

SEQ ID NO: 1739731 - RNA, 15 nt, Human
aguuucuccaagcag

SEQ ID NO: 1739732 - RNA, 13 nt, Human
aguuucuccaagc

SEQ ID NO: 1739733 - RNA, 21 nt, Human
aguuucuccaagcaggacaug

SEQ ID NO: 1739734 - RNA, 16 nt, Human
aguuucucagcuccca

SEQ ID NO: 1739735 - RNA, 16 nt, Human
aguuucguuuucaaaa

SEQ ID NO: 1739736 - RNA, 15 nt, Human
aguuucguuuucaaa

SEQ ID NO: 1739737 - RNA, 14 nt, Human
uguugucagcugaa

SEQ ID NO: 1739738 - RNA, 16 nt, Human
uguuugccucugccuc

SEQ ID NO: 1739739 - RNA, 14 nt, Human
uguuugccucugcc

SEQ ID NO: 1739740 - RNA, 15 nt, Human
uguuugcaucugaaa

SEQ ID NO: 1739741 - RNA, 15 nt, Human
uguuuggggaugaga

SEQ ID NO: 1739742 - RNA, 19 nt, Human
uguuuggggaugagaaagg

SEQ ID NO: 1739743 - RNA, 13 nt, Human
aguucucuccuuc

SEQ ID NO: 1739744 - RNA, 16 nt, Human
aguucucuccuucuuc

SEQ ID NO: 1739745 - RNA, 15 nt, Human
uguuuucucuugaga

SEQ ID NO: 1739746 - RNA, 17 nt, Human
uguuuucaguguacaug

SEQ ID NO: 1739747 - RNA, 15 nt, Human
uguuuucaguguaca

SEQ ID NO: 1739748 - RNA, 23 nt, Human
aguugauagcacagacccugccc

SEQ ID NO: 1739749 - RNA, 22 nt, Human
aguugauagcacagacccugcc

SEQ ID NO: 1739750 - RNA, 13 nt, Human
aguugauucagcu

SEQ ID NO: 1739751 - RNA, 18 nt, Human
aguugauucagcucugca

SEQ ID NO: 1739752 - RNA, 17 nt, Human
aguugauucagcucugc

SEQ ID NO: 1739753 - RNA, 15 nt, Human
aguugauucagcucu

SEQ ID NO: 1739754 - RNA, 14 nt, Human
aguugauucagcuc

SEQ ID NO: 1739755 - RNA, 23 nt, Human
aguugauucagcucugcaagaau

SEQ ID NO: 1739756 - RNA, 19 nt, Human
aguugcaacuuuguauaaa

SEQ ID NO: 1739757 - RNA, 21 nt, Human
aguugauagcacagacccugc

SEQ ID NO: 1739758 - RNA, 20 nt, Human
aguugauagcacagacccug

SEQ ID NO: 1739759 - RNA, 19 nt, Human
aguugauagcacagacccu

SEQ ID NO: 1739760 - RNA, 15 nt, Human
aguugauagcacaga

SEQ ID NO: 1739761 - RNA, 23 nt, Human
aguguacauggaauaacauguaa

SEQ ID NO: 1739762 - RNA, 17 nt, Human
aguguacagucuuguau

SEQ ID NO: 1739763 - RNA, 16 nt, Human
uguucccauucuugca

SEQ ID NO: 1739764 - RNA, 13 nt, Human
uguucugggacac

SEQ ID NO: 1739765 - RNA, 15 nt, Human
uguucugggacacag

SEQ ID NO: 1739766 - RNA, 14 nt, Human
uguucugggacaca

SEQ ID NO: 1739767 - RNA, 14 nt, Human
uguucuuaauucuu

SEQ ID NO: 1739768 - RNA, 16 nt, Human
uguucuuaauucuuag

SEQ ID NO: 1739769 - RNA, 19 nt, Human
uguucuugguuuguaaauu

SEQ ID NO: 1739770 - RNA, 13 nt, Human
uguucuuuccaaa

SEQ ID NO: 1739771 - RNA, 14 nt, Human
uguucuuuccaaag

SEQ ID NO: 1739772 - RNA, 17 nt, Human
uguucuugguuuguaaa

SEQ ID NO: 1739773 - RNA, 18 nt, Human
uguucuugguuuguaaau

SEQ ID NO: 1739774 - RNA, 16 nt, Human
uguucuuaagacguga

SEQ ID NO: 1739775 - RNA, 22 nt, Human
aguguacauggaauaacaugua

SEQ ID NO: 1739776 - RNA, 21 nt, Human
aguguacauggaauaacaugu

SEQ ID NO: 1739777 - RNA, 13 nt, Human
aguguacagucuu

SEQ ID NO: 1739778 - RNA, 15 nt, Human
aguguacagucuugu

SEQ ID NO: 1739779 - RNA, 16 nt, Human
aguguacagucuugua

SEQ ID NO: 1739780 - RNA, 19 nt, Human
agugggugaauaauacagu

SEQ ID NO: 1739781 - RNA, 21 nt, Human
agugguuccuaauccucuagg

SEQ ID NO: 1739782 - RNA, 16 nt, Human
aguggugcgaucuggg

SEQ ID NO: 1739783 - RNA, 13 nt, Human
aguggcagcugcu

SEQ ID NO: 1739784 - RNA, 12 nt, Human
aguggcagcugc

SEQ ID NO: 1739785 - RNA, 20 nt, Human
aguggcagcugcuuuugucu

SEQ ID NO: 1739786 - RNA, 14 nt, Human
aguggcagcugcuu

SEQ ID NO: 1739787 - RNA, 18 nt, Human
agugggugaauaauacag

SEQ ID NO: 1739788 - RNA, 13 nt, Human
agugggugaauaa

SEQ ID NO: 1739789 - RNA, 18 nt, Human
agugggggaucacagccu

SEQ ID NO: 1739790 - RNA, 20 nt, Human
agugggggaguggccacaga

SEQ ID NO: 1739791 - RNA, 19 nt, Human
agugggggaguggccacag

SEQ ID NO: 1739792 - RNA, 20 nt, Human
aguuauuauauuuacaaaug

SEQ ID NO: 1739793 - RNA, 18 nt, Human
uguucuuuccaaaguaca

SEQ ID NO: 1739794 - RNA, 20 nt, Human
uguucuuuccaaaguacacu

SEQ ID NO: 1739795 - RNA, 15 nt, Human
aguuaccagugccuu

SEQ ID NO: 1739796 - RNA, 16 nt, Human
aguuaccagugccuua

SEQ ID NO: 1739797 - RNA, 15 nt, Human
aguuaguuccacuga

SEQ ID NO: 1739798 - RNA, 17 nt, Human
aguuaguuccacugaga

SEQ ID NO: 1739799 - RNA, 19 nt, Human
aguuaguuccacugagacc

SEQ ID NO: 1739800 - RNA, 17 nt, Human
aguucccuacuuccugu

SEQ ID NO: 1739801 - RNA, 21 nt, Human
aguuauuuuuauuuauuuaaa

SEQ ID NO: 1739802 - RNA, 14 nt, Human
uguuguauucauug

SEQ ID NO: 1739803 - RNA, 13 nt, Human
uguugucagcuga

SEQ ID NO: 1739804 - RNA, 11 nt, Human
uguugucaaga

SEQ ID NO: 1739805 - RNA, 16 nt, Human
uguugucaagaauagc

SEQ ID NO: 1739806 - RNA, 20 nt, Human
uguugucaagaauagcauug

SEQ ID NO: 1739807 - RNA, 16 nt, Human
uguugggccaggagcc

SEQ ID NO: 1739808 - RNA, 13 nt, Human
uguugggccagga

SEQ ID NO: 1739809 - RNA, 22 nt, Human
uuaucaugugaaaucauucauu

SEQ ID NO: 1739810 - RNA, 20 nt, Human
uuaucaugugaaaucauuca

SEQ ID NO: 1739811 - RNA, 18 nt, Human
uuaucaugugaaaucauu

SEQ ID NO: 1739812 - RNA, 17 nt, Human
uuaucaugugaaaucau

SEQ ID NO: 1739813 - RNA, 19 nt, Human
auaccagccaguaaauggg

SEQ ID NO: 1739814 - RNA, 21 nt, Human
auacuaaccagcagaaaugcc

SEQ ID NO: 1739815 - RNA, 13 nt, Human
auacuacaguuug

SEQ ID NO: 1739816 - RNA, 15 nt, Human
auacuacaguuuguu

SEQ ID NO: 1739817 - RNA, 16 nt, Human
auacuacaguuuguua

SEQ ID NO: 1739818 - RNA, 20 nt, Human
auacuacaguuuguuaguau

SEQ ID NO: 1739819 - RNA, 21 nt, Human
auacaguucggugagcuacaa

SEQ ID NO: 1739820 - RNA, 22 nt, Human
auacaggaaaagcugcugacag

SEQ ID NO: 1739821 - RNA, 20 nt, Human
auacaggaaaagcugcugac

SEQ ID NO: 1739822 - RNA, 19 nt, Human
auacaggaaaagcugcuga

SEQ ID NO: 1739823 - RNA, 14 nt, Human
auacaggaaaagcu

SEQ ID NO: 1739824 - RNA, 16 nt, Human
auacauuugauaaagu

SEQ ID NO: 1739825 - RNA, 16 nt, Human
auacauuuaaaacauu

SEQ ID NO: 1739826 - RNA, 21 nt, Human
auacauuuaaaacauuaaaau

SEQ ID NO: 1739827 - RNA, 20 nt, Human
auacauaaacaagaccacgu

SEQ ID NO: 1739828 - RNA, 14 nt, Human
uuagccccauaauu

SEQ ID NO: 1739829 - RNA, 16 nt, Human
uuagcaguuugcuuug

SEQ ID NO: 1739830 - RNA, 18 nt, Human
uuauacccccugcaaagc

SEQ ID NO: 1739831 - RNA, 12 nt, Human
auaauuuuguaa

SEQ ID NO: 1739832 - RNA, 13 nt, Human
auaauuuuguaau

SEQ ID NO: 1739833 - RNA, 23 nt, Human
auaauuuuguaauguaucaaaua

SEQ ID NO: 1739834 - RNA, 22 nt, Human
auacaaaaaaaaaaaaaaauua

SEQ ID NO: 1739835 - RNA, 12 nt, Human
auacaaaagcau

SEQ ID NO: 1739836 - RNA, 13 nt, Human
auacaaaagcaug

SEQ ID NO: 1739837 - RNA, 15 nt, Human
auacaaaagcaugug

SEQ ID NO: 1739838 - RNA, 13 nt, Human
auaaacuuuaccu

SEQ ID NO: 1739839 - RNA, 15 nt, Human
auaaacuuuaccuuu

SEQ ID NO: 1739840 - RNA, 16 nt, Human
auaaacuuuaccuuuu

SEQ ID NO: 1739841 - RNA, 23 nt, Human
auaaacacucuugaaaaaugcau

SEQ ID NO: 1739842 - RNA, 20 nt, Human
auaaccaguguuguggauuu

SEQ ID NO: 1739843 - RNA, 20 nt, Human
auaaccaaagcccaaagugg

SEQ ID NO: 1739844 - RNA, 19 nt, Human
auaacaugugaaaagaaua

SEQ ID NO: 1739845 - RNA, 19 nt, Human
auaaauaaaguuuguugaa

SEQ ID NO: 1739846 - RNA, 13 nt, Human
auaaauaaaguuu

SEQ ID NO: 1739847 - RNA, 12 nt, Human
auaaauaacuuu

SEQ ID NO: 1739848 - RNA, 16 nt, Human
uuacaggaaguacugg

SEQ ID NO: 1739849 - RNA, 15 nt, Human
uuacaggaaguacug

SEQ ID NO: 1739850 - RNA, 22 nt, Human
uuacaggaaguacuggagaaaa

SEQ ID NO: 1739851 - RNA, 18 nt, Human
uuacaggaaguacuggag

SEQ ID NO: 1739852 - RNA, 23 nt, Human
uuaccauuuugggguacccacug

SEQ ID NO: 1739853 - RNA, 14 nt, Human
auaaugaauacuuu

SEQ ID NO: 1739854 - RNA, 14 nt, Human
auaauucuacuuug

SEQ ID NO: 1739855 - RNA, 19 nt, Human
auaauacaguaucucaggg

SEQ ID NO: 1739856 - RNA, 16 nt, Human
uuagauguaauuuugu

SEQ ID NO: 1739857 - RNA, 23 nt, Human
auaauacaccacuacauucuguu

SEQ ID NO: 1739858 - RNA, 21 nt, Human
auaauacaccacuacauucug

SEQ ID NO: 1739859 - RNA, 22 nt, Human
auaaguuaacuuccaauuuaca

SEQ ID NO: 1739860 - RNA, 22 nt, Human
auaagaaccuuuugagugccuu

SEQ ID NO: 1739861 - RNA, 17 nt, Human
auaaguuaacuuccaau

SEQ ID NO: 1739862 - RNA, 23 nt, Human
auaagaaccuuuugagugccuua

SEQ ID NO: 1739863 - RNA, 23 nt, Human
uggguggaugccugguggcagcu

SEQ ID NO: 1739864 - RNA, 14 nt, Human
uggguggaugccug

SEQ ID NO: 1739865 - RNA, 22 nt, Human
ugggucuuguuuuuuuuuucca

SEQ ID NO: 1739866 - RNA, 21 nt, Human
uggucaccaaaucagcugcua

SEQ ID NO: 1739867 - RNA, 23 nt, Human
uggucaccaaaucagcugcuacu

SEQ ID NO: 1739868 - RNA, 22 nt, Human
ugguaauuuaagauuccagaga

SEQ ID NO: 1739869 - RNA, 16 nt, Human
ugguccauagagagca

SEQ ID NO: 1739870 - RNA, 15 nt, Human
ugguccauagagagc

SEQ ID NO: 1739871 - RNA, 19 nt, Human
aggguacuaaggaaucuuu

SEQ ID NO: 1739872 - RNA, 16 nt, Human
aggguaucaggugcug

SEQ ID NO: 1739873 - RNA, 12 nt, Human
aggguagggugg

SEQ ID NO: 1739874 - RNA, 18 nt, Human
aggguaucaggugcugcc

SEQ ID NO: 1739875 - RNA, 12 nt, Human
aggguaaguauu

SEQ ID NO: 1739876 - RNA, 16 nt, Human
aggggauagagagaga

SEQ ID NO: 1739877 - RNA, 13 nt, Human
agggggcugggac

SEQ ID NO: 1739878 - RNA, 15 nt, Human
agggggaaggcaggg

SEQ ID NO: 1739879 - RNA, 15 nt, Human
aggucagugcaaaua

SEQ ID NO: 1739880 - RNA, 21 nt, Human
aggucaaggcugcagugagcc

SEQ ID NO: 1739881 - RNA, 22 nt, Human
aggucauuuuuuuuaagaaaaa

SEQ ID NO: 1739882 - RNA, 23 nt, Human
aggucauuuuuuuuaagaaaaag

SEQ ID NO: 1739883 - RNA, 17 nt, Human
agguccacaacacacag

SEQ ID NO: 1739884 - RNA, 21 nt, Human
aggucuugaacuccuggccuc

SEQ ID NO: 1739885 - RNA, 20 nt, Human
aggucuugaacuccuggccu

SEQ ID NO: 1739886 - RNA, 22 nt, Human
aggucuugaacuccuggccuca

SEQ ID NO: 1739887 - RNA, 19 nt, Human
aggugaaacuccagaugcc

SEQ ID NO: 1739888 - RNA, 20 nt, Human
aggugaaacuccagaugcca

SEQ ID NO: 1739889 - RNA, 21 nt, Human
aggugaaacuccagaugccac

SEQ ID NO: 1739890 - RNA, 22 nt, Human
aggugaaacuccagaugccaca

SEQ ID NO: 1739891 - RNA, 17 nt, Human
agguaugcaaucaaauc

SEQ ID NO: 1739892 - RNA, 20 nt, Human
aggguuuauguuuaggaugu

SEQ ID NO: 1739893 - RNA, 17 nt, Human
aggguugggcugguguc

SEQ ID NO: 1739894 - RNA, 14 nt, Human
uggucuuuugguua

SEQ ID NO: 1739895 - RNA, 19 nt, Human
uggugaacagaacaaaagg

SEQ ID NO: 1739896 - RNA, 15 nt, Human
uggugaacauugcaa

SEQ ID NO: 1739897 - RNA, 20 nt, Human
uggugaacauugcaauagaa

SEQ ID NO: 1739898 - RNA, 21 nt, Human
aggguggugaccucugccuga

SEQ ID NO: 1739899 - RNA, 19 nt, Human
aggguggugaccucugccu

SEQ ID NO: 1739900 - RNA, 18 nt, Human
aggguggugaccucugcc

SEQ ID NO: 1739901 - RNA, 17 nt, Human
aggguggugaccucugc

SEQ ID NO: 1739902 - RNA, 15 nt, Human
aggguugggcuggug

SEQ ID NO: 1739903 - RNA, 17 nt, Human
aggguuggccccugccc

SEQ ID NO: 1739904 - RNA, 14 nt, Human
aggguuggccccug

SEQ ID NO: 1739905 - RNA, 13 nt, Human
aggguuggccccu

SEQ ID NO: 1739906 - RNA, 22 nt, Human
ugguccaugggccauaugaaaa

SEQ ID NO: 1739907 - RNA, 19 nt, Human
ugguccauagagagcaaga

SEQ ID NO: 1739908 - RNA, 13 nt, Human
uggucccacccca

SEQ ID NO: 1739909 - RNA, 19 nt, Human
uggucucgaacuccugacc

SEQ ID NO: 1739910 - RNA, 15 nt, Human
uggucucgaacuccu

SEQ ID NO: 1739911 - RNA, 21 nt, Human
uggucucgaacuccugaccuu

SEQ ID NO: 1739912 - RNA, 20 nt, Human
uggucucgaacuccugaccu

SEQ ID NO: 1739913 - RNA, 22 nt, Human
uggucugugagaugcuagaacu

SEQ ID NO: 1739914 - RNA, 12 nt, Human
uggucuguguga

SEQ ID NO: 1739915 - RNA, 16 nt, Human
uggucuuauuuguaaa

SEQ ID NO: 1739916 - RNA, 18 nt, Human
uggucugacccacugcuu

SEQ ID NO: 1739917 - RNA, 16 nt, Human
uguaaaggaauuuaaa

SEQ ID NO: 1739918 - RNA, 13 nt, Human
ugguuuucuguuc

SEQ ID NO: 1739919 - RNA, 15 nt, Human
ugguuuucuguucuu

SEQ ID NO: 1739920 - RNA, 23 nt, Human
aggugauccacccaccucagccu

SEQ ID NO: 1739921 - RNA, 14 nt, Human
ugguuucagaaaug

SEQ ID NO: 1739922 - RNA, 15 nt, Human
ugguuucagaaaugu

SEQ ID NO: 1739923 - RNA, 21 nt, Human
ugguuuguaaauuaacuuuua

SEQ ID NO: 1739924 - RNA, 12 nt, Human
ugguuuucuguu

SEQ ID NO: 1739925 - RNA, 18 nt, Human
ugguuuuaguugcaacuu

SEQ ID NO: 1739926 - RNA, 17 nt, Human
ugguguuuccuggcacu

SEQ ID NO: 1739927 - RNA, 15 nt, Human
ugguguuuccuggca

SEQ ID NO: 1739928 - RNA, 23 nt, Human
ugguucaggguuggccccugccc

SEQ ID NO: 1739929 - RNA, 22 nt, Human
ugguucaggguuggccccugcc

SEQ ID NO: 1739930 - RNA, 20 nt, Human
ugguucaggguuggccccug

SEQ ID NO: 1739931 - RNA, 12 nt, Human
ugguggcagcug

SEQ ID NO: 1739932 - RNA, 15 nt, Human
ugguguguguaugcg

SEQ ID NO: 1739933 - RNA, 23 nt, Human
ugguggcagcucaccucucccuu

SEQ ID NO: 1739934 - RNA, 20 nt, Human
ugguggcagcucaccucucc

SEQ ID NO: 1739935 - RNA, 19 nt, Human
ugguggcagcucaccucuc

SEQ ID NO: 1739936 - RNA, 16 nt, Human
ugguggcagcucaccu

SEQ ID NO: 1739937 - RNA, 12 nt, Human
ugguggcagcuc

SEQ ID NO: 1739938 - RNA, 15 nt, Human
ugguggcagagugga

SEQ ID NO: 1739939 - RNA, 14 nt, Human
aggugaacauuggu

SEQ ID NO: 1739940 - RNA, 21 nt, Human
aggugaacauugguucuuuca

SEQ ID NO: 1739941 - RNA, 19 nt, Human
uguacuugcucuugaugcc

SEQ ID NO: 1739942 - RNA, 15 nt, Human
uguacuugcucuuga

SEQ ID NO: 1739943 - RNA, 17 nt, Human
uguacaugaaaacacau

SEQ ID NO: 1739944 - RNA, 18 nt, Human
uguacaugaaaacacauu

SEQ ID NO: 1739945 - RNA, 19 nt, Human
uguacaugaaaacacauuu

SEQ ID NO: 1739946 - RNA, 20 nt, Human
uguacaugaaaacacauuuu

SEQ ID NO: 1739947 - RNA, 23 nt, Human
uguacaaaguagaagucuuagau

SEQ ID NO: 1739948 - RNA, 19 nt, Human
uguacaaaguagaagucuu

SEQ ID NO: 1739949 - RNA, 17 nt, Human
uguaauuugugauacaa

SEQ ID NO: 1739950 - RNA, 21 nt, Human
uguaauuugugauacaaugcu

SEQ ID NO: 1739951 - RNA, 18 nt, Human
uguaaggaaugauuaauu

SEQ ID NO: 1739952 - RNA, 16 nt, Human
uguaauuugugauaca

SEQ ID NO: 1739953 - RNA, 15 nt, Human
uguaaggcaaucaug

SEQ ID NO: 1739954 - RNA, 22 nt, Human
uguaagcucuacugaggugcua

SEQ ID NO: 1739955 - RNA, 15 nt, Human
uguaagaaauacaga

SEQ ID NO: 1739956 - RNA, 17 nt, Human
uguaagaaauacagacu

SEQ ID NO: 1739957 - RNA, 15 nt, Human
uguaaggaaugauua

SEQ ID NO: 1739958 - RNA, 14 nt, Human
uguaaggaaugauu

SEQ ID NO: 1739959 - RNA, 13 nt, Human
uguaaggaaugau

SEQ ID NO: 1739960 - RNA, 20 nt, Human
agguugucugaagucacugc

SEQ ID NO: 1739961 - RNA, 16 nt, Human
agguugucugaaguca

SEQ ID NO: 1739962 - RNA, 20 nt, Human
aggugugagucaccaagccc

SEQ ID NO: 1739963 - RNA, 14 nt, Human
aggugugagucacc

SEQ ID NO: 1739964 - RNA, 20 nt, Human
aggugugacugaauuucuuu

SEQ ID NO: 1739965 - RNA, 20 nt, Human
aggugugagccaccacgccc

SEQ ID NO: 1739966 - RNA, 22 nt, Human
aggugugaaccaccacacccag

SEQ ID NO: 1739967 - RNA, 23 nt, Human
aggugugaaccaccacacccagc

SEQ ID NO: 1739968 - RNA, 18 nt, Human
aggugugacugaauuucu

SEQ ID NO: 1739969 - RNA, 13 nt, Human
agguggggcagcu

SEQ ID NO: 1739970 - RNA, 22 nt, Human
aggugauccacucgccuucauc

SEQ ID NO: 1739971 - RNA, 23 nt, Human
agguggggucacucuggcagcuc

SEQ ID NO: 1739972 - RNA, 14 nt, Human
agguggggcagcuu

SEQ ID NO: 1739973 - RNA, 16 nt, Human
agguggggcagcuuga

SEQ ID NO: 1739974 - RNA, 17 nt, Human
agugaaagaaaauaaca

SEQ ID NO: 1739975 - RNA, 14 nt, Human
agugagacagcucu

SEQ ID NO: 1739976 - RNA, 14 nt, Human
agugaaaauauagc

SEQ ID NO: 1739977 - RNA, 15 nt, Human
agugaaaacuuugua

SEQ ID NO: 1739978 - RNA, 16 nt, Human
agugaaaacuuuguag

SEQ ID NO: 1739979 - RNA, 13 nt, Human
agugagacucugu

SEQ ID NO: 1739980 - RNA, 21 nt, Human
agugagacccugucucaaaaa

SEQ ID NO: 1739981 - RNA, 17 nt, Human
agugagacccugucuca

SEQ ID NO: 1739982 - RNA, 13 nt, Human
agugagacagacu

SEQ ID NO: 1739983 - RNA, 17 nt, Human
agugagacucugucuca

SEQ ID NO: 1739984 - RNA, 16 nt, Human
agugagacucugucuc

SEQ ID NO: 1739985 - RNA, 22 nt, Human
agugagacucugucucaaaaaa

SEQ ID NO: 1739986 - RNA, 14 nt, Human
agugagagcugggu

SEQ ID NO: 1739987 - RNA, 16 nt, Human
agugagccgagauugu

SEQ ID NO: 1739988 - RNA, 16 nt, Human
ugugauggggcccugc

SEQ ID NO: 1739989 - RNA, 15 nt, Human
ugugauggggcccug

SEQ ID NO: 1739990 - RNA, 18 nt, Human
ugugauggggcccugccu

SEQ ID NO: 1739991 - RNA, 17 nt, Human
ugugauggggcccugcc

SEQ ID NO: 1739992 - RNA, 19 nt, Human
agucuccaaagucucugga

SEQ ID NO: 1739993 - RNA, 18 nt, Human
agucucccucccuugggg

SEQ ID NO: 1739994 - RNA, 14 nt, Human
agucucccucccuu

SEQ ID NO: 1739995 - RNA, 23 nt, Human
ugugaacugaacucugacaacag

SEQ ID NO: 1739996 - RNA, 14 nt, Human
ugugaacugaacuc

SEQ ID NO: 1739997 - RNA, 19 nt, Human
ugugagcacaaagguagcu

SEQ ID NO: 1739998 - RNA, 23 nt, Human
agugaaaaaggaggaagagaaaa

SEQ ID NO: 1739999 - RNA, 20 nt, Human
agugaaaaaggaggaagaga

SEQ ID NO: 1740000 - RNA, 17 nt, Human
agugaaaaaggaggaag

SEQ ID NO: 1740001 - RNA, 11 nt, Human
agugaaaaagg

SEQ ID NO: 1740002 - RNA, 15 nt, Human
agucuuuuccaugaa

SEQ ID NO: 1740003 - RNA, 13 nt, Human
agucuuuuccaug

SEQ ID NO: 1740004 - RNA, 21 nt, Human
ugucuugcaauggcagccuug

SEQ ID NO: 1740005 - RNA, 20 nt, Human
ugucuugcaauggcagccuu

SEQ ID NO: 1740006 - RNA, 18 nt, Human
ugucuugcaauggcagcc

SEQ ID NO: 1740007 - RNA, 17 nt, Human
ugucuugcaauggcagc

SEQ ID NO: 1740008 - RNA, 15 nt, Human
ugucuugcaauggca

SEQ ID NO: 1740009 - RNA, 23 nt, Human
ugugaaccaccacacccagccca

SEQ ID NO: 1740010 - RNA, 22 nt, Human
ugugaaccaccacacccagccc

SEQ ID NO: 1740011 - RNA, 17 nt, Human
ugugaaccaccacaccc

SEQ ID NO: 1740012 - RNA, 16 nt, Human
ugugaaccaccacacc

SEQ ID NO: 1740013 - RNA, 15 nt, Human
ugugaaccaccacac

SEQ ID NO: 1740014 - RNA, 17 nt, Human
ugucucuacuaaaaaua

SEQ ID NO: 1740015 - RNA, 21 nt, Human
ugucucgugguaggacuguag

SEQ ID NO: 1740016 - RNA, 18 nt, Human
ugucucgugguaggacug

SEQ ID NO: 1740017 - RNA, 19 nt, Human
ugucucgugguaggacugu

SEQ ID NO: 1740018 - RNA, 20 nt, Human
ugucucgugguaggacugua

SEQ ID NO: 1740019 - RNA, 13 nt, Human
ugucucugagagu

SEQ ID NO: 1740020 - RNA, 22 nt, Human
ugucucuggauuauauuaugaa

SEQ ID NO: 1740021 - RNA, 16 nt, Human
agucccugccaaugga

SEQ ID NO: 1740022 - RNA, 14 nt, Human
agucccugccaaug

SEQ ID NO: 1740023 - RNA, 13 nt, Human
agucccugccaau

SEQ ID NO: 1740024 - RNA, 23 nt, Human
aguccccuguuuguuucugaaag

SEQ ID NO: 1740025 - RNA, 18 nt, Human
ugucuuaauuuucuuuca

SEQ ID NO: 1740026 - RNA, 21 nt, Human
ugucucuuuaaugucacaggc

SEQ ID NO: 1740027 - RNA, 22 nt, Human
ugucucuugguccugcugcagu

SEQ ID NO: 1740028 - RNA, 22 nt, Human
ugucucuuuaaugucacaggca

SEQ ID NO: 1740029 - RNA, 21 nt, Human
ugucucuugguccugcugcag

SEQ ID NO: 1740030 - RNA, 20 nt, Human
ugucucuugguccugcugca

SEQ ID NO: 1740031 - RNA, 19 nt, Human
ugucucuugguccugcugc

SEQ ID NO: 1740032 - RNA, 18 nt, Human
ugucucuugguccugcug

SEQ ID NO: 1740033 - RNA, 15 nt, Human
uguagagccaggguc

SEQ ID NO: 1740034 - RNA, 12 nt, Human
uguagagccagg

SEQ ID NO: 1740035 - RNA, 14 nt, Human
uguauguguaagua

SEQ ID NO: 1740036 - RNA, 16 nt, Human
uguaucccaugagccu

SEQ ID NO: 1740037 - RNA, 15 nt, Human
uguaucccaugagcc

SEQ ID NO: 1740038 - RNA, 15 nt, Human
ugucaaaguggugag

SEQ ID NO: 1740039 - RNA, 14 nt, Human
ugucaaagugguga

SEQ ID NO: 1740040 - RNA, 11 nt, Human
uguauuaugug

SEQ ID NO: 1740041 - RNA, 15 nt, Human
uguauuagucacaga

SEQ ID NO: 1740042 - RNA, 21 nt, Human
uguauuaaguuguuaauaaaa

SEQ ID NO: 1740043 - RNA, 19 nt, Human
ugucaaaguggugagaggc

SEQ ID NO: 1740044 - RNA, 16 nt, Human
ugucaaaguggugaga

SEQ ID NO: 1740045 - RNA, 19 nt, Human
ugucaaauauuuagaugua

SEQ ID NO: 1740046 - RNA, 14 nt, Human
aguagcugggacua

SEQ ID NO: 1740047 - RNA, 13 nt, Human
aguagcugggacu

SEQ ID NO: 1740048 - RNA, 15 nt, Human
aguauuauaccuuuu

SEQ ID NO: 1740049 - RNA, 14 nt, Human
aguauuauaccuuu

SEQ ID NO: 1740050 - RNA, 21 nt, Human
aguagcugggacuacaggcac

SEQ ID NO: 1740051 - RNA, 19 nt, Human
aguagcugggacuacaggc

SEQ ID NO: 1740052 - RNA, 22 nt, Human
aguagcugggacuacaggcacc

SEQ ID NO: 1740053 - RNA, 17 nt, Human
aguagcuggauuacagg

SEQ ID NO: 1740054 - RNA, 21 nt, Human
aguauuuaauucauguugccu

SEQ ID NO: 1740055 - RNA, 22 nt, Human
agucacagagauaauucuagcu

SEQ ID NO: 1740056 - RNA, 20 nt, Human
agucacauuccaagccucau

SEQ ID NO: 1740057 - RNA, 15 nt, Human
ugucagcauagaagu

SEQ ID NO: 1740058 - RNA, 17 nt, Human
agucacugagacagccc

SEQ ID NO: 1740059 - RNA, 16 nt, Human
agucacugagacagcc

SEQ ID NO: 1740060 - RNA, 15 nt, Human
agucacugagacagc

SEQ ID NO: 1740061 - RNA, 19 nt, Human
agucagggguucccuuuuu

SEQ ID NO: 1740062 - RNA, 23 nt, Human
agucccaccuuggcugcagggag

SEQ ID NO: 1740063 - RNA, 21 nt, Human
agucccaccuuggcugcaggg

SEQ ID NO: 1740064 - RNA, 20 nt, Human
agucccaggcugagccucag

SEQ ID NO: 1740065 - RNA, 19 nt, Human
aguccccuguuuguuucug

SEQ ID NO: 1740066 - RNA, 14 nt, Human
aguccccuguuugu

SEQ ID NO: 1740067 - RNA, 16 nt, Human
ugucagccauuccugu

SEQ ID NO: 1740068 - RNA, 18 nt, Human
agucacugagacagcccg

SEQ ID NO: 1740069 - RNA, 19 nt, Human
uguccaggcacugcugccc

SEQ ID NO: 1740070 - RNA, 21 nt, Human
uguccaggcacugcugcccag

SEQ ID NO: 1740071 - RNA, 20 nt, Human
uguccaggcacugcugccca

SEQ ID NO: 1740072 - RNA, 22 nt, Human
ugucccuaccgagucucuucuc

SEQ ID NO: 1740073 - RNA, 21 nt, Human
ugucccuaccgagucucuucu

SEQ ID NO: 1740074 - RNA, 20 nt, Human
ugucccuaccgagucucuuc

SEQ ID NO: 1740075 - RNA, 14 nt, Human
ugucccugcacuug

SEQ ID NO: 1740076 - RNA, 12 nt, Human
ugucccuuuucc

SEQ ID NO: 1740077 - RNA, 17 nt, Human
ugucccuuuuccuuuuu

SEQ ID NO: 1740078 - RNA, 13 nt, Human
ugaaagaaaauaa

SEQ ID NO: 1740079 - RNA, 17 nt, Human
ugaaacuggauuaaacu

SEQ ID NO: 1740080 - RNA, 18 nt, Human
ugaaacuggauuaaacuu

SEQ ID NO: 1740081 - RNA, 14 nt, Human
ugaaaauuaacaug

SEQ ID NO: 1740082 - RNA, 15 nt, Human
ugaaaacacauuuuu

SEQ ID NO: 1740083 - RNA, 17 nt, Human
ugaaaacacauuuuucu

SEQ ID NO: 1740084 - RNA, 19 nt, Human
ugaaaacacauuuuucuua

SEQ ID NO: 1740085 - RNA, 20 nt, Human
ugaaaacacauuuuucuuag

SEQ ID NO: 1740086 - RNA, 14 nt, Human
ugaaaacacauuuu

SEQ ID NO: 1740087 - RNA, 12 nt, Human
ugaaaacacauu

SEQ ID NO: 1740088 - RNA, 13 nt, Human
ugaaaacacauuu

SEQ ID NO: 1740089 - RNA, 16 nt, Human
ucuuuuuuugugaugu

SEQ ID NO: 1740090 - RNA, 14 nt, Human
ucuuuuuuugugau

SEQ ID NO: 1740091 - RNA, 23 nt, Human
ucuuuuuuuuuuuuuaaagacag

SEQ ID NO: 1740092 - RNA, 22 nt, Human
ugaaagaaaauaccaaggaaca

SEQ ID NO: 1740093 - RNA, 16 nt, Human
ugaaagacuguacaaa

SEQ ID NO: 1740094 - RNA, 17 nt, Human
ugaaagaggaaugaagu

SEQ ID NO: 1740095 - RNA, 22 nt, Human
ugaaagacuguacaaaguagaa

SEQ ID NO: 1740096 - RNA, 19 nt, Human
ugaaagacuguacaaagua

SEQ ID NO: 1740097 - RNA, 18 nt, Human
ugaaagacuguacaaagu

SEQ ID NO: 1740098 - RNA, 18 nt, Human
ugaaagaggaaugaagua

SEQ ID NO: 1740099 - RNA, 21 nt, Human
agagaccaucccugaaggccc

SEQ ID NO: 1740100 - RNA, 19 nt, Human
agagaccaucccugaaggc

SEQ ID NO: 1740101 - RNA, 23 nt, Human
agagaccaucccugaaggccccg

SEQ ID NO: 1740102 - RNA, 22 nt, Human
agagaccaucccugaaggcccc

SEQ ID NO: 1740103 - RNA, 17 nt, Human
agagaguggcuccuccc

SEQ ID NO: 1740104 - RNA, 14 nt, Human
agagacuccugcag

SEQ ID NO: 1740105 - RNA, 13 nt, Human
agagacuccugca

SEQ ID NO: 1740106 - RNA, 12 nt, Human
agagacuccugc

SEQ ID NO: 1740107 - RNA, 15 nt, Human
agagacuccugcagg

SEQ ID NO: 1740108 - RNA, 14 nt, Human
ucuuuguggcuucc

SEQ ID NO: 1740109 - RNA, 22 nt, Human
ucuuuuuucuaaaguaaaaaca

SEQ ID NO: 1740110 - RNA, 21 nt, Human
ucuuuuuucuaaaguaaaaac

SEQ ID NO: 1740111 - RNA, 14 nt, Human
agagacagaaagca

SEQ ID NO: 1740112 - RNA, 15 nt, Human
agagacagaaagcag

SEQ ID NO: 1740113 - RNA, 20 nt, Human
ucuuuguacagacaacaaac

SEQ ID NO: 1740114 - RNA, 15 nt, Human
ucuuuguacagacaa

SEQ ID NO: 1740115 - RNA, 14 nt, Human
ucuuuguacagaca

SEQ ID NO: 1740116 - RNA, 16 nt, Human
ucuuuguaaugaaaac

SEQ ID NO: 1740117 - RNA, 20 nt, Human
agacugguuccauggccucu

SEQ ID NO: 1740118 - RNA, 15 nt, Human
agacuuuggaaagag

SEQ ID NO: 1740119 - RNA, 17 nt, Human
agacuuuggaaagacuu

SEQ ID NO: 1740120 - RNA, 14 nt, Human
agacuguacaaagu

SEQ ID NO: 1740121 - RNA, 19 nt, Human
agagacacaagccuucggc

SEQ ID NO: 1740122 - RNA, 16 nt, Human
agagacacaagccuuc

SEQ ID NO: 1740123 - RNA, 19 nt, Human
agacuuuucuuucagccaa

SEQ ID NO: 1740124 - RNA, 19 nt, Human
agacuuuggaaagaguagg

SEQ ID NO: 1740125 - RNA, 12 nt, Human
agacuuuuauga

SEQ ID NO: 1740126 - RNA, 15 nt, Human
agacuuuuccaaccc

SEQ ID NO: 1740127 - RNA, 15 nt, Human
agacuuuuaugauac

SEQ ID NO: 1740128 - RNA, 13 nt, Human
agacucugucuca

SEQ ID NO: 1740129 - RNA, 13 nt, Human
agacuccugcagg

SEQ ID NO: 1740130 - RNA, 21 nt, Human
agacuccagcuggguuggaaa

SEQ ID NO: 1740131 - RNA, 16 nt, Human
agacucccaagcugga

SEQ ID NO: 1740132 - RNA, 15 nt, Human
ucuuuaaugucacag

SEQ ID NO: 1740133 - RNA, 22 nt, Human
agacaggcaagcaccuccugcc

SEQ ID NO: 1740134 - RNA, 20 nt, Human
agacaggcaagcaccuccug

SEQ ID NO: 1740135 - RNA, 19 nt, Human
ucuuuaaugucacaggcag

SEQ ID NO: 1740136 - RNA, 18 nt, Human
ucuuuaaugucacaggca

SEQ ID NO: 1740137 - RNA, 12 nt, Human
ucuuuccugagg

SEQ ID NO: 1740138 - RNA, 15 nt, Human
ugaaguaauaugcac

SEQ ID NO: 1740139 - RNA, 14 nt, Human
ugaaguaagcaaag

SEQ ID NO: 1740140 - RNA, 13 nt, Human
ugaaguaagcaaa

SEQ ID NO: 1740141 - RNA, 16 nt, Human
ugaaguaauaugcaca

SEQ ID NO: 1740142 - RNA, 20 nt, Human
ugaaguaauaugcacacauu

SEQ ID NO: 1740143 - RNA, 21 nt, Human
ugaaguaauaugcacacauuu

SEQ ID NO: 1740144 - RNA, 22 nt, Human
ugaaguaauaugcacacauuuu

SEQ ID NO: 1740145 - RNA, 17 nt, Human
ugaaguacucauacaug

SEQ ID NO: 1740146 - RNA, 15 nt, Human
ugaaguaagcaaaga

SEQ ID NO: 1740147 - RNA, 12 nt, Human
ugaauaauacag

SEQ ID NO: 1740148 - RNA, 13 nt, Human
ugaagucacacag

SEQ ID NO: 1740149 - RNA, 13 nt, Human
ugaauaauacagu

SEQ ID NO: 1740150 - RNA, 23 nt, Human
ugaauaauguaagacaaauaugu

SEQ ID NO: 1740151 - RNA, 18 nt, Human
agaguaauccaagcaaau

SEQ ID NO: 1740152 - RNA, 22 nt, Human
agaguaauccaagcaaauguga

SEQ ID NO: 1740153 - RNA, 20 nt, Human
agaguaauccaagcaaaugu

SEQ ID NO: 1740154 - RNA, 16 nt, Human
agagguucaaagauau

SEQ ID NO: 1740155 - RNA, 19 nt, Human
agagguucaaagauauuuu

SEQ ID NO: 1740156 - RNA, 20 nt, Human
agagguucaaagauauuuug

SEQ ID NO: 1740157 - RNA, 22 nt, Human
agaggcugccucucccaucacu

SEQ ID NO: 1740158 - RNA, 15 nt, Human
agagggagugacaga

SEQ ID NO: 1740159 - RNA, 20 nt, Human
agagggagugacagaggcag

SEQ ID NO: 1740160 - RNA, 13 nt, Human
agagguucaaaga

SEQ ID NO: 1740161 - RNA, 23 nt, Human
agaggcagccccauucugccugc

SEQ ID NO: 1740162 - RNA, 21 nt, Human
agaggcagggucucacucugu

SEQ ID NO: 1740163 - RNA, 22 nt, Human
agaggcagccccauucugccug

SEQ ID NO: 1740164 - RNA, 21 nt, Human
agaggcagccccauucugccu

SEQ ID NO: 1740165 - RNA, 24 nt, Human
agaggcagccccauucugccugcc

SEQ ID NO: 1740166 - RNA, 14 nt, Human
ugaaauaagccaga

SEQ ID NO: 1740167 - RNA, 16 nt, Human
ugaaauaacauggccu

SEQ ID NO: 1740168 - RNA, 17 nt, Human
ugaaauaacauggccuu

SEQ ID NO: 1740169 - RNA, 16 nt, Human
agagauugugguuuca

SEQ ID NO: 1740170 - RNA, 23 nt, Human
ugaaauagacccacaagaggcag

SEQ ID NO: 1740171 - RNA, 19 nt, Human
ugaaauuuuuauuaaauua

SEQ ID NO: 1740172 - RNA, 20 nt, Human
ugaaauuuuuauuaaauuau

SEQ ID NO: 1740173 - RNA, 22 nt, Human
ugaacccauauuuguacaccaa

SEQ ID NO: 1740174 - RNA, 18 nt, Human
ugaacccgggaggcagag

SEQ ID NO: 1740175 - RNA, 18 nt, Human
ugaacaaauuuacagaga

SEQ ID NO: 1740176 - RNA, 22 nt, Human
ugaaccaccacacccagcccac

SEQ ID NO: 1740177 - RNA, 13 nt, Human
ugaacaaauuuac

SEQ ID NO: 1740178 - RNA, 21 nt, Human
ugaaccaccacacccagccca

SEQ ID NO: 1740179 - RNA, 11 nt, Human
ugaacuccugg

SEQ ID NO: 1740180 - RNA, 15 nt, Human
ugaacuccugaccuc

SEQ ID NO: 1740181 - RNA, 22 nt, Human
ugaagacaaugacuuacuguac

SEQ ID NO: 1740182 - RNA, 23 nt, Human
ugaagacaaugacuuacuguaca

SEQ ID NO: 1740183 - RNA, 13 nt, Human
ugaagacagagcu

SEQ ID NO: 1740184 - RNA, 13 nt, Human
ugagacagcccgg

SEQ ID NO: 1740185 - RNA, 21 nt, Human
ugagacagaguuuucacucuu

SEQ ID NO: 1740186 - RNA, 11 nt, Human
ugagacagagu

SEQ ID NO: 1740187 - RNA, 20 nt, Human
ugagacagaaucucgcucug

SEQ ID NO: 1740188 - RNA, 20 nt, Human
ugagacucugucucagucca

SEQ ID NO: 1740189 - RNA, 20 nt, Human
ugagacucugucucaaaaaa

SEQ ID NO: 1740190 - RNA, 12 nt, Human
ugagacagcucu

SEQ ID NO: 1740191 - RNA, 22 nt, Human
ugagacagcccgggcucugccu

SEQ ID NO: 1740192 - RNA, 20 nt, Human
ugagacagcccgggcucugc

SEQ ID NO: 1740193 - RNA, 19 nt, Human
ugagacagcccgggcucug

SEQ ID NO: 1740194 - RNA, 18 nt, Human
ugagacagcccgggcucu

SEQ ID NO: 1740195 - RNA, 17 nt, Human
ugagacagcccgggcuc

SEQ ID NO: 1740196 - RNA, 14 nt, Human
ugagaggaaaucac

SEQ ID NO: 1740197 - RNA, 13 nt, Human
ugagaggaaauca

SEQ ID NO: 1740198 - RNA, 12 nt, Human
ugagaggaaauc

SEQ ID NO: 1740199 - RNA, 11 nt, Human
ugagaggaaau

SEQ ID NO: 1740200 - RNA, 10 nt, Human
ugagaggaaa

SEQ ID NO: 1740201 - RNA, 14 nt, Human
ugagagcugggugu

SEQ ID NO: 1740202 - RNA, 23 nt, Human
ugagauguagccccucuccugga

SEQ ID NO: 1740203 - RNA, 23 nt, Human
ugagaggacuuuucuuuguggcu

SEQ ID NO: 1740204 - RNA, 17 nt, Human
ugagaggaaaucaccga

SEQ ID NO: 1740205 - RNA, 14 nt, Human
ugagauguguucac

SEQ ID NO: 1740206 - RNA, 17 nt, Human
agcaaggagauuuacaa

SEQ ID NO: 1740207 - RNA, 19 nt, Human
agcaaggagauuuacaacu

SEQ ID NO: 1740208 - RNA, 14 nt, Human
agcaaggagauuua

SEQ ID NO: 1740209 - RNA, 15 nt, Human
agcaagucagaauag

SEQ ID NO: 1740210 - RNA, 16 nt, Human
agcaagugagagcugg

SEQ ID NO: 1740211 - RNA, 15 nt, Human
agcaagugagagcug

SEQ ID NO: 1740212 - RNA, 16 nt, Human
agcaagugagacccug

SEQ ID NO: 1740213 - RNA, 13 nt, Human
ugagccacugcac

SEQ ID NO: 1740214 - RNA, 12 nt, Human
ugagccacugca

SEQ ID NO: 1740215 - RNA, 14 nt, Human
ugagcauuagauuu

SEQ ID NO: 1740216 - RNA, 16 nt, Human
ugagcauuagauuucu

SEQ ID NO: 1740217 - RNA, 15 nt, Human
ugagcaaauguggcu

SEQ ID NO: 1740218 - RNA, 19 nt, Human
ugagccagauuucacucuc

SEQ ID NO: 1740219 - RNA, 18 nt, Human
ugagccagauuucacucu

SEQ ID NO: 1740220 - RNA, 14 nt, Human
ugagccacugcacc

SEQ ID NO: 1740221 - RNA, 21 nt, Human
ugagccagauuucacucuccu

SEQ ID NO: 1740222 - RNA, 20 nt, Human
ugagccagauuucacucucc

SEQ ID NO: 1740223 - RNA, 18 nt, Human
agcaagugagagcugggu

SEQ ID NO: 1740224 - RNA, 17 nt, Human
agcaagugagagcuggg

SEQ ID NO: 1740225 - RNA, 21 nt, Human
agcacagcuucauuuccugug

SEQ ID NO: 1740226 - RNA, 22 nt, Human
agcacaugccucucucaggcca

SEQ ID NO: 1740227 - RNA, 21 nt, Human
agcacaugccucucucaggcc

SEQ ID NO: 1740228 - RNA, 20 nt, Human
agcacaugccucucucaggc

SEQ ID NO: 1740229 - RNA, 19 nt, Human
agcacaugccucucucagg

SEQ ID NO: 1740230 - RNA, 18 nt, Human
agcacaugccucucucag

SEQ ID NO: 1740231 - RNA, 16 nt, Human
agcaccaucucuccuc

SEQ ID NO: 1740232 - RNA, 23 nt, Human
agcacaugccucucucaggccaa

SEQ ID NO: 1740233 - RNA, 22 nt, Human
agcaccaaaagcuuaccaaggg

SEQ ID NO: 1740234 - RNA, 16 nt, Human
agcaccuccugccucg

SEQ ID NO: 1740235 - RNA, 14 nt, Human
agcaccuccugccu

SEQ ID NO: 1740236 - RNA, 13 nt, Human
agcaccuccugcc

SEQ ID NO: 1740237 - RNA, 17 nt, Human
agcaccuagccucgcuc

SEQ ID NO: 1740238 - RNA, 22 nt, Human
agcaccuacaguguacagucuu

SEQ ID NO: 1740239 - RNA, 14 nt, Human
agcaccuacagugu

SEQ ID NO: 1740240 - RNA, 15 nt, Human
agcaccuacagugua

SEQ ID NO: 1740241 - RNA, 19 nt, Human
agcaccuacaguguacagu

SEQ ID NO: 1740242 - RNA, 21 nt, Human
agcaccuacaguguacagucu

SEQ ID NO: 1740243 - RNA, 22 nt, Human
ugacagggcacaccgggcacuc

SEQ ID NO: 1740244 - RNA, 19 nt, Human
ugacaggcaaugcuggcug

SEQ ID NO: 1740245 - RNA, 17 nt, Human
ugacaggcaaugcuggc

SEQ ID NO: 1740246 - RNA, 16 nt, Human
ugacacgaauauugcu

SEQ ID NO: 1740247 - RNA, 15 nt, Human
ugacacuuaaaaaug

SEQ ID NO: 1740248 - RNA, 19 nt, Human
ugacacgaauauugcugau

SEQ ID NO: 1740249 - RNA, 19 nt, Human
agaugcuagaacucccuuu

SEQ ID NO: 1740250 - RNA, 21 nt, Human
agaugcuagaacucccuuuca

SEQ ID NO: 1740251 - RNA, 22 nt, Human
agaugcuagaacucccuuucaa

SEQ ID NO: 1740252 - RNA, 22 nt, Human
agauguagccccucuccuggaa

SEQ ID NO: 1740253 - RNA, 21 nt, Human
agauguagccccucuccugga

SEQ ID NO: 1740254 - RNA, 16 nt, Human
agaucguucucugccu

SEQ ID NO: 1740255 - RNA, 18 nt, Human
agaucucuaacuucacca

SEQ ID NO: 1740256 - RNA, 18 nt, Human
agauccccaagccuggca

SEQ ID NO: 1740257 - RNA, 16 nt, Human
agauucauauuuacuu

SEQ ID NO: 1740258 - RNA, 13 nt, Human
agauucauauuua

SEQ ID NO: 1740259 - RNA, 17 nt, Human
ugacuuauuuauauaaa

SEQ ID NO: 1740260 - RNA, 14 nt, Human
agauuaagaaauag

SEQ ID NO: 1740261 - RNA, 15 nt, Human
agauuaagaaauaga

SEQ ID NO: 1740262 - RNA, 12 nt, Human
ugacuuacugua

SEQ ID NO: 1740263 - RNA, 20 nt, Human
ugacuuacuguacaugaaaa

SEQ ID NO: 1740264 - RNA, 19 nt, Human
agauucauauuuacuucuu

SEQ ID NO: 1740265 - RNA, 21 nt, Human
agauuccagagaguggcuccu

SEQ ID NO: 1740266 - RNA, 22 nt, Human
agauuccagagaguggcuccuc

SEQ ID NO: 1740267 - RNA, 19 nt, Human
agauuucacucuccuuggu

SEQ ID NO: 1740268 - RNA, 19 nt, Human
ugaccugccaggcacacug

SEQ ID NO: 1740269 - RNA, 16 nt, Human
ugaccugccaggcaca

SEQ ID NO: 1740270 - RNA, 15 nt, Human
ugaccuuuaagagaa

SEQ ID NO: 1740271 - RNA, 13 nt, Human
ugaccuuucaaua

SEQ ID NO: 1740272 - RNA, 12 nt, Human
ugaccuuucaau

SEQ ID NO: 1740273 - RNA, 21 nt, Human
ugacuguuuucucuugagagg

SEQ ID NO: 1740274 - RNA, 21 nt, Human
ugacucguauaugucucaggu

SEQ ID NO: 1740275 - RNA, 19 nt, Human
ugacuauuuuucagaaucu

SEQ ID NO: 1740276 - RNA, 23 nt, Human
ucucacuauguugcccaggcagg

SEQ ID NO: 1740277 - RNA, 22 nt, Human
ucucacuauguugcccaggcag

SEQ ID NO: 1740278 - RNA, 21 nt, Human
ucucacuauguugcccaggca

SEQ ID NO: 1740279 - RNA, 20 nt, Human
ucucacuauguugcccaggc

SEQ ID NO: 1740280 - RNA, 22 nt, Human
acuugcagacucuacagaggcc

SEQ ID NO: 1740281 - RNA, 19 nt, Human
acuugcagacucuacagag

SEQ ID NO: 1740282 - RNA, 23 nt, Human
acuugcagacucuacagaggcca

SEQ ID NO: 1740283 - RNA, 16 nt, Human
acuugcucuugaugcc

SEQ ID NO: 1740284 - RNA, 20 nt, Human
acuugcucuugaugccuggc

SEQ ID NO: 1740285 - RNA, 18 nt, Human
acuugcucuugaugccug

SEQ ID NO: 1740286 - RNA, 17 nt, Human
acuugcucuugaugccu

SEQ ID NO: 1740287 - RNA, 22 nt, Human
acuuguggacacagcucuucuc

SEQ ID NO: 1740288 - RNA, 19 nt, Human
acuuguggacacagcucuu

SEQ ID NO: 1740289 - RNA, 21 nt, Human
acuugucuuuggacccugagg

SEQ ID NO: 1740290 - RNA, 20 nt, Human
acuugucuuuggacccugag

SEQ ID NO: 1740291 - RNA, 19 nt, Human
acuuguauuauguguguuu

SEQ ID NO: 1740292 - RNA, 18 nt, Human
acuuguauuauguguguu

SEQ ID NO: 1740293 - RNA, 14 nt, Human
acuugcuuuuaaaa

SEQ ID NO: 1740294 - RNA, 13 nt, Human
ucucaggccagcu

SEQ ID NO: 1740295 - RNA, 12 nt, Human
ucucaggccagc

SEQ ID NO: 1740296 - RNA, 12 nt, Human
ucucaggccaaa

SEQ ID NO: 1740297 - RNA, 10 nt, Human
ucucaggcca

SEQ ID NO: 1740298 - RNA, 14 nt, Human
ucucauuugucaca

SEQ ID NO: 1740299 - RNA, 19 nt, Human
ucucauuugccaauaauaa

SEQ ID NO: 1740300 - RNA, 16 nt, Human
ucuccaagcaggacau

SEQ ID NO: 1740301 - RNA, 13 nt, Human
ucuccaaaauaaa

SEQ ID NO: 1740302 - RNA, 16 nt, Human
ucucauuugucacaca

SEQ ID NO: 1740303 - RNA, 18 nt, Human
ucucaggccagcugcuug

SEQ ID NO: 1740304 - RNA, 17 nt, Human
ucucaggccagcugcuu

SEQ ID NO: 1740305 - RNA, 21 nt, Human
ucucaggccagcugcuugggc

SEQ ID NO: 1740306 - RNA, 20 nt, Human
ucucaugccucagccuccug

SEQ ID NO: 1740307 - RNA, 21 nt, Human
ucucaugccucagccuccuga

SEQ ID NO: 1740308 - RNA, 12 nt, Human
acuuugaccucu

SEQ ID NO: 1740309 - RNA, 13 nt, Human
acuuugaccucug

SEQ ID NO: 1740310 - RNA, 20 nt, Human
acuuuguuaguuucuccaag

SEQ ID NO: 1740311 - RNA, 14 nt, Human
acuuuguucuggcu

SEQ ID NO: 1740312 - RNA, 21 nt, Human
acuuuguuaguuucuccaagc

SEQ ID NO: 1740313 - RNA, 12 nt, Human
acuuuuguucuu

SEQ ID NO: 1740314 - RNA, 13 nt, Human
acuuuuguucuug

SEQ ID NO: 1740315 - RNA, 15 nt, Human
acuuuuguucuuggu

SEQ ID NO: 1740316 - RNA, 23 nt, Human
acuuuuguucuugguuuguaaau

SEQ ID NO: 1740317 - RNA, 15 nt, Human
ucuccuucaccuuug

SEQ ID NO: 1740318 - RNA, 14 nt, Human
ucuccuucaccuuu

SEQ ID NO: 1740319 - RNA, 17 nt, Human
agaaaaaauauuuuccc

SEQ ID NO: 1740320 - RNA, 18 nt, Human
ucuccuucaccuuugucc

SEQ ID NO: 1740321 - RNA, 16 nt, Human
ucuccuucaccuuugu

SEQ ID NO: 1740322 - RNA, 13 nt, Human
ucuccuuguguua

SEQ ID NO: 1740323 - RNA, 21 nt, Human
ucuccuuguguuacuaaguuu

SEQ ID NO: 1740324 - RNA, 23 nt, Human
ucuccgaccagacaccuugacag

SEQ ID NO: 1740325 - RNA, 17 nt, Human
ucuccgaccagacaccu

SEQ ID NO: 1740326 - RNA, 15 nt, Human
ucucccuuuuccaug

SEQ ID NO: 1740327 - RNA, 19 nt, Human
ucuccaagcaggacaugga

SEQ ID NO: 1740328 - RNA, 18 nt, Human
ucuccaagcaggacaugg

SEQ ID NO: 1740329 - RNA, 12 nt, Human
ucuccacccugc

SEQ ID NO: 1740330 - RNA, 23 nt, Human
ucuccccagcaagugagagcugg

SEQ ID NO: 1740331 - RNA, 16 nt, Human
ucuccucugcugcugg

SEQ ID NO: 1740332 - RNA, 15 nt, Human
ucuccucugcugcug

SEQ ID NO: 1740333 - RNA, 15 nt, Human
ucuccuccagaguca

SEQ ID NO: 1740334 - RNA, 18 nt, Human
ucuccucugcugcuggcu

SEQ ID NO: 1740335 - RNA, 17 nt, Human
ucuccucugcugcuggc

SEQ ID NO: 1740336 - RNA, 20 nt, Human
acuuucugaaauaacauggc

SEQ ID NO: 1740337 - RNA, 14 nt, Human
acuuucugaaauaa

SEQ ID NO: 1740338 - RNA, 12 nt, Human
acuuuaccuuuu

SEQ ID NO: 1740339 - RNA, 17 nt, Human
acuuacacuuuaugcac

SEQ ID NO: 1740340 - RNA, 21 nt, Human
acuuacuguacaugaaaacac

SEQ ID NO: 1740341 - RNA, 22 nt, Human
acuuacuguacaugaaaacaca

SEQ ID NO: 1740342 - RNA, 14 nt, Human
acuuagcugggaga

SEQ ID NO: 1740343 - RNA, 15 nt, Human
acuuagguguggggg

SEQ ID NO: 1740344 - RNA, 20 nt, Human
acuuaaauaaugugaaacug

SEQ ID NO: 1740345 - RNA, 13 nt, Human
acuuaagcacacu

SEQ ID NO: 1740346 - RNA, 17 nt, Human
acuuaaucuaaauggaa

SEQ ID NO: 1740347 - RNA, 19 nt, Human
acuuaaucuaaauggaacc

SEQ ID NO: 1740348 - RNA, 22 nt, Human
acuuaaucuaaauggaaccacu

SEQ ID NO: 1740349 - RNA, 16 nt, Human
acuuacacuuuaugca

SEQ ID NO: 1740350 - RNA, 17 nt, Human
acuguucucugcccucc

SEQ ID NO: 1740351 - RNA, 16 nt, Human
acuguucucugcccuc

SEQ ID NO: 1740352 - RNA, 18 nt, Human
acuguucucugcccucca

SEQ ID NO: 1740353 - RNA, 19 nt, Human
acuguucucugcccuccaa

SEQ ID NO: 1740354 - RNA, 21 nt, Human
ucuacccuggcacuauaaugu

SEQ ID NO: 1740355 - RNA, 14 nt, Human
ucuacccuggcacu

SEQ ID NO: 1740356 - RNA, 19 nt, Human
ucuacccuggcacuauaau

SEQ ID NO: 1740357 - RNA, 14 nt, Human
ucuacccaggugcu

SEQ ID NO: 1740358 - RNA, 20 nt, Human
ucuacccagcgagcccuggu

SEQ ID NO: 1740359 - RNA, 18 nt, Human
uccugggagugagcuggu

SEQ ID NO: 1740360 - RNA, 21 nt, Human
ucuacagaggccaugggccuc

SEQ ID NO: 1740361 - RNA, 19 nt, Human
ucuacccagcgagcccugg

SEQ ID NO: 1740362 - RNA, 23 nt, Human
ucuacagcuaaucagcauucuca

SEQ ID NO: 1740363 - RNA, 20 nt, Human
ucuacagcuaaucagcauuc

SEQ ID NO: 1740364 - RNA, 13 nt, Human
ucuagccagagga

SEQ ID NO: 1740365 - RNA, 12 nt, Human
ucuaggaagacu

SEQ ID NO: 1740366 - RNA, 22 nt, Human
ucuaguuguuugauucagacag

SEQ ID NO: 1740367 - RNA, 22 nt, Human
ucuaguuugauuaaauucuugc

SEQ ID NO: 1740368 - RNA, 21 nt, Human
ucuaguuugauuaaauucuug

SEQ ID NO: 1740369 - RNA, 23 nt, Human
ucuaguuguuugauucagacagc

SEQ ID NO: 1740370 - RNA, 13 nt, Human
ucuagauacugua

SEQ ID NO: 1740371 - RNA, 18 nt, Human
ucuagcauggcugccaau

SEQ ID NO: 1740372 - RNA, 16 nt, Human
acuucaucccucuggg

SEQ ID NO: 1740373 - RNA, 19 nt, Human
acuuccccuuccuaauucc

SEQ ID NO: 1740374 - RNA, 13 nt, Human
acuuccccuuccu

SEQ ID NO: 1740375 - RNA, 19 nt, Human
ucucacuauguugcccagg

SEQ ID NO: 1740376 - RNA, 17 nt, Human
ucucacuauguugccca

SEQ ID NO: 1740377 - RNA, 23 nt, Human
agaauuaacacaugauccugcaa

SEQ ID NO: 1740378 - RNA, 15 nt, Human
agaauuaacacauga

SEQ ID NO: 1740379 - RNA, 18 nt, Human
ucugcuuuccucuuccug

SEQ ID NO: 1740380 - RNA, 13 nt, Human
ucugcuuuccucu

SEQ ID NO: 1740381 - RNA, 12 nt, Human
ucugcuuuccuc

SEQ ID NO: 1740382 - RNA, 23 nt, Human
agaaguuucugccgcagcccugc

SEQ ID NO: 1740383 - RNA, 22 nt, Human
agaaguuucugccgcagcccug

SEQ ID NO: 1740384 - RNA, 21 nt, Human
agaaguuucugccgcagcccu

SEQ ID NO: 1740385 - RNA, 20 nt, Human
agaaguggggacagagcaga

SEQ ID NO: 1740386 - RNA, 16 nt, Human
agaauagaugcugacu

SEQ ID NO: 1740387 - RNA, 17 nt, Human
agaauaaaauuuuuaau

SEQ ID NO: 1740388 - RNA, 14 nt, Human
agaauaaaauuuuu

SEQ ID NO: 1740389 - RNA, 12 nt, Human
agaauaaaauuu

SEQ ID NO: 1740390 - RNA, 14 nt, Human
ucugugagaugcua

SEQ ID NO: 1740391 - RNA, 23 nt, Human
ucugugagaugcuagaacucccu

SEQ ID NO: 1740392 - RNA, 17 nt, Human
ucugugagaugcuagaa

SEQ ID NO: 1740393 - RNA, 22 nt, Human
ucugugagaugcuagaacuccc

SEQ ID NO: 1740394 - RNA, 15 nt, Human
ucugggccagaauuu

SEQ ID NO: 1740395 - RNA, 14 nt, Human
ucugggccagaauu

SEQ ID NO: 1740396 - RNA, 13 nt, Human
ucuguuuagauaa

SEQ ID NO: 1740397 - RNA, 16 nt, Human
ucuguuguauucauug

SEQ ID NO: 1740398 - RNA, 13 nt, Human
ucuguucuuucca

SEQ ID NO: 1740399 - RNA, 22 nt, Human
ucuguucuuuccaaaguacacu

SEQ ID NO: 1740400 - RNA, 17 nt, Human
ucuguuggccaguguga

SEQ ID NO: 1740401 - RNA, 12 nt, Human
ucuguuggccag

SEQ ID NO: 1740402 - RNA, 15 nt, Human
ucuguugcugccuca

SEQ ID NO: 1740403 - RNA, 16 nt, Human
ucuguugcccaggcug

SEQ ID NO: 1740404 - RNA, 16 nt, Human
agacacaggcccggcu

SEQ ID NO: 1740405 - RNA, 13 nt, Human
agacacaggcccg

SEQ ID NO: 1740406 - RNA, 12 nt, Human
agacacaggccc

SEQ ID NO: 1740407 - RNA, 20 nt, Human
agacacauguccaagaagcc

SEQ ID NO: 1740408 - RNA, 16 nt, Human
agacacauguccaaga

SEQ ID NO: 1740409 - RNA, 17 nt, Human
agacaccuugacagggc

SEQ ID NO: 1740410 - RNA, 18 nt, Human
agacaccuugacagggca

SEQ ID NO: 1740411 - RNA, 19 nt, Human
agacaccuugacagggcac

SEQ ID NO: 1740412 - RNA, 13 nt, Human
agacagagcuaca

SEQ ID NO: 1740413 - RNA, 21 nt, Human
ucugaucauccacugugccau

SEQ ID NO: 1740414 - RNA, 17 nt, Human
ucugaucauccacugug

SEQ ID NO: 1740415 - RNA, 16 nt, Human
ucugaugcaagcaaga

SEQ ID NO: 1740416 - RNA, 21 nt, Human
ucugagacucgcgacaaugca

SEQ ID NO: 1740417 - RNA, 22 nt, Human
ucugagacucgcgacaaugcaa

SEQ ID NO: 1740418 - RNA, 18 nt, Human
ucugcagauaaacaguag

SEQ ID NO: 1740419 - RNA, 15 nt, Human
ucugcagauaaacag

SEQ ID NO: 1740420 - RNA, 17 nt, Human
ucugcagcaauaaagca

SEQ ID NO: 1740421 - RNA, 15 nt, Human
ucugcacuccccugc

SEQ ID NO: 1740422 - RNA, 14 nt, Human
ucugcacuccccug

SEQ ID NO: 1740423 - RNA, 16 nt, Human
ucugcacuccccugcu

SEQ ID NO: 1740424 - RNA, 17 nt, Human
ucugcacuccccugcug

SEQ ID NO: 1740425 - RNA, 21 nt, Human
ucugaugcaagcaagaaacac

SEQ ID NO: 1740426 - RNA, 14 nt, Human
agaaauguacagca

SEQ ID NO: 1740427 - RNA, 15 nt, Human
agaaauguacagcaa

SEQ ID NO: 1740428 - RNA, 14 nt, Human
ucugcaggucccua

SEQ ID NO: 1740429 - RNA, 13 nt, Human
ucugcaggucccu

SEQ ID NO: 1740430 - RNA, 12 nt, Human
ucugcagguccc

SEQ ID NO: 1740431 - RNA, 11 nt, Human
ucugcaggucc

SEQ ID NO: 1740432 - RNA, 21 nt, Human
ucugaaggacauugcggacag

SEQ ID NO: 1740433 - RNA, 22 nt, Human
ucugaaggacauugcggacagc

SEQ ID NO: 1740434 - RNA, 10 nt, Human
ucugaauuau

SEQ ID NO: 1740435 - RNA, 15 nt, Human
ucugacacacagcuc

SEQ ID NO: 1740436 - RNA, 14 nt, Human
ucugacacacagcu

SEQ ID NO: 1740437 - RNA, 13 nt, Human
ucugacacacagc

SEQ ID NO: 1740438 - RNA, 15 nt, Human
ucugaauuauuuucu

SEQ ID NO: 1740439 - RNA, 16 nt, Human
ucuccuuucacaaccu

SEQ ID NO: 1740440 - RNA, 22 nt, Human
agaaagcccuuaggaagaauuu

SEQ ID NO: 1740441 - RNA, 20 nt, Human
agaaagcccuuaggaagaau

SEQ ID NO: 1740442 - RNA, 20 nt, Human
agaaauugcauuuccugaca

SEQ ID NO: 1740443 - RNA, 17 nt, Human
agaaauugcauuuccug

SEQ ID NO: 1740444 - RNA, 18 nt, Human
agaagauuuugaaauuuu

SEQ ID NO: 1740445 - RNA, 17 nt, Human
ucugcccacucccugca

SEQ ID NO: 1740446 - RNA, 22 nt, Human
agaagcccaggaaaggcuccag

SEQ ID NO: 1740447 - RNA, 21 nt, Human
agaagcccaggaaaggcucca

SEQ ID NO: 1740448 - RNA, 20 nt, Human
agaagcccaggaaaggcucc

SEQ ID NO: 1740449 - RNA, 18 nt, Human
agaagcccaggaaaggcu

SEQ ID NO: 1740450 - RNA, 16 nt, Human
agaagcccaggaaagg

SEQ ID NO: 1740451 - RNA, 12 nt, Human
agaagcccagga

SEQ ID NO: 1740452 - RNA, 13 nt, Human
ucugcuucagccu

SEQ ID NO: 1740453 - RNA, 15 nt, Human
ucugcuucagccucc

SEQ ID NO: 1740454 - RNA, 14 nt, Human
ucugcuucagccuc

SEQ ID NO: 1740455 - RNA, 20 nt, Human
ucugcucacauaucugucau

SEQ ID NO: 1740456 - RNA, 19 nt, Human
ucugcucacauaucuguca

SEQ ID NO: 1740457 - RNA, 22 nt, Human
ucugccugcccaggccccugcc

SEQ ID NO: 1740458 - RNA, 21 nt, Human
ucugccugcccaggccccugc

SEQ ID NO: 1740459 - RNA, 22 nt, Human
ucugccgcagcccugcagaggg

SEQ ID NO: 1740460 - RNA, 23 nt, Human
ucugccgcagcccugcagagggc

SEQ ID NO: 1740461 - RNA, 19 nt, Human
ucugcccuccaagaccuuc

SEQ ID NO: 1740462 - RNA, 21 nt, Human
ucugcccacucccugcaaccu

SEQ ID NO: 1740463 - RNA, 18 nt, Human
ucugcccacucccugcaa

SEQ ID NO: 1740464 - RNA, 15 nt, Human
ucugccgcagcccug

SEQ ID NO: 1740465 - RNA, 14 nt, Human
ucugccgcagcccu

SEQ ID NO: 1740466 - RNA, 10 nt, Human
ucugcccugc

SEQ ID NO: 1740467 - RNA, 12 nt, Human
ucugcccugcgg

SEQ ID NO: 1740468 - RNA, 11 nt, Human
ucugcccugcg

SEQ ID NO: 1740469 - RNA, 19 nt, Human
acuccagugagacagcucu

SEQ ID NO: 1740470 - RNA, 21 nt, Human
acuccagaccccuggcuuuuc

SEQ ID NO: 1740471 - RNA, 19 nt, Human
acuccagaccccuggcuuu

SEQ ID NO: 1740472 - RNA, 18 nt, Human
acuccagaccccuggcuu

SEQ ID NO: 1740473 - RNA, 15 nt, Human
acucaccccagcccc

SEQ ID NO: 1740474 - RNA, 14 nt, Human
acucaccccagccc

SEQ ID NO: 1740475 - RNA, 16 nt, Human
acucaccccagcccca

SEQ ID NO: 1740476 - RNA, 15 nt, Human
acuccagaccccugg

SEQ ID NO: 1740477 - RNA, 13 nt, Human
acuccagaccccu

SEQ ID NO: 1740478 - RNA, 13 nt, Human
acucaccccagcc

SEQ ID NO: 1740479 - RNA, 11 nt, Human
acuccuggccu

SEQ ID NO: 1740480 - RNA, 17 nt, Human
ucccugguggcagcuca

SEQ ID NO: 1740481 - RNA, 16 nt, Human
ucccugguggcagcuc

SEQ ID NO: 1740482 - RNA, 21 nt, Human
ucccugguggcagcucaccuc

SEQ ID NO: 1740483 - RNA, 20 nt, Human
ucccugguggcagcucaccu

SEQ ID NO: 1740484 - RNA, 19 nt, Human
ucccugguggcagcucacc

SEQ ID NO: 1740485 - RNA, 18 nt, Human
ucccugguggcagcucac

SEQ ID NO: 1740486 - RNA, 16 nt, Human
acuccugcaggcagcc

SEQ ID NO: 1740487 - RNA, 15 nt, Human
acuccugcaggcagc

SEQ ID NO: 1740488 - RNA, 22 nt, Human
acuccugcaggcagccaggcca

SEQ ID NO: 1740489 - RNA, 14 nt, Human
acuccugcaggcag

SEQ ID NO: 1740490 - RNA, 12 nt, Human
acuccugcaggc

SEQ ID NO: 1740491 - RNA, 12 nt, Human
acuccucccagg

SEQ ID NO: 1740492 - RNA, 14 nt, Human
acuccuggccucaa

SEQ ID NO: 1740493 - RNA, 13 nt, Human
acuccuggccuca

SEQ ID NO: 1740494 - RNA, 13 nt, Human
uccuaggcauuug

SEQ ID NO: 1740495 - RNA, 12 nt, Human
acuccuggccuc

SEQ ID NO: 1740496 - RNA, 15 nt, Human
uccuacucuguguca

SEQ ID NO: 1740497 - RNA, 14 nt, Human
uccuacucuguguc

SEQ ID NO: 1740498 - RNA, 13 nt, Human
uccuacucugugu

SEQ ID NO: 1740499 - RNA, 21 nt, Human
ucccuuuuuuuaaguaaggaa

SEQ ID NO: 1740500 - RNA, 16 nt, Human
ucccuuuuuuuaagua

SEQ ID NO: 1740501 - RNA, 18 nt, Human
uccgguguuuaagacauu

SEQ ID NO: 1740502 - RNA, 20 nt, Human
ucccuuggauuguccccgac

SEQ ID NO: 1740503 - RNA, 19 nt, Human
ucccuuggauuguccccga

SEQ ID NO: 1740504 - RNA, 23 nt, Human
ucccugguggcagcucaccucuc

SEQ ID NO: 1740505 - RNA, 22 nt, Human
ucccugguggcagcucaccucu

SEQ ID NO: 1740506 - RNA, 18 nt, Human
ucccuuugacgccauccc

SEQ ID NO: 1740507 - RNA, 16 nt, Human
ucccuuugacgccauc

SEQ ID NO: 1740508 - RNA, 19 nt, Human
ucccuuuuuuggcugcuga

SEQ ID NO: 1740509 - RNA, 17 nt, Human
ucccuuuuuuggcugcu

SEQ ID NO: 1740510 - RNA, 19 nt, Human
ucccuuugacgccauccca

SEQ ID NO: 1740511 - RNA, 21 nt, Human
ucccuuugacgccaucccagc

SEQ ID NO: 1740512 - RNA, 22 nt, Human
ucccuuuuuuggcugcugaagg

SEQ ID NO: 1740513 - RNA, 20 nt, Human
ucccuuuuuuggcugcugaa

SEQ ID NO: 1740514 - RNA, 23 nt, Human
ucccuuuuuuggcugcugaaggc

SEQ ID NO: 1740515 - RNA, 13 nt, Human
ucccuuuuuuuaa

SEQ ID NO: 1740516 - RNA, 14 nt, Human
acucuugaccucag

SEQ ID NO: 1740517 - RNA, 16 nt, Human
acucuugaccucaggu

SEQ ID NO: 1740518 - RNA, 15 nt, Human
acucuugaccucagg

SEQ ID NO: 1740519 - RNA, 23 nt, Human
uccucauacccacccccacccaa

SEQ ID NO: 1740520 - RNA, 22 nt, Human
uccucauaguaugguggcuggg

SEQ ID NO: 1740521 - RNA, 13 nt, Human
uccucccaggcgc

SEQ ID NO: 1740522 - RNA, 21 nt, Human
uccucccaggcgccccuuccc

SEQ ID NO: 1740523 - RNA, 19 nt, Human
uccucccaggcgccccuuc

SEQ ID NO: 1740524 - RNA, 15 nt, Human
acucuccuugguguc

SEQ ID NO: 1740525 - RNA, 18 nt, Human
acucuccuggaaauauua

SEQ ID NO: 1740526 - RNA, 16 nt, Human
acucuccucugcugcu

SEQ ID NO: 1740527 - RNA, 14 nt, Human
acucuccucugcug

SEQ ID NO: 1740528 - RNA, 13 nt, Human
acucuccucugcu

SEQ ID NO: 1740529 - RNA, 12 nt, Human
acucuccucugc

SEQ ID NO: 1740530 - RNA, 17 nt, Human
acucuccuccagaguca

SEQ ID NO: 1740531 - RNA, 14 nt, Human
acucuccuccagag

SEQ ID NO: 1740532 - RNA, 24 nt, Human
acuccuugaaaacacuguucucug

SEQ ID NO: 1740533 - RNA, 23 nt, Human
acuccuugaaaacacuguucucu

SEQ ID NO: 1740534 - RNA, 15 nt, Human
acucuggcagcucag

SEQ ID NO: 1740535 - RNA, 13 nt, Human
acucuggcagcuc

SEQ ID NO: 1740536 - RNA, 16 nt, Human
acucugccuccucuuc

SEQ ID NO: 1740537 - RNA, 12 nt, Human
acucugccuccu

SEQ ID NO: 1740538 - RNA, 23 nt, Human
acucuccuuggugucgggcauga

SEQ ID NO: 1740539 - RNA, 16 nt, Human
acucuccuuggugucg

SEQ ID NO: 1740540 - RNA, 22 nt, Human
acucugagacucgcgacaaugc

SEQ ID NO: 1740541 - RNA, 11 nt, Human
acucugagacu

SEQ ID NO: 1740542 - RNA, 18 nt, Human
acugagagugaacaaauu

SEQ ID NO: 1740543 - RNA, 23 nt, Human
acugagacagcccgggcucugcc

SEQ ID NO: 1740544 - RNA, 22 nt, Human
acugagacagcccgggcucugc

SEQ ID NO: 1740545 - RNA, 21 nt, Human
acugagacagcccgggcucug

SEQ ID NO: 1740546 - RNA, 18 nt, Human
acugagacagcccgggcu

SEQ ID NO: 1740547 - RNA, 15 nt, Human
acugagacagcccgg

SEQ ID NO: 1740548 - RNA, 21 nt, Human
acugagaaauuuauaaacuuu

SEQ ID NO: 1740549 - RNA, 17 nt, Human
acugagaaauuuauaaa

SEQ ID NO: 1740550 - RNA, 12 nt, Human
acugagaaauuu

SEQ ID NO: 1740551 - RNA, 12 nt, Human
uccucuuuccau

SEQ ID NO: 1740552 - RNA, 11 nt, Human
uccucuuucca

SEQ ID NO: 1740553 - RNA, 14 nt, Human
uccucccucccucu

SEQ ID NO: 1740554 - RNA, 11 nt, Human
uccucccuccc

SEQ ID NO: 1740555 - RNA, 21 nt, Human
uccucuuuggucuacacugug

SEQ ID NO: 1740556 - RNA, 19 nt, Human
uccucuuuggucuacacug

SEQ ID NO: 1740557 - RNA, 19 nt, Human
uccucuuuccaucuacccu

SEQ ID NO: 1740558 - RNA, 23 nt, Human
uccucuuuggucuacacugugcu

SEQ ID NO: 1740559 - RNA, 22 nt, Human
uccucuuuggucuacacugugc

SEQ ID NO: 1740560 - RNA, 21 nt, Human
uccugaauuuuauuuuuuggg

SEQ ID NO: 1740561 - RNA, 19 nt, Human
acucuuucuauuguuucuu

SEQ ID NO: 1740562 - RNA, 15 nt, Human
acucuuguuuccuua

SEQ ID NO: 1740563 - RNA, 20 nt, Human
acugaacucugacaacagac

SEQ ID NO: 1740564 - RNA, 13 nt, Human
acugaacauucca

SEQ ID NO: 1740565 - RNA, 16 nt, Human
acugaacauuccagag

SEQ ID NO: 1740566 - RNA, 13 nt, Human
acugauaaagaug

SEQ ID NO: 1740567 - RNA, 21 nt, Human
acugauaaagaugagugagca

SEQ ID NO: 1740568 - RNA, 20 nt, Human
acugcaacuuguaaaugugg

SEQ ID NO: 1740569 - RNA, 16 nt, Human
acugcaacuucugccu

SEQ ID NO: 1740570 - RNA, 14 nt, Human
acugcaacuucugc

SEQ ID NO: 1740571 - RNA, 14 nt, Human
acugcaccgggcca

SEQ ID NO: 1740572 - RNA, 20 nt, Human
acugcacuauagccuaggug

SEQ ID NO: 1740573 - RNA, 16 nt, Human
acugcaccgggccaca

SEQ ID NO: 1740574 - RNA, 23 nt, Human
acugcacagugcaucucagccca

SEQ ID NO: 1740575 - RNA, 21 nt, Human
uccugcacacgcuccuuccuc

SEQ ID NO: 1740576 - RNA, 14 nt, Human
uccugcacacgcuc

SEQ ID NO: 1740577 - RNA, 22 nt, Human
uccugcacacgcuccuuccucu

SEQ ID NO: 1740578 - RNA, 21 nt, Human
uccugaugcuucuucagagac

SEQ ID NO: 1740579 - RNA, 20 nt, Human
uccugaugcuucuucagaga

SEQ ID NO: 1740580 - RNA, 19 nt, Human
uccugaugcuucuucagag

SEQ ID NO: 1740581 - RNA, 20 nt, Human
acugcacuccagccugggug

SEQ ID NO: 1740582 - RNA, 19 nt, Human
acugcacuccagccugggu

SEQ ID NO: 1740583 - RNA, 18 nt, Human
acugcacuccagccuggg

SEQ ID NO: 1740584 - RNA, 17 nt, Human
acugcacuccagccugg

SEQ ID NO: 1740585 - RNA, 14 nt, Human
acugcacuccagcc

SEQ ID NO: 1740586 - RNA, 21 nt, Human
acugcacuauagccuagguga

SEQ ID NO: 1740587 - RNA, 15 nt, Human
uccuggaaauauuaa

SEQ ID NO: 1740588 - RNA, 23 nt, Human
uccuggaagugcuaauuuugaaa

SEQ ID NO: 1740589 - RNA, 17 nt, Human
uccugggagugagcugg

SEQ ID NO: 1740590 - RNA, 14 nt, Human
uccugggagugagc

SEQ ID NO: 1740591 - RNA, 12 nt, Human
uccugggaguga

SEQ ID NO: 1740592 - RNA, 15 nt, Human
uccugcaggcagcca

SEQ ID NO: 1740593 - RNA, 14 nt, Human
uccugcaggcagcc

SEQ ID NO: 1740594 - RNA, 13 nt, Human
uccugcaggcagc

SEQ ID NO: 1740595 - RNA, 12 nt, Human
uccugcaggcag

SEQ ID NO: 1740596 - RNA, 15 nt, Human
acuaauuuuaaaaug

SEQ ID NO: 1740597 - RNA, 22 nt, Human
acguuucuaaaggcuaccuuug

SEQ ID NO: 1740598 - RNA, 18 nt, Human
ucccagauacuugggggg

SEQ ID NO: 1740599 - RNA, 16 nt, Human
ucccagauacuugggg

SEQ ID NO: 1740600 - RNA, 19 nt, Human
uccauccugaggcuccacu

SEQ ID NO: 1740601 - RNA, 12 nt, Human
uccauccugagg

SEQ ID NO: 1740602 - RNA, 15 nt, Human
uccauccugaggcuc

SEQ ID NO: 1740603 - RNA, 17 nt, Human
acguaaagcuagaaaug

SEQ ID NO: 1740604 - RNA, 18 nt, Human
acguaaagcuagaaauga

SEQ ID NO: 1740605 - RNA, 16 nt, Human
acguuucuaaaggcua

SEQ ID NO: 1740606 - RNA, 14 nt, Human
acguugugcauuug

SEQ ID NO: 1740607 - RNA, 15 nt, Human
acguugugcauuugg

SEQ ID NO: 1740608 - RNA, 13 nt, Human
acguugugcauuu

SEQ ID NO: 1740609 - RNA, 15 nt, Human
acguuaccaggcagg

SEQ ID NO: 1740610 - RNA, 21 nt, Human
acguggcugcuucaaggaucc

SEQ ID NO: 1740611 - RNA, 19 nt, Human
acguggcugcuucaaggau

SEQ ID NO: 1740612 - RNA, 18 nt, Human
acguggcugcuucaagga

SEQ ID NO: 1740613 - RNA, 16 nt, Human
acucaaugcacugaca

SEQ ID NO: 1740614 - RNA, 14 nt, Human
acuauguugcccag

SEQ ID NO: 1740615 - RNA, 22 nt, Human
acuauggcccuggccuagcaua

SEQ ID NO: 1740616 - RNA, 16 nt, Human
acuauguugcccaggc

SEQ ID NO: 1740617 - RNA, 15 nt, Human
acuauguugcccagg

SEQ ID NO: 1740618 - RNA, 17 nt, Human
acuauguugcccaggca

SEQ ID NO: 1740619 - RNA, 21 nt, Human
acuaucuaaauguugaaagau

SEQ ID NO: 1740620 - RNA, 16 nt, Human
acuaucuaaauguuga

SEQ ID NO: 1740621 - RNA, 22 nt, Human
acuauagccuaggugacagagu

SEQ ID NO: 1740622 - RNA, 20 nt, Human
acuauagccuaggugacaga

SEQ ID NO: 1740623 - RNA, 18 nt, Human
uccccaggaggccagccu

SEQ ID NO: 1740624 - RNA, 16 nt, Human
uccccaccgcagacag

SEQ ID NO: 1740625 - RNA, 15 nt, Human
uccccaccgcagaca

SEQ ID NO: 1740626 - RNA, 23 nt, Human
uccccacccugaaagcccugagc

SEQ ID NO: 1740627 - RNA, 21 nt, Human
uccccaggaggccagccuuga

SEQ ID NO: 1740628 - RNA, 20 nt, Human
uccccaggaggccagccuug

SEQ ID NO: 1740629 - RNA, 11 nt, Human
ucccccagccc

SEQ ID NO: 1740630 - RNA, 15 nt, Human
ucccccagccccauc

SEQ ID NO: 1740631 - RNA, 13 nt, Human
ucccccagcccca

SEQ ID NO: 1740632 - RNA, 16 nt, Human
ucccccagccccaucc

SEQ ID NO: 1740633 - RNA, 19 nt, Human
acuagacucccaagcugga

SEQ ID NO: 1740634 - RNA, 12 nt, Human
acggccaggcca

SEQ ID NO: 1740635 - RNA, 18 nt, Human
acggcucacugcagccuc

SEQ ID NO: 1740636 - RNA, 17 nt, Human
acggcucacugcagccu

SEQ ID NO: 1740637 - RNA, 16 nt, Human
acggcucacugcagcc

SEQ ID NO: 1740638 - RNA, 13 nt, Human
acggccaggccag

SEQ ID NO: 1740639 - RNA, 15 nt, Human
uccaguaucuugaag

SEQ ID NO: 1740640 - RNA, 14 nt, Human
uccaguaucuugaa

SEQ ID NO: 1740641 - RNA, 18 nt, Human
acggcuuuuacuuaaacc

SEQ ID NO: 1740642 - RNA, 18 nt, Human
uccagugagacagcucug

SEQ ID NO: 1740643 - RNA, 15 nt, Human
uccagugaggcucug

SEQ ID NO: 1740644 - RNA, 16 nt, Human
uccagugaggcucugc

SEQ ID NO: 1740645 - RNA, 23 nt, Human
uccagugaggcucugcccuuggu

SEQ ID NO: 1740646 - RNA, 22 nt, Human
uccagugaggcucugcccuugg

SEQ ID NO: 1740647 - RNA, 18 nt, Human
uccaguaucuugaagacu

SEQ ID NO: 1740648 - RNA, 16 nt, Human
uccaguaucuugaaga

SEQ ID NO: 1740649 - RNA, 11 nt, Human
acgcucucugg

SEQ ID NO: 1740650 - RNA, 14 nt, Human
acgcucucuggccu

SEQ ID NO: 1740651 - RNA, 13 nt, Human
acgcuggaccuug

SEQ ID NO: 1740652 - RNA, 15 nt, Human
acgcuccuuccucug

SEQ ID NO: 1740653 - RNA, 14 nt, Human
acgcuccuuccucu

SEQ ID NO: 1740654 - RNA, 16 nt, Human
acgcuggagugcagug

SEQ ID NO: 1740655 - RNA, 15 nt, Human
acgcuggagugcagu

SEQ ID NO: 1740656 - RNA, 23 nt, Human
acgcuggaccuugaacuggguac

SEQ ID NO: 1740657 - RNA, 20 nt, Human
acgcuggaccuugaacuggg

SEQ ID NO: 1740658 - RNA, 18 nt, Human
acgcuggagugcagugag

SEQ ID NO: 1740659 - RNA, 17 nt, Human
acgcuggagugcaguga

SEQ ID NO: 1740660 - RNA, 23 nt, Human
acggagucccaccuuggcugcag

SEQ ID NO: 1740661 - RNA, 21 nt, Human
acgaauauugcugauggugca

SEQ ID NO: 1740662 - RNA, 21 nt, Human
acgcuacccgggaagggggcu

SEQ ID NO: 1740663 - RNA, 20 nt, Human
acgcgugcacacaccagagc

SEQ ID NO: 1740664 - RNA, 13 nt, Human
accuuuuuuauac

SEQ ID NO: 1740665 - RNA, 22 nt, Human
uccacugguucuucuuggucuc

SEQ ID NO: 1740666 - RNA, 21 nt, Human
uccacugugccaugugccagg

SEQ ID NO: 1740667 - RNA, 18 nt, Human
uccagaauggucuuucua

SEQ ID NO: 1740668 - RNA, 19 nt, Human
accuugaaaacuuuaugcu

SEQ ID NO: 1740669 - RNA, 20 nt, Human
accuugaacuggguacuugu

SEQ ID NO: 1740670 - RNA, 18 nt, Human
accuuuguccccaccgca

SEQ ID NO: 1740671 - RNA, 22 nt, Human
accuuuguuugcaucugaaaau

SEQ ID NO: 1740672 - RNA, 17 nt, Human
accuuuguccccaccgc

SEQ ID NO: 1740673 - RNA, 18 nt, Human
accuuugacaaagguaaa

SEQ ID NO: 1740674 - RNA, 17 nt, Human
accuuugacaaagguaa

SEQ ID NO: 1740675 - RNA, 21 nt, Human
uccaggcugggagagccuucc

SEQ ID NO: 1740676 - RNA, 20 nt, Human
uccaggcugggagagccuuc

SEQ ID NO: 1740677 - RNA, 22 nt, Human
uccaggcuccuuuagcgcccag

SEQ ID NO: 1740678 - RNA, 12 nt, Human
uccaggcuccuu

SEQ ID NO: 1740679 - RNA, 10 nt, Human
uccaggcucc

SEQ ID NO: 1740680 - RNA, 18 nt, Human
acgaauauugcugauggu

SEQ ID NO: 1740681 - RNA, 15 nt, Human
acgaauauugcugau

SEQ ID NO: 1740682 - RNA, 23 nt, Human
uccaggcugggagagccuuccag

SEQ ID NO: 1740683 - RNA, 15 nt, Human
uccagaauuucccaa

SEQ ID NO: 1740684 - RNA, 14 nt, Human
uccagaauuuccca

SEQ ID NO: 1740685 - RNA, 13 nt, Human
uccagaccccugg

SEQ ID NO: 1740686 - RNA, 11 nt, Human
uccagccuggg

SEQ ID NO: 1740687 - RNA, 20 nt, Human
uccagccugcugccugcuuu

SEQ ID NO: 1740688 - RNA, 20 nt, Human
ucauauuuuaaacagaggau

SEQ ID NO: 1740689 - RNA, 16 nt, Human
ucauauuuacuucuua

SEQ ID NO: 1740690 - RNA, 17 nt, Human
accgagucucuucucca

SEQ ID NO: 1740691 - RNA, 16 nt, Human
accgagucucuucucc

SEQ ID NO: 1740692 - RNA, 23 nt, Human
ucauauuuacuucuuauacauuu

SEQ ID NO: 1740693 - RNA, 15 nt, Human
ucauauuuacuucuu

SEQ ID NO: 1740694 - RNA, 21 nt, Human
ucauaguaugguggcuggguu

SEQ ID NO: 1740695 - RNA, 18 nt, Human
ucauauaagauucauauu

SEQ ID NO: 1740696 - RNA, 19 nt, Human
ucauaguaugguggcuggg

SEQ ID NO: 1740697 - RNA, 18 nt, Human
ucauaguaugguggcugg

SEQ ID NO: 1740698 - RNA, 15 nt, Human
ucauaguaugguggc

SEQ ID NO: 1740699 - RNA, 14 nt, Human
ucauaaccuagccu

SEQ ID NO: 1740700 - RNA, 16 nt, Human
ucaguuuucaggagug

SEQ ID NO: 1740701 - RNA, 17 nt, Human
ucaguuuuugugaaaag

SEQ ID NO: 1740702 - RNA, 15 nt, Human
ucaguuuuugugaaa

SEQ ID NO: 1740703 - RNA, 11 nt, Human
ucaguggcagc

SEQ ID NO: 1740704 - RNA, 18 nt, Human
ucagugccuuauggaaca

SEQ ID NO: 1740705 - RNA, 16 nt, Human
ucagugccuuauggaa

SEQ ID NO: 1740706 - RNA, 13 nt, Human
ucaguggcagcug

SEQ ID NO: 1740707 - RNA, 12 nt, Human
ucaguggcagcu

SEQ ID NO: 1740708 - RNA, 16 nt, Human
ucaguggggaggggcu

SEQ ID NO: 1740709 - RNA, 15 nt, Human
ucagugccuuaugga

SEQ ID NO: 1740710 - RNA, 14 nt, Human
ucagugccuuaugg

SEQ ID NO: 1740711 - RNA, 12 nt, Human
ucagugccuuau

SEQ ID NO: 1740712 - RNA, 11 nt, Human
ucagugccuua

SEQ ID NO: 1740713 - RNA, 10 nt, Human
ucagugccuu

SEQ ID NO: 1740714 - RNA, 9 nt, Human
ucagugccu

SEQ ID NO: 1740715 - RNA, 20 nt, Human
ucagugcccuccaggauaga

SEQ ID NO: 1740716 - RNA, 19 nt, Human
accgaaaacguggcugcuu

SEQ ID NO: 1740717 - RNA, 17 nt, Human
accgaaaacguggcugc

SEQ ID NO: 1740718 - RNA, 12 nt, Human
ucagugccacua

SEQ ID NO: 1740719 - RNA, 16 nt, Human
ucagugccaaaaacaa

SEQ ID NO: 1740720 - RNA, 16 nt, Human
accgcagacaggacca

SEQ ID NO: 1740721 - RNA, 12 nt, Human
accgcagacagg

SEQ ID NO: 1740722 - RNA, 17 nt, Human
accgcagacaggaccag

SEQ ID NO: 1740723 - RNA, 20 nt, Human
accucccacaaaggagagcu

SEQ ID NO: 1740724 - RNA, 14 nt, Human
ucaugcaaacuuua

SEQ ID NO: 1740725 - RNA, 11 nt, Human
ucaugauuuuu

SEQ ID NO: 1740726 - RNA, 13 nt, Human
ucaucuaggauuu

SEQ ID NO: 1740727 - RNA, 13 nt, Human
ucauccauccagg

SEQ ID NO: 1740728 - RNA, 23 nt, Human
ucaugcaaacuuuauuuuguguu

SEQ ID NO: 1740729 - RNA, 16 nt, Human
ucaugugaaaucauuc

SEQ ID NO: 1740730 - RNA, 17 nt, Human
ucaugugaaaucauuca

SEQ ID NO: 1740731 - RNA, 15 nt, Human
ucagcaaaagaugcu

SEQ ID NO: 1740732 - RNA, 18 nt, Human
accaguguuguggauuua

SEQ ID NO: 1740733 - RNA, 12 nt, Human
ucagauuugaac

SEQ ID NO: 1740734 - RNA, 21 nt, Human
ucagauuugaacucuucaauc

SEQ ID NO: 1740735 - RNA, 22 nt, Human
accccagccccaaaacucuccu

SEQ ID NO: 1740736 - RNA, 13 nt, Human
accccagccccaa

SEQ ID NO: 1740737 - RNA, 17 nt, Human
accccacacacgccaga

SEQ ID NO: 1740738 - RNA, 23 nt, Human
acccaggagccccgaggccuucu

SEQ ID NO: 1740739 - RNA, 19 nt, Human
acccaggagccccgaggcc

SEQ ID NO: 1740740 - RNA, 17 nt, Human
ucagcccucccugcccc

SEQ ID NO: 1740741 - RNA, 16 nt, Human
ucagcccucccugccc

SEQ ID NO: 1740742 - RNA, 15 nt, Human
ucagcccucccugcc

SEQ ID NO: 1740743 - RNA, 14 nt, Human
ucagcccucccugc

SEQ ID NO: 1740744 - RNA, 13 nt, Human
ucagcccucccug

SEQ ID NO: 1740745 - RNA, 15 nt, Human
accccugagcuugca

SEQ ID NO: 1740746 - RNA, 18 nt, Human
accccaucucuacaaaaa

SEQ ID NO: 1740747 - RNA, 23 nt, Human
ucagcggggacagcuccuucugu

SEQ ID NO: 1740748 - RNA, 21 nt, Human
ucagcggggacagcuccuucu

SEQ ID NO: 1740749 - RNA, 20 nt, Human
ucagcggggacagcuccuuc

SEQ ID NO: 1740750 - RNA, 19 nt, Human
ucagcggggacagcuccuu

SEQ ID NO: 1740751 - RNA, 12 nt, Human
ucagcuccagcu

SEQ ID NO: 1740752 - RNA, 21 nt, Human
accccuggcuuuucacugcug

SEQ ID NO: 1740753 - RNA, 20 nt, Human
accccuggcuuuucacugcu

SEQ ID NO: 1740754 - RNA, 19 nt, Human
accccuggcuuuucacugc

SEQ ID NO: 1740755 - RNA, 18 nt, Human
accccuggcuuuucacug

SEQ ID NO: 1740756 - RNA, 17 nt, Human
acccgggaggcagaggu

SEQ ID NO: 1740757 - RNA, 13 nt, Human
acccgggaagggg

SEQ ID NO: 1740758 - RNA, 12 nt, Human
acccgggaaggg

SEQ ID NO: 1740759 - RNA, 20 nt, Human
acccggccccugcugguuca

SEQ ID NO: 1740760 - RNA, 17 nt, Human
acccggccccugcuggu

SEQ ID NO: 1740761 - RNA, 22 nt, Human
acccggccccugcugguucagg

SEQ ID NO: 1740762 - RNA, 16 nt, Human
acccggccccugcugg

SEQ ID NO: 1740763 - RNA, 15 nt, Human
acccggccccugcug

SEQ ID NO: 1740764 - RNA, 14 nt, Human
acccggccccugcu

SEQ ID NO: 1740765 - RNA, 21 nt, Human
acccggaggggccuggcagcc

SEQ ID NO: 1740766 - RNA, 18 nt, Human
acccggaggggccuggca

SEQ ID NO: 1740767 - RNA, 22 nt, Human
ucagguaacaggcagauacagg

SEQ ID NO: 1740768 - RNA, 21 nt, Human
ucagguaacaggcagauacag

SEQ ID NO: 1740769 - RNA, 23 nt, Human
ucagguaacaggcagauacagga

SEQ ID NO: 1740770 - RNA, 17 nt, Human
ucaggguuggccccugc

SEQ ID NO: 1740771 - RNA, 16 nt, Human
ucaggguuggccccug

SEQ ID NO: 1740772 - RNA, 19 nt, Human
ucagggucccugguggcag

SEQ ID NO: 1740773 - RNA, 23 nt, Human
ucaggccaggcccucugcccacu

SEQ ID NO: 1740774 - RNA, 22 nt, Human
ucagcuuguaaauagcucaggu

SEQ ID NO: 1740775 - RNA, 21 nt, Human
ucagcuuguaaauagcucagg

SEQ ID NO: 1740776 - RNA, 15 nt, Human
ucagcuccagcucac

SEQ ID NO: 1740777 - RNA, 14 nt, Human
ucagcuccagcuca

SEQ ID NO: 1740778 - RNA, 22 nt, Human
ucaggccaggcccucugcccac

SEQ ID NO: 1740779 - RNA, 21 nt, Human
ucaggccaggcccucugccca

SEQ ID NO: 1740780 - RNA, 15 nt, Human
acccugcccuguggg

SEQ ID NO: 1740781 - RNA, 17 nt, Human
acccugaggcccagagg

SEQ ID NO: 1740782 - RNA, 16 nt, Human
acccugaggcccagag

SEQ ID NO: 1740783 - RNA, 15 nt, Human
acccugaggcccaga

SEQ ID NO: 1740784 - RNA, 22 nt, Human
acccugcccugugggcccccaa

SEQ ID NO: 1740785 - RNA, 17 nt, Human
acccugcccugugggcc

SEQ ID NO: 1740786 - RNA, 12 nt, Human
acccuucuuuuc

SEQ ID NO: 1740787 - RNA, 23 nt, Human
acccuuguggucccaccccacac

SEQ ID NO: 1740788 - RNA, 20 nt, Human
acccuuguggucccacccca

SEQ ID NO: 1740789 - RNA, 17 nt, Human
acccuugccgucuaccu

SEQ ID NO: 1740790 - RNA, 15 nt, Human
accgaaaacguggcu

SEQ ID NO: 1740791 - RNA, 14 nt, Human
acccugaggcccag

SEQ ID NO: 1740792 - RNA, 18 nt, Human
acccugaaagcccugagc

SEQ ID NO: 1740793 - RNA, 16 nt, Human
acccugaaagcccuga

SEQ ID NO: 1740794 - RNA, 19 nt, Human
acccucgaggcggaucuuu

SEQ ID NO: 1740795 - RNA, 14 nt, Human
ucaaauuucuaaau

SEQ ID NO: 1740796 - RNA, 13 nt, Human
ucaaauuucuaaa

SEQ ID NO: 1740797 - RNA, 14 nt, Human
ucaaccagcagaug

SEQ ID NO: 1740798 - RNA, 18 nt, Human
ucaaccauuccccauggg

SEQ ID NO: 1740799 - RNA, 15 nt, Human
ucaaccauuccccau

SEQ ID NO: 1740800 - RNA, 20 nt, Human
ucaacugcaucaagauguga

SEQ ID NO: 1740801 - RNA, 14 nt, Human
acauuccugaugcu

SEQ ID NO: 1740802 - RNA, 23 nt, Human
acauguaauuaaguacuauguau

SEQ ID NO: 1740803 - RNA, 15 nt, Human
acauguccaagaagc

SEQ ID NO: 1740804 - RNA, 19 nt, Human
acauguccaagaagcccag

SEQ ID NO: 1740805 - RNA, 14 nt, Human
acauggaaguacua

SEQ ID NO: 1740806 - RNA, 22 nt, Human
acauguaauuaaguacuaugua

SEQ ID NO: 1740807 - RNA, 21 nt, Human
acauguaauuaaguacuaugu

SEQ ID NO: 1740808 - RNA, 19 nt, Human
acauguaauuaaguacuau

SEQ ID NO: 1740809 - RNA, 17 nt, Human
acauguaauuaaguacu

SEQ ID NO: 1740810 - RNA, 15 nt, Human
acauguaauuaagua

SEQ ID NO: 1740811 - RNA, 23 nt, Human
acaugagguacugagagugaaca

SEQ ID NO: 1740812 - RNA, 15 nt, Human
acaugcuacacacug

SEQ ID NO: 1740813 - RNA, 21 nt, Human
acaugcuacacacugcauguu

SEQ ID NO: 1740814 - RNA, 20 nt, Human
acaugagguacugagaguga

SEQ ID NO: 1740815 - RNA, 12 nt, Human
acagucccugcc

SEQ ID NO: 1740816 - RNA, 20 nt, Human
acaugaauauuuaguguuca

SEQ ID NO: 1740817 - RNA, 23 nt, Human
ucaaugaaugaaugaauggcuaa

SEQ ID NO: 1740818 - RNA, 22 nt, Human
ucaauaucuuuuuuuuaauaaa

SEQ ID NO: 1740819 - RNA, 18 nt, Human
acauuuuauuuuauuaug

SEQ ID NO: 1740820 - RNA, 14 nt, Human
acauuuuauuuuau

SEQ ID NO: 1740821 - RNA, 19 nt, Human
acauuuuauuuuauuaugc

SEQ ID NO: 1740822 - RNA, 20 nt, Human
acauuuuauuuuauuaugca

SEQ ID NO: 1740823 - RNA, 15 nt, Human
acauugcaauagaaa

SEQ ID NO: 1740824 - RNA, 16 nt, Human
acauugcaauagaaau

SEQ ID NO: 1740825 - RNA, 14 nt, Human
acauugcaauagaa

SEQ ID NO: 1740826 - RNA, 21 nt, Human
acauuuuuaagugcugcauuu

SEQ ID NO: 1740827 - RNA, 22 nt, Human
acauuuuuaagugcugcauuua

SEQ ID NO: 1740828 - RNA, 23 nt, Human
acauuuuuaagugcugcauuuaa

SEQ ID NO: 1740829 - RNA, 11 nt, Human
acauuuuguau

SEQ ID NO: 1740830 - RNA, 14 nt, Human
acauuuuuuaaaug

SEQ ID NO: 1740831 - RNA, 16 nt, Human
acauuuuuuaaaugca

SEQ ID NO: 1740832 - RNA, 17 nt, Human
acauuuuuuaaaugcac

SEQ ID NO: 1740833 - RNA, 21 nt, Human
acauuuuuuaaaugcaccugg

SEQ ID NO: 1740834 - RNA, 23 nt, Human
ucacuguugcccaggcuggcgug

SEQ ID NO: 1740835 - RNA, 13 nt, Human
ucacugcauccuc

SEQ ID NO: 1740836 - RNA, 15 nt, Human
ucacugcagccucaa

SEQ ID NO: 1740837 - RNA, 14 nt, Human
ucacugcagccuca

SEQ ID NO: 1740838 - RNA, 22 nt, Human
ucacugagacagcccgggcucu

SEQ ID NO: 1740839 - RNA, 21 nt, Human
ucacugagacagcccgggcuc

SEQ ID NO: 1740840 - RNA, 17 nt, Human
ucacugagacagcccgg

SEQ ID NO: 1740841 - RNA, 16 nt, Human
ucacugagacagcccg

SEQ ID NO: 1740842 - RNA, 17 nt, Human
ucacuauguugcccagg

SEQ ID NO: 1740843 - RNA, 20 nt, Human
ucacuaucccggcugcccuu

SEQ ID NO: 1740844 - RNA, 19 nt, Human
ucacuaucccggcugcccu

SEQ ID NO: 1740845 - RNA, 23 nt, Human
ucacuugaacccgggaggcagag

SEQ ID NO: 1740846 - RNA, 10 nt, Human
ucacuugagu

SEQ ID NO: 1740847 - RNA, 15 nt, Human
accaguguuguggau

SEQ ID NO: 1740848 - RNA, 17 nt, Human
accaguguuguggauuu

SEQ ID NO: 1740849 - RNA, 18 nt, Human
ucacguaaagcuagaaau

SEQ ID NO: 1740850 - RNA, 16 nt, Human
ucacuaggcuucuggu

SEQ ID NO: 1740851 - RNA, 19 nt, Human
ucacguaaagcuagaaaug

SEQ ID NO: 1740852 - RNA, 20 nt, Human
ucacguaaagcuagaaauga

SEQ ID NO: 1740853 - RNA, 17 nt, Human
accacuacauucuguua

SEQ ID NO: 1740854 - RNA, 16 nt, Human
accacuacauucuguu

SEQ ID NO: 1740855 - RNA, 15 nt, Human
accacuacauucugu

SEQ ID NO: 1740856 - RNA, 22 nt, Human
accagcgugugacuacuccccc

SEQ ID NO: 1740857 - RNA, 17 nt, Human
ucacaaaggaugcccaa

SEQ ID NO: 1740858 - RNA, 16 nt, Human
ucaauucuugccaaau

SEQ ID NO: 1740859 - RNA, 20 nt, Human
ucacaguucucuccuucuuc

SEQ ID NO: 1740860 - RNA, 16 nt, Human
ucacaguucucuccuu

SEQ ID NO: 1740861 - RNA, 13 nt, Human
ucacagccucuga

SEQ ID NO: 1740862 - RNA, 21 nt, Human
ucacagaugugugauucacag

SEQ ID NO: 1740863 - RNA, 23 nt, Human
ucacagaugugugauucacagug

SEQ ID NO: 1740864 - RNA, 20 nt, Human
ucacagaugggugcuuggag

SEQ ID NO: 1740865 - RNA, 14 nt, Human
ucacaaccuucugu

SEQ ID NO: 1740866 - RNA, 15 nt, Human
ucaccauguuggcca

SEQ ID NO: 1740867 - RNA, 22 nt, Human
ucaccauguuggccaggcuggu

SEQ ID NO: 1740868 - RNA, 21 nt, Human
ucaccauguuggccaggcugg

SEQ ID NO: 1740869 - RNA, 19 nt, Human
accacaucuugcucugcug

SEQ ID NO: 1740870 - RNA, 18 nt, Human
accacaucuugcucugcu

SEQ ID NO: 1740871 - RNA, 17 nt, Human
accacaucuugcucugc

SEQ ID NO: 1740872 - RNA, 18 nt, Human
accacaugugcacaugca

SEQ ID NO: 1740873 - RNA, 24 nt, Human
accacauuggagauguuuaguaau

SEQ ID NO: 1740874 - RNA, 19 nt, Human
accaccaacuacuaccugu

SEQ ID NO: 1740875 - RNA, 20 nt, Human
accaccacacccagcccacu

SEQ ID NO: 1740876 - RNA, 15 nt, Human
accaccacacccagc

SEQ ID NO: 1740877 - RNA, 20 nt, Human
uaacgauaaaagacagugaa

SEQ ID NO: 1740878 - RNA, 18 nt, Human
uaacauggugugcuucuu

SEQ ID NO: 1740879 - RNA, 12 nt, Human
uaacuagaacug

SEQ ID NO: 1740880 - RNA, 14 nt, Human
uaacuagaacugaa

SEQ ID NO: 1740881 - RNA, 17 nt, Human
uaacuagaacugaauuu

SEQ ID NO: 1740882 - RNA, 20 nt, Human
uaacuagaacugaauuuugu

SEQ ID NO: 1740883 - RNA, 21 nt, Human
uaacuucacauauugauuucc

SEQ ID NO: 1740884 - RNA, 17 nt, Human
uaacuuccaauuuacau

SEQ ID NO: 1740885 - RNA, 14 nt, Human
uaacuucaccauau

SEQ ID NO: 1740886 - RNA, 18 nt, Human
uaagaagugaaaaucuac

SEQ ID NO: 1740887 - RNA, 13 nt, Human
uaagacaaauaug

SEQ ID NO: 1740888 - RNA, 16 nt, Human
uaacuuucugaaauaa

SEQ ID NO: 1740889 - RNA, 18 nt, Human
uaacauggacaugaucuu

SEQ ID NO: 1740890 - RNA, 17 nt, Human
uaacauguaauuaagua

SEQ ID NO: 1740891 - RNA, 23 nt, Human
uaacauggacaugaucuucuuua

SEQ ID NO: 1740892 - RNA, 17 nt, Human
uaacaguggacaaaguu

SEQ ID NO: 1740893 - RNA, 18 nt, Human
aauauauuuuaagacgaa

SEQ ID NO: 1740894 - RNA, 16 nt, Human
aauaguggugugauuu

SEQ ID NO: 1740895 - RNA, 22 nt, Human
aauaguggugugauuuggggau

SEQ ID NO: 1740896 - RNA, 13 nt, Human
aauaguuggcuag

SEQ ID NO: 1740897 - RNA, 15 nt, Human
aauauauuuuaagac

SEQ ID NO: 1740898 - RNA, 14 nt, Human
aauauauuuuaaga

SEQ ID NO: 1740899 - RNA, 14 nt, Human
aauaguuguugauu

SEQ ID NO: 1740900 - RNA, 14 nt, Human
uaagauuccagaga

SEQ ID NO: 1740901 - RNA, 21 nt, Human
uaagauuccagagaguggcuc

SEQ ID NO: 1740902 - RNA, 22 nt, Human
uaagcuguuacugucuucagua

SEQ ID NO: 1740903 - RNA, 18 nt, Human
uaagcacacuugacauca

SEQ ID NO: 1740904 - RNA, 15 nt, Human
aauauuccugcauuu

SEQ ID NO: 1740905 - RNA, 12 nt, Human
aauauuccagag

SEQ ID NO: 1740906 - RNA, 22 nt, Human
aauaugcacacauuuuuuaaau

SEQ ID NO: 1740907 - RNA, 16 nt, Human
aauaugcacacauuuu

SEQ ID NO: 1740908 - RNA, 17 nt, Human
aauaugcacacauuuuu

SEQ ID NO: 1740909 - RNA, 15 nt, Human
uaagagaaaugagcu

SEQ ID NO: 1740910 - RNA, 12 nt, Human
aauauuuagugu

SEQ ID NO: 1740911 - RNA, 17 nt, Human
aauauugauaugcuuau

SEQ ID NO: 1740912 - RNA, 23 nt, Human
aauauuguacaguuuuuauugcu

SEQ ID NO: 1740913 - RNA, 15 nt, Human
aauauuguacaguuu

SEQ ID NO: 1740914 - RNA, 17 nt, Human
aauauuguacaguuuuu

SEQ ID NO: 1740915 - RNA, 21 nt, Human
aauccuggggaacauagaacu

SEQ ID NO: 1740916 - RNA, 14 nt, Human
aauccuggggaaca

SEQ ID NO: 1740917 - RNA, 15 nt, Human
aaucgaccugccucg

SEQ ID NO: 1740918 - RNA, 15 nt, Human
aaucauuagguguga

SEQ ID NO: 1740919 - RNA, 17 nt, Human
aaucauuaggugugacu

SEQ ID NO: 1740920 - RNA, 23 nt, Human
aaucauuaggugugacugaauuu

SEQ ID NO: 1740921 - RNA, 12 nt, Human
aauccgcccauc

SEQ ID NO: 1740922 - RNA, 19 nt, Human
aaucuuauaauuuaaaaua

SEQ ID NO: 1740923 - RNA, 17 nt, Human
aaucugggccagaauuu

SEQ ID NO: 1740924 - RNA, 16 nt, Human
aaucugggccagaauu

SEQ ID NO: 1740925 - RNA, 19 nt, Human
aaucuacacuccagugaga

SEQ ID NO: 1740926 - RNA, 18 nt, Human
uaauaaacacucuugaaa

SEQ ID NO: 1740927 - RNA, 12 nt, Human
uaauaaacacuc

SEQ ID NO: 1740928 - RNA, 19 nt, Human
uaaguauucuuauuuaaug

SEQ ID NO: 1740929 - RNA, 20 nt, Human
uaaguauucuuauuuaauga

SEQ ID NO: 1740930 - RNA, 21 nt, Human
uaaguauucuuauuuaaugaa

SEQ ID NO: 1740931 - RNA, 19 nt, Human
uaaguacuauguaucaaug

SEQ ID NO: 1740932 - RNA, 17 nt, Human
uaaguacuauguaucaa

SEQ ID NO: 1740933 - RNA, 16 nt, Human
uaaguacuauguauca

SEQ ID NO: 1740934 - RNA, 13 nt, Human
uaaguacuaugua

SEQ ID NO: 1740935 - RNA, 15 nt, Human
uaaugaaugcauaaa

SEQ ID NO: 1740936 - RNA, 13 nt, Human
uaauguacugcau

SEQ ID NO: 1740937 - RNA, 19 nt, Human
uaauguaucaaauacauuu

SEQ ID NO: 1740938 - RNA, 18 nt, Human
uaaugucacaggcagguc

SEQ ID NO: 1740939 - RNA, 16 nt, Human
aaucuuuaauuuuaca

SEQ ID NO: 1740940 - RNA, 15 nt, Human
aaucuuuaauuuuac

SEQ ID NO: 1740941 - RNA, 13 nt, Human
aaugaaugucagu

SEQ ID NO: 1740942 - RNA, 22 nt, Human
aaugaauggcuaagcaaaaugu

SEQ ID NO: 1740943 - RNA, 17 nt, Human
aaugaaugcauaaaaug

SEQ ID NO: 1740944 - RNA, 22 nt, Human
aaugaaugucagugugacugau

SEQ ID NO: 1740945 - RNA, 13 nt, Human
aaugacacagucu

SEQ ID NO: 1740946 - RNA, 17 nt, Human
aaugaaacauuuuguca

SEQ ID NO: 1740947 - RNA, 13 nt, Human
aaucuuucugcag

SEQ ID NO: 1740948 - RNA, 17 nt, Human
aaugaaaccugugucuc

SEQ ID NO: 1740949 - RNA, 17 nt, Human
aaugaaagacuguacaa

SEQ ID NO: 1740950 - RNA, 16 nt, Human
aaugaaagacuguaca

SEQ ID NO: 1740951 - RNA, 17 nt, Human
uaaugaaugaaacauuu

SEQ ID NO: 1740952 - RNA, 18 nt, Human
uaauagacaauuuauuau

SEQ ID NO: 1740953 - RNA, 22 nt, Human
uaauagacaauuuauuauggca

SEQ ID NO: 1740954 - RNA, 19 nt, Human
uaauagcgucauaacuaga

SEQ ID NO: 1740955 - RNA, 16 nt, Human
uaauacaccacuacau

SEQ ID NO: 1740956 - RNA, 18 nt, Human
uaauacaccacuacauuc

SEQ ID NO: 1740957 - RNA, 19 nt, Human
uaauacaccacuacauucu

SEQ ID NO: 1740958 - RNA, 14 nt, Human
uaauagacaauuua

SEQ ID NO: 1740959 - RNA, 16 nt, Human
uaauagacaauuuauu

SEQ ID NO: 1740960 - RNA, 15 nt, Human
aauuagccaagugug

SEQ ID NO: 1740961 - RNA, 11 nt, Human
aauuacaggaa

SEQ ID NO: 1740962 - RNA, 20 nt, Human
uaccugccaggaagccagca

SEQ ID NO: 1740963 - RNA, 18 nt, Human
uaccugccaggaagccag

SEQ ID NO: 1740964 - RNA, 23 nt, Human
uaccugccaggaagccagcaggc

SEQ ID NO: 1740965 - RNA, 17 nt, Human
uaccugucccccugaca

SEQ ID NO: 1740966 - RNA, 16 nt, Human
uaccugucccccugac

SEQ ID NO: 1740967 - RNA, 14 nt, Human
uaccugucccccug

SEQ ID NO: 1740968 - RNA, 13 nt, Human
uaccugucccccu

SEQ ID NO: 1740969 - RNA, 10 nt, Human
uaccuguccc

SEQ ID NO: 1740970 - RNA, 18 nt, Human
aauuccaagugauugaaa

SEQ ID NO: 1740971 - RNA, 22 nt, Human
aauuccacuuauaggaauugac

SEQ ID NO: 1740972 - RNA, 12 nt, Human
aauuccccagau

SEQ ID NO: 1740973 - RNA, 14 nt, Human
aauuccccacccug

SEQ ID NO: 1740974 - RNA, 16 nt, Human
aauuauuauuuggccc

SEQ ID NO: 1740975 - RNA, 16 nt, Human
uacuggagaaaaugga

SEQ ID NO: 1740976 - RNA, 12 nt, Human
uacucuguguca

SEQ ID NO: 1740977 - RNA, 21 nt, Human
uacucugugucagguggggca

SEQ ID NO: 1740978 - RNA, 18 nt, Human
uacuguaaggcaaucaug

SEQ ID NO: 1740979 - RNA, 19 nt, Human
uacuguaauuugugauaca

SEQ ID NO: 1740980 - RNA, 20 nt, Human
uacuguaauuugugauacaa

SEQ ID NO: 1740981 - RNA, 18 nt, Human
uacuguaauuugugauac

SEQ ID NO: 1740982 - RNA, 19 nt, Human
uacuguaaggcaaucaugg

SEQ ID NO: 1740983 - RNA, 22 nt, Human
aauugacccacaagaaaugaaa

SEQ ID NO: 1740984 - RNA, 14 nt, Human
aauugacuuauuua

SEQ ID NO: 1740985 - RNA, 21 nt, Human
aauugacccacaagaaaugaa

SEQ ID NO: 1740986 - RNA, 23 nt, Human
uacuguaauuugugauacaaugc

SEQ ID NO: 1740987 - RNA, 21 nt, Human
uacuguacaugaaaacacauu

SEQ ID NO: 1740988 - RNA, 22 nt, Human
uacuguacaugaaaacacauuu

SEQ ID NO: 1740989 - RNA, 12 nt, Human
aauugcauuucc

SEQ ID NO: 1740990 - RNA, 19 nt, Human
aauugaugggauuugguca

SEQ ID NO: 1740991 - RNA, 21 nt, Human
aauugacuuauuuauauaaau

SEQ ID NO: 1740992 - RNA, 22 nt, Human
uacgccaggggaaaaucagccu

SEQ ID NO: 1740993 - RNA, 18 nt, Human
uacgggaggguaaggcug

SEQ ID NO: 1740994 - RNA, 12 nt, Human
uacguacacauu

SEQ ID NO: 1740995 - RNA, 13 nt, Human
uacguacacauuu

SEQ ID NO: 1740996 - RNA, 14 nt, Human
uacguacacauuuu

SEQ ID NO: 1740997 - RNA, 15 nt, Human
uacguugugcauuug

SEQ ID NO: 1740998 - RNA, 16 nt, Human
uacguugugcauuugg

SEQ ID NO: 1740999 - RNA, 20 nt, Human
uacuaucaugucaaacguga

SEQ ID NO: 1741000 - RNA, 17 nt, Human
uacuacuccuguaggaa

SEQ ID NO: 1741001 - RNA, 13 nt, Human
uacuacuccugua

SEQ ID NO: 1741002 - RNA, 23 nt, Human
uacucuccuggaaauauuaagaa

SEQ ID NO: 1741003 - RNA, 22 nt, Human
uacucuccuggaaauauuaaga

SEQ ID NO: 1741004 - RNA, 14 nt, Human
uacuauguaucaau

SEQ ID NO: 1741005 - RNA, 13 nt, Human
uacuauguaucaa

SEQ ID NO: 1741006 - RNA, 12 nt, Human
uacuauguauca

SEQ ID NO: 1741007 - RNA, 23 nt, Human
uacuauggcccuggccuagcaua

SEQ ID NO: 1741008 - RNA, 23 nt, Human
aauggcacaaucucggcucacug

SEQ ID NO: 1741009 - RNA, 12 nt, Human
aauggcagccuu

SEQ ID NO: 1741010 - RNA, 16 nt, Human
aauggcagccuuggca

SEQ ID NO: 1741011 - RNA, 15 nt, Human
uacacuaaaagguga

SEQ ID NO: 1741012 - RNA, 23 nt, Human
uacacauuuuauuuuauuaugca

SEQ ID NO: 1741013 - RNA, 21 nt, Human
uacacauuuuauuuuauuaug

SEQ ID NO: 1741014 - RNA, 22 nt, Human
uacacauuuuauuuuauuaugc

SEQ ID NO: 1741015 - RNA, 19 nt, Human
uacacauuuuauuuuauua

SEQ ID NO: 1741016 - RNA, 22 nt, Human
uacagacaacaaaccuguuucu

SEQ ID NO: 1741017 - RNA, 20 nt, Human
uacagauccccaagccuggc

SEQ ID NO: 1741018 - RNA, 22 nt, Human
aaugcuguauuagucacagaga

SEQ ID NO: 1741019 - RNA, 12 nt, Human
aaugcccagccc

SEQ ID NO: 1741020 - RNA, 11 nt, Human
aaugcccagcc

SEQ ID NO: 1741021 - RNA, 13 nt, Human
aaugcccagcccc

SEQ ID NO: 1741022 - RNA, 20 nt, Human
aauggacuaacuugucuuug

SEQ ID NO: 1741023 - RNA, 23 nt, Human
aauggacguguuaugacuccaga

SEQ ID NO: 1741024 - RNA, 14 nt, Human
aauggaaccacucu

SEQ ID NO: 1741025 - RNA, 21 nt, Human
aauggaaaugggcagagcaga

SEQ ID NO: 1741026 - RNA, 20 nt, Human
aauggaaaugggcagagcag

SEQ ID NO: 1741027 - RNA, 16 nt, Human
aaugcuucaucccuuu

SEQ ID NO: 1741028 - RNA, 22 nt, Human
aaugcacuuuguucuggcucuu

SEQ ID NO: 1741029 - RNA, 21 nt, Human
aaugcacuuuguucuggcucu

SEQ ID NO: 1741030 - RNA, 20 nt, Human
aaugaccuuucaauaggaaa

SEQ ID NO: 1741031 - RNA, 17 nt, Human
aaugaccuuucaauagg

SEQ ID NO: 1741032 - RNA, 16 nt, Human
aaugaccuuucaauag

SEQ ID NO: 1741033 - RNA, 18 nt, Human
aaugaccuuucaauagga

SEQ ID NO: 1741034 - RNA, 21 nt, Human
uacaaugcugugcccuaaagu

SEQ ID NO: 1741035 - RNA, 13 nt, Human
uacauucuguuaa

SEQ ID NO: 1741036 - RNA, 21 nt, Human
aauuaagaaaggauaaaguug

SEQ ID NO: 1741037 - RNA, 22 nt, Human
aauuaaucugggccagaauuuc

SEQ ID NO: 1741038 - RNA, 11 nt, Human
aauuaacuuuu

SEQ ID NO: 1741039 - RNA, 16 nt, Human
uacaggugugagucac

SEQ ID NO: 1741040 - RNA, 23 nt, Human
uacauaaugcgugcauaccacuu

SEQ ID NO: 1741041 - RNA, 24 nt, Human
uacauaaugcgugcauaccacuuu

SEQ ID NO: 1741042 - RNA, 15 nt, Human
aaugugaaacuggau

SEQ ID NO: 1741043 - RNA, 19 nt, Human
aaugugaaaagaaaaauga

SEQ ID NO: 1741044 - RNA, 14 nt, Human
aaugugaaacugga

SEQ ID NO: 1741045 - RNA, 11 nt, Human
aaugugugugu

SEQ ID NO: 1741046 - RNA, 20 nt, Human
aauguauguguaaguauucu

SEQ ID NO: 1741047 - RNA, 18 nt, Human
aauguaucaaauacauuu

SEQ ID NO: 1741048 - RNA, 19 nt, Human
aauguauguguaaguauuc

SEQ ID NO: 1741049 - RNA, 20 nt, Human
acagggaggacgcucucugg

SEQ ID NO: 1741050 - RNA, 21 nt, Human
acagggaggacgcucucuggc

SEQ ID NO: 1741051 - RNA, 23 nt, Human
acaggcugggcuucaguggcagc

SEQ ID NO: 1741052 - RNA, 22 nt, Human
acaggcugggcuucaguggcag

SEQ ID NO: 1741053 - RNA, 12 nt, Human
acaggcugggcu

SEQ ID NO: 1741054 - RNA, 22 nt, Human
acaggcuccugccaccacgccc

SEQ ID NO: 1741055 - RNA, 21 nt, Human
acaggcuccugccaccacgcc

SEQ ID NO: 1741056 - RNA, 15 nt, Human
acaggcuccugccac

SEQ ID NO: 1741057 - RNA, 13 nt, Human
acaggcuccugcc

SEQ ID NO: 1741058 - RNA, 20 nt, Human
acagggcacaccgggcacuc

SEQ ID NO: 1741059 - RNA, 12 nt, Human
acagggcacacc

SEQ ID NO: 1741060 - RNA, 21 nt, Human
uauucagcucauggacuucug

SEQ ID NO: 1741061 - RNA, 20 nt, Human
uauucaguaauaacucuacc

SEQ ID NO: 1741062 - RNA, 14 nt, Human
uauucaggaagcuc

SEQ ID NO: 1741063 - RNA, 16 nt, Human
uauucaggaagcucag

SEQ ID NO: 1741064 - RNA, 14 nt, Human
uauucauaauuauu

SEQ ID NO: 1741065 - RNA, 22 nt, Human
acaggcgugagccaccgugccu

SEQ ID NO: 1741066 - RNA, 12 nt, Human
acaggcuccugc

SEQ ID NO: 1741067 - RNA, 13 nt, Human
uauuacuucugcu

SEQ ID NO: 1741068 - RNA, 14 nt, Human
uauuacuucugcua

SEQ ID NO: 1741069 - RNA, 19 nt, Human
uauuagugaccucagcuuu

SEQ ID NO: 1741070 - RNA, 21 nt, Human
uauuagugaccucagcuuuga

SEQ ID NO: 1741071 - RNA, 20 nt, Human
acaggcauguucucugagga

SEQ ID NO: 1741072 - RNA, 19 nt, Human
acaggcauguucucugagg

SEQ ID NO: 1741073 - RNA, 18 nt, Human
acaggcauguucucugag

SEQ ID NO: 1741074 - RNA, 15 nt, Human
acaggcauguucucu

SEQ ID NO: 1741075 - RNA, 22 nt, Human
acaggcauguucucugaggaca

SEQ ID NO: 1741076 - RNA, 14 nt, Human
uaugugaaacaugu

SEQ ID NO: 1741077 - RNA, 20 nt, Human
uauguggaguucaucuugaa

SEQ ID NO: 1741078 - RNA, 23 nt, Human
uaugugccagauuuaugcauauu

SEQ ID NO: 1741079 - RNA, 17 nt, Human
uaugugaaacauguuuc

SEQ ID NO: 1741080 - RNA, 17 nt, Human
acaggaaguagaggagg

SEQ ID NO: 1741081 - RNA, 13 nt, Human
acaggaaguacug

SEQ ID NO: 1741082 - RNA, 18 nt, Human
acaggaaaagcugcugac

SEQ ID NO: 1741083 - RNA, 17 nt, Human
acaggaaaagcugcuga

SEQ ID NO: 1741084 - RNA, 16 nt, Human
acaggaaaagcugcug

SEQ ID NO: 1741085 - RNA, 15 nt, Human
acaggaaaagcugcu

SEQ ID NO: 1741086 - RNA, 13 nt, Human
acagcuaacaugg

SEQ ID NO: 1741087 - RNA, 11 nt, Human
acagccuggca

SEQ ID NO: 1741088 - RNA, 23 nt, Human
acaggaccagggauuuccaugau

SEQ ID NO: 1741089 - RNA, 14 nt, Human
acaggacucugccu

SEQ ID NO: 1741090 - RNA, 15 nt, Human
acaggaucagucuga

SEQ ID NO: 1741091 - RNA, 14 nt, Human
acaggaucagucug

SEQ ID NO: 1741092 - RNA, 16 nt, Human
acaggagugagcacua

SEQ ID NO: 1741093 - RNA, 16 nt, Human
acaggcagguccaggg

SEQ ID NO: 1741094 - RNA, 14 nt, Human
acaggcagguccag

SEQ ID NO: 1741095 - RNA, 14 nt, Human
acaggcauguucuc

SEQ ID NO: 1741096 - RNA, 16 nt, Human
uauauuuaguaucuuu

SEQ ID NO: 1741097 - RNA, 15 nt, Human
acagacccugcccug

SEQ ID NO: 1741098 - RNA, 14 nt, Human
acagacccugcccu

SEQ ID NO: 1741099 - RNA, 13 nt, Human
acagacccugccc

SEQ ID NO: 1741100 - RNA, 18 nt, Human
acagaaaauucuucucca

SEQ ID NO: 1741101 - RNA, 17 nt, Human
acagaaaauucuucucc

SEQ ID NO: 1741102 - RNA, 20 nt, Human
acagaaaauggaagacagcu

SEQ ID NO: 1741103 - RNA, 14 nt, Human
acagaaauguacag

SEQ ID NO: 1741104 - RNA, 16 nt, Human
acagaaauguacagca

SEQ ID NO: 1741105 - RNA, 17 nt, Human
acagaaauguacagcaa

SEQ ID NO: 1741106 - RNA, 23 nt, Human
uauaaguguguguuuuucauaaa

SEQ ID NO: 1741107 - RNA, 17 nt, Human
uauaaguguguguuuuu

SEQ ID NO: 1741108 - RNA, 18 nt, Human
uaucaaguauuauaccuu

SEQ ID NO: 1741109 - RNA, 14 nt, Human
uaucucccccagcc

SEQ ID NO: 1741110 - RNA, 16 nt, Human
uaucucccccagcccc

SEQ ID NO: 1741111 - RNA, 13 nt, Human
uaucucccccagc

SEQ ID NO: 1741112 - RNA, 18 nt, Human
acagagaaaguacuucuc

SEQ ID NO: 1741113 - RNA, 11 nt, Human
acagagaaagu

SEQ ID NO: 1741114 - RNA, 12 nt, Human
acagccuggcac

SEQ ID NO: 1741115 - RNA, 23 nt, Human
uauggcuuuugugcauuaucuag

SEQ ID NO: 1741116 - RNA, 15 nt, Human
uaugcuuauacacuu

SEQ ID NO: 1741117 - RNA, 18 nt, Human
uauggcuuuugugcauua

SEQ ID NO: 1741118 - RNA, 21 nt, Human
uauggcuuuugugcauuaucu

SEQ ID NO: 1741119 - RNA, 17 nt, Human
uauggcuuuugugcauu

SEQ ID NO: 1741120 - RNA, 17 nt, Human
uaugccugggcagaagg

SEQ ID NO: 1741121 - RNA, 11 nt, Human
uaugcauuuga

SEQ ID NO: 1741122 - RNA, 23 nt, Human
uaugcauuugaaaauuuugaugu

SEQ ID NO: 1741123 - RNA, 24 nt, Human
uaugcauuugaaaauuuugauguu

SEQ ID NO: 1741124 - RNA, 18 nt, Human
acagccguuuguucccca

SEQ ID NO: 1741125 - RNA, 17 nt, Human
acagcccgggcucugcc

SEQ ID NO: 1741126 - RNA, 21 nt, Human
acagcaaggagauuuacaacu

SEQ ID NO: 1741127 - RNA, 20 nt, Human
acagcccgggcucugccucc

SEQ ID NO: 1741128 - RNA, 19 nt, Human
acagcccgggcucugccuc

SEQ ID NO: 1741129 - RNA, 18 nt, Human
acagcccgggcucugccu

SEQ ID NO: 1741130 - RNA, 17 nt, Human
acagcaaggagauuuac

SEQ ID NO: 1741131 - RNA, 15 nt, Human
acagauuugagcuca

SEQ ID NO: 1741132 - RNA, 14 nt, Human
acagauuugagcuc

SEQ ID NO: 1741133 - RNA, 19 nt, Human
acagagcccacgcccccac

SEQ ID NO: 1741134 - RNA, 18 nt, Human
acagagcccacgccccca

SEQ ID NO: 1741135 - RNA, 15 nt, Human
acagagcccacgccc

SEQ ID NO: 1741136 - RNA, 17 nt, Human
acagauccccaagccug

SEQ ID NO: 1741137 - RNA, 18 nt, Human
acagauccccaagccugg

SEQ ID NO: 1741138 - RNA, 22 nt, Human
acagaucucugcuuuggaaauc

SEQ ID NO: 1741139 - RNA, 21 nt, Human
uagugaaucacguaaagcuag

SEQ ID NO: 1741140 - RNA, 18 nt, Human
acacaguauuacuucugc

SEQ ID NO: 1741141 - RNA, 22 nt, Human
acacaguauuacuucugcuaca

SEQ ID NO: 1741142 - RNA, 19 nt, Human
acacaguauuacuucugcu

SEQ ID NO: 1741143 - RNA, 21 nt, Human
acaaugcugugcccuaaagug

SEQ ID NO: 1741144 - RNA, 22 nt, Human
acaaugcugugcccuaaagugu

SEQ ID NO: 1741145 - RNA, 23 nt, Human
acaaugcugugcccuaaagugua

SEQ ID NO: 1741146 - RNA, 24 nt, Human
acaaugcugugcccuaaaguguau

SEQ ID NO: 1741147 - RNA, 19 nt, Human
acaauggauaggcacagga

SEQ ID NO: 1741148 - RNA, 17 nt, Human
acaaugugaaaagaaaa

SEQ ID NO: 1741149 - RNA, 19 nt, Human
acaaugugaaaagaaaaau

SEQ ID NO: 1741150 - RNA, 21 nt, Human
acacacugcauguuugugauu

SEQ ID NO: 1741151 - RNA, 21 nt, Human
acacacgcgugcacacaccag

SEQ ID NO: 1741152 - RNA, 20 nt, Human
acacaccagagcccaccuug

SEQ ID NO: 1741153 - RNA, 15 nt, Human
acacaccagagccca

SEQ ID NO: 1741154 - RNA, 14 nt, Human
acacaccagagccc

SEQ ID NO: 1741155 - RNA, 22 nt, Human
acacacacgcgugcacacacca

SEQ ID NO: 1741156 - RNA, 14 nt, Human
acacacagcucugu

SEQ ID NO: 1741157 - RNA, 13 nt, Human
acacacagcucug

SEQ ID NO: 1741158 - RNA, 17 nt, Human
acacacagcucuguccu

SEQ ID NO: 1741159 - RNA, 19 nt, Human
acacacagcucuguccugg

SEQ ID NO: 1741160 - RNA, 20 nt, Human
uaguuccaccaucaagccac

SEQ ID NO: 1741161 - RNA, 14 nt, Human
uaguuccacugaga

SEQ ID NO: 1741162 - RNA, 15 nt, Human
uaguuccacugagac

SEQ ID NO: 1741163 - RNA, 19 nt, Human
uauaaaagccuguuuaaga

SEQ ID NO: 1741164 - RNA, 22 nt, Human
uauaaaagggacugagaaauuu

SEQ ID NO: 1741165 - RNA, 20 nt, Human
uauaaaagccuguuuaagag

SEQ ID NO: 1741166 - RNA, 19 nt, Human
uauaaaaauaaaaaacacu

SEQ ID NO: 1741167 - RNA, 21 nt, Human
acacauuuuauuuuauuaugc

SEQ ID NO: 1741168 - RNA, 18 nt, Human
acacaugauccugcaauu

SEQ ID NO: 1741169 - RNA, 21 nt, Human
acacaugagcaucaggccagg

SEQ ID NO: 1741170 - RNA, 14 nt, Human
acacauuuuauuuu

SEQ ID NO: 1741171 - RNA, 19 nt, Human
acacauuuuauuuuauuau

SEQ ID NO: 1741172 - RNA, 20 nt, Human
acacauuuuauuuuauuaug

SEQ ID NO: 1741173 - RNA, 15 nt, Human
acacucaaaagcugg

SEQ ID NO: 1741174 - RNA, 22 nt, Human
acacucacauuuauucugcuca

SEQ ID NO: 1741175 - RNA, 20 nt, Human
acacucacauuuauucugcu

SEQ ID NO: 1741176 - RNA, 15 nt, Human
uauaaguguguguuu

SEQ ID NO: 1741177 - RNA, 16 nt, Human
acaccgggcacucaga

SEQ ID NO: 1741178 - RNA, 14 nt, Human
acaccgggccugga

SEQ ID NO: 1741179 - RNA, 21 nt, Human
acaccucugcacaagcugcac

SEQ ID NO: 1741180 - RNA, 20 nt, Human
acacuaaccacgcuggaccu

SEQ ID NO: 1741181 - RNA, 21 nt, Human
acaccuuagccugcccuccuu

SEQ ID NO: 1741182 - RNA, 19 nt, Human
acaaggacuaggguccugg

SEQ ID NO: 1741183 - RNA, 18 nt, Human
acaaggacuaggguccug

SEQ ID NO: 1741184 - RNA, 21 nt, Human
acaaggacagccccuccucca

SEQ ID NO: 1741185 - RNA, 22 nt, Human
acaaggacagccccuccuccau

SEQ ID NO: 1741186 - RNA, 12 nt, Human
acaaugacuuac

SEQ ID NO: 1741187 - RNA, 17 nt, Human
acaaugacuuacuguac

SEQ ID NO: 1741188 - RNA, 18 nt, Human
acaaugacuuacuguaca

SEQ ID NO: 1741189 - RNA, 19 nt, Human
acaaugacuuacuguacau

SEQ ID NO: 1741190 - RNA, 19 nt, Human
uagcuaauaacaugugaaa

SEQ ID NO: 1741191 - RNA, 16 nt, Human
uaggaaauccagggug

SEQ ID NO: 1741192 - RNA, 21 nt, Human
uagcuuacaagccagcuggag

SEQ ID NO: 1741193 - RNA, 13 nt, Human
uaggacuguagaa

SEQ ID NO: 1741194 - RNA, 14 nt, Human
uaggacuguagaaa

SEQ ID NO: 1741195 - RNA, 20 nt, Human
uaggcauuugcugaauacag

SEQ ID NO: 1741196 - RNA, 16 nt, Human
uaggcauuugcugaau

SEQ ID NO: 1741197 - RNA, 14 nt, Human
uaggcauuguggga

SEQ ID NO: 1741198 - RNA, 16 nt, Human
uagcauuuugcuaaau

SEQ ID NO: 1741199 - RNA, 18 nt, Human
uagcaugucgucaaagcu

SEQ ID NO: 1741200 - RNA, 22 nt, Human
uagcauuuugcuaaaugugaau

SEQ ID NO: 1741201 - RNA, 21 nt, Human
uagccaaggccaaaggaagca

SEQ ID NO: 1741202 - RNA, 14 nt, Human
uagaugcugacugu

SEQ ID NO: 1741203 - RNA, 23 nt, Human
uagaugcugacuguacuccuccc

SEQ ID NO: 1741204 - RNA, 19 nt, Human
uagcauggcugccaauggg

SEQ ID NO: 1741205 - RNA, 19 nt, Human
acaaauuuacagagacaga

SEQ ID NO: 1741206 - RNA, 18 nt, Human
acaaauuuacagagacag

SEQ ID NO: 1741207 - RNA, 15 nt, Human
uagccagaggagaga

SEQ ID NO: 1741208 - RNA, 11 nt, Human
uagccagagga

SEQ ID NO: 1741209 - RNA, 20 nt, Human
acaagacccaaaaggcagaa

SEQ ID NO: 1741210 - RNA, 19 nt, Human
acaagacccuugugguccc

SEQ ID NO: 1741211 - RNA, 19 nt, Human
acaagaccacguuucuaaa

SEQ ID NO: 1741212 - RNA, 21 nt, Human
acaacacucauugaccugagg

SEQ ID NO: 1741213 - RNA, 23 nt, Human
acaacacucauugaccugaggcc

SEQ ID NO: 1741214 - RNA, 18 nt, Human
acaaaaggauaaugaaua

SEQ ID NO: 1741215 - RNA, 11 nt, Human
acaaaagcaug

SEQ ID NO: 1741216 - RNA, 22 nt, Human
acaaaagcaugugagacugguu

SEQ ID NO: 1741217 - RNA, 16 nt, Human
aauuguuacaaauugu

SEQ ID NO: 1741218 - RNA, 21 nt, Human
aauuguguuuauaauuuuaaa

SEQ ID NO: 1741219 - RNA, 22 nt, Human
acaaaggaugcccaaagaugca

SEQ ID NO: 1741220 - RNA, 19 nt, Human
uagaggagaaacuggaacu

SEQ ID NO: 1741221 - RNA, 22 nt, Human
uagaggagaaacuggaacucuc

SEQ ID NO: 1741222 - RNA, 15 nt, Human
uagauauaugcucug

SEQ ID NO: 1741223 - RNA, 19 nt, Human
uagauauaugcucugcaug

SEQ ID NO: 1741224 - RNA, 11 nt, Human
gugauuaccag

SEQ ID NO: 1741225 - RNA, 16 nt, Human
gugauuaccagggacu

SEQ ID NO: 1741226 - RNA, 17 nt, Human
gugauuaccagggacug

SEQ ID NO: 1741227 - RNA, 23 nt, Human
gugaugguuccccuguucacucu

SEQ ID NO: 1741228 - RNA, 17 nt, Human
gugcauuugaggucugu

SEQ ID NO: 1741229 - RNA, 19 nt, Human
gugcauuugaggucuguuc

SEQ ID NO: 1741230 - RNA, 23 nt, Human
gugccaaaaacaacaacaaaaug

SEQ ID NO: 1741231 - RNA, 21 nt, Human
gugcauuuggugguuucagaa

SEQ ID NO: 1741232 - RNA, 21 nt, Human
gugcacaagcuccaagcuccc

SEQ ID NO: 1741233 - RNA, 16 nt, Human
gugcacaagcuccaag

SEQ ID NO: 1741234 - RNA, 13 nt, Human
gugcacaagcucc

SEQ ID NO: 1741235 - RNA, 18 nt, Human
gugcaaugaccuuucaau

SEQ ID NO: 1741236 - RNA, 21 nt, Human
gugcacaugcacgugugugca

SEQ ID NO: 1741237 - RNA, 23 nt, Human
gugcacaagcuccaagcucccag

SEQ ID NO: 1741238 - RNA, 22 nt, Human
gugcaaugaccuuucaauagga

SEQ ID NO: 1741239 - RNA, 13 nt, Human
aacuucagacaua

SEQ ID NO: 1741240 - RNA, 22 nt, Human
aacuucuccccugguagaaaga

SEQ ID NO: 1741241 - RNA, 14 nt, Human
aacuucacauauug

SEQ ID NO: 1741242 - RNA, 22 nt, Human
aacuucacauauugauuuccgu

SEQ ID NO: 1741243 - RNA, 22 nt, Human
aacuucaccauauuaccacaga

SEQ ID NO: 1741244 - RNA, 17 nt, Human
aacugcccccucugccc

SEQ ID NO: 1741245 - RNA, 16 nt, Human
aacugcccccucugcc

SEQ ID NO: 1741246 - RNA, 21 nt, Human
aacugcccccucugcccugcg

SEQ ID NO: 1741247 - RNA, 20 nt, Human
aacugcccccucugcccugc

SEQ ID NO: 1741248 - RNA, 19 nt, Human
aacugcccccucugcccug

SEQ ID NO: 1741249 - RNA, 18 nt, Human
aacugcccccucugcccu

SEQ ID NO: 1741250 - RNA, 14 nt, Human
aagaaagaaaauca

SEQ ID NO: 1741251 - RNA, 16 nt, Human
aagaaagaaaaucagg

SEQ ID NO: 1741252 - RNA, 19 nt, Human
aagaaagcccuuaggaaga

SEQ ID NO: 1741253 - RNA, 15 nt, Human
aagaaaauaguggug

SEQ ID NO: 1741254 - RNA, 21 nt, Human
aagaaaauaguggugugauuu

SEQ ID NO: 1741255 - RNA, 22 nt, Human
aagaaaauaguggugugauuug

SEQ ID NO: 1741256 - RNA, 18 nt, Human
aagaaaaaugagccuggc

SEQ ID NO: 1741257 - RNA, 17 nt, Human
aagaaaaaugagccugg

SEQ ID NO: 1741258 - RNA, 18 nt, Human
aagaaaaagaaaaagaaa

SEQ ID NO: 1741259 - RNA, 13 nt, Human
aagaaaaagaaaa

SEQ ID NO: 1741260 - RNA, 19 nt, Human
aagaaaaaauauuuucccu

SEQ ID NO: 1741261 - RNA, 21 nt, Human
aacuuuaccuuuuuuauacau

SEQ ID NO: 1741262 - RNA, 22 nt, Human
aacuuuaccuuuuuuauacaua

SEQ ID NO: 1741263 - RNA, 23 nt, Human
aacuuuaccuuuuuuauacauaa

SEQ ID NO: 1741264 - RNA, 19 nt, Human
gugccagauuuaugcauau

SEQ ID NO: 1741265 - RNA, 18 nt, Human
gugcuaucucccccagcc

SEQ ID NO: 1741266 - RNA, 15 nt, Human
gugcuaucuccccca

SEQ ID NO: 1741267 - RNA, 17 nt, Human
gugcuaggaacacuccu

SEQ ID NO: 1741268 - RNA, 15 nt, Human
gugcugcccugccca

SEQ ID NO: 1741269 - RNA, 14 nt, Human
gugcugcccugccc

SEQ ID NO: 1741270 - RNA, 13 nt, Human
gugcugcccugcc

SEQ ID NO: 1741271 - RNA, 12 nt, Human
gugcugcccugc

SEQ ID NO: 1741272 - RNA, 14 nt, Human
gugcucuggacagg

SEQ ID NO: 1741273 - RNA, 13 nt, Human
gugcucuggacag

SEQ ID NO: 1741274 - RNA, 16 nt, Human
gugcucugaucaucca

SEQ ID NO: 1741275 - RNA, 16 nt, Human
gugcucaggagcccug

SEQ ID NO: 1741276 - RNA, 19 nt, Human
gugcuaucucccccagccc

SEQ ID NO: 1741277 - RNA, 18 nt, Human
gugcucaggagcccuggg

SEQ ID NO: 1741278 - RNA, 19 nt, Human
gugcucaggagcccuggga

SEQ ID NO: 1741279 - RNA, 15 nt, Human
aacuaaaauaauuuu

SEQ ID NO: 1741280 - RNA, 19 nt, Human
aacuaaaauaauuuuguaa

SEQ ID NO: 1741281 - RNA, 17 nt, Human
aacuaaaauaauuuugu

SEQ ID NO: 1741282 - RNA, 17 nt, Human
aacuagggaagauaaua

SEQ ID NO: 1741283 - RNA, 21 nt, Human
aacuaggugcauauuuauaaa

SEQ ID NO: 1741284 - RNA, 17 nt, Human
aacguuuuuccuguucu

SEQ ID NO: 1741285 - RNA, 13 nt, Human
aacguggcugcuu

SEQ ID NO: 1741286 - RNA, 12 nt, Human
aacguggcugcu

SEQ ID NO: 1741287 - RNA, 15 nt, Human
aacuauguugauaaa

SEQ ID NO: 1741288 - RNA, 12 nt, Human
aacuauggccug

SEQ ID NO: 1741289 - RNA, 23 nt, Human
aaccuggucacaggacucugccu

SEQ ID NO: 1741290 - RNA, 12 nt, Human
aacgugaaaaug

SEQ ID NO: 1741291 - RNA, 21 nt, Human
aaccuucgccaccuggguucc

SEQ ID NO: 1741292 - RNA, 22 nt, Human
gucuuguuuuuuuuuuccacuu

SEQ ID NO: 1741293 - RNA, 20 nt, Human
gucuuguguuucuuuaguuu

SEQ ID NO: 1741294 - RNA, 16 nt, Human
gucuggaaugcagugg

SEQ ID NO: 1741295 - RNA, 15 nt, Human
gucuggaaugcagug

SEQ ID NO: 1741296 - RNA, 18 nt, Human
gucuggaaugcaguggua

SEQ ID NO: 1741297 - RNA, 14 nt, Human
gucugacaggcaau

SEQ ID NO: 1741298 - RNA, 13 nt, Human
gucugacaggcaa

SEQ ID NO: 1741299 - RNA, 12 nt, Human
gucugacaggca

SEQ ID NO: 1741300 - RNA, 18 nt, Human
gucugacaggcaaugcug

SEQ ID NO: 1741301 - RNA, 15 nt, Human
gucugacaggcaaug

SEQ ID NO: 1741302 - RNA, 20 nt, Human
gucugacaggcaaugcuggc

SEQ ID NO: 1741303 - RNA, 19 nt, Human
gucucaaaaaaagaaaaag

SEQ ID NO: 1741304 - RNA, 17 nt, Human
gucucaaaaaaagaaaa

SEQ ID NO: 1741305 - RNA, 14 nt, Human
gucucaaaaaaaca

SEQ ID NO: 1741306 - RNA, 14 nt, Human
gucugaaggcuggg

SEQ ID NO: 1741307 - RNA, 16 nt, Human
gugacuucagcucugu

SEQ ID NO: 1741308 - RNA, 19 nt, Human
gugacaugucuuuucuugc

SEQ ID NO: 1741309 - RNA, 22 nt, Human
gugacauguguuggcagccucu

SEQ ID NO: 1741310 - RNA, 16 nt, Human
gugagacucugucuca

SEQ ID NO: 1741311 - RNA, 14 nt, Human
gugagacucugucu

SEQ ID NO: 1741312 - RNA, 23 nt, Human
gugagaccugccccuccucucug

SEQ ID NO: 1741313 - RNA, 16 nt, Human
gugagaccugccccuc

SEQ ID NO: 1741314 - RNA, 22 nt, Human
gugagacccugucucaaaaaaa

SEQ ID NO: 1741315 - RNA, 15 nt, Human
gugagaccugccccu

SEQ ID NO: 1741316 - RNA, 14 nt, Human
gugagaccugcccc

SEQ ID NO: 1741317 - RNA, 13 nt, Human
gugagaccugccc

SEQ ID NO: 1741318 - RNA, 23 nt, Human
gugaauaauacaguaucucaggg

SEQ ID NO: 1741319 - RNA, 19 nt, Human
gugaaguuuaauugacuua

SEQ ID NO: 1741320 - RNA, 14 nt, Human
aacuccugaccuca

SEQ ID NO: 1741321 - RNA, 12 nt, Human
aacuccugaccu

SEQ ID NO: 1741322 - RNA, 22 nt, Human
gugacagagugagacucugucu

SEQ ID NO: 1741323 - RNA, 20 nt, Human
gugacagagugagacucugu

SEQ ID NO: 1741324 - RNA, 16 nt, Human
aacugcauuggcuuug

SEQ ID NO: 1741325 - RNA, 23 nt, Human
aacugauuuuuuuuuccuucagu

SEQ ID NO: 1741326 - RNA, 22 nt, Human
aacugauuuuuuuuuccuucag

SEQ ID NO: 1741327 - RNA, 21 nt, Human
aacugauuuuuuuuuccuuca

SEQ ID NO: 1741328 - RNA, 20 nt, Human
aacugauuuuuuuuuccuuc

SEQ ID NO: 1741329 - RNA, 23 nt, Human
aacucuccucugcugcuggcugg

SEQ ID NO: 1741330 - RNA, 22 nt, Human
aacucuccucugcugcuggcug

SEQ ID NO: 1741331 - RNA, 16 nt, Human
aacucugacaacagac

SEQ ID NO: 1741332 - RNA, 17 nt, Human
gugaggcucugcccuug

SEQ ID NO: 1741333 - RNA, 16 nt, Human
gugaggcucugcccuu

SEQ ID NO: 1741334 - RNA, 15 nt, Human
gugaggcucugcccu

SEQ ID NO: 1741335 - RNA, 14 nt, Human
gugaggcucugccc

SEQ ID NO: 1741336 - RNA, 13 nt, Human
gugaggcucugcc

SEQ ID NO: 1741337 - RNA, 12 nt, Human
gugaggcucugc

SEQ ID NO: 1741338 - RNA, 18 nt, Human
gugagacucugucucaaa

SEQ ID NO: 1741339 - RNA, 21 nt, Human
aacucuccucugcugcuggcu

SEQ ID NO: 1741340 - RNA, 19 nt, Human
aacucuccucugcugcugg

SEQ ID NO: 1741341 - RNA, 19 nt, Human
gugagucaccaagcccagu

SEQ ID NO: 1741342 - RNA, 17 nt, Human
gugagucaccaagccca

SEQ ID NO: 1741343 - RNA, 23 nt, Human
gugaguacuacaguccucccauc

SEQ ID NO: 1741344 - RNA, 18 nt, Human
gugaggcucugcccuugg

SEQ ID NO: 1741345 - RNA, 14 nt, Human
aaauuaaucugggc

SEQ ID NO: 1741346 - RNA, 15 nt, Human
aaauguggcuccugg

SEQ ID NO: 1741347 - RNA, 23 nt, Human
aaauuaugugccagauuuaugca

SEQ ID NO: 1741348 - RNA, 19 nt, Human
aaauuaggauuucaugauu

SEQ ID NO: 1741349 - RNA, 18 nt, Human
aaauuaggauuucaugau

SEQ ID NO: 1741350 - RNA, 17 nt, Human
aaauuccaagugauuga

SEQ ID NO: 1741351 - RNA, 16 nt, Human
aaauuccccacccuga

SEQ ID NO: 1741352 - RNA, 17 nt, Human
aaauuguauuacaaauc

SEQ ID NO: 1741353 - RNA, 18 nt, Human
aaauugucagaugcugug

SEQ ID NO: 1741354 - RNA, 21 nt, Human
aaaugucucuuuaaugucaca

SEQ ID NO: 1741355 - RNA, 14 nt, Human
aaaugucuuccugg

SEQ ID NO: 1741356 - RNA, 11 nt, Human
guauuuauuca

SEQ ID NO: 1741357 - RNA, 18 nt, Human
guauucucuccuguaccu

SEQ ID NO: 1741358 - RNA, 21 nt, Human
guauucucuccuguaccucuu

SEQ ID NO: 1741359 - RNA, 16 nt, Human
aaaucauucauuuucu

SEQ ID NO: 1741360 - RNA, 20 nt, Human
gucacaggaaguagaggagg

SEQ ID NO: 1741361 - RNA, 18 nt, Human
gucacaggacucugccuc

SEQ ID NO: 1741362 - RNA, 17 nt, Human
gucacaggacucugccu

SEQ ID NO: 1741363 - RNA, 12 nt, Human
gucacaggcagg

SEQ ID NO: 1741364 - RNA, 16 nt, Human
gucacaggagggaggg

SEQ ID NO: 1741365 - RNA, 19 nt, Human
gucacaggacucugccucc

SEQ ID NO: 1741366 - RNA, 22 nt, Human
gucaccaaaucagcugcuacua

SEQ ID NO: 1741367 - RNA, 21 nt, Human
gucaauuuuguuauguauauu

SEQ ID NO: 1741368 - RNA, 13 nt, Human
gucacaggaagua

SEQ ID NO: 1741369 - RNA, 15 nt, Human
gucacaggaaguaga

SEQ ID NO: 1741370 - RNA, 22 nt, Human
gucaauuacaggaaguacugga

SEQ ID NO: 1741371 - RNA, 23 nt, Human
gucacucuggcagcucagagagg

SEQ ID NO: 1741372 - RNA, 15 nt, Human
gucaccaagcccagu

SEQ ID NO: 1741373 - RNA, 12 nt, Human
gucaccaagccc

SEQ ID NO: 1741374 - RNA, 16 nt, Human
gucacugagacagccc

SEQ ID NO: 1741375 - RNA, 15 nt, Human
gucacugagacagcc

SEQ ID NO: 1741376 - RNA, 14 nt, Human
gucacugagacagc

SEQ ID NO: 1741377 - RNA, 23 nt, Human
gucacugagacagcccgggcucu

SEQ ID NO: 1741378 - RNA, 21 nt, Human
gucacugagacagcccgggcu

SEQ ID NO: 1741379 - RNA, 18 nt, Human
gucacugagacagcccgg

SEQ ID NO: 1741380 - RNA, 17 nt, Human
gucacugagacagcccg

SEQ ID NO: 1741381 - RNA, 10 nt, Human
gucacugcuu

SEQ ID NO: 1741382 - RNA, 23 nt, Human
gucacugcacagugcaucucagc

SEQ ID NO: 1741383 - RNA, 20 nt, Human
gucacugcacagugcaucuc

SEQ ID NO: 1741384 - RNA, 21 nt, Human
gucagaaguuucugccgcagc

SEQ ID NO: 1741385 - RNA, 23 nt, Human
gucagaaguuucugccgcagccc

SEQ ID NO: 1741386 - RNA, 17 nt, Human
gucacuuuguuuuacug

SEQ ID NO: 1741387 - RNA, 15 nt, Human
gucacugcuuaacuu

SEQ ID NO: 1741388 - RNA, 21 nt, Human
gucacugcuuaacuucacaua

SEQ ID NO: 1741389 - RNA, 22 nt, Human
gucagguggggcagcuugaggg

SEQ ID NO: 1741390 - RNA, 18 nt, Human
gucagguggggcagcuug

SEQ ID NO: 1741391 - RNA, 17 nt, Human
gucagguggggcagcuu

SEQ ID NO: 1741392 - RNA, 16 nt, Human
gucagguggggcagcu

SEQ ID NO: 1741393 - RNA, 15 nt, Human
gucagugugacugau

SEQ ID NO: 1741394 - RNA, 13 nt, Human
aaauuucuaaauc

SEQ ID NO: 1741395 - RNA, 15 nt, Human
aaauuucuaaaucuc

SEQ ID NO: 1741396 - RNA, 19 nt, Human
aaauuucuaaaucuccaaa

SEQ ID NO: 1741397 - RNA, 17 nt, Human
aaauuucucuacugucu

SEQ ID NO: 1741398 - RNA, 19 nt, Human
aacacaaacgggcucagca

SEQ ID NO: 1741399 - RNA, 18 nt, Human
aacacuguucucugcccu

SEQ ID NO: 1741400 - RNA, 17 nt, Human
aacacuguucucugccc

SEQ ID NO: 1741401 - RNA, 16 nt, Human
aacacuguucucugcc

SEQ ID NO: 1741402 - RNA, 19 nt, Human
aacacuguucucugcccuc

SEQ ID NO: 1741403 - RNA, 17 nt, Human
gucauuugagcagggcu

SEQ ID NO: 1741404 - RNA, 21 nt, Human
aacacucacauuuauucugcu

SEQ ID NO: 1741405 - RNA, 17 nt, Human
aacacucauugaccuga

SEQ ID NO: 1741406 - RNA, 21 nt, Human
aacacugggagaaaugaaaaa

SEQ ID NO: 1741407 - RNA, 22 nt, Human
guccaugaagauguagaggaga

SEQ ID NO: 1741408 - RNA, 23 nt, Human
guccaugaagauguagaggagaa

SEQ ID NO: 1741409 - RNA, 19 nt, Human
gucauuugagcagggcuca

SEQ ID NO: 1741410 - RNA, 18 nt, Human
guccccaccgcagacagg

SEQ ID NO: 1741411 - RNA, 20 nt, Human
gucccaccccacacacgcca

SEQ ID NO: 1741412 - RNA, 22 nt, Human
guccccaccgcagacaggacca

SEQ ID NO: 1741413 - RNA, 15 nt, Human
gucccaccccacaca

SEQ ID NO: 1741414 - RNA, 18 nt, Human
guccccuguuuguuucug

SEQ ID NO: 1741415 - RNA, 22 nt, Human
guccccuguuuguuucugaaag

SEQ ID NO: 1741416 - RNA, 12 nt, Human
gucccuaauaaa

SEQ ID NO: 1741417 - RNA, 19 nt, Human
gucccuuacgugaguccug

SEQ ID NO: 1741418 - RNA, 18 nt, Human
gucccuuacgugaguccu

SEQ ID NO: 1741419 - RNA, 19 nt, Human
gucccugguggcagcucac

SEQ ID NO: 1741420 - RNA, 18 nt, Human
gucccugguggcagcuca

SEQ ID NO: 1741421 - RNA, 15 nt, Human
gucccuaauaaagcu

SEQ ID NO: 1741422 - RNA, 18 nt, Human
aacaguccauugaaaggg

SEQ ID NO: 1741423 - RNA, 14 nt, Human
aacauuguagccuc

SEQ ID NO: 1741424 - RNA, 17 nt, Human
aacaugugaaaagaaua

SEQ ID NO: 1741425 - RNA, 22 nt, Human
gucuaugggacucaaugcacug

SEQ ID NO: 1741426 - RNA, 23 nt, Human
gucuaggcaggaccuguggccaa

SEQ ID NO: 1741427 - RNA, 16 nt, Human
gucuaccugaggggcc

SEQ ID NO: 1741428 - RNA, 15 nt, Human
gucuaccugaggggc

SEQ ID NO: 1741429 - RNA, 13 nt, Human
gucuaccugaggg

SEQ ID NO: 1741430 - RNA, 14 nt, Human
gucuaccugagggg

SEQ ID NO: 1741431 - RNA, 12 nt, Human
gucgccucugca

SEQ ID NO: 1741432 - RNA, 16 nt, Human
guccuggcaugggaau

SEQ ID NO: 1741433 - RNA, 19 nt, Human
guccugcugcaguugccag

SEQ ID NO: 1741434 - RNA, 14 nt, Human
guccucuuuucuga

SEQ ID NO: 1741435 - RNA, 12 nt, Human
gucgaggcagga

SEQ ID NO: 1741436 - RNA, 16 nt, Human
gucgaggacagggagg

SEQ ID NO: 1741437 - RNA, 21 nt, Human
uaaaaaaaaaccugagcccca

SEQ ID NO: 1741438 - RNA, 22 nt, Human
uaaaaagcuccaaaugcagcuu

SEQ ID NO: 1741439 - RNA, 23 nt, Human
uaaaaaucucaaauuucuaaauc

SEQ ID NO: 1741440 - RNA, 15 nt, Human
uaaaaaugagguacu

SEQ ID NO: 1741441 - RNA, 22 nt, Human
uaaaaaugagguacucuccugg

SEQ ID NO: 1741442 - RNA, 12 nt, Human
uaaaacuuuuua

SEQ ID NO: 1741443 - RNA, 15 nt, Human
uaaaacuuuuuaaaa

SEQ ID NO: 1741444 - RNA, 13 nt, Human
uaaaacccaagug

SEQ ID NO: 1741445 - RNA, 20 nt, Human
uaaaaguacauguuaaacuu

SEQ ID NO: 1741446 - RNA, 13 nt, Human
uaaaagucuugug

SEQ ID NO: 1741447 - RNA, 23 nt, Human
aagugauccucccaccucagccu

SEQ ID NO: 1741448 - RNA, 19 nt, Human
aagugauucucaugccuca

SEQ ID NO: 1741449 - RNA, 16 nt, Human
aagugauucucaugcc

SEQ ID NO: 1741450 - RNA, 13 nt, Human
aagugauucucau

SEQ ID NO: 1741451 - RNA, 17 nt, Human
aagugauucucaugccu

SEQ ID NO: 1741452 - RNA, 21 nt, Human
aagugauucuccugccucagc

SEQ ID NO: 1741453 - RNA, 20 nt, Human
aagugauccucccaccucag

SEQ ID NO: 1741454 - RNA, 19 nt, Human
aagugauccucccaccuca

SEQ ID NO: 1741455 - RNA, 13 nt, Human
aagugauccuccc

SEQ ID NO: 1741456 - RNA, 21 nt, Human
uaaaauaccagccaguaaaug

SEQ ID NO: 1741457 - RNA, 9 nt, Human
uaaaauggu

SEQ ID NO: 1741458 - RNA, 20 nt, Human
aaguuugagaucagccuggg

SEQ ID NO: 1741459 - RNA, 21 nt, Human
aaguuucugccgcagcccugc

SEQ ID NO: 1741460 - RNA, 19 nt, Human
aaguuucugccgcagcccu

SEQ ID NO: 1741461 - RNA, 20 nt, Human
aaguucccuacuuccuguga

SEQ ID NO: 1741462 - RNA, 17 nt, Human
aaguucccuacuuccug

SEQ ID NO: 1741463 - RNA, 14 nt, Human
aaguucccuacuuc

SEQ ID NO: 1741464 - RNA, 23 nt, Human
aaguguauuuuuuuacuaauaga

SEQ ID NO: 1741465 - RNA, 13 nt, Human
aagugugguagag

SEQ ID NO: 1741466 - RNA, 12 nt, Human
aaguguguguuu

SEQ ID NO: 1741467 - RNA, 21 nt, Human
aaguguguguuuuucauaaag

SEQ ID NO: 1741468 - RNA, 16 nt, Human
aaguguguguuuuuca

SEQ ID NO: 1741469 - RNA, 11 nt, Human
aaguuaagaau

SEQ ID NO: 1741470 - RNA, 23 nt, Human
aaguuaagaauguucuuauguug

SEQ ID NO: 1741471 - RNA, 14 nt, Human
aaguuacacauuuu

SEQ ID NO: 1741472 - RNA, 18 nt, Human
aaguuaguuccacugaga

SEQ ID NO: 1741473 - RNA, 19 nt, Human
aaguuaguuccacugagac

SEQ ID NO: 1741474 - RNA, 23 nt, Human
aagguuucagaaagaagugggga

SEQ ID NO: 1741475 - RNA, 23 nt, Human
aagggggcugggacaugggaaag

SEQ ID NO: 1741476 - RNA, 12 nt, Human
aagggggcuggg

SEQ ID NO: 1741477 - RNA, 13 nt, Human
aaggggagaguaa

SEQ ID NO: 1741478 - RNA, 20 nt, Human
aaggcugucaauuacaggaa

SEQ ID NO: 1741479 - RNA, 22 nt, Human
aaggcugggggaagaagcucuc

SEQ ID NO: 1741480 - RNA, 19 nt, Human
aaggcugggggaagaagcu

SEQ ID NO: 1741481 - RNA, 11 nt, Human
guuucagaaau

SEQ ID NO: 1741482 - RNA, 13 nt, Human
guuucagaaaugu

SEQ ID NO: 1741483 - RNA, 16 nt, Human
aaggcugggggaagaa

SEQ ID NO: 1741484 - RNA, 14 nt, Human
guuuaugauuccac

SEQ ID NO: 1741485 - RNA, 23 nt, Human
guuguuugauucagacagcugcc

SEQ ID NO: 1741486 - RNA, 22 nt, Human
aaggaaacccagcucuggucca

SEQ ID NO: 1741487 - RNA, 17 nt, Human
aaggaaacccagcucug

SEQ ID NO: 1741488 - RNA, 21 nt, Human
guuuaagugacugauggcuaa

SEQ ID NO: 1741489 - RNA, 22 nt, Human
aagucacugcacagugcaucuc

SEQ ID NO: 1741490 - RNA, 21 nt, Human
aaguauucuuauuuaaugaaa

SEQ ID NO: 1741491 - RNA, 16 nt, Human
aaguauuauaccuuuu

SEQ ID NO: 1741492 - RNA, 19 nt, Human
aaguauuauaccuuuuuua

SEQ ID NO: 1741493 - RNA, 23 nt, Human
aaguauucuuauuuaaugaaaga

SEQ ID NO: 1741494 - RNA, 15 nt, Human
aaguauuuuccuguu

SEQ ID NO: 1741495 - RNA, 15 nt, Human
aaguauuauaccuuu

SEQ ID NO: 1741496 - RNA, 20 nt, Human
aaguacuucuccacccugcu

SEQ ID NO: 1741497 - RNA, 19 nt, Human
aaguacuucuccacccugc

SEQ ID NO: 1741498 - RNA, 18 nt, Human
aaguacuucuccacccug

SEQ ID NO: 1741499 - RNA, 15 nt, Human
aaguacuauguauca

SEQ ID NO: 1741500 - RNA, 13 nt, Human
aaguacuauguau

SEQ ID NO: 1741501 - RNA, 17 nt, Human
aaguacuauaauuuacc

SEQ ID NO: 1741502 - RNA, 14 nt, Human
aaguacuauaauuu

SEQ ID NO: 1741503 - RNA, 22 nt, Human
guuuuaaggaugcuuguacaua

SEQ ID NO: 1741504 - RNA, 14 nt, Human
guuuucuguucuuu

SEQ ID NO: 1741505 - RNA, 15 nt, Human
guuuucuguucuuuc

SEQ ID NO: 1741506 - RNA, 16 nt, Human
guuuucuguucuuucu

SEQ ID NO: 1741507 - RNA, 19 nt, Human
guuuucuguucuuucuggc

SEQ ID NO: 1741508 - RNA, 13 nt, Human
guuuggagacaga

SEQ ID NO: 1741509 - RNA, 20 nt, Human
guuugcuuuguaugcacuuu

SEQ ID NO: 1741510 - RNA, 21 nt, Human
aaguaauaugcacacauuuuu

SEQ ID NO: 1741511 - RNA, 17 nt, Human
aaguaauaugcacacau

SEQ ID NO: 1741512 - RNA, 18 nt, Human
aaguaauaugcacacauu

SEQ ID NO: 1741513 - RNA, 20 nt, Human
aaguaauaugcacacauuuu

SEQ ID NO: 1741514 - RNA, 14 nt, Human
guucuugguuugua

SEQ ID NO: 1741515 - RNA, 15 nt, Human
guucuugguuuguaa

SEQ ID NO: 1741516 - RNA, 18 nt, Human
guucuugguuuguaaauu

SEQ ID NO: 1741517 - RNA, 19 nt, Human
guugauagcacagacccug

SEQ ID NO: 1741518 - RNA, 14 nt, Human
guugauagcacaga

SEQ ID NO: 1741519 - RNA, 22 nt, Human
guugauagcacagacccugccc

SEQ ID NO: 1741520 - RNA, 14 nt, Human
guucuuaauucuua

SEQ ID NO: 1741521 - RNA, 17 nt, Human
guucuuaauucuuagcu

SEQ ID NO: 1741522 - RNA, 18 nt, Human
guucucugcccuccaaga

SEQ ID NO: 1741523 - RNA, 17 nt, Human
guucucugcccuccaag

SEQ ID NO: 1741524 - RNA, 13 nt, Human
guucuuaauucuu

SEQ ID NO: 1741525 - RNA, 16 nt, Human
guucuuaagacgugau

SEQ ID NO: 1741526 - RNA, 15 nt, Human
guucucugcccucca

SEQ ID NO: 1741527 - RNA, 14 nt, Human
guucucugaggaca

SEQ ID NO: 1741528 - RNA, 12 nt, Human
guucucugagga

SEQ ID NO: 1741529 - RNA, 15 nt, Human
guucucucuucucca

SEQ ID NO: 1741530 - RNA, 19 nt, Human
guucuagcauggcugccaa

SEQ ID NO: 1741531 - RNA, 17 nt, Human
aagcucugcuccucucc

SEQ ID NO: 1741532 - RNA, 22 nt, Human
guucccuuuuuuggcugcugaa

SEQ ID NO: 1741533 - RNA, 21 nt, Human
guucccuuuuuuggcugcuga

SEQ ID NO: 1741534 - RNA, 21 nt, Human
aagcuuuuaugugaaacaugu

SEQ ID NO: 1741535 - RNA, 19 nt, Human
aagcuuuuaugugaaacau

SEQ ID NO: 1741536 - RNA, 15 nt, Human
guuccccaagacauu

SEQ ID NO: 1741537 - RNA, 18 nt, Human
guucccccuguuucagag

SEQ ID NO: 1741538 - RNA, 20 nt, Human
guuauuauauuuacaaaugg

SEQ ID NO: 1741539 - RNA, 22 nt, Human
guuauugguguaagguacuuuc

SEQ ID NO: 1741540 - RNA, 19 nt, Human
guuauuauauuuacaaaug

SEQ ID NO: 1741541 - RNA, 19 nt, Human
guuagagguucccuuugac

SEQ ID NO: 1741542 - RNA, 13 nt, Human
aagcccagcuuga

SEQ ID NO: 1741543 - RNA, 18 nt, Human
guuaaucauuagguguga

SEQ ID NO: 1741544 - RNA, 19 nt, Human
guuaauauuuauaggucac

SEQ ID NO: 1741545 - RNA, 23 nt, Human
guuacucuucaguuaagccuuug

SEQ ID NO: 1741546 - RNA, 15 nt, Human
aagccuccuccagcc

SEQ ID NO: 1741547 - RNA, 16 nt, Human
aagccucccacgacug

SEQ ID NO: 1741548 - RNA, 18 nt, Human
aagccuguuuaagagaca

SEQ ID NO: 1741549 - RNA, 15 nt, Human
aagccuguuuaagag

SEQ ID NO: 1741550 - RNA, 23 nt, Human
guucagcuuguaaauagcucagg

SEQ ID NO: 1741551 - RNA, 18 nt, Human
guuauuuugauguaaaga

SEQ ID NO: 1741552 - RNA, 22 nt, Human
guucaggguuggccccugcccg

SEQ ID NO: 1741553 - RNA, 21 nt, Human
guucaggguuggccccugccc

SEQ ID NO: 1741554 - RNA, 20 nt, Human
guucaggguuggccccugcc

SEQ ID NO: 1741555 - RNA, 21 nt, Human
aagccgugauuuucauugcug

SEQ ID NO: 1741556 - RNA, 15 nt, Human
aagccguggcuuccc

SEQ ID NO: 1741557 - RNA, 14 nt, Human
aagccguggcuucc

SEQ ID NO: 1741558 - RNA, 13 nt, Human
aagccguggcuuc

SEQ ID NO: 1741559 - RNA, 18 nt, Human
guucagguaacaggcaga

SEQ ID NO: 1741560 - RNA, 17 nt, Human
guucagguaacaggcag

SEQ ID NO: 1741561 - RNA, 16 nt, Human
aagcacuaaacaaaga

SEQ ID NO: 1741562 - RNA, 17 nt, Human
aagcaccuccugccucg

SEQ ID NO: 1741563 - RNA, 16 nt, Human
aagcaccuccugccuc

SEQ ID NO: 1741564 - RNA, 15 nt, Human
aagcaccuccugccu

SEQ ID NO: 1741565 - RNA, 14 nt, Human
aagcaccuccugcc

SEQ ID NO: 1741566 - RNA, 13 nt, Human
aagcaccuccugc

SEQ ID NO: 1741567 - RNA, 21 nt, Human
aagcacaugccucucucaggc

SEQ ID NO: 1741568 - RNA, 20 nt, Human
aagcacaugccucucucagg

SEQ ID NO: 1741569 - RNA, 19 nt, Human
aagcacaugccucucucag

SEQ ID NO: 1741570 - RNA, 16 nt, Human
aagcacaugccucucu

SEQ ID NO: 1741571 - RNA, 15 nt, Human
aagcacaugccucuc

SEQ ID NO: 1741572 - RNA, 14 nt, Human
aagcacaugccucu

SEQ ID NO: 1741573 - RNA, 16 nt, Human
aagcacacuugacauc

SEQ ID NO: 1741574 - RNA, 13 nt, Human
guguuucuuuagu

SEQ ID NO: 1741575 - RNA, 16 nt, Human
guguuucuuuaguuuu

SEQ ID NO: 1741576 - RNA, 12 nt, Human
aagcauuuugua

SEQ ID NO: 1741577 - RNA, 13 nt, Human
aagcauuuuguaa

SEQ ID NO: 1741578 - RNA, 20 nt, Human
aagccaaagcuaggccuggc

SEQ ID NO: 1741579 - RNA, 18 nt, Human
aagccaaagcuaggccug

SEQ ID NO: 1741580 - RNA, 17 nt, Human
aagccaaagcuaggccu

SEQ ID NO: 1741581 - RNA, 12 nt, Human
aagcaugugaga

SEQ ID NO: 1741582 - RNA, 23 nt, Human
aagcaugcacaaauucugucucu

SEQ ID NO: 1741583 - RNA, 15 nt, Human
gugguuucagaaaug

SEQ ID NO: 1741584 - RNA, 23 nt, Human
gugcugcccugcccaccuggccu

SEQ ID NO: 1741585 - RNA, 22 nt, Human
aagagggagggagggcuccaga

SEQ ID NO: 1741586 - RNA, 21 nt, Human
aagagggagggagggcuccag

SEQ ID NO: 1741587 - RNA, 14 nt, Human
aagaggcagggucu

SEQ ID NO: 1741588 - RNA, 11 nt, Human
aagaggcaggg

SEQ ID NO: 1741589 - RNA, 18 nt, Human
guguaagaaauacagacu

SEQ ID NO: 1741590 - RNA, 13 nt, Human
aagcaaaauguga

SEQ ID NO: 1741591 - RNA, 20 nt, Human
aagcaaaugugaaucauuuu

SEQ ID NO: 1741592 - RNA, 17 nt, Human
aagcaacccaaauguuc

SEQ ID NO: 1741593 - RNA, 20 nt, Human
aagaucaaaagguuaauaaa

SEQ ID NO: 1741594 - RNA, 23 nt, Human
aagaucaaaagguuaauaaagua

SEQ ID NO: 1741595 - RNA, 16 nt, Human
aagauggcugugccuc

SEQ ID NO: 1741596 - RNA, 23 nt, Human
aagauggcacuuauaaccaaagc

SEQ ID NO: 1741597 - RNA, 19 nt, Human
gugucagguggggcagcuu

SEQ ID NO: 1741598 - RNA, 20 nt, Human
gugucagguggggcagcuug

SEQ ID NO: 1741599 - RNA, 23 nt, Human
gugugaaccaccacacccagccc

SEQ ID NO: 1741600 - RNA, 18 nt, Human
gugucagguggggcagcu

SEQ ID NO: 1741601 - RNA, 14 nt, Human
gugucagguggggc

SEQ ID NO: 1741602 - RNA, 22 nt, Human
gugucaccugaagacucauucu

SEQ ID NO: 1741603 - RNA, 14 nt, Human
gugucaccugaaga

SEQ ID NO: 1741604 - RNA, 23 nt, Human
cuccacuuggucugugagaugcu

SEQ ID NO: 1741605 - RNA, 19 nt, Human
cuccacuuucuagccagag

SEQ ID NO: 1741606 - RNA, 16 nt, Human
cuccacuuucuagcca

SEQ ID NO: 1741607 - RNA, 20 nt, Human
cuccacuuucuagccagagg

SEQ ID NO: 1741608 - RNA, 13 nt, Human
cuccacuuggucu

SEQ ID NO: 1741609 - RNA, 15 nt, Human
cuccacuuggucugu

SEQ ID NO: 1741610 - RNA, 17 nt, Human
cuccaagcucccaggca

SEQ ID NO: 1741611 - RNA, 16 nt, Human
cuccacuggauggagg

SEQ ID NO: 1741612 - RNA, 16 nt, Human
cuccacuuggucugug

SEQ ID NO: 1741613 - RNA, 17 nt, Human
cuccacuuggucuguga

SEQ ID NO: 1741614 - RNA, 21 nt, Human
cuccacuuggucugugagaug

SEQ ID NO: 1741615 - RNA, 22 nt, Human
cuccacuuggucugugagaugc

SEQ ID NO: 1741616 - RNA, 16 nt, Human
cuccaagcucccaggc

SEQ ID NO: 1741617 - RNA, 15 nt, Human
cuccaagcucccagg

SEQ ID NO: 1741618 - RNA, 14 nt, Human
cuccaagcucccag

SEQ ID NO: 1741619 - RNA, 13 nt, Human
cuccaagcuccca

SEQ ID NO: 1741620 - RNA, 14 nt, Human
cuccaagcuccauc

SEQ ID NO: 1741621 - RNA, 19 nt, Human
cuccaagcuccaucuccac

SEQ ID NO: 1741622 - RNA, 18 nt, Human
cuccaagcuccaucucca

SEQ ID NO: 1741623 - RNA, 24 nt, Human
cuccaagcaggacauggacaagga

SEQ ID NO: 1741624 - RNA, 22 nt, Human
cuccaagcaggacauggacaag

SEQ ID NO: 1741625 - RNA, 14 nt, Human
cuccaagcaggaca

SEQ ID NO: 1741626 - RNA, 13 nt, Human
cuccaagcaggac

SEQ ID NO: 1741627 - RNA, 22 nt, Human
cuccaagaccuucuccuucacc

SEQ ID NO: 1741628 - RNA, 15 nt, Human
cuccaagaccuucuc

SEQ ID NO: 1741629 - RNA, 12 nt, Human
cucaugccucag

SEQ ID NO: 1741630 - RNA, 16 nt, Human
cucaugccucagccuc

SEQ ID NO: 1741631 - RNA, 17 nt, Human
cucagucucccucccuu

SEQ ID NO: 1741632 - RNA, 16 nt, Human
cucagucucccucccu

SEQ ID NO: 1741633 - RNA, 15 nt, Human
cucagucucccuccc

SEQ ID NO: 1741634 - RNA, 13 nt, Human
cucagucucccuc

SEQ ID NO: 1741635 - RNA, 21 nt, Human
cucgugguaggacuguagaaa

SEQ ID NO: 1741636 - RNA, 15 nt, Human
cucuaucaccaagga

SEQ ID NO: 1741637 - RNA, 16 nt, Human
cucgaacuggcugcaa

SEQ ID NO: 1741638 - RNA, 15 nt, Human
cucgaacuggcugca

SEQ ID NO: 1741639 - RNA, 14 nt, Human
cucgaacuggcugc

SEQ ID NO: 1741640 - RNA, 13 nt, Human
cucgaacuggcug

SEQ ID NO: 1741641 - RNA, 23 nt, Human
cuccuggggguucuuucuuccuc

SEQ ID NO: 1741642 - RNA, 18 nt, Human
cuccuggggguucuuucu

SEQ ID NO: 1741643 - RNA, 22 nt, Human
cuccuggggguucuuucuuccu

SEQ ID NO: 1741644 - RNA, 20 nt, Human
cuccuggggguucuuucuuc

SEQ ID NO: 1741645 - RNA, 18 nt, Human
cuccucugcugcuggcug

SEQ ID NO: 1741646 - RNA, 16 nt, Human
cuccucugcugcuggc

SEQ ID NO: 1741647 - RNA, 19 nt, Human
cuccucucugcccuaaugc

SEQ ID NO: 1741648 - RNA, 15 nt, Human
cuccucucugcccua

SEQ ID NO: 1741649 - RNA, 14 nt, Human
cuccucucugcccu

SEQ ID NO: 1741650 - RNA, 13 nt, Human
cuccucucugccc

SEQ ID NO: 1741651 - RNA, 18 nt, Human
cuccuggcccacugcauc

SEQ ID NO: 1741652 - RNA, 16 nt, Human
cuccuggcccacugca

SEQ ID NO: 1741653 - RNA, 15 nt, Human
cuccuggacuccugc

SEQ ID NO: 1741654 - RNA, 23 nt, Human
cuccucuucaacugaccagccuc

SEQ ID NO: 1741655 - RNA, 18 nt, Human
cuccucuucaacugacca

SEQ ID NO: 1741656 - RNA, 20 nt, Human
cucccccagccccauccucu

SEQ ID NO: 1741657 - RNA, 15 nt, Human
cucccccagccccau

SEQ ID NO: 1741658 - RNA, 22 nt, Human
cucccccagccccauccucugu

SEQ ID NO: 1741659 - RNA, 13 nt, Human
cucccccaucucu

SEQ ID NO: 1741660 - RNA, 19 nt, Human
cugacaacagacuucugaa

SEQ ID NO: 1741661 - RNA, 18 nt, Human
cugacaacagacuucuga

SEQ ID NO: 1741662 - RNA, 15 nt, Human
cugacaacagacuuc

SEQ ID NO: 1741663 - RNA, 22 nt, Human
cugacccaugcugcccugugag

SEQ ID NO: 1741664 - RNA, 21 nt, Human
cugacccaugcugcccuguga

SEQ ID NO: 1741665 - RNA, 23 nt, Human
cugagacagcccgggcucugccu

SEQ ID NO: 1741666 - RNA, 21 nt, Human
cugagacucgcgacaaugcaa

SEQ ID NO: 1741667 - RNA, 22 nt, Human
cugagacucgcgacaaugcaaa

SEQ ID NO: 1741668 - RNA, 22 nt, Human
cugagaggacuuuucuuugugg

SEQ ID NO: 1741669 - RNA, 21 nt, Human
cugagaggacuuuucuuugug

SEQ ID NO: 1741670 - RNA, 14 nt, Human
cugagaggcugucu

SEQ ID NO: 1741671 - RNA, 17 nt, Human
cugagaguagagucacu

SEQ ID NO: 1741672 - RNA, 15 nt, Human
cugagcuuucugcua

SEQ ID NO: 1741673 - RNA, 14 nt, Human
cugagcuuucugcu

SEQ ID NO: 1741674 - RNA, 21 nt, Human
cugagaucaaaacgguuuuac

SEQ ID NO: 1741675 - RNA, 20 nt, Human
cugaggaauccagacccggc

SEQ ID NO: 1741676 - RNA, 17 nt, Human
cugaggaauccagaccc

SEQ ID NO: 1741677 - RNA, 20 nt, Human
cugaggacacuaaccacgcu

SEQ ID NO: 1741678 - RNA, 21 nt, Human
cugaggaauccagacccggcu

SEQ ID NO: 1741679 - RNA, 23 nt, Human
cugaggacacuaaccacgcugga

SEQ ID NO: 1741680 - RNA, 23 nt, Human
cugaggacaagagaaaaaagcca

SEQ ID NO: 1741681 - RNA, 12 nt, Human
cugaggugggag

SEQ ID NO: 1741682 - RNA, 21 nt, Human
cugaguacguugugcauuugg

SEQ ID NO: 1741683 - RNA, 19 nt, Human
cugaguagcuggauuacag

SEQ ID NO: 1741684 - RNA, 18 nt, Human
cugaguacguugugcauu

SEQ ID NO: 1741685 - RNA, 17 nt, Human
cugaguacguugugcau

SEQ ID NO: 1741686 - RNA, 19 nt, Human
cugaguacguugugcauuu

SEQ ID NO: 1741687 - RNA, 20 nt, Human
cugaguacguugugcauuug

SEQ ID NO: 1741688 - RNA, 14 nt, Human
cugaggaccagcca

SEQ ID NO: 1741689 - RNA, 22 nt, Human
cugaggacuuaaaauauuccug

SEQ ID NO: 1741690 - RNA, 20 nt, Human
cugaguagcugggauuacag

SEQ ID NO: 1741691 - RNA, 15 nt, Human
cugaguagcugggau

SEQ ID NO: 1741692 - RNA, 14 nt, Human
cugaguagcuggga

SEQ ID NO: 1741693 - RNA, 20 nt, Human
cugaguagcuggauuacagg

SEQ ID NO: 1741694 - RNA, 23 nt, Human
cugacaacacucauugaccugag

SEQ ID NO: 1741695 - RNA, 22 nt, Human
cugacaacacucauugaccuga

SEQ ID NO: 1741696 - RNA, 21 nt, Human
cugaaggccccgcccaggcuu

SEQ ID NO: 1741697 - RNA, 17 nt, Human
cugaaggcuggguucug

SEQ ID NO: 1741698 - RNA, 19 nt, Human
cugaaggccccgcccaggc

SEQ ID NO: 1741699 - RNA, 23 nt, Human
cugaaggacauugcggacagcca

SEQ ID NO: 1741700 - RNA, 22 nt, Human
cugaagcuaucguaaaauuaag

SEQ ID NO: 1741701 - RNA, 21 nt, Human
cugaagcuaucguaaaauuaa

SEQ ID NO: 1741702 - RNA, 22 nt, Human
cugaaaauugaugggauuuggu

SEQ ID NO: 1741703 - RNA, 21 nt, Human
cucuugaugccuggcggggug

SEQ ID NO: 1741704 - RNA, 16 nt, Human
cucuugaugccuggcg

SEQ ID NO: 1741705 - RNA, 15 nt, Human
cucuugaugccuggc

SEQ ID NO: 1741706 - RNA, 13 nt, Human
cucuugaugccug

SEQ ID NO: 1741707 - RNA, 16 nt, Human
cucuugagccuugaac

SEQ ID NO: 1741708 - RNA, 17 nt, Human
cucuugagccuugaacu

SEQ ID NO: 1741709 - RNA, 18 nt, Human
cucuugagccuugaacuu

SEQ ID NO: 1741710 - RNA, 23 nt, Human
cucuugagccuugaacuuugacc

SEQ ID NO: 1741711 - RNA, 20 nt, Human
cucuucaacugaccagccuc

SEQ ID NO: 1741712 - RNA, 17 nt, Human
cucuucaacugaccagc

SEQ ID NO: 1741713 - RNA, 16 nt, Human
cucuucaacugaccag

SEQ ID NO: 1741714 - RNA, 18 nt, Human
cucuucagaucucuaacu

SEQ ID NO: 1741715 - RNA, 19 nt, Human
cucuucagaucucuaacuu

SEQ ID NO: 1741716 - RNA, 14 nt, Human
cucuucaaucucuu

SEQ ID NO: 1741717 - RNA, 13 nt, Human
cucuuauugccca

SEQ ID NO: 1741718 - RNA, 20 nt, Human
cucuuauugcccacgcugga

SEQ ID NO: 1741719 - RNA, 19 nt, Human
cucuuauugcccacgcugg

SEQ ID NO: 1741720 - RNA, 15 nt, Human
cucuuauugcccacg

SEQ ID NO: 1741721 - RNA, 14 nt, Human
cucuuauugcccac

SEQ ID NO: 1741722 - RNA, 15 nt, Human
cucugguccauagag

SEQ ID NO: 1741723 - RNA, 15 nt, Human
cucugguuaucuaau

SEQ ID NO: 1741724 - RNA, 12 nt, Human
cucuguccaggc

SEQ ID NO: 1741725 - RNA, 16 nt, Human
cucugcugacagacac

SEQ ID NO: 1741726 - RNA, 14 nt, Human
cucugcugacagac

SEQ ID NO: 1741727 - RNA, 13 nt, Human
cucugcugacaga

SEQ ID NO: 1741728 - RNA, 14 nt, Human
cucugguccauaga

SEQ ID NO: 1741729 - RNA, 20 nt, Human
cucugcacuccccugcuggg

SEQ ID NO: 1741730 - RNA, 21 nt, Human
cucugcacuccccugcugggu

SEQ ID NO: 1741731 - RNA, 13 nt, Human
cucugcagcaaua

SEQ ID NO: 1741732 - RNA, 20 nt, Human
cucugcuccucuccccagca

SEQ ID NO: 1741733 - RNA, 18 nt, Human
cucugcuccucuccccag

SEQ ID NO: 1741734 - RNA, 13 nt, Human
cucugcuccucuc

SEQ ID NO: 1741735 - RNA, 17 nt, Human
cucugcaggucccuaau

SEQ ID NO: 1741736 - RNA, 16 nt, Human
cucugcaggucccuaa

SEQ ID NO: 1741737 - RNA, 15 nt, Human
cucugcaggucccua

SEQ ID NO: 1741738 - RNA, 14 nt, Human
cucugcaggucccu

SEQ ID NO: 1741739 - RNA, 12 nt, Human
cuagaacucccu

SEQ ID NO: 1741740 - RNA, 13 nt, Human
cuagaacucccuu

SEQ ID NO: 1741741 - RNA, 22 nt, Human
cuagaagauuuugaaauuuuua

SEQ ID NO: 1741742 - RNA, 21 nt, Human
cuagcauacguacacauuuua

SEQ ID NO: 1741743 - RNA, 23 nt, Human
cuagcauacguacacauuuuauu

SEQ ID NO: 1741744 - RNA, 20 nt, Human
cuacaugagguacugagagu

SEQ ID NO: 1741745 - RNA, 18 nt, Human
cuacaugagguacugaga

SEQ ID NO: 1741746 - RNA, 17 nt, Human
cuaccuuuguauucucu

SEQ ID NO: 1741747 - RNA, 17 nt, Human
cuacguuaccaggcagg

SEQ ID NO: 1741748 - RNA, 19 nt, Human
cuacaguccucccaucuca

SEQ ID NO: 1741749 - RNA, 22 nt, Human
cuacaguugaaaaacagcugag

SEQ ID NO: 1741750 - RNA, 13 nt, Human
cuacaguguacag

SEQ ID NO: 1741751 - RNA, 14 nt, Human
cuacaguguacagu

SEQ ID NO: 1741752 - RNA, 21 nt, Human
cuacaguugaaaaacagcuga

SEQ ID NO: 1741753 - RNA, 20 nt, Human
cuacaguccucccaucucac

SEQ ID NO: 1741754 - RNA, 11 nt, Human
cgugugugugu

SEQ ID NO: 1741755 - RNA, 23 nt, Human
cuaagugauccucccaccucagc

SEQ ID NO: 1741756 - RNA, 21 nt, Human
cuaagugguacuaacuuuccu

SEQ ID NO: 1741757 - RNA, 20 nt, Human
cuaaguuuuuauggcuuuug

SEQ ID NO: 1741758 - RNA, 23 nt, Human
cuaaguuuuuauggcuuuugugc

SEQ ID NO: 1741759 - RNA, 15 nt, Human
cuaauucuaugccug

SEQ ID NO: 1741760 - RNA, 14 nt, Human
cucaauaaaguaca

SEQ ID NO: 1741761 - RNA, 20 nt, Human
cucaaacucuugaccucagg

SEQ ID NO: 1741762 - RNA, 14 nt, Human
cucaaacuccugac

SEQ ID NO: 1741763 - RNA, 13 nt, Human
cucaaacuccuga

SEQ ID NO: 1741764 - RNA, 11 nt, Human
cucacaaaaga

SEQ ID NO: 1741765 - RNA, 15 nt, Human
cucaaugcacugaca

SEQ ID NO: 1741766 - RNA, 13 nt, Human
cucaaugcacuga

SEQ ID NO: 1741767 - RNA, 17 nt, Human
cucaaaaaaagaaaaag

SEQ ID NO: 1741768 - RNA, 18 nt, Human
cucaaaagcugggcaggu

SEQ ID NO: 1741769 - RNA, 17 nt, Human
cuaucucccccagcccc

SEQ ID NO: 1741770 - RNA, 16 nt, Human
cuaucucccccagccc

SEQ ID NO: 1741771 - RNA, 18 nt, Human
cuaucucccccagcccca

SEQ ID NO: 1741772 - RNA, 15 nt, Human
cuagccagaggagag

SEQ ID NO: 1741773 - RNA, 13 nt, Human
cuagccagaggag

SEQ ID NO: 1741774 - RNA, 12 nt, Human
cuagccagagga

SEQ ID NO: 1741775 - RNA, 23 nt, Human
cuaguuguuugauucagacagcu

SEQ ID NO: 1741776 - RNA, 22 nt, Human
cuaguuguuugauucagacagc

SEQ ID NO: 1741777 - RNA, 13 nt, Human
cuaguuugauuaa

SEQ ID NO: 1741778 - RNA, 15 nt, Human
cuaguuugauuaaau

SEQ ID NO: 1741779 - RNA, 22 nt, Human
cuaguuugauuaaauucuugca

SEQ ID NO: 1741780 - RNA, 21 nt, Human
cuaguuugauuaaauucuugc

SEQ ID NO: 1741781 - RNA, 15 nt, Human
cuaucucccccagcc

SEQ ID NO: 1741782 - RNA, 14 nt, Human
cuaucuaaauguug

SEQ ID NO: 1741783 - RNA, 17 nt, Human
cuaucguaaaauuaaga

SEQ ID NO: 1741784 - RNA, 18 nt, Human
cuaucguaaaauuaagaa

SEQ ID NO: 1741785 - RNA, 18 nt, Human
cuaucaugucaaacguga

SEQ ID NO: 1741786 - RNA, 17 nt, Human
ccuuuugagugccuuac

SEQ ID NO: 1741787 - RNA, 15 nt, Human
ccuuuugagugccuu

SEQ ID NO: 1741788 - RNA, 21 nt, Human
ccuuucaauaggaaaaacuga

SEQ ID NO: 1741789 - RNA, 15 nt, Human
ccuuucacaaccuuc

SEQ ID NO: 1741790 - RNA, 16 nt, Human
ccuugccgucuaccug

SEQ ID NO: 1741791 - RNA, 21 nt, Human
ccuuuuuuagaguugauacua

SEQ ID NO: 1741792 - RNA, 12 nt, Human
cgacaaugcaaa

SEQ ID NO: 1741793 - RNA, 13 nt, Human
cgacaaugcaaac

SEQ ID NO: 1741794 - RNA, 13 nt, Human
cgacagccuggca

SEQ ID NO: 1741795 - RNA, 12 nt, Human
cgacagccuggc

SEQ ID NO: 1741796 - RNA, 14 nt, Human
cgacagccuggcac

SEQ ID NO: 1741797 - RNA, 17 nt, Human
cgacugcccggcagggu

SEQ ID NO: 1741798 - RNA, 17 nt, Human
cgacugccaucuuggac

SEQ ID NO: 1741799 - RNA, 20 nt, Human
cgacccuugccgucuaccug

SEQ ID NO: 1741800 - RNA, 19 nt, Human
cgacccuugccgucuaccu

SEQ ID NO: 1741801 - RNA, 17 nt, Human
cgccagauucuuuccug

SEQ ID NO: 1741802 - RNA, 13 nt, Human
cgccucugcauuc

SEQ ID NO: 1741803 - RNA, 22 nt, Human
cgcaggauucuuccucccuccc

SEQ ID NO: 1741804 - RNA, 13 nt, Human
cgcaggcuggccc

SEQ ID NO: 1741805 - RNA, 14 nt, Human
cgauagugguggug

SEQ ID NO: 1741806 - RNA, 16 nt, Human
cgagucucuucuccac

SEQ ID NO: 1741807 - RNA, 16 nt, Human
cgguuuuacugcagcu

SEQ ID NO: 1741808 - RNA, 23 nt, Human
cgguguuuaagacauuuuuggaa

SEQ ID NO: 1741809 - RNA, 14 nt, Human
cguaaaauuaagaa

SEQ ID NO: 1741810 - RNA, 16 nt, Human
cguaaagcuagaaaug

SEQ ID NO: 1741811 - RNA, 16 nt, Human
cgugaguccuggcaug

SEQ ID NO: 1741812 - RNA, 17 nt, Human
cgugaggccagagacac

SEQ ID NO: 1741813 - RNA, 17 nt, Human
cgugaguccuggcaugg

SEQ ID NO: 1741814 - RNA, 20 nt, Human
cguguaaccauggacccaau

SEQ ID NO: 1741815 - RNA, 14 nt, Human
cgugcacacaccag

SEQ ID NO: 1741816 - RNA, 18 nt, Human
cgugauuuugcuguagaa

SEQ ID NO: 1741817 - RNA, 12 nt, Human
cggcuccaggcu

SEQ ID NO: 1741818 - RNA, 17 nt, Human
cggcucacugcagccuc

SEQ ID NO: 1741819 - RNA, 16 nt, Human
cggcucacugcagccu

SEQ ID NO: 1741820 - RNA, 15 nt, Human
cggcucacugcagcc

SEQ ID NO: 1741821 - RNA, 20 nt, Human
cggagucccaccuuggcugc

SEQ ID NO: 1741822 - RNA, 18 nt, Human
cggagucccaccuuggcu

SEQ ID NO: 1741823 - RNA, 16 nt, Human
cggcuccaggcuccuu

SEQ ID NO: 1741824 - RNA, 15 nt, Human
cggcuccaggcuccu

SEQ ID NO: 1741825 - RNA, 14 nt, Human
cggcuccaggcucc

SEQ ID NO: 1741826 - RNA, 13 nt, Human
cggcuccaggcuc

SEQ ID NO: 1741827 - RNA, 14 nt, Human
cgggccacagagaa

SEQ ID NO: 1741828 - RNA, 12 nt, Human
cgggccacagag

SEQ ID NO: 1741829 - RNA, 16 nt, Human
cgggcucugccuccca

SEQ ID NO: 1741830 - RNA, 14 nt, Human
cgggcucugccucc

SEQ ID NO: 1741831 - RNA, 15 nt, Human
cgggcucagcaaaag

SEQ ID NO: 1741832 - RNA, 11 nt, Human
cgggcucagca

SEQ ID NO: 1741833 - RNA, 17 nt, Human
cgggccacagagaaagu

SEQ ID NO: 1741834 - RNA, 18 nt, Human
cgguguggagaagcggcu

SEQ ID NO: 1741835 - RNA, 15 nt, Human
cggggacagcuccuu

SEQ ID NO: 1741836 - RNA, 17 nt, Human
cgggcucugccucccau

SEQ ID NO: 1741837 - RNA, 14 nt, Human
cggggacagcuccu

SEQ ID NO: 1741838 - RNA, 16 nt, Human
cggagucccaccuugg

SEQ ID NO: 1741839 - RNA, 20 nt, Human
ccauaauuuuuuuuuuccuu

SEQ ID NO: 1741840 - RNA, 13 nt, Human
ccaucccagcccc

SEQ ID NO: 1741841 - RNA, 12 nt, Human
ccaucccagccc

SEQ ID NO: 1741842 - RNA, 23 nt, Human
ccaucccaaacccuucagugcca

SEQ ID NO: 1741843 - RNA, 13 nt, Human
ccaugggccuccu

SEQ ID NO: 1741844 - RNA, 16 nt, Human
ccaugaguccccuguu

SEQ ID NO: 1741845 - RNA, 15 nt, Human
ccaugaguccccugu

SEQ ID NO: 1741846 - RNA, 14 nt, Human
ccaugaguccccug

SEQ ID NO: 1741847 - RNA, 13 nt, Human
ccaugaguccccu

SEQ ID NO: 1741848 - RNA, 19 nt, Human
ccaugagccucagcauccu

SEQ ID NO: 1741849 - RNA, 18 nt, Human
ccaugagccucagcaucc

SEQ ID NO: 1741850 - RNA, 14 nt, Human
ccaugagccucagc

SEQ ID NO: 1741851 - RNA, 22 nt, Human
ccauccccuguagagugggagc

SEQ ID NO: 1741852 - RNA, 16 nt, Human
ccauccccuguagagu

SEQ ID NO: 1741853 - RNA, 20 nt, Human
ccauuuaauggggaggacaa

SEQ ID NO: 1741854 - RNA, 15 nt, Human
ccaugggccuccugu

SEQ ID NO: 1741855 - RNA, 14 nt, Human
ccaugggccuccug

SEQ ID NO: 1741856 - RNA, 17 nt, Human
ccaugggccuccugugu

SEQ ID NO: 1741857 - RNA, 21 nt, Human
ccagucaccccggccaccugc

SEQ ID NO: 1741858 - RNA, 20 nt, Human
ccagucaccccggccaccug

SEQ ID NO: 1741859 - RNA, 13 nt, Human
ccagucaccccgg

SEQ ID NO: 1741860 - RNA, 12 nt, Human
ccagucaccccg

SEQ ID NO: 1741861 - RNA, 14 nt, Human
ccagucccccugcc

SEQ ID NO: 1741862 - RNA, 22 nt, Human
ccaggauguacaaggacagccc

SEQ ID NO: 1741863 - RNA, 14 nt, Human
ccaggcugggagag

SEQ ID NO: 1741864 - RNA, 13 nt, Human
ccaggcugggaga

SEQ ID NO: 1741865 - RNA, 17 nt, Human
ccaggcaacuugggaac

SEQ ID NO: 1741866 - RNA, 22 nt, Human
ccaggcugggagagccuuccag

SEQ ID NO: 1741867 - RNA, 23 nt, Human
ccaggcugggagagccuuccagg

SEQ ID NO: 1741868 - RNA, 21 nt, Human
ccaggcugggagagccuucca

SEQ ID NO: 1741869 - RNA, 18 nt, Human
ccaggcugggagagccuu

SEQ ID NO: 1741870 - RNA, 17 nt, Human
ccaggcugggagagccu

SEQ ID NO: 1741871 - RNA, 15 nt, Human
ccaggcugggagagc

SEQ ID NO: 1741872 - RNA, 21 nt, Human
ccagccccuggaugcagccuc

SEQ ID NO: 1741873 - RNA, 10 nt, Human
ccagccccuu

SEQ ID NO: 1741874 - RNA, 15 nt, Human
ccagcagccuggacc

SEQ ID NO: 1741875 - RNA, 20 nt, Human
ccagcagccuggacccugug

SEQ ID NO: 1741876 - RNA, 19 nt, Human
ccagcagccuggacccugu

SEQ ID NO: 1741877 - RNA, 23 nt, Human
ccaggaaaggcuccaggagcagc

SEQ ID NO: 1741878 - RNA, 22 nt, Human
ccaggaaaggcuccaggagcag

SEQ ID NO: 1741879 - RNA, 21 nt, Human
ccaggaaaggcuccaggagca

SEQ ID NO: 1741880 - RNA, 20 nt, Human
ccagcuugaaaccuucacuu

SEQ ID NO: 1741881 - RNA, 18 nt, Human
ccagcuugaaaccuucac

SEQ ID NO: 1741882 - RNA, 19 nt, Human
ccagcagagcaccuuagac

SEQ ID NO: 1741883 - RNA, 23 nt, Human
ccagcagagcaccuuagacaguc

SEQ ID NO: 1741884 - RNA, 20 nt, Human
cccaggcuuagucacugaga

SEQ ID NO: 1741885 - RNA, 15 nt, Human
cccaggcuuagucac

SEQ ID NO: 1741886 - RNA, 23 nt, Human
cccagcugugcucuggacaggca

SEQ ID NO: 1741887 - RNA, 21 nt, Human
cccagcugugcucuggacagg

SEQ ID NO: 1741888 - RNA, 19 nt, Human
cccaggaaaggcuccagga

SEQ ID NO: 1741889 - RNA, 22 nt, Human
cccagcuuaaaggggcuagagu

SEQ ID NO: 1741890 - RNA, 11 nt, Human
cccagcuguuu

SEQ ID NO: 1741891 - RNA, 22 nt, Human
cccaggaaaggcuccaggagca

SEQ ID NO: 1741892 - RNA, 21 nt, Human
cccaggaaaggcuccaggagc

SEQ ID NO: 1741893 - RNA, 23 nt, Human
cccaggaaaggcuccaggagcag

SEQ ID NO: 1741894 - RNA, 14 nt, Human
cccagcccacuucu

SEQ ID NO: 1741895 - RNA, 17 nt, Human
cccagcccacuucugcc

SEQ ID NO: 1741896 - RNA, 22 nt, Human
cccauucugccugcccaggccc

SEQ ID NO: 1741897 - RNA, 21 nt, Human
cccauucugccugcccaggcc

SEQ ID NO: 1741898 - RNA, 20 nt, Human
cccauucugccugcccaggc

SEQ ID NO: 1741899 - RNA, 21 nt, Human
ccccagcaagugagagcuggg

SEQ ID NO: 1741900 - RNA, 17 nt, Human
ccccauccucuguacag

SEQ ID NO: 1741901 - RNA, 20 nt, Human
ccccagcaagugagagcugg

SEQ ID NO: 1741902 - RNA, 19 nt, Human
ccccagcaagugagagcug

SEQ ID NO: 1741903 - RNA, 21 nt, Human
ccccauccucuguacagagcc

SEQ ID NO: 1741904 - RNA, 19 nt, Human
ccccauccucuguacagag

SEQ ID NO: 1741905 - RNA, 22 nt, Human
ccccauccucuguacagagccc

SEQ ID NO: 1741906 - RNA, 17 nt, Human
ccccagcaagugagagc

SEQ ID NO: 1741907 - RNA, 23 nt, Human
ccccagauugcaacaggcugggc

SEQ ID NO: 1741908 - RNA, 22 nt, Human
ccccagauugcaacaggcuggg

SEQ ID NO: 1741909 - RNA, 21 nt, Human
ccccagauugcaacaggcugg

SEQ ID NO: 1741910 - RNA, 23 nt, Human
cccauucugccugcccaggcccc

SEQ ID NO: 1741911 - RNA, 22 nt, Human
cccauaauuuuuuuuuuccuuu

SEQ ID NO: 1741912 - RNA, 23 nt, Human
cccauaauuuuuuuuuuccuuuu

SEQ ID NO: 1741913 - RNA, 13 nt, Human
cccaguuguauuu

SEQ ID NO: 1741914 - RNA, 18 nt, Human
ccccugcacuccagccug

SEQ ID NO: 1741915 - RNA, 17 nt, Human
ccccugcaaagcccagc

SEQ ID NO: 1741916 - RNA, 16 nt, Human
ccccugcaaagcccag

SEQ ID NO: 1741917 - RNA, 15 nt, Human
ccccugcaaagccca

SEQ ID NO: 1741918 - RNA, 17 nt, Human
ccccuucgcuccugugu

SEQ ID NO: 1741919 - RNA, 15 nt, Human
ccccuucgcuccugu

SEQ ID NO: 1741920 - RNA, 14 nt, Human
ccccuucgcuccug

SEQ ID NO: 1741921 - RNA, 19 nt, Human
ccccuucgcuccugugucu

SEQ ID NO: 1741922 - RNA, 14 nt, Human
ccccauucugccug

SEQ ID NO: 1741923 - RNA, 13 nt, Human
ccccauucugccu

SEQ ID NO: 1741924 - RNA, 15 nt, Human
ccccauucugccugc

SEQ ID NO: 1741925 - RNA, 12 nt, Human
cccggcugcgga

SEQ ID NO: 1741926 - RNA, 13 nt, Human
cccggcugcccuu

SEQ ID NO: 1741927 - RNA, 12 nt, Human
cccggcugcccu

SEQ ID NO: 1741928 - RNA, 12 nt, Human
cccgggaagggg

SEQ ID NO: 1741929 - RNA, 17 nt, Human
ccccuucugacccaugc

SEQ ID NO: 1741930 - RNA, 13 nt, Human
cccucagagccac

SEQ ID NO: 1741931 - RNA, 14 nt, Human
ccucaaaacaaagg

SEQ ID NO: 1741932 - RNA, 17 nt, Human
ccucccaccucagccuc

SEQ ID NO: 1741933 - RNA, 15 nt, Human
ccucccaccucagcc

SEQ ID NO: 1741934 - RNA, 23 nt, Human
ccucauuuuugaauacaggcaua

SEQ ID NO: 1741935 - RNA, 13 nt, Human
ccucccaucucac

SEQ ID NO: 1741936 - RNA, 16 nt, Human
ccucccaucucacaca

SEQ ID NO: 1741937 - RNA, 14 nt, Human
ccggccccugcugg

SEQ ID NO: 1741938 - RNA, 22 nt, Human
cccuucucuccagccccuggau

SEQ ID NO: 1741939 - RNA, 21 nt, Human
cccuucucuccagccccugga

SEQ ID NO: 1741940 - RNA, 15 nt, Human
cccuucgcuccugug

SEQ ID NO: 1741941 - RNA, 14 nt, Human
cccuucgcuccugu

SEQ ID NO: 1741942 - RNA, 23 nt, Human
ccgcaggauuugggcucuuggaa

SEQ ID NO: 1741943 - RNA, 13 nt, Human
ccggccccugcug

SEQ ID NO: 1741944 - RNA, 23 nt, Human
cccugucucaaaaaaagaaaaag

SEQ ID NO: 1741945 - RNA, 20 nt, Human
cccugucucaaaaaaagaaa

SEQ ID NO: 1741946 - RNA, 16 nt, Human
cccugucuaaugaaac

SEQ ID NO: 1741947 - RNA, 13 nt, Human
cccuucgcuccug

SEQ ID NO: 1741948 - RNA, 20 nt, Human
cccugugauggggcccugcc

SEQ ID NO: 1741949 - RNA, 19 nt, Human
cccugugauggggcccugc

SEQ ID NO: 1741950 - RNA, 18 nt, Human
cccugugauggggcccug

SEQ ID NO: 1741951 - RNA, 17 nt, Human
cccugugauggggcccu

SEQ ID NO: 1741952 - RNA, 22 nt, Human
ccugucuaaugaaaccuguguc

SEQ ID NO: 1741953 - RNA, 15 nt, Human
ccugucuaaugaaac

SEQ ID NO: 1741954 - RNA, 18 nt, Human
ccugugacuucagcucug

SEQ ID NO: 1741955 - RNA, 17 nt, Human
ccugugaacugaacucu

SEQ ID NO: 1741956 - RNA, 16 nt, Human
ccugugaacugaacuc

SEQ ID NO: 1741957 - RNA, 15 nt, Human
ccuguaaucacagcu

SEQ ID NO: 1741958 - RNA, 17 nt, Human
ccuguccugccuaaggc

SEQ ID NO: 1741959 - RNA, 19 nt, Human
ccuguccugccuaaggcug

SEQ ID NO: 1741960 - RNA, 15 nt, Human
ccugguuuccugccc

SEQ ID NO: 1741961 - RNA, 16 nt, Human
ccugguuuccugcccu

SEQ ID NO: 1741962 - RNA, 14 nt, Human
ccugguuuccugcc

SEQ ID NO: 1741963 - RNA, 13 nt, Human
ccugguuuccugc

SEQ ID NO: 1741964 - RNA, 21 nt, Human
ccugguggcagugggagcugc

SEQ ID NO: 1741965 - RNA, 18 nt, Human
ccugggggcugggcagag

SEQ ID NO: 1741966 - RNA, 22 nt, Human
ccuggccucugcacuccccugc

SEQ ID NO: 1741967 - RNA, 20 nt, Human
ccugggccccaguuguauuu

SEQ ID NO: 1741968 - RNA, 21 nt, Human
ccuggccucugcacuccccug

SEQ ID NO: 1741969 - RNA, 20 nt, Human
ccuggccucugcacuccccu

SEQ ID NO: 1741970 - RNA, 22 nt, Human
ccuggccucaagugauucuccu

SEQ ID NO: 1741971 - RNA, 22 nt, Human
ccuggccuagcauacguacaca

SEQ ID NO: 1741972 - RNA, 13 nt, Human
ccucuuucccucc

SEQ ID NO: 1741973 - RNA, 16 nt, Human
ccucuuucccucccuu

SEQ ID NO: 1741974 - RNA, 21 nt, Human
ccugaguagcugggauuacag

SEQ ID NO: 1741975 - RNA, 19 nt, Human
ccugcacuugcagacucua

SEQ ID NO: 1741976 - RNA, 18 nt, Human
ccugcacuugcagacucu

SEQ ID NO: 1741977 - RNA, 17 nt, Human
ccugcacuugcagacuc

SEQ ID NO: 1741978 - RNA, 16 nt, Human
ccugcacuugcagacu

SEQ ID NO: 1741979 - RNA, 20 nt, Human
ccugcccaccuggccucugc

SEQ ID NO: 1741980 - RNA, 14 nt, Human
ccugcccaccuggc

SEQ ID NO: 1741981 - RNA, 13 nt, Human
ccugcccaccugg

SEQ ID NO: 1741982 - RNA, 12 nt, Human
ccugcccaccug

SEQ ID NO: 1741983 - RNA, 17 nt, Human
ccugccccagggcuccc

SEQ ID NO: 1741984 - RNA, 13 nt, Human
ccugcccaggccc

SEQ ID NO: 1741985 - RNA, 20 nt, Human
ccugcugcaguugccaguca

SEQ ID NO: 1741986 - RNA, 21 nt, Human
ccugcugcaguugccagucac

SEQ ID NO: 1741987 - RNA, 19 nt, Human
ccugcugcaguugccaguc

SEQ ID NO: 1741988 - RNA, 17 nt, Human
ccugcugcaguugccag

SEQ ID NO: 1741989 - RNA, 23 nt, Human
ccugccucgaacuggcugcaaag

SEQ ID NO: 1741990 - RNA, 21 nt, Human
ccugccucgaacuggcugcaa

SEQ ID NO: 1741991 - RNA, 19 nt, Human
ccugccucgaacuggcugc

SEQ ID NO: 1741992 - RNA, 11 nt, Human
ccucuuucccu

SEQ ID NO: 1741993 - RNA, 21 nt, Human
ccaaaacucuccucugcugcu

SEQ ID NO: 1741994 - RNA, 20 nt, Human
ccaaaacucuccucugcugc

SEQ ID NO: 1741995 - RNA, 22 nt, Human
cauuuuuuuuaagaaaaaggau

SEQ ID NO: 1741996 - RNA, 18 nt, Human
ccaaauguucaucaauga

SEQ ID NO: 1741997 - RNA, 18 nt, Human
ccaacucaccccagcccc

SEQ ID NO: 1741998 - RNA, 17 nt, Human
ccaacucaccccagccc

SEQ ID NO: 1741999 - RNA, 16 nt, Human
ccaacucaccccagcc

SEQ ID NO: 1742000 - RNA, 17 nt, Human
ccaaauguucaucaaug

SEQ ID NO: 1742001 - RNA, 14 nt, Human
ccaacucaccccag

SEQ ID NO: 1742002 - RNA, 23 nt, Human
ccaaauggaaaugggcagagcag

SEQ ID NO: 1742003 - RNA, 13 nt, Human
ccaagcucugcuc

SEQ ID NO: 1742004 - RNA, 12 nt, Human
ccaagcucugcu

SEQ ID NO: 1742005 - RNA, 18 nt, Human
ccaagcucugcuccucuc

SEQ ID NO: 1742006 - RNA, 14 nt, Human
ccaaugcacuuugu

SEQ ID NO: 1742007 - RNA, 15 nt, Human
ccaaugauggucacc

SEQ ID NO: 1742008 - RNA, 17 nt, Human
ccaauauuuaccagacc

SEQ ID NO: 1742009 - RNA, 17 nt, Human
ccaaugggagcucaugg

SEQ ID NO: 1742010 - RNA, 21 nt, Human
ccaccuuugaagaaguaagga

SEQ ID NO: 1742011 - RNA, 22 nt, Human
ccaccgcagacaggaccaggga

SEQ ID NO: 1742012 - RNA, 13 nt, Human
ccaccgcagacag

SEQ ID NO: 1742013 - RNA, 17 nt, Human
ccacgcccccacuggug

SEQ ID NO: 1742014 - RNA, 16 nt, Human
ccacgcccccacuggu

SEQ ID NO: 1742015 - RNA, 19 nt, Human
ccacgcccccacuggugac

SEQ ID NO: 1742016 - RNA, 18 nt, Human
ccacgcccccacugguga

SEQ ID NO: 1742017 - RNA, 13 nt, Human
ccacgcccggcua

SEQ ID NO: 1742018 - RNA, 23 nt, Human
ccacagcgcuggccgggaccccg

SEQ ID NO: 1742019 - RNA, 15 nt, Human
ccaccaucaagccac

SEQ ID NO: 1742020 - RNA, 14 nt, Human
ccaccaucaagcca

SEQ ID NO: 1742021 - RNA, 13 nt, Human
ccaccaucaagcc

SEQ ID NO: 1742022 - RNA, 14 nt, Human
ccacagcugcucaa

SEQ ID NO: 1742023 - RNA, 17 nt, Human
ccaccacacccagccca

SEQ ID NO: 1742024 - RNA, 17 nt, Human
ccacucccugcaaccug

SEQ ID NO: 1742025 - RNA, 19 nt, Human
caguggugguuuucuguuc

SEQ ID NO: 1742026 - RNA, 20 nt, Human
caguggugguuuucuguucu

SEQ ID NO: 1742027 - RNA, 21 nt, Human
caguggugguuuucuguucuu

SEQ ID NO: 1742028 - RNA, 22 nt, Human
caguggugguuuucuguucuuu

SEQ ID NO: 1742029 - RNA, 18 nt, Human
cauauucuguuggccagu

SEQ ID NO: 1742030 - RNA, 17 nt, Human
cauauucuguuggccag

SEQ ID NO: 1742031 - RNA, 16 nt, Human
cauauuaccacagaca

SEQ ID NO: 1742032 - RNA, 14 nt, Human
caucacuucccuac

SEQ ID NO: 1742033 - RNA, 12 nt, Human
caucacuucccu

SEQ ID NO: 1742034 - RNA, 15 nt, Human
cauccuggcacccgg

SEQ ID NO: 1742035 - RNA, 22 nt, Human
cauccuggcacccggccccugc

SEQ ID NO: 1742036 - RNA, 23 nt, Human
cauccuggcacccggccccugcu

SEQ ID NO: 1742037 - RNA, 14 nt, Human
caugcuacacacug

SEQ ID NO: 1742038 - RNA, 20 nt, Human
caugcuacacacugcauguu

SEQ ID NO: 1742039 - RNA, 23 nt, Human
caugcuacacacugcauguuugu

SEQ ID NO: 1742040 - RNA, 13 nt, Human
caugauguuuucc

SEQ ID NO: 1742041 - RNA, 17 nt, Human
caugggaaugaauguca

SEQ ID NO: 1742042 - RNA, 16 nt, Human
caugggaaugaauguc

SEQ ID NO: 1742043 - RNA, 15 nt, Human
caugggaaugaaugu

SEQ ID NO: 1742044 - RNA, 14 nt, Human
caugggaaugaaug

SEQ ID NO: 1742045 - RNA, 17 nt, Human
cauggcugccaauggga

SEQ ID NO: 1742046 - RNA, 13 nt, Human
cauucuccaccug

SEQ ID NO: 1742047 - RNA, 16 nt, Human
cauucuccaccugcca

SEQ ID NO: 1742048 - RNA, 14 nt, Human
cauucuccaccugc

SEQ ID NO: 1742049 - RNA, 23 nt, Human
caugucccuaccgagucucuucu

SEQ ID NO: 1742050 - RNA, 19 nt, Human
caugucaaacgugaaaaug

SEQ ID NO: 1742051 - RNA, 14 nt, Human
caugucaaacguga

SEQ ID NO: 1742052 - RNA, 22 nt, Human
caugucccuaccgagucucuuc

SEQ ID NO: 1742053 - RNA, 16 nt, Human
caugucccuaccgagu

SEQ ID NO: 1742054 - RNA, 15 nt, Human
cauguuggccaggcu

SEQ ID NO: 1742055 - RNA, 14 nt, Human
cauguuggccaggc

SEQ ID NO: 1742056 - RNA, 16 nt, Human
cauguuggccaggcug

SEQ ID NO: 1742057 - RNA, 15 nt, Human
cagauccccaagccu

SEQ ID NO: 1742058 - RNA, 19 nt, Human
cagauccccaagccuggca

SEQ ID NO: 1742059 - RNA, 17 nt, Human
cagagguugcagugagc

SEQ ID NO: 1742060 - RNA, 16 nt, Human
cagagguugcagugag

SEQ ID NO: 1742061 - RNA, 20 nt, Human
cagagguccacaacacacag

SEQ ID NO: 1742062 - RNA, 15 nt, Human
cagagguccacaaca

SEQ ID NO: 1742063 - RNA, 21 nt, Human
cagaguaauccaagcaaaugu

SEQ ID NO: 1742064 - RNA, 23 nt, Human
cagaggggguggccucccaacuc

SEQ ID NO: 1742065 - RNA, 22 nt, Human
cagaggggguggccucccaacu

SEQ ID NO: 1742066 - RNA, 19 nt, Human
cagauucuuuccugaggcu

SEQ ID NO: 1742067 - RNA, 18 nt, Human
cagauucuuuccugaggc

SEQ ID NO: 1742068 - RNA, 17 nt, Human
cagauucuuuccugagg

SEQ ID NO: 1742069 - RNA, 15 nt, Human
cagauucuuuccuga

SEQ ID NO: 1742070 - RNA, 17 nt, Human
cagcauagaaguaacuu

SEQ ID NO: 1742071 - RNA, 13 nt, Human
cagcauaauacuu

SEQ ID NO: 1742072 - RNA, 22 nt, Human
cagauucuuuccugaggcuggg

SEQ ID NO: 1742073 - RNA, 20 nt, Human
cagauucuuuccugaggcug

SEQ ID NO: 1742074 - RNA, 17 nt, Human
cagauugcaacaggcug

SEQ ID NO: 1742075 - RNA, 16 nt, Human
cagcacgauuucuguu

SEQ ID NO: 1742076 - RNA, 18 nt, Human
cagcacgauuucuguuua

SEQ ID NO: 1742077 - RNA, 19 nt, Human
cagcacgauuucuguuuag

SEQ ID NO: 1742078 - RNA, 20 nt, Human
cagcacgauuucuguuuaga

SEQ ID NO: 1742079 - RNA, 13 nt, Human
cagccaguaaaug

SEQ ID NO: 1742080 - RNA, 20 nt, Human
cagcaucauggagguuugaa

SEQ ID NO: 1742081 - RNA, 14 nt, Human
cagcugccugggau

SEQ ID NO: 1742082 - RNA, 13 nt, Human
cagcugccuggga

SEQ ID NO: 1742083 - RNA, 12 nt, Human
cagcugccugca

SEQ ID NO: 1742084 - RNA, 12 nt, Human
cagcugccuggg

SEQ ID NO: 1742085 - RNA, 19 nt, Human
cagcugagggugagugggu

SEQ ID NO: 1742086 - RNA, 20 nt, Human
cagcugugcucuggacaggc

SEQ ID NO: 1742087 - RNA, 15 nt, Human
cagcugccugggauc

SEQ ID NO: 1742088 - RNA, 24 nt, Human
cagcugugcucuggacaggcaugu

SEQ ID NO: 1742089 - RNA, 21 nt, Human
cagcuguuuaugcauagauaa

SEQ ID NO: 1742090 - RNA, 16 nt, Human
caggaaaagcugcuga

SEQ ID NO: 1742091 - RNA, 15 nt, Human
caggaaaagcugcug

SEQ ID NO: 1742092 - RNA, 18 nt, Human
caggaaaagcugcugaca

SEQ ID NO: 1742093 - RNA, 21 nt, Human
cagcggggacagcuccuucug

SEQ ID NO: 1742094 - RNA, 19 nt, Human
cagcggggacagcuccuuc

SEQ ID NO: 1742095 - RNA, 18 nt, Human
cagcggggacagcuccuu

SEQ ID NO: 1742096 - RNA, 12 nt, Human
cagccugcucca

SEQ ID NO: 1742097 - RNA, 15 nt, Human
cagccugcuccagcu

SEQ ID NO: 1742098 - RNA, 19 nt, Human
cagccugcuaauuccccag

SEQ ID NO: 1742099 - RNA, 20 nt, Human
cagccgagauagccaaggcc

SEQ ID NO: 1742100 - RNA, 19 nt, Human
cagccgagauagccaaggc

SEQ ID NO: 1742101 - RNA, 15 nt, Human
cagucacauuccaag

SEQ ID NO: 1742102 - RNA, 21 nt, Human
caggugcacaagcuccaagcu

SEQ ID NO: 1742103 - RNA, 22 nt, Human
caggugcacaagcuccaagcuc

SEQ ID NO: 1742104 - RNA, 23 nt, Human
cagguugucugaagucacugcac

SEQ ID NO: 1742105 - RNA, 22 nt, Human
cagguugucugaagucacugca

SEQ ID NO: 1742106 - RNA, 16 nt, Human
cagguuuuccugaaga

SEQ ID NO: 1742107 - RNA, 12 nt, Human
cagguuuuccug

SEQ ID NO: 1742108 - RNA, 14 nt, Human
cagguuuaagcugu

SEQ ID NO: 1742109 - RNA, 23 nt, Human
caguaaagaacaucccuccuggg

SEQ ID NO: 1742110 - RNA, 20 nt, Human
caggugcacaagcuccaagc

SEQ ID NO: 1742111 - RNA, 19 nt, Human
caggugcacaagcuccaag

SEQ ID NO: 1742112 - RNA, 18 nt, Human
caggugcacaagcuccaa

SEQ ID NO: 1742113 - RNA, 17 nt, Human
caggugcacaagcucca

SEQ ID NO: 1742114 - RNA, 23 nt, Human
caggugauccacccaccucagcc

SEQ ID NO: 1742115 - RNA, 22 nt, Human
caggugauccacccaccucagc

SEQ ID NO: 1742116 - RNA, 15 nt, Human
caggugcacaagcuc

SEQ ID NO: 1742117 - RNA, 21 nt, Human
caggugauccacccaccucag

SEQ ID NO: 1742118 - RNA, 18 nt, Human
cagucuggaaugcagugg

SEQ ID NO: 1742119 - RNA, 12 nt, Human
cagugcaucuca

SEQ ID NO: 1742120 - RNA, 17 nt, Human
cagucuggaaugcagug

SEQ ID NO: 1742121 - RNA, 15 nt, Human
cagucuggaaugcag

SEQ ID NO: 1742122 - RNA, 14 nt, Human
cagugcaugcuguc

SEQ ID NO: 1742123 - RNA, 13 nt, Human
cagugcaugcugu

SEQ ID NO: 1742124 - RNA, 18 nt, Human
cagugcaucucagcccac

SEQ ID NO: 1742125 - RNA, 17 nt, Human
cagugcaucucagccca

SEQ ID NO: 1742126 - RNA, 16 nt, Human
cagugcaucucagccc

SEQ ID NO: 1742127 - RNA, 15 nt, Human
cagugcaucucagcc

SEQ ID NO: 1742128 - RNA, 18 nt, Human
cagugcccacaggaucag

SEQ ID NO: 1742129 - RNA, 23 nt, Human
cagugggagcugccuguucagcu

SEQ ID NO: 1742130 - RNA, 20 nt, Human
cagugggagcugccuguuca

SEQ ID NO: 1742131 - RNA, 17 nt, Human
cagugcccacaggauca

SEQ ID NO: 1742132 - RNA, 15 nt, Human
cagugcccacaggau

SEQ ID NO: 1742133 - RNA, 13 nt, Human
cagugcccacagg

SEQ ID NO: 1742134 - RNA, 17 nt, Human
cagugcaugcugucccu

SEQ ID NO: 1742135 - RNA, 16 nt, Human
cagugcaugcuguccc

SEQ ID NO: 1742136 - RNA, 21 nt, Human
caguggugcgaucuggguuca

SEQ ID NO: 1742137 - RNA, 18 nt, Human
caguggugguuuucuguu

SEQ ID NO: 1742138 - RNA, 20 nt, Human
caguggggaggggcuguggg

SEQ ID NO: 1742139 - RNA, 20 nt, Human
caggcugggcuucaguggca

SEQ ID NO: 1742140 - RNA, 15 nt, Human
caggcugggagagcc

SEQ ID NO: 1742141 - RNA, 14 nt, Human
caggcugggagagc

SEQ ID NO: 1742142 - RNA, 12 nt, Human
caggcugggaga

SEQ ID NO: 1742143 - RNA, 22 nt, Human
caggcugggcuucaguggcagc

SEQ ID NO: 1742144 - RNA, 21 nt, Human
caggcugggcuucaguggcag

SEQ ID NO: 1742145 - RNA, 23 nt, Human
cagggcucagcggggacagcucc

SEQ ID NO: 1742146 - RNA, 21 nt, Human
cagggcucagcggggacagcu

SEQ ID NO: 1742147 - RNA, 19 nt, Human
caggggaaaaucagccugc

SEQ ID NO: 1742148 - RNA, 20 nt, Human
caggggaaaaucagccugcu

SEQ ID NO: 1742149 - RNA, 20 nt, Human
caggccaggcccucugccca

SEQ ID NO: 1742150 - RNA, 16 nt, Human
caggccagagggagug

SEQ ID NO: 1742151 - RNA, 19 nt, Human
caggccaggcccucugccc

SEQ ID NO: 1742152 - RNA, 18 nt, Human
caggccaggcccucugcc

SEQ ID NO: 1742153 - RNA, 17 nt, Human
caggccaggcccucugc

SEQ ID NO: 1742154 - RNA, 23 nt, Human
caggccagcugcuugggcuucau

SEQ ID NO: 1742155 - RNA, 21 nt, Human
caggccagcugcuugggcuuc

SEQ ID NO: 1742156 - RNA, 19 nt, Human
caggccagcugcuugggcu

SEQ ID NO: 1742157 - RNA, 17 nt, Human
caggccagcugcuuggg

SEQ ID NO: 1742158 - RNA, 15 nt, Human
caggccagagggagu

SEQ ID NO: 1742159 - RNA, 13 nt, Human
caggccagaggga

SEQ ID NO: 1742160 - RNA, 18 nt, Human
caggcagauacaggaaaa

SEQ ID NO: 1742161 - RNA, 15 nt, Human
caggccacuugauga

SEQ ID NO: 1742162 - RNA, 15 nt, Human
cagaacacauaauuc

SEQ ID NO: 1742163 - RNA, 17 nt, Human
cagaaauguguuaucac

SEQ ID NO: 1742164 - RNA, 22 nt, Human
cagaauauuagugaccucagcu

SEQ ID NO: 1742165 - RNA, 21 nt, Human
cagaaguuucugccgcagccc

SEQ ID NO: 1742166 - RNA, 20 nt, Human
cagaaguuucugccgcagcc

SEQ ID NO: 1742167 - RNA, 22 nt, Human
cagaaguuucugccgcagcccu

SEQ ID NO: 1742168 - RNA, 23 nt, Human
cagaaguuucugccgcagcccug

SEQ ID NO: 1742169 - RNA, 19 nt, Human
cacuguuucaaacuuuacu

SEQ ID NO: 1742170 - RNA, 17 nt, Human
cacuguugcccaggcug

SEQ ID NO: 1742171 - RNA, 19 nt, Human
cacuuagaaauugcauuuc

SEQ ID NO: 1742172 - RNA, 17 nt, Human
cacuuagaaauugcauu

SEQ ID NO: 1742173 - RNA, 17 nt, Human
cacuuggucugugagau

SEQ ID NO: 1742174 - RNA, 20 nt, Human
cacuuggucugugagaugcu

SEQ ID NO: 1742175 - RNA, 20 nt, Human
cacuuagaaauugcauuucc

SEQ ID NO: 1742176 - RNA, 22 nt, Human
cacugggcuuggggaccagagc

SEQ ID NO: 1742177 - RNA, 23 nt, Human
cacugggcuuggggaccagagcu

SEQ ID NO: 1742178 - RNA, 16 nt, Human
cacuguugcccaggcu

SEQ ID NO: 1742179 - RNA, 15 nt, Human
cacuguugcccaggc

SEQ ID NO: 1742180 - RNA, 22 nt, Human
cacugguggcccgacagccugg

SEQ ID NO: 1742181 - RNA, 21 nt, Human
cacugguggcccgacagccug

SEQ ID NO: 1742182 - RNA, 13 nt, Human
cacugguggcccg

SEQ ID NO: 1742183 - RNA, 17 nt, Human
cacuggugacaugucuu

SEQ ID NO: 1742184 - RNA, 23 nt, Human
cacuacggaauaguuggcuagga

SEQ ID NO: 1742185 - RNA, 17 nt, Human
cacggccaggccagagg

SEQ ID NO: 1742186 - RNA, 20 nt, Human
cacggagggugacgggggug

SEQ ID NO: 1742187 - RNA, 16 nt, Human
cacggccaggccagag

SEQ ID NO: 1742188 - RNA, 15 nt, Human
cacggccaggccaga

SEQ ID NO: 1742189 - RNA, 14 nt, Human
cacggccaggccag

SEQ ID NO: 1742190 - RNA, 19 nt, Human
cacucuuauugcccacgcu

SEQ ID NO: 1742191 - RNA, 18 nt, Human
cacucuuauugcccacgc

SEQ ID NO: 1742192 - RNA, 17 nt, Human
cacucuuauugcccacg

SEQ ID NO: 1742193 - RNA, 17 nt, Human
cacucuugaaaaaugca

SEQ ID NO: 1742194 - RNA, 21 nt, Human
caccuacaugagguacugaga

SEQ ID NO: 1742195 - RNA, 16 nt, Human
caccugccagggacag

SEQ ID NO: 1742196 - RNA, 14 nt, Human
caccugccagggac

SEQ ID NO: 1742197 - RNA, 20 nt, Human
caccuaccaccacgcccggc

SEQ ID NO: 1742198 - RNA, 13 nt, Human
caccuuggcucaa

SEQ ID NO: 1742199 - RNA, 14 nt, Human
caccuuggcucaag

SEQ ID NO: 1742200 - RNA, 19 nt, Human
caccuugacagggcacacc

SEQ ID NO: 1742201 - RNA, 17 nt, Human
caccugccagggacaga

SEQ ID NO: 1742202 - RNA, 15 nt, Human
caccuuuguccccac

SEQ ID NO: 1742203 - RNA, 14 nt, Human
caccuuugucccca

SEQ ID NO: 1742204 - RNA, 17 nt, Human
caccuuuguccccaccg

SEQ ID NO: 1742205 - RNA, 14 nt, Human
caccuuuauucugg

SEQ ID NO: 1742206 - RNA, 22 nt, Human
caaguaauccaccugccucggc

SEQ ID NO: 1742207 - RNA, 13 nt, Human
caaguauuauacc

SEQ ID NO: 1742208 - RNA, 12 nt, Human
caauuuaaaaaa

SEQ ID NO: 1742209 - RNA, 16 nt, Human
cacaagacccuugugg

SEQ ID NO: 1742210 - RNA, 14 nt, Human
cacaagacccuugu

SEQ ID NO: 1742211 - RNA, 14 nt, Human
cacaagccuucggc

SEQ ID NO: 1742212 - RNA, 23 nt, Human
caaugcuggcuguuggcuggggg

SEQ ID NO: 1742213 - RNA, 22 nt, Human
caaugcuggcuguuggcugggg

SEQ ID NO: 1742214 - RNA, 22 nt, Human
caaugcugugcccuaaagugua

SEQ ID NO: 1742215 - RNA, 17 nt, Human
caauucuccugccucag

SEQ ID NO: 1742216 - RNA, 19 nt, Human
caauucuccugccucagcc

SEQ ID NO: 1742217 - RNA, 22 nt, Human
cacaucagcacgauuucuguuu

SEQ ID NO: 1742218 - RNA, 17 nt, Human
cacaucuugcucugcug

SEQ ID NO: 1742219 - RNA, 16 nt, Human
cacaucuugcucugcu

SEQ ID NO: 1742220 - RNA, 20 nt, Human
cacaucagcacgauuucugu

SEQ ID NO: 1742221 - RNA, 21 nt, Human
cacaucagcacgauuucuguu

SEQ ID NO: 1742222 - RNA, 21 nt, Human
caccaacauacucccaucugu

SEQ ID NO: 1742223 - RNA, 20 nt, Human
caccaacauacucccaucug

SEQ ID NO: 1742224 - RNA, 18 nt, Human
cacauuuuucagauauaa

SEQ ID NO: 1742225 - RNA, 13 nt, Human
cacauuuuucuua

SEQ ID NO: 1742226 - RNA, 14 nt, Human
cacauuuuucuuag

SEQ ID NO: 1742227 - RNA, 17 nt, Human
cacauuuuuuaaaugca

SEQ ID NO: 1742228 - RNA, 21 nt, Human
cacauuuuuuaaaugcaccug

SEQ ID NO: 1742229 - RNA, 18 nt, Human
cacaucuugcucugcuga

SEQ ID NO: 1742230 - RNA, 19 nt, Human
cacaucuugcucugcugac

SEQ ID NO: 1742231 - RNA, 15 nt, Human
cacauuuuauuuuau

SEQ ID NO: 1742232 - RNA, 14 nt, Human
cacauuuuucagau

SEQ ID NO: 1742233 - RNA, 23 nt, Human
cacccaggagccccgaggccuuc

SEQ ID NO: 1742234 - RNA, 20 nt, Human
cacccaggagccccgaggcc

SEQ ID NO: 1742235 - RNA, 19 nt, Human
cacccagcccacuucugcc

SEQ ID NO: 1742236 - RNA, 24 nt, Human
cacccaggagccccgaggccuucu

SEQ ID NO: 1742237 - RNA, 15 nt, Human
caccagcagccugga

SEQ ID NO: 1742238 - RNA, 12 nt, Human
caccagcagccu

SEQ ID NO: 1742239 - RNA, 14 nt, Human
caccagcagccugg

SEQ ID NO: 1742240 - RNA, 23 nt, Human
caccaacauacucccaucuguga

SEQ ID NO: 1742241 - RNA, 17 nt, Human
cacccagcccacuucug

SEQ ID NO: 1742242 - RNA, 16 nt, Human
cacccagcccacuucu

SEQ ID NO: 1742243 - RNA, 19 nt, Human
cacaguauuacuucugcua

SEQ ID NO: 1742244 - RNA, 18 nt, Human
cacaguauuacuucugcu

SEQ ID NO: 1742245 - RNA, 16 nt, Human
cacaguauuacuucug

SEQ ID NO: 1742246 - RNA, 16 nt, Human
cacagcuaacauggaa

SEQ ID NO: 1742247 - RNA, 15 nt, Human
cacagcuaacaugga

SEQ ID NO: 1742248 - RNA, 22 nt, Human
cacagacccugcccugugggcc

SEQ ID NO: 1742249 - RNA, 18 nt, Human
cacagacauacuaaccag

SEQ ID NO: 1742250 - RNA, 21 nt, Human
cacagacccugcccugugggc

SEQ ID NO: 1742251 - RNA, 20 nt, Human
cacagacccugcccuguggg

SEQ ID NO: 1742252 - RNA, 19 nt, Human
cacagacccugcccugugg

SEQ ID NO: 1742253 - RNA, 10 nt, Human
cacagcucuu

SEQ ID NO: 1742254 - RNA, 23 nt, Human
cacagcucuguccugggagugag

SEQ ID NO: 1742255 - RNA, 20 nt, Human
cacagcucuguccugggagu

SEQ ID NO: 1742256 - RNA, 22 nt, Human
cacagcuaacauggaaguacua

SEQ ID NO: 1742257 - RNA, 18 nt, Human
auuuugauccaagcuggu

SEQ ID NO: 1742258 - RNA, 20 nt, Human
auuuguuucuuucucugagg

SEQ ID NO: 1742259 - RNA, 20 nt, Human
auuuguuugaacugauaaag

SEQ ID NO: 1742260 - RNA, 14 nt, Human
auuuguuugaacug

SEQ ID NO: 1742261 - RNA, 16 nt, Human
auuuguuugaacugau

SEQ ID NO: 1742262 - RNA, 13 nt, Human
auuuguuugaacu

SEQ ID NO: 1742263 - RNA, 20 nt, Human
auuuuuaaagaaaaguuuug

SEQ ID NO: 1742264 - RNA, 17 nt, Human
auuuuuuuuuccuucag

SEQ ID NO: 1742265 - RNA, 13 nt, Human
auuuuuaagugcu

SEQ ID NO: 1742266 - RNA, 16 nt, Human
auuuuuuuuuccuuca

SEQ ID NO: 1742267 - RNA, 13 nt, Human
auuuuuuuuuccu

SEQ ID NO: 1742268 - RNA, 12 nt, Human
auuuuuuuuucc

SEQ ID NO: 1742269 - RNA, 19 nt, Human
caaaagcugggcagguugg

SEQ ID NO: 1742270 - RNA, 15 nt, Human
caaaagcugggcagg

SEQ ID NO: 1742271 - RNA, 18 nt, Human
caaccacugcgaccacaa

SEQ ID NO: 1742272 - RNA, 17 nt, Human
caacuaugauuuggaaa

SEQ ID NO: 1742273 - RNA, 22 nt, Human
caacuaugauuuggaaaauaaa

SEQ ID NO: 1742274 - RNA, 19 nt, Human
caacuaugauuuggaaaau

SEQ ID NO: 1742275 - RNA, 18 nt, Human
caacuaugauuuggaaaa

SEQ ID NO: 1742276 - RNA, 17 nt, Human
caacccccagccugcua

SEQ ID NO: 1742277 - RNA, 16 nt, Human
caacccccagccugcu

SEQ ID NO: 1742278 - RNA, 15 nt, Human
caacccccagccugc

SEQ ID NO: 1742279 - RNA, 19 nt, Human
caacccaaauguucaucaa

SEQ ID NO: 1742280 - RNA, 14 nt, Human
caaccauuccccau

SEQ ID NO: 1742281 - RNA, 14 nt, Human
caaccauuugaaac

SEQ ID NO: 1742282 - RNA, 15 nt, Human
caacucaccccagcc

SEQ ID NO: 1742283 - RNA, 13 nt, Human
caacucaccccag

SEQ ID NO: 1742284 - RNA, 16 nt, Human
caacucaccccagccc

SEQ ID NO: 1742285 - RNA, 17 nt, Human
caacucaccccagcccc

SEQ ID NO: 1742286 - RNA, 19 nt, Human
caagacccuugugguccca

SEQ ID NO: 1742287 - RNA, 18 nt, Human
caagacccuugugguccc

SEQ ID NO: 1742288 - RNA, 22 nt, Human
caagacccuuguggucccaccc

SEQ ID NO: 1742289 - RNA, 23 nt, Human
caagacccuuguggucccacccc

SEQ ID NO: 1742290 - RNA, 13 nt, Human
caagacacaguga

SEQ ID NO: 1742291 - RNA, 21 nt, Human
caaaguacacuguuucaaacu

SEQ ID NO: 1742292 - RNA, 16 nt, Human
caaaguacacuguuuc

SEQ ID NO: 1742293 - RNA, 20 nt, Human
caaaguacacuguuucaaac

SEQ ID NO: 1742294 - RNA, 14 nt, Human
caaagaugcagccg

SEQ ID NO: 1742295 - RNA, 13 nt, Human
caaagaugcagcc

SEQ ID NO: 1742296 - RNA, 17 nt, Human
caaaucagcugcuacua

SEQ ID NO: 1742297 - RNA, 22 nt, Human
caaauccagccugcugccugcu

SEQ ID NO: 1742298 - RNA, 23 nt, Human
caacaaaccuguuucugcagcca

SEQ ID NO: 1742299 - RNA, 21 nt, Human
caaaucugcuuuuuaaagaau

SEQ ID NO: 1742300 - RNA, 13 nt, Human
caaaugcagcuuu

SEQ ID NO: 1742301 - RNA, 20 nt, Human
caacaccuuguuucccucuc

SEQ ID NO: 1742302 - RNA, 22 nt, Human
caacaccucugcacaagcugca

SEQ ID NO: 1742303 - RNA, 13 nt, Human
caacacaaagauu

SEQ ID NO: 1742304 - RNA, 18 nt, Human
auucacaagacccaaaag

SEQ ID NO: 1742305 - RNA, 15 nt, Human
auuauguguguuuua

SEQ ID NO: 1742306 - RNA, 21 nt, Human
auuauguguguuuuaaaauga

SEQ ID NO: 1742307 - RNA, 20 nt, Human
auuauguguguuuuaaaaug

SEQ ID NO: 1742308 - RNA, 20 nt, Human
auuaaauucuugcaaaguau

SEQ ID NO: 1742309 - RNA, 14 nt, Human
auuaaauucuugca

SEQ ID NO: 1742310 - RNA, 18 nt, Human
auuaaauucuugcaaagu

SEQ ID NO: 1742311 - RNA, 19 nt, Human
auucauauuuacuucuuau

SEQ ID NO: 1742312 - RNA, 18 nt, Human
auucauauuuacuucuua

SEQ ID NO: 1742313 - RNA, 20 nt, Human
auucauauuuacuucuuaua

SEQ ID NO: 1742314 - RNA, 17 nt, Human
auucuugccaaauauaa

SEQ ID NO: 1742315 - RNA, 18 nt, Human
auucugaccuuaaaugca

SEQ ID NO: 1742316 - RNA, 21 nt, Human
auuccugaugcuucuucagag

SEQ ID NO: 1742317 - RNA, 19 nt, Human
auucucuccuguaccucuu

SEQ ID NO: 1742318 - RNA, 21 nt, Human
auucucuccuguaccucuuga

SEQ ID NO: 1742319 - RNA, 22 nt, Human
auucuuuccugaggcugggcuc

SEQ ID NO: 1742320 - RNA, 17 nt, Human
auucuuuccugaggcug

SEQ ID NO: 1742321 - RNA, 17 nt, Human
auugauccagaaagaaa

SEQ ID NO: 1742322 - RNA, 16 nt, Human
auugauccagaaagaa

SEQ ID NO: 1742323 - RNA, 23 nt, Human
auuguaauaggcguaacuaauuu

SEQ ID NO: 1742324 - RNA, 16 nt, Human
auuguaaggaaugauu

SEQ ID NO: 1742325 - RNA, 15 nt, Human
auuguaaggaaugau

SEQ ID NO: 1742326 - RNA, 18 nt, Human
auuguaagcaugcacaaa

SEQ ID NO: 1742327 - RNA, 18 nt, Human
auugaugggauuugguca

SEQ ID NO: 1742328 - RNA, 13 nt, Human
auuguaaaagcau

SEQ ID NO: 1742329 - RNA, 13 nt, Human
auuguaaaauggu

SEQ ID NO: 1742330 - RNA, 19 nt, Human
auuguaaaagcauuuugua

SEQ ID NO: 1742331 - RNA, 20 nt, Human
auuguaaaagcauuuuguaa

SEQ ID NO: 1742332 - RNA, 21 nt, Human
auuguaaaagcauuuuguaau

SEQ ID NO: 1742333 - RNA, 23 nt, Human
auuguaaaagcauuuuguaauaa

SEQ ID NO: 1742334 - RNA, 22 nt, Human
auugauccagaaagaaaacuug

SEQ ID NO: 1742335 - RNA, 19 nt, Human
auugauccagaaagaaaac

SEQ ID NO: 1742336 - RNA, 18 nt, Human
auugauccagaaagaaaa

SEQ ID NO: 1742337 - RNA, 13 nt, Human
auuguacaguuuu

SEQ ID NO: 1742338 - RNA, 19 nt, Human
auuguucuuaguuugcagu

SEQ ID NO: 1742339 - RNA, 16 nt, Human
auuucagcagcugcag

SEQ ID NO: 1742340 - RNA, 15 nt, Human
auuucagauuuguga

SEQ ID NO: 1742341 - RNA, 17 nt, Human
auuuaauggggaggaca

SEQ ID NO: 1742342 - RNA, 15 nt, Human
auuuaaugaaagacu

SEQ ID NO: 1742343 - RNA, 14 nt, Human
auuuaaugaaagac

SEQ ID NO: 1742344 - RNA, 12 nt, Human
auuucuguuuag

SEQ ID NO: 1742345 - RNA, 14 nt, Human
auuucuguuuagau

SEQ ID NO: 1742346 - RNA, 16 nt, Human
auuucuguuuagauaa

SEQ ID NO: 1742347 - RNA, 21 nt, Human
ggaucuuuggacagaagcagc

SEQ ID NO: 1742348 - RNA, 18 nt, Human
ggaucucuugagccuggg

SEQ ID NO: 1742349 - RNA, 23 nt, Human
ggauccugagccagauuucacuc

SEQ ID NO: 1742350 - RNA, 20 nt, Human
ggauccugagccagauuuca

SEQ ID NO: 1742351 - RNA, 19 nt, Human
ggauccugagccagauuuc

SEQ ID NO: 1742352 - RNA, 18 nt, Human
ggauccugagccagauuu

SEQ ID NO: 1742353 - RNA, 16 nt, Human
ggauccugagccagau

SEQ ID NO: 1742354 - RNA, 15 nt, Human
ggauccugagccaga

SEQ ID NO: 1742355 - RNA, 16 nt, Human
ggaguucaucuugaau

SEQ ID NO: 1742356 - RNA, 20 nt, Human
ggauuguccccgacccuugc

SEQ ID NO: 1742357 - RNA, 16 nt, Human
ggauuguccccgaccc

SEQ ID NO: 1742358 - RNA, 12 nt, Human
ggauuuaacaga

SEQ ID NO: 1742359 - RNA, 22 nt, Human
ggauuuaacagaaauguacagc

SEQ ID NO: 1742360 - RNA, 16 nt, Human
ggauuuaacagaaaug

SEQ ID NO: 1742361 - RNA, 17 nt, Human
ggauuuaacagaaaugu

SEQ ID NO: 1742362 - RNA, 14 nt, Human
ggaugaaaaaauaa

SEQ ID NO: 1742363 - RNA, 22 nt, Human
ggaucuuuggacagaagcagcu

SEQ ID NO: 1742364 - RNA, 13 nt, Human
ggauuguccccga

SEQ ID NO: 1742365 - RNA, 14 nt, Human
ggauuguaguccca

SEQ ID NO: 1742366 - RNA, 15 nt, Human
ggaguggccacagaa

SEQ ID NO: 1742367 - RNA, 22 nt, Human
ggagugggcccaaugcacuuug

SEQ ID NO: 1742368 - RNA, 12 nt, Human
ggagugggccca

SEQ ID NO: 1742369 - RNA, 16 nt, Human
ggaguggccacagaaa

SEQ ID NO: 1742370 - RNA, 15 nt, Human
ggaggcucuggagcc

SEQ ID NO: 1742371 - RNA, 14 nt, Human
ggaggggggaggug

SEQ ID NO: 1742372 - RNA, 13 nt, Human
ggaggggggaggu

SEQ ID NO: 1742373 - RNA, 23 nt, Human
ggaggugggauccuccaggugca

SEQ ID NO: 1742374 - RNA, 22 nt, Human
ggaggugggauccuccaggugc

SEQ ID NO: 1742375 - RNA, 21 nt, Human
ggagggugacgggggugaacu

SEQ ID NO: 1742376 - RNA, 22 nt, Human
ggagguaaggaauaccuguccc

SEQ ID NO: 1742377 - RNA, 19 nt, Human
ggccaaaggaagcacaugc

SEQ ID NO: 1742378 - RNA, 21 nt, Human
ggccaaaggaagcacaugccu

SEQ ID NO: 1742379 - RNA, 17 nt, Human
ggcauuuguuucuuucu

SEQ ID NO: 1742380 - RNA, 23 nt, Human
ggcauuuguuucuuucucugagg

SEQ ID NO: 1742381 - RNA, 16 nt, Human
ggccaaaggaagcaca

SEQ ID NO: 1742382 - RNA, 14 nt, Human
ggccaaaggaagca

SEQ ID NO: 1742383 - RNA, 17 nt, Human
ggcauuuguuugaacug

SEQ ID NO: 1742384 - RNA, 19 nt, Human
ggccagagggagugacaga

SEQ ID NO: 1742385 - RNA, 17 nt, Human
ggccagagggagugaca

SEQ ID NO: 1742386 - RNA, 18 nt, Human
ggccagagacacaagccu

SEQ ID NO: 1742387 - RNA, 17 nt, Human
ggccagagacacaagcc

SEQ ID NO: 1742388 - RNA, 14 nt, Human
ggcauuugcugaau

SEQ ID NO: 1742389 - RNA, 20 nt, Human
ggcaucgcaauguaagacuc

SEQ ID NO: 1742390 - RNA, 15 nt, Human
ggcaaaaaggcagga

SEQ ID NO: 1742391 - RNA, 14 nt, Human
ggauuuuugucuug

SEQ ID NO: 1742392 - RNA, 16 nt, Human
ggauuuuugucuugug

SEQ ID NO: 1742393 - RNA, 18 nt, Human
ggcacaccgggcacucag

SEQ ID NO: 1742394 - RNA, 16 nt, Human
ggcacugcuuccagug

SEQ ID NO: 1742395 - RNA, 18 nt, Human
ggcacaucagcacgauuu

SEQ ID NO: 1742396 - RNA, 21 nt, Human
ggcagccccauucugccugcc

SEQ ID NO: 1742397 - RNA, 20 nt, Human
ggcagccccauucugccugc

SEQ ID NO: 1742398 - RNA, 16 nt, Human
ggcagccccauucugc

SEQ ID NO: 1742399 - RNA, 22 nt, Human
ggcagccccauucugccugccc

SEQ ID NO: 1742400 - RNA, 23 nt, Human
ggcagccccauucugccugccca

SEQ ID NO: 1742401 - RNA, 16 nt, Human
ggcagccucuucaaaa

SEQ ID NO: 1742402 - RNA, 20 nt, Human
ggcacugcuuccagugaggc

SEQ ID NO: 1742403 - RNA, 22 nt, Human
ggcacugcuuccagugaggcuc

SEQ ID NO: 1742404 - RNA, 13 nt, Human
ggcagccaggcca

SEQ ID NO: 1742405 - RNA, 14 nt, Human
ggcagccaggccac

SEQ ID NO: 1742406 - RNA, 18 nt, Human
ggcaggaggaucacuuga

SEQ ID NO: 1742407 - RNA, 10 nt, Human
ggcagggagg

SEQ ID NO: 1742408 - RNA, 18 nt, Human
ggcagggagggccugggc

SEQ ID NO: 1742409 - RNA, 17 nt, Human
ggcagggagggccuggg

SEQ ID NO: 1742410 - RNA, 20 nt, Human
ggcagggagggccugggccc

SEQ ID NO: 1742411 - RNA, 19 nt, Human
ggcagggagggccugggcc

SEQ ID NO: 1742412 - RNA, 20 nt, Human
ggcuaagcuucacuguaaaa

SEQ ID NO: 1742413 - RNA, 18 nt, Human
ggcgugagaccugccccu

SEQ ID NO: 1742414 - RNA, 17 nt, Human
ggcgugagaccugcccc

SEQ ID NO: 1742415 - RNA, 16 nt, Human
ggcgugagaccugccc

SEQ ID NO: 1742416 - RNA, 14 nt, Human
ggcgugagaccugc

SEQ ID NO: 1742417 - RNA, 18 nt, Human
ggccuucggccuccaucc

SEQ ID NO: 1742418 - RNA, 22 nt, Human
ggccuucggccuccauccugag

SEQ ID NO: 1742419 - RNA, 16 nt, Human
ggccuucggccuccau

SEQ ID NO: 1742420 - RNA, 16 nt, Human
ggcuaauguacugcau

SEQ ID NO: 1742421 - RNA, 20 nt, Human
ggcuaagugauccucccacc

SEQ ID NO: 1742422 - RNA, 18 nt, Human
ggcuaauuuuuguuuugu

SEQ ID NO: 1742423 - RNA, 13 nt, Human
ggcuaccuuugua

SEQ ID NO: 1742424 - RNA, 22 nt, Human
ggcuacaccuuagccugcccuc

SEQ ID NO: 1742425 - RNA, 23 nt, Human
ggcuacaccuuagccugcccucc

SEQ ID NO: 1742426 - RNA, 14 nt, Human
ggcuaccuuuguau

SEQ ID NO: 1742427 - RNA, 16 nt, Human
ggcuagagguucaaag

SEQ ID NO: 1742428 - RNA, 16 nt, Human
ggccugcaagggagug

SEQ ID NO: 1742429 - RNA, 11 nt, Human
ggccugccugu

SEQ ID NO: 1742430 - RNA, 15 nt, Human
ggccuggccagaugc

SEQ ID NO: 1742431 - RNA, 12 nt, Human
ggccuggccaga

SEQ ID NO: 1742432 - RNA, 15 nt, Human
ggccuggcagccgug

SEQ ID NO: 1742433 - RNA, 14 nt, Human
ggccuggcagccgu

SEQ ID NO: 1742434 - RNA, 16 nt, Human
ggccuggccagaugca

SEQ ID NO: 1742435 - RNA, 17 nt, Human
ggccuucagggagugag

SEQ ID NO: 1742436 - RNA, 19 nt, Human
ggccucccaacucacccca

SEQ ID NO: 1742437 - RNA, 18 nt, Human
ggccucccaacucacccc

SEQ ID NO: 1742438 - RNA, 17 nt, Human
ggccucccaacucaccc

SEQ ID NO: 1742439 - RNA, 13 nt, Human
ggccucagugcca

SEQ ID NO: 1742440 - RNA, 22 nt, Human
ggccucccaacucaccccagcc

SEQ ID NO: 1742441 - RNA, 20 nt, Human
ggccucccaacucaccccag

SEQ ID NO: 1742442 - RNA, 23 nt, Human
ggccucccaacucaccccagccc

SEQ ID NO: 1742443 - RNA, 16 nt, Human
ggccagaugcaccagc

SEQ ID NO: 1742444 - RNA, 15 nt, Human
ggccagaugcaccag

SEQ ID NO: 1742445 - RNA, 22 nt, Human
ggccagagggagugacagaggc

SEQ ID NO: 1742446 - RNA, 17 nt, Human
ggccagaugcaccagcc

SEQ ID NO: 1742447 - RNA, 21 nt, Human
ggccccugccucucugcaggu

SEQ ID NO: 1742448 - RNA, 19 nt, Human
ggccccugccucucugcag

SEQ ID NO: 1742449 - RNA, 18 nt, Human
ggccccugccucucugca

SEQ ID NO: 1742450 - RNA, 17 nt, Human
ggccccugccucucugc

SEQ ID NO: 1742451 - RNA, 13 nt, Human
ggccccugccucu

SEQ ID NO: 1742452 - RNA, 13 nt, Human
aaaaauacaaaaa

SEQ ID NO: 1742453 - RNA, 22 nt, Human
ggcuggguucuacccaggugcu

SEQ ID NO: 1742454 - RNA, 14 nt, Human
ggcuggguuggagg

SEQ ID NO: 1742455 - RNA, 14 nt, Human
aaaaaggaggaaga

SEQ ID NO: 1742456 - RNA, 12 nt, Human
aaaaaggcagga

SEQ ID NO: 1742457 - RNA, 21 nt, Human
aaaaaggaugcacagaguugu

SEQ ID NO: 1742458 - RNA, 14 nt, Human
aaaaauaaaaaaca

SEQ ID NO: 1742459 - RNA, 22 nt, Human
aaaaaacugcugacuguuuucu

SEQ ID NO: 1742460 - RNA, 15 nt, Human
ggcuggccuggcccc

SEQ ID NO: 1742461 - RNA, 14 nt, Human
ggcuggccuggccc

SEQ ID NO: 1742462 - RNA, 13 nt, Human
ggcuggccuggcc

SEQ ID NO: 1742463 - RNA, 17 nt, Human
ggcuggcccugcccugg

SEQ ID NO: 1742464 - RNA, 15 nt, Human
ggcucacugcagccu

SEQ ID NO: 1742465 - RNA, 14 nt, Human
ggcucacugcagcc

SEQ ID NO: 1742466 - RNA, 13 nt, Human
ggcucacugcagc

SEQ ID NO: 1742467 - RNA, 20 nt, Human
ggcucuuccaggcugggaga

SEQ ID NO: 1742468 - RNA, 18 nt, Human
ggcucuuccaggcuggga

SEQ ID NO: 1742469 - RNA, 17 nt, Human
ggcucuuccaggcuggg

SEQ ID NO: 1742470 - RNA, 15 nt, Human
ggcucuuccaggcug

SEQ ID NO: 1742471 - RNA, 13 nt, Human
ggcucccuuccca

SEQ ID NO: 1742472 - RNA, 18 nt, Human
ggcugcccuuucugggca

SEQ ID NO: 1742473 - RNA, 14 nt, Human
ggcugcccuuucug

SEQ ID NO: 1742474 - RNA, 11 nt, Human
ggcugcccuuu

SEQ ID NO: 1742475 - RNA, 10 nt, Human
ggcugcccuu

SEQ ID NO: 1742476 - RNA, 12 nt, Human
ggcugcccuggu

SEQ ID NO: 1742477 - RNA, 15 nt, Human
aaagcagcguuucua

SEQ ID NO: 1742478 - RNA, 16 nt, Human
aaagcuaggccuggcc

SEQ ID NO: 1742479 - RNA, 14 nt, Human
aaagcuaggccugg

SEQ ID NO: 1742480 - RNA, 16 nt, Human
aaagcagugcaugcug

SEQ ID NO: 1742481 - RNA, 14 nt, Human
aaagcuagaaauga

SEQ ID NO: 1742482 - RNA, 13 nt, Human
aaagcagugcaug

SEQ ID NO: 1742483 - RNA, 13 nt, Human
aaagcugccagcc

SEQ ID NO: 1742484 - RNA, 12 nt, Human
aaagcugccagc

SEQ ID NO: 1742485 - RNA, 17 nt, Human
aaagcuaggccuggcca

SEQ ID NO: 1742486 - RNA, 22 nt, Human
aaagcugccagccgagauagcc

SEQ ID NO: 1742487 - RNA, 14 nt, Human
aaagcuguguggca

SEQ ID NO: 1742488 - RNA, 16 nt, Human
aaagcagaacagugau

SEQ ID NO: 1742489 - RNA, 20 nt, Human
gguggcaccagcagccugga

SEQ ID NO: 1742490 - RNA, 14 nt, Human
gguggcaccagcag

SEQ ID NO: 1742491 - RNA, 12 nt, Human
aaacuuuaugcu

SEQ ID NO: 1742492 - RNA, 19 nt, Human
aaacuuuaugcuaagugaa

SEQ ID NO: 1742493 - RNA, 20 nt, Human
aaagggcccagagagggugg

SEQ ID NO: 1742494 - RNA, 18 nt, Human
aaagguucaugcaaacuu

SEQ ID NO: 1742495 - RNA, 20 nt, Human
ggugggaggaucucuugagc

SEQ ID NO: 1742496 - RNA, 17 nt, Human
ggugggacacccuguga

SEQ ID NO: 1742497 - RNA, 16 nt, Human
ggugggacacccugug

SEQ ID NO: 1742498 - RNA, 13 nt, Human
ggugggacacccu

SEQ ID NO: 1742499 - RNA, 19 nt, Human
gguggggaccucaggccug

SEQ ID NO: 1742500 - RNA, 18 nt, Human
gguggcuggguuggaggg

SEQ ID NO: 1742501 - RNA, 21 nt, Human
aaaguaaaaacaaagaaauua

SEQ ID NO: 1742502 - RNA, 17 nt, Human
gguguuuccuggcacug

SEQ ID NO: 1742503 - RNA, 19 nt, Human
gguguuuccuggcacugcu

SEQ ID NO: 1742504 - RNA, 17 nt, Human
gguucccauuugcuccu

SEQ ID NO: 1742505 - RNA, 22 nt, Human
gguucccuuuuuuggcugcuga

SEQ ID NO: 1742506 - RNA, 23 nt, Human
gguucccuuugacgccaucccag

SEQ ID NO: 1742507 - RNA, 12 nt, Human
gguguggagaag

SEQ ID NO: 1742508 - RNA, 23 nt, Human
gguguggagaagcggcuggcagc

SEQ ID NO: 1742509 - RNA, 14 nt, Human
gguguggagaagcg

SEQ ID NO: 1742510 - RNA, 13 nt, Human
ggugggggccucg

SEQ ID NO: 1742511 - RNA, 13 nt, Human
ggugugggggaag

SEQ ID NO: 1742512 - RNA, 11 nt, Human
gguguggggga

SEQ ID NO: 1742513 - RNA, 21 nt, Human
aaaguauccugcuucugauau

SEQ ID NO: 1742514 - RNA, 14 nt, Human
aaaguguauuuuuu

SEQ ID NO: 1742515 - RNA, 21 nt, Human
aaaguguauuuuuuuacuaau

SEQ ID NO: 1742516 - RNA, 16 nt, Human
aaagugguauagaaau

SEQ ID NO: 1742517 - RNA, 17 nt, Human
aaagugguauagaaaug

SEQ ID NO: 1742518 - RNA, 20 nt, Human
aaagugguauagaaaugcug

SEQ ID NO: 1742519 - RNA, 19 nt, Human
aaaguacacuguuucaaac

SEQ ID NO: 1742520 - RNA, 18 nt, Human
aaaguacacuguuucaaa

SEQ ID NO: 1742521 - RNA, 22 nt, Human
aaaguagaagucuuagauguau

SEQ ID NO: 1742522 - RNA, 20 nt, Human
aaaguagaagucuuagaugu

SEQ ID NO: 1742523 - RNA, 21 nt, Human
aaaguaucccuacuguaauuu

SEQ ID NO: 1742524 - RNA, 20 nt, Human
gguuuguaaauuaacuuuua

SEQ ID NO: 1742525 - RNA, 16 nt, Human
gguuucuaaagcugcc

SEQ ID NO: 1742526 - RNA, 19 nt, Human
gguuuccugcccugggagg

SEQ ID NO: 1742527 - RNA, 16 nt, Human
gguuuccugcccuggg

SEQ ID NO: 1742528 - RNA, 22 nt, Human
gguuucuaaagcugccagccga

SEQ ID NO: 1742529 - RNA, 15 nt, Human
gguuuccugcccugg

SEQ ID NO: 1742530 - RNA, 13 nt, Human
gguuuccugcccu

SEQ ID NO: 1742531 - RNA, 12 nt, Human
gguuuccugccc

SEQ ID NO: 1742532 - RNA, 15 nt, Human
aaauauaggaacuua

SEQ ID NO: 1742533 - RNA, 20 nt, Human
aaauaccagccaguaaaugg

SEQ ID NO: 1742534 - RNA, 21 nt, Human
aaauaccagccaguaaauggg

SEQ ID NO: 1742535 - RNA, 16 nt, Human
guacacacacauacac

SEQ ID NO: 1742536 - RNA, 19 nt, Human
aaauaccagccaguaaaug

SEQ ID NO: 1742537 - RNA, 18 nt, Human
aaauauaugcuaagucuu

SEQ ID NO: 1742538 - RNA, 14 nt, Human
aaauauauaucaaa

SEQ ID NO: 1742539 - RNA, 22 nt, Human
aaauauauuuuaagacgaaaca

SEQ ID NO: 1742540 - RNA, 16 nt, Human
aaauauauuuuaagac

SEQ ID NO: 1742541 - RNA, 23 nt, Human
aaaucagccugcuccagcuguuc

SEQ ID NO: 1742542 - RNA, 21 nt, Human
aaaucagccugcuccagcugu

SEQ ID NO: 1742543 - RNA, 19 nt, Human
aaaucagccugcuccagcu

SEQ ID NO: 1742544 - RNA, 19 nt, Human
aaauauuaagaaagacuau

SEQ ID NO: 1742545 - RNA, 20 nt, Human
aaauauuccugcauuuguga

SEQ ID NO: 1742546 - RNA, 19 nt, Human
aaauauggucuuuugguua

SEQ ID NO: 1742547 - RNA, 23 nt, Human
aaauaucugaaaauguaugugua

SEQ ID NO: 1742548 - RNA, 22 nt, Human
aaauaucugaaaauguaugugu

SEQ ID NO: 1742549 - RNA, 21 nt, Human
aaauaucugaaaauguaugug

SEQ ID NO: 1742550 - RNA, 19 nt, Human
aaauaucugaaaauguaug

SEQ ID NO: 1742551 - RNA, 18 nt, Human
aaauaucugaaaauguau

SEQ ID NO: 1742552 - RNA, 17 nt, Human
aaauaucugaaaaugua

SEQ ID NO: 1742553 - RNA, 14 nt, Human
aaauaucugaaaau

SEQ ID NO: 1742554 - RNA, 12 nt, Human
aaauaucugaaa

SEQ ID NO: 1742555 - RNA, 13 nt, Human
guaacuaaaauaa

SEQ ID NO: 1742556 - RNA, 15 nt, Human
guaacuaaaauaauu

SEQ ID NO: 1742557 - RNA, 20 nt, Human
guaacuaaaauaauuuugua

SEQ ID NO: 1742558 - RNA, 22 nt, Human
guaacuaaaauaauuuuguaau

SEQ ID NO: 1742559 - RNA, 12 nt, Human
guaauaauaaag

SEQ ID NO: 1742560 - RNA, 16 nt, Human
guaauaauaaagaaua

SEQ ID NO: 1742561 - RNA, 15 nt, Human
guaaucgaccugccu

SEQ ID NO: 1742562 - RNA, 23 nt, Human
guaauccuagcacuuugggaggc

SEQ ID NO: 1742563 - RNA, 15 nt, Human
guaauuugugauaca

SEQ ID NO: 1742564 - RNA, 17 nt, Human
guaaucgaccugccucg

SEQ ID NO: 1742565 - RNA, 17 nt, Human
guaauuugugauacaau

SEQ ID NO: 1742566 - RNA, 20 nt, Human
guaauuugugauacaaugcu

SEQ ID NO: 1742567 - RNA, 22 nt, Human
guaauuugugauacaaugcugu

SEQ ID NO: 1742568 - RNA, 21 nt, Human
guaauuuuuuuaucgucacug

SEQ ID NO: 1742569 - RNA, 22 nt, Human
guacaaccuguucugcuuuccu

SEQ ID NO: 1742570 - RNA, 22 nt, Human
aaaguguauuuuuuuacuaaua

SEQ ID NO: 1742571 - RNA, 22 nt, Human
aaauaaugugaaacuggauuaa

SEQ ID NO: 1742572 - RNA, 14 nt, Human
aaauaaugugaaac

SEQ ID NO: 1742573 - RNA, 13 nt, Human
guaaaccuuuuau

SEQ ID NO: 1742574 - RNA, 20 nt, Human
guaacaggaaaauuuuaaaa

SEQ ID NO: 1742575 - RNA, 19 nt, Human
guaacaggaaaauuuuaaa

SEQ ID NO: 1742576 - RNA, 16 nt, Human
guaacaagccacccca

SEQ ID NO: 1742577 - RNA, 15 nt, Human
guaaagcuagaaaug

SEQ ID NO: 1742578 - RNA, 16 nt, Human
guaaagcuagaaauga

SEQ ID NO: 1742579 - RNA, 23 nt, Human
ggguuuugccauguuggccaggc

SEQ ID NO: 1742580 - RNA, 20 nt, Human
ggguuuugccauguuggcca

SEQ ID NO: 1742581 - RNA, 19 nt, Human
gggugggacacccugugau

SEQ ID NO: 1742582 - RNA, 15 nt, Human
gggugguggugauag

SEQ ID NO: 1742583 - RNA, 13 nt, Human
gguaacaggcaga

SEQ ID NO: 1742584 - RNA, 22 nt, Human
gguaaaucagacuaugaaguuu

SEQ ID NO: 1742585 - RNA, 21 nt, Human
aaacguggcugcuucaaggau

SEQ ID NO: 1742586 - RNA, 18 nt, Human
gggugggacacccuguga

SEQ ID NO: 1742587 - RNA, 15 nt, Human
gggugggacacccug

SEQ ID NO: 1742588 - RNA, 14 nt, Human
aaacuuaaucuaaa

SEQ ID NO: 1742589 - RNA, 14 nt, Human
gguaucaggugcug

SEQ ID NO: 1742590 - RNA, 20 nt, Human
gguaggguaagugagagagg

SEQ ID NO: 1742591 - RNA, 23 nt, Human
gguagggugggccuucagggagu

SEQ ID NO: 1742592 - RNA, 11 nt, Human
gguaggguggg

SEQ ID NO: 1742593 - RNA, 13 nt, Human
gguauagaaaugc

SEQ ID NO: 1742594 - RNA, 20 nt, Human
gguaaggaauaccugucccc

SEQ ID NO: 1742595 - RNA, 22 nt, Human
aaacuugauguguuaucucuua

SEQ ID NO: 1742596 - RNA, 14 nt, Human
ggucagugcaaaua

SEQ ID NO: 1742597 - RNA, 19 nt, Human
gguaucaggugcugccauc

SEQ ID NO: 1742598 - RNA, 19 nt, Human
aaacauuuugucauauaag

SEQ ID NO: 1742599 - RNA, 20 nt, Human
gggucacucuggcagcucag

SEQ ID NO: 1742600 - RNA, 14 nt, Human
gggucacucuggca

SEQ ID NO: 1742601 - RNA, 22 nt, Human
gggucacucuggcagcucagag

SEQ ID NO: 1742602 - RNA, 22 nt, Human
aaaccugugucucugagaguag

SEQ ID NO: 1742603 - RNA, 17 nt, Human
aaaccuucacuuaggaa

SEQ ID NO: 1742604 - RNA, 15 nt, Human
ggggaccagagcugc

SEQ ID NO: 1742605 - RNA, 14 nt, Human
ggggaccagagcug

SEQ ID NO: 1742606 - RNA, 13 nt, Human
ggggaccagagcu

SEQ ID NO: 1742607 - RNA, 12 nt, Human
ggggaccagagc

SEQ ID NO: 1742608 - RNA, 18 nt, Human
aaaauguauguguaagua

SEQ ID NO: 1742609 - RNA, 15 nt, Human
gggggcugggcagag

SEQ ID NO: 1742610 - RNA, 13 nt, Human
ggggguggccucc

SEQ ID NO: 1742611 - RNA, 21 nt, Human
ggggucacucuggcagcucag

SEQ ID NO: 1742612 - RNA, 15 nt, Human
ggggcccugccuccu

SEQ ID NO: 1742613 - RNA, 17 nt, Human
gggggaucacagccucu

SEQ ID NO: 1742614 - RNA, 11 nt, Human
gggggcuggga

SEQ ID NO: 1742615 - RNA, 15 nt, Human
aaaauauuccugcau

SEQ ID NO: 1742616 - RNA, 22 nt, Human
aaaauaugaccacacuccagcu

SEQ ID NO: 1742617 - RNA, 16 nt, Human
aaaauauuuuccugcc

SEQ ID NO: 1742618 - RNA, 20 nt, Human
aaaauggaagacagcucuua

SEQ ID NO: 1742619 - RNA, 23 nt, Human
aaaaugcuguauuagucacagag

SEQ ID NO: 1742620 - RNA, 12 nt, Human
aaaaugagaaau

SEQ ID NO: 1742621 - RNA, 11 nt, Human
aaaaugagaaa

SEQ ID NO: 1742622 - RNA, 15 nt, Human
aaaaucugcuaggga

SEQ ID NO: 1742623 - RNA, 13 nt, Human
aaaauaauuuugu

SEQ ID NO: 1742624 - RNA, 14 nt, Human
aaaauaauuuugua

SEQ ID NO: 1742625 - RNA, 13 nt, Human
aaaauaccaagga

SEQ ID NO: 1742626 - RNA, 14 nt, Human
aaaauaccaaggaa

SEQ ID NO: 1742627 - RNA, 11 nt, Human
aaaaggcagga

SEQ ID NO: 1742628 - RNA, 17 nt, Human
aaaagguuaauaaagua

SEQ ID NO: 1742629 - RNA, 16 nt, Human
aaaagguuaauaaagu

SEQ ID NO: 1742630 - RNA, 14 nt, Human
aaaaggaugcacag

SEQ ID NO: 1742631 - RNA, 15 nt, Human
aaaaggaugcacaga

SEQ ID NO: 1742632 - RNA, 19 nt, Human
aaaaggaugcacagaguug

SEQ ID NO: 1742633 - RNA, 22 nt, Human
aaaaggaugcacagaguuguua

SEQ ID NO: 1742634 - RNA, 22 nt, Human
aaaaggagccaauuuaaagaaa

SEQ ID NO: 1742635 - RNA, 13 nt, Human
aaaaggaugcaca

SEQ ID NO: 1742636 - RNA, 16 nt, Human
aaaaugguuuaaaugg

SEQ ID NO: 1742637 - RNA, 18 nt, Human
aaaaugguuuaaaugguc

SEQ ID NO: 1742638 - RNA, 17 nt, Human
gggcuggguucuaccca

SEQ ID NO: 1742639 - RNA, 15 nt, Human
gggcugggcagagga

SEQ ID NO: 1742640 - RNA, 21 nt, Human
gggcugcaccggcuggccugg

SEQ ID NO: 1742641 - RNA, 20 nt, Human
gggcugcaccggcuggccug

SEQ ID NO: 1742642 - RNA, 19 nt, Human
gggcucagcggggacagcu

SEQ ID NO: 1742643 - RNA, 17 nt, Human
gggcucagcggggacag

SEQ ID NO: 1742644 - RNA, 22 nt, Human
gggcucagcaaaagaugcuucu

SEQ ID NO: 1742645 - RNA, 18 nt, Human
gggcuaguugggcuuccu

SEQ ID NO: 1742646 - RNA, 15 nt, Human
gggcuaguugggcuu

SEQ ID NO: 1742647 - RNA, 20 nt, Human
gggcuaggaaauccagggug

SEQ ID NO: 1742648 - RNA, 13 nt, Human
gggcuccagacac

SEQ ID NO: 1742649 - RNA, 10 nt, Human
gggcuccaga

SEQ ID NO: 1742650 - RNA, 21 nt, Human
gggcucagcggggacagcucc

SEQ ID NO: 1742651 - RNA, 19 nt, Human
gggcugcaccggcuggccu

SEQ ID NO: 1742652 - RNA, 15 nt, Human
gggcgugguggugag

SEQ ID NO: 1742653 - RNA, 21 nt, Human
gggcggugagaggggaacaga

SEQ ID NO: 1742654 - RNA, 19 nt, Human
gggcgugagaccugccccu

SEQ ID NO: 1742655 - RNA, 18 nt, Human
gggcgugagaccugcccc

SEQ ID NO: 1742656 - RNA, 22 nt, Human
gggccucgguguggagaagcgg

SEQ ID NO: 1742657 - RNA, 18 nt, Human
gggccucuuaugggcugg

SEQ ID NO: 1742658 - RNA, 19 nt, Human
gggccucuuaugggcuggg

SEQ ID NO: 1742659 - RNA, 14 nt, Human
gggccucagugcca

SEQ ID NO: 1742660 - RNA, 13 nt, Human
gggccucagugcc

SEQ ID NO: 1742661 - RNA, 15 nt, Human
gggccucagugccac

SEQ ID NO: 1742662 - RNA, 14 nt, Human
gggccaggagccuc

SEQ ID NO: 1742663 - RNA, 13 nt, Human
gggccaggagccu

SEQ ID NO: 1742664 - RNA, 20 nt, Human
gcuguuggcugggggccuca

SEQ ID NO: 1742665 - RNA, 16 nt, Human
gcuguuggcugggggc

SEQ ID NO: 1742666 - RNA, 15 nt, Human
gcuguuggcuggggg

SEQ ID NO: 1742667 - RNA, 17 nt, Human
gcugugcugcccugccc

SEQ ID NO: 1742668 - RNA, 16 nt, Human
gcugugcugcccugcc

SEQ ID NO: 1742669 - RNA, 15 nt, Human
gcugugcugcccugc

SEQ ID NO: 1742670 - RNA, 13 nt, Human
gcugugcucugga

SEQ ID NO: 1742671 - RNA, 16 nt, Human
gcugugccucugccug

SEQ ID NO: 1742672 - RNA, 15 nt, Human
gcugugccucugccu

SEQ ID NO: 1742673 - RNA, 14 nt, Human
gcugugccucugcc

SEQ ID NO: 1742674 - RNA, 16 nt, Human
gcugugcucuggacag

SEQ ID NO: 1742675 - RNA, 15 nt, Human
gcugugcucuggaca

SEQ ID NO: 1742676 - RNA, 18 nt, Human
gcugugcucuggacaggc

SEQ ID NO: 1742677 - RNA, 14 nt, Human
gcugugcugcccug

SEQ ID NO: 1742678 - RNA, 19 nt, Human
gcuguaucccaugagccuc

SEQ ID NO: 1742679 - RNA, 17 nt, Human
gcuguaucccaugagcc

SEQ ID NO: 1742680 - RNA, 12 nt, Human
gcugcugaaggc

SEQ ID NO: 1742681 - RNA, 14 nt, Human
gcuggcgugcagug

SEQ ID NO: 1742682 - RNA, 19 nt, Human
gcuggcuguuggcuggggg

SEQ ID NO: 1742683 - RNA, 18 nt, Human
gcuggcuguuggcugggg

SEQ ID NO: 1742684 - RNA, 11 nt, Human
gcuggcugccu

SEQ ID NO: 1742685 - RNA, 20 nt, Human
gcuggcugccuuagaaccuu

SEQ ID NO: 1742686 - RNA, 14 nt, Human
gcuggcugccuuag

SEQ ID NO: 1742687 - RNA, 18 nt, Human
gcuggcgugcaguggugc

SEQ ID NO: 1742688 - RNA, 15 nt, Human
gcuggcgugcagugg

SEQ ID NO: 1742689 - RNA, 21 nt, Human
gcuggguucuacccaggugcu

SEQ ID NO: 1742690 - RNA, 20 nt, Human
gcuggguucuacccaggugc

SEQ ID NO: 1742691 - RNA, 17 nt, Human
gcuggguucuacccagg

SEQ ID NO: 1742692 - RNA, 18 nt, Human
gcuggguucuacccaggu

SEQ ID NO: 1742693 - RNA, 23 nt, Human
gcugggguggggaccucaggccu

SEQ ID NO: 1742694 - RNA, 22 nt, Human
gcugggguggggaccucaggcc

SEQ ID NO: 1742695 - RNA, 19 nt, Human
gcugggguggggaccucag

SEQ ID NO: 1742696 - RNA, 17 nt, Human
gcugggguggggaccuc

SEQ ID NO: 1742697 - RNA, 20 nt, Human
gcugggccccugccucucug

SEQ ID NO: 1742698 - RNA, 18 nt, Human
gcugggccccugccucuc

SEQ ID NO: 1742699 - RNA, 14 nt, Human
gcugggccccugcc

SEQ ID NO: 1742700 - RNA, 13 nt, Human
gcugggccccugc

SEQ ID NO: 1742701 - RNA, 12 nt, Human
gcugggccccug

SEQ ID NO: 1742702 - RNA, 23 nt, Human
gcuggcuguuggcugggggccuc

SEQ ID NO: 1742703 - RNA, 20 nt, Human
gcuggcuguuggcugggggc

SEQ ID NO: 1742704 - RNA, 15 nt, Human
gcugaggugggagga

SEQ ID NO: 1742705 - RNA, 14 nt, Human
gcugaggugggagg

SEQ ID NO: 1742706 - RNA, 23 nt, Human
gcugagggugagugggugaauaa

SEQ ID NO: 1742707 - RNA, 16 nt, Human
gcugagaggagagaga

SEQ ID NO: 1742708 - RNA, 14 nt, Human
gcugcaccggcugg

SEQ ID NO: 1742709 - RNA, 13 nt, Human
gcugcaccggcug

SEQ ID NO: 1742710 - RNA, 19 nt, Human
gcugcacccucaggcaggu

SEQ ID NO: 1742711 - RNA, 18 nt, Human
gcugcacccucaggcagg

SEQ ID NO: 1742712 - RNA, 13 nt, Human
gcugccucaugcu

SEQ ID NO: 1742713 - RNA, 16 nt, Human
gcugccucucccauca

SEQ ID NO: 1742714 - RNA, 20 nt, Human
gcugccugggaucccucauc

SEQ ID NO: 1742715 - RNA, 13 nt, Human
gcugccuguucag

SEQ ID NO: 1742716 - RNA, 12 nt, Human
gcugccuguuca

SEQ ID NO: 1742717 - RNA, 17 nt, Human
gcugccuguucagcucc

SEQ ID NO: 1742718 - RNA, 23 nt, Human
gcugcucuugaacuccugaccuc

SEQ ID NO: 1742719 - RNA, 21 nt, Human
gcugccugggaucccucaucc

SEQ ID NO: 1742720 - RNA, 19 nt, Human
gcugccccuggcagccccu

SEQ ID NO: 1742721 - RNA, 18 nt, Human
gcugccccuggcagcccc

SEQ ID NO: 1742722 - RNA, 20 nt, Human
gcugccccuggcagccccug

SEQ ID NO: 1742723 - RNA, 15 nt, Human
gcuuuuuaauauuga

SEQ ID NO: 1742724 - RNA, 13 nt, Human
gcuuuugugcauu

SEQ ID NO: 1742725 - RNA, 19 nt, Human
gcuuuugugcauuaucuag

SEQ ID NO: 1742726 - RNA, 16 nt, Human
ggaaaaaauaacaaug

SEQ ID NO: 1742727 - RNA, 21 nt, Human
ggaaacuaggugcauauuuau

SEQ ID NO: 1742728 - RNA, 20 nt, Human
ggaaacagcuaaugggacac

SEQ ID NO: 1742729 - RNA, 15 nt, Human
ggaaacccagcucug

SEQ ID NO: 1742730 - RNA, 17 nt, Human
ggaaagaguaggaagac

SEQ ID NO: 1742731 - RNA, 16 nt, Human
ggaaagaguaggaaga

SEQ ID NO: 1742732 - RNA, 19 nt, Human
ggaaagcaaaggagauugg

SEQ ID NO: 1742733 - RNA, 14 nt, Human
ggaaagaggcucug

SEQ ID NO: 1742734 - RNA, 20 nt, Human
ggaaagacuuuuccaacccu

SEQ ID NO: 1742735 - RNA, 20 nt, Human
gcuuuucccuuuuuuuaagu

SEQ ID NO: 1742736 - RNA, 21 nt, Human
gcuuuucccuuuuuuuaagua

SEQ ID NO: 1742737 - RNA, 16 nt, Human
gcuuggggaccagagc

SEQ ID NO: 1742738 - RNA, 23 nt, Human
gcuugggcuucauccuccucaga

SEQ ID NO: 1742739 - RNA, 19 nt, Human
gcuugaccgugaggccaga

SEQ ID NO: 1742740 - RNA, 18 nt, Human
gcuugaccgugaggccag

SEQ ID NO: 1742741 - RNA, 17 nt, Human
gcuugaccgugaggcca

SEQ ID NO: 1742742 - RNA, 23 nt, Human
gcuucuucagagacuccugcagg

SEQ ID NO: 1742743 - RNA, 21 nt, Human
gcuucuucagagacuccugca

SEQ ID NO: 1742744 - RNA, 19 nt, Human
gcuucuucagagacuccug

SEQ ID NO: 1742745 - RNA, 16 nt, Human
gcuuaacuucacauau

SEQ ID NO: 1742746 - RNA, 17 nt, Human
gcuuaacuucacauauu

SEQ ID NO: 1742747 - RNA, 16 nt, Human
gcuucuucagagacuc

SEQ ID NO: 1742748 - RNA, 23 nt, Human
gcuuucuacccagcgagcccugg

SEQ ID NO: 1742749 - RNA, 22 nt, Human
gcuuucuacccagcgagcccug

SEQ ID NO: 1742750 - RNA, 19 nt, Human
gcuuucuacccagcgagcc

SEQ ID NO: 1742751 - RNA, 13 nt, Human
gcuuucuacccag

SEQ ID NO: 1742752 - RNA, 21 nt, Human
gcuuggggaccagagcugcca

SEQ ID NO: 1742753 - RNA, 20 nt, Human
gcuuggggaccagagcugcc

SEQ ID NO: 1742754 - RNA, 18 nt, Human
gcuuggggaccagagcug

SEQ ID NO: 1742755 - RNA, 17 nt, Human
gcuuggggaccagagcu

SEQ ID NO: 1742756 - RNA, 22 nt, Human
gcuuggggaccagagcugccac

SEQ ID NO: 1742757 - RNA, 14 nt, Human
gcuuuggaaguuuu

SEQ ID NO: 1742758 - RNA, 17 nt, Human
ggaagcucagggccugg

SEQ ID NO: 1742759 - RNA, 16 nt, Human
ggaagcucagggccug

SEQ ID NO: 1742760 - RNA, 15 nt, Human
ggaauaccugucccc

SEQ ID NO: 1742761 - RNA, 21 nt, Human
ggaagcucagggccuggcuca

SEQ ID NO: 1742762 - RNA, 22 nt, Human
ggaagcucagggccuggcucag

SEQ ID NO: 1742763 - RNA, 16 nt, Human
ggaauauauaaccagu

SEQ ID NO: 1742764 - RNA, 19 nt, Human
ggaauaccugucccccuga

SEQ ID NO: 1742765 - RNA, 16 nt, Human
ggaauaccuguccccc

SEQ ID NO: 1742766 - RNA, 12 nt, Human
ggacacagcucu

SEQ ID NO: 1742767 - RNA, 14 nt, Human
ggaaugauuaauua

SEQ ID NO: 1742768 - RNA, 19 nt, Human
ggaaugaaugucaguguga

SEQ ID NO: 1742769 - RNA, 13 nt, Human
ggacacagcucuu

SEQ ID NO: 1742770 - RNA, 14 nt, Human
ggacacagcucuuc

SEQ ID NO: 1742771 - RNA, 12 nt, Human
ggacacccugug

SEQ ID NO: 1742772 - RNA, 15 nt, Human
ggacagggcauggcc

SEQ ID NO: 1742773 - RNA, 22 nt, Human
ggacagggcauggccagguggc

SEQ ID NO: 1742774 - RNA, 17 nt, Human
ggacagggaggugaccc

SEQ ID NO: 1742775 - RNA, 23 nt, Human
ggacacccugugauggggcccug

SEQ ID NO: 1742776 - RNA, 13 nt, Human
ggacacccuguga

SEQ ID NO: 1742777 - RNA, 14 nt, Human
ggacauggacaagg

SEQ ID NO: 1742778 - RNA, 13 nt, Human
ggacauggacaag

SEQ ID NO: 1742779 - RNA, 23 nt, Human
ggaaaucaccgaaaacguggcug

SEQ ID NO: 1742780 - RNA, 16 nt, Human
ggaaauccaggguggu

SEQ ID NO: 1742781 - RNA, 21 nt, Human
ggaagccagcaggcucucagg

SEQ ID NO: 1742782 - RNA, 23 nt, Human
ggaagccagcaggcucucaggcc

SEQ ID NO: 1742783 - RNA, 22 nt, Human
ggaagccagcaggcucucaggc

SEQ ID NO: 1742784 - RNA, 18 nt, Human
ggaagccgcuggggccag

SEQ ID NO: 1742785 - RNA, 16 nt, Human
gcucagagcaguguuu

SEQ ID NO: 1742786 - RNA, 19 nt, Human
gcucagggccuggcucagg

SEQ ID NO: 1742787 - RNA, 18 nt, Human
gcucagggccuggcucag

SEQ ID NO: 1742788 - RNA, 13 nt, Human
gcucaggaguuug

SEQ ID NO: 1742789 - RNA, 23 nt, Human
gcucaggagcccugggaggcucu

SEQ ID NO: 1742790 - RNA, 22 nt, Human
gcucaggagcccugggaggcuc

SEQ ID NO: 1742791 - RNA, 20 nt, Human
gcucagggccuggcucaggu

SEQ ID NO: 1742792 - RNA, 18 nt, Human
gcuauucaguaauaacuc

SEQ ID NO: 1742793 - RNA, 16 nt, Human
gcuaguugggcuuccu

SEQ ID NO: 1742794 - RNA, 14 nt, Human
gcuaguugggcuuc

SEQ ID NO: 1742795 - RNA, 21 nt, Human
gcuaguugggcuuccucauag

SEQ ID NO: 1742796 - RNA, 20 nt, Human
gcuaggaccccuccaugugg

SEQ ID NO: 1742797 - RNA, 22 nt, Human
gcuaggaccccuccaugugggc

SEQ ID NO: 1742798 - RNA, 21 nt, Human
gcuaggaauuguguuuauaau

SEQ ID NO: 1742799 - RNA, 22 nt, Human
gcuaagugauccucccaccuca

SEQ ID NO: 1742800 - RNA, 18 nt, Human
gcuaagugauccucccac

SEQ ID NO: 1742801 - RNA, 15 nt, Human
gcggcuggcagccca

SEQ ID NO: 1742802 - RNA, 16 nt, Human
gcgcaggcuggcccug

SEQ ID NO: 1742803 - RNA, 15 nt, Human
gcgcaggcuggcccu

SEQ ID NO: 1742804 - RNA, 23 nt, Human
gcgauucuucugcuucagccucc

SEQ ID NO: 1742805 - RNA, 21 nt, Human
gcgcagcauauucaggaagcu

SEQ ID NO: 1742806 - RNA, 14 nt, Human
gcgcaggcuggccc

SEQ ID NO: 1742807 - RNA, 23 nt, Human
gccuugaccauucuccaccugcc

SEQ ID NO: 1742808 - RNA, 22 nt, Human
gcgauucuucugcuucagccuc

SEQ ID NO: 1742809 - RNA, 22 nt, Human
gccuugaccauucuccaccugc

SEQ ID NO: 1742810 - RNA, 16 nt, Human
gccuugaccauucucc

SEQ ID NO: 1742811 - RNA, 23 nt, Human
gccuugaacuuugaccucugcag

SEQ ID NO: 1742812 - RNA, 19 nt, Human
gccugugccucugggacug

SEQ ID NO: 1742813 - RNA, 11 nt, Human
gccugggcaga

SEQ ID NO: 1742814 - RNA, 23 nt, Human
gccugggaucccucauccucaua

SEQ ID NO: 1742815 - RNA, 17 nt, Human
gccuguucagcuccagc

SEQ ID NO: 1742816 - RNA, 16 nt, Human
gccuguucagcuccag

SEQ ID NO: 1742817 - RNA, 15 nt, Human
gccuguucagcucca

SEQ ID NO: 1742818 - RNA, 16 nt, Human
gccuucucugaaggac

SEQ ID NO: 1742819 - RNA, 15 nt, Human
gccuucucugaagga

SEQ ID NO: 1742820 - RNA, 14 nt, Human
gccuugaacuuuga

SEQ ID NO: 1742821 - RNA, 19 nt, Human
gcauuuaggccaugggaca

SEQ ID NO: 1742822 - RNA, 18 nt, Human
gcauuuacuuuguguuca

SEQ ID NO: 1742823 - RNA, 21 nt, Human
gcccacgcccccacuggugac

SEQ ID NO: 1742824 - RNA, 17 nt, Human
gcccacgcccccacugg

SEQ ID NO: 1742825 - RNA, 16 nt, Human
gcccacgcccccacug

SEQ ID NO: 1742826 - RNA, 15 nt, Human
gcccacgcccccacu

SEQ ID NO: 1742827 - RNA, 17 nt, Human
gccauugacuucuuccc

SEQ ID NO: 1742828 - RNA, 23 nt, Human
gcccaggaaaggcuccaggagca

SEQ ID NO: 1742829 - RNA, 22 nt, Human
gcccaggaaaggcuccaggagc

SEQ ID NO: 1742830 - RNA, 24 nt, Human
gcccaggaaaggcuccaggagcag

SEQ ID NO: 1742831 - RNA, 13 nt, Human
gcccacuucugcc

SEQ ID NO: 1742832 - RNA, 21 nt, Human
gcccacgcuggagugcaguga

SEQ ID NO: 1742833 - RNA, 19 nt, Human
gcccacgcuggagugcagu

SEQ ID NO: 1742834 - RNA, 23 nt, Human
gcccacgcuggagugcagugagc

SEQ ID NO: 1742835 - RNA, 22 nt, Human
gcccacuguacuugcucuugau

SEQ ID NO: 1742836 - RNA, 20 nt, Human
gcccacuguacuugcucuug

SEQ ID NO: 1742837 - RNA, 15 nt, Human
gcccacuguacuugc

SEQ ID NO: 1742838 - RNA, 22 nt, Human
gcccaggccccugccacccugg

SEQ ID NO: 1742839 - RNA, 21 nt, Human
gcccaggccccugccacccug

SEQ ID NO: 1742840 - RNA, 20 nt, Human
gcccaggccccugccacccu

SEQ ID NO: 1742841 - RNA, 12 nt, Human
gcccaggccccu

SEQ ID NO: 1742842 - RNA, 11 nt, Human
gcccaggcccc

SEQ ID NO: 1742843 - RNA, 11 nt, Human
gcccaggcagg

SEQ ID NO: 1742844 - RNA, 12 nt, Human
gcccaggcaggu

SEQ ID NO: 1742845 - RNA, 11 nt, Human
gccccaaaagg

SEQ ID NO: 1742846 - RNA, 21 nt, Human
gccccaaaacucuccucugcu

SEQ ID NO: 1742847 - RNA, 20 nt, Human
gccccaaaacucuccucugc

SEQ ID NO: 1742848 - RNA, 15 nt, Human
gccccuggcagcccc

SEQ ID NO: 1742849 - RNA, 12 nt, Human
gccccuggcagc

SEQ ID NO: 1742850 - RNA, 16 nt, Human
gccccugcugguucag

SEQ ID NO: 1742851 - RNA, 15 nt, Human
gccccugcugguuca

SEQ ID NO: 1742852 - RNA, 17 nt, Human
gcccccucugcccugcg

SEQ ID NO: 1742853 - RNA, 12 nt, Human
gccccugcuggu

SEQ ID NO: 1742854 - RNA, 16 nt, Human
gcccccucugcccugc

SEQ ID NO: 1742855 - RNA, 15 nt, Human
gcccccucugcccug

SEQ ID NO: 1742856 - RNA, 13 nt, Human
gccuccauccuga

SEQ ID NO: 1742857 - RNA, 14 nt, Human
gccuccauccugag

SEQ ID NO: 1742858 - RNA, 15 nt, Human
gccuccauccugagg

SEQ ID NO: 1742859 - RNA, 18 nt, Human
gccuccugcccuuaccug

SEQ ID NO: 1742860 - RNA, 19 nt, Human
gccuccugaguagcuggga

SEQ ID NO: 1742861 - RNA, 13 nt, Human
gccucgaacuggc

SEQ ID NO: 1742862 - RNA, 22 nt, Human
gccuccuuugugaggaagccgc

SEQ ID NO: 1742863 - RNA, 16 nt, Human
gccucgaacuggcugc

SEQ ID NO: 1742864 - RNA, 22 nt, Human
gccucauguccacugguucuuc

SEQ ID NO: 1742865 - RNA, 19 nt, Human
gccucaugucaaauauuua

SEQ ID NO: 1742866 - RNA, 19 nt, Human
gccucaugcuaagacucag

SEQ ID NO: 1742867 - RNA, 12 nt, Human
gccuagcauacg

SEQ ID NO: 1742868 - RNA, 19 nt, Human
gccuagcauacguacacau

SEQ ID NO: 1742869 - RNA, 17 nt, Human
gccuacaggagugagca

SEQ ID NO: 1742870 - RNA, 17 nt, Human
gccccuggcagccccug

SEQ ID NO: 1742871 - RNA, 16 nt, Human
gccccuggcagccccu

SEQ ID NO: 1742872 - RNA, 21 nt, Human
gccccugcugguucaggguug

SEQ ID NO: 1742873 - RNA, 22 nt, Human
gcccuuaccugccaggaagcca

SEQ ID NO: 1742874 - RNA, 21 nt, Human
gcccuuaccugccaggaagcc

SEQ ID NO: 1742875 - RNA, 17 nt, Human
gcccugugggcccccaa

SEQ ID NO: 1742876 - RNA, 16 nt, Human
gcccugugggccccca

SEQ ID NO: 1742877 - RNA, 21 nt, Human
gcccugugggcccccaaaugg

SEQ ID NO: 1742878 - RNA, 23 nt, Human
gcccuuaccugccaggaagccag

SEQ ID NO: 1742879 - RNA, 19 nt, Human
gcccuuagcagggaaacag

SEQ ID NO: 1742880 - RNA, 15 nt, Human
gcccugcccaccugg

SEQ ID NO: 1742881 - RNA, 14 nt, Human
gcccugcccaccug

SEQ ID NO: 1742882 - RNA, 20 nt, Human
gcccugcgggucacaggagg

SEQ ID NO: 1742883 - RNA, 16 nt, Human
gccuacaggagugagc

SEQ ID NO: 1742884 - RNA, 21 nt, Human
gcccuuccaugucgccucugc

SEQ ID NO: 1742885 - RNA, 12 nt, Human
gcccuuccaugu

SEQ ID NO: 1742886 - RNA, 12 nt, Human
gcccuuccucuc

SEQ ID NO: 1742887 - RNA, 22 nt, Human
gcccuuccaugucgccucugca

SEQ ID NO: 1742888 - RNA, 15 nt, Human
gcccuuccucuccac

SEQ ID NO: 1742889 - RNA, 14 nt, Human
gcccuuccucucca

SEQ ID NO: 1742890 - RNA, 20 nt, Human
gacuuuuccaacccucauca

SEQ ID NO: 1742891 - RNA, 19 nt, Human
gacuuuuccaacccucauc

SEQ ID NO: 1742892 - RNA, 14 nt, Human
gacuuuuccaaccc

SEQ ID NO: 1742893 - RNA, 18 nt, Human
gacuuuuauuuccaguga

SEQ ID NO: 1742894 - RNA, 23 nt, Human
gagaaugaaagggcccagagagg

SEQ ID NO: 1742895 - RNA, 15 nt, Human
gagaaugaaagggcc

SEQ ID NO: 1742896 - RNA, 14 nt, Human
gagacggaguccca

SEQ ID NO: 1742897 - RNA, 19 nt, Human
gagacggagucccaccuug

SEQ ID NO: 1742898 - RNA, 16 nt, Human
gagacggagucccacc

SEQ ID NO: 1742899 - RNA, 18 nt, Human
gagacgggggcagagagg

SEQ ID NO: 1742900 - RNA, 21 nt, Human
gagauugugccccugcacucc

SEQ ID NO: 1742901 - RNA, 14 nt, Human
gagauuggaaggaa

SEQ ID NO: 1742902 - RNA, 20 nt, Human
gagaugcuagaacucccuuu

SEQ ID NO: 1742903 - RNA, 16 nt, Human
gagaugcuagaacucc

SEQ ID NO: 1742904 - RNA, 15 nt, Human
gagauuauguucuuu

SEQ ID NO: 1742905 - RNA, 20 nt, Human
gagagcugggugucaagagg

SEQ ID NO: 1742906 - RNA, 12 nt, Human
gagaggaaauca

SEQ ID NO: 1742907 - RNA, 22 nt, Human
gagagcuucuguugcugccuca

SEQ ID NO: 1742908 - RNA, 15 nt, Human
gagaggacccccuga

SEQ ID NO: 1742909 - RNA, 20 nt, Human
gagagccuuccagggguggg

SEQ ID NO: 1742910 - RNA, 18 nt, Human
gagagccuuccaggggug

SEQ ID NO: 1742911 - RNA, 21 nt, Human
gagagcuagcagcagggaggg

SEQ ID NO: 1742912 - RNA, 15 nt, Human
gagagcuagcagcag

SEQ ID NO: 1742913 - RNA, 13 nt, Human
gagagcugggugu

SEQ ID NO: 1742914 - RNA, 16 nt, Human
gagagccuuccagggg

SEQ ID NO: 1742915 - RNA, 15 nt, Human
gagagccuuccaggg

SEQ ID NO: 1742916 - RNA, 14 nt, Human
gagacuccugcagg

SEQ ID NO: 1742917 - RNA, 13 nt, Human
gagacuccugcag

SEQ ID NO: 1742918 - RNA, 14 nt, Human
gagcaucaggccag

SEQ ID NO: 1742919 - RNA, 13 nt, Human
gagcaugccugga

SEQ ID NO: 1742920 - RNA, 21 nt, Human
gagcaugccuggauggggcug

SEQ ID NO: 1742921 - RNA, 16 nt, Human
gagcaucaggccaggc

SEQ ID NO: 1742922 - RNA, 15 nt, Human
gagcaucaggccagg

SEQ ID NO: 1742923 - RNA, 17 nt, Human
gagcaucaggccaggcc

SEQ ID NO: 1742924 - RNA, 17 nt, Human
gagccccgaggccuucu

SEQ ID NO: 1742925 - RNA, 14 nt, Human
gagccccgaggccu

SEQ ID NO: 1742926 - RNA, 20 nt, Human
gagcccugggaggcucugga

SEQ ID NO: 1742927 - RNA, 19 nt, Human
gagcccugggaggcucugg

SEQ ID NO: 1742928 - RNA, 18 nt, Human
gagcccugggaggcucug

SEQ ID NO: 1742929 - RNA, 16 nt, Human
gagcccugggaggcuc

SEQ ID NO: 1742930 - RNA, 12 nt, Human
gagcccugggag

SEQ ID NO: 1742931 - RNA, 14 nt, Human
gagcccugguggca

SEQ ID NO: 1742932 - RNA, 13 nt, Human
gagcccugguggc

SEQ ID NO: 1742933 - RNA, 21 nt, Human
gaggacgcucucuggccuucg

SEQ ID NO: 1742934 - RNA, 20 nt, Human
gaggacgcucucuggccuuc

SEQ ID NO: 1742935 - RNA, 23 nt, Human
gaggacuuuucuuuguggcuucc

SEQ ID NO: 1742936 - RNA, 20 nt, Human
gaggacuuuucuuuguggcu

SEQ ID NO: 1742937 - RNA, 16 nt, Human
gaggacuuuucuuugu

SEQ ID NO: 1742938 - RNA, 12 nt, Human
gaggagaaacug

SEQ ID NO: 1742939 - RNA, 14 nt, Human
gaggagaaacugga

SEQ ID NO: 1742940 - RNA, 15 nt, Human
gaggagagaggaccc

SEQ ID NO: 1742941 - RNA, 14 nt, Human
gaggagagaggacc

SEQ ID NO: 1742942 - RNA, 12 nt, Human
gaggagagagga

SEQ ID NO: 1742943 - RNA, 20 nt, Human
gaggcagggucucacucugu

SEQ ID NO: 1742944 - RNA, 19 nt, Human
gaggcagggucucacucug

SEQ ID NO: 1742945 - RNA, 22 nt, Human
gaggcagggucucacucugucg

SEQ ID NO: 1742946 - RNA, 18 nt, Human
gaggcugagaugggagaa

SEQ ID NO: 1742947 - RNA, 20 nt, Human
gaggcucuggagcccacugu

SEQ ID NO: 1742948 - RNA, 17 nt, Human
gaggcuccacuuggucu

SEQ ID NO: 1742949 - RNA, 18 nt, Human
gaggcuccacuuggucug

SEQ ID NO: 1742950 - RNA, 15 nt, Human
gaggcuccacuuggu

SEQ ID NO: 1742951 - RNA, 21 nt, Human
gaggcauuuguuugaacugau

SEQ ID NO: 1742952 - RNA, 21 nt, Human
gaggcaugugaugagaggaaa

SEQ ID NO: 1742953 - RNA, 20 nt, Human
gaggcaugugaugagaggaa

SEQ ID NO: 1742954 - RNA, 22 nt, Human
gaggcaugugaugagaggaaau

SEQ ID NO: 1742955 - RNA, 19 nt, Human
gaggcauuuguuugaacug

SEQ ID NO: 1742956 - RNA, 21 nt, Human
gagggccugcaagggagugag

SEQ ID NO: 1742957 - RNA, 17 nt, Human
gagggccugcaagggag

SEQ ID NO: 1742958 - RNA, 14 nt, Human
gagggccugcaagg

SEQ ID NO: 1742959 - RNA, 12 nt, Human
gagggccugggc

SEQ ID NO: 1742960 - RNA, 18 nt, Human
gaaugcacaaacagaggc

SEQ ID NO: 1742961 - RNA, 17 nt, Human
gaauguuugccucugcc

SEQ ID NO: 1742962 - RNA, 16 nt, Human
gaauguuugccucugc

SEQ ID NO: 1742963 - RNA, 19 nt, Human
gaaugcacaaacagaggcc

SEQ ID NO: 1742964 - RNA, 14 nt, Human
gaaugauuaauuaa

SEQ ID NO: 1742965 - RNA, 14 nt, Human
gaaugaugccauga

SEQ ID NO: 1742966 - RNA, 20 nt, Human
gaaugaugauccuaggcauu

SEQ ID NO: 1742967 - RNA, 15 nt, Human
gaaugaauggcuaag

SEQ ID NO: 1742968 - RNA, 20 nt, Human
gaaugaauggcuaagcaaaa

SEQ ID NO: 1742969 - RNA, 14 nt, Human
gaauuaacacauga

SEQ ID NO: 1742970 - RNA, 15 nt, Human
gaauuaacacaugau

SEQ ID NO: 1742971 - RNA, 19 nt, Human
gaauguuugccucugccuc

SEQ ID NO: 1742972 - RNA, 18 nt, Human
gaauguuugccucugccu

SEQ ID NO: 1742973 - RNA, 13 nt, Human
gacacagcucuuc

SEQ ID NO: 1742974 - RNA, 21 nt, Human
gacacagcucuucuccaggcu

SEQ ID NO: 1742975 - RNA, 20 nt, Human
gacacagcucuucuccaggc

SEQ ID NO: 1742976 - RNA, 19 nt, Human
gacacagcucuucuccagg

SEQ ID NO: 1742977 - RNA, 12 nt, Human
gacacagcucuu

SEQ ID NO: 1742978 - RNA, 14 nt, Human
gaaugaauggcuaa

SEQ ID NO: 1742979 - RNA, 24 nt, Human
gaauauugcugauggugcaaugac

SEQ ID NO: 1742980 - RNA, 19 nt, Human
gaauauugccauuaugcuu

SEQ ID NO: 1742981 - RNA, 23 nt, Human
gaauauugcugauggugcaauga

SEQ ID NO: 1742982 - RNA, 22 nt, Human
gaauauugcugauggugcaaug

SEQ ID NO: 1742983 - RNA, 15 nt, Human
gaauauauaaccagu

SEQ ID NO: 1742984 - RNA, 13 nt, Human
gaauauugcugau

SEQ ID NO: 1742985 - RNA, 12 nt, Human
gaauauugcuga

SEQ ID NO: 1742986 - RNA, 11 nt, Human
gaauauugcug

SEQ ID NO: 1742987 - RNA, 14 nt, Human
gacgcucucuggcc

SEQ ID NO: 1742988 - RNA, 23 nt, Human
gacgcuacccgggaagggggcug

SEQ ID NO: 1742989 - RNA, 22 nt, Human
gacgcuacccgggaagggggcu

SEQ ID NO: 1742990 - RNA, 21 nt, Human
gacgcugugcugcccugccca

SEQ ID NO: 1742991 - RNA, 18 nt, Human
gacgcugugcugcccugc

SEQ ID NO: 1742992 - RNA, 17 nt, Human
gacgcugugcugcccug

SEQ ID NO: 1742993 - RNA, 16 nt, Human
gacgcugugcugcccu

SEQ ID NO: 1742994 - RNA, 13 nt, Human
gacgccaucccag

SEQ ID NO: 1742995 - RNA, 12 nt, Human
gacgccauccca

SEQ ID NO: 1742996 - RNA, 13 nt, Human
gaccucugccuga

SEQ ID NO: 1742997 - RNA, 21 nt, Human
gacgccaucccagccccaaug

SEQ ID NO: 1742998 - RNA, 15 nt, Human
gacgccaucccagcc

SEQ ID NO: 1742999 - RNA, 16 nt, Human
gaccucugcagcaaua

SEQ ID NO: 1743000 - RNA, 18 nt, Human
gaccucugcagcaauaaa

SEQ ID NO: 1743001 - RNA, 22 nt, Human
gaccucugcagcaauaaagcag

SEQ ID NO: 1743002 - RNA, 17 nt, Human
gacccggaggggccugg

SEQ ID NO: 1743003 - RNA, 16 nt, Human
gaccccugagcuugca

SEQ ID NO: 1743004 - RNA, 20 nt, Human
gacccggaggggccuggcag

SEQ ID NO: 1743005 - RNA, 19 nt, Human
gacccggaggggccuggca

SEQ ID NO: 1743006 - RNA, 18 nt, Human
gacccggaggggccuggc

SEQ ID NO: 1743007 - RNA, 21 nt, Human
gaccucaggugauccacccac

SEQ ID NO: 1743008 - RNA, 20 nt, Human
gaccucaggugauccaccca

SEQ ID NO: 1743009 - RNA, 19 nt, Human
gaccucaggugauccaccc

SEQ ID NO: 1743010 - RNA, 21 nt, Human
gaccucaggugagaagcagag

SEQ ID NO: 1743011 - RNA, 19 nt, Human
gaccucaggugagaagcag

SEQ ID NO: 1743012 - RNA, 18 nt, Human
gaccucaggugagaagca

SEQ ID NO: 1743013 - RNA, 19 nt, Human
gaccucaggccugggggcu

SEQ ID NO: 1743014 - RNA, 23 nt, Human
gaccucagguaaucgaccugccu

SEQ ID NO: 1743015 - RNA, 22 nt, Human
gaccucagguaaucgaccugcc

SEQ ID NO: 1743016 - RNA, 14 nt, Human
gaccucaggccugg

SEQ ID NO: 1743017 - RNA, 10 nt, Human
gacccugagg

SEQ ID NO: 1743018 - RNA, 11 nt, Human
gacagcucuua

SEQ ID NO: 1743019 - RNA, 12 nt, Human
gacagucccugc

SEQ ID NO: 1743020 - RNA, 12 nt, Human
gacagcucugca

SEQ ID NO: 1743021 - RNA, 19 nt, Human
gacagcuccuucuguccua

SEQ ID NO: 1743022 - RNA, 10 nt, Human
gacagcucuu

SEQ ID NO: 1743023 - RNA, 20 nt, Human
gacagucccugccaauggac

SEQ ID NO: 1743024 - RNA, 16 nt, Human
gacagucccugccaau

SEQ ID NO: 1743025 - RNA, 15 nt, Human
gacagucccugccaa

SEQ ID NO: 1743026 - RNA, 14 nt, Human
gacagucccugcca

SEQ ID NO: 1743027 - RNA, 18 nt, Human
gacagcuccuucuguccu

SEQ ID NO: 1743028 - RNA, 17 nt, Human
gacagcuccuucugucc

SEQ ID NO: 1743029 - RNA, 16 nt, Human
gacagcccgggcucug

SEQ ID NO: 1743030 - RNA, 14 nt, Human
gacagcccgggcuc

SEQ ID NO: 1743031 - RNA, 23 nt, Human
gacauugcggacagccacggcca

SEQ ID NO: 1743032 - RNA, 17 nt, Human
gacauugcggacagcca

SEQ ID NO: 1743033 - RNA, 19 nt, Human
gacauuguagagcuucugg

SEQ ID NO: 1743034 - RNA, 20 nt, Human
gcaucuagcaugucgucaaa

SEQ ID NO: 1743035 - RNA, 13 nt, Human
gcauccuggcacc

SEQ ID NO: 1743036 - RNA, 17 nt, Human
gcauccuccgccucccg

SEQ ID NO: 1743037 - RNA, 14 nt, Human
gcauccuggcaccc

SEQ ID NO: 1743038 - RNA, 21 nt, Human
gcauggcugccaaugggagcu

SEQ ID NO: 1743039 - RNA, 15 nt, Human
gcauuuacuuugugu

SEQ ID NO: 1743040 - RNA, 18 nt, Human
gcauuuaaaagauacagu

SEQ ID NO: 1743041 - RNA, 22 nt, Human
gcauuuaaaagauacaguuacu

SEQ ID NO: 1743042 - RNA, 18 nt, Human
gcauugugggaaggggag

SEQ ID NO: 1743043 - RNA, 16 nt, Human
gcauugugggaagggg

SEQ ID NO: 1743044 - RNA, 16 nt, Human
gcauuuaaaagauaca

SEQ ID NO: 1743045 - RNA, 17 nt, Human
gcauuuaaaagauacag

SEQ ID NO: 1743046 - RNA, 15 nt, Human
gcauugugggaaggg

SEQ ID NO: 1743047 - RNA, 13 nt, Human
gcauugugggaag

SEQ ID NO: 1743048 - RNA, 21 nt, Human
gcaugugaugagaggaaauca

SEQ ID NO: 1743049 - RNA, 19 nt, Human
gcaugugaugagaggaaau

SEQ ID NO: 1743050 - RNA, 17 nt, Human
gcauccaguaucuugaa

SEQ ID NO: 1743051 - RNA, 14 nt, Human
gcauccaguaucuu

SEQ ID NO: 1743052 - RNA, 18 nt, Human
gcauccaguaucuugaag

SEQ ID NO: 1743053 - RNA, 15 nt, Human
gcauacguacacauu

SEQ ID NO: 1743054 - RNA, 16 nt, Human
gcauacguacacauuu

SEQ ID NO: 1743055 - RNA, 17 nt, Human
gcauacguacacauuuu

SEQ ID NO: 1743056 - RNA, 18 nt, Human
gcauacguacacauuuua

SEQ ID NO: 1743057 - RNA, 12 nt, Human
gcagaacaguga

SEQ ID NO: 1743058 - RNA, 13 nt, Human
gcagaacagugau

SEQ ID NO: 1743059 - RNA, 22 nt, Human
gcacuuuguucuggcucuucca

SEQ ID NO: 1743060 - RNA, 15 nt, Human
gcacuccagccuggg

SEQ ID NO: 1743061 - RNA, 14 nt, Human
gcacuccagccugg

SEQ ID NO: 1743062 - RNA, 14 nt, Human
gcacuccccugcug

SEQ ID NO: 1743063 - RNA, 13 nt, Human
gcacuccccugcu

SEQ ID NO: 1743064 - RNA, 19 nt, Human
gcacuuuguucuggcucuu

SEQ ID NO: 1743065 - RNA, 18 nt, Human
gcacuuuguucuggcucu

SEQ ID NO: 1743066 - RNA, 16 nt, Human
gcacuccccugcuggg

SEQ ID NO: 1743067 - RNA, 15 nt, Human
gcacuccccugcugg

SEQ ID NO: 1743068 - RNA, 19 nt, Human
gcaagugagagcugggugu

SEQ ID NO: 1743069 - RNA, 18 nt, Human
gcaagugagagcugggug

SEQ ID NO: 1743070 - RNA, 20 nt, Human
gcacucagaagacacugaug

SEQ ID NO: 1743071 - RNA, 18 nt, Human
gcagaacagugauuacca

SEQ ID NO: 1743072 - RNA, 22 nt, Human
gcagaacagugauuaccaggga

SEQ ID NO: 1743073 - RNA, 20 nt, Human
gcagaggaaagcaaaggaga

SEQ ID NO: 1743074 - RNA, 18 nt, Human
gcagaggaaagcaaagga

SEQ ID NO: 1743075 - RNA, 14 nt, Human
gcagaggaaagcaa

SEQ ID NO: 1743076 - RNA, 13 nt, Human
gcagaggaaagca

SEQ ID NO: 1743077 - RNA, 21 nt, Human
gcagaggaaagcaaaggagau

SEQ ID NO: 1743078 - RNA, 23 nt, Human
gcagcauauucaggaagcucagg

SEQ ID NO: 1743079 - RNA, 19 nt, Human
gcagcauauucaggaagcu

SEQ ID NO: 1743080 - RNA, 18 nt, Human
gcagcauauucaggaagc

SEQ ID NO: 1743081 - RNA, 17 nt, Human
gcagcauauucaggaag

SEQ ID NO: 1743082 - RNA, 14 nt, Human
gcagagggcacaga

SEQ ID NO: 1743083 - RNA, 18 nt, Human
gcagcccaccccucaaca

SEQ ID NO: 1743084 - RNA, 15 nt, Human
gcagccacauuccug

SEQ ID NO: 1743085 - RNA, 13 nt, Human
gcaacaggcuggg

SEQ ID NO: 1743086 - RNA, 15 nt, Human
gcaacaggcugggcu

SEQ ID NO: 1743087 - RNA, 14 nt, Human
gcaacaggcugggc

SEQ ID NO: 1743088 - RNA, 18 nt, Human
gcaaccaccaccaaccac

SEQ ID NO: 1743089 - RNA, 16 nt, Human
gcaaccaccaccaacc

SEQ ID NO: 1743090 - RNA, 13 nt, Human
gcaaccaccacca

SEQ ID NO: 1743091 - RNA, 19 nt, Human
gcaacaggcugggcuucag

SEQ ID NO: 1743092 - RNA, 16 nt, Human
gcaacaggcugggcuu

SEQ ID NO: 1743093 - RNA, 20 nt, Human
gcaaccuucgccaccugggu

SEQ ID NO: 1743094 - RNA, 20 nt, Human
gcaaccuccgccucuugggu

SEQ ID NO: 1743095 - RNA, 17 nt, Human
gcaacccccagccugcu

SEQ ID NO: 1743096 - RNA, 16 nt, Human
gcaacccccagccugc

SEQ ID NO: 1743097 - RNA, 15 nt, Human
gcaacccccagccug

SEQ ID NO: 1743098 - RNA, 14 nt, Human
gcaacccccagccu

SEQ ID NO: 1743099 - RNA, 14 nt, Human
gcaaccauuugaaa

SEQ ID NO: 1743100 - RNA, 16 nt, Human
gcaagugagagcuggg

SEQ ID NO: 1743101 - RNA, 15 nt, Human
gauucuucugcuuca

SEQ ID NO: 1743102 - RNA, 13 nt, Human
gauucuucugcuu

SEQ ID NO: 1743103 - RNA, 19 nt, Human
gauuuaacagaaauguaca

SEQ ID NO: 1743104 - RNA, 20 nt, Human
gauucuucugcuucagccuc

SEQ ID NO: 1743105 - RNA, 16 nt, Human
gauuuaacagaaaugu

SEQ ID NO: 1743106 - RNA, 17 nt, Human
gauuuaacagaaaugua

SEQ ID NO: 1743107 - RNA, 18 nt, Human
gauuuaacagaaauguac

SEQ ID NO: 1743108 - RNA, 18 nt, Human
gauuuuuuuuuccuucag

SEQ ID NO: 1743109 - RNA, 17 nt, Human
gauuuuuuuuuccuuca

SEQ ID NO: 1743110 - RNA, 12 nt, Human
gauuucacucuc

SEQ ID NO: 1743111 - RNA, 16 nt, Human
gauuuuuuuuuccuuc

SEQ ID NO: 1743112 - RNA, 11 nt, Human
gauuucacucu

SEQ ID NO: 1743113 - RNA, 16 nt, Human
gauuuaauuugaaaua

SEQ ID NO: 1743114 - RNA, 21 nt, Human
gauuuuuuuuuccuucagugc

SEQ ID NO: 1743115 - RNA, 14 nt, Human
gcaaaaaggcagga

SEQ ID NO: 1743116 - RNA, 22 nt, Human
gcaaaagaugcuucucacugcc

SEQ ID NO: 1743117 - RNA, 17 nt, Human
gcaaaagaugcuucuca

SEQ ID NO: 1743118 - RNA, 19 nt, Human
gaucucuugagccugggag

SEQ ID NO: 1743119 - RNA, 17 nt, Human
gaucugaugcaagcaag

SEQ ID NO: 1743120 - RNA, 20 nt, Human
gaugcuucuucagagacucc

SEQ ID NO: 1743121 - RNA, 17 nt, Human
gaugcuucuucagagac

SEQ ID NO: 1743122 - RNA, 21 nt, Human
gaugcuucuucagagacuccu

SEQ ID NO: 1743123 - RNA, 14 nt, Human
gaugauccuaggca

SEQ ID NO: 1743124 - RNA, 13 nt, Human
gaugauccuaggc

SEQ ID NO: 1743125 - RNA, 22 nt, Human
gaugauuggaggggggaggugg

SEQ ID NO: 1743126 - RNA, 19 nt, Human
gauccaagcuggucccacu

SEQ ID NO: 1743127 - RNA, 17 nt, Human
gauccaagcugguccca

SEQ ID NO: 1743128 - RNA, 16 nt, Human
gauccaagcugguccc

SEQ ID NO: 1743129 - RNA, 12 nt, Human
gauccaagcugg

SEQ ID NO: 1743130 - RNA, 19 nt, Human
gauccacccaccucagccu

SEQ ID NO: 1743131 - RNA, 18 nt, Human
gauccacccaccucagcc

SEQ ID NO: 1743132 - RNA, 21 nt, Human
gauccaagcuggucccacuca

SEQ ID NO: 1743133 - RNA, 21 nt, Human
gauccacccaccucagccucc

SEQ ID NO: 1743134 - RNA, 20 nt, Human
gauccacccaccucagccuc

SEQ ID NO: 1743135 - RNA, 22 nt, Human
gauccacccaccucagccuccc

SEQ ID NO: 1743136 - RNA, 22 nt, Human
gaucaaaccccgaccaccugcc

SEQ ID NO: 1743137 - RNA, 23 nt, Human
gaucaaaagguuaauaaaguaau

SEQ ID NO: 1743138 - RNA, 20 nt, Human
gaucaaaagguuaauaaagu

SEQ ID NO: 1743139 - RNA, 15 nt, Human
gauauuuugcuuugu

SEQ ID NO: 1743140 - RNA, 23 nt, Human
gauauuuucaacgcagcccugcu

SEQ ID NO: 1743141 - RNA, 22 nt, Human
gauauuuucaacgcagcccugc

SEQ ID NO: 1743142 - RNA, 21 nt, Human
gauauuuucaacgcagcccug

SEQ ID NO: 1743143 - RNA, 18 nt, Human
gauacuuugauauuuuca

SEQ ID NO: 1743144 - RNA, 19 nt, Human
gauauuuucaacgcagccc

SEQ ID NO: 1743145 - RNA, 17 nt, Human
gauacuguaucaugaca

SEQ ID NO: 1743146 - RNA, 21 nt, Human
gauacuguaucaugacaaaga

SEQ ID NO: 1743147 - RNA, 16 nt, Human
gauacaguuacucaga

SEQ ID NO: 1743148 - RNA, 19 nt, Human
gauacaguuacucagaauu

SEQ ID NO: 1743149 - RNA, 23 nt, Human
gauacaguuacucagaauucucu

SEQ ID NO: 1743150 - RNA, 14 nt, Human
cugcucacauaucu

SEQ ID NO: 1743151 - RNA, 17 nt, Human
cugcuaucaaagagguu

SEQ ID NO: 1743152 - RNA, 18 nt, Human
cugcugaaggcucgagca

SEQ ID NO: 1743153 - RNA, 23 nt, Human
cugcugaaggcucgagcaugccu

SEQ ID NO: 1743154 - RNA, 24 nt, Human
cugcugaaggcucgagcaugccug

SEQ ID NO: 1743155 - RNA, 23 nt, Human
cugccuguucagcuccagcucac

SEQ ID NO: 1743156 - RNA, 20 nt, Human
cugccuguucagcuccagcu

SEQ ID NO: 1743157 - RNA, 19 nt, Human
cugccuguucccauucuug

SEQ ID NO: 1743158 - RNA, 15 nt, Human
cugccuguucccauu

SEQ ID NO: 1743159 - RNA, 14 nt, Human
cugccuccuuugug

SEQ ID NO: 1743160 - RNA, 14 nt, Human
cugccucgaacugg

SEQ ID NO: 1743161 - RNA, 23 nt, Human
cugccuccuuugugaggaagccg

SEQ ID NO: 1743162 - RNA, 21 nt, Human
cugccuccuuugugaggaagc

SEQ ID NO: 1743163 - RNA, 17 nt, Human
cugccuccuuugugagg

SEQ ID NO: 1743164 - RNA, 20 nt, Human
cugccucgaacuggcugcaa

SEQ ID NO: 1743165 - RNA, 23 nt, Human
cugcccuuaccugccaggaagcc

SEQ ID NO: 1743166 - RNA, 22 nt, Human
cugcccuuaccugccaggaagc

SEQ ID NO: 1743167 - RNA, 12 nt, Human
cugcccuguggg

SEQ ID NO: 1743168 - RNA, 11 nt, Human
cugcccugugg

SEQ ID NO: 1743169 - RNA, 19 nt, Human
cugcccuuaccugccagga

SEQ ID NO: 1743170 - RNA, 14 nt, Human
cugcccugugggcc

SEQ ID NO: 1743171 - RNA, 20 nt, Human
cugcccugguuuccugcccu

SEQ ID NO: 1743172 - RNA, 24 nt, Human
cugcccugugaguacuacaguccu

SEQ ID NO: 1743173 - RNA, 21 nt, Human
cugcccugguuuccugcccug

SEQ ID NO: 1743174 - RNA, 19 nt, Human
cugcccugguuuccugccc

SEQ ID NO: 1743175 - RNA, 18 nt, Human
cugcccugguuuccugcc

SEQ ID NO: 1743176 - RNA, 17 nt, Human
cugcccugguuuccugc

SEQ ID NO: 1743177 - RNA, 23 nt, Human
cugcccuggugcugccacacuuc

SEQ ID NO: 1743178 - RNA, 15 nt, Human
cugcccuggugcugc

SEQ ID NO: 1743179 - RNA, 14 nt, Human
cugcccuggugcug

SEQ ID NO: 1743180 - RNA, 13 nt, Human
cugcccuggugcu

SEQ ID NO: 1743181 - RNA, 12 nt, Human
cugcccuggugc

SEQ ID NO: 1743182 - RNA, 14 nt, Human
cugcuuccagugag

SEQ ID NO: 1743183 - RNA, 20 nt, Human
cugcuucaaggauccugagc

SEQ ID NO: 1743184 - RNA, 19 nt, Human
cugcuucaaggauccugag

SEQ ID NO: 1743185 - RNA, 16 nt, Human
cugcuucaaggauccu

SEQ ID NO: 1743186 - RNA, 14 nt, Human
cugcuucaaggauc

SEQ ID NO: 1743187 - RNA, 17 nt, Human
cuggauccaucaggcca

SEQ ID NO: 1743188 - RNA, 15 nt, Human
cuggagaacuagaga

SEQ ID NO: 1743189 - RNA, 14 nt, Human
cuggagaacuagag

SEQ ID NO: 1743190 - RNA, 21 nt, Human
cuggagaaaauggacguguua

SEQ ID NO: 1743191 - RNA, 23 nt, Human
cuggacuccucuguccaggcacu

SEQ ID NO: 1743192 - RNA, 22 nt, Human
cuggacuccucuguccaggcac

SEQ ID NO: 1743193 - RNA, 23 nt, Human
cuggacucuaaagucuguugauu

SEQ ID NO: 1743194 - RNA, 18 nt, Human
cuggaugcagccucacag

SEQ ID NO: 1743195 - RNA, 17 nt, Human
cuggaugcagccucaca

SEQ ID NO: 1743196 - RNA, 16 nt, Human
cuggaugcagccucac

SEQ ID NO: 1743197 - RNA, 20 nt, Human
cuggaucuccauucucucag

SEQ ID NO: 1743198 - RNA, 19 nt, Human
cuggauccaucaggccacu

SEQ ID NO: 1743199 - RNA, 22 nt, Human
cuggcagaguugaagacagagc

SEQ ID NO: 1743200 - RNA, 23 nt, Human
cuggcagccccuguucuggcaga

SEQ ID NO: 1743201 - RNA, 13 nt, Human
cuggcagccgugc

SEQ ID NO: 1743202 - RNA, 21 nt, Human
cuggcagaguugaagacagag

SEQ ID NO: 1743203 - RNA, 20 nt, Human
cuggcagaguugaagacaga

SEQ ID NO: 1743204 - RNA, 17 nt, Human
cugggacuacaggugug

SEQ ID NO: 1743205 - RNA, 21 nt, Human
cugggacuacaggcacccacc

SEQ ID NO: 1743206 - RNA, 17 nt, Human
cugggacuacaggcacc

SEQ ID NO: 1743207 - RNA, 15 nt, Human
cuggcucuuccaggc

SEQ ID NO: 1743208 - RNA, 14 nt, Human
cuggcucuuccagg

SEQ ID NO: 1743209 - RNA, 13 nt, Human
cuggcucuuccag

SEQ ID NO: 1743210 - RNA, 22 nt, Human
cuggcucccacaggcccuuccu

SEQ ID NO: 1743211 - RNA, 22 nt, Human
cuggccgggaccccgagccugg

SEQ ID NO: 1743212 - RNA, 18 nt, Human
cuggcucccacaggcccu

SEQ ID NO: 1743213 - RNA, 19 nt, Human
cuggcucccacaggcccuu

SEQ ID NO: 1743214 - RNA, 19 nt, Human
cuggcagcucagagagggu

SEQ ID NO: 1743215 - RNA, 17 nt, Human
cuggcagcucagagagg

SEQ ID NO: 1743216 - RNA, 16 nt, Human
cuggcagcucagagag

SEQ ID NO: 1743217 - RNA, 18 nt, Human
cuggcagccgugccuuca

SEQ ID NO: 1743218 - RNA, 17 nt, Human
cuggcagccgugccuuc

SEQ ID NO: 1743219 - RNA, 15 nt, Human
cuguuggccagugug

SEQ ID NO: 1743220 - RNA, 12 nt, Human
cuguuggccagu

SEQ ID NO: 1743221 - RNA, 14 nt, Human
cuuaaauaauguga

SEQ ID NO: 1743222 - RNA, 16 nt, Human
cuuaaauaaugugaaa

SEQ ID NO: 1743223 - RNA, 19 nt, Human
cuuaaauaaugugaaacug

SEQ ID NO: 1743224 - RNA, 13 nt, Human
cuuaaaaaugguu

SEQ ID NO: 1743225 - RNA, 20 nt, Human
cuuaaaaaugguuuaaaugg

SEQ ID NO: 1743226 - RNA, 23 nt, Human
cugugagaugcuagaacucccuu

SEQ ID NO: 1743227 - RNA, 17 nt, Human
cugugcucuggacaggc

SEQ ID NO: 1743228 - RNA, 16 nt, Human
cugugaacugaacucu

SEQ ID NO: 1743229 - RNA, 15 nt, Human
cugugaacugaacuc

SEQ ID NO: 1743230 - RNA, 13 nt, Human
cugugaacugaac

SEQ ID NO: 1743231 - RNA, 15 nt, Human
cuguucagcuccagc

SEQ ID NO: 1743232 - RNA, 13 nt, Human
cuguucacucuac

SEQ ID NO: 1743233 - RNA, 18 nt, Human
cuguucagcugguugagg

SEQ ID NO: 1743234 - RNA, 12 nt, Human
cuguucagcugg

SEQ ID NO: 1743235 - RNA, 22 nt, Human
cuguucagcuccagcucaccag

SEQ ID NO: 1743236 - RNA, 19 nt, Human
cuguucagcuccagcucac

SEQ ID NO: 1743237 - RNA, 18 nt, Human
cuguucagcuccagcuca

SEQ ID NO: 1743238 - RNA, 16 nt, Human
cuguucagcuccagcu

SEQ ID NO: 1743239 - RNA, 17 nt, Human
cuguuacugucuucagu

SEQ ID NO: 1743240 - RNA, 19 nt, Human
cugugcucuggacaggcau

SEQ ID NO: 1743241 - RNA, 18 nt, Human
cugugcucuggacaggca

SEQ ID NO: 1743242 - RNA, 22 nt, Human
cugugucagguggggcagcuug

SEQ ID NO: 1743243 - RNA, 18 nt, Human
cuguaggaagguuaaugu

SEQ ID NO: 1743244 - RNA, 21 nt, Human
cuguccugggagugagcuggu

SEQ ID NO: 1743245 - RNA, 20 nt, Human
cuguccugggagugagcugg

SEQ ID NO: 1743246 - RNA, 14 nt, Human
cuguccugggagug

SEQ ID NO: 1743247 - RNA, 13 nt, Human
cuguccugggagu

SEQ ID NO: 1743248 - RNA, 14 nt, Human
cugucauuugagca

SEQ ID NO: 1743249 - RNA, 22 nt, Human
cugucuaaugaaaccugugucu

SEQ ID NO: 1743250 - RNA, 15 nt, Human
cugucguuaaaaaca

SEQ ID NO: 1743251 - RNA, 15 nt, Human
cuguagagugggagc

SEQ ID NO: 1743252 - RNA, 21 nt, Human
cuguacuugcucuugaugccu

SEQ ID NO: 1743253 - RNA, 20 nt, Human
cuguacuugcucuugaugcc

SEQ ID NO: 1743254 - RNA, 19 nt, Human
cuguacuugcucuugaugc

SEQ ID NO: 1743255 - RNA, 16 nt, Human
cuguacuugcucuuga

SEQ ID NO: 1743256 - RNA, 14 nt, Human
cugguuuuucaguu

SEQ ID NO: 1743257 - RNA, 15 nt, Human
cugguuuuucaguuu

SEQ ID NO: 1743258 - RNA, 16 nt, Human
cugguuuuucaguuuu

SEQ ID NO: 1743259 - RNA, 12 nt, Human
cuggugccucac

SEQ ID NO: 1743260 - RNA, 18 nt, Human
cuggucuuauuuguaaag

SEQ ID NO: 1743261 - RNA, 21 nt, Human
cuggucucgaacuccugaccu

SEQ ID NO: 1743262 - RNA, 20 nt, Human
cuuacauuagcaguuugcuu

SEQ ID NO: 1743263 - RNA, 16 nt, Human
cuucuuauacauuuga

SEQ ID NO: 1743264 - RNA, 13 nt, Human
cuucuuauacauu

SEQ ID NO: 1743265 - RNA, 17 nt, Human
cuucugacccaugcugc

SEQ ID NO: 1743266 - RNA, 16 nt, Human
cuucugacccaugcug

SEQ ID NO: 1743267 - RNA, 18 nt, Human
cuucugacccaugcugcc

SEQ ID NO: 1743268 - RNA, 23 nt, Human
cuucugaacuuggcgcugccccu

SEQ ID NO: 1743269 - RNA, 18 nt, Human
cuuccucccucccucuuu

SEQ ID NO: 1743270 - RNA, 14 nt, Human
cuuccucccucccu

SEQ ID NO: 1743271 - RNA, 13 nt, Human
cuuccucccuccc

SEQ ID NO: 1743272 - RNA, 12 nt, Human
cuuccucccucc

SEQ ID NO: 1743273 - RNA, 13 nt, Human
cuuccucugcuga

SEQ ID NO: 1743274 - RNA, 12 nt, Human
cuuccucugcug

SEQ ID NO: 1743275 - RNA, 11 nt, Human
cuuccucugcu

SEQ ID NO: 1743276 - RNA, 21 nt, Human
cuuccucuccacugccuucga

SEQ ID NO: 1743277 - RNA, 19 nt, Human
cuuccucuccacugccuuc

SEQ ID NO: 1743278 - RNA, 17 nt, Human
cuuccucuccacugccu

SEQ ID NO: 1743279 - RNA, 16 nt, Human
cuuccucuccacugcc

SEQ ID NO: 1743280 - RNA, 22 nt, Human
cuucugaacuuggcgcugcccc

SEQ ID NO: 1743281 - RNA, 15 nt, Human
cuucugacccaugcu

SEQ ID NO: 1743282 - RNA, 19 nt, Human
cuucugaacuuggcgcugc

SEQ ID NO: 1743283 - RNA, 13 nt, Human
cuugucuguagau

SEQ ID NO: 1743284 - RNA, 20 nt, Human
cuugucuuuggacccugagg

SEQ ID NO: 1743285 - RNA, 23 nt, Human
cuuggucucagugucaaugcagc

SEQ ID NO: 1743286 - RNA, 22 nt, Human
cuugguccugcugcaguugcca

SEQ ID NO: 1743287 - RNA, 16 nt, Human
cuugguucccauuugc

SEQ ID NO: 1743288 - RNA, 20 nt, Human
cuugguucccauuugcuccu

SEQ ID NO: 1743289 - RNA, 15 nt, Human
cuugguccugcugca

SEQ ID NO: 1743290 - RNA, 20 nt, Human
cuugguccugcugcaguugc

SEQ ID NO: 1743291 - RNA, 18 nt, Human
cuugguccugcugcaguu

SEQ ID NO: 1743292 - RNA, 17 nt, Human
cuugguccugcugcagu

SEQ ID NO: 1743293 - RNA, 16 nt, Human
cuugguccugcugcag

SEQ ID NO: 1743294 - RNA, 18 nt, Human
cuuucaauaggaaaaacu

SEQ ID NO: 1743295 - RNA, 17 nt, Human
cuuucaauaggaaaaac

SEQ ID NO: 1743296 - RNA, 20 nt, Human
cuuuaaugucacaggcaggu

SEQ ID NO: 1743297 - RNA, 19 nt, Human
cuuuaaugucacaggcagg

SEQ ID NO: 1743298 - RNA, 18 nt, Human
cuuuaaugucacaggcag

SEQ ID NO: 1743299 - RNA, 17 nt, Human
cuuuaaugucacaggca

SEQ ID NO: 1743300 - RNA, 15 nt, Human
cuuucaauaggaaaa

SEQ ID NO: 1743301 - RNA, 14 nt, Human
cuuucaauaggaaa

SEQ ID NO: 1743302 - RNA, 22 nt, Human
cuuuaaugucacaggcaggucc

SEQ ID NO: 1743303 - RNA, 22 nt, Human
cuugucuuuggacccugaggcc

SEQ ID NO: 1743304 - RNA, 21 nt, Human
cuugucuuuggacccugaggc

SEQ ID NO: 1743305 - RNA, 16 nt, Human
cuuuaaugauaugcuu

SEQ ID NO: 1743306 - RNA, 21 nt, Human
cuuuaaugauaugcuuguaac

SEQ ID NO: 1743307 - RNA, 22 nt, Human
cuuuaaugauaugcuuguaacu

SEQ ID NO: 1743308 - RNA, 15 nt, Human
cuugauguguuaucu

SEQ ID NO: 1743309 - RNA, 19 nt, Human
cuugauucauaaugacuua

SEQ ID NO: 1743310 - RNA, 18 nt, Human
cuugccgucuaccugagg

SEQ ID NO: 1743311 - RNA, 19 nt, Human
cuugccgucuaccugaggg

SEQ ID NO: 1743312 - RNA, 15 nt, Human
cuuggauuguccccg

SEQ ID NO: 1743313 - RNA, 20 nt, Human
cuuggauuguccccgacccu

SEQ ID NO: 1743314 - RNA, 18 nt, Human
cuuggauuguccccgacc

SEQ ID NO: 1743315 - RNA, 22 nt, Human
cuuggauuguccccgacccuug

SEQ ID NO: 1743316 - RNA, 23 nt, Human
cuuggcgcugccccuggcagccc

SEQ ID NO: 1743317 - RNA, 22 nt, Human
cuuggcgcugccccuggcagcc

SEQ ID NO: 1743318 - RNA, 21 nt, Human
cuuggcgcugccccuggcagc

SEQ ID NO: 1743319 - RNA, 18 nt, Human
gaaagaaguggggacaga

SEQ ID NO: 1743320 - RNA, 18 nt, Human
gaaaugaaagcagggacu

SEQ ID NO: 1743321 - RNA, 18 nt, Human
gaaauuuuuauuaaauua

SEQ ID NO: 1743322 - RNA, 17 nt, Human
gaaaucaccgaaaacgu

SEQ ID NO: 1743323 - RNA, 17 nt, Human
gaacaaauuuacagaga

SEQ ID NO: 1743324 - RNA, 18 nt, Human
gaacaaauuuacagagac

SEQ ID NO: 1743325 - RNA, 19 nt, Human
gaaauuuuuauuaaauuau

SEQ ID NO: 1743326 - RNA, 23 nt, Human
gaacaaauuuacagagacagaaa

SEQ ID NO: 1743327 - RNA, 21 nt, Human
gaaaguacuucuccacccugc

SEQ ID NO: 1743328 - RNA, 22 nt, Human
gaaaguacuucuccacccugcu

SEQ ID NO: 1743329 - RNA, 20 nt, Human
gaaaggcuccaggagcagcc

SEQ ID NO: 1743330 - RNA, 19 nt, Human
gaaaggcuccaggagcagc

SEQ ID NO: 1743331 - RNA, 18 nt, Human
gaaaggcuccaggagcag

SEQ ID NO: 1743332 - RNA, 17 nt, Human
gaaaggcuccaggagca

SEQ ID NO: 1743333 - RNA, 18 nt, Human
gaaagacuaucuaaaugu

SEQ ID NO: 1743334 - RNA, 21 nt, Human
gaacaaggcaaggcugucaau

SEQ ID NO: 1743335 - RNA, 18 nt, Human
gaacaaggcaaggcuguc

SEQ ID NO: 1743336 - RNA, 17 nt, Human
gaacaaggcaaggcugu

SEQ ID NO: 1743337 - RNA, 15 nt, Human
gaacaaggcaaggcu

SEQ ID NO: 1743338 - RNA, 14 nt, Human
gaacaaggcaaggc

SEQ ID NO: 1743339 - RNA, 17 nt, Human
cuuuugucuaugggacu

SEQ ID NO: 1743340 - RNA, 16 nt, Human
cuuuuggucuguguga

SEQ ID NO: 1743341 - RNA, 15 nt, Human
cuuuuggucugugug

SEQ ID NO: 1743342 - RNA, 18 nt, Human
cuuuugccguuauuaaaa

SEQ ID NO: 1743343 - RNA, 14 nt, Human
cuuuugugcauuau

SEQ ID NO: 1743344 - RNA, 18 nt, Human
cuuuugugcauuaucuag

SEQ ID NO: 1743345 - RNA, 14 nt, Human
cuuuuuuuuaaguu

SEQ ID NO: 1743346 - RNA, 21 nt, Human
cuuuuuuuuuuuuuuugacaa

SEQ ID NO: 1743347 - RNA, 19 nt, Human
gaaaaaauauuuuccugcc

SEQ ID NO: 1743348 - RNA, 14 nt, Human
gaaaaaauauauau

SEQ ID NO: 1743349 - RNA, 18 nt, Human
gaaaauuuugauguuuua

SEQ ID NO: 1743350 - RNA, 18 nt, Human
gaaaacuuguauuaugug

SEQ ID NO: 1743351 - RNA, 19 nt, Human
gaaaacugcaacuuguaaa

SEQ ID NO: 1743352 - RNA, 22 nt, Human
gaaaauuaggauuucaugauuu

SEQ ID NO: 1743353 - RNA, 18 nt, Human
gaaaauuaggauuucaug

SEQ ID NO: 1743354 - RNA, 14 nt, Human
gaaaauuaacauga

SEQ ID NO: 1743355 - RNA, 19 nt, Human
cuuuuaugugaaacauguu

SEQ ID NO: 1743356 - RNA, 21 nt, Human
agcuggucccacucaguccau

SEQ ID NO: 1743357 - RNA, 14 nt, Human
agcuggguuggaaa

SEQ ID NO: 1743358 - RNA, 22 nt, Human
agcugggugucaagagggucug

SEQ ID NO: 1743359 - RNA, 17 nt, Human
agcugggugucaagagg

SEQ ID NO: 1743360 - RNA, 22 nt, Human
agcuucuguugcugccucaugc

SEQ ID NO: 1743361 - RNA, 21 nt, Human
agcuucuguugcugccucaug

SEQ ID NO: 1743362 - RNA, 20 nt, Human
agcuucuguugcugccucau

SEQ ID NO: 1743363 - RNA, 15 nt, Human
aggaaaaacugauuu

SEQ ID NO: 1743364 - RNA, 13 nt, Human
aggaaaaacugau

SEQ ID NO: 1743365 - RNA, 15 nt, Human
agcuuuucccuuuuu

SEQ ID NO: 1743366 - RNA, 16 nt, Human
agcuuuucccuucuuu

SEQ ID NO: 1743367 - RNA, 13 nt, Human
agcuuuucccuuc

SEQ ID NO: 1743368 - RNA, 23 nt, Human
agcuucuguugcugccucaugcu

SEQ ID NO: 1743369 - RNA, 17 nt, Human
aggaaauccaggguggu

SEQ ID NO: 1743370 - RNA, 15 nt, Human
aggaaauccagggug

SEQ ID NO: 1743371 - RNA, 22 nt, Human
aggaacguaaucguguccccua

SEQ ID NO: 1743372 - RNA, 17 nt, Human
aggauguugaaaaaguu

SEQ ID NO: 1743373 - RNA, 14 nt, Human
aggauguugaaaaa

SEQ ID NO: 1743374 - RNA, 20 nt, Human
aggauguucugggacacagu

SEQ ID NO: 1743375 - RNA, 17 nt, Human
aggaggggauagagaga

SEQ ID NO: 1743376 - RNA, 12 nt, Human
aggauucuuccu

SEQ ID NO: 1743377 - RNA, 16 nt, Human
aggauucuuccucccu

SEQ ID NO: 1743378 - RNA, 22 nt, Human
aggcacugcugcccagccucca

SEQ ID NO: 1743379 - RNA, 16 nt, Human
aggcacugcugcccag

SEQ ID NO: 1743380 - RNA, 14 nt, Human
aggcacugcugccc

SEQ ID NO: 1743381 - RNA, 17 nt, Human
aggacccggaggggccu

SEQ ID NO: 1743382 - RNA, 20 nt, Human
aggaccucaggugagaagca

SEQ ID NO: 1743383 - RNA, 14 nt, Human
aggaccucagguga

SEQ ID NO: 1743384 - RNA, 18 nt, Human
aggagaggggcacagggu

SEQ ID NO: 1743385 - RNA, 16 nt, Human
aggagaggggcacagg

SEQ ID NO: 1743386 - RNA, 15 nt, Human
aggagaggagagggg

SEQ ID NO: 1743387 - RNA, 15 nt, Human
aggagagcuagcagc

SEQ ID NO: 1743388 - RNA, 20 nt, Human
aggaccccuccaugugggcu

SEQ ID NO: 1743389 - RNA, 15 nt, Human
aggaacuacugagga

SEQ ID NO: 1743390 - RNA, 14 nt, Human
aggcucuucuccuu

SEQ ID NO: 1743391 - RNA, 21 nt, Human
aggcugaacuuguuuucuggg

SEQ ID NO: 1743392 - RNA, 20 nt, Human
aggcugaacuuguuuucugg

SEQ ID NO: 1743393 - RNA, 23 nt, Human
aggcuagugugguguuuccuggc

SEQ ID NO: 1743394 - RNA, 20 nt, Human
agggacagaggggguggccu

SEQ ID NO: 1743395 - RNA, 13 nt, Human
agggacagagggg

SEQ ID NO: 1743396 - RNA, 12 nt, Human
agggacagaggg

SEQ ID NO: 1743397 - RNA, 21 nt, Human
agggacgcuacccgggaaggg

SEQ ID NO: 1743398 - RNA, 20 nt, Human
agggacucaucauuuccauu

SEQ ID NO: 1743399 - RNA, 18 nt, Human
aggcugccucucccauca

SEQ ID NO: 1743400 - RNA, 16 nt, Human
aggcugucuguuguau

SEQ ID NO: 1743401 - RNA, 17 nt, Human
agggccuggccugagcu

SEQ ID NO: 1743402 - RNA, 16 nt, Human
agggccuggccugagc

SEQ ID NO: 1743403 - RNA, 15 nt, Human
agggccuggccugag

SEQ ID NO: 1743404 - RNA, 21 nt, Human
agggcacaccgggcacucaga

SEQ ID NO: 1743405 - RNA, 20 nt, Human
agggcacaccgggcacucag

SEQ ID NO: 1743406 - RNA, 22 nt, Human
agggcacagaaaauggaagaca

SEQ ID NO: 1743407 - RNA, 17 nt, Human
agggcacaccgggcacu

SEQ ID NO: 1743408 - RNA, 18 nt, Human
agggccuggccugagcug

SEQ ID NO: 1743409 - RNA, 19 nt, Human
agggcgggaggauguucug

SEQ ID NO: 1743410 - RNA, 21 nt, Human
aggggauagagagagaccacu

SEQ ID NO: 1743411 - RNA, 15 nt, Human
aggggcacagggucu

SEQ ID NO: 1743412 - RNA, 15 nt, Human
agguuaauaaaguaa

SEQ ID NO: 1743413 - RNA, 14 nt, Human
agguuaauguucau

SEQ ID NO: 1743414 - RNA, 17 nt, Human
agguucaaagauauuuu

SEQ ID NO: 1743415 - RNA, 13 nt, Human
agguucagcuugu

SEQ ID NO: 1743416 - RNA, 17 nt, Human
agguucaugcaaacuuu

SEQ ID NO: 1743417 - RNA, 18 nt, Human
agguuccacagaggacac

SEQ ID NO: 1743418 - RNA, 17 nt, Human
aggugcugccauccagg

SEQ ID NO: 1743419 - RNA, 16 nt, Human
aggugcugccauccag

SEQ ID NO: 1743420 - RNA, 14 nt, Human
aggucgaggcagga

SEQ ID NO: 1743421 - RNA, 20 nt, Human
aggucgcuugggaauuuuau

SEQ ID NO: 1743422 - RNA, 15 nt, Human
agguggaaauaaacu

SEQ ID NO: 1743423 - RNA, 17 nt, Human
agguaaggaauaccugu

SEQ ID NO: 1743424 - RNA, 17 nt, Human
agguaaucgaccugccu

SEQ ID NO: 1743425 - RNA, 18 nt, Human
agguaaucgaccugccuc

SEQ ID NO: 1743426 - RNA, 22 nt, Human
agguacgaaaagaggggaagag

SEQ ID NO: 1743427 - RNA, 20 nt, Human
aggucccuaauaaagcugug

SEQ ID NO: 1743428 - RNA, 19 nt, Human
aggucccuaauaaagcugu

SEQ ID NO: 1743429 - RNA, 18 nt, Human
aggucccuaauaaagcug

SEQ ID NO: 1743430 - RNA, 17 nt, Human
aggucccuaauaaagcu

SEQ ID NO: 1743431 - RNA, 13 nt, Human
agauguaauuuug

SEQ ID NO: 1743432 - RNA, 21 nt, Human
agaugggagaaucacuugaac

SEQ ID NO: 1743433 - RNA, 14 nt, Human
agauguagaggaga

SEQ ID NO: 1743434 - RNA, 14 nt, Human
agauguaauuuugu

SEQ ID NO: 1743435 - RNA, 15 nt, Human
agauguaauuuugug

SEQ ID NO: 1743436 - RNA, 17 nt, Human
agauguaauuuugugua

SEQ ID NO: 1743437 - RNA, 19 nt, Human
agauguaauuuuguguaag

SEQ ID NO: 1743438 - RNA, 19 nt, Human
agcacuaaggugugcucug

SEQ ID NO: 1743439 - RNA, 20 nt, Human
agcacuaaggugugcucuga

SEQ ID NO: 1743440 - RNA, 21 nt, Human
agcagccacauuccugaugcu

SEQ ID NO: 1743441 - RNA, 23 nt, Human
agccaaggccaaaggaagcacau

SEQ ID NO: 1743442 - RNA, 22 nt, Human
agccaaggccaaaggaagcaca

SEQ ID NO: 1743443 - RNA, 20 nt, Human
agccagaggagagaggaccc

SEQ ID NO: 1743444 - RNA, 23 nt, Human
agccaaagcuaggccuggccaga

SEQ ID NO: 1743445 - RNA, 20 nt, Human
agccaaagcuaggccuggcc

SEQ ID NO: 1743446 - RNA, 19 nt, Human
agccaaagcuaggccuggc

SEQ ID NO: 1743447 - RNA, 20 nt, Human
agcaugccuggauggggcug

SEQ ID NO: 1743448 - RNA, 12 nt, Human
agcaugccugga

SEQ ID NO: 1743449 - RNA, 14 nt, Human
agcaugcacaaauu

SEQ ID NO: 1743450 - RNA, 20 nt, Human
agcaugagagggaugaggca

SEQ ID NO: 1743451 - RNA, 11 nt, Human
agccuccugag

SEQ ID NO: 1743452 - RNA, 17 nt, Human
agccucccgaguagcug

SEQ ID NO: 1743453 - RNA, 22 nt, Human
agccucccgaauagcugggacu

SEQ ID NO: 1743454 - RNA, 20 nt, Human
agccucccgaauagcuggga

SEQ ID NO: 1743455 - RNA, 19 nt, Human
agccucccgaauagcuggg

SEQ ID NO: 1743456 - RNA, 18 nt, Human
agccucccgaauagcugg

SEQ ID NO: 1743457 - RNA, 20 nt, Human
agccucccaaagugcuggga

SEQ ID NO: 1743458 - RNA, 19 nt, Human
agccgagauugcaccacug

SEQ ID NO: 1743459 - RNA, 21 nt, Human
agccgagaucacgccacugca

SEQ ID NO: 1743460 - RNA, 20 nt, Human
agccgagauugcaccacugc

SEQ ID NO: 1743461 - RNA, 22 nt, Human
agccgcuggggccaguuggucc

SEQ ID NO: 1743462 - RNA, 14 nt, Human
agccgcuggggcca

SEQ ID NO: 1743463 - RNA, 19 nt, Human
agccucccaaagugcuggg

SEQ ID NO: 1743464 - RNA, 18 nt, Human
agccucccaaagugcugg

SEQ ID NO: 1743465 - RNA, 19 nt, Human
agccuccugaguagcugga

SEQ ID NO: 1743466 - RNA, 20 nt, Human
agccgagaucacgccacugc

SEQ ID NO: 1743467 - RNA, 19 nt, Human
agccgagaucacgccacug

SEQ ID NO: 1743468 - RNA, 15 nt, Human
agcccugagcuuucu

SEQ ID NO: 1743469 - RNA, 11 nt, Human
agccccauccu

SEQ ID NO: 1743470 - RNA, 20 nt, Human
agccccaucccaaacccuuc

SEQ ID NO: 1743471 - RNA, 16 nt, Human
agccccagugcccaca

SEQ ID NO: 1743472 - RNA, 23 nt, Human
agccccauaauuuuuuuuuuccu

SEQ ID NO: 1743473 - RNA, 20 nt, Human
agcccaaagugguauagaaa

SEQ ID NO: 1743474 - RNA, 23 nt, Human
agcccaaagugguauagaaaugc

SEQ ID NO: 1743475 - RNA, 21 nt, Human
agauaggucagugcaaauacu

SEQ ID NO: 1743476 - RNA, 16 nt, Human
agauagccaaggccaa

SEQ ID NO: 1743477 - RNA, 15 nt, Human
agauagccaaggcca

SEQ ID NO: 1743478 - RNA, 14 nt, Human
agaucuucuguggg

SEQ ID NO: 1743479 - RNA, 23 nt, Human
agauggcugugccucugccuguc

SEQ ID NO: 1743480 - RNA, 22 nt, Human
agauacuuggggggcugaggug

SEQ ID NO: 1743481 - RNA, 13 nt, Human
agauagccaaggc

SEQ ID NO: 1743482 - RNA, 22 nt, Human
agaggggaacagacuggaagca

SEQ ID NO: 1743483 - RNA, 16 nt, Human
agaggggaagagacuu

SEQ ID NO: 1743484 - RNA, 13 nt, Human
agaggagaggggc

SEQ ID NO: 1743485 - RNA, 21 nt, Human
agagaagagauugugguuuca

SEQ ID NO: 1743486 - RNA, 10 nt, Human
agagaagaga

SEQ ID NO: 1743487 - RNA, 18 nt, Human
agagaaaguacuucucca

SEQ ID NO: 1743488 - RNA, 16 nt, Human
agagagcuucuguugc

SEQ ID NO: 1743489 - RNA, 23 nt, Human
agagagcuucuguugcugccuca

SEQ ID NO: 1743490 - RNA, 20 nt, Human
agagagcuucuguugcugcc

SEQ ID NO: 1743491 - RNA, 23 nt, Human
agagaggguggugaccucugccu

SEQ ID NO: 1743492 - RNA, 16 nt, Human
agagaguggcuccucc

SEQ ID NO: 1743493 - RNA, 14 nt, Human
agagaguggcuccu

SEQ ID NO: 1743494 - RNA, 23 nt, Human
agacugaguacguugugcauuug

SEQ ID NO: 1743495 - RNA, 17 nt, Human
agacagcccgggcucug

SEQ ID NO: 1743496 - RNA, 20 nt, Human
agacagcccgggcucugccu

SEQ ID NO: 1743497 - RNA, 18 nt, Human
agacagcccgggcucugc

SEQ ID NO: 1743498 - RNA, 21 nt, Human
agaccaucccugaaggccccg

SEQ ID NO: 1743499 - RNA, 18 nt, Human
agaccaucccugaaggcc

SEQ ID NO: 1743500 - RNA, 17 nt, Human
agaccaucccugaaggc

SEQ ID NO: 1743501 - RNA, 14 nt, Human
agaccaucccugaa

SEQ ID NO: 1743502 - RNA, 13 nt, Human
agaccaucccuga

SEQ ID NO: 1743503 - RNA, 18 nt, Human
agacgggggcagagaggg

SEQ ID NO: 1743504 - RNA, 19 nt, Human
agacggagucccaccuugg

SEQ ID NO: 1743505 - RNA, 13 nt, Human
agacaaugacuua

SEQ ID NO: 1743506 - RNA, 17 nt, Human
agacaaugacuuacugu

SEQ ID NO: 1743507 - RNA, 19 nt, Human
agacaaugacuuacuguac

SEQ ID NO: 1743508 - RNA, 15 nt, Human
agacaauuuauuaug

SEQ ID NO: 1743509 - RNA, 21 nt, Human
agacaauuuauuauggcacau

SEQ ID NO: 1743510 - RNA, 14 nt, Human
auccuccucagauc

SEQ ID NO: 1743511 - RNA, 13 nt, Human
aucgaugcagugc

SEQ ID NO: 1743512 - RNA, 22 nt, Human
auccuccaggugcacaagcucc

SEQ ID NO: 1743513 - RNA, 19 nt, Human
auccuccaggugcacaagc

SEQ ID NO: 1743514 - RNA, 14 nt, Human
auccuccaggugca

SEQ ID NO: 1743515 - RNA, 13 nt, Human
auccuccaggugc

SEQ ID NO: 1743516 - RNA, 11 nt, Human
auccuccucag

SEQ ID NO: 1743517 - RNA, 23 nt, Human
auccucauacccacccccaccca

SEQ ID NO: 1743518 - RNA, 22 nt, Human
auccucauacccacccccaccc

SEQ ID NO: 1743519 - RNA, 19 nt, Human
auccucauacccaccccca

SEQ ID NO: 1743520 - RNA, 18 nt, Human
auccucauacccaccccc

SEQ ID NO: 1743521 - RNA, 13 nt, Human
aucccucauccuc

SEQ ID NO: 1743522 - RNA, 15 nt, Human
aucccuacuguaauu

SEQ ID NO: 1743523 - RNA, 14 nt, Human
aucccggcugcccu

SEQ ID NO: 1743524 - RNA, 20 nt, Human
auccacccaccucagccucc

SEQ ID NO: 1743525 - RNA, 18 nt, Human
auccacccaccucagccu

SEQ ID NO: 1743526 - RNA, 13 nt, Human
aucaccugcccug

SEQ ID NO: 1743527 - RNA, 12 nt, Human
aucaccugcccu

SEQ ID NO: 1743528 - RNA, 12 nt, Human
aucagcugcuac

SEQ ID NO: 1743529 - RNA, 21 nt, Human
aucagccugggcaaugugaua

SEQ ID NO: 1743530 - RNA, 20 nt, Human
aucagccugggcaaugugau

SEQ ID NO: 1743531 - RNA, 11 nt, Human
aucagccuggg

SEQ ID NO: 1743532 - RNA, 23 nt, Human
aucagcugcuacuacuccuguag

SEQ ID NO: 1743533 - RNA, 13 nt, Human
aucagcugcuacu

SEQ ID NO: 1743534 - RNA, 14 nt, Human
augagccuggcaag

SEQ ID NO: 1743535 - RNA, 13 nt, Human
augagccuggcaa

SEQ ID NO: 1743536 - RNA, 23 nt, Human
augaaaaaauauauaucaaauau

SEQ ID NO: 1743537 - RNA, 22 nt, Human
augaaaaaauauauaucaaaua

SEQ ID NO: 1743538 - RNA, 17 nt, Human
augaaaaaauauauauc

SEQ ID NO: 1743539 - RNA, 14 nt, Human
augaaaaaauauau

SEQ ID NO: 1743540 - RNA, 16 nt, Human
augacuccagaauuuc

SEQ ID NO: 1743541 - RNA, 12 nt, Human
augacuccagaa

SEQ ID NO: 1743542 - RNA, 17 nt, Human
augacuccagaauuucc

SEQ ID NO: 1743543 - RNA, 12 nt, Human
augacccagugg

SEQ ID NO: 1743544 - RNA, 21 nt, Human
augaagcuuuuaugugaaaca

SEQ ID NO: 1743545 - RNA, 20 nt, Human
augaagcuuuuaugugaaac

SEQ ID NO: 1743546 - RNA, 19 nt, Human
augaagcuuuuaugugaaa

SEQ ID NO: 1743547 - RNA, 18 nt, Human
augaagcuuuuaugugaa

SEQ ID NO: 1743548 - RNA, 22 nt, Human
aucuuauaauuuaaaauaugcu

SEQ ID NO: 1743549 - RNA, 17 nt, Human
aucugggccagaauuuc

SEQ ID NO: 1743550 - RNA, 15 nt, Human
aucugggccagaauu

SEQ ID NO: 1743551 - RNA, 19 nt, Human
aucuuccaacucaaacucu

SEQ ID NO: 1743552 - RNA, 22 nt, Human
aucucucgugauugauaagaac

SEQ ID NO: 1743553 - RNA, 15 nt, Human
aucucucuucuuuuc

SEQ ID NO: 1743554 - RNA, 17 nt, Human
aucuucuuuauaauucu

SEQ ID NO: 1743555 - RNA, 22 nt, Human
aucuucugaacuuggcgcugcc

SEQ ID NO: 1743556 - RNA, 17 nt, Human
aucuugaagacuuuucu

SEQ ID NO: 1743557 - RNA, 18 nt, Human
auguuuuaagaggcaggg

SEQ ID NO: 1743558 - RNA, 16 nt, Human
auguuuuaagaggcag

SEQ ID NO: 1743559 - RNA, 13 nt, Human
auuaaauucuugc

SEQ ID NO: 1743560 - RNA, 16 nt, Human
auuaaaugcccagccc

SEQ ID NO: 1743561 - RNA, 15 nt, Human
auuaaaugcccagcc

SEQ ID NO: 1743562 - RNA, 14 nt, Human
auuaaaugcccagc

SEQ ID NO: 1743563 - RNA, 18 nt, Human
auguucucugaggacacu

SEQ ID NO: 1743564 - RNA, 22 nt, Human
auguucugacccugcuucaaau

SEQ ID NO: 1743565 - RNA, 20 nt, Human
auguucuuaguggauguucu

SEQ ID NO: 1743566 - RNA, 15 nt, Human
auguucuuaauucuu

SEQ ID NO: 1743567 - RNA, 20 nt, Human
auguucuuucacccuuuucu

SEQ ID NO: 1743568 - RNA, 18 nt, Human
auguuucuuuguaaugaa

SEQ ID NO: 1743569 - RNA, 14 nt, Human
auguguaaguauuc

SEQ ID NO: 1743570 - RNA, 17 nt, Human
auguacauguacugauu

SEQ ID NO: 1743571 - RNA, 19 nt, Human
augucaaauauuuagaugu

SEQ ID NO: 1743572 - RNA, 23 nt, Human
augucaaauauuuagauguaauu

SEQ ID NO: 1743573 - RNA, 17 nt, Human
augucacaggcaggucc

SEQ ID NO: 1743574 - RNA, 16 nt, Human
augucacaggcagguc

SEQ ID NO: 1743575 - RNA, 15 nt, Human
augucacaggcaggu

SEQ ID NO: 1743576 - RNA, 17 nt, Human
auguaagcucuacugag

SEQ ID NO: 1743577 - RNA, 23 nt, Human
augauguauguugaagccuuugu

SEQ ID NO: 1743578 - RNA, 16 nt, Human
augaugugugaaaacu

SEQ ID NO: 1743579 - RNA, 17 nt, Human
augcacacauuuuuuaa

SEQ ID NO: 1743580 - RNA, 19 nt, Human
augcacacauuuuuuaaau

SEQ ID NO: 1743581 - RNA, 22 nt, Human
augcacacauuuuuuaaaugca

SEQ ID NO: 1743582 - RNA, 14 nt, Human
augcacagcuaaca

SEQ ID NO: 1743583 - RNA, 23 nt, Human
augcacacauuuuuuaaaugcac

SEQ ID NO: 1743584 - RNA, 21 nt, Human
augcacagcuaacauggaagu

SEQ ID NO: 1743585 - RNA, 17 nt, Human
augccugguggcagcug

SEQ ID NO: 1743586 - RNA, 16 nt, Human
augccugguggcagcu

SEQ ID NO: 1743587 - RNA, 15 nt, Human
augccugguggcagc

SEQ ID NO: 1743588 - RNA, 17 nt, Human
augccugggcagaagga

SEQ ID NO: 1743589 - RNA, 23 nt, Human
augccuggauggggcugcaccgg

SEQ ID NO: 1743590 - RNA, 21 nt, Human
augccuggauggggcugcacc

SEQ ID NO: 1743591 - RNA, 10 nt, Human
augcauuuga

SEQ ID NO: 1743592 - RNA, 12 nt, Human
augcauuugaaa

SEQ ID NO: 1743593 - RNA, 18 nt, Human
augcauuugaaaauuuug

SEQ ID NO: 1743594 - RNA, 23 nt, Human
augcaugaaguaauaugcacaca

SEQ ID NO: 1743595 - RNA, 20 nt, Human
augcaugaaguaauaugcac

SEQ ID NO: 1743596 - RNA, 21 nt, Human
augccuuuguacuuuagggaa

SEQ ID NO: 1743597 - RNA, 15 nt, Human
augggaaugaauguc

SEQ ID NO: 1743598 - RNA, 21 nt, Human
augggaaugaaugucagugug

SEQ ID NO: 1743599 - RNA, 23 nt, Human
auggcugccaaugggagcucaug

SEQ ID NO: 1743600 - RNA, 20 nt, Human
auggaaaugggcagagcaga

SEQ ID NO: 1743601 - RNA, 19 nt, Human
auggaaaugggcagagcag

SEQ ID NO: 1743602 - RNA, 13 nt, Human
auggaaauguuua

SEQ ID NO: 1743603 - RNA, 12 nt, Human
auaccugucccc

SEQ ID NO: 1743604 - RNA, 13 nt, Human
auaccuguccccc

SEQ ID NO: 1743605 - RNA, 14 nt, Human
auaauuacuauguc

SEQ ID NO: 1743606 - RNA, 22 nt, Human
auacccccugcaaagcccagcu

SEQ ID NO: 1743607 - RNA, 19 nt, Human
auaaugugaaacuggauua

SEQ ID NO: 1743608 - RNA, 21 nt, Human
auaaugugaaacuggauuaaa

SEQ ID NO: 1743609 - RNA, 18 nt, Human
auaaugugaaacuggauu

SEQ ID NO: 1743610 - RNA, 22 nt, Human
auaaguguguguuuuucauaaa

SEQ ID NO: 1743611 - RNA, 19 nt, Human
auaaguguguguuuuucau

SEQ ID NO: 1743612 - RNA, 19 nt, Human
auaaguauuuaauucaugu

SEQ ID NO: 1743613 - RNA, 15 nt, Human
auaaguggugugugu

SEQ ID NO: 1743614 - RNA, 16 nt, Human
auauaggaacuuaaau

SEQ ID NO: 1743615 - RNA, 19 nt, Human
auacuugaaaauuaacaug

SEQ ID NO: 1743616 - RNA, 15 nt, Human
auaguaugguggcug

SEQ ID NO: 1743617 - RNA, 16 nt, Human
auacuugaaaauuaac

SEQ ID NO: 1743618 - RNA, 15 nt, Human
auacuugaaaauuaa

SEQ ID NO: 1743619 - RNA, 16 nt, Human
auaguaugguggcugg

SEQ ID NO: 1743620 - RNA, 15 nt, Human
auauaagugauugcu

SEQ ID NO: 1743621 - RNA, 15 nt, Human
auauaaguguguguu

SEQ ID NO: 1743622 - RNA, 22 nt, Human
auaugccugggcagaaggaaga

SEQ ID NO: 1743623 - RNA, 17 nt, Human
auaugcaguuuuccuua

SEQ ID NO: 1743624 - RNA, 19 nt, Human
auaugcuuauacacuuaca

SEQ ID NO: 1743625 - RNA, 16 nt, Human
auaugcuuauacacuu

SEQ ID NO: 1743626 - RNA, 14 nt, Human
auaugcuuauacac

SEQ ID NO: 1743627 - RNA, 21 nt, Human
auaugcuuauacacuuacacu

SEQ ID NO: 1743628 - RNA, 19 nt, Human
auaugcuuguaacuaaaau

SEQ ID NO: 1743629 - RNA, 16 nt, Human
auauuuauaaaaauaa

SEQ ID NO: 1743630 - RNA, 18 nt, Human
auauuuaguguucauaaa

SEQ ID NO: 1743631 - RNA, 13 nt, Human
auauucaggaagc

SEQ ID NO: 1743632 - RNA, 16 nt, Human
auauucaggaagcuca

SEQ ID NO: 1743633 - RNA, 14 nt, Human
auauucaggaagcu

SEQ ID NO: 1743634 - RNA, 17 nt, Human
auauucaggaagcucag

SEQ ID NO: 1743635 - RNA, 20 nt, Human
auauuuagauguaauuuugu

SEQ ID NO: 1743636 - RNA, 22 nt, Human
auauuuagauguaauuuugugu

SEQ ID NO: 1743637 - RNA, 18 nt, Human
aguuguaccgcaauguga

SEQ ID NO: 1743638 - RNA, 19 nt, Human
aguuguaccgcaaugugac

SEQ ID NO: 1743639 - RNA, 18 nt, Human
aguuacagacaaagcgug

SEQ ID NO: 1743640 - RNA, 16 nt, Human
aguuguuacauuuuua

SEQ ID NO: 1743641 - RNA, 23 nt, Human
aguuguuaauaaaaguacauguu

SEQ ID NO: 1743642 - RNA, 13 nt, Human
aguuguuacauuu

SEQ ID NO: 1743643 - RNA, 15 nt, Human
aguuguuacauuuuu

SEQ ID NO: 1743644 - RNA, 18 nt, Human
agugauuaccagggacug

SEQ ID NO: 1743645 - RNA, 15 nt, Human
agugauuaccaggga

SEQ ID NO: 1743646 - RNA, 19 nt, Human
agugauucucaugccucag

SEQ ID NO: 1743647 - RNA, 18 nt, Human
agugauucucaugccuca

SEQ ID NO: 1743648 - RNA, 23 nt, Human
agugugacaaggauugcuacugu

SEQ ID NO: 1743649 - RNA, 16 nt, Human
agucaagugaaaaagg

SEQ ID NO: 1743650 - RNA, 18 nt, Human
agucaaggguaggguggg

SEQ ID NO: 1743651 - RNA, 20 nt, Human
agucaagugaaaaaggagga

SEQ ID NO: 1743652 - RNA, 13 nt, Human
agugauccuccca

SEQ ID NO: 1743653 - RNA, 16 nt, Human
aguccacaguggaacc

SEQ ID NO: 1743654 - RNA, 19 nt, Human
acccaugcugcccugugag

SEQ ID NO: 1743655 - RNA, 18 nt, Human
acccaugcugcccuguga

SEQ ID NO: 1743656 - RNA, 17 nt, Human
acccaugcugcccugug

SEQ ID NO: 1743657 - RNA, 15 nt, Human
acccacaagaaauga

SEQ ID NO: 1743658 - RNA, 16 nt, Human
acccaagggccuggcc

SEQ ID NO: 1743659 - RNA, 13 nt, Human
acccaagggccug

SEQ ID NO: 1743660 - RNA, 18 nt, Human
accccgaccaccugccca

SEQ ID NO: 1743661 - RNA, 15 nt, Human
accccggccaccugc

SEQ ID NO: 1743662 - RNA, 22 nt, Human
accccuaaagagauacuuugau

SEQ ID NO: 1743663 - RNA, 18 nt, Human
accaucccugaaggcccc

SEQ ID NO: 1743664 - RNA, 12 nt, Human
accaucauugaa

SEQ ID NO: 1743665 - RNA, 17 nt, Human
accaucaugucuggcua

SEQ ID NO: 1743666 - RNA, 16 nt, Human
accaucaugucuggcu

SEQ ID NO: 1743667 - RNA, 22 nt, Human
accaucccugaaggccccgccc

SEQ ID NO: 1743668 - RNA, 21 nt, Human
accaucccugaaggccccgcc

SEQ ID NO: 1743669 - RNA, 14 nt, Human
accaucaugucugg

SEQ ID NO: 1743670 - RNA, 20 nt, Human
accccucaacaccucugcac

SEQ ID NO: 1743671 - RNA, 20 nt, Human
acaucagcacgauuucuguu

SEQ ID NO: 1743672 - RNA, 21 nt, Human
acaucagcacgauuucuguuu

SEQ ID NO: 1743673 - RNA, 22 nt, Human
acaucagcacgauuucuguuua

SEQ ID NO: 1743674 - RNA, 23 nt, Human
acauaaacaagaccacguuucua

SEQ ID NO: 1743675 - RNA, 13 nt, Human
acauguuacaaca

SEQ ID NO: 1743676 - RNA, 21 nt, Human
acauguuuuucuucucccuca

SEQ ID NO: 1743677 - RNA, 23 nt, Human
acaugcacagcuaacauggaagu

SEQ ID NO: 1743678 - RNA, 20 nt, Human
acaugcacagcuaacaugga

SEQ ID NO: 1743679 - RNA, 19 nt, Human
acaugcaaggucauuuuuu

SEQ ID NO: 1743680 - RNA, 17 nt, Human
accagcagccuggaccc

SEQ ID NO: 1743681 - RNA, 14 nt, Human
accagcagccugga

SEQ ID NO: 1743682 - RNA, 15 nt, Human
accacguuucuaaag

SEQ ID NO: 1743683 - RNA, 19 nt, Human
accacguuucuaaaggcua

SEQ ID NO: 1743684 - RNA, 14 nt, Human
accacuacauucug

SEQ ID NO: 1743685 - RNA, 14 nt, Human
accacgcccggcua

SEQ ID NO: 1743686 - RNA, 20 nt, Human
accacgcccggcuaauuuuu

SEQ ID NO: 1743687 - RNA, 23 nt, Human
acagagucucacuguugcccagg

SEQ ID NO: 1743688 - RNA, 19 nt, Human
acagagucucacuguugcc

SEQ ID NO: 1743689 - RNA, 17 nt, Human
acagagucucacuguug

SEQ ID NO: 1743690 - RNA, 14 nt, Human
acagagucucacug

SEQ ID NO: 1743691 - RNA, 12 nt, Human
acagagucucac

SEQ ID NO: 1743692 - RNA, 22 nt, Human
acagaggggguggccucccaac

SEQ ID NO: 1743693 - RNA, 15 nt, Human
acagccaugauucuu

SEQ ID NO: 1743694 - RNA, 21 nt, Human
acagaacacauaauucaggaa

SEQ ID NO: 1743695 - RNA, 12 nt, Human
acagaagcagcu

SEQ ID NO: 1743696 - RNA, 14 nt, Human
acagaagcagcucu

SEQ ID NO: 1743697 - RNA, 13 nt, Human
acagaagcagcuc

SEQ ID NO: 1743698 - RNA, 15 nt, Human
acagaagcagcucuu

SEQ ID NO: 1743699 - RNA, 16 nt, Human
acaggcaagcaccucc

SEQ ID NO: 1743700 - RNA, 15 nt, Human
acaggcaagcaccuc

SEQ ID NO: 1743701 - RNA, 18 nt, Human
acaggcaagcaccuccug

SEQ ID NO: 1743702 - RNA, 19 nt, Human
acaggcaagcaccuccugc

SEQ ID NO: 1743703 - RNA, 21 nt, Human
acagcugcucaauaaaguaca

SEQ ID NO: 1743704 - RNA, 23 nt, Human
acaggugugaaccaccacaccca

SEQ ID NO: 1743705 - RNA, 20 nt, Human
acaggugugaaccaccacac

SEQ ID NO: 1743706 - RNA, 21 nt, Human
acaggugugagccaccacgcc

SEQ ID NO: 1743707 - RNA, 22 nt, Human
acaggugugagccaccacgccc

SEQ ID NO: 1743708 - RNA, 20 nt, Human
acagcucugcauacucauua

SEQ ID NO: 1743709 - RNA, 15 nt, Human
acagcuccuucuguc

SEQ ID NO: 1743710 - RNA, 14 nt, Human
acagcugccuggga

SEQ ID NO: 1743711 - RNA, 13 nt, Human
acagcucuguccu

SEQ ID NO: 1743712 - RNA, 23 nt, Human
acagcugccugggaucccucauc

SEQ ID NO: 1743713 - RNA, 14 nt, Human
acagcuccuucugu

SEQ ID NO: 1743714 - RNA, 13 nt, Human
acagcuccuucug

SEQ ID NO: 1743715 - RNA, 12 nt, Human
acagcuccuucu

SEQ ID NO: 1743716 - RNA, 13 nt, Human
aauuuugaaaaac

SEQ ID NO: 1743717 - RNA, 18 nt, Human
acaacuaugauuuggaaa

SEQ ID NO: 1743718 - RNA, 13 nt, Human
acaaagacugagu

SEQ ID NO: 1743719 - RNA, 15 nt, Human
acaaacgggcucagc

SEQ ID NO: 1743720 - RNA, 21 nt, Human
acaaaccuguuucugcagcca

SEQ ID NO: 1743721 - RNA, 12 nt, Human
aauuuucuuuca

SEQ ID NO: 1743722 - RNA, 20 nt, Human
acaaaauguaggguuauaau

SEQ ID NO: 1743723 - RNA, 23 nt, Human
acaaguaugaauaaagacaccua

SEQ ID NO: 1743724 - RNA, 21 nt, Human
acaaguaugaauaaagacacc

SEQ ID NO: 1743725 - RNA, 24 nt, Human
acaacuugcacguauuuuaauagc

SEQ ID NO: 1743726 - RNA, 18 nt, Human
acacaaacgggcucagca

SEQ ID NO: 1743727 - RNA, 16 nt, Human
acaauuuauuauggca

SEQ ID NO: 1743728 - RNA, 15 nt, Human
acaauuuauuauggc

SEQ ID NO: 1743729 - RNA, 14 nt, Human
acaccacuacauuc

SEQ ID NO: 1743730 - RNA, 13 nt, Human
acaccagagccca

SEQ ID NO: 1743731 - RNA, 12 nt, Human
acaccagagccc

SEQ ID NO: 1743732 - RNA, 19 nt, Human
acacgcuccuuccucugag

SEQ ID NO: 1743733 - RNA, 17 nt, Human
acacgcuccuuccucug

SEQ ID NO: 1743734 - RNA, 12 nt, Human
acacagcucugu

SEQ ID NO: 1743735 - RNA, 11 nt, Human
acacagcucug

SEQ ID NO: 1743736 - RNA, 14 nt, Human
acacagcucugucc

SEQ ID NO: 1743737 - RNA, 15 nt, Human
acacuaaccacgcug

SEQ ID NO: 1743738 - RNA, 14 nt, Human
acacuaaccacgcu

SEQ ID NO: 1743739 - RNA, 15 nt, Human
acacggacacucaaa

SEQ ID NO: 1743740 - RNA, 14 nt, Human
agaaaauaacaaua

SEQ ID NO: 1743741 - RNA, 20 nt, Human
agaaaauggacguguuauga

SEQ ID NO: 1743742 - RNA, 15 nt, Human
agaaaauggacgugu

SEQ ID NO: 1743743 - RNA, 23 nt, Human
agaaaauggaagacagcucuuau

SEQ ID NO: 1743744 - RNA, 23 nt, Human
agaaaauggacguguuaugacuc

SEQ ID NO: 1743745 - RNA, 22 nt, Human
agaaaauggacguguuaugacu

SEQ ID NO: 1743746 - RNA, 15 nt, Human
acuuuuauaaacuuu

SEQ ID NO: 1743747 - RNA, 19 nt, Human
acuuuuauaaacuuuaccu

SEQ ID NO: 1743748 - RNA, 22 nt, Human
acuuuuauaaacuuuaccuuuu

SEQ ID NO: 1743749 - RNA, 20 nt, Human
agaaaagggaacugaacauu

SEQ ID NO: 1743750 - RNA, 23 nt, Human
acuuuagggaaguacuuuuggca

SEQ ID NO: 1743751 - RNA, 22 nt, Human
acuuucauauuuuaaacagagg

SEQ ID NO: 1743752 - RNA, 23 nt, Human
acuuuccuucauucaacccaccu

SEQ ID NO: 1743753 - RNA, 23 nt, Human
acuuuguucuggcucuuccaggc

SEQ ID NO: 1743754 - RNA, 16 nt, Human
acuuucuagccagagg

SEQ ID NO: 1743755 - RNA, 23 nt, Human
agaaaggaggggauagagagaga

SEQ ID NO: 1743756 - RNA, 20 nt, Human
agaaaggaggggauagagag

SEQ ID NO: 1743757 - RNA, 18 nt, Human
agaaauaaaguuucuguu

SEQ ID NO: 1743758 - RNA, 15 nt, Human
agaaauaaaguuucu

SEQ ID NO: 1743759 - RNA, 16 nt, Human
agaaaggauaaaguug

SEQ ID NO: 1743760 - RNA, 14 nt, Human
acuggagaaaaugg

SEQ ID NO: 1743761 - RNA, 14 nt, Human
acuggaagcacagc

SEQ ID NO: 1743762 - RNA, 15 nt, Human
acuggaagcacagcu

SEQ ID NO: 1743763 - RNA, 16 nt, Human
acuggaagcacagcuu

SEQ ID NO: 1743764 - RNA, 20 nt, Human
acugcccccucugcccugcg

SEQ ID NO: 1743765 - RNA, 18 nt, Human
acugcccccucugcccug

SEQ ID NO: 1743766 - RNA, 19 nt, Human
acugcccccucugcccugc

SEQ ID NO: 1743767 - RNA, 12 nt, Human
acugucuucagu

SEQ ID NO: 1743768 - RNA, 16 nt, Human
acugugccaugugcca

SEQ ID NO: 1743769 - RNA, 23 nt, Human
acugguggcccgacagccuggca

SEQ ID NO: 1743770 - RNA, 20 nt, Human
acugguggcccgacagccug

SEQ ID NO: 1743771 - RNA, 22 nt, Human
acugguggcccgacagccuggc

SEQ ID NO: 1743772 - RNA, 21 nt, Human
acugguggcccgacagccugg

SEQ ID NO: 1743773 - RNA, 19 nt, Human
acugucucaagagggcacu

SEQ ID NO: 1743774 - RNA, 13 nt, Human
acuguuucaaacu

SEQ ID NO: 1743775 - RNA, 19 nt, Human
acuucacauauugauuucc

SEQ ID NO: 1743776 - RNA, 15 nt, Human
acuuauuuauauaaa

SEQ ID NO: 1743777 - RNA, 19 nt, Human
acuuguaaaggaauuuaaa

SEQ ID NO: 1743778 - RNA, 20 nt, Human
acuuguaaaggaauuuaaaa

SEQ ID NO: 1743779 - RNA, 14 nt, Human
acuuggucugugag

SEQ ID NO: 1743780 - RNA, 15 nt, Human
acuuggucugugaga

SEQ ID NO: 1743781 - RNA, 19 nt, Human
acuucugccauauucuguu

SEQ ID NO: 1743782 - RNA, 23 nt, Human
acuucacauauugauuuccguua

SEQ ID NO: 1743783 - RNA, 18 nt, Human
acuucugccauauucugu

SEQ ID NO: 1743784 - RNA, 22 nt, Human
acuucugccagcauaauacuug

SEQ ID NO: 1743785 - RNA, 21 nt, Human
acuuggucugugagaugcuag

SEQ ID NO: 1743786 - RNA, 18 nt, Human
acuuguaaaugugguaaa

SEQ ID NO: 1743787 - RNA, 20 nt, Human
acuuguaaaugugguaaaga

SEQ ID NO: 1743788 - RNA, 14 nt, Human
acuagcuauggugu

SEQ ID NO: 1743789 - RNA, 15 nt, Human
acuaggguccugggg

SEQ ID NO: 1743790 - RNA, 16 nt, Human
acuaggguccugggga

SEQ ID NO: 1743791 - RNA, 14 nt, Human
acucccccaggugg

SEQ ID NO: 1743792 - RNA, 17 nt, Human
acuccccugcugggugu

SEQ ID NO: 1743793 - RNA, 13 nt, Human
acuccccugcugg

SEQ ID NO: 1743794 - RNA, 12 nt, Human
acuccccuccuu

SEQ ID NO: 1743795 - RNA, 14 nt, Human
acucaguggggagg

SEQ ID NO: 1743796 - RNA, 11 nt, Human
acuauaaugua

SEQ ID NO: 1743797 - RNA, 16 nt, Human
acucaaacucuuaaaa

SEQ ID NO: 1743798 - RNA, 17 nt, Human
acucaaacucuuaaaac

SEQ ID NO: 1743799 - RNA, 12 nt, Human
acucccuuucaa

SEQ ID NO: 1743800 - RNA, 13 nt, Human
acucccuuucaac

SEQ ID NO: 1743801 - RNA, 18 nt, Human
acucuacccucuuagaaa

SEQ ID NO: 1743802 - RNA, 13 nt, Human
acucuacccucuu

SEQ ID NO: 1743803 - RNA, 21 nt, Human
acucuacccucuuagaaaaac

SEQ ID NO: 1743804 - RNA, 14 nt, Human
acucuaucaaguau

SEQ ID NO: 1743805 - RNA, 16 nt, Human
acucuaucaaguauua

SEQ ID NO: 1743806 - RNA, 21 nt, Human
acucuaucaaguauuauaccu

SEQ ID NO: 1743807 - RNA, 16 nt, Human
acucugugucaggugg

SEQ ID NO: 1743808 - RNA, 18 nt, Human
acucuuaaaacccaagug

SEQ ID NO: 1743809 - RNA, 11 nt, Human
acucuuaaaac

SEQ ID NO: 1743810 - RNA, 15 nt, Human
acuaaguuuuuaugg

SEQ ID NO: 1743811 - RNA, 22 nt, Human
acuaaguuuuuauggcuuuugu

SEQ ID NO: 1743812 - RNA, 19 nt, Human
acgugauuuugcuguagaa

SEQ ID NO: 1743813 - RNA, 18 nt, Human
acgcugugcugcccugcc

SEQ ID NO: 1743814 - RNA, 17 nt, Human
acgcugugcugcccugc

SEQ ID NO: 1743815 - RNA, 16 nt, Human
acgcugugcugcccug

SEQ ID NO: 1743816 - RNA, 17 nt, Human
acgccagauucuuuccu

SEQ ID NO: 1743817 - RNA, 15 nt, Human
acgcugugcugcccu

SEQ ID NO: 1743818 - RNA, 17 nt, Human
acguggcugcuucaagg

SEQ ID NO: 1743819 - RNA, 15 nt, Human
acguggcugcuucaa

SEQ ID NO: 1743820 - RNA, 14 nt, Human
acguggcugcuuca

SEQ ID NO: 1743821 - RNA, 13 nt, Human
acguggcugcuuc

SEQ ID NO: 1743822 - RNA, 12 nt, Human
acgauuucuguu

SEQ ID NO: 1743823 - RNA, 13 nt, Human
acgauuucuguuu

SEQ ID NO: 1743824 - RNA, 14 nt, Human
acgauuucuguuua

SEQ ID NO: 1743825 - RNA, 17 nt, Human
acgauuucuguuuagau

SEQ ID NO: 1743826 - RNA, 18 nt, Human
acgccacugcacuauagc

SEQ ID NO: 1743827 - RNA, 23 nt, Human
accuuucaauaggaaaaacugau

SEQ ID NO: 1743828 - RNA, 21 nt, Human
accuuucaauaggaaaaacug

SEQ ID NO: 1743829 - RNA, 17 nt, Human
accuuucaauaggaaaa

SEQ ID NO: 1743830 - RNA, 14 nt, Human
accuuggcugcagg

SEQ ID NO: 1743831 - RNA, 16 nt, Human
accuuucaauaggaaa

SEQ ID NO: 1743832 - RNA, 13 nt, Human
accuuuauucugg

SEQ ID NO: 1743833 - RNA, 12 nt, Human
accuuuauucug

SEQ ID NO: 1743834 - RNA, 12 nt, Human
accuuggcugca

SEQ ID NO: 1743835 - RNA, 14 nt, Human
accuuggcucaagu

SEQ ID NO: 1743836 - RNA, 22 nt, Human
accugccccuccucucugcccu

SEQ ID NO: 1743837 - RNA, 20 nt, Human
accugccccuccucucugcc

SEQ ID NO: 1743838 - RNA, 15 nt, Human
accuguaaugacagg

SEQ ID NO: 1743839 - RNA, 20 nt, Human
accuguaaugacaggccugu

SEQ ID NO: 1743840 - RNA, 18 nt, Human
accucugcacaagcugca

SEQ ID NO: 1743841 - RNA, 16 nt, Human
accucugcacaagcug

SEQ ID NO: 1743842 - RNA, 21 nt, Human
accucugcacaagcugcaccc

SEQ ID NO: 1743843 - RNA, 23 nt, Human
accugccccucaacucuccucca

SEQ ID NO: 1743844 - RNA, 18 nt, Human
accugccccuccucucug

SEQ ID NO: 1743845 - RNA, 14 nt, Human
accugccccuccuc

SEQ ID NO: 1743846 - RNA, 21 nt, Human
accugcccaaccugcucuccu

SEQ ID NO: 1743847 - RNA, 13 nt, Human
aacaugauuuggg

SEQ ID NO: 1743848 - RNA, 13 nt, Human
aacagcucgacuu

SEQ ID NO: 1743849 - RNA, 17 nt, Human
aaccaguguuguggauu

SEQ ID NO: 1743850 - RNA, 14 nt, Human
aaccagaucauugu

SEQ ID NO: 1743851 - RNA, 21 nt, Human
aacauguaauuaaguacuaug

SEQ ID NO: 1743852 - RNA, 14 nt, Human
aacauguaauuaag

SEQ ID NO: 1743853 - RNA, 23 nt, Human
aacauguaauuaaguacuaugua

SEQ ID NO: 1743854 - RNA, 22 nt, Human
aaccacucuaucaaguauuaua

SEQ ID NO: 1743855 - RNA, 14 nt, Human
aacccuggugacca

SEQ ID NO: 1743856 - RNA, 19 nt, Human
aacacauuuuucuuaggga

SEQ ID NO: 1743857 - RNA, 18 nt, Human
aaauugcauuuccugaca

SEQ ID NO: 1743858 - RNA, 17 nt, Human
aacaaagaaauuaugug

SEQ ID NO: 1743859 - RNA, 15 nt, Human
aacaaagaaauuaug

SEQ ID NO: 1743860 - RNA, 15 nt, Human
aacugaauuuugucu

SEQ ID NO: 1743861 - RNA, 19 nt, Human
aacugaccagccuccaugc

SEQ ID NO: 1743862 - RNA, 14 nt, Human
aacugaccagccuc

SEQ ID NO: 1743863 - RNA, 19 nt, Human
aacugauuuuuuuuuccuu

SEQ ID NO: 1743864 - RNA, 17 nt, Human
aacugauuuuuuuuucc

SEQ ID NO: 1743865 - RNA, 19 nt, Human
aacuuaaauaaugugaaac

SEQ ID NO: 1743866 - RNA, 17 nt, Human
aacuuaaauaaugugaa

SEQ ID NO: 1743867 - RNA, 16 nt, Human
aacucaccugccccuc

SEQ ID NO: 1743868 - RNA, 15 nt, Human
aacucaccugccccu

SEQ ID NO: 1743869 - RNA, 15 nt, Human
aacucaccccagccc

SEQ ID NO: 1743870 - RNA, 12 nt, Human
aacucaccccag

SEQ ID NO: 1743871 - RNA, 16 nt, Human
aacugaacucugacaa

SEQ ID NO: 1743872 - RNA, 20 nt, Human
aacugaacucugacaacaga

SEQ ID NO: 1743873 - RNA, 19 nt, Human
aacugaacucugacaacag

SEQ ID NO: 1743874 - RNA, 23 nt, Human
aacugaacucugacaacagacuu

SEQ ID NO: 1743875 - RNA, 13 nt, Human
aacuucacauauu

SEQ ID NO: 1743876 - RNA, 14 nt, Human
aacuuuuuuuuaag

SEQ ID NO: 1743877 - RNA, 20 nt, Human
aacuuuuuuuuaaguuacac

SEQ ID NO: 1743878 - RNA, 16 nt, Human
aacuuuuauaaacuuu

SEQ ID NO: 1743879 - RNA, 19 nt, Human
aacuuuuauaaacuuuacc

SEQ ID NO: 1743880 - RNA, 19 nt, Human
aacuuugaccucugcagca

SEQ ID NO: 1743881 - RNA, 20 nt, Human
aacuuugaccucugcagcaa

SEQ ID NO: 1743882 - RNA, 12 nt, Human
aacuuuuauaaa

SEQ ID NO: 1743883 - RNA, 15 nt, Human
aacuuuuauaaacuu

SEQ ID NO: 1743884 - RNA, 13 nt, Human
aacuuugaccucu

SEQ ID NO: 1743885 - RNA, 14 nt, Human
aacuuugaccucug

SEQ ID NO: 1743886 - RNA, 17 nt, Human
aacuuugaccucugcag

SEQ ID NO: 1743887 - RNA, 17 nt, Human
aaacagauuuggaaaga

SEQ ID NO: 1743888 - RNA, 22 nt, Human
aaacacuguucucugcccucca

SEQ ID NO: 1743889 - RNA, 19 nt, Human
aaacacuguucucugcccu

SEQ ID NO: 1743890 - RNA, 13 nt, Human
aaacacucuugaa

SEQ ID NO: 1743891 - RNA, 18 nt, Human
aaacacuguucucugccc

SEQ ID NO: 1743892 - RNA, 17 nt, Human
aaacacucuugaaaaau

SEQ ID NO: 1743893 - RNA, 14 nt, Human
aaacacucuugaaa

SEQ ID NO: 1743894 - RNA, 13 nt, Human
aaaacacauuuuu

SEQ ID NO: 1743895 - RNA, 15 nt, Human
aaaacacauuuuucu

SEQ ID NO: 1743896 - RNA, 13 nt, Human
aaaauucagugga

SEQ ID NO: 1743897 - RNA, 12 nt, Human
aaagaguacucu

SEQ ID NO: 1743898 - RNA, 17 nt, Human
aaagaguacucuuguuu

SEQ ID NO: 1743899 - RNA, 11 nt, Human
aaagaacaucc

SEQ ID NO: 1743900 - RNA, 15 nt, Human
aaagaaauuaugugc

SEQ ID NO: 1743901 - RNA, 13 nt, Human
aaagaaauuaugu

SEQ ID NO: 1743902 - RNA, 20 nt, Human
aaagaaaacuuguauuaugu

SEQ ID NO: 1743903 - RNA, 12 nt, Human
aaagaaaacuug

SEQ ID NO: 1743904 - RNA, 12 nt, Human
aaauaacaauga

SEQ ID NO: 1743905 - RNA, 22 nt, Human
aaauaaaauuaaagcugaaaac

SEQ ID NO: 1743906 - RNA, 14 nt, Human
aaagugcugggauu

SEQ ID NO: 1743907 - RNA, 12 nt, Human
aaagugcuggga

SEQ ID NO: 1743908 - RNA, 11 nt, Human
aaagugcuggg

SEQ ID NO: 1743909 - RNA, 23 nt, Human
aaagugagacuuugaggguguau

SEQ ID NO: 1743910 - RNA, 22 nt, Human
aaagucucuggaauuugaaaca

SEQ ID NO: 1743911 - RNA, 20 nt, Human
aaagucucuggaauuugaaa

SEQ ID NO: 1743912 - RNA, 18 nt, Human
aaagucuguugauuaaag

SEQ ID NO: 1743913 - RNA, 19 nt, Human
aaagucuguugauuaaaga

SEQ ID NO: 1743914 - RNA, 20 nt, Human
aaagucuguugauuaaagau

SEQ ID NO: 1743915 - RNA, 19 nt, Human
aaagucucuggaauuugaa

SEQ ID NO: 1743916 - RNA, 16 nt, Human
aaagggacugagaaau

SEQ ID NO: 1743917 - RNA, 16 nt, Human
aaagggaacugaacau

SEQ ID NO: 1743918 - RNA, 21 nt, Human
aaagggaacugaacauuccag

SEQ ID NO: 1743919 - RNA, 18 nt, Human
aaauggaagacagcucuu

SEQ ID NO: 1743920 - RNA, 16 nt, Human
aaauggaaaugggcag

SEQ ID NO: 1743921 - RNA, 22 nt, Human
aaauggacguguuaugacucca

SEQ ID NO: 1743922 - RNA, 21 nt, Human
aaauggacguguuaugacucc

SEQ ID NO: 1743923 - RNA, 20 nt, Human
aaauggacguguuaugacuc

SEQ ID NO: 1743924 - RNA, 17 nt, Human
aaauagacagcaugaga

SEQ ID NO: 1743925 - RNA, 16 nt, Human
aaauaguaaaaauaaa

SEQ ID NO: 1743926 - RNA, 13 nt, Human
aaauaguaaaaau

SEQ ID NO: 1743927 - RNA, 14 nt, Human
aaauauaauugaca

SEQ ID NO: 1743928 - RNA, 22 nt, Human
aaauacuguuuuuaacaacuau

SEQ ID NO: 1743929 - RNA, 11 nt, Human
aagcugggcag

SEQ ID NO: 1743930 - RNA, 18 nt, Human
aaggacauugcggacagc

SEQ ID NO: 1743931 - RNA, 13 nt, Human
aagcugggcaggu

SEQ ID NO: 1743932 - RNA, 15 nt, Human
aagcugggcagguug

SEQ ID NO: 1743933 - RNA, 20 nt, Human
aaggacuaggguccugggga

SEQ ID NO: 1743934 - RNA, 18 nt, Human
aaggacuaggguccuggg

SEQ ID NO: 1743935 - RNA, 21 nt, Human
aaggacccggaggggccuggc

SEQ ID NO: 1743936 - RNA, 15 nt, Human
aaggacuaggguccu

SEQ ID NO: 1743937 - RNA, 18 nt, Human
aaggacccggaggggccu

SEQ ID NO: 1743938 - RNA, 12 nt, Human
aagcguggugga

SEQ ID NO: 1743939 - RNA, 20 nt, Human
aagcugcacccucaggcagg

SEQ ID NO: 1743940 - RNA, 21 nt, Human
aagcugcacccucaggcaggu

SEQ ID NO: 1743941 - RNA, 17 nt, Human
aagcuaagguuuagaua

SEQ ID NO: 1743942 - RNA, 22 nt, Human
aagcugcacccucaggcaggug

SEQ ID NO: 1743943 - RNA, 18 nt, Human
aaggcaaggcugucaauu

SEQ ID NO: 1743944 - RNA, 17 nt, Human
aaggcaaggcugucaau

SEQ ID NO: 1743945 - RNA, 22 nt, Human
aagaaauuaugugccagauuua

SEQ ID NO: 1743946 - RNA, 13 nt, Human
aagaaauuaugug

SEQ ID NO: 1743947 - RNA, 21 nt, Human
aagaaauuuccacucaggucu

SEQ ID NO: 1743948 - RNA, 21 nt, Human
aagcagaggaaggagaggaga

SEQ ID NO: 1743949 - RNA, 11 nt, Human
aagcagcucuu

SEQ ID NO: 1743950 - RNA, 14 nt, Human
aagcagaggaagga

SEQ ID NO: 1743951 - RNA, 21 nt, Human
aauaauccuaaacauaugaau

SEQ ID NO: 1743952 - RNA, 12 nt, Human
aauaauaaagaa

SEQ ID NO: 1743953 - RNA, 20 nt, Human
aauaauaaagaauagcuuua

SEQ ID NO: 1743954 - RNA, 16 nt, Human
aauaaugugaaacugg

SEQ ID NO: 1743955 - RNA, 19 nt, Human
aauaauguaagacaaauau

SEQ ID NO: 1743956 - RNA, 12 nt, Human
aauaauguaaga

SEQ ID NO: 1743957 - RNA, 15 nt, Human
aaguuguuaauaaaa

SEQ ID NO: 1743958 - RNA, 17 nt, Human
aagugguauagaaaugc

SEQ ID NO: 1743959 - RNA, 13 nt, Human
aagugguauagaa

SEQ ID NO: 1743960 - RNA, 23 nt, Human
aauaaaauuaaagcugaaaacug

SEQ ID NO: 1743961 - RNA, 19 nt, Human
aauaaacuauuuguaaagu

SEQ ID NO: 1743962 - RNA, 16 nt, Human
aaguaucccuacugua

SEQ ID NO: 1743963 - RNA, 23 nt, Human
aaguccaggcuuuuuuaucaugu

SEQ ID NO: 1743964 - RNA, 11 nt, Human
aaguacuucuu

SEQ ID NO: 1743965 - RNA, 15 nt, Human
aaguacuuuuggcau

SEQ ID NO: 1743966 - RNA, 14 nt, Human
aaguacuuuuggca

SEQ ID NO: 1743967 - RNA, 20 nt, Human
aagguuaauguucaucaucc

SEQ ID NO: 1743968 - RNA, 16 nt, Human
aagguuaauaaaguaa

SEQ ID NO: 1743969 - RNA, 15 nt, Human
aagguuaauaaagua

SEQ ID NO: 1743970 - RNA, 11 nt, Human
aaggugggagg

SEQ ID NO: 1743971 - RNA, 19 nt, Human
aagucucuggaauuugaaa

SEQ ID NO: 1743972 - RNA, 16 nt, Human
aagucuuagauguaua

SEQ ID NO: 1743973 - RNA, 17 nt, Human
aagucuuagauguauau

SEQ ID NO: 1743974 - RNA, 21 nt, Human
aaugaugauccuaggcauuug

SEQ ID NO: 1743975 - RNA, 22 nt, Human
aaucugcuuuuuaaagaaugcu

SEQ ID NO: 1743976 - RNA, 23 nt, Human
aaugaaccacaucuugcucugcu

SEQ ID NO: 1743977 - RNA, 17 nt, Human
aaugaaccacaucuugc

SEQ ID NO: 1743978 - RNA, 16 nt, Human
aaugaaccacaucuug

SEQ ID NO: 1743979 - RNA, 13 nt, Human
aaucuccaaaaua

SEQ ID NO: 1743980 - RNA, 14 nt, Human
aaucuccaaaauaa

SEQ ID NO: 1743981 - RNA, 18 nt, Human
aaucuccaaaauaaaacu

SEQ ID NO: 1743982 - RNA, 18 nt, Human
aauccaggguggugguga

SEQ ID NO: 1743983 - RNA, 19 nt, Human
aaugaugccaugaggaaca

SEQ ID NO: 1743984 - RNA, 18 nt, Human
aauauggucuuuugguua

SEQ ID NO: 1743985 - RNA, 18 nt, Human
aauauaggaacuuaaaua

SEQ ID NO: 1743986 - RNA, 20 nt, Human
aauauaggaacuuaaauaau

SEQ ID NO: 1743987 - RNA, 21 nt, Human
aauauaggaacuuaaauaaug

SEQ ID NO: 1743988 - RNA, 20 nt, Human
aaugucucuuuaaugucaca

SEQ ID NO: 1743989 - RNA, 21 nt, Human
aaugucagugugacugaucuc

SEQ ID NO: 1743990 - RNA, 17 nt, Human
aaugucagugugacuga

SEQ ID NO: 1743991 - RNA, 22 nt, Human
aaugucuaguuguaacaccaug

SEQ ID NO: 1743992 - RNA, 22 nt, Human
aauggucuuucuaaugugugaa

SEQ ID NO: 1743993 - RNA, 13 nt, Human
aaugucaguguga

SEQ ID NO: 1743994 - RNA, 16 nt, Human
aaugucagugugacug

SEQ ID NO: 1743995 - RNA, 15 nt, Human
aaugucagugugacu

SEQ ID NO: 1743996 - RNA, 13 nt, Human
aaugggcagagca

SEQ ID NO: 1743997 - RNA, 15 nt, Human
aaugggcagagcaga

SEQ ID NO: 1743998 - RNA, 20 nt, Human
aaugguacuccacauauuuc

SEQ ID NO: 1743999 - RNA, 18 nt, Human
aauuaaaacacaacaucu

SEQ ID NO: 1744000 - RNA, 19 nt, Human
aauguuugccucugccucu

SEQ ID NO: 1744001 - RNA, 18 nt, Human
aauguuugccucugccuc

SEQ ID NO: 1744002 - RNA, 18 nt, Human
aauuaguggcacuugcuu

SEQ ID NO: 1744003 - RNA, 14 nt, Human
aaaaacacaaaagu

SEQ ID NO: 1744004 - RNA, 12 nt, Human
aaaaagaggcua

SEQ ID NO: 1744005 - RNA, 13 nt, Human
aaaaacugauuuu

SEQ ID NO: 1744006 - RNA, 14 nt, Human
aaaaacauggccuu

SEQ ID NO: 1744007 - RNA, 15 nt, Human
aaaaacugauuuuuu

SEQ ID NO: 1744008 - RNA, 12 nt, Human
aaaacacauuuu

SEQ ID NO: 1744009 - RNA, 16 nt, Human
uuaucuugaauaaugu

SEQ ID NO: 1744010 - RNA, 14 nt, Human
uuaucuugaauaau

SEQ ID NO: 1744011 - RNA, 14 nt, Human
uuaucuagauacug

SEQ ID NO: 1744012 - RNA, 16 nt, Human
uuauauuuacaaaugg

SEQ ID NO: 1744013 - RNA, 21 nt, Human
uuauuaaaugcccagccccuu

SEQ ID NO: 1744014 - RNA, 19 nt, Human
uuauuaaaugcccagcccc

SEQ ID NO: 1744015 - RNA, 23 nt, Human
uuauuaaaaaucucaaauuucua

SEQ ID NO: 1744016 - RNA, 16 nt, Human
uuauggcuuuugugca

SEQ ID NO: 1744017 - RNA, 14 nt, Human
uuauggcacaucag

SEQ ID NO: 1744018 - RNA, 17 nt, Human
uuauguugcauagaaua

SEQ ID NO: 1744019 - RNA, 18 nt, Human
uuauggcuuuugugcauu

SEQ ID NO: 1744020 - RNA, 17 nt, Human
uuauggcuuuugugcau

SEQ ID NO: 1744021 - RNA, 20 nt, Human
uuauggaacacucugagacu

SEQ ID NO: 1744022 - RNA, 18 nt, Human
uuauggaacacucugaga

SEQ ID NO: 1744023 - RNA, 21 nt, Human
uuauggacaaugacccagugg

SEQ ID NO: 1744024 - RNA, 17 nt, Human
uuauggaacacucugag

SEQ ID NO: 1744025 - RNA, 16 nt, Human
uuaugauuuuuaaaga

SEQ ID NO: 1744026 - RNA, 19 nt, Human
uuaugauuuuuaaagaaaa

SEQ ID NO: 1744027 - RNA, 19 nt, Human
uuagugaccucagcuuuga

SEQ ID NO: 1744028 - RNA, 15 nt, Human
ugugaaaagaaaaau

SEQ ID NO: 1744029 - RNA, 13 nt, Human
ugugaaaagaaaa

SEQ ID NO: 1744030 - RNA, 17 nt, Human
ugugaaaagaaaaauga

SEQ ID NO: 1744031 - RNA, 21 nt, Human
ugugaaaagaaaaaugagccu

SEQ ID NO: 1744032 - RNA, 12 nt, Human
uuauaauuuaaa

SEQ ID NO: 1744033 - RNA, 12 nt, Human
uuauaauuuuaa

SEQ ID NO: 1744034 - RNA, 21 nt, Human
uuauaauuuuaaauguuuuuu

SEQ ID NO: 1744035 - RNA, 17 nt, Human
uuauaauuuuaaauguu

SEQ ID NO: 1744036 - RNA, 15 nt, Human
uuauaauaauguuaa

SEQ ID NO: 1744037 - RNA, 18 nt, Human
uuauaauaauguuaacau

SEQ ID NO: 1744038 - RNA, 15 nt, Human
uuauaaugaaugaaa

SEQ ID NO: 1744039 - RNA, 16 nt, Human
uuauauuaugaagcuu

SEQ ID NO: 1744040 - RNA, 11 nt, Human
uuauacauaaa

SEQ ID NO: 1744041 - RNA, 13 nt, Human
uuauacauaaaca

SEQ ID NO: 1744042 - RNA, 13 nt, Human
uuccaaaguacac

SEQ ID NO: 1744043 - RNA, 16 nt, Human
uuccaaaguacacugu

SEQ ID NO: 1744044 - RNA, 15 nt, Human
uuccauggacuuugu

SEQ ID NO: 1744045 - RNA, 14 nt, Human
uuccauggacuuug

SEQ ID NO: 1744046 - RNA, 13 nt, Human
uuccagagccuca

SEQ ID NO: 1744047 - RNA, 19 nt, Human
uuccaacccucaucaccaa

SEQ ID NO: 1744048 - RNA, 23 nt, Human
uucaguuauuauauuuacaaaug

SEQ ID NO: 1744049 - RNA, 20 nt, Human
uucauaaauaaaguuuguug

SEQ ID NO: 1744050 - RNA, 19 nt, Human
uucauccuccucagaucuu

SEQ ID NO: 1744051 - RNA, 15 nt, Human
uucauccuccucaga

SEQ ID NO: 1744052 - RNA, 15 nt, Human
uucauaaccuagccu

SEQ ID NO: 1744053 - RNA, 16 nt, Human
uucaguggcagcugcu

SEQ ID NO: 1744054 - RNA, 15 nt, Human
uucaguggcagcugc

SEQ ID NO: 1744055 - RNA, 17 nt, Human
uucaguggcagcugcuu

SEQ ID NO: 1744056 - RNA, 12 nt, Human
uucaguguacau

SEQ ID NO: 1744057 - RNA, 13 nt, Human
uucaguguacaug

SEQ ID NO: 1744058 - RNA, 15 nt, Human
uucagcuccagcuca

SEQ ID NO: 1744059 - RNA, 12 nt, Human
uucagcuccagc

SEQ ID NO: 1744060 - RNA, 22 nt, Human
uucagcuccagcucaccagccc

SEQ ID NO: 1744061 - RNA, 14 nt, Human
uucaguggcagcug

SEQ ID NO: 1744062 - RNA, 22 nt, Human
uucagcuuguaaauagcucagg

SEQ ID NO: 1744063 - RNA, 17 nt, Human
uuauuuuaauucaguug

SEQ ID NO: 1744064 - RNA, 18 nt, Human
uuauuuuauuaugcauga

SEQ ID NO: 1744065 - RNA, 22 nt, Human
uuauuuuggaaaauaaauuauu

SEQ ID NO: 1744066 - RNA, 18 nt, Human
uucaaaugcuguaacuuu

SEQ ID NO: 1744067 - RNA, 15 nt, Human
uucaaccauucccca

SEQ ID NO: 1744068 - RNA, 12 nt, Human
uucagauauaaa

SEQ ID NO: 1744069 - RNA, 14 nt, Human
uucagcucacugca

SEQ ID NO: 1744070 - RNA, 19 nt, Human
uucagauauaaaagacuga

SEQ ID NO: 1744071 - RNA, 14 nt, Human
uucagauauaaaag

SEQ ID NO: 1744072 - RNA, 15 nt, Human
uucagauauaaaaga

SEQ ID NO: 1744073 - RNA, 17 nt, Human
uucagacagcugccugg

SEQ ID NO: 1744074 - RNA, 16 nt, Human
uucagacagcugccug

SEQ ID NO: 1744075 - RNA, 15 nt, Human
uucagacagcugccu

SEQ ID NO: 1744076 - RNA, 14 nt, Human
uucagacagcugcc

SEQ ID NO: 1744077 - RNA, 17 nt, Human
uucacggaagagccuug

SEQ ID NO: 1744078 - RNA, 22 nt, Human
uucaccuuuguccccaccgcag

SEQ ID NO: 1744079 - RNA, 13 nt, Human
uucacggaagagc

SEQ ID NO: 1744080 - RNA, 22 nt, Human
uucacaagacccaaaaggcaga

SEQ ID NO: 1744081 - RNA, 21 nt, Human
uucacaaccuucuguggcuca

SEQ ID NO: 1744082 - RNA, 13 nt, Human
uucacccuuuucu

SEQ ID NO: 1744083 - RNA, 20 nt, Human
uucaccuuuguccccaccgc

SEQ ID NO: 1744084 - RNA, 19 nt, Human
uucaccuuuguccccaccg

SEQ ID NO: 1744085 - RNA, 14 nt, Human
uucaccuuuguccc

SEQ ID NO: 1744086 - RNA, 22 nt, Human
uucaauaggaaaaacugauuuu

SEQ ID NO: 1744087 - RNA, 21 nt, Human
uucaauaggaaaaacugauuu

SEQ ID NO: 1744088 - RNA, 14 nt, Human
uugaauuguaagga

SEQ ID NO: 1744089 - RNA, 18 nt, Human
uugaacuggguacuugug

SEQ ID NO: 1744090 - RNA, 17 nt, Human
uugaacuccugaccuca

SEQ ID NO: 1744091 - RNA, 13 nt, Human
uugaacuuugacc

SEQ ID NO: 1744092 - RNA, 17 nt, Human
uugacccacaagaaaug

SEQ ID NO: 1744093 - RNA, 17 nt, Human
uugaccgugaggccaga

SEQ ID NO: 1744094 - RNA, 14 nt, Human
uugacccacaagaa

SEQ ID NO: 1744095 - RNA, 14 nt, Human
uugaccucugcagc

SEQ ID NO: 1744096 - RNA, 15 nt, Human
uugaccucugcagca

SEQ ID NO: 1744097 - RNA, 21 nt, Human
uugaccucaggugauccaccc

SEQ ID NO: 1744098 - RNA, 20 nt, Human
uugacgccaucccagcccca

SEQ ID NO: 1744099 - RNA, 19 nt, Human
uugacgccaucccagcccc

SEQ ID NO: 1744100 - RNA, 18 nt, Human
uugacgccaucccagccc

SEQ ID NO: 1744101 - RNA, 17 nt, Human
uugacgccaucccagcc

SEQ ID NO: 1744102 - RNA, 16 nt, Human
uugaccucugcagcaa

SEQ ID NO: 1744103 - RNA, 23 nt, Human
uugauauccucuuugagugaagc

SEQ ID NO: 1744104 - RNA, 11 nt, Human
uugagccuggg

SEQ ID NO: 1744105 - RNA, 13 nt, Human
uugaggguugggc

SEQ ID NO: 1744106 - RNA, 14 nt, Human
uugagccugggagg

SEQ ID NO: 1744107 - RNA, 16 nt, Human
uugaggguugggcugg

SEQ ID NO: 1744108 - RNA, 16 nt, Human
uugaugaucuuugcag

SEQ ID NO: 1744109 - RNA, 17 nt, Human
uugaugacccccaacca

SEQ ID NO: 1744110 - RNA, 21 nt, Human
uugcaaaguaucccuacugua

SEQ ID NO: 1744111 - RNA, 21 nt, Human
uucuuauacauuugauaaagu

SEQ ID NO: 1744112 - RNA, 21 nt, Human
uucuuccacaagagcccaggc

SEQ ID NO: 1744113 - RNA, 21 nt, Human
uucuuguguguuuauugucaa

SEQ ID NO: 1744114 - RNA, 13 nt, Human
uucuuccucccuc

SEQ ID NO: 1744115 - RNA, 12 nt, Human
uucuuucagcca

SEQ ID NO: 1744116 - RNA, 14 nt, Human
uucuuuccaaagua

SEQ ID NO: 1744117 - RNA, 16 nt, Human
uugaacuccuggccuc

SEQ ID NO: 1744118 - RNA, 15 nt, Human
uugaacuccuggccu

SEQ ID NO: 1744119 - RNA, 20 nt, Human
uugaaaaaccauuuugcugu

SEQ ID NO: 1744120 - RNA, 21 nt, Human
uucuuuccaaaguacacuguu

SEQ ID NO: 1744121 - RNA, 23 nt, Human
uugaaaacacuguucucugcccu

SEQ ID NO: 1744122 - RNA, 19 nt, Human
uucugcuucagccucccga

SEQ ID NO: 1744123 - RNA, 16 nt, Human
uucugcuucagccucc

SEQ ID NO: 1744124 - RNA, 15 nt, Human
uucugcuucagccuc

SEQ ID NO: 1744125 - RNA, 14 nt, Human
uucugcuucagccu

SEQ ID NO: 1744126 - RNA, 18 nt, Human
uucugcuuuccucuuccu

SEQ ID NO: 1744127 - RNA, 14 nt, Human
uucuuaguugcugu

SEQ ID NO: 1744128 - RNA, 15 nt, Human
uucuuaguugcugua

SEQ ID NO: 1744129 - RNA, 23 nt, Human
uucuuaguugcuguaugucucgu

SEQ ID NO: 1744130 - RNA, 18 nt, Human
uucuguauuuuguuuuug

SEQ ID NO: 1744131 - RNA, 18 nt, Human
uucggugagcuacaaaug

SEQ ID NO: 1744132 - RNA, 21 nt, Human
uuccuugaguugauucagcuc

SEQ ID NO: 1744133 - RNA, 15 nt, Human
uuccugcauuuguga

SEQ ID NO: 1744134 - RNA, 16 nt, Human
uuccaugucgccucug

SEQ ID NO: 1744135 - RNA, 12 nt, Human
uuccauggccuc

SEQ ID NO: 1744136 - RNA, 16 nt, Human
uuccauggccucuuca

SEQ ID NO: 1744137 - RNA, 15 nt, Human
uuccugaggcugggc

SEQ ID NO: 1744138 - RNA, 20 nt, Human
uuccugaggcugggcucccu

SEQ ID NO: 1744139 - RNA, 19 nt, Human
uucuacccagcgagcccug

SEQ ID NO: 1744140 - RNA, 12 nt, Human
uucuacccagcg

SEQ ID NO: 1744141 - RNA, 23 nt, Human
uucuaaugugugaaucagagcac

SEQ ID NO: 1744142 - RNA, 13 nt, Human
uucuacgccaggg

SEQ ID NO: 1744143 - RNA, 13 nt, Human
uucuacuauuuau

SEQ ID NO: 1744144 - RNA, 21 nt, Human
uucuacccagcgagcccuggu

SEQ ID NO: 1744145 - RNA, 20 nt, Human
uucuacccagcgagcccugg

SEQ ID NO: 1744146 - RNA, 14 nt, Human
uucuacccaggugc

SEQ ID NO: 1744147 - RNA, 22 nt, Human
uucuacucgaguuacagacaaa

SEQ ID NO: 1744148 - RNA, 14 nt, Human
uucuauagcuuuuc

SEQ ID NO: 1744149 - RNA, 21 nt, Human
uucugacccugcuucaaauau

SEQ ID NO: 1744150 - RNA, 18 nt, Human
uucugacccugcuucaaa

SEQ ID NO: 1744151 - RNA, 22 nt, Human
uucugacccaugcugcccugug

SEQ ID NO: 1744152 - RNA, 23 nt, Human
uucugacccaugcugcccuguga

SEQ ID NO: 1744153 - RNA, 17 nt, Human
uucucugcccuccaaga

SEQ ID NO: 1744154 - RNA, 16 nt, Human
uucucugcccuccaag

SEQ ID NO: 1744155 - RNA, 19 nt, Human
uucugauccuaguuccacc

SEQ ID NO: 1744156 - RNA, 22 nt, Human
uucugauaugcaguuuuccuua

SEQ ID NO: 1744157 - RNA, 19 nt, Human
uucugcucacauaucuguc

SEQ ID NO: 1744158 - RNA, 20 nt, Human
uucucauuugccaauaauaa

SEQ ID NO: 1744159 - RNA, 16 nt, Human
uucuccacccugcucu

SEQ ID NO: 1744160 - RNA, 15 nt, Human
uucuccaccugccag

SEQ ID NO: 1744161 - RNA, 14 nt, Human
uucuccaccugcca

SEQ ID NO: 1744162 - RNA, 12 nt, Human
uucuccaccugc

SEQ ID NO: 1744163 - RNA, 21 nt, Human
uucuccaccucccacaaagga

SEQ ID NO: 1744164 - RNA, 18 nt, Human
uucuccaccugccaggga

SEQ ID NO: 1744165 - RNA, 16 nt, Human
uucuccaccugccagg

SEQ ID NO: 1744166 - RNA, 20 nt, Human
uucuccaccugccagggaca

SEQ ID NO: 1744167 - RNA, 12 nt, Human
uucuccacugga

SEQ ID NO: 1744168 - RNA, 12 nt, Human
uucucugcccuc

SEQ ID NO: 1744169 - RNA, 11 nt, Human
uucucugcccu

SEQ ID NO: 1744170 - RNA, 20 nt, Human
uucucugaggacacuaacca

SEQ ID NO: 1744171 - RNA, 14 nt, Human
uucucugaggacac

SEQ ID NO: 1744172 - RNA, 22 nt, Human
uucucuccuguaccucuugagc

SEQ ID NO: 1744173 - RNA, 19 nt, Human
uucucuccuguaccucuug

SEQ ID NO: 1744174 - RNA, 13 nt, Human
uucucugaggaca

SEQ ID NO: 1744175 - RNA, 16 nt, Human
uucucugaggacaaga

SEQ ID NO: 1744176 - RNA, 20 nt, Human
uucucugaggacaagagaaa

SEQ ID NO: 1744177 - RNA, 16 nt, Human
uucucuccagccccug

SEQ ID NO: 1744178 - RNA, 15 nt, Human
uucucuccagccccu

SEQ ID NO: 1744179 - RNA, 14 nt, Human
uucucuccuguacc

SEQ ID NO: 1744180 - RNA, 18 nt, Human
uucucuccuguaccucuu

SEQ ID NO: 1744181 - RNA, 14 nt, Human
uucucuccagcccc

SEQ ID NO: 1744182 - RNA, 13 nt, Human
uucucuccagccc

SEQ ID NO: 1744183 - RNA, 14 nt, Human
uuuauggcuuuugu

SEQ ID NO: 1744184 - RNA, 16 nt, Human
uuuauggcuuuugugc

SEQ ID NO: 1744185 - RNA, 13 nt, Human
uuuauuaugcaug

SEQ ID NO: 1744186 - RNA, 13 nt, Human
uuuauuauggcac

SEQ ID NO: 1744187 - RNA, 19 nt, Human
uuuauuuaguuccuugagu

SEQ ID NO: 1744188 - RNA, 21 nt, Human
uuucaacgcagcccugcuuug

SEQ ID NO: 1744189 - RNA, 20 nt, Human
uuucaacgcagcccugcuuu

SEQ ID NO: 1744190 - RNA, 16 nt, Human
uuucaacgcagcccug

SEQ ID NO: 1744191 - RNA, 15 nt, Human
uuucaacgcagcccu

SEQ ID NO: 1744192 - RNA, 14 nt, Human
uuucagauauaaaa

SEQ ID NO: 1744193 - RNA, 16 nt, Human
uuucagauauaaaaga

SEQ ID NO: 1744194 - RNA, 18 nt, Human
uuucagauauaaaagacu

SEQ ID NO: 1744195 - RNA, 16 nt, Human
uuucacaaccuucugu

SEQ ID NO: 1744196 - RNA, 22 nt, Human
uuucacaaccuucuguggcuca

SEQ ID NO: 1744197 - RNA, 19 nt, Human
uuucaauaggaaaaacuga

SEQ ID NO: 1744198 - RNA, 17 nt, Human
uuucaauaggaaaaacu

SEQ ID NO: 1744199 - RNA, 14 nt, Human
uuucaauaggaaaa

SEQ ID NO: 1744200 - RNA, 12 nt, Human
uuucaauaggaa

SEQ ID NO: 1744201 - RNA, 14 nt, Human
uuucaguguacaug

SEQ ID NO: 1744202 - RNA, 13 nt, Human
uuucaguguacau

SEQ ID NO: 1744203 - RNA, 11 nt, Human
uuucagugagg

SEQ ID NO: 1744204 - RNA, 23 nt, Human
uuucagcaccuacaguguacagu

SEQ ID NO: 1744205 - RNA, 18 nt, Human
uuucauuuaggugaggaa

SEQ ID NO: 1744206 - RNA, 14 nt, Human
uuucauuuagguga

SEQ ID NO: 1744207 - RNA, 16 nt, Human
uuuacagcugccugca

SEQ ID NO: 1744208 - RNA, 15 nt, Human
uuuacagcugccugc

SEQ ID NO: 1744209 - RNA, 22 nt, Human
uuuaauagcgucauaacuagaa

SEQ ID NO: 1744210 - RNA, 21 nt, Human
uuuaauagcgucauaacuaga

SEQ ID NO: 1744211 - RNA, 22 nt, Human
uuuacuucuuauacauuugaua

SEQ ID NO: 1744212 - RNA, 19 nt, Human
uuuacuucuuauacauuug

SEQ ID NO: 1744213 - RNA, 14 nt, Human
uuuagaaauauaau

SEQ ID NO: 1744214 - RNA, 12 nt, Human
uuuagacagagu

SEQ ID NO: 1744215 - RNA, 23 nt, Human
uuuauaaaaauaaaaaacacugg

SEQ ID NO: 1744216 - RNA, 21 nt, Human
uuuauaaaaauaaaaaacacu

SEQ ID NO: 1744217 - RNA, 19 nt, Human
uuuaacucuauaauguguu

SEQ ID NO: 1744218 - RNA, 18 nt, Human
uuguuuggagacagaguc

SEQ ID NO: 1744219 - RNA, 23 nt, Human
uuuaacaacuaugauuuggaaaa

SEQ ID NO: 1744220 - RNA, 18 nt, Human
uuuaacagaaauguacag

SEQ ID NO: 1744221 - RNA, 20 nt, Human
uuuaagacgaaacauuuguu

SEQ ID NO: 1744222 - RNA, 18 nt, Human
uuuaaguuacacauuuuu

SEQ ID NO: 1744223 - RNA, 22 nt, Human
uuuaagaaaaaggaugcacaga

SEQ ID NO: 1744224 - RNA, 19 nt, Human
uuuaagacauuuuuggaag

SEQ ID NO: 1744225 - RNA, 18 nt, Human
uuuaagaaaaaggaugca

SEQ ID NO: 1744226 - RNA, 20 nt, Human
uuguuagugugucuuagugu

SEQ ID NO: 1744227 - RNA, 22 nt, Human
uuguuaguaugaggcauuuguu

SEQ ID NO: 1744228 - RNA, 19 nt, Human
uuguuaguaugaggcauuu

SEQ ID NO: 1744229 - RNA, 21 nt, Human
uuguuaguaugaggcauuugu

SEQ ID NO: 1744230 - RNA, 14 nt, Human
uuguuacauuuuua

SEQ ID NO: 1744231 - RNA, 19 nt, Human
uuguguuucuuuaguuuuu

SEQ ID NO: 1744232 - RNA, 21 nt, Human
uuguuaauaaaaguacauguu

SEQ ID NO: 1744233 - RNA, 14 nt, Human
uuguuaauaaaagu

SEQ ID NO: 1744234 - RNA, 19 nt, Human
uuguuaauaaaaguacaug

SEQ ID NO: 1744235 - RNA, 21 nt, Human
uuguguuuauauauaagccaa

SEQ ID NO: 1744236 - RNA, 22 nt, Human
uuguggauuuaacagaaaugua

SEQ ID NO: 1744237 - RNA, 23 nt, Human
uuguggauuuaacagaaauguac

SEQ ID NO: 1744238 - RNA, 20 nt, Human
uuguggauuuaacagaaaug

SEQ ID NO: 1744239 - RNA, 21 nt, Human
uuguggauuuaacagaaaugu

SEQ ID NO: 1744240 - RNA, 16 nt, Human
uuguggacacagcucu

SEQ ID NO: 1744241 - RNA, 21 nt, Human
uuguggaaaaugaaaauuagg

SEQ ID NO: 1744242 - RNA, 17 nt, Human
uuguggacacagcucuu

SEQ ID NO: 1744243 - RNA, 12 nt, Human
uugugccccugc

SEQ ID NO: 1744244 - RNA, 21 nt, Human
uugugccagaaugcuuuagga

SEQ ID NO: 1744245 - RNA, 16 nt, Human
uugugccagaaugcuu

SEQ ID NO: 1744246 - RNA, 17 nt, Human
uugugcauuaucuagau

SEQ ID NO: 1744247 - RNA, 22 nt, Human
uugugcauuaucuagauacugu

SEQ ID NO: 1744248 - RNA, 23 nt, Human
uugugcauuaucuagauacugua

SEQ ID NO: 1744249 - RNA, 12 nt, Human
uugugcauuugg

SEQ ID NO: 1744250 - RNA, 21 nt, Human
uuguauucagaguugaugguu

SEQ ID NO: 1744251 - RNA, 15 nt, Human
uuguauucucuccug

SEQ ID NO: 1744252 - RNA, 16 nt, Human
uuguauucucuccugu

SEQ ID NO: 1744253 - RNA, 19 nt, Human
uuguauucucuccuguacc

SEQ ID NO: 1744254 - RNA, 20 nt, Human
uugucugaagucacugcaca

SEQ ID NO: 1744255 - RNA, 15 nt, Human
uugucuuaaaaagug

SEQ ID NO: 1744256 - RNA, 21 nt, Human
uugucugaagucacugcacag

SEQ ID NO: 1744257 - RNA, 22 nt, Human
uugucuuaaaaaguggaaaaau

SEQ ID NO: 1744258 - RNA, 20 nt, Human
uugugaaaggaaagaggcuc

SEQ ID NO: 1744259 - RNA, 16 nt, Human
uugugauuuuuguaau

SEQ ID NO: 1744260 - RNA, 17 nt, Human
uugugauuuuuguaauu

SEQ ID NO: 1744261 - RNA, 12 nt, Human
uugugauuuuug

SEQ ID NO: 1744262 - RNA, 13 nt, Human
uugugaaauuauu

SEQ ID NO: 1744263 - RNA, 14 nt, Human
uugugaaaugaugg

SEQ ID NO: 1744264 - RNA, 22 nt, Human
uuggguucaagcgauucuucug

SEQ ID NO: 1744265 - RNA, 19 nt, Human
uugcacguauuuuaauagc

SEQ ID NO: 1744266 - RNA, 16 nt, Human
uuggucugugagaugc

SEQ ID NO: 1744267 - RNA, 13 nt, Human
uuggucuguguga

SEQ ID NO: 1744268 - RNA, 21 nt, Human
uuggugaacauugcaauagaa

SEQ ID NO: 1744269 - RNA, 22 nt, Human
uuguaaaaauuaaaaguuaugg

SEQ ID NO: 1744270 - RNA, 17 nt, Human
uuguaaauagcucaggu

SEQ ID NO: 1744271 - RNA, 21 nt, Human
uuguaaaugugguaaagaguu

SEQ ID NO: 1744272 - RNA, 16 nt, Human
uuguaaaugugguaaa

SEQ ID NO: 1744273 - RNA, 17 nt, Human
uuguaaaagcauuuugu

SEQ ID NO: 1744274 - RNA, 18 nt, Human
uuguaaaagcauuuugua

SEQ ID NO: 1744275 - RNA, 19 nt, Human
uuguaaaagcauuuuguaa

SEQ ID NO: 1744276 - RNA, 20 nt, Human
uuguaaaagcauuuuguaau

SEQ ID NO: 1744277 - RNA, 15 nt, Human
uuguaaauuaacuuu

SEQ ID NO: 1744278 - RNA, 16 nt, Human
uuguaaauuaacuuuu

SEQ ID NO: 1744279 - RNA, 18 nt, Human
uuguaaauuaacuuuuau

SEQ ID NO: 1744280 - RNA, 23 nt, Human
uuguaaauuaacuuuuauaaacu

SEQ ID NO: 1744281 - RNA, 18 nt, Human
uuguacauaaugcgugca

SEQ ID NO: 1744282 - RNA, 13 nt, Human
uuuuuuuugacaa

SEQ ID NO: 1744283 - RNA, 13 nt, Human
uuuuuuccacuua

SEQ ID NO: 1744284 - RNA, 11 nt, Human
uuuuuuuacua

SEQ ID NO: 1744285 - RNA, 12 nt, Human
uuuuuuuuaaga

SEQ ID NO: 1744286 - RNA, 12 nt, Human
uuuuucaguuuu

SEQ ID NO: 1744287 - RNA, 15 nt, Human
uuuuucaguuuucag

SEQ ID NO: 1744288 - RNA, 13 nt, Human
uuuuuaaucuuua

SEQ ID NO: 1744289 - RNA, 18 nt, Human
uuuuuaaguuacacauuu

SEQ ID NO: 1744290 - RNA, 17 nt, Human
uuuuuaauaaagacagg

SEQ ID NO: 1744291 - RNA, 20 nt, Human
uuuuuaauaaagacaggguu

SEQ ID NO: 1744292 - RNA, 12 nt, Human
uuuuuaagaaaa

SEQ ID NO: 1744293 - RNA, 23 nt, Human
uuuuuaagaaaaaggaugcacag

SEQ ID NO: 1744294 - RNA, 16 nt, Human
uuuuuaagugcugcau

SEQ ID NO: 1744295 - RNA, 17 nt, Human
uuuuuaagugcugcauu

SEQ ID NO: 1744296 - RNA, 18 nt, Human
uuuuuaagugcugcauuu

SEQ ID NO: 1744297 - RNA, 19 nt, Human
uuuuuaagugcugcauuua

SEQ ID NO: 1744298 - RNA, 22 nt, Human
uuuuuaagugcugcauuuaaaa

SEQ ID NO: 1744299 - RNA, 23 nt, Human
uuuuuaagugcugcauuuaaaag

SEQ ID NO: 1744300 - RNA, 21 nt, Human
uuuuaaaguaacccuacaaaa

SEQ ID NO: 1744301 - RNA, 17 nt, Human
uuuuacaauaaaaucuu

SEQ ID NO: 1744302 - RNA, 19 nt, Human
uuuuacaaaaaagaaaaga

SEQ ID NO: 1744303 - RNA, 15 nt, Human
uuuuacuaauagaca

SEQ ID NO: 1744304 - RNA, 19 nt, Human
uuuuacguccaucucuugu

SEQ ID NO: 1744305 - RNA, 13 nt, Human
uuuuauacauaaa

SEQ ID NO: 1744306 - RNA, 21 nt, Human
uuuuauacauaaacaagacca

SEQ ID NO: 1744307 - RNA, 18 nt, Human
uuuuauuuuuagacagag

SEQ ID NO: 1744308 - RNA, 17 nt, Human
uuuucaaaauaaaaaug

SEQ ID NO: 1744309 - RNA, 21 nt, Human
uuuucaaaauuguuacaaauu

SEQ ID NO: 1744310 - RNA, 22 nt, Human
uuuucccuauuagagaagagau

SEQ ID NO: 1744311 - RNA, 18 nt, Human
uuuucccuauuagagaag

SEQ ID NO: 1744312 - RNA, 15 nt, Human
uuuucagauauaaaa

SEQ ID NO: 1744313 - RNA, 17 nt, Human
uuuucagauauaaaaga

SEQ ID NO: 1744314 - RNA, 23 nt, Human
uuuucuacucgaguuacagacaa

SEQ ID NO: 1744315 - RNA, 22 nt, Human
uuuucuacucgaguuacagaca

SEQ ID NO: 1744316 - RNA, 20 nt, Human
uuuucuacucgaguuacaga

SEQ ID NO: 1744317 - RNA, 13 nt, Human
uuuucuacucgag

SEQ ID NO: 1744318 - RNA, 13 nt, Human
uuuucuucucccu

SEQ ID NO: 1744319 - RNA, 22 nt, Human
uuuucuuguguguuuauuguca

SEQ ID NO: 1744320 - RNA, 16 nt, Human
uuuucuuucagccaag

SEQ ID NO: 1744321 - RNA, 15 nt, Human
uuuccguuaaaauac

SEQ ID NO: 1744322 - RNA, 17 nt, Human
uuuccguuaaaauacca

SEQ ID NO: 1744323 - RNA, 21 nt, Human
uuugagugccuuacacaaugg

SEQ ID NO: 1744324 - RNA, 13 nt, Human
uuuggacccugag

SEQ ID NO: 1744325 - RNA, 12 nt, Human
uuuggaaaauaa

SEQ ID NO: 1744326 - RNA, 16 nt, Human
uuuggaaagacuggac

SEQ ID NO: 1744327 - RNA, 18 nt, Human
uuugcauaacguauaaaa

SEQ ID NO: 1744328 - RNA, 15 nt, Human
uuuggucaacacuaa

SEQ ID NO: 1744329 - RNA, 17 nt, Human
uuuggucuacacugugc

SEQ ID NO: 1744330 - RNA, 14 nt, Human
uuuguauuuuuagu

SEQ ID NO: 1744331 - RNA, 22 nt, Human
uuuguuaguaugaggcauuugu

SEQ ID NO: 1744332 - RNA, 15 nt, Human
uuuguugucagcuga

SEQ ID NO: 1744333 - RNA, 16 nt, Human
uuuguugucagcugaa

SEQ ID NO: 1744334 - RNA, 14 nt, Human
uuuuaaaauccacu

SEQ ID NO: 1744335 - RNA, 23 nt, Human
uuuuaaaauccacuuuaucuuga

SEQ ID NO: 1744336 - RNA, 20 nt, Human
uuuuaaacccuauugguaaa

SEQ ID NO: 1744337 - RNA, 14 nt, Human
ugcauccuccgccu

SEQ ID NO: 1744338 - RNA, 19 nt, Human
ugcagauaaacaguaguga

SEQ ID NO: 1744339 - RNA, 15 nt, Human
ugcauguuugugauu

SEQ ID NO: 1744340 - RNA, 15 nt, Human
ugcauccuccgccuc

SEQ ID NO: 1744341 - RNA, 17 nt, Human
ugcaugguuuagaaagc

SEQ ID NO: 1744342 - RNA, 12 nt, Human
ugcauuaucuag

SEQ ID NO: 1744343 - RNA, 17 nt, Human
ugcauuaucuagauacu

SEQ ID NO: 1744344 - RNA, 18 nt, Human
ugcauuaucuagauacug

SEQ ID NO: 1744345 - RNA, 15 nt, Human
ugccaccacgcccgg

SEQ ID NO: 1744346 - RNA, 12 nt, Human
ugccauccaggu

SEQ ID NO: 1744347 - RNA, 20 nt, Human
ugccauccagguucagcuug

SEQ ID NO: 1744348 - RNA, 15 nt, Human
ugccauccagguuca

SEQ ID NO: 1744349 - RNA, 17 nt, Human
ugccagguuuuuggucu

SEQ ID NO: 1744350 - RNA, 19 nt, Human
ugccaggaagccagcaggc

SEQ ID NO: 1744351 - RNA, 18 nt, Human
ugccaggaagccagcagg

SEQ ID NO: 1744352 - RNA, 16 nt, Human
ugccaggaagccagca

SEQ ID NO: 1744353 - RNA, 12 nt, Human
ugccaggaagcc

SEQ ID NO: 1744354 - RNA, 20 nt, Human
ugcccaccuggccucugcac

SEQ ID NO: 1744355 - RNA, 16 nt, Human
ugccauguuggccagg

SEQ ID NO: 1744356 - RNA, 15 nt, Human
ugccauguuggccag

SEQ ID NO: 1744357 - RNA, 12 nt, Human
ugccauguuggc

SEQ ID NO: 1744358 - RNA, 13 nt, Human
ugcccacucccug

SEQ ID NO: 1744359 - RNA, 18 nt, Human
ugcccacgcuggagugca

SEQ ID NO: 1744360 - RNA, 20 nt, Human
ugccaugaggaacaaggcaa

SEQ ID NO: 1744361 - RNA, 23 nt, Human
ugccaugaggaacaaggcaaggc

SEQ ID NO: 1744362 - RNA, 15 nt, Human
ugccaugugccaggu

SEQ ID NO: 1744363 - RNA, 14 nt, Human
ugccaugugccagg

SEQ ID NO: 1744364 - RNA, 18 nt, Human
ugcccuggauccaucagg

SEQ ID NO: 1744365 - RNA, 18 nt, Human
ugcccuggugcugccaca

SEQ ID NO: 1744366 - RNA, 20 nt, Human
ugcccuggugcugccacacu

SEQ ID NO: 1744367 - RNA, 21 nt, Human
ugcccuggugcugccacacuu

SEQ ID NO: 1744368 - RNA, 19 nt, Human
ugccgucuaccugaggggc

SEQ ID NO: 1744369 - RNA, 17 nt, Human
ugccgucuaccugaggg

SEQ ID NO: 1744370 - RNA, 16 nt, Human
ugccgucuaccugagg

SEQ ID NO: 1744371 - RNA, 15 nt, Human
ugccgucuaccugag

SEQ ID NO: 1744372 - RNA, 15 nt, Human
ugcccugguuuccug

SEQ ID NO: 1744373 - RNA, 23 nt, Human
ugcccugcccaccuggccucugc

SEQ ID NO: 1744374 - RNA, 22 nt, Human
ugcccugcccaccuggccucug

SEQ ID NO: 1744375 - RNA, 17 nt, Human
ugcccuaaaguguauuu

SEQ ID NO: 1744376 - RNA, 19 nt, Human
ugcccuaaaguguauuuuu

SEQ ID NO: 1744377 - RNA, 23 nt, Human
ugcccugcugagucccaggcuga

SEQ ID NO: 1744378 - RNA, 22 nt, Human
ugcccugcugagucccaggcug

SEQ ID NO: 1744379 - RNA, 18 nt, Human
ugcccugcugagucccag

SEQ ID NO: 1744380 - RNA, 19 nt, Human
ugcccugcgggucacagga

SEQ ID NO: 1744381 - RNA, 13 nt, Human
ugccucugggacu

SEQ ID NO: 1744382 - RNA, 14 nt, Human
ugccucugggacug

SEQ ID NO: 1744383 - RNA, 18 nt, Human
ugccucugccugucuccc

SEQ ID NO: 1744384 - RNA, 14 nt, Human
ugccucugccuguc

SEQ ID NO: 1744385 - RNA, 13 nt, Human
ugccucugccugu

SEQ ID NO: 1744386 - RNA, 20 nt, Human
ugccuccuuugugaggaagc

SEQ ID NO: 1744387 - RNA, 21 nt, Human
ugccuccuuugugaggaagcc

SEQ ID NO: 1744388 - RNA, 22 nt, Human
ugccuccuuugugaggaagccg

SEQ ID NO: 1744389 - RNA, 19 nt, Human
ugccugguggcagcugcgg

SEQ ID NO: 1744390 - RNA, 18 nt, Human
ugccugguggcagcugcg

SEQ ID NO: 1744391 - RNA, 17 nt, Human
ugccugguggcagcugc

SEQ ID NO: 1744392 - RNA, 13 nt, Human
ugccugcccaggc

SEQ ID NO: 1744393 - RNA, 21 nt, Human
ugccucuucucuacucuaggg

SEQ ID NO: 1744394 - RNA, 13 nt, Human
ugccucuuccucc

SEQ ID NO: 1744395 - RNA, 16 nt, Human
ugauuuuuuuuuuuca

SEQ ID NO: 1744396 - RNA, 23 nt, Human
ugauuuuuuuuuccuucagugcc

SEQ ID NO: 1744397 - RNA, 22 nt, Human
ugauuuuuuuuuccuucagugc

SEQ ID NO: 1744398 - RNA, 20 nt, Human
ugauuuuuuuuuccuucagu

SEQ ID NO: 1744399 - RNA, 19 nt, Human
ugauuuuuuuuuccuucag

SEQ ID NO: 1744400 - RNA, 17 nt, Human
ugauuuuuuuuuccuuc

SEQ ID NO: 1744401 - RNA, 16 nt, Human
ugauuuuuuuuuccuu

SEQ ID NO: 1744402 - RNA, 13 nt, Human
ugauuuuuuucca

SEQ ID NO: 1744403 - RNA, 13 nt, Human
ugauuuucauugc

SEQ ID NO: 1744404 - RNA, 15 nt, Human
ugauuuucauugcug

SEQ ID NO: 1744405 - RNA, 19 nt, Human
ugauuuuuaaagaaaaguu

SEQ ID NO: 1744406 - RNA, 17 nt, Human
ugauuuugcuguagaag

SEQ ID NO: 1744407 - RNA, 19 nt, Human
ugauuuugcuguagaagau

SEQ ID NO: 1744408 - RNA, 14 nt, Human
ugauuuugcuguag

SEQ ID NO: 1744409 - RNA, 16 nt, Human
ugauuuugcuguagaa

SEQ ID NO: 1744410 - RNA, 17 nt, Human
ugcaacaggcugggcuu

SEQ ID NO: 1744411 - RNA, 16 nt, Human
ugcaacaggcugggcu

SEQ ID NO: 1744412 - RNA, 15 nt, Human
ugcaacaggcugggc

SEQ ID NO: 1744413 - RNA, 14 nt, Human
ugcaacaggcuggg

SEQ ID NO: 1744414 - RNA, 20 nt, Human
ugcaacaggcugggcuucag

SEQ ID NO: 1744415 - RNA, 19 nt, Human
ugcaacaggcugggcuuca

SEQ ID NO: 1744416 - RNA, 14 nt, Human
ugcaaccuccgccu

SEQ ID NO: 1744417 - RNA, 13 nt, Human
ugcaaccuccgcc

SEQ ID NO: 1744418 - RNA, 16 nt, Human
ugcaaccauuugaaac

SEQ ID NO: 1744419 - RNA, 21 nt, Human
ugcaaccuccgccucuugggu

SEQ ID NO: 1744420 - RNA, 20 nt, Human
ugcaaccuccgccucuuggg

SEQ ID NO: 1744421 - RNA, 18 nt, Human
ugcaaccuccgccucuug

SEQ ID NO: 1744422 - RNA, 20 nt, Human
ugcaaccugauugugucucu

SEQ ID NO: 1744423 - RNA, 19 nt, Human
ugcaaccugauugugucuc

SEQ ID NO: 1744424 - RNA, 22 nt, Human
ugcaaccugauugugucucuug

SEQ ID NO: 1744425 - RNA, 21 nt, Human
ugcaaccuucgccaccugggu

SEQ ID NO: 1744426 - RNA, 18 nt, Human
ugcaaccuucgccaccug

SEQ ID NO: 1744427 - RNA, 18 nt, Human
ugcaacuuuguauaaaag

SEQ ID NO: 1744428 - RNA, 18 nt, Human
ugcaacuuguaaaugugg

SEQ ID NO: 1744429 - RNA, 16 nt, Human
ugcaacuuguaaaugu

SEQ ID NO: 1744430 - RNA, 13 nt, Human
ugcaacuucugcc

SEQ ID NO: 1744431 - RNA, 14 nt, Human
ugcaacuucugccu

SEQ ID NO: 1744432 - RNA, 21 nt, Human
ugcaaugacacagucuuggcu

SEQ ID NO: 1744433 - RNA, 16 nt, Human
ugcaaugaccuuucaa

SEQ ID NO: 1744434 - RNA, 13 nt, Human
ugcaaugaccuuu

SEQ ID NO: 1744435 - RNA, 23 nt, Human
ugcaaugaccuuucaauaggaaa

SEQ ID NO: 1744436 - RNA, 22 nt, Human
ugcaaugaccuuucaauaggaa

SEQ ID NO: 1744437 - RNA, 19 nt, Human
ugcaaugaccuuucaauag

SEQ ID NO: 1744438 - RNA, 17 nt, Human
ugcaaugaccuuucaau

SEQ ID NO: 1744439 - RNA, 16 nt, Human
ugcaauggcagccuug

SEQ ID NO: 1744440 - RNA, 15 nt, Human
ugcaauggcagccuu

SEQ ID NO: 1744441 - RNA, 14 nt, Human
ugcaauggcagccu

SEQ ID NO: 1744442 - RNA, 13 nt, Human
ugcaauggcagcc

SEQ ID NO: 1744443 - RNA, 16 nt, Human
ugcacaaacagaggcc

SEQ ID NO: 1744444 - RNA, 15 nt, Human
ugcacaaacagaggc

SEQ ID NO: 1744445 - RNA, 19 nt, Human
ugcacaaacagaggccgcc

SEQ ID NO: 1744446 - RNA, 17 nt, Human
ugcacaaacagaggccg

SEQ ID NO: 1744447 - RNA, 20 nt, Human
ugcacaaacagaggccgcca

SEQ ID NO: 1744448 - RNA, 17 nt, Human
ugcacagaguuguuaca

SEQ ID NO: 1744449 - RNA, 17 nt, Human
ugcacaaagcccuucca

SEQ ID NO: 1744450 - RNA, 15 nt, Human
ugcacaaagcccuuc

SEQ ID NO: 1744451 - RNA, 18 nt, Human
ugcacagaguuguuacau

SEQ ID NO: 1744452 - RNA, 19 nt, Human
ugcacagaguuguuacauu

SEQ ID NO: 1744453 - RNA, 16 nt, Human
ugcacuugcagacucu

SEQ ID NO: 1744454 - RNA, 19 nt, Human
ugcagagguccacaacaca

SEQ ID NO: 1744455 - RNA, 21 nt, Human
ugcacugacauuguuggccaa

SEQ ID NO: 1744456 - RNA, 18 nt, Human
ugcacugacauuguuggc

SEQ ID NO: 1744457 - RNA, 21 nt, Human
ugcaccggcuggccuggcccc

SEQ ID NO: 1744458 - RNA, 17 nt, Human
ugcaccuggaauauaua

SEQ ID NO: 1744459 - RNA, 20 nt, Human
ugcaccuggaauauauaacc

SEQ ID NO: 1744460 - RNA, 22 nt, Human
ugcaccuggaauauauaaccag

SEQ ID NO: 1744461 - RNA, 20 nt, Human
ugcaccggcuggccuggccc

SEQ ID NO: 1744462 - RNA, 19 nt, Human
ugcaccggcuggccuggcc

SEQ ID NO: 1744463 - RNA, 18 nt, Human
ugcaccggcuggccuggc

SEQ ID NO: 1744464 - RNA, 17 nt, Human
ugcacagugcaucucag

SEQ ID NO: 1744465 - RNA, 16 nt, Human
ugcacagugcaucuca

SEQ ID NO: 1744466 - RNA, 20 nt, Human
ugcacagaguuguuacauuu

SEQ ID NO: 1744467 - RNA, 15 nt, Human
ugcacagugcaucuc

SEQ ID NO: 1744468 - RNA, 23 nt, Human
ugaccauucuccaccugccaggg

SEQ ID NO: 1744469 - RNA, 22 nt, Human
ugaccauucuccaccugccagg

SEQ ID NO: 1744470 - RNA, 21 nt, Human
ugaccauucuccaccugccag

SEQ ID NO: 1744471 - RNA, 20 nt, Human
ugaccauucuccaccugcca

SEQ ID NO: 1744472 - RNA, 17 nt, Human
ucuugaauuguaaggaa

SEQ ID NO: 1744473 - RNA, 15 nt, Human
ucuugaacuccuggc

SEQ ID NO: 1744474 - RNA, 16 nt, Human
ucuugaauaauguaag

SEQ ID NO: 1744475 - RNA, 16 nt, Human
ugaccuuucaauagga

SEQ ID NO: 1744476 - RNA, 15 nt, Human
ugaccuuucaauagg

SEQ ID NO: 1744477 - RNA, 14 nt, Human
ugaccuuucaauag

SEQ ID NO: 1744478 - RNA, 18 nt, Human
ugaccucugcagcaauaa

SEQ ID NO: 1744479 - RNA, 21 nt, Human
ugaccucugcagcaauaaagc

SEQ ID NO: 1744480 - RNA, 12 nt, Human
ugaccucugccu

SEQ ID NO: 1744481 - RNA, 23 nt, Human
ugaccucugcagcaauaaagcag

SEQ ID NO: 1744482 - RNA, 22 nt, Human
ugaccucaggugauccacccac

SEQ ID NO: 1744483 - RNA, 16 nt, Human
ugaccucagcuuugau

SEQ ID NO: 1744484 - RNA, 13 nt, Human
ugaccucugcagc

SEQ ID NO: 1744485 - RNA, 16 nt, Human
ugaccucugcagcaau

SEQ ID NO: 1744486 - RNA, 14 nt, Human
ugacugaauuucuu

SEQ ID NO: 1744487 - RNA, 15 nt, Human
ugacugaauuucuuu

SEQ ID NO: 1744488 - RNA, 13 nt, Human
ugacugaauuucu

SEQ ID NO: 1744489 - RNA, 20 nt, Human
ugacgccaucccagccccaa

SEQ ID NO: 1744490 - RNA, 19 nt, Human
ugacgccaucccagcccca

SEQ ID NO: 1744491 - RNA, 18 nt, Human
ugacgccaucccagcccc

SEQ ID NO: 1744492 - RNA, 17 nt, Human
ugacgccaucccagccc

SEQ ID NO: 1744493 - RNA, 16 nt, Human
ugacgccaucccagcc

SEQ ID NO: 1744494 - RNA, 15 nt, Human
ugacgccaucccagc

SEQ ID NO: 1744495 - RNA, 14 nt, Human
ugacgccaucccag

SEQ ID NO: 1744496 - RNA, 13 nt, Human
ugacgccauccca

SEQ ID NO: 1744497 - RNA, 22 nt, Human
ugaccuuucaauaggaaaaacu

SEQ ID NO: 1744498 - RNA, 18 nt, Human
ugaccuuucaauaggaaa

SEQ ID NO: 1744499 - RNA, 14 nt, Human
ugagacagcucugc

SEQ ID NO: 1744500 - RNA, 16 nt, Human
ugagacagcucugcau

SEQ ID NO: 1744501 - RNA, 12 nt, Human
ugagacccuguc

SEQ ID NO: 1744502 - RNA, 22 nt, Human
ugacuguacuccucccaggcgc

SEQ ID NO: 1744503 - RNA, 18 nt, Human
ugacuguacuccucccag

SEQ ID NO: 1744504 - RNA, 17 nt, Human
ugacuguacuccuccca

SEQ ID NO: 1744505 - RNA, 16 nt, Human
ugacuguacuccuccc

SEQ ID NO: 1744506 - RNA, 13 nt, Human
ugagaaaucuaaa

SEQ ID NO: 1744507 - RNA, 17 nt, Human
ugagaaaucuaaaaaac

SEQ ID NO: 1744508 - RNA, 17 nt, Human
ugagaguagagucacug

SEQ ID NO: 1744509 - RNA, 22 nt, Human
ugagaggcauccaguaucuuga

SEQ ID NO: 1744510 - RNA, 23 nt, Human
ugagaggcauccaguaucuugaa

SEQ ID NO: 1744511 - RNA, 14 nt, Human
ugagacucugucuc

SEQ ID NO: 1744512 - RNA, 13 nt, Human
ugagacucugucu

SEQ ID NO: 1744513 - RNA, 12 nt, Human
ugagacucuguc

SEQ ID NO: 1744514 - RNA, 16 nt, Human
ugagcaucaggccagg

SEQ ID NO: 1744515 - RNA, 15 nt, Human
ugagcaucaggccag

SEQ ID NO: 1744516 - RNA, 14 nt, Human
ugagcaucaggcca

SEQ ID NO: 1744517 - RNA, 13 nt, Human
ugagccccaaaag

SEQ ID NO: 1744518 - RNA, 13 nt, Human
ugagcaucaggcc

SEQ ID NO: 1744519 - RNA, 14 nt, Human
ugagaugcuagaac

SEQ ID NO: 1744520 - RNA, 16 nt, Human
ugagaugcuagaacuc

SEQ ID NO: 1744521 - RNA, 20 nt, Human
ugagaugcuagaacucccuu

SEQ ID NO: 1744522 - RNA, 15 nt, Human
ugagccucagcaucc

SEQ ID NO: 1744523 - RNA, 13 nt, Human
ugagccucagcau

SEQ ID NO: 1744524 - RNA, 16 nt, Human
ugauagcacagacccu

SEQ ID NO: 1744525 - RNA, 15 nt, Human
ugauagcacagaccc

SEQ ID NO: 1744526 - RNA, 21 nt, Human
ugauagcacagacccugcccu

SEQ ID NO: 1744527 - RNA, 20 nt, Human
ugauagcacagacccugccc

SEQ ID NO: 1744528 - RNA, 18 nt, Human
ugauagcacagacccugc

SEQ ID NO: 1744529 - RNA, 17 nt, Human
ugauagcacagacccug

SEQ ID NO: 1744530 - RNA, 23 nt, Human
ugauagcacagacccugcccugu

SEQ ID NO: 1744531 - RNA, 22 nt, Human
ugauagcacagacccugcccug

SEQ ID NO: 1744532 - RNA, 18 nt, Human
ugauagguauaaguggug

SEQ ID NO: 1744533 - RNA, 22 nt, Human
ugauagguuauuuugauguaaa

SEQ ID NO: 1744534 - RNA, 18 nt, Human
ugagucgaggacagggag

SEQ ID NO: 1744535 - RNA, 19 nt, Human
ugaguugauucagcucugc

SEQ ID NO: 1744536 - RNA, 16 nt, Human
ugaguugauucagcuc

SEQ ID NO: 1744537 - RNA, 23 nt, Human
ugaguugauagcacagacccugc

SEQ ID NO: 1744538 - RNA, 21 nt, Human
ugaguugauagcacagacccu

SEQ ID NO: 1744539 - RNA, 16 nt, Human
ugagucgaggacaggg

SEQ ID NO: 1744540 - RNA, 15 nt, Human
ugagucgaggacagg

SEQ ID NO: 1744541 - RNA, 15 nt, Human
ugaggugcuauguuc

SEQ ID NO: 1744542 - RNA, 16 nt, Human
ugaggugcuauguucu

SEQ ID NO: 1744543 - RNA, 21 nt, Human
ugaguccccuguuuguuucug

SEQ ID NO: 1744544 - RNA, 19 nt, Human
ugagguuucaaaccucccu

SEQ ID NO: 1744545 - RNA, 18 nt, Human
ugaguccuggcaugggaa

SEQ ID NO: 1744546 - RNA, 11 nt, Human
ugaguccuggc

SEQ ID NO: 1744547 - RNA, 22 nt, Human
ugaguccuggcaugggaaugaa

SEQ ID NO: 1744548 - RNA, 19 nt, Human
ugaguccuggcaugggaau

SEQ ID NO: 1744549 - RNA, 14 nt, Human
ugagucgaggacag

SEQ ID NO: 1744550 - RNA, 20 nt, Human
ugaggucuguucuuuccaaa

SEQ ID NO: 1744551 - RNA, 14 nt, Human
ugaggucuguucuu

SEQ ID NO: 1744552 - RNA, 15 nt, Human
ugaggucuguucuuu

SEQ ID NO: 1744553 - RNA, 11 nt, Human
ugaggcugggc

SEQ ID NO: 1744554 - RNA, 23 nt, Human
ugaggacuuaaaauauuccugca

SEQ ID NO: 1744555 - RNA, 14 nt, Human
ugaugccaugagga

SEQ ID NO: 1744556 - RNA, 20 nt, Human
ugaugaugaaaugaggucag

SEQ ID NO: 1744557 - RNA, 23 nt, Human
ugaugaucuuugcagacaggcaa

SEQ ID NO: 1744558 - RNA, 22 nt, Human
ugaugaucuuugcagacaggca

SEQ ID NO: 1744559 - RNA, 20 nt, Human
ugaucuuugcagacaggcaa

SEQ ID NO: 1744560 - RNA, 19 nt, Human
ugaucuuugcagacaggca

SEQ ID NO: 1744561 - RNA, 21 nt, Human
ugaucugaugcaagcaagaaa

SEQ ID NO: 1744562 - RNA, 23 nt, Human
ugaucuuugcagacaggcaagca

SEQ ID NO: 1744563 - RNA, 21 nt, Human
ugaucuuugcagacaggcaag

SEQ ID NO: 1744564 - RNA, 23 nt, Human
ugaugcuucuucagagacuccug

SEQ ID NO: 1744565 - RNA, 13 nt, Human
ugauguacaugua

SEQ ID NO: 1744566 - RNA, 22 nt, Human
ugaugcuucuucagagacuccu

SEQ ID NO: 1744567 - RNA, 21 nt, Human
ugaugcuucuucagagacucc

SEQ ID NO: 1744568 - RNA, 19 nt, Human
ugaugcuucuucagagacu

SEQ ID NO: 1744569 - RNA, 24 nt, Human
ugauaguuguaccgcaaugugacu

SEQ ID NO: 1744570 - RNA, 23 nt, Human
ugauauaaguguguguuuuucau

SEQ ID NO: 1744571 - RNA, 17 nt, Human
ugauauaaguguguguu

SEQ ID NO: 1744572 - RNA, 22 nt, Human
ugaucacggcucacugcagccu

SEQ ID NO: 1744573 - RNA, 19 nt, Human
ugauaugcaguuuuccuua

SEQ ID NO: 1744574 - RNA, 20 nt, Human
ugauccacccaccucagccu

SEQ ID NO: 1744575 - RNA, 16 nt, Human
ugauccacccaccuca

SEQ ID NO: 1744576 - RNA, 15 nt, Human
ugauccacccaccuc

SEQ ID NO: 1744577 - RNA, 21 nt, Human
ugauccaagcuggucccacuc

SEQ ID NO: 1744578 - RNA, 24 nt, Human
ugaucauccacugugccaugugcc

SEQ ID NO: 1744579 - RNA, 13 nt, Human
ugaucauccacug

SEQ ID NO: 1744580 - RNA, 21 nt, Human
ugaucuaggaagacuuuggaa

SEQ ID NO: 1744581 - RNA, 19 nt, Human
ugaucuaggaagacuuugg

SEQ ID NO: 1744582 - RNA, 22 nt, Human
ugauccacccaccucagccucc

SEQ ID NO: 1744583 - RNA, 21 nt, Human
ugauccacccaccucagccuc

SEQ ID NO: 1744584 - RNA, 20 nt, Human
ugaucugaugcaagcaagaa

SEQ ID NO: 1744585 - RNA, 19 nt, Human
ugcuuaacuucacauauug

SEQ ID NO: 1744586 - RNA, 13 nt, Human
ugcuuaacuucac

SEQ ID NO: 1744587 - RNA, 14 nt, Human
ugcuuaacuucaca

SEQ ID NO: 1744588 - RNA, 17 nt, Human
ugcuuaacuucacauau

SEQ ID NO: 1744589 - RNA, 18 nt, Human
ugcuuaacuucacauauu

SEQ ID NO: 1744590 - RNA, 23 nt, Human
ugcuuccagugaggcucugcccu

SEQ ID NO: 1744591 - RNA, 22 nt, Human
ugcuuccagugaggcucugccc

SEQ ID NO: 1744592 - RNA, 14 nt, Human
ugcuuguuaacuga

SEQ ID NO: 1744593 - RNA, 16 nt, Human
ugcuuguuaacugagu

SEQ ID NO: 1744594 - RNA, 13 nt, Human
ugcuucuucagag

SEQ ID NO: 1744595 - RNA, 18 nt, Human
ugcuugugaaaggaaaga

SEQ ID NO: 1744596 - RNA, 17 nt, Human
ugcuuuggaaaacccag

SEQ ID NO: 1744597 - RNA, 13 nt, Human
ugcuuuggaaauc

SEQ ID NO: 1744598 - RNA, 17 nt, Human
uggaacacucugagacu

SEQ ID NO: 1744599 - RNA, 15 nt, Human
uggaacacucugaga

SEQ ID NO: 1744600 - RNA, 23 nt, Human
uggacaggcauguucucugagga

SEQ ID NO: 1744601 - RNA, 22 nt, Human
uggacaggcauguucucugagg

SEQ ID NO: 1744602 - RNA, 18 nt, Human
uggacaggcauguucucu

SEQ ID NO: 1744603 - RNA, 23 nt, Human
uggacguguuaugacuccagaau

SEQ ID NO: 1744604 - RNA, 19 nt, Human
uggacguguuaugacucca

SEQ ID NO: 1744605 - RNA, 20 nt, Human
uggacuaacuugucuuugga

SEQ ID NO: 1744606 - RNA, 19 nt, Human
uggacuaacuugucuuugg

SEQ ID NO: 1744607 - RNA, 22 nt, Human
uggcacugcuuccagugaggcu

SEQ ID NO: 1744608 - RNA, 22 nt, Human
uggcacuauaauguaagcucua

SEQ ID NO: 1744609 - RNA, 19 nt, Human
uggcacugcuuccagugag

SEQ ID NO: 1744610 - RNA, 21 nt, Human
uggcacuauaauguaagcucu

SEQ ID NO: 1744611 - RNA, 15 nt, Human
uggauuuaacagaaa

SEQ ID NO: 1744612 - RNA, 17 nt, Human
uggauuuaacagaaaug

SEQ ID NO: 1744613 - RNA, 23 nt, Human
uggaggggggaggugggauccuc

SEQ ID NO: 1744614 - RNA, 21 nt, Human
uggaugcagccucacaguccu

SEQ ID NO: 1744615 - RNA, 13 nt, Human
uggaugcagccuc

SEQ ID NO: 1744616 - RNA, 22 nt, Human
uggaugcagccucacaguccuu

SEQ ID NO: 1744617 - RNA, 19 nt, Human
uggaucaaauccagccugc

SEQ ID NO: 1744618 - RNA, 18 nt, Human
ugggaggaucucuugagc

SEQ ID NO: 1744619 - RNA, 18 nt, Human
ugggaugauuggaggggg

SEQ ID NO: 1744620 - RNA, 14 nt, Human
ugggacagggagga

SEQ ID NO: 1744621 - RNA, 16 nt, Human
ugggaggaucucuuga

SEQ ID NO: 1744622 - RNA, 15 nt, Human
ugggacacccuguga

SEQ ID NO: 1744623 - RNA, 14 nt, Human
ugggacacccugug

SEQ ID NO: 1744624 - RNA, 21 nt, Human
ugggaaugaaugucaguguga

SEQ ID NO: 1744625 - RNA, 16 nt, Human
ugggaaugaaugucag

SEQ ID NO: 1744626 - RNA, 17 nt, Human
ugggcagagcagagacc

SEQ ID NO: 1744627 - RNA, 15 nt, Human
ugggcagagcagaga

SEQ ID NO: 1744628 - RNA, 14 nt, Human
ugggcagagcagag

SEQ ID NO: 1744629 - RNA, 18 nt, Human
ugggcagagcagagacca

SEQ ID NO: 1744630 - RNA, 19 nt, Human
uggggggcugaggugggag

SEQ ID NO: 1744631 - RNA, 16 nt, Human
ugggggccucagugcc

SEQ ID NO: 1744632 - RNA, 17 nt, Human
uggggccaggcuggguc

SEQ ID NO: 1744633 - RNA, 21 nt, Human
ugggcuugucuguagauuuua

SEQ ID NO: 1744634 - RNA, 17 nt, Human
ugggcuugucuguagau

SEQ ID NO: 1744635 - RNA, 23 nt, Human
ugggcuuggggaccagagcugcc

SEQ ID NO: 1744636 - RNA, 13 nt, Human
uggggcagcuuga

SEQ ID NO: 1744637 - RNA, 21 nt, Human
ugggcuucaguggcagcugcu

SEQ ID NO: 1744638 - RNA, 22 nt, Human
ugggcuucaguggcagcugcuu

SEQ ID NO: 1744639 - RNA, 15 nt, Human
ugggcuucauccucc

SEQ ID NO: 1744640 - RNA, 22 nt, Human
ugggcuucauccuccucagauc

SEQ ID NO: 1744641 - RNA, 23 nt, Human
uggccuucggccuccauccugag

SEQ ID NO: 1744642 - RNA, 13 nt, Human
uggccucugcacu

SEQ ID NO: 1744643 - RNA, 22 nt, Human
uggccuucggccuccauccuga

SEQ ID NO: 1744644 - RNA, 17 nt, Human
uggcuccagcuggccgg

SEQ ID NO: 1744645 - RNA, 16 nt, Human
uggcugcugaaggcuc

SEQ ID NO: 1744646 - RNA, 14 nt, Human
uggcugcugaaggc

SEQ ID NO: 1744647 - RNA, 13 nt, Human
uggcugcugaagg

SEQ ID NO: 1744648 - RNA, 14 nt, Human
ugggaaugaagcaa

SEQ ID NO: 1744649 - RNA, 22 nt, Human
uggcuuuucacugcuggcugcc

SEQ ID NO: 1744650 - RNA, 21 nt, Human
uggcuuuucacugcuggcugc

SEQ ID NO: 1744651 - RNA, 19 nt, Human
uggcuuuucacugcuggcu

SEQ ID NO: 1744652 - RNA, 18 nt, Human
uggcuuuucacugcuggc

SEQ ID NO: 1744653 - RNA, 16 nt, Human
uggcuuuucacugcug

SEQ ID NO: 1744654 - RNA, 22 nt, Human
uggcuuccuaaaauucagugga

SEQ ID NO: 1744655 - RNA, 22 nt, Human
uggcuucccgcucagcccuccc

SEQ ID NO: 1744656 - RNA, 21 nt, Human
uggcuucccgcucagcccucc

SEQ ID NO: 1744657 - RNA, 20 nt, Human
uggcuucccgcucagcccuc

SEQ ID NO: 1744658 - RNA, 19 nt, Human
uggcuucccgcucagcccu

SEQ ID NO: 1744659 - RNA, 18 nt, Human
uggcuucccgcucagccc

SEQ ID NO: 1744660 - RNA, 22 nt, Human
uggccucccaacucaccccagc

SEQ ID NO: 1744661 - RNA, 21 nt, Human
uggccucccaacucaccccag

SEQ ID NO: 1744662 - RNA, 20 nt, Human
uggccucccaacucacccca

SEQ ID NO: 1744663 - RNA, 19 nt, Human
uggccucccaacucacccc

SEQ ID NO: 1744664 - RNA, 14 nt, Human
uggccucccaacuc

SEQ ID NO: 1744665 - RNA, 11 nt, Human
uggccucccaa

SEQ ID NO: 1744666 - RNA, 13 nt, Human
uggccuccaaguc

SEQ ID NO: 1744667 - RNA, 23 nt, Human
uggccuccaaguccacaguggaa

SEQ ID NO: 1744668 - RNA, 23 nt, Human
uggccucaagugauucuccugcc

SEQ ID NO: 1744669 - RNA, 18 nt, Human
uggccucaagugauucuc

SEQ ID NO: 1744670 - RNA, 23 nt, Human
uggccuagcauacguacacauuu

SEQ ID NO: 1744671 - RNA, 20 nt, Human
uggccccucagggucccugg

SEQ ID NO: 1744672 - RNA, 13 nt, Human
uggccccucaggg

SEQ ID NO: 1744673 - RNA, 19 nt, Human
uggcagcugcgguccaccc

SEQ ID NO: 1744674 - RNA, 17 nt, Human
uggcagcugcgguccac

SEQ ID NO: 1744675 - RNA, 22 nt, Human
uggccccucagggucccuggug

SEQ ID NO: 1744676 - RNA, 21 nt, Human
uggccccucagggucccuggu

SEQ ID NO: 1744677 - RNA, 14 nt, Human
uggccccugcccgg

SEQ ID NO: 1744678 - RNA, 20 nt, Human
uggccuagcauacguacaca

SEQ ID NO: 1744679 - RNA, 16 nt, Human
ugucuguuguauucau

SEQ ID NO: 1744680 - RNA, 23 nt, Human
ugucuuuggacccugaggcccag

SEQ ID NO: 1744681 - RNA, 16 nt, Human
ugucuuuucuugcaug

SEQ ID NO: 1744682 - RNA, 19 nt, Human
ugucucaagagggcacugg

SEQ ID NO: 1744683 - RNA, 21 nt, Human
ugucucaaaaaaagaaaaaga

SEQ ID NO: 1744684 - RNA, 18 nt, Human
ugucucaagagggcacug

SEQ ID NO: 1744685 - RNA, 17 nt, Human
ugucucaagagggcacu

SEQ ID NO: 1744686 - RNA, 23 nt, Human
ugucuaguuguuugauucagaca

SEQ ID NO: 1744687 - RNA, 15 nt, Human
ugucuaguuguuuga

SEQ ID NO: 1744688 - RNA, 17 nt, Human
ugucuaggcaggaccug

SEQ ID NO: 1744689 - RNA, 19 nt, Human
ugucuaggcaggaccugug

SEQ ID NO: 1744690 - RNA, 16 nt, Human
ugucuaugggacucaa

SEQ ID NO: 1744691 - RNA, 15 nt, Human
ugucuaugggacuca

SEQ ID NO: 1744692 - RNA, 14 nt, Human
ugucuaugggacuc

SEQ ID NO: 1744693 - RNA, 14 nt, Human
ugucuaaugaaacc

SEQ ID NO: 1744694 - RNA, 20 nt, Human
uguccugggagugagcuggu

SEQ ID NO: 1744695 - RNA, 19 nt, Human
uguccugggagugagcugg

SEQ ID NO: 1744696 - RNA, 12 nt, Human
uguccugggagu

SEQ ID NO: 1744697 - RNA, 22 nt, Human
uguccugccuaaggcugaacuu

SEQ ID NO: 1744698 - RNA, 19 nt, Human
uguccccgcacugggcuug

SEQ ID NO: 1744699 - RNA, 17 nt, Human
uguccccgcacugggcu

SEQ ID NO: 1744700 - RNA, 13 nt, Human
ugucaucucagcu

SEQ ID NO: 1744701 - RNA, 13 nt, Human
uguccccuauccu

SEQ ID NO: 1744702 - RNA, 23 nt, Human
uguacagcaaggagauuuacaac

SEQ ID NO: 1744703 - RNA, 12 nt, Human
uguacagagccc

SEQ ID NO: 1744704 - RNA, 21 nt, Human
uguacagagcccacgccccca

SEQ ID NO: 1744705 - RNA, 13 nt, Human
uguacagagccca

SEQ ID NO: 1744706 - RNA, 22 nt, Human
uguacagcaaggagauuuacaa

SEQ ID NO: 1744707 - RNA, 13 nt, Human
uguaucugagcag

SEQ ID NO: 1744708 - RNA, 22 nt, Human
uguaugaaagauggcugugccu

SEQ ID NO: 1744709 - RNA, 19 nt, Human
uguauuuuacuaauaaaau

SEQ ID NO: 1744710 - RNA, 14 nt, Human
ugucacaggcaggu

SEQ ID NO: 1744711 - RNA, 13 nt, Human
ugucacacacuuu

SEQ ID NO: 1744712 - RNA, 21 nt, Human
ugucaauuacaggaaguacug

SEQ ID NO: 1744713 - RNA, 13 nt, Human
uguaugcgugugu

SEQ ID NO: 1744714 - RNA, 14 nt, Human
ugucagugugacug

SEQ ID NO: 1744715 - RNA, 15 nt, Human
ugucagugugacuga

SEQ ID NO: 1744716 - RNA, 19 nt, Human
ugucagugugacugaucuc

SEQ ID NO: 1744717 - RNA, 16 nt, Human
ugucagugugacugau

SEQ ID NO: 1744718 - RNA, 21 nt, Human
ugucacaggcagguccagggu

SEQ ID NO: 1744719 - RNA, 17 nt, Human
ugucacaggcaggucca

SEQ ID NO: 1744720 - RNA, 16 nt, Human
ugucacaggcaggucc

SEQ ID NO: 1744721 - RNA, 15 nt, Human
ugucacaggcagguc

SEQ ID NO: 1744722 - RNA, 11 nt, Human
uguacagagcc

SEQ ID NO: 1744723 - RNA, 14 nt, Human
uguacagacaacaa

SEQ ID NO: 1744724 - RNA, 17 nt, Human
uguaaugaaaaccacau

SEQ ID NO: 1744725 - RNA, 13 nt, Human
uguaaugaaaacc

SEQ ID NO: 1744726 - RNA, 12 nt, Human
uguaaugaaaac

SEQ ID NO: 1744727 - RNA, 11 nt, Human
uguaaugaaaa

SEQ ID NO: 1744728 - RNA, 19 nt, Human
uguaauaauaaagaauagc

SEQ ID NO: 1744729 - RNA, 17 nt, Human
uguaacaagccacccca

SEQ ID NO: 1744730 - RNA, 14 nt, Human
uguaacaagccacc

SEQ ID NO: 1744731 - RNA, 13 nt, Human
ugguugcauccua

SEQ ID NO: 1744732 - RNA, 16 nt, Human
ugguuuucuguucuuu

SEQ ID NO: 1744733 - RNA, 20 nt, Human
ugguuguacauauaagugau

SEQ ID NO: 1744734 - RNA, 23 nt, Human
ugguuuuuaaaaaacugcugacu

SEQ ID NO: 1744735 - RNA, 16 nt, Human
ugguuuuucaguuuuc

SEQ ID NO: 1744736 - RNA, 21 nt, Human
ugguuuuuaaaaaacugcuga

SEQ ID NO: 1744737 - RNA, 19 nt, Human
ugguuuucuuguguguuua

SEQ ID NO: 1744738 - RNA, 11 nt, Human
uguaaaauggu

SEQ ID NO: 1744739 - RNA, 12 nt, Human
uguaaaauggug

SEQ ID NO: 1744740 - RNA, 17 nt, Human
uguaaaagcauuuugua

SEQ ID NO: 1744741 - RNA, 18 nt, Human
uguaaaagcauuuuguaa

SEQ ID NO: 1744742 - RNA, 19 nt, Human
uguaaaagcauuuuguaau

SEQ ID NO: 1744743 - RNA, 23 nt, Human
uggguacuuguggacacagcucu

SEQ ID NO: 1744744 - RNA, 20 nt, Human
uggguacuuguggacacagc

SEQ ID NO: 1744745 - RNA, 14 nt, Human
uggugagaggcauc

SEQ ID NO: 1744746 - RNA, 20 nt, Human
uggugcaaugaccuuucaau

SEQ ID NO: 1744747 - RNA, 19 nt, Human
uggugcaaugaccuuucaa

SEQ ID NO: 1744748 - RNA, 14 nt, Human
uggugcaaugaccu

SEQ ID NO: 1744749 - RNA, 18 nt, Human
ugguggcagugggagcug

SEQ ID NO: 1744750 - RNA, 13 nt, Human
ugguggcaguggg

SEQ ID NO: 1744751 - RNA, 20 nt, Human
ugguggcagugggagcugcc

SEQ ID NO: 1744752 - RNA, 19 nt, Human
ugguggcccgacagccugg

SEQ ID NO: 1744753 - RNA, 18 nt, Human
uggugggggccucggugu

SEQ ID NO: 1744754 - RNA, 16 nt, Human
uggugggggccucggu

SEQ ID NO: 1744755 - RNA, 13 nt, Human
ugguggcuggguu

SEQ ID NO: 1744756 - RNA, 21 nt, Human
ugguggcccgacagccuggca

SEQ ID NO: 1744757 - RNA, 19 nt, Human
uggugguuuucuguucuuu

SEQ ID NO: 1744758 - RNA, 18 nt, Human
ugguguaagguacuuuca

SEQ ID NO: 1744759 - RNA, 17 nt, Human
uggugguuucagaaaug

SEQ ID NO: 1744760 - RNA, 18 nt, Human
uggugguuucagaaaugu

SEQ ID NO: 1744761 - RNA, 20 nt, Human
ugguggggcugccaggggag

SEQ ID NO: 1744762 - RNA, 18 nt, Human
ugguugaugaucuuugca

SEQ ID NO: 1744763 - RNA, 23 nt, Human
ugguuccccuguucacucuacuu

SEQ ID NO: 1744764 - RNA, 23 nt, Human
ugguuccuccccuccuccuggac

SEQ ID NO: 1744765 - RNA, 18 nt, Human
ugguuccuccccuccucc

SEQ ID NO: 1744766 - RNA, 12 nt, Human
ugguuccucccc

SEQ ID NO: 1744767 - RNA, 19 nt, Human
uggugucgggcaugacacg

SEQ ID NO: 1744768 - RNA, 18 nt, Human
uggugucgggcaugacac

SEQ ID NO: 1744769 - RNA, 20 nt, Human
ugguuccccuguucacucua

SEQ ID NO: 1744770 - RNA, 19 nt, Human
ugguuccccuguucacucu

SEQ ID NO: 1744771 - RNA, 18 nt, Human
ugguuccccuguucacuc

SEQ ID NO: 1744772 - RNA, 11 nt, Human
ugguuccccug

SEQ ID NO: 1744773 - RNA, 15 nt, Human
uggugucgggcauga

SEQ ID NO: 1744774 - RNA, 16 nt, Human
uggugucaccugaaga

SEQ ID NO: 1744775 - RNA, 16 nt, Human
ucccuaauaaagcugu

SEQ ID NO: 1744776 - RNA, 16 nt, Human
ucccuauuagagaaga

SEQ ID NO: 1744777 - RNA, 19 nt, Human
ucccuccugggaaugaagc

SEQ ID NO: 1744778 - RNA, 11 nt, Human
ucccuccuggg

SEQ ID NO: 1744779 - RNA, 21 nt, Human
uccccuguuuguuucugaaag

SEQ ID NO: 1744780 - RNA, 13 nt, Human
uccccuucacucc

SEQ ID NO: 1744781 - RNA, 20 nt, Human
uccccuguuuguuucugaaa

SEQ ID NO: 1744782 - RNA, 18 nt, Human
uccagguuuaagcuguua

SEQ ID NO: 1744783 - RNA, 17 nt, Human
uccagguuuaagcuguu

SEQ ID NO: 1744784 - RNA, 15 nt, Human
ucccuaauaaagcug

SEQ ID NO: 1744785 - RNA, 14 nt, Human
ucccuaauaaagcu

SEQ ID NO: 1744786 - RNA, 16 nt, Human
ucccguggaacguuuu

SEQ ID NO: 1744787 - RNA, 22 nt, Human
ucccguggaacguuuuuccugu

SEQ ID NO: 1744788 - RNA, 23 nt, Human
ucccguggaacguuuuuccuguu

SEQ ID NO: 1744789 - RNA, 13 nt, Human
ucccuucccaccu

SEQ ID NO: 1744790 - RNA, 14 nt, Human
ucccuucccaccuc

SEQ ID NO: 1744791 - RNA, 14 nt, Human
ucccugcacuugca

SEQ ID NO: 1744792 - RNA, 19 nt, Human
ucccugccccucccuucaa

SEQ ID NO: 1744793 - RNA, 13 nt, Human
ucccugcacuugc

SEQ ID NO: 1744794 - RNA, 20 nt, Human
ucccugccccucccuucaac

SEQ ID NO: 1744795 - RNA, 17 nt, Human
uccucugcugcuggcug

SEQ ID NO: 1744796 - RNA, 16 nt, Human
uccucugcugcuggcu

SEQ ID NO: 1744797 - RNA, 15 nt, Human
uccucugcugcuggc

SEQ ID NO: 1744798 - RNA, 14 nt, Human
uccucugcugcugg

SEQ ID NO: 1744799 - RNA, 17 nt, Human
uccucuaggaggucucu

SEQ ID NO: 1744800 - RNA, 19 nt, Human
uccucuguacagagcccac

SEQ ID NO: 1744801 - RNA, 18 nt, Human
uccucuguacagagccca

SEQ ID NO: 1744802 - RNA, 17 nt, Human
uccucuguacagagccc

SEQ ID NO: 1744803 - RNA, 16 nt, Human
uccucuguacagagcc

SEQ ID NO: 1744804 - RNA, 21 nt, Human
uccucuuccugaauuuuauuu

SEQ ID NO: 1744805 - RNA, 14 nt, Human
uccucuaggagguc

SEQ ID NO: 1744806 - RNA, 19 nt, Human
uccuccuuuucacaguucu

SEQ ID NO: 1744807 - RNA, 18 nt, Human
uccuauauuguuuucagu

SEQ ID NO: 1744808 - RNA, 21 nt, Human
uccuauauuguuuucagugua

SEQ ID NO: 1744809 - RNA, 17 nt, Human
uccucauuagcauuuug

SEQ ID NO: 1744810 - RNA, 18 nt, Human
uccuacccacccuccuuu

SEQ ID NO: 1744811 - RNA, 15 nt, Human
uccuacaagacacag

SEQ ID NO: 1744812 - RNA, 18 nt, Human
uccuaauuccacagcugc

SEQ ID NO: 1744813 - RNA, 17 nt, Human
uccuaauuccacagcug

SEQ ID NO: 1744814 - RNA, 16 nt, Human
uccuaauuccacagcu

SEQ ID NO: 1744815 - RNA, 15 nt, Human
uccuaauuccacagc

SEQ ID NO: 1744816 - RNA, 22 nt, Human
uccuaaugaaugcauaaaaugu

SEQ ID NO: 1744817 - RNA, 17 nt, Human
uccgaccagacaccuug

SEQ ID NO: 1744818 - RNA, 13 nt, Human
uccgaccagacac

SEQ ID NO: 1744819 - RNA, 16 nt, Human
uccuaaucuucugaac

SEQ ID NO: 1744820 - RNA, 22 nt, Human
uccuucaccuuuguccccaccg

SEQ ID NO: 1744821 - RNA, 21 nt, Human
uccuucaccuuuguccccacc

SEQ ID NO: 1744822 - RNA, 20 nt, Human
uccuucaccuuuguccccac

SEQ ID NO: 1744823 - RNA, 18 nt, Human
uccuucaccuuugucccc

SEQ ID NO: 1744824 - RNA, 20 nt, Human
uccuuaccagcagagcaccu

SEQ ID NO: 1744825 - RNA, 19 nt, Human
uccuucacagaugggugcu

SEQ ID NO: 1744826 - RNA, 18 nt, Human
uccuucacagaugggugc

SEQ ID NO: 1744827 - RNA, 18 nt, Human
uccuuaccagcagagcac

SEQ ID NO: 1744828 - RNA, 17 nt, Human
uccuuaccagcagagca

SEQ ID NO: 1744829 - RNA, 16 nt, Human
uccuuaccagcagagc

SEQ ID NO: 1744830 - RNA, 23 nt, Human
uccuuuucacaguucucuccuuc

SEQ ID NO: 1744831 - RNA, 19 nt, Human
uccuuuuaaaacacuucca

SEQ ID NO: 1744832 - RNA, 18 nt, Human
uccuuuucgcaggauucu

SEQ ID NO: 1744833 - RNA, 13 nt, Human
ucgaacuggcugc

SEQ ID NO: 1744834 - RNA, 22 nt, Human
ucgaggcggaucuuuggacaga

SEQ ID NO: 1744835 - RNA, 17 nt, Human
ucgaggcggaucuuugg

SEQ ID NO: 1744836 - RNA, 15 nt, Human
ucgaacuccugaccu

SEQ ID NO: 1744837 - RNA, 20 nt, Human
uccugccuaagugcagcccc

SEQ ID NO: 1744838 - RNA, 14 nt, Human
uccugagccagauu

SEQ ID NO: 1744839 - RNA, 14 nt, Human
uccugccucagccu

SEQ ID NO: 1744840 - RNA, 13 nt, Human
uccugagccagau

SEQ ID NO: 1744841 - RNA, 19 nt, Human
uccuggcacccggccccug

SEQ ID NO: 1744842 - RNA, 16 nt, Human
uccuggcacccggccc

SEQ ID NO: 1744843 - RNA, 14 nt, Human
uccuggcacccggc

SEQ ID NO: 1744844 - RNA, 15 nt, Human
uccugccucagccuc

SEQ ID NO: 1744845 - RNA, 13 nt, Human
uccugccucagcc

SEQ ID NO: 1744846 - RNA, 16 nt, Human
uccugccucagccucc

SEQ ID NO: 1744847 - RNA, 17 nt, Human
uccugccucagccuccc

SEQ ID NO: 1744848 - RNA, 17 nt, Human
uccuggcacugcuucca

SEQ ID NO: 1744849 - RNA, 22 nt, Human
uccuggcacccggccccugcug

SEQ ID NO: 1744850 - RNA, 21 nt, Human
uccuggcacccggccccugcu

SEQ ID NO: 1744851 - RNA, 20 nt, Human
uccuggcacccggccccugc

SEQ ID NO: 1744852 - RNA, 22 nt, Human
uccuggcacugcuuccagugag

SEQ ID NO: 1744853 - RNA, 18 nt, Human
uccuggcacugcuuccag

SEQ ID NO: 1744854 - RNA, 22 nt, Human
uccuguaccucuugagccuuga

SEQ ID NO: 1744855 - RNA, 20 nt, Human
uccuguaccucuugagccuu

SEQ ID NO: 1744856 - RNA, 22 nt, Human
ucuaaaucuccaaaauaaaacu

SEQ ID NO: 1744857 - RNA, 21 nt, Human
ucuaaaucuccaaaauaaaac

SEQ ID NO: 1744858 - RNA, 18 nt, Human
ucggccuccauccugagg

SEQ ID NO: 1744859 - RNA, 16 nt, Human
ucgagguuucucaaag

SEQ ID NO: 1744860 - RNA, 22 nt, Human
ucgagguuucucaaagaaauuu

SEQ ID NO: 1744861 - RNA, 16 nt, Human
ucgugauugauaagaa

SEQ ID NO: 1744862 - RNA, 22 nt, Human
ucggccucccaaagugcuggga

SEQ ID NO: 1744863 - RNA, 14 nt, Human
ucuaaugugugaau

SEQ ID NO: 1744864 - RNA, 14 nt, Human
ucuaauauguaaca

SEQ ID NO: 1744865 - RNA, 18 nt, Human
ucuaggaggucucuaaga

SEQ ID NO: 1744866 - RNA, 13 nt, Human
ucuaugccugucu

SEQ ID NO: 1744867 - RNA, 17 nt, Human
ucucaaauaacuaaaag

SEQ ID NO: 1744868 - RNA, 21 nt, Human
ucucaaagaaauuuccacuca

SEQ ID NO: 1744869 - RNA, 22 nt, Human
ucucaaagaaauuuccacucag

SEQ ID NO: 1744870 - RNA, 21 nt, Human
ucuaucaaguauuauaccuuu

SEQ ID NO: 1744871 - RNA, 22 nt, Human
ucuaucaaguauuauaccuuuu

SEQ ID NO: 1744872 - RNA, 15 nt, Human
ucuaucaaguauuau

SEQ ID NO: 1744873 - RNA, 12 nt, Human
ucuccugccuca

SEQ ID NO: 1744874 - RNA, 18 nt, Human
ucucaagagggcacuggu

SEQ ID NO: 1744875 - RNA, 17 nt, Human
ucucaagagggcacugg

SEQ ID NO: 1744876 - RNA, 19 nt, Human
ucucaagagggcacuggug

SEQ ID NO: 1744877 - RNA, 15 nt, Human
ucuccugccucagcc

SEQ ID NO: 1744878 - RNA, 17 nt, Human
ucuccugccucagccuc

SEQ ID NO: 1744879 - RNA, 19 nt, Human
ucuccugccucagccuccc

SEQ ID NO: 1744880 - RNA, 15 nt, Human
ucuccuguaccucuu

SEQ ID NO: 1744881 - RNA, 21 nt, Human
ucuccuggaaauauuaagaaa

SEQ ID NO: 1744882 - RNA, 21 nt, Human
ucuccuggaagugcuaauuuu

SEQ ID NO: 1744883 - RNA, 19 nt, Human
ucucuaacuucaccauauu

SEQ ID NO: 1744884 - RNA, 12 nt, Human
ucucuaacuuca

SEQ ID NO: 1744885 - RNA, 20 nt, Human
ucucuaacaguggacaaagu

SEQ ID NO: 1744886 - RNA, 14 nt, Human
ucucuaacagugga

SEQ ID NO: 1744887 - RNA, 22 nt, Human
ucucgugauugauaagaaccuu

SEQ ID NO: 1744888 - RNA, 14 nt, Human
ucucgugauugaua

SEQ ID NO: 1744889 - RNA, 19 nt, Human
ucucgugguaggacuguag

SEQ ID NO: 1744890 - RNA, 21 nt, Human
ucucgugguaggacuguagaa

SEQ ID NO: 1744891 - RNA, 19 nt, Human
ucuccuguaccucuugagc

SEQ ID NO: 1744892 - RNA, 16 nt, Human
ucuccuguaccucuug

SEQ ID NO: 1744893 - RNA, 17 nt, Human
ucuccuguaccucuuga

SEQ ID NO: 1744894 - RNA, 18 nt, Human
ucucugcaggucccuaau

SEQ ID NO: 1744895 - RNA, 16 nt, Human
ucucugcaggucccua

SEQ ID NO: 1744896 - RNA, 15 nt, Human
ucucugcaggucccu

SEQ ID NO: 1744897 - RNA, 17 nt, Human
ucucugaggacacuaac

SEQ ID NO: 1744898 - RNA, 14 nt, Human
ucucugcagguccc

SEQ ID NO: 1744899 - RNA, 13 nt, Human
ucucugcaggucc

SEQ ID NO: 1744900 - RNA, 16 nt, Human
ucucuaguuugauuaa

SEQ ID NO: 1744901 - RNA, 15 nt, Human
ucucuaguuugauua

SEQ ID NO: 1744902 - RNA, 17 nt, Human
ucugcauucaggaucaa

SEQ ID NO: 1744903 - RNA, 23 nt, Human
ucugaggaauccagacccggcug

SEQ ID NO: 1744904 - RNA, 15 nt, Human
ucugacccacugcuu

SEQ ID NO: 1744905 - RNA, 14 nt, Human
ucugacccacugcu

SEQ ID NO: 1744906 - RNA, 21 nt, Human
ucugcaagaauugaagcagga

SEQ ID NO: 1744907 - RNA, 20 nt, Human
ucugcaagaauugaagcagg

SEQ ID NO: 1744908 - RNA, 14 nt, Human
ucugcacacagcac

SEQ ID NO: 1744909 - RNA, 23 nt, Human
ucugaggcugaaauucagaauau

SEQ ID NO: 1744910 - RNA, 11 nt, Human
ucugaggcuga

SEQ ID NO: 1744911 - RNA, 13 nt, Human
ucugacccacugc

SEQ ID NO: 1744912 - RNA, 15 nt, Human
ucugacauaaguauu

SEQ ID NO: 1744913 - RNA, 22 nt, Human
ucugacaggcaaugcuggcugu

SEQ ID NO: 1744914 - RNA, 21 nt, Human
ucugacaggcaaugcuggcug

SEQ ID NO: 1744915 - RNA, 12 nt, Human
ucugacaggcaa

SEQ ID NO: 1744916 - RNA, 19 nt, Human
ucugacacacagcucuguc

SEQ ID NO: 1744917 - RNA, 18 nt, Human
ucugacacacagcucugu

SEQ ID NO: 1744918 - RNA, 17 nt, Human
ucugacacacagcucug

SEQ ID NO: 1744919 - RNA, 16 nt, Human
ucugacacacagcucu

SEQ ID NO: 1744920 - RNA, 13 nt, Human
ucugaaaauguau

SEQ ID NO: 1744921 - RNA, 14 nt, Human
ucugaaaauugaug

SEQ ID NO: 1744922 - RNA, 14 nt, Human
ucugaaaauguaug

SEQ ID NO: 1744923 - RNA, 22 nt, Human
ucugaaaauugaugggauuugg

SEQ ID NO: 1744924 - RNA, 17 nt, Human
ucuuccuggauuauuca

SEQ ID NO: 1744925 - RNA, 18 nt, Human
ucuucagaucucuaacuu

SEQ ID NO: 1744926 - RNA, 23 nt, Human
ucuucagaucucuaacuucacca

SEQ ID NO: 1744927 - RNA, 12 nt, Human
ucuugaacuccu

SEQ ID NO: 1744928 - RNA, 19 nt, Human
ucuugaacuccugaccuca

SEQ ID NO: 1744929 - RNA, 17 nt, Human
ucuugaacuccugaccu

SEQ ID NO: 1744930 - RNA, 13 nt, Human
ucuugaaaaaugc

SEQ ID NO: 1744931 - RNA, 13 nt, Human
ucuucuccuuuca

SEQ ID NO: 1744932 - RNA, 14 nt, Human
ucuucuccuuucac

SEQ ID NO: 1744933 - RNA, 18 nt, Human
ucuucuuuuuuugugaug

SEQ ID NO: 1744934 - RNA, 17 nt, Human
ucuucuuuuuuugugau

SEQ ID NO: 1744935 - RNA, 16 nt, Human
ucuucuuuuuuuguga

SEQ ID NO: 1744936 - RNA, 19 nt, Human
ucuucuuuuugcuucaaaa

SEQ ID NO: 1744937 - RNA, 12 nt, Human
ucuucuccacug

SEQ ID NO: 1744938 - RNA, 13 nt, Human
ucuuaaaaagugg

SEQ ID NO: 1744939 - RNA, 22 nt, Human
ucuuaaauauguggaguucauc

SEQ ID NO: 1744940 - RNA, 17 nt, Human
ucuuaaccagaucauug

SEQ ID NO: 1744941 - RNA, 16 nt, Human
ucuuaaccagaucauu

SEQ ID NO: 1744942 - RNA, 22 nt, Human
ucuuaaccagaucauugugaaa

SEQ ID NO: 1744943 - RNA, 17 nt, Human
ucuggccuucggccucc

SEQ ID NO: 1744944 - RNA, 18 nt, Human
ucuggccuucggccucca

SEQ ID NO: 1744945 - RNA, 23 nt, Human
ucuggccuucggccuccauccug

SEQ ID NO: 1744946 - RNA, 19 nt, Human
ucuggcuaugcauuugaaa

SEQ ID NO: 1744947 - RNA, 22 nt, Human
ucuggcuaugcauuugaaaauu

SEQ ID NO: 1744948 - RNA, 15 nt, Human
ucuggcuccagcugg

SEQ ID NO: 1744949 - RNA, 14 nt, Human
ucugggacacaguu

SEQ ID NO: 1744950 - RNA, 23 nt, Human
ucuggugacuuuccucuuugguc

SEQ ID NO: 1744951 - RNA, 23 nt, Human
ucuggcucuuccaggcugggaga

SEQ ID NO: 1744952 - RNA, 18 nt, Human
ucuggcucuuccaggcug

SEQ ID NO: 1744953 - RNA, 19 nt, Human
ucuguccuacucuguguca

SEQ ID NO: 1744954 - RNA, 15 nt, Human
ucuguccuacucugu

SEQ ID NO: 1744955 - RNA, 20 nt, Human
ucuguccuacucugugucag

SEQ ID NO: 1744956 - RNA, 21 nt, Human
ucuguccugggagugagcugg

SEQ ID NO: 1744957 - RNA, 14 nt, Human
ucugucgcccaguc

SEQ ID NO: 1744958 - RNA, 16 nt, Human
ucugucgcccagucug

SEQ ID NO: 1744959 - RNA, 22 nt, Human
ucugucucuggauuauauuaug

SEQ ID NO: 1744960 - RNA, 13 nt, Human
ucugguuccuccc

SEQ ID NO: 1744961 - RNA, 14 nt, Human
ucuguccuacucug

SEQ ID NO: 1744962 - RNA, 21 nt, Human
ucugguuccuccccuccuccu

SEQ ID NO: 1744963 - RNA, 20 nt, Human
ucugguuccuccccuccucc

SEQ ID NO: 1744964 - RNA, 22 nt, Human
ucugcugacagacacaggcccg

SEQ ID NO: 1744965 - RNA, 21 nt, Human
ucugcugacagacacaggccc

SEQ ID NO: 1744966 - RNA, 20 nt, Human
ucugcugacagacacaggcc

SEQ ID NO: 1744967 - RNA, 19 nt, Human
ucugcugacagacacaggc

SEQ ID NO: 1744968 - RNA, 22 nt, Human
ucugcugauccucccaggcuuc

SEQ ID NO: 1744969 - RNA, 19 nt, Human
ucuggaauaaggagaauga

SEQ ID NO: 1744970 - RNA, 15 nt, Human
ucuggaaugcagugg

SEQ ID NO: 1744971 - RNA, 14 nt, Human
ucuggacaggcaug

SEQ ID NO: 1744972 - RNA, 16 nt, Human
ucuggaaugcaguggu

SEQ ID NO: 1744973 - RNA, 21 nt, Human
ucuggacaggcauguucucug

SEQ ID NO: 1744974 - RNA, 18 nt, Human
ucugcugacagacacagg

SEQ ID NO: 1744975 - RNA, 21 nt, Human
ucugcuccucuccccagcaag

SEQ ID NO: 1744976 - RNA, 18 nt, Human
ucugcuccucuccccagc

SEQ ID NO: 1744977 - RNA, 16 nt, Human
ucugccugcccaggcc

SEQ ID NO: 1744978 - RNA, 15 nt, Human
ucugccugcccaggc

SEQ ID NO: 1744979 - RNA, 22 nt, Human
ucugcuccccuaaagccucaaa

SEQ ID NO: 1744980 - RNA, 14 nt, Human
ucugccugcccagg

SEQ ID NO: 1744981 - RNA, 18 nt, Human
ucugccauauucuguugg

SEQ ID NO: 1744982 - RNA, 15 nt, Human
ucaaaugagaaaaug

SEQ ID NO: 1744983 - RNA, 20 nt, Human
ucaaauuguaagcaugcaca

SEQ ID NO: 1744984 - RNA, 17 nt, Human
ucaaauuguaagcaugc

SEQ ID NO: 1744985 - RNA, 23 nt, Human
ucaaccccuucgcuccugugucu

SEQ ID NO: 1744986 - RNA, 23 nt, Human
ucaaauauauucagccuggcuuc

SEQ ID NO: 1744987 - RNA, 22 nt, Human
ucaaauauauucagccuggcuu

SEQ ID NO: 1744988 - RNA, 21 nt, Human
ucaaauauauucagccuggcu

SEQ ID NO: 1744989 - RNA, 16 nt, Human
ucaaaacaaaggccua

SEQ ID NO: 1744990 - RNA, 12 nt, Human
ucaaagaaauuu

SEQ ID NO: 1744991 - RNA, 13 nt, Human
ucaaagaaauuuc

SEQ ID NO: 1744992 - RNA, 19 nt, Human
ucaaagaaauuuccacuca

SEQ ID NO: 1744993 - RNA, 20 nt, Human
ucaaagaaauuuccacucag

SEQ ID NO: 1744994 - RNA, 19 nt, Human
uauuuucaacgcagcccug

SEQ ID NO: 1744995 - RNA, 14 nt, Human
uauuuuauuaugca

SEQ ID NO: 1744996 - RNA, 17 nt, Human
uauuuuauuaugcauga

SEQ ID NO: 1744997 - RNA, 13 nt, Human
uauuuauauaaau

SEQ ID NO: 1744998 - RNA, 17 nt, Human
uauuuuauguugcauag

SEQ ID NO: 1744999 - RNA, 15 nt, Human
ucaaaaaaagaaaaa

SEQ ID NO: 1745000 - RNA, 14 nt, Human
ucaaaaaaagaaaa

SEQ ID NO: 1745001 - RNA, 14 nt, Human
uauuuuuuuacuaa

SEQ ID NO: 1745002 - RNA, 17 nt, Human
uauuuuuuucuuuucuu

SEQ ID NO: 1745003 - RNA, 22 nt, Human
uauuuucccuauuagagaagag

SEQ ID NO: 1745004 - RNA, 21 nt, Human
ucaagugauucuccugccuca

SEQ ID NO: 1745005 - RNA, 19 nt, Human
ucaagugauucuccugccu

SEQ ID NO: 1745006 - RNA, 18 nt, Human
ucaagugauucuccugcc

SEQ ID NO: 1745007 - RNA, 20 nt, Human
ucaagugauucuccugccuc

SEQ ID NO: 1745008 - RNA, 18 nt, Human
ucaacgcagcccugcuuu

SEQ ID NO: 1745009 - RNA, 15 nt, Human
ucaacgcagcccugc

SEQ ID NO: 1745010 - RNA, 14 nt, Human
ucaacgcagcccug

SEQ ID NO: 1745011 - RNA, 23 nt, Human
ucaauuacaggaaguacuggaga

SEQ ID NO: 1745012 - RNA, 21 nt, Human
ucaauuacaggaaguacugga

SEQ ID NO: 1745013 - RNA, 13 nt, Human
ucaaugcagcccc

SEQ ID NO: 1745014 - RNA, 13 nt, Human
ucacaagacccaa

SEQ ID NO: 1745015 - RNA, 17 nt, Human
ucacaagacccaaaagg

SEQ ID NO: 1745016 - RNA, 18 nt, Human
ucacaagacccaaaaggc

SEQ ID NO: 1745017 - RNA, 16 nt, Human
ucacagucacauucca

SEQ ID NO: 1745018 - RNA, 19 nt, Human
ucacaguccuuaccagcag

SEQ ID NO: 1745019 - RNA, 23 nt, Human
ucacaguccuuaccagcagagca

SEQ ID NO: 1745020 - RNA, 22 nt, Human
ucacaguccuuaccagcagagc

SEQ ID NO: 1745021 - RNA, 19 nt, Human
ucacaggcagguccagggu

SEQ ID NO: 1745022 - RNA, 18 nt, Human
ucacaggcagguccaggg

SEQ ID NO: 1745023 - RNA, 17 nt, Human
ucacaggcagguccagg

SEQ ID NO: 1745024 - RNA, 16 nt, Human
ucacaggcagguccag

SEQ ID NO: 1745025 - RNA, 14 nt, Human
ucaccaaggcugau

SEQ ID NO: 1745026 - RNA, 21 nt, Human
ucaccaaaucagcugcuacua

SEQ ID NO: 1745027 - RNA, 20 nt, Human
ucaccaaaucagcugcuacu

SEQ ID NO: 1745028 - RNA, 19 nt, Human
ucaccaaaucagcugcuac

SEQ ID NO: 1745029 - RNA, 16 nt, Human
ucaccacaugugcaca

SEQ ID NO: 1745030 - RNA, 17 nt, Human
ucacauuuauucugcuc

SEQ ID NO: 1745031 - RNA, 19 nt, Human
ucacauuuauucugcucac

SEQ ID NO: 1745032 - RNA, 18 nt, Human
ucacauuuauucugcuca

SEQ ID NO: 1745033 - RNA, 17 nt, Human
uauugcugauggugcaa

SEQ ID NO: 1745034 - RNA, 22 nt, Human
uauuggaaauuuguuauaauga

SEQ ID NO: 1745035 - RNA, 22 nt, Human
uauugcugauggugcaaugacc

SEQ ID NO: 1745036 - RNA, 19 nt, Human
uauugcuuguuggauuuuu

SEQ ID NO: 1745037 - RNA, 21 nt, Human
uauugauaugcuuauacacuu

SEQ ID NO: 1745038 - RNA, 18 nt, Human
uauucucuccuguaccuc

SEQ ID NO: 1745039 - RNA, 17 nt, Human
uauucucuccuguaccu

SEQ ID NO: 1745040 - RNA, 12 nt, Human
uauuguuuucag

SEQ ID NO: 1745041 - RNA, 20 nt, Human
uauuguuuucaguguacaug

SEQ ID NO: 1745042 - RNA, 18 nt, Human
uauuguuuucaguguaca

SEQ ID NO: 1745043 - RNA, 22 nt, Human
uauuguuuucaguguacaugga

SEQ ID NO: 1745044 - RNA, 24 nt, Human
uauuuauaaaaauaaaaaacacug

SEQ ID NO: 1745045 - RNA, 21 nt, Human
uauuccugcauuugugaaaug

SEQ ID NO: 1745046 - RNA, 20 nt, Human
uauuccugcauuugugaaau

SEQ ID NO: 1745047 - RNA, 19 nt, Human
uauuccugcauuugugaaa

SEQ ID NO: 1745048 - RNA, 17 nt, Human
uauuccugcauuuguga

SEQ ID NO: 1745049 - RNA, 15 nt, Human
gggaguggccacaga

SEQ ID NO: 1745050 - RNA, 13 nt, Human
gggaguggccaca

SEQ ID NO: 1745051 - RNA, 20 nt, Human
uauguaaaugguaugucauu

SEQ ID NO: 1745052 - RNA, 21 nt, Human
uauguaaaugguaugucauuc

SEQ ID NO: 1745053 - RNA, 12 nt, Human
uauguugcauag

SEQ ID NO: 1745054 - RNA, 14 nt, Human
uauguugauaaaag

SEQ ID NO: 1745055 - RNA, 20 nt, Human
uauguugcccaggcaggucu

SEQ ID NO: 1745056 - RNA, 19 nt, Human
uauguugcccaggcagguc

SEQ ID NO: 1745057 - RNA, 16 nt, Human
uauguugcccaggcag

SEQ ID NO: 1745058 - RNA, 13 nt, Human
uauguugcccagg

SEQ ID NO: 1745059 - RNA, 16 nt, Human
uauguugcauagaaua

SEQ ID NO: 1745060 - RNA, 12 nt, Human
uauuaaauuaug

SEQ ID NO: 1745061 - RNA, 18 nt, Human
uccaauuuacauacucug

SEQ ID NO: 1745062 - RNA, 17 nt, Human
uccaauuuacauacucu

SEQ ID NO: 1745063 - RNA, 20 nt, Human
uccaaaauaaaacuuuuuaa

SEQ ID NO: 1745064 - RNA, 18 nt, Human
uccaaaauaaaacuuuuu

SEQ ID NO: 1745065 - RNA, 19 nt, Human
uccacaagagcccaggccu

SEQ ID NO: 1745066 - RNA, 18 nt, Human
uccacaagagcccaggcc

SEQ ID NO: 1745067 - RNA, 17 nt, Human
uccacaagagcccaggc

SEQ ID NO: 1745068 - RNA, 16 nt, Human
uccacaagagcccagg

SEQ ID NO: 1745069 - RNA, 18 nt, Human
uccacaaguuaaauaaau

SEQ ID NO: 1745070 - RNA, 17 nt, Human
uccacaaguuaaauaaa

SEQ ID NO: 1745071 - RNA, 15 nt, Human
uccacagaggacaca

SEQ ID NO: 1745072 - RNA, 17 nt, Human
uccacagaggacacaga

SEQ ID NO: 1745073 - RNA, 19 nt, Human
uccacagaggacacagaga

SEQ ID NO: 1745074 - RNA, 12 nt, Human
uccacccugcuc

SEQ ID NO: 1745075 - RNA, 15 nt, Human
uccaccugccaggga

SEQ ID NO: 1745076 - RNA, 17 nt, Human
uccaccugccagggaca

SEQ ID NO: 1745077 - RNA, 21 nt, Human
uccaccugccagggacagagg

SEQ ID NO: 1745078 - RNA, 18 nt, Human
uccaccugccagggacag

SEQ ID NO: 1745079 - RNA, 17 nt, Human
uccacuuggucugugag

SEQ ID NO: 1745080 - RNA, 15 nt, Human
uccacuuggucugug

SEQ ID NO: 1745081 - RNA, 16 nt, Human
uccacuuggucuguga

SEQ ID NO: 1745082 - RNA, 15 nt, Human
uccaccuucccaugc

SEQ ID NO: 1745083 - RNA, 16 nt, Human
uccaggagcagccaca

SEQ ID NO: 1745084 - RNA, 17 nt, Human
uccagcuguucagcugg

SEQ ID NO: 1745085 - RNA, 17 nt, Human
uccagcucaccagcccc

SEQ ID NO: 1745086 - RNA, 16 nt, Human
uccagcucaccagccc

SEQ ID NO: 1745087 - RNA, 18 nt, Human
uccagcucaccagcccca

SEQ ID NO: 1745088 - RNA, 22 nt, Human
uccaggugcacaagcuccaagc

SEQ ID NO: 1745089 - RNA, 21 nt, Human
uccaggugcacaagcuccaag

SEQ ID NO: 1745090 - RNA, 20 nt, Human
uccaggugcacaagcuccaa

SEQ ID NO: 1745091 - RNA, 18 nt, Human
uccaggugcacaagcucc

SEQ ID NO: 1745092 - RNA, 16 nt, Human
uccagguucagcuugu

SEQ ID NO: 1745093 - RNA, 15 nt, Human
uccagguucagcuug

SEQ ID NO: 1745094 - RNA, 11 nt, Human
uccaggguggu

SEQ ID NO: 1745095 - RNA, 18 nt, Human
uccaggagcagccacauu

SEQ ID NO: 1745096 - RNA, 17 nt, Human
uccaggagcagccacau

SEQ ID NO: 1745097 - RNA, 22 nt, Human
uccaggagcagccacauuccug

SEQ ID NO: 1745098 - RNA, 23 nt, Human
uccaggggugggacacccuguga

SEQ ID NO: 1745099 - RNA, 15 nt, Human
uccaggugcacaagc

SEQ ID NO: 1745100 - RNA, 23 nt, Human
ucaucuuagguuggcaaaaaggc

SEQ ID NO: 1745101 - RNA, 19 nt, Human
ucaucuugaauuguaagga

SEQ ID NO: 1745102 - RNA, 15 nt, Human
ucaggugcugccauc

SEQ ID NO: 1745103 - RNA, 14 nt, Human
ucaggugcugccau

SEQ ID NO: 1745104 - RNA, 13 nt, Human
ucaggugcugcca

SEQ ID NO: 1745105 - RNA, 21 nt, Human
ucaggugagaagcagaggaag

SEQ ID NO: 1745106 - RNA, 23 nt, Human
ucaggugccucaagagaaggcaa

SEQ ID NO: 1745107 - RNA, 21 nt, Human
ucaucaccaacgucugugcca

SEQ ID NO: 1745108 - RNA, 20 nt, Human
ucaucaccaacgucugugcc

SEQ ID NO: 1745109 - RNA, 19 nt, Human
ucaucaccaacgucugugc

SEQ ID NO: 1745110 - RNA, 15 nt, Human
ucauacucaccucac

SEQ ID NO: 1745111 - RNA, 21 nt, Human
ucauagcccucacccuggggc

SEQ ID NO: 1745112 - RNA, 21 nt, Human
ucauucaacccaccugcgucu

SEQ ID NO: 1745113 - RNA, 23 nt, Human
ucauuccaccuucccaugcccug

SEQ ID NO: 1745114 - RNA, 16 nt, Human
ucauuuccugugucuu

SEQ ID NO: 1745115 - RNA, 13 nt, Human
ucauuuccugugu

SEQ ID NO: 1745116 - RNA, 18 nt, Human
ucauugugaaauuauuca

SEQ ID NO: 1745117 - RNA, 17 nt, Human
ucauugugaaauuauuc

SEQ ID NO: 1745118 - RNA, 15 nt, Human
ucauugugaaauuau

SEQ ID NO: 1745119 - RNA, 12 nt, Human
ucauugugaaau

SEQ ID NO: 1745120 - RNA, 23 nt, Human
ucaggagcccugggaggcucugg

SEQ ID NO: 1745121 - RNA, 20 nt, Human
ucaggagcccugggaggcuc

SEQ ID NO: 1745122 - RNA, 18 nt, Human
ucaggagcccugggaggc

SEQ ID NO: 1745123 - RNA, 19 nt, Human
ucaggagcccugggaggcu

SEQ ID NO: 1745124 - RNA, 16 nt, Human
ucaggugagaagcaga

SEQ ID NO: 1745125 - RNA, 15 nt, Human
ucaggugagaagcag

SEQ ID NO: 1745126 - RNA, 16 nt, Human
ucagggccuggcucag

SEQ ID NO: 1745127 - RNA, 14 nt, Human
ucagggccuggcuc

SEQ ID NO: 1745128 - RNA, 21 nt, Human
ucagggagugggcuaagcacg

SEQ ID NO: 1745129 - RNA, 16 nt, Human
ucagcugaaccugggu

SEQ ID NO: 1745130 - RNA, 15 nt, Human
ucagcugaaccuggg

SEQ ID NO: 1745131 - RNA, 19 nt, Human
ucagccugcuccagcuguu

SEQ ID NO: 1745132 - RNA, 18 nt, Human
ucagccugcuccagcugu

SEQ ID NO: 1745133 - RNA, 22 nt, Human
ucagccuccugaguagcuggga

SEQ ID NO: 1745134 - RNA, 13 nt, Human
ucagccuccugag

SEQ ID NO: 1745135 - RNA, 21 nt, Human
ucagccuccugaguagcugga

SEQ ID NO: 1745136 - RNA, 22 nt, Human
ucagccucccgaguagcuggga

SEQ ID NO: 1745137 - RNA, 21 nt, Human
ucagccucccgaguagcuggg

SEQ ID NO: 1745138 - RNA, 20 nt, Human
ucagccuccugaguagcugg

SEQ ID NO: 1745139 - RNA, 21 nt, Human
ucagccucccaaagugcuggg

SEQ ID NO: 1745140 - RNA, 19 nt, Human
ucagccucccaaagugcug

SEQ ID NO: 1745141 - RNA, 14 nt, Human
ucagccucccaaag

SEQ ID NO: 1745142 - RNA, 23 nt, Human
ucagcauucucacuccuaccugg

SEQ ID NO: 1745143 - RNA, 22 nt, Human
ucagccucccgaauagcuggga

SEQ ID NO: 1745144 - RNA, 21 nt, Human
ucagccucccgaauagcuggg

SEQ ID NO: 1745145 - RNA, 18 nt, Human
ucagccucccgaguagcu

SEQ ID NO: 1745146 - RNA, 20 nt, Human
ucagccucccgaguagcugg

SEQ ID NO: 1745147 - RNA, 20 nt, Human
ucagcauucucacuccuacc

SEQ ID NO: 1745148 - RNA, 17 nt, Human
ucagcauucucacuccu

SEQ ID NO: 1745149 - RNA, 18 nt, Human
ucagauauaaaagacuga

SEQ ID NO: 1745150 - RNA, 20 nt, Human
ucagauauaaaagacugacc

SEQ ID NO: 1745151 - RNA, 17 nt, Human
ucagauauaaaagacug

SEQ ID NO: 1745152 - RNA, 22 nt, Human
ucagaguaauccaagcaaaugu

SEQ ID NO: 1745153 - RNA, 21 nt, Human
ucagaguaauccaagcaaaug

SEQ ID NO: 1745154 - RNA, 14 nt, Human
ucagacagcugccu

SEQ ID NO: 1745155 - RNA, 13 nt, Human
ucagacagcugcc

SEQ ID NO: 1745156 - RNA, 15 nt, Human
ucagaaauguguuau

SEQ ID NO: 1745157 - RNA, 23 nt, Human
ucagaauucucuaguuugauuaa

SEQ ID NO: 1745158 - RNA, 10 nt, Human
ucagaaaugu

SEQ ID NO: 1745159 - RNA, 14 nt, Human
ucacugcuuaacuu

SEQ ID NO: 1745160 - RNA, 22 nt, Human
ucacugcuggcugccuuagaac

SEQ ID NO: 1745161 - RNA, 18 nt, Human
ucacugcuggcugccuua

SEQ ID NO: 1745162 - RNA, 17 nt, Human
ucacugcuggcugccuu

SEQ ID NO: 1745163 - RNA, 12 nt, Human
ucacugcuggcu

SEQ ID NO: 1745164 - RNA, 16 nt, Human
ucacugcuggcugccu

SEQ ID NO: 1745165 - RNA, 15 nt, Human
ucacugcuggcugcc

SEQ ID NO: 1745166 - RNA, 14 nt, Human
ucacugcuggcugc

SEQ ID NO: 1745167 - RNA, 13 nt, Human
ucacugcuggcug

SEQ ID NO: 1745168 - RNA, 16 nt, Human
ucaccagccccagugc

SEQ ID NO: 1745169 - RNA, 13 nt, Human
ucaccagccccag

SEQ ID NO: 1745170 - RNA, 17 nt, Human
ucacucuuauugcccac

SEQ ID NO: 1745171 - RNA, 18 nt, Human
ucacugccaugccagcuu

SEQ ID NO: 1745172 - RNA, 20 nt, Human
ucacucuuauugcccacgcu

SEQ ID NO: 1745173 - RNA, 18 nt, Human
ucacugcauccuccgccu

SEQ ID NO: 1745174 - RNA, 19 nt, Human
ucacugcauccuccgccuc

SEQ ID NO: 1745175 - RNA, 19 nt, Human
gcucagcugucaaggcuca

SEQ ID NO: 1745176 - RNA, 18 nt, Human
gcucauggacuucugcca

SEQ ID NO: 1745177 - RNA, 23 nt, Human
gcucagcggggacagcuccuucu

SEQ ID NO: 1745178 - RNA, 19 nt, Human
gcucagcggggacagcucc

SEQ ID NO: 1745179 - RNA, 18 nt, Human
gcucagcggggacagcuc

SEQ ID NO: 1745180 - RNA, 17 nt, Human
gcucagcggggacagcu

SEQ ID NO: 1745181 - RNA, 21 nt, Human
gcucagcccucccugccccuc

SEQ ID NO: 1745182 - RNA, 19 nt, Human
gcucagcccucccugcccc

SEQ ID NO: 1745183 - RNA, 18 nt, Human
gcucagcccucccugccc

SEQ ID NO: 1745184 - RNA, 17 nt, Human
gcucagcccucccugcc

SEQ ID NO: 1745185 - RNA, 18 nt, Human
gcucaccagccccagugc

SEQ ID NO: 1745186 - RNA, 15 nt, Human
gcucaccagccccag

SEQ ID NO: 1745187 - RNA, 14 nt, Human
gcucaccagcccca

SEQ ID NO: 1745188 - RNA, 13 nt, Human
gcucaccagcccc

SEQ ID NO: 1745189 - RNA, 12 nt, Human
gcucaccagccc

SEQ ID NO: 1745190 - RNA, 16 nt, Human
gcucacauaucuguca

SEQ ID NO: 1745191 - RNA, 22 nt, Human
gcucacagaacccuuggagcca

SEQ ID NO: 1745192 - RNA, 18 nt, Human
gcucaccucucccuugga

SEQ ID NO: 1745193 - RNA, 17 nt, Human
gcucaccucucccuugg

SEQ ID NO: 1745194 - RNA, 16 nt, Human
gcucaccucucccuug

SEQ ID NO: 1745195 - RNA, 14 nt, Human
gcucaccucucccu

SEQ ID NO: 1745196 - RNA, 12 nt, Human
gcucagcccucc

SEQ ID NO: 1745197 - RNA, 16 nt, Human
gcucagcccucccugc

SEQ ID NO: 1745198 - RNA, 15 nt, Human
gcucagcccucccug

SEQ ID NO: 1745199 - RNA, 22 nt, Human
gcggugcuaucucccccagccc

SEQ ID NO: 1745200 - RNA, 19 nt, Human
gcggugcuaucucccccag

SEQ ID NO: 1745201 - RNA, 20 nt, Human
gcuauaacuauguugauaaa

SEQ ID NO: 1745202 - RNA, 22 nt, Human
gcucaaguccucuuuucugaga

SEQ ID NO: 1745203 - RNA, 19 nt, Human
gcucaaguccucuuuucug

SEQ ID NO: 1745204 - RNA, 15 nt, Human
gcuaucucccccagc

SEQ ID NO: 1745205 - RNA, 14 nt, Human
gcuaucucccccag

SEQ ID NO: 1745206 - RNA, 18 nt, Human
gcucaaguccucuuuucu

SEQ ID NO: 1745207 - RNA, 13 nt, Human
gcuaucuccccca

SEQ ID NO: 1745208 - RNA, 17 nt, Human
gcuaucguaaaauuaag

SEQ ID NO: 1745209 - RNA, 16 nt, Human
gcuaucguaaaauuaa

SEQ ID NO: 1745210 - RNA, 15 nt, Human
gcuaucguaaaauua

SEQ ID NO: 1745211 - RNA, 23 nt, Human
gcuccgcuuucuacccagcgagc

SEQ ID NO: 1745212 - RNA, 22 nt, Human
gcuccgcuuucuacccagcgag

SEQ ID NO: 1745213 - RNA, 21 nt, Human
gcuccgcuuucuacccagcga

SEQ ID NO: 1745214 - RNA, 18 nt, Human
gcuccgcuuucuacccag

SEQ ID NO: 1745215 - RNA, 20 nt, Human
gcucccuucccaccucucuc

SEQ ID NO: 1745216 - RNA, 15 nt, Human
gcucccacaggcccu

SEQ ID NO: 1745217 - RNA, 12 nt, Human
gcuccaggcucc

SEQ ID NO: 1745218 - RNA, 18 nt, Human
gcuccaggagcagccaca

SEQ ID NO: 1745219 - RNA, 17 nt, Human
gcuccaggagcagccac

SEQ ID NO: 1745220 - RNA, 16 nt, Human
gcuccaggagcagcca

SEQ ID NO: 1745221 - RNA, 15 nt, Human
gcuccaggagcagcc

SEQ ID NO: 1745222 - RNA, 21 nt, Human
gcuccagcuguucagcugguu

SEQ ID NO: 1745223 - RNA, 13 nt, Human
gcuccaaacccuc

SEQ ID NO: 1745224 - RNA, 14 nt, Human
gcuccaggagcagc

SEQ ID NO: 1745225 - RNA, 12 nt, Human
gcuccaggagca

SEQ ID NO: 1745226 - RNA, 11 nt, Human
gcuccaggagc

SEQ ID NO: 1745227 - RNA, 21 nt, Human
gcucgagcaugccuggauggg

SEQ ID NO: 1745228 - RNA, 19 nt, Human
gcucgagcaugccuggaug

SEQ ID NO: 1745229 - RNA, 17 nt, Human
gcuccuuuagcgcccag

SEQ ID NO: 1745230 - RNA, 13 nt, Human
gcuccuucugucc

SEQ ID NO: 1745231 - RNA, 15 nt, Human
gcuccuucuguccua

SEQ ID NO: 1745232 - RNA, 13 nt, Human
gcuccugugucuu

SEQ ID NO: 1745233 - RNA, 12 nt, Human
gcuccugugucu

SEQ ID NO: 1745234 - RNA, 18 nt, Human
gcuccuuccucugaggcu

SEQ ID NO: 1745235 - RNA, 22 nt, Human
gcuccuuccucugaggcugaaa

SEQ ID NO: 1745236 - RNA, 20 nt, Human
gcuccuuccucugaggcuga

SEQ ID NO: 1745237 - RNA, 24 nt, Human
gcuccgcuuucuacccagcgagcc

SEQ ID NO: 1745238 - RNA, 16 nt, Human
gcuccucccggugccc

SEQ ID NO: 1745239 - RNA, 14 nt, Human
gcuccucccggugc

SEQ ID NO: 1745240 - RNA, 23 nt, Human
gcuccuggggguucuuucuuccu

SEQ ID NO: 1745241 - RNA, 17 nt, Human
gccugagcgacagugag

SEQ ID NO: 1745242 - RNA, 20 nt, Human
gccugagcgacagugagacu

SEQ ID NO: 1745243 - RNA, 18 nt, Human
gccugaagucacacagug

SEQ ID NO: 1745244 - RNA, 17 nt, Human
gccugaagucacacagu

SEQ ID NO: 1745245 - RNA, 16 nt, Human
gccugaagucacacag

SEQ ID NO: 1745246 - RNA, 22 nt, Human
gcccaguuggguggaugccugg

SEQ ID NO: 1745247 - RNA, 21 nt, Human
gcccaguuggguggaugccug

SEQ ID NO: 1745248 - RNA, 19 nt, Human
gcccaguuggguggaugcc

SEQ ID NO: 1745249 - RNA, 12 nt, Human
gccugagcuggg

SEQ ID NO: 1745250 - RNA, 20 nt, Human
gccuggauggggcugcaccg

SEQ ID NO: 1745251 - RNA, 14 nt, Human
gccuggcacagggc

SEQ ID NO: 1745252 - RNA, 13 nt, Human
gccuggcacaggg

SEQ ID NO: 1745253 - RNA, 18 nt, Human
gccuggauggggcugcac

SEQ ID NO: 1745254 - RNA, 16 nt, Human
gccuggauggggcugc

SEQ ID NO: 1745255 - RNA, 15 nt, Human
gccuguaauccuagc

SEQ ID NO: 1745256 - RNA, 20 nt, Human
gccuguaauccuagcacuuu

SEQ ID NO: 1745257 - RNA, 22 nt, Human
gccuggccagaugcaccagccc

SEQ ID NO: 1745258 - RNA, 21 nt, Human
gccuggccagaugcaccagcc

SEQ ID NO: 1745259 - RNA, 20 nt, Human
gccuggccagaugcaccagc

SEQ ID NO: 1745260 - RNA, 22 nt, Human
gccuggcagccgugccuucagc

SEQ ID NO: 1745261 - RNA, 21 nt, Human
gccuggcagccgugccuucag

SEQ ID NO: 1745262 - RNA, 20 nt, Human
gccuggcagccgugccuuca

SEQ ID NO: 1745263 - RNA, 12 nt, Human
gccuggcagccg

SEQ ID NO: 1745264 - RNA, 19 nt, Human
gccuggcacagggcagugg

SEQ ID NO: 1745265 - RNA, 18 nt, Human
gccuggcacagggcagug

SEQ ID NO: 1745266 - RNA, 14 nt, Human
gccuggccccucag

SEQ ID NO: 1745267 - RNA, 13 nt, Human
gccuggccccuca

SEQ ID NO: 1745268 - RNA, 21 nt, Human
gcgacaaugcaaaccaucauu

SEQ ID NO: 1745269 - RNA, 20 nt, Human
gcgacaaugcaaaccaucau

SEQ ID NO: 1745270 - RNA, 13 nt, Human
gcgacaaugcaaa

SEQ ID NO: 1745271 - RNA, 12 nt, Human
gcgacaaugcaa

SEQ ID NO: 1745272 - RNA, 22 nt, Human
gcgcaggcuggcccugcccugg

SEQ ID NO: 1745273 - RNA, 21 nt, Human
gcgcaggcuggcccugcccug

SEQ ID NO: 1745274 - RNA, 20 nt, Human
gcgcaggcuggcccugcccu

SEQ ID NO: 1745275 - RNA, 17 nt, Human
gcgcaggcuggcccugc

SEQ ID NO: 1745276 - RNA, 19 nt, Human
gcgcaggcuggcccugccc

SEQ ID NO: 1745277 - RNA, 18 nt, Human
gcgcaggcuggcccugcc

SEQ ID NO: 1745278 - RNA, 16 nt, Human
gccuuacacaaugguu

SEQ ID NO: 1745279 - RNA, 15 nt, Human
gccuuacacaauggu

SEQ ID NO: 1745280 - RNA, 16 nt, Human
gccugucuuaauuuuc

SEQ ID NO: 1745281 - RNA, 17 nt, Human
gccugucuuaauuuucu

SEQ ID NO: 1745282 - RNA, 14 nt, Human
gcgguccacccagg

SEQ ID NO: 1745283 - RNA, 13 nt, Human
gcgguccacccag

SEQ ID NO: 1745284 - RNA, 19 nt, Human
gcggugagaggggaacaga

SEQ ID NO: 1745285 - RNA, 17 nt, Human
gcggggacagcuccuuc

SEQ ID NO: 1745286 - RNA, 15 nt, Human
gcggggacagcuccu

SEQ ID NO: 1745287 - RNA, 18 nt, Human
gcggggacagcuccuucu

SEQ ID NO: 1745288 - RNA, 21 nt, Human
gcgcugccccuggcagccccu

SEQ ID NO: 1745289 - RNA, 18 nt, Human
gcgcugccccuggcagcc

SEQ ID NO: 1745290 - RNA, 14 nt, Human
gcggggacagcucc

SEQ ID NO: 1745291 - RNA, 19 nt, Human
gcggagacggagucccacc

SEQ ID NO: 1745292 - RNA, 16 nt, Human
gcggagaaaggaaggg

SEQ ID NO: 1745293 - RNA, 23 nt, Human
gcgcccaguuggguggaugccug

SEQ ID NO: 1745294 - RNA, 13 nt, Human
gcgccccuucccc

SEQ ID NO: 1745295 - RNA, 21 nt, Human
gcgccuuaaggauguucuagc

SEQ ID NO: 1745296 - RNA, 15 nt, Human
gcuggaccuugaacu

SEQ ID NO: 1745297 - RNA, 16 nt, Human
gcuggaccuugaacug

SEQ ID NO: 1745298 - RNA, 19 nt, Human
gcuggcccuggcucccaca

SEQ ID NO: 1745299 - RNA, 16 nt, Human
gcuggcccugcccugg

SEQ ID NO: 1745300 - RNA, 15 nt, Human
gcuggcccugcccug

SEQ ID NO: 1745301 - RNA, 14 nt, Human
gcuggcccugcccu

SEQ ID NO: 1745302 - RNA, 23 nt, Human
gcuggaaugauuucagcucacug

SEQ ID NO: 1745303 - RNA, 22 nt, Human
gcugcuuuugucuaugggacuc

SEQ ID NO: 1745304 - RNA, 12 nt, Human
gcugcccugccc

SEQ ID NO: 1745305 - RNA, 14 nt, Human
gcugcccugcccac

SEQ ID NO: 1745306 - RNA, 13 nt, Human
gcugcccugccca

SEQ ID NO: 1745307 - RNA, 24 nt, Human
gcugcccugcccaccuggccucug

SEQ ID NO: 1745308 - RNA, 23 nt, Human
gcugcccugcccaccuggccucu

SEQ ID NO: 1745309 - RNA, 22 nt, Human
gcugcccugcccaccuggccuc

SEQ ID NO: 1745310 - RNA, 21 nt, Human
gcugcccugcccaccuggccu

SEQ ID NO: 1745311 - RNA, 20 nt, Human
gcugcccugcccaccuggcc

SEQ ID NO: 1745312 - RNA, 18 nt, Human
gcugcccugcccaccugg

SEQ ID NO: 1745313 - RNA, 16 nt, Human
gcugcccugcccaccu

SEQ ID NO: 1745314 - RNA, 21 nt, Human
gcugcgguccacccaggagcc

SEQ ID NO: 1745315 - RNA, 16 nt, Human
gcugcgguccacccag

SEQ ID NO: 1745316 - RNA, 22 nt, Human
gcugcgguccacccaggagccc

SEQ ID NO: 1745317 - RNA, 15 nt, Human
gcugcgguccaccca

SEQ ID NO: 1745318 - RNA, 14 nt, Human
gcugcgguccaccc

SEQ ID NO: 1745319 - RNA, 19 nt, Human
gcugccuguucagcuccag

SEQ ID NO: 1745320 - RNA, 18 nt, Human
gcugccuguucagcucca

SEQ ID NO: 1745321 - RNA, 15 nt, Human
gcugcccuggugcug

SEQ ID NO: 1745322 - RNA, 14 nt, Human
gcugcccuggugcu

SEQ ID NO: 1745323 - RNA, 13 nt, Human
gcugcccuggugc

SEQ ID NO: 1745324 - RNA, 12 nt, Human
gcugcccuggug

SEQ ID NO: 1745325 - RNA, 22 nt, Human
gcugccuguucagcuccagcuc

SEQ ID NO: 1745326 - RNA, 20 nt, Human
gcugccuguucagcuccagc

SEQ ID NO: 1745327 - RNA, 20 nt, Human
gcugccuuagaaccuuucuu

SEQ ID NO: 1745328 - RNA, 15 nt, Human
gcugccuuagaaccu

SEQ ID NO: 1745329 - RNA, 17 nt, Human
gcugcccuggugcugcc

SEQ ID NO: 1745330 - RNA, 21 nt, Human
gcugauuaaaccaaggcuaga

SEQ ID NO: 1745331 - RNA, 23 nt, Human
gcugcaaaggguaucaggugcug

SEQ ID NO: 1745332 - RNA, 22 nt, Human
gcugcaaaggguaucaggugcu

SEQ ID NO: 1745333 - RNA, 13 nt, Human
gcugccaccugcc

SEQ ID NO: 1745334 - RNA, 12 nt, Human
gcugccaccugc

SEQ ID NO: 1745335 - RNA, 23 nt, Human
gcugccacacuucaggcucuucu

SEQ ID NO: 1745336 - RNA, 22 nt, Human
gcugccacacuucaggcucuuc

SEQ ID NO: 1745337 - RNA, 21 nt, Human
gcugccacacuucaggcucuu

SEQ ID NO: 1745338 - RNA, 18 nt, Human
gcugccacacuucaggcu

SEQ ID NO: 1745339 - RNA, 17 nt, Human
gcugccacacuucaggc

SEQ ID NO: 1745340 - RNA, 15 nt, Human
gcugccacacuucag

SEQ ID NO: 1745341 - RNA, 14 nt, Human
gcugcaguugccag

SEQ ID NO: 1745342 - RNA, 13 nt, Human
gcugcaguugcca

SEQ ID NO: 1745343 - RNA, 17 nt, Human
gcugcaguugccaguca

SEQ ID NO: 1745344 - RNA, 18 nt, Human
gcugcauuuaaaagauac

SEQ ID NO: 1745345 - RNA, 19 nt, Human
gcugcauuuaaaagauaca

SEQ ID NO: 1745346 - RNA, 19 nt, Human
gcugacagacacaggcccg

SEQ ID NO: 1745347 - RNA, 18 nt, Human
gcugacagacacaggccc

SEQ ID NO: 1745348 - RNA, 20 nt, Human
gcugacagacacaggcccgg

SEQ ID NO: 1745349 - RNA, 22 nt, Human
gcugacuguuuucucuugagag

SEQ ID NO: 1745350 - RNA, 21 nt, Human
gcucucaggccagcugcuugg

SEQ ID NO: 1745351 - RNA, 21 nt, Human
gcucuugaacuccugaccuca

SEQ ID NO: 1745352 - RNA, 19 nt, Human
gcucuugaacuccugaccu

SEQ ID NO: 1745353 - RNA, 16 nt, Human
gcucuugaacuccuga

SEQ ID NO: 1745354 - RNA, 14 nt, Human
gcucuugaacuccu

SEQ ID NO: 1745355 - RNA, 19 nt, Human
gcucuugaugccuggcggg

SEQ ID NO: 1745356 - RNA, 19 nt, Human
gcucuuggcagguacucag

SEQ ID NO: 1745357 - RNA, 13 nt, Human
gcuuaucucaggg

SEQ ID NO: 1745358 - RNA, 20 nt, Human
gcuucaguggcagcugcuuu

SEQ ID NO: 1745359 - RNA, 19 nt, Human
gcuucaguggcagcugcuu

SEQ ID NO: 1745360 - RNA, 19 nt, Human
gcuucuguugcugccucau

SEQ ID NO: 1745361 - RNA, 18 nt, Human
gcuucuguugcugccuca

SEQ ID NO: 1745362 - RNA, 17 nt, Human
gcuucuguugcugccuc

SEQ ID NO: 1745363 - RNA, 22 nt, Human
gcuucucacugccaugccagcu

SEQ ID NO: 1745364 - RNA, 15 nt, Human
gcuuuuaugugaaac

SEQ ID NO: 1745365 - RNA, 13 nt, Human
gcuuuuaugugaa

SEQ ID NO: 1745366 - RNA, 19 nt, Human
gcuuugggcugcccuggug

SEQ ID NO: 1745367 - RNA, 18 nt, Human
gcuuugggcugcccuggu

SEQ ID NO: 1745368 - RNA, 14 nt, Human
gcuuguuggauuuu

SEQ ID NO: 1745369 - RNA, 15 nt, Human
gcuggugucaccuga

SEQ ID NO: 1745370 - RNA, 14 nt, Human
gcuggugucaccug

SEQ ID NO: 1745371 - RNA, 17 nt, Human
gcugucagccauuccug

SEQ ID NO: 1745372 - RNA, 13 nt, Human
gcugucaucucag

SEQ ID NO: 1745373 - RNA, 16 nt, Human
gcugucccuuuuccuu

SEQ ID NO: 1745374 - RNA, 23 nt, Human
gcugucccuuacgugaguccugg

SEQ ID NO: 1745375 - RNA, 15 nt, Human
gcugugucucccuuc

SEQ ID NO: 1745376 - RNA, 16 nt, Human
gcuguguggcagucug

SEQ ID NO: 1745377 - RNA, 23 nt, Human
gcuguuagggguuauugguguaa

SEQ ID NO: 1745378 - RNA, 14 nt, Human
gcuggucccacuca

SEQ ID NO: 1745379 - RNA, 20 nt, Human
gcuggucucaaacuccugac

SEQ ID NO: 1745380 - RNA, 19 nt, Human
gcuggucucaaacuccuga

SEQ ID NO: 1745381 - RNA, 23 nt, Human
gcuggucucgaacuccugaccuu

SEQ ID NO: 1745382 - RNA, 22 nt, Human
gcuggucucgaacuccugaccu

SEQ ID NO: 1745383 - RNA, 19 nt, Human
gcuggucucgaacuccuga

SEQ ID NO: 1745384 - RNA, 18 nt, Human
gcugggggccucagugcc

SEQ ID NO: 1745385 - RNA, 15 nt, Human
gcugggggccucagu

SEQ ID NO: 1745386 - RNA, 14 nt, Human
gcugggggccucag

SEQ ID NO: 1745387 - RNA, 15 nt, Human
gcuggccuggccccu

SEQ ID NO: 1745388 - RNA, 14 nt, Human
gcuggccuggcccc

SEQ ID NO: 1745389 - RNA, 12 nt, Human
gcuggccuggcc

SEQ ID NO: 1745390 - RNA, 13 nt, Human
gcuggccuggccc

SEQ ID NO: 1745391 - RNA, 21 nt, Human
gcugggcucccuucccaccuc

SEQ ID NO: 1745392 - RNA, 19 nt, Human
gcugggaugauuggagggg

SEQ ID NO: 1745393 - RNA, 20 nt, Human
gcugggcuucaguggcagcu

SEQ ID NO: 1745394 - RNA, 21 nt, Human
gcugggaugauuggagggggg

SEQ ID NO: 1745395 - RNA, 22 nt, Human
gcugggcuucaguggcagcugc

SEQ ID NO: 1745396 - RNA, 21 nt, Human
gcugggcuucaguggcagcug

SEQ ID NO: 1745397 - RNA, 13 nt, Human
ggcuuuucacugc

SEQ ID NO: 1745398 - RNA, 21 nt, Human
gggaauguuugccucugccuc

SEQ ID NO: 1745399 - RNA, 19 nt, Human
gggaauguuugccucugcc

SEQ ID NO: 1745400 - RNA, 14 nt, Human
gggacacccuguga

SEQ ID NO: 1745401 - RNA, 21 nt, Human
gggacugaggggaggggagca

SEQ ID NO: 1745402 - RNA, 23 nt, Human
gggacucaaugcacugacauugu

SEQ ID NO: 1745403 - RNA, 15 nt, Human
gggacugagaaauuu

SEQ ID NO: 1745404 - RNA, 23 nt, Human
gggacugccagucccccugcccc

SEQ ID NO: 1745405 - RNA, 19 nt, Human
gggacucaaugcacugaca

SEQ ID NO: 1745406 - RNA, 17 nt, Human
gggacucaaugcacuga

SEQ ID NO: 1745407 - RNA, 16 nt, Human
gggaccccgagccugg

SEQ ID NO: 1745408 - RNA, 17 nt, Human
gggaggacgcucucugg

SEQ ID NO: 1745409 - RNA, 20 nt, Human
gggaggacgcucucuggccu

SEQ ID NO: 1745410 - RNA, 21 nt, Human
gggaggauugcuugagcucag

SEQ ID NO: 1745411 - RNA, 22 nt, Human
gggaggauguucugggacacag

SEQ ID NO: 1745412 - RNA, 23 nt, Human
gggaggaucucuugagccuggga

SEQ ID NO: 1745413 - RNA, 11 nt, Human
gggaggcagag

SEQ ID NO: 1745414 - RNA, 20 nt, Human
gggaggugggauccuccagg

SEQ ID NO: 1745415 - RNA, 23 nt, Human
gggaggauugcuugagcucagga

SEQ ID NO: 1745416 - RNA, 17 nt, Human
gggagugacagaggcag

SEQ ID NO: 1745417 - RNA, 21 nt, Human
gggagugaguugauagcacag

SEQ ID NO: 1745418 - RNA, 22 nt, Human
gggagcugccuguucagcucca

SEQ ID NO: 1745419 - RNA, 21 nt, Human
gggagcugccuguucagcucc

SEQ ID NO: 1745420 - RNA, 13 nt, Human
gggagcugccugu

SEQ ID NO: 1745421 - RNA, 12 nt, Human
gggagcucugca

SEQ ID NO: 1745422 - RNA, 21 nt, Human
gggagccugaucaccugcccu

SEQ ID NO: 1745423 - RNA, 12 nt, Human
ggcuucacagau

SEQ ID NO: 1745424 - RNA, 21 nt, Human
ggcuucacggaagagccuugc

SEQ ID NO: 1745425 - RNA, 20 nt, Human
ggcuucacggaagagccuug

SEQ ID NO: 1745426 - RNA, 15 nt, Human
ggcuuagucacugag

SEQ ID NO: 1745427 - RNA, 14 nt, Human
ggcuuagucacuga

SEQ ID NO: 1745428 - RNA, 19 nt, Human
ggcuuggggaccagagcug

SEQ ID NO: 1745429 - RNA, 18 nt, Human
ggcuuggggaccagagcu

SEQ ID NO: 1745430 - RNA, 17 nt, Human
ggcuuggggaccagagc

SEQ ID NO: 1745431 - RNA, 11 nt, Human
ggcuugcugcc

SEQ ID NO: 1745432 - RNA, 15 nt, Human
ggcuuaaaacaacac

SEQ ID NO: 1745433 - RNA, 20 nt, Human
ggcuguuggcugggggccuc

SEQ ID NO: 1745434 - RNA, 16 nt, Human
ggcuguuggcuggggg

SEQ ID NO: 1745435 - RNA, 15 nt, Human
ggcuguuggcugggg

SEQ ID NO: 1745436 - RNA, 14 nt, Human
ggcuguuggcuggg

SEQ ID NO: 1745437 - RNA, 16 nt, Human
ggcugugccucugccu

SEQ ID NO: 1745438 - RNA, 13 nt, Human
ggcugugccucug

SEQ ID NO: 1745439 - RNA, 17 nt, Human
ggcugucuguuguauuc

SEQ ID NO: 1745440 - RNA, 19 nt, Human
ggcugcuucaaggauccug

SEQ ID NO: 1745441 - RNA, 15 nt, Human
ggcugcuucaaggau

SEQ ID NO: 1745442 - RNA, 17 nt, Human
ggcucugccucccauca

SEQ ID NO: 1745443 - RNA, 23 nt, Human
ggcucuggagcccacuguacuug

SEQ ID NO: 1745444 - RNA, 20 nt, Human
ggcugcuucaaggauccuga

SEQ ID NO: 1745445 - RNA, 21 nt, Human
ggcugcuucaaggauccugag

SEQ ID NO: 1745446 - RNA, 14 nt, Human
ggcugggggccuca

SEQ ID NO: 1745447 - RNA, 16 nt, Human
ggcugggggaagaagc

SEQ ID NO: 1745448 - RNA, 22 nt, Human
ggcugggcuucaguggcagcug

SEQ ID NO: 1745449 - RNA, 21 nt, Human
ggcugggcuucaguggcagcu

SEQ ID NO: 1745450 - RNA, 11 nt, Human
ggcugggcuuc

SEQ ID NO: 1745451 - RNA, 21 nt, Human
ggcugggcucccuucccaccu

SEQ ID NO: 1745452 - RNA, 20 nt, Human
ggcugggcucccuucccacc

SEQ ID NO: 1745453 - RNA, 15 nt, Human
ggcugggagcucugc

SEQ ID NO: 1745454 - RNA, 16 nt, Human
ggcuccacuuggucug

SEQ ID NO: 1745455 - RNA, 9 nt, Human
ggcuccaga

SEQ ID NO: 1745456 - RNA, 12 nt, Human
ggcuaugcauuu

SEQ ID NO: 1745457 - RNA, 13 nt, Human
ggcuaugcauuug

SEQ ID NO: 1745458 - RNA, 14 nt, Human
ggcuaugcauuuga

SEQ ID NO: 1745459 - RNA, 13 nt, Human
ggcuccaggcucc

SEQ ID NO: 1745460 - RNA, 12 nt, Human
ggcuccaggcuc

SEQ ID NO: 1745461 - RNA, 17 nt, Human
ggcuccaggagcagcca

SEQ ID NO: 1745462 - RNA, 18 nt, Human
ggcuccaggagcagccac

SEQ ID NO: 1745463 - RNA, 16 nt, Human
ggcuccaggagcagcc

SEQ ID NO: 1745464 - RNA, 14 nt, Human
ggcuccaggagcag

SEQ ID NO: 1745465 - RNA, 10 nt, Human
ggcuccagac

SEQ ID NO: 1745466 - RNA, 20 nt, Human
ggcuaguaucaaaagaaaga

SEQ ID NO: 1745467 - RNA, 11 nt, Human
ggcgcugcccc

SEQ ID NO: 1745468 - RNA, 17 nt, Human
ggcgcugccccuggcag

SEQ ID NO: 1745469 - RNA, 14 nt, Human
ggcuccaggcuccu

SEQ ID NO: 1745470 - RNA, 15 nt, Human
ggcuccaggcuccuu

SEQ ID NO: 1745471 - RNA, 16 nt, Human
ggcucucaggccagcu

SEQ ID NO: 1745472 - RNA, 15 nt, Human
ggcucucaggccagc

SEQ ID NO: 1745473 - RNA, 20 nt, Human
ggcucucaggccagcugcuu

SEQ ID NO: 1745474 - RNA, 19 nt, Human
ggcucucaggccagcugcu

SEQ ID NO: 1745475 - RNA, 18 nt, Human
ggcucucaggccagcugc

SEQ ID NO: 1745476 - RNA, 17 nt, Human
ggcucucaggccagcug

SEQ ID NO: 1745477 - RNA, 12 nt, Human
ggcucugcccuu

SEQ ID NO: 1745478 - RNA, 15 nt, Human
ggcucugccucccau

SEQ ID NO: 1745479 - RNA, 13 nt, Human
ggcucugccuccc

SEQ ID NO: 1745480 - RNA, 15 nt, Human
ggcucugcccuuggu

SEQ ID NO: 1745481 - RNA, 14 nt, Human
ggcucugcccuugg

SEQ ID NO: 1745482 - RNA, 16 nt, Human
ggcucugccucccauc

SEQ ID NO: 1745483 - RNA, 16 nt, Human
ggcucuggagcccacu

SEQ ID NO: 1745484 - RNA, 19 nt, Human
ggcucuggagcccacugua

SEQ ID NO: 1745485 - RNA, 17 nt, Human
ggcucuggagcccacug

SEQ ID NO: 1745486 - RNA, 24 nt, Human
ggcgcagcauauucaggaagcuca

SEQ ID NO: 1745487 - RNA, 23 nt, Human
ggcgcagcauauucaggaagcuc

SEQ ID NO: 1745488 - RNA, 23 nt, Human
ggccugggggcugggcagaggaa

SEQ ID NO: 1745489 - RNA, 11 nt, Human
ggccugggccc

SEQ ID NO: 1745490 - RNA, 16 nt, Human
ggccuggccugagcug

SEQ ID NO: 1745491 - RNA, 15 nt, Human
ggccuggccugagcu

SEQ ID NO: 1745492 - RNA, 14 nt, Human
ggccuggccugagc

SEQ ID NO: 1745493 - RNA, 13 nt, Human
ggccuggccugag

SEQ ID NO: 1745494 - RNA, 10 nt, Human
ggccuggccu

SEQ ID NO: 1745495 - RNA, 23 nt, Human
ggccuggccccucagggucccug

SEQ ID NO: 1745496 - RNA, 18 nt, Human
ggccuggccccucagggu

SEQ ID NO: 1745497 - RNA, 17 nt, Human
ggccuggccccucaggg

SEQ ID NO: 1745498 - RNA, 15 nt, Human
ggccuggccccucag

SEQ ID NO: 1745499 - RNA, 14 nt, Human
ggccuggccccuca

SEQ ID NO: 1745500 - RNA, 19 nt, Human
ggccucugcacuccccugc

SEQ ID NO: 1745501 - RNA, 18 nt, Human
ggccucugcacuccccug

SEQ ID NO: 1745502 - RNA, 22 nt, Human
ggccucugcacuccccugcugg

SEQ ID NO: 1745503 - RNA, 13 nt, Human
ggccuggccccuc

SEQ ID NO: 1745504 - RNA, 12 nt, Human
ggccugagcugg

SEQ ID NO: 1745505 - RNA, 14 nt, Human
ggccuccugugugu

SEQ ID NO: 1745506 - RNA, 17 nt, Human
ggccucggacuuagcug

SEQ ID NO: 1745507 - RNA, 23 nt, Human
ggccucaagugauucuccugccu

SEQ ID NO: 1745508 - RNA, 22 nt, Human
ggccucaagugauucuccugcc

SEQ ID NO: 1745509 - RNA, 14 nt, Human
ggccucaagugauu

SEQ ID NO: 1745510 - RNA, 20 nt, Human
ggccuagcauacguacacau

SEQ ID NO: 1745511 - RNA, 22 nt, Human
ggccuagcauacguacacauuu

SEQ ID NO: 1745512 - RNA, 23 nt, Human
ggccuagcauacguacacauuuu

SEQ ID NO: 1745513 - RNA, 20 nt, Human
ggcccagagggccugcaagg

SEQ ID NO: 1745514 - RNA, 19 nt, Human
ggcccagagggccugcaag

SEQ ID NO: 1745515 - RNA, 17 nt, Human
ggcccagagggccugca

SEQ ID NO: 1745516 - RNA, 14 nt, Human
ggcccagagggccu

SEQ ID NO: 1745517 - RNA, 15 nt, Human
ggccgggagccugau

SEQ ID NO: 1745518 - RNA, 23 nt, Human
ggccgggaccccgagccuggcuc

SEQ ID NO: 1745519 - RNA, 22 nt, Human
ggccgggaccccgagccuggcu

SEQ ID NO: 1745520 - RNA, 21 nt, Human
ggauucuuccucccucccucu

SEQ ID NO: 1745521 - RNA, 17 nt, Human
ggcaagcaccuccugcc

SEQ ID NO: 1745522 - RNA, 19 nt, Human
ggcaagcaccuccugccuc

SEQ ID NO: 1745523 - RNA, 18 nt, Human
ggcaagcaccuccugccu

SEQ ID NO: 1745524 - RNA, 17 nt, Human
ggcaccagcagccugga

SEQ ID NO: 1745525 - RNA, 21 nt, Human
ggcagagguugcagugagccg

SEQ ID NO: 1745526 - RNA, 22 nt, Human
ggcagagcagagaccaucccug

SEQ ID NO: 1745527 - RNA, 20 nt, Human
ggcacucagaagacacugau

SEQ ID NO: 1745528 - RNA, 19 nt, Human
ggcacucagaagacacuga

SEQ ID NO: 1745529 - RNA, 18 nt, Human
ggcacucagaagacacug

SEQ ID NO: 1745530 - RNA, 20 nt, Human
ggcacccggccccugcuggu

SEQ ID NO: 1745531 - RNA, 19 nt, Human
ggcacccggccccugcugg

SEQ ID NO: 1745532 - RNA, 18 nt, Human
ggcacccggccccugcug

SEQ ID NO: 1745533 - RNA, 20 nt, Human
ggcacccaccaucaugucug

SEQ ID NO: 1745534 - RNA, 23 nt, Human
ggagucccaccuuggcugcaggg

SEQ ID NO: 1745535 - RNA, 22 nt, Human
ggaugaucuaggaagacuuugg

SEQ ID NO: 1745536 - RNA, 18 nt, Human
ggaugaucuaggaagacu

SEQ ID NO: 1745537 - RNA, 16 nt, Human
ggaugaucuaggaaga

SEQ ID NO: 1745538 - RNA, 17 nt, Human
ggaugccugguggcagc

SEQ ID NO: 1745539 - RNA, 13 nt, Human
ggaugccuggugg

SEQ ID NO: 1745540 - RNA, 19 nt, Human
ggaugcccaaagaugcagc

SEQ ID NO: 1745541 - RNA, 17 nt, Human
ggaugccccgucccccu

SEQ ID NO: 1745542 - RNA, 18 nt, Human
ggaugcccaaagaugcag

SEQ ID NO: 1745543 - RNA, 18 nt, Human
ggaugaugacuauggaaa

SEQ ID NO: 1745544 - RNA, 21 nt, Human
ggaugccugguggcagcugcg

SEQ ID NO: 1745545 - RNA, 20 nt, Human
ggaugccugguggcagcugc

SEQ ID NO: 1745546 - RNA, 19 nt, Human
ggaugccugguggcagcug

SEQ ID NO: 1745547 - RNA, 18 nt, Human
ggaugccugguggcagcu

SEQ ID NO: 1745548 - RNA, 12 nt, Human
ggauuauauuau

SEQ ID NO: 1745549 - RNA, 21 nt, Human
ggcagcugcgguccacccagg

SEQ ID NO: 1745550 - RNA, 21 nt, Human
ggcagaguugaagacagagcu

SEQ ID NO: 1745551 - RNA, 19 nt, Human
ggcagaguugaagacagag

SEQ ID NO: 1745552 - RNA, 17 nt, Human
ggcagaguugaagacag

SEQ ID NO: 1745553 - RNA, 12 nt, Human
ggcaggguccua

SEQ ID NO: 1745554 - RNA, 24 nt, Human
ggcagcugcgguccacccaggagc

SEQ ID NO: 1745555 - RNA, 23 nt, Human
ggcagcugcgguccacccaggag

SEQ ID NO: 1745556 - RNA, 18 nt, Human
ggcagggucucacucugu

SEQ ID NO: 1745557 - RNA, 17 nt, Human
ggcagggucucacucug

SEQ ID NO: 1745558 - RNA, 17 nt, Human
ggcagguuggugggggc

SEQ ID NO: 1745559 - RNA, 23 nt, Human
ggcaugugaugagaggaaaucac

SEQ ID NO: 1745560 - RNA, 18 nt, Human
ggcaugugaugagaggaa

SEQ ID NO: 1745561 - RNA, 22 nt, Human
ggcaugacacgaauauugcuga

SEQ ID NO: 1745562 - RNA, 16 nt, Human
ggccaggcccucugcc

SEQ ID NO: 1745563 - RNA, 15 nt, Human
ggccaggcccucugc

SEQ ID NO: 1745564 - RNA, 17 nt, Human
ggccaggcccucugccc

SEQ ID NO: 1745565 - RNA, 14 nt, Human
ggccaggcccucug

SEQ ID NO: 1745566 - RNA, 13 nt, Human
ggccaggagccuc

SEQ ID NO: 1745567 - RNA, 11 nt, Human
ggccaggagcc

SEQ ID NO: 1745568 - RNA, 20 nt, Human
ggccacugugaagagaacca

SEQ ID NO: 1745569 - RNA, 20 nt, Human
ggcauguucucugaggacac

SEQ ID NO: 1745570 - RNA, 22 nt, Human
ggccacagaaaauucuucucca

SEQ ID NO: 1745571 - RNA, 16 nt, Human
ggaggacgcucucugg

SEQ ID NO: 1745572 - RNA, 21 nt, Human
ggaggauguucugggacacag

SEQ ID NO: 1745573 - RNA, 18 nt, Human
ggaggauguucugggaca

SEQ ID NO: 1745574 - RNA, 16 nt, Human
ggagggagggcuccag

SEQ ID NO: 1745575 - RNA, 13 nt, Human
ggagggagggcuc

SEQ ID NO: 1745576 - RNA, 17 nt, Human
ggagggagggcuccaga

SEQ ID NO: 1745577 - RNA, 17 nt, Human
ggaggcaggaguuucgu

SEQ ID NO: 1745578 - RNA, 19 nt, Human
ggaggggagcaugggaagu

SEQ ID NO: 1745579 - RNA, 13 nt, Human
ggagggccugggc

SEQ ID NO: 1745580 - RNA, 13 nt, Human
ggaggggccuggc

SEQ ID NO: 1745581 - RNA, 22 nt, Human
ggagucccaccuuggcugcagg

SEQ ID NO: 1745582 - RNA, 21 nt, Human
ggaggggccuggcagccgugc

SEQ ID NO: 1745583 - RNA, 18 nt, Human
ggaggggccuggcagccg

SEQ ID NO: 1745584 - RNA, 14 nt, Human
ggaggggccuggca

SEQ ID NO: 1745585 - RNA, 19 nt, Human
ggagcccugggaggcucug

SEQ ID NO: 1745586 - RNA, 16 nt, Human
ggagcccugggaggcu

SEQ ID NO: 1745587 - RNA, 14 nt, Human
ggagccuccugccc

SEQ ID NO: 1745588 - RNA, 20 nt, Human
ggagcccugggaggcucugg

SEQ ID NO: 1745589 - RNA, 15 nt, Human
ggagccuccugcccu

SEQ ID NO: 1745590 - RNA, 18 nt, Human
ggacugagaaauuuauaa

SEQ ID NO: 1745591 - RNA, 16 nt, Human
ggacgcucucuggccu

SEQ ID NO: 1745592 - RNA, 19 nt, Human
ggacgcucucuggccuucg

SEQ ID NO: 1745593 - RNA, 14 nt, Human
ggacugagaaauuu

SEQ ID NO: 1745594 - RNA, 18 nt, Human
ggaccuugaacuggguac

SEQ ID NO: 1745595 - RNA, 19 nt, Human
ggaccagagcugccaccug

SEQ ID NO: 1745596 - RNA, 17 nt, Human
ggacagcuccuucuguc

SEQ ID NO: 1745597 - RNA, 16 nt, Human
ggacagcuccuucugu

SEQ ID NO: 1745598 - RNA, 15 nt, Human
ggacagcuccuucug

SEQ ID NO: 1745599 - RNA, 11 nt, Human
ggacagcuccu

SEQ ID NO: 1745600 - RNA, 20 nt, Human
ggacagaggggguggccucc

SEQ ID NO: 1745601 - RNA, 16 nt, Human
ggacagccccuccucc

SEQ ID NO: 1745602 - RNA, 15 nt, Human
ggacagccccuccuc

SEQ ID NO: 1745603 - RNA, 16 nt, Human
ggacagaggggguggc

SEQ ID NO: 1745604 - RNA, 14 nt, Human
ggacagaagcagcu

SEQ ID NO: 1745605 - RNA, 17 nt, Human
ggacagaagcagcucuu

SEQ ID NO: 1745606 - RNA, 16 nt, Human
ggacagaagcagcucu

SEQ ID NO: 1745607 - RNA, 15 nt, Human
ggacagaagcagcuc

SEQ ID NO: 1745608 - RNA, 21 nt, Human
gcuuuuaugugaaacauguuu

SEQ ID NO: 1745609 - RNA, 20 nt, Human
gcuuuuaugugaaacauguu

SEQ ID NO: 1745610 - RNA, 19 nt, Human
gcuuuuaugugaaacaugu

SEQ ID NO: 1745611 - RNA, 12 nt, Human
gcuuuucacugc

SEQ ID NO: 1745612 - RNA, 22 nt, Human
gccacacuucaggcucuucucc

SEQ ID NO: 1745613 - RNA, 20 nt, Human
gccacacuucaggcucuucu

SEQ ID NO: 1745614 - RNA, 20 nt, Human
gccacagagaaaguacuucu

SEQ ID NO: 1745615 - RNA, 14 nt, Human
gccacagagaaagu

SEQ ID NO: 1745616 - RNA, 13 nt, Human
gccacagagaaag

SEQ ID NO: 1745617 - RNA, 23 nt, Human
gccacacuucaggcucuucuccu

SEQ ID NO: 1745618 - RNA, 23 nt, Human
gccacagagaaaguacuucucca

SEQ ID NO: 1745619 - RNA, 22 nt, Human
gccacaagacccuugugguccc

SEQ ID NO: 1745620 - RNA, 16 nt, Human
gccacaagacccuugu

SEQ ID NO: 1745621 - RNA, 21 nt, Human
gccaaggcugggggaagaagc

SEQ ID NO: 1745622 - RNA, 12 nt, Human
gcauuugugaaa

SEQ ID NO: 1745623 - RNA, 21 nt, Human
gcauuugaggucuguucuuuc

SEQ ID NO: 1745624 - RNA, 19 nt, Human
gcauuugaggucuguucuu

SEQ ID NO: 1745625 - RNA, 20 nt, Human
gcauuugaggucuguucuuu

SEQ ID NO: 1745626 - RNA, 22 nt, Human
gcauuuggugguuucagaaaug

SEQ ID NO: 1745627 - RNA, 23 nt, Human
gcauuuggugguuucagaaaugu

SEQ ID NO: 1745628 - RNA, 23 nt, Human
gccaaggugggaggauugcuuga

SEQ ID NO: 1745629 - RNA, 15 nt, Human
gccaaggugggagga

SEQ ID NO: 1745630 - RNA, 14 nt, Human
gccaaggugggagg

SEQ ID NO: 1745631 - RNA, 21 nt, Human
gccaauggagacugucucaag

SEQ ID NO: 1745632 - RNA, 19 nt, Human
gccaauggagacugucuca

SEQ ID NO: 1745633 - RNA, 16 nt, Human
gccaauggagacuguc

SEQ ID NO: 1745634 - RNA, 20 nt, Human
gccaauaauaauaccucccu

SEQ ID NO: 1745635 - RNA, 12 nt, Human
gccaaguucuua

SEQ ID NO: 1745636 - RNA, 20 nt, Human
gccacuauuguuagucucuu

SEQ ID NO: 1745637 - RNA, 16 nt, Human
gccagagacacaagcc

SEQ ID NO: 1745638 - RNA, 19 nt, Human
gccagagacacaagccuuc

SEQ ID NO: 1745639 - RNA, 17 nt, Human
gccagagacacaagccu

SEQ ID NO: 1745640 - RNA, 10 nt, Human
gccagaggag

SEQ ID NO: 1745641 - RNA, 20 nt, Human
gccagagacacaagccuucg

SEQ ID NO: 1745642 - RNA, 18 nt, Human
gccagaugcaccagcccu

SEQ ID NO: 1745643 - RNA, 17 nt, Human
gccagaugcaccagccc

SEQ ID NO: 1745644 - RNA, 16 nt, Human
gccagaugcaccagcc

SEQ ID NO: 1745645 - RNA, 23 nt, Human
gccagagggagugacagaggcag

SEQ ID NO: 1745646 - RNA, 22 nt, Human
gccagagggagugacagaggca

SEQ ID NO: 1745647 - RNA, 21 nt, Human
gccagagggagugacagaggc

SEQ ID NO: 1745648 - RNA, 22 nt, Human
gccagaggagagaggacccccu

SEQ ID NO: 1745649 - RNA, 19 nt, Human
gccagaggagagaggaccc

SEQ ID NO: 1745650 - RNA, 17 nt, Human
gccagaggagagaggac

SEQ ID NO: 1745651 - RNA, 15 nt, Human
gccagaggagagagg

SEQ ID NO: 1745652 - RNA, 13 nt, Human
gccagaggagaga

SEQ ID NO: 1745653 - RNA, 12 nt, Human
gccagaggagag

SEQ ID NO: 1745654 - RNA, 17 nt, Human
gccaccugccuguuggg

SEQ ID NO: 1745655 - RNA, 22 nt, Human
gccaccgugccuggccacgccc

SEQ ID NO: 1745656 - RNA, 17 nt, Human
gccaccgugccuggcca

SEQ ID NO: 1745657 - RNA, 17 nt, Human
gccaccgcgcccagccu

SEQ ID NO: 1745658 - RNA, 18 nt, Human
gccacggccaggccagag

SEQ ID NO: 1745659 - RNA, 20 nt, Human
gccacgcccaacuaauuuuu

SEQ ID NO: 1745660 - RNA, 19 nt, Human
gccacggccaggccagagg

SEQ ID NO: 1745661 - RNA, 20 nt, Human
gccaccugcggugcuaucuc

SEQ ID NO: 1745662 - RNA, 14 nt, Human
gccaccugcggugc

SEQ ID NO: 1745663 - RNA, 22 nt, Human
gccaccugcggugcuaucuccc

SEQ ID NO: 1745664 - RNA, 11 nt, Human
gccaccugggu

SEQ ID NO: 1745665 - RNA, 22 nt, Human
gccaugggacagggaggacgcu

SEQ ID NO: 1745666 - RNA, 23 nt, Human
gccaugggacagggaggacgcuc

SEQ ID NO: 1745667 - RNA, 14 nt, Human
gcccaaccugcucu

SEQ ID NO: 1745668 - RNA, 20 nt, Human
gccaugaggaacaaggcaag

SEQ ID NO: 1745669 - RNA, 18 nt, Human
gccaugaggaacaaggca

SEQ ID NO: 1745670 - RNA, 18 nt, Human
gccaugccagcuuaucuc

SEQ ID NO: 1745671 - RNA, 13 nt, Human
gccaugccagcuu

SEQ ID NO: 1745672 - RNA, 19 nt, Human
gccaugccagcuuaucuca

SEQ ID NO: 1745673 - RNA, 14 nt, Human
gccaggcugcucuu

SEQ ID NO: 1745674 - RNA, 13 nt, Human
gccaggcugcucu

SEQ ID NO: 1745675 - RNA, 13 nt, Human
gccaggcuggguc

SEQ ID NO: 1745676 - RNA, 22 nt, Human
gccaggcugcucuugaacuccu

SEQ ID NO: 1745677 - RNA, 21 nt, Human
gccagauuucacucuccuugg

SEQ ID NO: 1745678 - RNA, 18 nt, Human
gccagauuucacucuccu

SEQ ID NO: 1745679 - RNA, 16 nt, Human
gccagauuucacucuc

SEQ ID NO: 1745680 - RNA, 23 nt, Human
gccagggacagaggggguggccu

SEQ ID NO: 1745681 - RNA, 18 nt, Human
gccagggacagagggggu

SEQ ID NO: 1745682 - RNA, 16 nt, Human
gccagggacagagggg

SEQ ID NO: 1745683 - RNA, 13 nt, Human
gccagggacagag

SEQ ID NO: 1745684 - RNA, 22 nt, Human
gccaggcuggucucgaacuccu

SEQ ID NO: 1745685 - RNA, 18 nt, Human
gccagucaccccggccac

SEQ ID NO: 1745686 - RNA, 17 nt, Human
gccagucaccccggcca

SEQ ID NO: 1745687 - RNA, 20 nt, Human
gccagucaccccggccaccu

SEQ ID NO: 1745688 - RNA, 21 nt, Human
gccagucaccccggccaccug

SEQ ID NO: 1745689 - RNA, 17 nt, Human
gccagguuuuuggucug

SEQ ID NO: 1745690 - RNA, 12 nt, Human
gccaguaaaugg

SEQ ID NO: 1745691 - RNA, 20 nt, Human
gcccagucuggaaugcagug

SEQ ID NO: 1745692 - RNA, 19 nt, Human
gcccagucuggaaugcagu

SEQ ID NO: 1745693 - RNA, 21 nt, Human
gcccaggcuuagucacugaga

SEQ ID NO: 1745694 - RNA, 19 nt, Human
gcccaggcuuagucacuga

SEQ ID NO: 1745695 - RNA, 23 nt, Human
gcccaggcuuagucacugagaca

SEQ ID NO: 1745696 - RNA, 21 nt, Human
gcccaggaaaggcuccaggag

SEQ ID NO: 1745697 - RNA, 20 nt, Human
gcccaggaaaggcuccagga

SEQ ID NO: 1745698 - RNA, 19 nt, Human
gcccaggaaaggcuccagg

SEQ ID NO: 1745699 - RNA, 18 nt, Human
gcccaggaaaggcuccag

SEQ ID NO: 1745700 - RNA, 20 nt, Human
gcccaggcuggcgugcagug

SEQ ID NO: 1745701 - RNA, 19 nt, Human
gcccaggcuggcgugcagu

SEQ ID NO: 1745702 - RNA, 22 nt, Human
gcccaggcuggcgugcaguggu

SEQ ID NO: 1745703 - RNA, 17 nt, Human
gcccagccccuucugac

SEQ ID NO: 1745704 - RNA, 16 nt, Human
gcccagccccuucuga

SEQ ID NO: 1745705 - RNA, 14 nt, Human
gcccagccccuucu

SEQ ID NO: 1745706 - RNA, 13 nt, Human
gcccagccccuuc

SEQ ID NO: 1745707 - RNA, 24 nt, Human
gcccagccccuucugacccaugcu

SEQ ID NO: 1745708 - RNA, 20 nt, Human
gcccagccccuucugaccca

SEQ ID NO: 1745709 - RNA, 21 nt, Human
gcccagcuugaaaccuucacu

SEQ ID NO: 1745710 - RNA, 12 nt, Human
gcccagccccuu

SEQ ID NO: 1745711 - RNA, 11 nt, Human
gcccagccccu

SEQ ID NO: 1745712 - RNA, 9 nt, Human
gcccagccc

SEQ ID NO: 1745713 - RNA, 21 nt, Human
gcccagagggccugcaaggga

SEQ ID NO: 1745714 - RNA, 20 nt, Human
gcccagagggccugcaaggg

SEQ ID NO: 1745715 - RNA, 22 nt, Human
gcccagagggccugcaagggag

SEQ ID NO: 1745716 - RNA, 19 nt, Human
gcccagagggccugcaagg

SEQ ID NO: 1745717 - RNA, 18 nt, Human
gcccagagggccugcaag

SEQ ID NO: 1745718 - RNA, 15 nt, Human
gcccagagggccugc

SEQ ID NO: 1745719 - RNA, 14 nt, Human
gcccagagggccug

SEQ ID NO: 1745720 - RNA, 12 nt, Human
gcccagagggcc

SEQ ID NO: 1745721 - RNA, 15 nt, Human
gcccagagagggugg

SEQ ID NO: 1745722 - RNA, 21 nt, Human
gcccaaugcacuuuguucugg

SEQ ID NO: 1745723 - RNA, 15 nt, Human
gcaucucagcccaca

SEQ ID NO: 1745724 - RNA, 22 nt, Human
gcaugacacgaauauugcugau

SEQ ID NO: 1745725 - RNA, 21 nt, Human
gcaugacacgaauauugcuga

SEQ ID NO: 1745726 - RNA, 23 nt, Human
gcaugaaguaauaugcacacauu

SEQ ID NO: 1745727 - RNA, 20 nt, Human
gcaugaaguaauaugcacac

SEQ ID NO: 1745728 - RNA, 21 nt, Human
gcaugaaguaauaugcacaca

SEQ ID NO: 1745729 - RNA, 22 nt, Human
gcaugaaguaauaugcacacau

SEQ ID NO: 1745730 - RNA, 12 nt, Human
gcaucucagccc

SEQ ID NO: 1745731 - RNA, 14 nt, Human
gcaucucagcccac

SEQ ID NO: 1745732 - RNA, 13 nt, Human
gcaucucagccca

SEQ ID NO: 1745733 - RNA, 23 nt, Human
gcaucagugcccuccaggauaga

SEQ ID NO: 1745734 - RNA, 12 nt, Human
gcaucaggccag

SEQ ID NO: 1745735 - RNA, 18 nt, Human
gcaucaggccaggcccuc

SEQ ID NO: 1745736 - RNA, 23 nt, Human
gcaucaggccaggcccucugccc

SEQ ID NO: 1745737 - RNA, 15 nt, Human
gcaucagugcccucc

SEQ ID NO: 1745738 - RNA, 14 nt, Human
gcaugccuggaugg

SEQ ID NO: 1745739 - RNA, 14 nt, Human
gcauguucucugag

SEQ ID NO: 1745740 - RNA, 13 nt, Human
gcauguuacauaa

SEQ ID NO: 1745741 - RNA, 15 nt, Human
gcaugccuggauggg

SEQ ID NO: 1745742 - RNA, 22 nt, Human
gcauuaucuagauacuguauca

SEQ ID NO: 1745743 - RNA, 24 nt, Human
gcauuaucuagauacuguaucaug

SEQ ID NO: 1745744 - RNA, 21 nt, Human
gcauuccccaggaggccagcc

SEQ ID NO: 1745745 - RNA, 20 nt, Human
gcauuccccaggaggccagc

SEQ ID NO: 1745746 - RNA, 19 nt, Human
gcauuccccaggaggccag

SEQ ID NO: 1745747 - RNA, 18 nt, Human
gcauuccccaggaggcca

SEQ ID NO: 1745748 - RNA, 17 nt, Human
gcauuccccaggaggcc

SEQ ID NO: 1745749 - RNA, 16 nt, Human
gcauuccccaggaggc

SEQ ID NO: 1745750 - RNA, 15 nt, Human
gcauuccccaggagg

SEQ ID NO: 1745751 - RNA, 14 nt, Human
gcauuccccaggag

SEQ ID NO: 1745752 - RNA, 22 nt, Human
gcauuccccaggaggccagccu

SEQ ID NO: 1745753 - RNA, 18 nt, Human
gcauuugaggucuguucu

SEQ ID NO: 1745754 - RNA, 19 nt, Human
gcauacguacacauuuuau

SEQ ID NO: 1745755 - RNA, 22 nt, Human
gcaguggugguuuucuguucuu

SEQ ID NO: 1745756 - RNA, 20 nt, Human
gcaguggugguuuucuguuc

SEQ ID NO: 1745757 - RNA, 21 nt, Human
gcaguggugguuuucuguucu

SEQ ID NO: 1745758 - RNA, 21 nt, Human
gcaguggugcgaucuggguuc

SEQ ID NO: 1745759 - RNA, 20 nt, Human
gcaguggugcgaucuggguu

SEQ ID NO: 1745760 - RNA, 22 nt, Human
gcaguggugcgaucuggguuca

SEQ ID NO: 1745761 - RNA, 19 nt, Human
gcaguggugguuuucuguu

SEQ ID NO: 1745762 - RNA, 19 nt, Human
gcaguggugcgaucugggu

SEQ ID NO: 1745763 - RNA, 18 nt, Human
gcaguggugcgaucuggg

SEQ ID NO: 1745764 - RNA, 12 nt, Human
gcagugggagcu

SEQ ID NO: 1745765 - RNA, 11 nt, Human
gcagugggagc

SEQ ID NO: 1745766 - RNA, 21 nt, Human
gcagugggacagggcauggcc

SEQ ID NO: 1745767 - RNA, 23 nt, Human
gcaggucccuaauaaagcugugu

SEQ ID NO: 1745768 - RNA, 21 nt, Human
gcaggucccuaauaaagcugu

SEQ ID NO: 1745769 - RNA, 20 nt, Human
gcaggucccuaauaaagcug

SEQ ID NO: 1745770 - RNA, 19 nt, Human
gcaggucccuaauaaagcu

SEQ ID NO: 1745771 - RNA, 18 nt, Human
gcaggucccuaauaaagc

SEQ ID NO: 1745772 - RNA, 17 nt, Human
gcaggucccuaauaaag

SEQ ID NO: 1745773 - RNA, 16 nt, Human
gcaggucccuaauaaa

SEQ ID NO: 1745774 - RNA, 22 nt, Human
gcaggggaggguagagcggaga

SEQ ID NO: 1745775 - RNA, 16 nt, Human
gcagggucucacucug

SEQ ID NO: 1745776 - RNA, 19 nt, Human
gcaggguccuagaaauucc

SEQ ID NO: 1745777 - RNA, 15 nt, Human
gcaggucccuaauaa

SEQ ID NO: 1745778 - RNA, 14 nt, Human
gcaggucccuaaua

SEQ ID NO: 1745779 - RNA, 17 nt, Human
gcaggcagccaggccac

SEQ ID NO: 1745780 - RNA, 18 nt, Human
gcaggcagccaggccaca

SEQ ID NO: 1745781 - RNA, 19 nt, Human
gcacuguuuuauuuuaauu

SEQ ID NO: 1745782 - RNA, 14 nt, Human
gcacugggcuuggg

SEQ ID NO: 1745783 - RNA, 12 nt, Human
gcacugggcuug

SEQ ID NO: 1745784 - RNA, 15 nt, Human
gcacugcuuccagug

SEQ ID NO: 1745785 - RNA, 14 nt, Human
gcacugcuuccagu

SEQ ID NO: 1745786 - RNA, 13 nt, Human
gcacugcuuccag

SEQ ID NO: 1745787 - RNA, 12 nt, Human
gcacugcuucca

SEQ ID NO: 1745788 - RNA, 15 nt, Human
gcacuauaauguaag

SEQ ID NO: 1745789 - RNA, 14 nt, Human
gcacuauaauguaa

SEQ ID NO: 1745790 - RNA, 20 nt, Human
gcacuauaauguaagcucua

SEQ ID NO: 1745791 - RNA, 22 nt, Human
gcacuauaauguaagcucuacu

SEQ ID NO: 1745792 - RNA, 20 nt, Human
gcacuaaggugugcucugau

SEQ ID NO: 1745793 - RNA, 14 nt, Human
gcacgugugugcac

SEQ ID NO: 1745794 - RNA, 19 nt, Human
gcacccucaggcagguggg

SEQ ID NO: 1745795 - RNA, 16 nt, Human
gcacccucaggcaggu

SEQ ID NO: 1745796 - RNA, 20 nt, Human
gauugugucucuugguccug

SEQ ID NO: 1745797 - RNA, 23 nt, Human
gcacagcuucauuuccugugucu

SEQ ID NO: 1745798 - RNA, 16 nt, Human
gcacagggcaguggga

SEQ ID NO: 1745799 - RNA, 15 nt, Human
gcaccaucucuccuc

SEQ ID NO: 1745800 - RNA, 14 nt, Human
gcaccaucucuccu

SEQ ID NO: 1745801 - RNA, 13 nt, Human
gcaccagcagccu

SEQ ID NO: 1745802 - RNA, 14 nt, Human
gcaccagcagccug

SEQ ID NO: 1745803 - RNA, 17 nt, Human
gcaccaucucuccuccu

SEQ ID NO: 1745804 - RNA, 22 nt, Human
gcacuucgggaggucgaggcag

SEQ ID NO: 1745805 - RNA, 16 nt, Human
gcacuugcagacucua

SEQ ID NO: 1745806 - RNA, 14 nt, Human
gcacuugcagacuc

SEQ ID NO: 1745807 - RNA, 22 nt, Human
gcagacucuacagaggccaugg

SEQ ID NO: 1745808 - RNA, 19 nt, Human
gcagacucuacagaggcca

SEQ ID NO: 1745809 - RNA, 18 nt, Human
gcagacucuacagaggcc

SEQ ID NO: 1745810 - RNA, 17 nt, Human
gcagacucuacagaggc

SEQ ID NO: 1745811 - RNA, 21 nt, Human
gcagagaccaucccugaaggc

SEQ ID NO: 1745812 - RNA, 20 nt, Human
gcagagaccaucccugaagg

SEQ ID NO: 1745813 - RNA, 22 nt, Human
gcagagaccaucccugaaggcc

SEQ ID NO: 1745814 - RNA, 18 nt, Human
gcagauguccuugaugcu

SEQ ID NO: 1745815 - RNA, 18 nt, Human
gcagauggagaccccuug

SEQ ID NO: 1745816 - RNA, 23 nt, Human
gcagagguugcagugagccgaga

SEQ ID NO: 1745817 - RNA, 18 nt, Human
gcagagguugcagugagc

SEQ ID NO: 1745818 - RNA, 21 nt, Human
gcagagguccacaacacacag

SEQ ID NO: 1745819 - RNA, 19 nt, Human
gcagccucacaguccuuac

SEQ ID NO: 1745820 - RNA, 17 nt, Human
gcagccucacaguccuu

SEQ ID NO: 1745821 - RNA, 15 nt, Human
gcagccucacagucc

SEQ ID NO: 1745822 - RNA, 19 nt, Human
gcagcagggagggcuucug

SEQ ID NO: 1745823 - RNA, 18 nt, Human
gcagcagggagggcuucu

SEQ ID NO: 1745824 - RNA, 20 nt, Human
gcagcagggagggcuucugc

SEQ ID NO: 1745825 - RNA, 14 nt, Human
gcagcccugcuuug

SEQ ID NO: 1745826 - RNA, 24 nt, Human
gcagcccugcuuugggcugcccug

SEQ ID NO: 1745827 - RNA, 14 nt, Human
gcagcucagagagg

SEQ ID NO: 1745828 - RNA, 21 nt, Human
gcagcucaccucucccuugga

SEQ ID NO: 1745829 - RNA, 20 nt, Human
gcagcucaccucucccuugg

SEQ ID NO: 1745830 - RNA, 17 nt, Human
gcagcucaccucucccu

SEQ ID NO: 1745831 - RNA, 16 nt, Human
gcagcucaccucuccc

SEQ ID NO: 1745832 - RNA, 19 nt, Human
gcagcucagagaggguggg

SEQ ID NO: 1745833 - RNA, 18 nt, Human
gcagcucagagagggugg

SEQ ID NO: 1745834 - RNA, 22 nt, Human
gaugggcaacccccagccugcu

SEQ ID NO: 1745835 - RNA, 21 nt, Human
gauggcacuuauaaccaaagc

SEQ ID NO: 1745836 - RNA, 21 nt, Human
gaugccuggcgggguggggug

SEQ ID NO: 1745837 - RNA, 23 nt, Human
gaugagaaauaaaguuucuguug

SEQ ID NO: 1745838 - RNA, 22 nt, Human
gaugagaaagguugaagcacca

SEQ ID NO: 1745839 - RNA, 11 nt, Human
gaugagaaagg

SEQ ID NO: 1745840 - RNA, 14 nt, Human
gaugacuauggaaa

SEQ ID NO: 1745841 - RNA, 16 nt, Human
gaucuuugcagacagg

SEQ ID NO: 1745842 - RNA, 15 nt, Human
gaugaaaaaauaaca

SEQ ID NO: 1745843 - RNA, 17 nt, Human
gaucuuugcagacaggc

SEQ ID NO: 1745844 - RNA, 17 nt, Human
gauccuuuuggagucag

SEQ ID NO: 1745845 - RNA, 15 nt, Human
gauccuuuuggaguc

SEQ ID NO: 1745846 - RNA, 19 nt, Human
gauccugagccagauuuca

SEQ ID NO: 1745847 - RNA, 15 nt, Human
gauccugagccagau

SEQ ID NO: 1745848 - RNA, 14 nt, Human
gauccugagccaga

SEQ ID NO: 1745849 - RNA, 13 nt, Human
gauccugagccag

SEQ ID NO: 1745850 - RNA, 21 nt, Human
gauccucccaccucagccucc

SEQ ID NO: 1745851 - RNA, 20 nt, Human
gauccucccaccucagccuc

SEQ ID NO: 1745852 - RNA, 19 nt, Human
gauccucccaccucagccu

SEQ ID NO: 1745853 - RNA, 12 nt, Human
gauccuccaggu

SEQ ID NO: 1745854 - RNA, 14 nt, Human
gaucacgccacugc

SEQ ID NO: 1745855 - RNA, 13 nt, Human
gaucacgccacug

SEQ ID NO: 1745856 - RNA, 23 nt, Human
gaucaaccccuucgcuccugugu

SEQ ID NO: 1745857 - RNA, 18 nt, Human
gauccuaguuccaccauc

SEQ ID NO: 1745858 - RNA, 15 nt, Human
gaucacgccacugca

SEQ ID NO: 1745859 - RNA, 11 nt, Human
gauccuccagg

SEQ ID NO: 1745860 - RNA, 23 nt, Human
gauugacgggacuguugguauug

SEQ ID NO: 1745861 - RNA, 13 nt, Human
gauugugccccug

SEQ ID NO: 1745862 - RNA, 20 nt, Human
gauuguccccgacccuugcc

SEQ ID NO: 1745863 - RNA, 15 nt, Human
gauuguccccgaccc

SEQ ID NO: 1745864 - RNA, 23 nt, Human
gauuguaauauguaaaugguaug

SEQ ID NO: 1745865 - RNA, 22 nt, Human
gauucccaagcucugcuccucu

SEQ ID NO: 1745866 - RNA, 12 nt, Human
gauucagacagc

SEQ ID NO: 1745867 - RNA, 20 nt, Human
gaugugcuuguuaacugagu

SEQ ID NO: 1745868 - RNA, 16 nt, Human
gauguucugggacaca

SEQ ID NO: 1745869 - RNA, 20 nt, Human
gauggugcaaugaccuuuca

SEQ ID NO: 1745870 - RNA, 23 nt, Human
gauggugcaaugaccuuucaaua

SEQ ID NO: 1745871 - RNA, 19 nt, Human
gaugugcuuguuaacugag

SEQ ID NO: 1745872 - RNA, 19 nt, Human
gauguugaaaaaguucugc

SEQ ID NO: 1745873 - RNA, 21 nt, Human
gauguucuuucacccuuuucu

SEQ ID NO: 1745874 - RNA, 14 nt, Human
gauguuuuccauga

SEQ ID NO: 1745875 - RNA, 23 nt, Human
gauguuuuccaugaguccccugu

SEQ ID NO: 1745876 - RNA, 15 nt, Human
gauguuuuccaugag

SEQ ID NO: 1745877 - RNA, 12 nt, Human
gauuaaauucuu

SEQ ID NO: 1745878 - RNA, 19 nt, Human
gauuaaauucuugcaaagu

SEQ ID NO: 1745879 - RNA, 21 nt, Human
gauuaaccacuucagcugacu

SEQ ID NO: 1745880 - RNA, 19 nt, Human
gauuaaccacuucagcuga

SEQ ID NO: 1745881 - RNA, 18 nt, Human
gauuaaccacuucagcug

SEQ ID NO: 1745882 - RNA, 19 nt, Human
gauucaacagguuuuccug

SEQ ID NO: 1745883 - RNA, 21 nt, Human
gaguugaaaaucuuauaauuu

SEQ ID NO: 1745884 - RNA, 14 nt, Human
gaguugaagacaga

SEQ ID NO: 1745885 - RNA, 23 nt, Human
gaguucaucuugaauuguaagga

SEQ ID NO: 1745886 - RNA, 17 nt, Human
gagugugccugaagucc

SEQ ID NO: 1745887 - RNA, 22 nt, Human
gagugaacaaauuuacagagac

SEQ ID NO: 1745888 - RNA, 23 nt, Human
gagugaacaaauuuacagagaca

SEQ ID NO: 1745889 - RNA, 19 nt, Human
gagugaacaaauuuacaga

SEQ ID NO: 1745890 - RNA, 23 nt, Human
gagugggggaucacagccucuga

SEQ ID NO: 1745891 - RNA, 12 nt, Human
gagugggcccaa

SEQ ID NO: 1745892 - RNA, 15 nt, Human
gaguggcuccucccg

SEQ ID NO: 1745893 - RNA, 13 nt, Human
gaguggcuccucc

SEQ ID NO: 1745894 - RNA, 13 nt, Human
gauacaaugcugu

SEQ ID NO: 1745895 - RNA, 18 nt, Human
gauacaaugcugugcccu

SEQ ID NO: 1745896 - RNA, 18 nt, Human
gauagcacagacccugcc

SEQ ID NO: 1745897 - RNA, 17 nt, Human
gauagcacagacccugc

SEQ ID NO: 1745898 - RNA, 23 nt, Human
gauauaugcucugcauguuacau

SEQ ID NO: 1745899 - RNA, 22 nt, Human
gaucaaccccuucgcuccugug

SEQ ID NO: 1745900 - RNA, 21 nt, Human
gaucaaccccuucgcuccugu

SEQ ID NO: 1745901 - RNA, 20 nt, Human
gauagcacagacccugcccu

SEQ ID NO: 1745902 - RNA, 19 nt, Human
gauagcacagacccugccc

SEQ ID NO: 1745903 - RNA, 12 nt, Human
gauagccaaggc

SEQ ID NO: 1745904 - RNA, 14 nt, Human
gauagccaaggcca

SEQ ID NO: 1745905 - RNA, 13 nt, Human
gauagccaaggcc

SEQ ID NO: 1745906 - RNA, 17 nt, Human
gauauaaguguguguuu

SEQ ID NO: 1745907 - RNA, 21 nt, Human
gauauaaguguguguuuuuca

SEQ ID NO: 1745908 - RNA, 14 nt, Human
gaguagcugggacu

SEQ ID NO: 1745909 - RNA, 12 nt, Human
gaguagcuggga

SEQ ID NO: 1745910 - RNA, 12 nt, Human
gaguccccuguu

SEQ ID NO: 1745911 - RNA, 19 nt, Human
gagucccaggcugagccuc

SEQ ID NO: 1745912 - RNA, 18 nt, Human
gagucccaggcugagccu

SEQ ID NO: 1745913 - RNA, 23 nt, Human
gaguccccuguuuguuucugaaa

SEQ ID NO: 1745914 - RNA, 14 nt, Human
gaguccccuguuug

SEQ ID NO: 1745915 - RNA, 17 nt, Human
gagucgaggacagggag

SEQ ID NO: 1745916 - RNA, 21 nt, Human
gagucucacuguugcccaggc

SEQ ID NO: 1745917 - RNA, 20 nt, Human
gagucucacuguugcccagg

SEQ ID NO: 1745918 - RNA, 19 nt, Human
gagucucacuguugcccag

SEQ ID NO: 1745919 - RNA, 23 nt, Human
gagucucacuguugcccaggcug

SEQ ID NO: 1745920 - RNA, 22 nt, Human
gagucucacuguugcccaggcu

SEQ ID NO: 1745921 - RNA, 12 nt, Human
gagucucuucuc

SEQ ID NO: 1745922 - RNA, 23 nt, Human
gagucucgcuauugucaccaggg

SEQ ID NO: 1745923 - RNA, 21 nt, Human
gagucugaaggcuggguucug

SEQ ID NO: 1745924 - RNA, 18 nt, Human
gagucucuucuccacugg

SEQ ID NO: 1745925 - RNA, 17 nt, Human
gagucucuucuccacug

SEQ ID NO: 1745926 - RNA, 16 nt, Human
gagucucuucuccacu

SEQ ID NO: 1745927 - RNA, 15 nt, Human
gagucucuucuccac

SEQ ID NO: 1745928 - RNA, 14 nt, Human
gagucucuucucca

SEQ ID NO: 1745929 - RNA, 18 nt, Human
gaggugggauccuccagg

SEQ ID NO: 1745930 - RNA, 22 nt, Human
gaggugggauccuccaggugca

SEQ ID NO: 1745931 - RNA, 21 nt, Human
gaggugggauccuccaggugc

SEQ ID NO: 1745932 - RNA, 15 nt, Human
gaggggggagguggg

SEQ ID NO: 1745933 - RNA, 15 nt, Human
gaggggguggccucc

SEQ ID NO: 1745934 - RNA, 18 nt, Human
gagguccacaacacacag

SEQ ID NO: 1745935 - RNA, 22 nt, Human
gaggggggaggugggauccucc

SEQ ID NO: 1745936 - RNA, 19 nt, Human
gaguacuacaguccuccca

SEQ ID NO: 1745937 - RNA, 18 nt, Human
gaguacuacaguccuccc

SEQ ID NO: 1745938 - RNA, 12 nt, Human
gaguagcuggau

SEQ ID NO: 1745939 - RNA, 17 nt, Human
gaguacguugugcauuu

SEQ ID NO: 1745940 - RNA, 18 nt, Human
gaguacguugugcauuug

SEQ ID NO: 1745941 - RNA, 15 nt, Human
gaguacuacaguccu

SEQ ID NO: 1745942 - RNA, 20 nt, Human
gaguacguugugcauuuggu

SEQ ID NO: 1745943 - RNA, 14 nt, Human
gagguucccuuuga

SEQ ID NO: 1745944 - RNA, 19 nt, Human
gagguucaaagauauuuug

SEQ ID NO: 1745945 - RNA, 19 nt, Human
gagguuuuaaaaaaauccc

SEQ ID NO: 1745946 - RNA, 16 nt, Human
gaguacguugugcauu

SEQ ID NO: 1745947 - RNA, 18 nt, Human
gagcagccacauuccuga

SEQ ID NO: 1745948 - RNA, 13 nt, Human
gagccacugcacc

SEQ ID NO: 1745949 - RNA, 20 nt, Human
gagccaccgugccuggccac

SEQ ID NO: 1745950 - RNA, 14 nt, Human
gagccaccgugccu

SEQ ID NO: 1745951 - RNA, 18 nt, Human
gagccaccgcgcccagcc

SEQ ID NO: 1745952 - RNA, 12 nt, Human
gagcccaggccu

SEQ ID NO: 1745953 - RNA, 16 nt, Human
gagcccacgcccccac

SEQ ID NO: 1745954 - RNA, 15 nt, Human
gagcccacgccccca

SEQ ID NO: 1745955 - RNA, 12 nt, Human
gagcccacgccc

SEQ ID NO: 1745956 - RNA, 14 nt, Human
gagcccaggccucc

SEQ ID NO: 1745957 - RNA, 13 nt, Human
gagcccaggccuc

SEQ ID NO: 1745958 - RNA, 13 nt, Human
gagccagauuuca

SEQ ID NO: 1745959 - RNA, 22 nt, Human
gagccacugcaccgggccacag

SEQ ID NO: 1745960 - RNA, 11 nt, Human
gagcccacgcc

SEQ ID NO: 1745961 - RNA, 19 nt, Human
gagcaaaaucgaugcagug

SEQ ID NO: 1745962 - RNA, 23 nt, Human
gagcaagacgcugugcugcccug

SEQ ID NO: 1745963 - RNA, 22 nt, Human
gagcaagacgcugugcugcccu

SEQ ID NO: 1745964 - RNA, 18 nt, Human
gagcaagacgcugugcug

SEQ ID NO: 1745965 - RNA, 21 nt, Human
gagcaagacgcugugcugccc

SEQ ID NO: 1745966 - RNA, 17 nt, Human
gagcaccuuagacaguc

SEQ ID NO: 1745967 - RNA, 19 nt, Human
gagcaccuuagacaguccc

SEQ ID NO: 1745968 - RNA, 20 nt, Human
gagaucaaccccuucgcucc

SEQ ID NO: 1745969 - RNA, 16 nt, Human
gagaucagccugggca

SEQ ID NO: 1745970 - RNA, 14 nt, Human
gagaucagccuggg

SEQ ID NO: 1745971 - RNA, 13 nt, Human
gagaucagccugg

SEQ ID NO: 1745972 - RNA, 14 nt, Human
gagcuacaaaugca

SEQ ID NO: 1745973 - RNA, 23 nt, Human
gagcuacacaggggaaaagagga

SEQ ID NO: 1745974 - RNA, 16 nt, Human
gagcugccaccugccu

SEQ ID NO: 1745975 - RNA, 15 nt, Human
gagcugccaccugcc

SEQ ID NO: 1745976 - RNA, 13 nt, Human
gagcugccaccug

SEQ ID NO: 1745977 - RNA, 16 nt, Human
gagcucugcagagcag

SEQ ID NO: 1745978 - RNA, 15 nt, Human
gagcuuaacagugug

SEQ ID NO: 1745979 - RNA, 18 nt, Human
gagcuucuguugcugccu

SEQ ID NO: 1745980 - RNA, 14 nt, Human
gagcuucuggcacu

SEQ ID NO: 1745981 - RNA, 12 nt, Human
gagcuacaaaug

SEQ ID NO: 1745982 - RNA, 13 nt, Human
gagcuacaaaugc

SEQ ID NO: 1745983 - RNA, 21 nt, Human
gagccugggaggucaaggcug

SEQ ID NO: 1745984 - RNA, 13 nt, Human
gagccugggaggu

SEQ ID NO: 1745985 - RNA, 10 nt, Human
gagccuggca

SEQ ID NO: 1745986 - RNA, 15 nt, Human
gagccuggcaagaau

SEQ ID NO: 1745987 - RNA, 22 nt, Human
gagccuccugcccuuaccugcc

SEQ ID NO: 1745988 - RNA, 20 nt, Human
gagccuccugcccuuaccug

SEQ ID NO: 1745989 - RNA, 17 nt, Human
gagcccugguggcagug

SEQ ID NO: 1745990 - RNA, 19 nt, Human
gagccucagcauccuggca

SEQ ID NO: 1745991 - RNA, 16 nt, Human
gagcccugguggcagu

SEQ ID NO: 1745992 - RNA, 15 nt, Human
gagcccugguggcag

SEQ ID NO: 1745993 - RNA, 21 nt, Human
gagccucagcauccuggcacc

SEQ ID NO: 1745994 - RNA, 20 nt, Human
gagccucagcauccuggcac

SEQ ID NO: 1745995 - RNA, 14 nt, Human
gagccuccugcccu

SEQ ID NO: 1745996 - RNA, 18 nt, Human
gagcccugguggcagugg

SEQ ID NO: 1745997 - RNA, 18 nt, Human
gagccucagucucccucc

SEQ ID NO: 1745998 - RNA, 15 nt, Human
gaggaauccagaccc

SEQ ID NO: 1745999 - RNA, 18 nt, Human
gaggacaagagaaaaaag

SEQ ID NO: 1746000 - RNA, 13 nt, Human
gaggacacagaga

SEQ ID NO: 1746001 - RNA, 14 nt, Human
gaggaauccagacc

SEQ ID NO: 1746002 - RNA, 22 nt, Human
gaggaaggaaacccagcucugg

SEQ ID NO: 1746003 - RNA, 21 nt, Human
gagcuucuguugcugccucau

SEQ ID NO: 1746004 - RNA, 23 nt, Human
gaggacagggaggugaccccagg

SEQ ID NO: 1746005 - RNA, 22 nt, Human
gaggacagggaggugaccccag

SEQ ID NO: 1746006 - RNA, 13 nt, Human
gaggacagggagg

SEQ ID NO: 1746007 - RNA, 13 nt, Human
gaggccagccuug

SEQ ID NO: 1746008 - RNA, 12 nt, Human
gaggccagccuu

SEQ ID NO: 1746009 - RNA, 22 nt, Human
gaggcagccccauucugccugc

SEQ ID NO: 1746010 - RNA, 18 nt, Human
gaggcagccccauucugc

SEQ ID NO: 1746011 - RNA, 23 nt, Human
gaggcagccccauucugccugcc

SEQ ID NO: 1746012 - RNA, 13 nt, Human
gaggcagccccau

SEQ ID NO: 1746013 - RNA, 23 nt, Human
gaggaguuugggguaugggagag

SEQ ID NO: 1746014 - RNA, 16 nt, Human
gaggauugcuugagcu

SEQ ID NO: 1746015 - RNA, 20 nt, Human
gaggauguucugggacacag

SEQ ID NO: 1746016 - RNA, 17 nt, Human
gaggauguucugggaca

SEQ ID NO: 1746017 - RNA, 12 nt, Human
gaggauguucug

SEQ ID NO: 1746018 - RNA, 13 nt, Human
gaggcccggccuc

SEQ ID NO: 1746019 - RNA, 23 nt, Human
gaggcccuucucuccagccccug

SEQ ID NO: 1746020 - RNA, 14 nt, Human
gaggcccuucucuc

SEQ ID NO: 1746021 - RNA, 24 nt, Human
gaggcccuucucuccagccccugg

SEQ ID NO: 1746022 - RNA, 14 nt, Human
gaggccuucucuga

SEQ ID NO: 1746023 - RNA, 19 nt, Human
gaggcggaucuuuggacag

SEQ ID NO: 1746024 - RNA, 20 nt, Human
gaggcggccccggccggggu

SEQ ID NO: 1746025 - RNA, 15 nt, Human
gaggcugggcucccu

SEQ ID NO: 1746026 - RNA, 16 nt, Human
gaggcugggcucccuu

SEQ ID NO: 1746027 - RNA, 14 nt, Human
gaggcugggcuccc

SEQ ID NO: 1746028 - RNA, 13 nt, Human
gaggcugggcucc

SEQ ID NO: 1746029 - RNA, 16 nt, Human
gagggagugacagagg

SEQ ID NO: 1746030 - RNA, 16 nt, Human
gagggagggcuccaga

SEQ ID NO: 1746031 - RNA, 14 nt, Human
gagggagugacaga

SEQ ID NO: 1746032 - RNA, 13 nt, Human
gagggagugacag

SEQ ID NO: 1746033 - RNA, 14 nt, Human
gagggagguaagga

SEQ ID NO: 1746034 - RNA, 22 nt, Human
gagggcacagaaaauggaagac

SEQ ID NO: 1746035 - RNA, 14 nt, Human
gagggcacagaaaa

SEQ ID NO: 1746036 - RNA, 23 nt, Human
gagggcacagaaaauggaagaca

SEQ ID NO: 1746037 - RNA, 12 nt, Human
gagggcacuggu

SEQ ID NO: 1746038 - RNA, 18 nt, Human
gagggcacugguggcccg

SEQ ID NO: 1746039 - RNA, 16 nt, Human
gagggcacugguggcc

SEQ ID NO: 1746040 - RNA, 22 nt, Human
gaggggccucuuaugggcuggg

SEQ ID NO: 1746041 - RNA, 20 nt, Human
gaggggccuggcagccgugc

SEQ ID NO: 1746042 - RNA, 18 nt, Human
gaggggccuggcagccgu

SEQ ID NO: 1746043 - RNA, 14 nt, Human
gaggggccuggcag

SEQ ID NO: 1746044 - RNA, 13 nt, Human
gaggggccuggca

SEQ ID NO: 1746045 - RNA, 15 nt, Human
gagggagggcuccag

SEQ ID NO: 1746046 - RNA, 15 nt, Human
gagggagggagggcu

SEQ ID NO: 1746047 - RNA, 14 nt, Human
gagggagggagggc

SEQ ID NO: 1746048 - RNA, 14 nt, Human
cucacugcagccuc

SEQ ID NO: 1746049 - RNA, 13 nt, Human
cucacugcagccu

SEQ ID NO: 1746050 - RNA, 12 nt, Human
cucacugcagcc

SEQ ID NO: 1746051 - RNA, 21 nt, Human
cucacucugucgcccagucug

SEQ ID NO: 1746052 - RNA, 13 nt, Human
cucacucugucgc

SEQ ID NO: 1746053 - RNA, 22 nt, Human
cucacucugucgcccagucugg

SEQ ID NO: 1746054 - RNA, 12 nt, Human
cucacucugucg

SEQ ID NO: 1746055 - RNA, 11 nt, Human
cucacucuguc

SEQ ID NO: 1746056 - RNA, 13 nt, Human
cucacuccuugaa

SEQ ID NO: 1746057 - RNA, 19 nt, Human
cucacuccuaccugguaau

SEQ ID NO: 1746058 - RNA, 17 nt, Human
cucacuccuaccuggua

SEQ ID NO: 1746059 - RNA, 16 nt, Human
cucacuccuaccuggu

SEQ ID NO: 1746060 - RNA, 22 nt, Human
cucacuauguugcccaggcagg

SEQ ID NO: 1746061 - RNA, 21 nt, Human
cucacuauguugcccaggcag

SEQ ID NO: 1746062 - RNA, 23 nt, Human
cucacuauguugcccaggcaggu

SEQ ID NO: 1746063 - RNA, 15 nt, Human
cucacuccuaccugg

SEQ ID NO: 1746064 - RNA, 13 nt, Human
cucacuccuaccu

SEQ ID NO: 1746065 - RNA, 15 nt, Human
cucaccccagcccca

SEQ ID NO: 1746066 - RNA, 20 nt, Human
cucacuauguugcccaggca

SEQ ID NO: 1746067 - RNA, 19 nt, Human
cucacuauguugcccaggc

SEQ ID NO: 1746068 - RNA, 15 nt, Human
cucagauuguaauau

SEQ ID NO: 1746069 - RNA, 22 nt, Human
cucagauuguaauauguaaaug

SEQ ID NO: 1746070 - RNA, 15 nt, Human
cucagaucuucugug

SEQ ID NO: 1746071 - RNA, 17 nt, Human
cucagcauccuggcacc

SEQ ID NO: 1746072 - RNA, 16 nt, Human
cucagcauccuggcac

SEQ ID NO: 1746073 - RNA, 20 nt, Human
cucacuguugcccaggcugg

SEQ ID NO: 1746074 - RNA, 22 nt, Human
cucacugccaugccagcuuauc

SEQ ID NO: 1746075 - RNA, 19 nt, Human
cucacugccaugccagcuu

SEQ ID NO: 1746076 - RNA, 22 nt, Human
cucacuguugcccaggcuggcg

SEQ ID NO: 1746077 - RNA, 21 nt, Human
cucacuguugcccaggcuggc

SEQ ID NO: 1746078 - RNA, 14 nt, Human
cucagagagggugg

SEQ ID NO: 1746079 - RNA, 18 nt, Human
cucagagagggugggagu

SEQ ID NO: 1746080 - RNA, 17 nt, Human
cucaaccuccugggcua

SEQ ID NO: 1746081 - RNA, 15 nt, Human
cucaaccuccugggc

SEQ ID NO: 1746082 - RNA, 13 nt, Human
cucaaccuccugg

SEQ ID NO: 1746083 - RNA, 21 nt, Human
cucaacaccucugcacaagcu

SEQ ID NO: 1746084 - RNA, 18 nt, Human
cuauuguuagucucuuga

SEQ ID NO: 1746085 - RNA, 19 nt, Human
cuauugucaccagggcugg

SEQ ID NO: 1746086 - RNA, 22 nt, Human
cuauuuaugugauccuuuugga

SEQ ID NO: 1746087 - RNA, 23 nt, Human
cucacaguccuuaccagcagagc

SEQ ID NO: 1746088 - RNA, 22 nt, Human
cucacaguccuuaccagcagag

SEQ ID NO: 1746089 - RNA, 19 nt, Human
cucacaguccuuaccagca

SEQ ID NO: 1746090 - RNA, 17 nt, Human
cucacaguccuuaccag

SEQ ID NO: 1746091 - RNA, 19 nt, Human
cucacauuuauucugcuca

SEQ ID NO: 1746092 - RNA, 15 nt, Human
cucacauuuauucug

SEQ ID NO: 1746093 - RNA, 22 nt, Human
cucacauuuauucugcucacau

SEQ ID NO: 1746094 - RNA, 15 nt, Human
cucaccagccccagu

SEQ ID NO: 1746095 - RNA, 14 nt, Human
cucaccagccccag

SEQ ID NO: 1746096 - RNA, 13 nt, Human
cucaccagcccca

SEQ ID NO: 1746097 - RNA, 18 nt, Human
cucaccagccccagugcc

SEQ ID NO: 1746098 - RNA, 17 nt, Human
cucaccagccccagugc

SEQ ID NO: 1746099 - RNA, 15 nt, Human
cucacaguccuuacc

SEQ ID NO: 1746100 - RNA, 24 nt, Human
cucacacaugagcaucaggccagg

SEQ ID NO: 1746101 - RNA, 22 nt, Human
cucacacaugagcaucaggcca

SEQ ID NO: 1746102 - RNA, 21 nt, Human
cucaaguccucuuuucugaga

SEQ ID NO: 1746103 - RNA, 16 nt, Human
cucaagacuuccagag

SEQ ID NO: 1746104 - RNA, 17 nt, Human
cucaagugauucuccug

SEQ ID NO: 1746105 - RNA, 14 nt, Human
cucaagacuuccag

SEQ ID NO: 1746106 - RNA, 24 nt, Human
cuaggugacagagugagacucugu

SEQ ID NO: 1746107 - RNA, 18 nt, Human
cuaggugacagagugaga

SEQ ID NO: 1746108 - RNA, 14 nt, Human
cuaggugacagagu

SEQ ID NO: 1746109 - RNA, 22 nt, Human
cgcccaguuggguggaugccug

SEQ ID NO: 1746110 - RNA, 15 nt, Human
cgccaugcuccuggc

SEQ ID NO: 1746111 - RNA, 20 nt, Human
cgccaucccagccccaauga

SEQ ID NO: 1746112 - RNA, 23 nt, Human
cgcccaguuggguggaugccugg

SEQ ID NO: 1746113 - RNA, 22 nt, Human
cuagguaaauuacaguuccuag

SEQ ID NO: 1746114 - RNA, 17 nt, Human
cuauagccuaggugaca

SEQ ID NO: 1746115 - RNA, 16 nt, Human
cuauaauguaagcucu

SEQ ID NO: 1746116 - RNA, 22 nt, Human
cuauaauuuaccugaagucuuu

SEQ ID NO: 1746117 - RNA, 21 nt, Human
cuauaauguaagcucuacuga

SEQ ID NO: 1746118 - RNA, 13 nt, Human
cuauggccugugg

SEQ ID NO: 1746119 - RNA, 20 nt, Human
cuaugcagagguccacaaca

SEQ ID NO: 1746120 - RNA, 15 nt, Human
cuauuagagaagaga

SEQ ID NO: 1746121 - RNA, 23 nt, Human
cuaugggacucaaugcacugaca

SEQ ID NO: 1746122 - RNA, 22 nt, Human
cuaugggacucaaugcacugac

SEQ ID NO: 1746123 - RNA, 18 nt, Human
cuaugggacucaaugcac

SEQ ID NO: 1746124 - RNA, 18 nt, Human
cuccaaaauaaaacuuuu

SEQ ID NO: 1746125 - RNA, 18 nt, Human
cucauuugucacacacuu

SEQ ID NO: 1746126 - RNA, 15 nt, Human
cuccaaaauaaaacu

SEQ ID NO: 1746127 - RNA, 16 nt, Human
cuccaaaauaaaacuu

SEQ ID NO: 1746128 - RNA, 17 nt, Human
cucauuugucacacacu

SEQ ID NO: 1746129 - RNA, 13 nt, Human
cucauuaaaaaaa

SEQ ID NO: 1746130 - RNA, 15 nt, Human
cuccaauuuuuuaag

SEQ ID NO: 1746131 - RNA, 23 nt, Human
cuccaauuuuuuaagugaaaaua

SEQ ID NO: 1746132 - RNA, 22 nt, Human
cuccaaucccaccaacccucag

SEQ ID NO: 1746133 - RNA, 13 nt, Human
cuccacccugcuc

SEQ ID NO: 1746134 - RNA, 15 nt, Human
cuccacccugcucuc

SEQ ID NO: 1746135 - RNA, 12 nt, Human
cuccauccugag

SEQ ID NO: 1746136 - RNA, 23 nt, Human
cuccaggagcagccacauuccug

SEQ ID NO: 1746137 - RNA, 18 nt, Human
cuccaggagcagccacau

SEQ ID NO: 1746138 - RNA, 17 nt, Human
cuccaggagcagccaca

SEQ ID NO: 1746139 - RNA, 16 nt, Human
cuccaggagcagccac

SEQ ID NO: 1746140 - RNA, 15 nt, Human
cuccaggagcagcca

SEQ ID NO: 1746141 - RNA, 14 nt, Human
cuccaggagcagcc

SEQ ID NO: 1746142 - RNA, 13 nt, Human
cuccaggagcagc

SEQ ID NO: 1746143 - RNA, 11 nt, Human
cuccaggagca

SEQ ID NO: 1746144 - RNA, 12 nt, Human
cuccagccuggg

SEQ ID NO: 1746145 - RNA, 14 nt, Human
cuccagcucaccag

SEQ ID NO: 1746146 - RNA, 17 nt, Human
cuccagccccuggaugc

SEQ ID NO: 1746147 - RNA, 16 nt, Human
cuccagccccuggaug

SEQ ID NO: 1746148 - RNA, 20 nt, Human
cuccagccccuggaugcagc

SEQ ID NO: 1746149 - RNA, 15 nt, Human
cuccagccccuggau

SEQ ID NO: 1746150 - RNA, 13 nt, Human
cuccaccugccag

SEQ ID NO: 1746151 - RNA, 12 nt, Human
cuccaccugcca

SEQ ID NO: 1746152 - RNA, 14 nt, Human
cuccaccugccagg

SEQ ID NO: 1746153 - RNA, 15 nt, Human
cuccaccugccaggg

SEQ ID NO: 1746154 - RNA, 20 nt, Human
cucaggugagaagcagagga

SEQ ID NO: 1746155 - RNA, 19 nt, Human
cucaggugagaagcagagg

SEQ ID NO: 1746156 - RNA, 16 nt, Human
cucaggugagaagcag

SEQ ID NO: 1746157 - RNA, 18 nt, Human
cucagggucccugguggc

SEQ ID NO: 1746158 - RNA, 17 nt, Human
cucagggucccuggugg

SEQ ID NO: 1746159 - RNA, 16 nt, Human
cucagggucccuggug

SEQ ID NO: 1746160 - RNA, 15 nt, Human
cucagggucccuggu

SEQ ID NO: 1746161 - RNA, 15 nt, Human
cucagggccuggucg

SEQ ID NO: 1746162 - RNA, 16 nt, Human
cucagggccuggcuca

SEQ ID NO: 1746163 - RNA, 13 nt, Human
cucagggccuggc

SEQ ID NO: 1746164 - RNA, 15 nt, Human
cucagggccuggcuc

SEQ ID NO: 1746165 - RNA, 14 nt, Human
cucagggccuggcu

SEQ ID NO: 1746166 - RNA, 18 nt, Human
cucagcauccuggcaccc

SEQ ID NO: 1746167 - RNA, 23 nt, Human
cucaggaguuugagaccaaccug

SEQ ID NO: 1746168 - RNA, 18 nt, Human
cucaggaguuugagacca

SEQ ID NO: 1746169 - RNA, 21 nt, Human
cucagcccacauagugauggu

SEQ ID NO: 1746170 - RNA, 19 nt, Human
cucagcccacauagugaug

SEQ ID NO: 1746171 - RNA, 15 nt, Human
cucauccucauaccc

SEQ ID NO: 1746172 - RNA, 23 nt, Human
cucauaguaugguggcuggguug

SEQ ID NO: 1746173 - RNA, 21 nt, Human
cucaucaccaacgucugugcc

SEQ ID NO: 1746174 - RNA, 22 nt, Human
cucaucaccaacgucugugcca

SEQ ID NO: 1746175 - RNA, 21 nt, Human
cucauacccacccccacccaa

SEQ ID NO: 1746176 - RNA, 19 nt, Human
cucauacccacccccaccc

SEQ ID NO: 1746177 - RNA, 18 nt, Human
cucauacccacccccacc

SEQ ID NO: 1746178 - RNA, 16 nt, Human
cucauacccaccccca

SEQ ID NO: 1746179 - RNA, 19 nt, Human
cucaggugauccacccacc

SEQ ID NO: 1746180 - RNA, 18 nt, Human
cucaggugauccacccac

SEQ ID NO: 1746181 - RNA, 20 nt, Human
cucaggugauccacccaccu

SEQ ID NO: 1746182 - RNA, 22 nt, Human
cucaggugauccacccaccuca

SEQ ID NO: 1746183 - RNA, 21 nt, Human
cucauaguaugguggcugggu

SEQ ID NO: 1746184 - RNA, 21 nt, Human
cucauagcccucacccugggg

SEQ ID NO: 1746185 - RNA, 20 nt, Human
cucauagcccucacccuggg

SEQ ID NO: 1746186 - RNA, 17 nt, Human
cucauagcccucacccu

SEQ ID NO: 1746187 - RNA, 13 nt, Human
cucauagcccuca

SEQ ID NO: 1746188 - RNA, 14 nt, Human
cucauacucaccuc

SEQ ID NO: 1746189 - RNA, 22 nt, Human
cucauacucaccucaccccacu

SEQ ID NO: 1746190 - RNA, 14 nt, Human
cuccauccugaggc

SEQ ID NO: 1746191 - RNA, 13 nt, Human
cuccauccugagg

SEQ ID NO: 1746192 - RNA, 23 nt, Human
cuccccagcaagugagagcuggg

SEQ ID NO: 1746193 - RNA, 22 nt, Human
cuccccagcaagugagagcugg

SEQ ID NO: 1746194 - RNA, 20 nt, Human
cuccccuccuccuggacucc

SEQ ID NO: 1746195 - RNA, 12 nt, Human
cuccccuccucc

SEQ ID NO: 1746196 - RNA, 20 nt, Human
cucccgaguagcugggacua

SEQ ID NO: 1746197 - RNA, 19 nt, Human
cucccgaguagcugggacu

SEQ ID NO: 1746198 - RNA, 21 nt, Human
cucccggugcccaagaauaga

SEQ ID NO: 1746199 - RNA, 15 nt, Human
cucccggugcccaag

SEQ ID NO: 1746200 - RNA, 21 nt, Human
cucccugccccucccuucaac

SEQ ID NO: 1746201 - RNA, 20 nt, Human
cucccugccccucccuucaa

SEQ ID NO: 1746202 - RNA, 18 nt, Human
cucccugccccucccuuc

SEQ ID NO: 1746203 - RNA, 17 nt, Human
cucccugccccucccuu

SEQ ID NO: 1746204 - RNA, 14 nt, Human
cucccugccccucc

SEQ ID NO: 1746205 - RNA, 13 nt, Human
cucccugccccuc

SEQ ID NO: 1746206 - RNA, 23 nt, Human
cucccugccccccagcccuccuu

SEQ ID NO: 1746207 - RNA, 17 nt, Human
cucccugccccccagcc

SEQ ID NO: 1746208 - RNA, 12 nt, Human
cucccuuucaac

SEQ ID NO: 1746209 - RNA, 19 nt, Human
cucccuuggggccuaugca

SEQ ID NO: 1746210 - RNA, 18 nt, Human
cuccucagaucuucugug

SEQ ID NO: 1746211 - RNA, 15 nt, Human
cuccuccagagucag

SEQ ID NO: 1746212 - RNA, 13 nt, Human
cuccuccagaguc

SEQ ID NO: 1746213 - RNA, 15 nt, Human
cuccuccagccgcca

SEQ ID NO: 1746214 - RNA, 22 nt, Human
cuccuccagccgccaugcuccu

SEQ ID NO: 1746215 - RNA, 23 nt, Human
cuccucccaggcgccccuucccc

SEQ ID NO: 1746216 - RNA, 22 nt, Human
cuccucccaggcgccccuuccc

SEQ ID NO: 1746217 - RNA, 17 nt, Human
cuccucccaggcgcccc

SEQ ID NO: 1746218 - RNA, 19 nt, Human
cuccuccuggacuccugca

SEQ ID NO: 1746219 - RNA, 15 nt, Human
cuccuccuggacucc

SEQ ID NO: 1746220 - RNA, 14 nt, Human
cuccuccuggacuc

SEQ ID NO: 1746221 - RNA, 21 nt, Human
cuccugccucgaacuggcugc

SEQ ID NO: 1746222 - RNA, 20 nt, Human
cuccugccucgaacuggcug

SEQ ID NO: 1746223 - RNA, 18 nt, Human
cuccugccucgaacuggc

SEQ ID NO: 1746224 - RNA, 19 nt, Human
cuccugccucagccucccg

SEQ ID NO: 1746225 - RNA, 21 nt, Human
cuccugccucagccuccugag

SEQ ID NO: 1746226 - RNA, 22 nt, Human
cuccugccucgaacuggcugca

SEQ ID NO: 1746227 - RNA, 15 nt, Human
cuccucuccccagca

SEQ ID NO: 1746228 - RNA, 13 nt, Human
cuccucuccccag

SEQ ID NO: 1746229 - RNA, 11 nt, Human
cuccugccuca

SEQ ID NO: 1746230 - RNA, 12 nt, Human
cuccugccucag

SEQ ID NO: 1746231 - RNA, 17 nt, Human
cuccugccucagccucc

SEQ ID NO: 1746232 - RNA, 14 nt, Human
cuccuggaaauauu

SEQ ID NO: 1746233 - RNA, 24 nt, Human
cuccugugugugcgccuacaggag

SEQ ID NO: 1746234 - RNA, 23 nt, Human
cuccugugugugcgccuacagga

SEQ ID NO: 1746235 - RNA, 21 nt, Human
cuccugugugugcgccuacag

SEQ ID NO: 1746236 - RNA, 11 nt, Human
cuccuggacuc

SEQ ID NO: 1746237 - RNA, 22 nt, Human
cuccuuaucaaaggacaccauu

SEQ ID NO: 1746238 - RNA, 17 nt, Human
cuccuuaucaaaggaca

SEQ ID NO: 1746239 - RNA, 12 nt, Human
cuccuggacucc

SEQ ID NO: 1746240 - RNA, 13 nt, Human
cuccuuagaagug

SEQ ID NO: 1746241 - RNA, 17 nt, Human
cuccuuagaaguggaag

SEQ ID NO: 1746242 - RNA, 20 nt, Human
cuccuuagaaguggaaguag

SEQ ID NO: 1746243 - RNA, 23 nt, Human
cuccuuggugucgggcaugacac

SEQ ID NO: 1746244 - RNA, 19 nt, Human
cucgagcaugccuggaugg

SEQ ID NO: 1746245 - RNA, 16 nt, Human
cucgagcaugccugga

SEQ ID NO: 1746246 - RNA, 15 nt, Human
cucgagcaugccugg

SEQ ID NO: 1746247 - RNA, 13 nt, Human
cucgagcaugccu

SEQ ID NO: 1746248 - RNA, 22 nt, Human
cucgagcaugccuggauggggc

SEQ ID NO: 1746249 - RNA, 23 nt, Human
cucgcucugucgcccaggcugga

SEQ ID NO: 1746250 - RNA, 15 nt, Human
cucgccuucaucucc

SEQ ID NO: 1746251 - RNA, 14 nt, Human
cugagccagauuuc

SEQ ID NO: 1746252 - RNA, 13 nt, Human
cugagccagauuu

SEQ ID NO: 1746253 - RNA, 15 nt, Human
cugagccagauuuca

SEQ ID NO: 1746254 - RNA, 22 nt, Human
cugagacagcccgggcucugcc

SEQ ID NO: 1746255 - RNA, 21 nt, Human
cugagacagcccgggcucugc

SEQ ID NO: 1746256 - RNA, 19 nt, Human
cugagacagcccgggcucu

SEQ ID NO: 1746257 - RNA, 20 nt, Human
cugagacagcccgggcucug

SEQ ID NO: 1746258 - RNA, 23 nt, Human
cugagauuauaggcaccuaccac

SEQ ID NO: 1746259 - RNA, 21 nt, Human
cugagcaaauguggcuccugg

SEQ ID NO: 1746260 - RNA, 20 nt, Human
cugagcaaauguggcuccug

SEQ ID NO: 1746261 - RNA, 17 nt, Human
cugagcaaauguggcuc

SEQ ID NO: 1746262 - RNA, 15 nt, Human
cugagcaaauguggc

SEQ ID NO: 1746263 - RNA, 17 nt, Human
cugacuguacuccuccc

SEQ ID NO: 1746264 - RNA, 18 nt, Human
cugacagacacaggcccg

SEQ ID NO: 1746265 - RNA, 17 nt, Human
cugacagacacaggccc

SEQ ID NO: 1746266 - RNA, 17 nt, Human
cugaccagccuccaugc

SEQ ID NO: 1746267 - RNA, 16 nt, Human
cugacagacacaggcc

SEQ ID NO: 1746268 - RNA, 14 nt, Human
cugaauuucuuuug

SEQ ID NO: 1746269 - RNA, 23 nt, Human
cugaccagccuccaugcugccuc

SEQ ID NO: 1746270 - RNA, 21 nt, Human
cugaccagccuccaugcugcc

SEQ ID NO: 1746271 - RNA, 20 nt, Human
cugaaugguuuucaaaauaa

SEQ ID NO: 1746272 - RNA, 19 nt, Human
cugaaugguuuucaaaaua

SEQ ID NO: 1746273 - RNA, 12 nt, Human
cugaauuucuuu

SEQ ID NO: 1746274 - RNA, 12 nt, Human
cugaauuauuuu

SEQ ID NO: 1746275 - RNA, 17 nt, Human
cugaagucacacaguga

SEQ ID NO: 1746276 - RNA, 19 nt, Human
cugaagucacacagugagu

SEQ ID NO: 1746277 - RNA, 18 nt, Human
cugaagucacacagugag

SEQ ID NO: 1746278 - RNA, 21 nt, Human
cugaagucacacagugagucg

SEQ ID NO: 1746279 - RNA, 15 nt, Human
cugaagucacugcac

SEQ ID NO: 1746280 - RNA, 14 nt, Human
cugaagucacugca

SEQ ID NO: 1746281 - RNA, 13 nt, Human
cugaagucacugc

SEQ ID NO: 1746282 - RNA, 20 nt, Human
cugaagucuuuguacagaca

SEQ ID NO: 1746283 - RNA, 17 nt, Human
cugaagucuuuguacag

SEQ ID NO: 1746284 - RNA, 22 nt, Human
cugaagucccagauacuugggg

SEQ ID NO: 1746285 - RNA, 17 nt, Human
cugaaguucagcugcau

SEQ ID NO: 1746286 - RNA, 20 nt, Human
cucuuuguucuaaagaugga

SEQ ID NO: 1746287 - RNA, 23 nt, Human
cugaaagggacgcuacccgggaa

SEQ ID NO: 1746288 - RNA, 14 nt, Human
cucuuuucaaaaca

SEQ ID NO: 1746289 - RNA, 23 nt, Human
cucuuuggucuacacugugcuga

SEQ ID NO: 1746290 - RNA, 22 nt, Human
cucuuuggucuacacugugcug

SEQ ID NO: 1746291 - RNA, 16 nt, Human
cucuucuccaggcugu

SEQ ID NO: 1746292 - RNA, 15 nt, Human
cugaacauuccagag

SEQ ID NO: 1746293 - RNA, 16 nt, Human
cucugacaacagacuu

SEQ ID NO: 1746294 - RNA, 22 nt, Human
cucugaaggacauugcggacag

SEQ ID NO: 1746295 - RNA, 23 nt, Human
cucugacagaagaaccccagggu

SEQ ID NO: 1746296 - RNA, 19 nt, Human
cucugacacacagcucugu

SEQ ID NO: 1746297 - RNA, 18 nt, Human
cucugacacacagcucug

SEQ ID NO: 1746298 - RNA, 17 nt, Human
cucugacacacagcucu

SEQ ID NO: 1746299 - RNA, 16 nt, Human
cucugacacacagcuc

SEQ ID NO: 1746300 - RNA, 15 nt, Human
cucugacacacagcu

SEQ ID NO: 1746301 - RNA, 14 nt, Human
cucugacacacagc

SEQ ID NO: 1746302 - RNA, 22 nt, Human
cucugacaacagacuucugaaa

SEQ ID NO: 1746303 - RNA, 21 nt, Human
cucugacaacagacuucugaa

SEQ ID NO: 1746304 - RNA, 21 nt, Human
cucugagacucgcgacaaugc

SEQ ID NO: 1746305 - RNA, 14 nt, Human
cucugaggacacua

SEQ ID NO: 1746306 - RNA, 12 nt, Human
cucugaggacac

SEQ ID NO: 1746307 - RNA, 16 nt, Human
cucugaggacacuaac

SEQ ID NO: 1746308 - RNA, 23 nt, Human
cucugagacucgcgacaaugcaa

SEQ ID NO: 1746309 - RNA, 12 nt, Human
cucugaggacaa

SEQ ID NO: 1746310 - RNA, 17 nt, Human
cucugccucccaucacc

SEQ ID NO: 1746311 - RNA, 16 nt, Human
cucugccucccaucac

SEQ ID NO: 1746312 - RNA, 14 nt, Human
cucugccucccauc

SEQ ID NO: 1746313 - RNA, 13 nt, Human
cucugccucccau

SEQ ID NO: 1746314 - RNA, 20 nt, Human
cucugcccuaaugcgcaggc

SEQ ID NO: 1746315 - RNA, 22 nt, Human
cucugcccuaaugcgcaggcug

SEQ ID NO: 1746316 - RNA, 17 nt, Human
cucugcccacucccugc

SEQ ID NO: 1746317 - RNA, 16 nt, Human
cucugcccacucccug

SEQ ID NO: 1746318 - RNA, 15 nt, Human
cucugcccacucccu

SEQ ID NO: 1746319 - RNA, 13 nt, Human
cucugcccacucc

SEQ ID NO: 1746320 - RNA, 20 nt, Human
cucugcccacucccugcaac

SEQ ID NO: 1746321 - RNA, 18 nt, Human
cucugcccacucccugca

SEQ ID NO: 1746322 - RNA, 18 nt, Human
cucugcaggucccuaaua

SEQ ID NO: 1746323 - RNA, 22 nt, Human
cucugcaggucccuaauaaagc

SEQ ID NO: 1746324 - RNA, 21 nt, Human
cucugcaggucccuaauaaag

SEQ ID NO: 1746325 - RNA, 15 nt, Human
cucugcacaagcugc

SEQ ID NO: 1746326 - RNA, 14 nt, Human
cucugcacaagcug

SEQ ID NO: 1746327 - RNA, 20 nt, Human
cucugcaggucccuaauaaa

SEQ ID NO: 1746328 - RNA, 19 nt, Human
cucugcaggucccuaauaa

SEQ ID NO: 1746329 - RNA, 13 nt, Human
cucugcacaagcu

SEQ ID NO: 1746330 - RNA, 20 nt, Human
cucuguugcccaggcuggag

SEQ ID NO: 1746331 - RNA, 22 nt, Human
cucuguugcccaggcuggagug

SEQ ID NO: 1746332 - RNA, 23 nt, Human
cucugugucagguggggcagcuu

SEQ ID NO: 1746333 - RNA, 22 nt, Human
cucugugucagguggggcagcu

SEQ ID NO: 1746334 - RNA, 21 nt, Human
cucugugucagguggggcagc

SEQ ID NO: 1746335 - RNA, 20 nt, Human
cucugugucagguggggcag

SEQ ID NO: 1746336 - RNA, 13 nt, Human
cucuucuccaggc

SEQ ID NO: 1746337 - RNA, 15 nt, Human
cucuucuccaggcug

SEQ ID NO: 1746338 - RNA, 13 nt, Human
cucuucuccacug

SEQ ID NO: 1746339 - RNA, 12 nt, Human
cucuucuccacu

SEQ ID NO: 1746340 - RNA, 21 nt, Human
cucuggccuucggccuccauc

SEQ ID NO: 1746341 - RNA, 22 nt, Human
cucuggccuucggccuccaucc

SEQ ID NO: 1746342 - RNA, 23 nt, Human
cucuggcagcucagagagggugg

SEQ ID NO: 1746343 - RNA, 20 nt, Human
cucugccucugacacacagc

SEQ ID NO: 1746344 - RNA, 19 nt, Human
cucugccucugacacacag

SEQ ID NO: 1746345 - RNA, 21 nt, Human
cucugccucccaucacccgcu

SEQ ID NO: 1746346 - RNA, 10 nt, Human
cucugccuga

SEQ ID NO: 1746347 - RNA, 20 nt, Human
cucuggauuauauuaugaag

SEQ ID NO: 1746348 - RNA, 19 nt, Human
cucuggauuauauuaugaa

SEQ ID NO: 1746349 - RNA, 22 nt, Human
cucuguccugggagugagcugg

SEQ ID NO: 1746350 - RNA, 15 nt, Human
cucuguccugggagu

SEQ ID NO: 1746351 - RNA, 14 nt, Human
cucuguccugggag

SEQ ID NO: 1746352 - RNA, 13 nt, Human
cucugucgcccag

SEQ ID NO: 1746353 - RNA, 15 nt, Human
cucugucgcccaggc

SEQ ID NO: 1746354 - RNA, 17 nt, Human
cucugucgcccagucug

SEQ ID NO: 1746355 - RNA, 22 nt, Human
cucugucgcccaggcuggagug

SEQ ID NO: 1746356 - RNA, 18 nt, Human
cucugucgcccaggcugg

SEQ ID NO: 1746357 - RNA, 19 nt, Human
cucugucgcccagucugga

SEQ ID NO: 1746358 - RNA, 18 nt, Human
cucugucgcccagucugg

SEQ ID NO: 1746359 - RNA, 18 nt, Human
cugcgguccacccaggag

SEQ ID NO: 1746360 - RNA, 20 nt, Human
cugcgguccacccaggagcc

SEQ ID NO: 1746361 - RNA, 19 nt, Human
cugcgguccacccaggagc

SEQ ID NO: 1746362 - RNA, 22 nt, Human
cugccugcccaggccccugcca

SEQ ID NO: 1746363 - RNA, 21 nt, Human
cugccugcccaggccccugcc

SEQ ID NO: 1746364 - RNA, 21 nt, Human
cugccucugacacacagcucu

SEQ ID NO: 1746365 - RNA, 18 nt, Human
cugccucugacacacagc

SEQ ID NO: 1746366 - RNA, 17 nt, Human
cugccucugacacacag

SEQ ID NO: 1746367 - RNA, 19 nt, Human
cugccucucugcagguccc

SEQ ID NO: 1746368 - RNA, 22 nt, Human
cugccgcagcccugcagagggc

SEQ ID NO: 1746369 - RNA, 21 nt, Human
cugccgcagcccugcagaggg

SEQ ID NO: 1746370 - RNA, 20 nt, Human
cugccgcagcccugcagagg

SEQ ID NO: 1746371 - RNA, 19 nt, Human
cugccgcagcccugcagag

SEQ ID NO: 1746372 - RNA, 14 nt, Human
cugccgcagcccug

SEQ ID NO: 1746373 - RNA, 23 nt, Human
cugccgcagcccugcagagggca

SEQ ID NO: 1746374 - RNA, 13 nt, Human
cugccgcagcccu

SEQ ID NO: 1746375 - RNA, 12 nt, Human
cugccgcagccc

SEQ ID NO: 1746376 - RNA, 20 nt, Human
cugccccuccucucugcccu

SEQ ID NO: 1746377 - RNA, 21 nt, Human
cugccccuccucucugcccua

SEQ ID NO: 1746378 - RNA, 19 nt, Human
cugccucagccucccaaag

SEQ ID NO: 1746379 - RNA, 17 nt, Human
cugccucagccucccga

SEQ ID NO: 1746380 - RNA, 15 nt, Human
cugccucagccuccc

SEQ ID NO: 1746381 - RNA, 22 nt, Human
cugccuccagaauggucuuucu

SEQ ID NO: 1746382 - RNA, 14 nt, Human
cugccuccagaaug

SEQ ID NO: 1746383 - RNA, 18 nt, Human
cugccucucugcaggucc

SEQ ID NO: 1746384 - RNA, 17 nt, Human
cugccucucugcagguc

SEQ ID NO: 1746385 - RNA, 16 nt, Human
cugccucucugcaggu

SEQ ID NO: 1746386 - RNA, 15 nt, Human
cugccucucugcagg

SEQ ID NO: 1746387 - RNA, 19 nt, Human
cugcaguugccagucaccc

SEQ ID NO: 1746388 - RNA, 23 nt, Human
cugcacuugcagacucuacagag

SEQ ID NO: 1746389 - RNA, 22 nt, Human
cugcaguugccagucaccccgg

SEQ ID NO: 1746390 - RNA, 21 nt, Human
cugcaguugccagucaccccg

SEQ ID NO: 1746391 - RNA, 22 nt, Human
cugcaucguuucaucuuccaac

SEQ ID NO: 1746392 - RNA, 16 nt, Human
cugcaucguuucaucu

SEQ ID NO: 1746393 - RNA, 20 nt, Human
cugcauccuccgccucccgg

SEQ ID NO: 1746394 - RNA, 19 nt, Human
cugcauccuccgccucccg

SEQ ID NO: 1746395 - RNA, 22 nt, Human
cugcaugcgggcuuccuccugg

SEQ ID NO: 1746396 - RNA, 18 nt, Human
cugcaugcgggcuuccuc

SEQ ID NO: 1746397 - RNA, 19 nt, Human
cugccaaugggagcucaug

SEQ ID NO: 1746398 - RNA, 18 nt, Human
cugccaaugggagcucau

SEQ ID NO: 1746399 - RNA, 16 nt, Human
cugcccacucccugca

SEQ ID NO: 1746400 - RNA, 15 nt, Human
cugcccacucccugc

SEQ ID NO: 1746401 - RNA, 14 nt, Human
cugcccacucccug

SEQ ID NO: 1746402 - RNA, 22 nt, Human
cugcccaccuggccucugcacu

SEQ ID NO: 1746403 - RNA, 20 nt, Human
cugcccaccuggccucugca

SEQ ID NO: 1746404 - RNA, 19 nt, Human
cugcccaccuggccucugc

SEQ ID NO: 1746405 - RNA, 18 nt, Human
cugcccaccuggccucug

SEQ ID NO: 1746406 - RNA, 17 nt, Human
cugcccaccuggccucu

SEQ ID NO: 1746407 - RNA, 18 nt, Human
cugcccacucccugcaac

SEQ ID NO: 1746408 - RNA, 17 nt, Human
cugcccagccuccaagc

SEQ ID NO: 1746409 - RNA, 15 nt, Human
cugcccaccuggccu

SEQ ID NO: 1746410 - RNA, 14 nt, Human
cugcccaccuggcc

SEQ ID NO: 1746411 - RNA, 13 nt, Human
cugcccaccuggc

SEQ ID NO: 1746412 - RNA, 15 nt, Human
cugccaugccagcuu

SEQ ID NO: 1746413 - RNA, 14 nt, Human
cugccaugccagcu

SEQ ID NO: 1746414 - RNA, 13 nt, Human
cugccaggcaugg

SEQ ID NO: 1746415 - RNA, 11 nt, Human
cugccaggcau

SEQ ID NO: 1746416 - RNA, 22 nt, Human
cugcacaagcugcacccucagg

SEQ ID NO: 1746417 - RNA, 13 nt, Human
cugcacacagcac

SEQ ID NO: 1746418 - RNA, 18 nt, Human
cugcaauaaggggagagu

SEQ ID NO: 1746419 - RNA, 17 nt, Human
cugcaaagcccagcuug

SEQ ID NO: 1746420 - RNA, 22 nt, Human
cugcacacgcuccuuccucuga

SEQ ID NO: 1746421 - RNA, 20 nt, Human
cugcacacgcuccuuccucu

SEQ ID NO: 1746422 - RNA, 14 nt, Human
cugcacacagcacg

SEQ ID NO: 1746423 - RNA, 15 nt, Human
cugcacuccccugcu

SEQ ID NO: 1746424 - RNA, 12 nt, Human
cugcaccgggcc

SEQ ID NO: 1746425 - RNA, 23 nt, Human
cugcaccggcuggccuggccccu

SEQ ID NO: 1746426 - RNA, 22 nt, Human
cugcaccggcuggccuggcccc

SEQ ID NO: 1746427 - RNA, 16 nt, Human
cugcacccucaggcag

SEQ ID NO: 1746428 - RNA, 14 nt, Human
cugcacccucaggc

SEQ ID NO: 1746429 - RNA, 13 nt, Human
cugcacccucagg

SEQ ID NO: 1746430 - RNA, 18 nt, Human
cugcacuccccugcuggg

SEQ ID NO: 1746431 - RNA, 17 nt, Human
cugcacuccccugcugg

SEQ ID NO: 1746432 - RNA, 16 nt, Human
cugcacuccccugcug

SEQ ID NO: 1746433 - RNA, 18 nt, Human
cugcacuugcagacucua

SEQ ID NO: 1746434 - RNA, 21 nt, Human
cugauugugucucuugguccu

SEQ ID NO: 1746435 - RNA, 21 nt, Human
cugauggugcaaugaccuuuc

SEQ ID NO: 1746436 - RNA, 20 nt, Human
cugauggugcaaugaccuuu

SEQ ID NO: 1746437 - RNA, 19 nt, Human
cugauggugcaaugaccuu

SEQ ID NO: 1746438 - RNA, 17 nt, Human
cugauggugcaaugacc

SEQ ID NO: 1746439 - RNA, 17 nt, Human
cugauugugucucuugg

SEQ ID NO: 1746440 - RNA, 22 nt, Human
cugauuuuuuuuuccuucagug

SEQ ID NO: 1746441 - RNA, 21 nt, Human
cugauuuuuuuuuccuucagu

SEQ ID NO: 1746442 - RNA, 23 nt, Human
cugauuuuuuuuuccuucagugc

SEQ ID NO: 1746443 - RNA, 15 nt, Human
cugcaaagcccagcu

SEQ ID NO: 1746444 - RNA, 13 nt, Human
cugcaaagcccag

SEQ ID NO: 1746445 - RNA, 20 nt, Human
cugauuuuuuuuuccuucag

SEQ ID NO: 1746446 - RNA, 19 nt, Human
cugauuuuuuuuuccuuca

SEQ ID NO: 1746447 - RNA, 18 nt, Human
cugauuuuuuuuuccuuc

SEQ ID NO: 1746448 - RNA, 16 nt, Human
cugauuuuuuuuuccu

SEQ ID NO: 1746449 - RNA, 19 nt, Human
cugagucugaaggcugggu

SEQ ID NO: 1746450 - RNA, 18 nt, Human
cugagucugaaggcuggg

SEQ ID NO: 1746451 - RNA, 20 nt, Human
cugagucccaggcugagccu

SEQ ID NO: 1746452 - RNA, 16 nt, Human
cugauggugcaaugac

SEQ ID NO: 1746453 - RNA, 15 nt, Human
cugauggugcaauga

SEQ ID NO: 1746454 - RNA, 14 nt, Human
cugauggugcaaug

SEQ ID NO: 1746455 - RNA, 21 nt, Human
cugauccuaguuccaccauca

SEQ ID NO: 1746456 - RNA, 20 nt, Human
cugauccuaguuccaccauc

SEQ ID NO: 1746457 - RNA, 15 nt, Human
cugaucaccugcccu

SEQ ID NO: 1746458 - RNA, 15 nt, Human
cugaggcuccacuug

SEQ ID NO: 1746459 - RNA, 21 nt, Human
cugaggcuccacuuggucugu

SEQ ID NO: 1746460 - RNA, 24 nt, Human
cugaggcccuucucuccagccccu

SEQ ID NO: 1746461 - RNA, 22 nt, Human
cugaggcugggcucccuuccca

SEQ ID NO: 1746462 - RNA, 17 nt, Human
cugaggcugggcucccu

SEQ ID NO: 1746463 - RNA, 16 nt, Human
cugaggcugggcuccc

SEQ ID NO: 1746464 - RNA, 15 nt, Human
cugaggcugggcucc

SEQ ID NO: 1746465 - RNA, 13 nt, Human
cugaggcugggcu

SEQ ID NO: 1746466 - RNA, 21 nt, Human
gaacuuguaaaggaauuuaaa

SEQ ID NO: 1746467 - RNA, 23 nt, Human
gaacuugguucccauuugcuccu

SEQ ID NO: 1746468 - RNA, 16 nt, Human
gaacuuggcgcugccc

SEQ ID NO: 1746469 - RNA, 15 nt, Human
gaacuuggcgcugcc

SEQ ID NO: 1746470 - RNA, 13 nt, Human
gaacuuggcgcug

SEQ ID NO: 1746471 - RNA, 15 nt, Human
gaacucccuuucaac

SEQ ID NO: 1746472 - RNA, 22 nt, Human
gaacuggguacuuguggacaca

SEQ ID NO: 1746473 - RNA, 14 nt, Human
gaacucccuuucaa

SEQ ID NO: 1746474 - RNA, 11 nt, Human
gaaccugaccc

SEQ ID NO: 1746475 - RNA, 12 nt, Human
gaaccugacccc

SEQ ID NO: 1746476 - RNA, 17 nt, Human
gaaccaccacacccagc

SEQ ID NO: 1746477 - RNA, 16 nt, Human
gaaccaccacacccag

SEQ ID NO: 1746478 - RNA, 21 nt, Human
gaaccacaucuugcucugcug

SEQ ID NO: 1746479 - RNA, 19 nt, Human
gaacagacuggaagcacag

SEQ ID NO: 1746480 - RNA, 16 nt, Human
gaacagacuggaagca

SEQ ID NO: 1746481 - RNA, 15 nt, Human
gaacagacuggaagc

SEQ ID NO: 1746482 - RNA, 18 nt, Human
gaaauagacagcaugaga

SEQ ID NO: 1746483 - RNA, 17 nt, Human
gaaauacagacuggaug

SEQ ID NO: 1746484 - RNA, 13 nt, Human
gaaauauaauuga

SEQ ID NO: 1746485 - RNA, 21 nt, Human
gaaauaucugaaaauguaugu

SEQ ID NO: 1746486 - RNA, 20 nt, Human
gaaacaugacucguauaugu

SEQ ID NO: 1746487 - RNA, 23 nt, Human
gaaaugcugguuuuucaguuuuc

SEQ ID NO: 1746488 - RNA, 20 nt, Human
gaaaugggcagagcagagac

SEQ ID NO: 1746489 - RNA, 14 nt, Human
gaaaugggcagagc

SEQ ID NO: 1746490 - RNA, 19 nt, Human
gaaauugcauuuccugaca

SEQ ID NO: 1746491 - RNA, 17 nt, Human
gaaauuuguuauaauga

SEQ ID NO: 1746492 - RNA, 20 nt, Human
gaauaauccuaaacauauga

SEQ ID NO: 1746493 - RNA, 14 nt, Human
gaauaacauguaau

SEQ ID NO: 1746494 - RNA, 15 nt, Human
gaauaaauugcuccu

SEQ ID NO: 1746495 - RNA, 14 nt, Human
gaauacuuuauaaa

SEQ ID NO: 1746496 - RNA, 24 nt, Human
gaauacuuugcagcacagcugaga

SEQ ID NO: 1746497 - RNA, 17 nt, Human
gaauagaagcuaagguu

SEQ ID NO: 1746498 - RNA, 12 nt, Human
gaaguuucugcc

SEQ ID NO: 1746499 - RNA, 12 nt, Human
gaauaaaauuuu

SEQ ID NO: 1746500 - RNA, 14 nt, Human
gaauaaagacaccu

SEQ ID NO: 1746501 - RNA, 16 nt, Human
gaaucucaaauaacua

SEQ ID NO: 1746502 - RNA, 21 nt, Human
gaaugaaagggcccagagagg

SEQ ID NO: 1746503 - RNA, 19 nt, Human
gaaugaaagggcccagaga

SEQ ID NO: 1746504 - RNA, 14 nt, Human
gaaugaaagggccc

SEQ ID NO: 1746505 - RNA, 14 nt, Human
gaauagcugggacu

SEQ ID NO: 1746506 - RNA, 15 nt, Human
gaauagaugcugacu

SEQ ID NO: 1746507 - RNA, 18 nt, Human
gaauagaagcuaagguuu

SEQ ID NO: 1746508 - RNA, 15 nt, Human
gaauagcugggacua

SEQ ID NO: 1746509 - RNA, 18 nt, Human
gaauccagacccggcugc

SEQ ID NO: 1746510 - RNA, 15 nt, Human
gaaggccccgcccag

SEQ ID NO: 1746511 - RNA, 14 nt, Human
gaaggccccgccca

SEQ ID NO: 1746512 - RNA, 16 nt, Human
gaaggccccgcccagg

SEQ ID NO: 1746513 - RNA, 14 nt, Human
gaaggcagggaggg

SEQ ID NO: 1746514 - RNA, 13 nt, Human
gaaggcagggagg

SEQ ID NO: 1746515 - RNA, 21 nt, Human
gaaggauacaaaagcauguga

SEQ ID NO: 1746516 - RNA, 12 nt, Human
gaaggauacaaa

SEQ ID NO: 1746517 - RNA, 19 nt, Human
gaaggauacaaaagcaugu

SEQ ID NO: 1746518 - RNA, 18 nt, Human
gaaggaaacccagcucug

SEQ ID NO: 1746519 - RNA, 23 nt, Human
gaaggacccggaggggccuggca

SEQ ID NO: 1746520 - RNA, 17 nt, Human
gaaggaaacccagcucu

SEQ ID NO: 1746521 - RNA, 14 nt, Human
gaaggaaacccagc

SEQ ID NO: 1746522 - RNA, 14 nt, Human
gaagaagcucucuc

SEQ ID NO: 1746523 - RNA, 21 nt, Human
gaagacucauucuucuguacg

SEQ ID NO: 1746524 - RNA, 19 nt, Human
gaagacucauucuucugua

SEQ ID NO: 1746525 - RNA, 16 nt, Human
gaagccagcaggcucu

SEQ ID NO: 1746526 - RNA, 15 nt, Human
gaagccagcaggcuc

SEQ ID NO: 1746527 - RNA, 22 nt, Human
gaagccacgguguucugugaua

SEQ ID NO: 1746528 - RNA, 23 nt, Human
gaagccagcaggcucucaggcca

SEQ ID NO: 1746529 - RNA, 19 nt, Human
gaagccagcaggcucucag

SEQ ID NO: 1746530 - RNA, 14 nt, Human
gaagcggcuggcag

SEQ ID NO: 1746531 - RNA, 11 nt, Human
gaagccuuugu

SEQ ID NO: 1746532 - RNA, 10 nt, Human
gaagccuuug

SEQ ID NO: 1746533 - RNA, 18 nt, Human
gaagcuuuuaugugaaac

SEQ ID NO: 1746534 - RNA, 22 nt, Human
gaagcccaggaaaggcuccagg

SEQ ID NO: 1746535 - RNA, 21 nt, Human
gaagcccaggaaaggcuccag

SEQ ID NO: 1746536 - RNA, 20 nt, Human
gaagcccaggaaaggcucca

SEQ ID NO: 1746537 - RNA, 23 nt, Human
gaagcccaggaaaggcuccagga

SEQ ID NO: 1746538 - RNA, 19 nt, Human
gaaaaccaagccguggcuu

SEQ ID NO: 1746539 - RNA, 18 nt, Human
gaaaaccaagccguggcu

SEQ ID NO: 1746540 - RNA, 21 nt, Human
gaaaaccaagccguggcuucc

SEQ ID NO: 1746541 - RNA, 16 nt, Human
gaaaacguggcugcuu

SEQ ID NO: 1746542 - RNA, 15 nt, Human
gaaaacguggcugcu

SEQ ID NO: 1746543 - RNA, 18 nt, Human
gaaaacguggcugcuuca

SEQ ID NO: 1746544 - RNA, 19 nt, Human
gaaaacguggcugcuucaa

SEQ ID NO: 1746545 - RNA, 22 nt, Human
gaaaacaauaacgauaaaagac

SEQ ID NO: 1746546 - RNA, 13 nt, Human
gaaaacacauuuu

SEQ ID NO: 1746547 - RNA, 14 nt, Human
gaaaacacauuuuu

SEQ ID NO: 1746548 - RNA, 12 nt, Human
gaaaacaugcua

SEQ ID NO: 1746549 - RNA, 14 nt, Human
gaaaacaugcuaca

SEQ ID NO: 1746550 - RNA, 15 nt, Human
gaaaacaugcuacac

SEQ ID NO: 1746551 - RNA, 15 nt, Human
cuuuuuucacuacau

SEQ ID NO: 1746552 - RNA, 14 nt, Human
cuuuuuucuaaagu

SEQ ID NO: 1746553 - RNA, 21 nt, Human
cuuuugagugccuuacacaau

SEQ ID NO: 1746554 - RNA, 16 nt, Human
cuuuugagcauuuaga

SEQ ID NO: 1746555 - RNA, 16 nt, Human
cuuuuuuggcugcuga

SEQ ID NO: 1746556 - RNA, 23 nt, Human
gaaaaaggaugcacagaguuguu

SEQ ID NO: 1746557 - RNA, 17 nt, Human
gaaaaaggaugcacaga

SEQ ID NO: 1746558 - RNA, 15 nt, Human
cuuuuuuggcugcug

SEQ ID NO: 1746559 - RNA, 14 nt, Human
cuuuuuuggcugcu

SEQ ID NO: 1746560 - RNA, 19 nt, Human
gaaaaucuuauaauuuaaa

SEQ ID NO: 1746561 - RNA, 18 nt, Human
gaaaaucagccugcucca

SEQ ID NO: 1746562 - RNA, 16 nt, Human
gaaaaucagccugcuc

SEQ ID NO: 1746563 - RNA, 14 nt, Human
gaaaaucagccugc

SEQ ID NO: 1746564 - RNA, 19 nt, Human
gaaaauaacgauaaaagac

SEQ ID NO: 1746565 - RNA, 17 nt, Human
gaaaagcugcugacagu

SEQ ID NO: 1746566 - RNA, 13 nt, Human
gaaaagcugcuga

SEQ ID NO: 1746567 - RNA, 20 nt, Human
gaaaaucuuauaauuuaaaa

SEQ ID NO: 1746568 - RNA, 22 nt, Human
gaaacacugggcuucuagaacc

SEQ ID NO: 1746569 - RNA, 18 nt, Human
gaaacagcuaaugggaca

SEQ ID NO: 1746570 - RNA, 20 nt, Human
gaaacagcucgacuuuaaaa

SEQ ID NO: 1746571 - RNA, 15 nt, Human
gaaacagcucgacuu

SEQ ID NO: 1746572 - RNA, 16 nt, Human
gaaacacuuugcauaa

SEQ ID NO: 1746573 - RNA, 23 nt, Human
cuuuucuguccgagcuuugaaaa

SEQ ID NO: 1746574 - RNA, 18 nt, Human
cuuuucuguccgagcuuu

SEQ ID NO: 1746575 - RNA, 23 nt, Human
cuuuucuugcaugaggcuagugu

SEQ ID NO: 1746576 - RNA, 18 nt, Human
cuuuucuugcaugaggcu

SEQ ID NO: 1746577 - RNA, 16 nt, Human
cuuuucuuucagccaa

SEQ ID NO: 1746578 - RNA, 20 nt, Human
cuuuucauaaccuagccuua

SEQ ID NO: 1746579 - RNA, 17 nt, Human
cuuuucacugcuggcug

SEQ ID NO: 1746580 - RNA, 20 nt, Human
cuuuucacugcuggcugccu

SEQ ID NO: 1746581 - RNA, 18 nt, Human
cuuuucacugcuggcugc

SEQ ID NO: 1746582 - RNA, 22 nt, Human
cuuuucauaaccuagccuuaga

SEQ ID NO: 1746583 - RNA, 20 nt, Human
cuuuguuuguugucagcuga

SEQ ID NO: 1746584 - RNA, 18 nt, Human
cuuuguuuguugucagcu

SEQ ID NO: 1746585 - RNA, 20 nt, Human
cuuuuacguccaucucuugu

SEQ ID NO: 1746586 - RNA, 15 nt, Human
cuuuguucuggcucu

SEQ ID NO: 1746587 - RNA, 14 nt, Human
cuuuguucuggcuc

SEQ ID NO: 1746588 - RNA, 18 nt, Human
cuuuguucuaaagaugga

SEQ ID NO: 1746589 - RNA, 17 nt, Human
cuuugugauuuuuguaa

SEQ ID NO: 1746590 - RNA, 18 nt, Human
cuuugugauuuuuguaau

SEQ ID NO: 1746591 - RNA, 19 nt, Human
cuuugugauuuuuguaauu

SEQ ID NO: 1746592 - RNA, 18 nt, Human
cuuuguccccaccgcaga

SEQ ID NO: 1746593 - RNA, 13 nt, Human
cuuugggaggcca

SEQ ID NO: 1746594 - RNA, 22 nt, Human
cuuuguccccaccgcagacagg

SEQ ID NO: 1746595 - RNA, 14 nt, Human
cuuugugauuuuug

SEQ ID NO: 1746596 - RNA, 16 nt, Human
cuuucccaucuuccaa

SEQ ID NO: 1746597 - RNA, 16 nt, Human
cuuuggacccugaggc

SEQ ID NO: 1746598 - RNA, 15 nt, Human
cuuuggacccugagg

SEQ ID NO: 1746599 - RNA, 21 nt, Human
cuuuggacagaagcagcucuu

SEQ ID NO: 1746600 - RNA, 20 nt, Human
cuuuggacagaagcagcucu

SEQ ID NO: 1746601 - RNA, 19 nt, Human
cuuuggacagaagcagcuc

SEQ ID NO: 1746602 - RNA, 18 nt, Human
cuuuggacagaagcagcu

SEQ ID NO: 1746603 - RNA, 18 nt, Human
cuuuggacccugaggccc

SEQ ID NO: 1746604 - RNA, 17 nt, Human
cuuuggacccugaggcc

SEQ ID NO: 1746605 - RNA, 19 nt, Human
cuuuggacccugaggccca

SEQ ID NO: 1746606 - RNA, 19 nt, Human
cuuguaaaggaauuuaaaa

SEQ ID NO: 1746607 - RNA, 22 nt, Human
cuuggggggcugaggugggagg

SEQ ID NO: 1746608 - RNA, 16 nt, Human
cuuggggggcugaggu

SEQ ID NO: 1746609 - RNA, 15 nt, Human
cuuggggggcugagg

SEQ ID NO: 1746610 - RNA, 22 nt, Human
cuuggggaccagagcugccacc

SEQ ID NO: 1746611 - RNA, 16 nt, Human
cuuggggaccagagcu

SEQ ID NO: 1746612 - RNA, 22 nt, Human
cuugggcuucauccuccucaga

SEQ ID NO: 1746613 - RNA, 21 nt, Human
cuuggggaccagagcugccac

SEQ ID NO: 1746614 - RNA, 20 nt, Human
cuuggggaccagagcugcca

SEQ ID NO: 1746615 - RNA, 14 nt, Human
cuugggccacugug

SEQ ID NO: 1746616 - RNA, 13 nt, Human
cuugggcuucauc

SEQ ID NO: 1746617 - RNA, 18 nt, Human
cuugggccacugugaaga

SEQ ID NO: 1746618 - RNA, 17 nt, Human
cuuggcugcagggaguc

SEQ ID NO: 1746619 - RNA, 13 nt, Human
cuugggaauuuua

SEQ ID NO: 1746620 - RNA, 16 nt, Human
cuuggcugcagggagu

SEQ ID NO: 1746621 - RNA, 12 nt, Human
cuuggagggcau

SEQ ID NO: 1746622 - RNA, 23 nt, Human
cuuggagggcaugaagacagaua

SEQ ID NO: 1746623 - RNA, 22 nt, Human
cuuggaggaaggaaacccagcu

SEQ ID NO: 1746624 - RNA, 15 nt, Human
cuugccacugccucu

SEQ ID NO: 1746625 - RNA, 14 nt, Human
cuugccacugccuc

SEQ ID NO: 1746626 - RNA, 21 nt, Human
cuucuccacccugcucuccga

SEQ ID NO: 1746627 - RNA, 18 nt, Human
cuucuccacccugcucuc

SEQ ID NO: 1746628 - RNA, 17 nt, Human
cuucuccacccugcucu

SEQ ID NO: 1746629 - RNA, 14 nt, Human
cuugcucugcugac

SEQ ID NO: 1746630 - RNA, 13 nt, Human
cuuggaggaagga

SEQ ID NO: 1746631 - RNA, 14 nt, Human
cuuggaagcuccgc

SEQ ID NO: 1746632 - RNA, 13 nt, Human
cuuggaagcuccg

SEQ ID NO: 1746633 - RNA, 16 nt, Human
cuuggaaaugggagac

SEQ ID NO: 1746634 - RNA, 20 nt, Human
cuugcuucaaccccaugaga

SEQ ID NO: 1746635 - RNA, 17 nt, Human
cuugcucugcugacaga

SEQ ID NO: 1746636 - RNA, 16 nt, Human
cuugcucugcugacag

SEQ ID NO: 1746637 - RNA, 21 nt, Human
cuuuauuuucuauaauuuaaa

SEQ ID NO: 1746638 - RNA, 13 nt, Human
cuuuaguuuuugu

SEQ ID NO: 1746639 - RNA, 15 nt, Human
cuuuaguuuuuguga

SEQ ID NO: 1746640 - RNA, 20 nt, Human
cuuuauucuggcagaggagg

SEQ ID NO: 1746641 - RNA, 17 nt, Human
cuuuauuaaauguagaa

SEQ ID NO: 1746642 - RNA, 16 nt, Human
cuuucauauuuuaaac

SEQ ID NO: 1746643 - RNA, 19 nt, Human
cuuucauauuuuaaacaga

SEQ ID NO: 1746644 - RNA, 23 nt, Human
cuuucauauuuuaaacagaggau

SEQ ID NO: 1746645 - RNA, 14 nt, Human
cuuucauuugcuuu

SEQ ID NO: 1746646 - RNA, 18 nt, Human
cuuucauuugcuuuggaa

SEQ ID NO: 1746647 - RNA, 22 nt, Human
cuuuccaaaugcccagcuuaaa

SEQ ID NO: 1746648 - RNA, 19 nt, Human
cuuuccaaaugcccagcuu

SEQ ID NO: 1746649 - RNA, 18 nt, Human
cuuuccaaaugcccagcu

SEQ ID NO: 1746650 - RNA, 21 nt, Human
cuuguuuuuuuuuuccacuua

SEQ ID NO: 1746651 - RNA, 20 nt, Human
cuuguuuuuuuuuuccacuu

SEQ ID NO: 1746652 - RNA, 19 nt, Human
cuuguuuuuuuuuuccacu

SEQ ID NO: 1746653 - RNA, 14 nt, Human
cuuguuuucuggga

SEQ ID NO: 1746654 - RNA, 21 nt, Human
cuuguguguuuauugucaaag

SEQ ID NO: 1746655 - RNA, 21 nt, Human
cuuguguuucuuuaguuuuug

SEQ ID NO: 1746656 - RNA, 21 nt, Human
cuuguuggauuuuugucuugu

SEQ ID NO: 1746657 - RNA, 23 nt, Human
cuuguuggauuuuugucuugugu

SEQ ID NO: 1746658 - RNA, 16 nt, Human
cuguuucagaggcuca

SEQ ID NO: 1746659 - RNA, 19 nt, Human
cuguuugcuaagugaggau

SEQ ID NO: 1746660 - RNA, 17 nt, Human
cuguuugcuaagugagg

SEQ ID NO: 1746661 - RNA, 18 nt, Human
cuguuuagauaauacacc

SEQ ID NO: 1746662 - RNA, 15 nt, Human
cuguuucaaacuuua

SEQ ID NO: 1746663 - RNA, 17 nt, Human
cuguuucaaacuuuacu

SEQ ID NO: 1746664 - RNA, 14 nt, Human
cuguuuagauaaua

SEQ ID NO: 1746665 - RNA, 17 nt, Human
cuguuuagauaauacac

SEQ ID NO: 1746666 - RNA, 17 nt, Human
cuguugcccaggcuggc

SEQ ID NO: 1746667 - RNA, 18 nt, Human
cuguugcccaggcuggcg

SEQ ID NO: 1746668 - RNA, 13 nt, Human
cuguuuucucuug

SEQ ID NO: 1746669 - RNA, 17 nt, Human
cuuaaaaaguggaaaaa

SEQ ID NO: 1746670 - RNA, 16 nt, Human
cuuaaaaaguggaaaa

SEQ ID NO: 1746671 - RNA, 22 nt, Human
cuguuuuacaaaaaagaaaaga

SEQ ID NO: 1746672 - RNA, 15 nt, Human
cuguucuuuccaaag

SEQ ID NO: 1746673 - RNA, 16 nt, Human
cuguucuuuccaaagu

SEQ ID NO: 1746674 - RNA, 19 nt, Human
cuguucuuuccaaaguaca

SEQ ID NO: 1746675 - RNA, 21 nt, Human
cuguucuuuccaaaguacacu

SEQ ID NO: 1746676 - RNA, 13 nt, Human
cuguucuuucugg

SEQ ID NO: 1746677 - RNA, 14 nt, Human
cuguucuuucuggc

SEQ ID NO: 1746678 - RNA, 21 nt, Human
cuguucuuucuggcuaugcau

SEQ ID NO: 1746679 - RNA, 16 nt, Human
cuguuaauaguucagg

SEQ ID NO: 1746680 - RNA, 18 nt, Human
cuguucuuaagacgugau

SEQ ID NO: 1746681 - RNA, 16 nt, Human
cuguugcccaggcugg

SEQ ID NO: 1746682 - RNA, 15 nt, Human
cuguugcccaggcug

SEQ ID NO: 1746683 - RNA, 14 nt, Human
cuguugcccaggcu

SEQ ID NO: 1746684 - RNA, 13 nt, Human
cuguugcccaggc

SEQ ID NO: 1746685 - RNA, 12 nt, Human
cuguugcccagg

SEQ ID NO: 1746686 - RNA, 23 nt, Human
cuguucuuucuggcuaugcauuu

SEQ ID NO: 1746687 - RNA, 12 nt, Human
cuuaaaaauggu

SEQ ID NO: 1746688 - RNA, 18 nt, Human
cuuaagaauuuugagcag

SEQ ID NO: 1746689 - RNA, 17 nt, Human
cuuaaccagaucauugu

SEQ ID NO: 1746690 - RNA, 20 nt, Human
cuuaauucuuagcucauucu

SEQ ID NO: 1746691 - RNA, 20 nt, Human
cuuagaagucacacaguauu

SEQ ID NO: 1746692 - RNA, 17 nt, Human
cuuagaagucacacagu

SEQ ID NO: 1746693 - RNA, 16 nt, Human
cuuagaaauugcauuu

SEQ ID NO: 1746694 - RNA, 16 nt, Human
cuuagaaguggaagua

SEQ ID NO: 1746695 - RNA, 20 nt, Human
cuuagaaaaaccaccaccau

SEQ ID NO: 1746696 - RNA, 13 nt, Human
cuuacuguacaug

SEQ ID NO: 1746697 - RNA, 20 nt, Human
cuuaccugccaggaagccag

SEQ ID NO: 1746698 - RNA, 21 nt, Human
cuuagguuggcaaaaaggcag

SEQ ID NO: 1746699 - RNA, 23 nt, Human
cuuagguuggcaaaaaggcagga

SEQ ID NO: 1746700 - RNA, 14 nt, Human
cuuagucacugaga

SEQ ID NO: 1746701 - RNA, 11 nt, Human
cuuagacaguc

SEQ ID NO: 1746702 - RNA, 19 nt, Human
cuuagaauuaguggcacuu

SEQ ID NO: 1746703 - RNA, 18 nt, Human
cuuagaaguuuguuguga

SEQ ID NO: 1746704 - RNA, 15 nt, Human
cuuccacaagagccc

SEQ ID NO: 1746705 - RNA, 14 nt, Human
cuuccacaagagcc

SEQ ID NO: 1746706 - RNA, 13 nt, Human
cuuccacaagagc

SEQ ID NO: 1746707 - RNA, 15 nt, Human
cuucaguaagccgug

SEQ ID NO: 1746708 - RNA, 14 nt, Human
cuucagugccaaaa

SEQ ID NO: 1746709 - RNA, 14 nt, Human
cuucagccucccga

SEQ ID NO: 1746710 - RNA, 15 nt, Human
cuucagccugaaaga

SEQ ID NO: 1746711 - RNA, 20 nt, Human
cuucagccucccgaguagcu

SEQ ID NO: 1746712 - RNA, 16 nt, Human
cuucagccucccgagu

SEQ ID NO: 1746713 - RNA, 19 nt, Human
cuucagcugacuuuucugu

SEQ ID NO: 1746714 - RNA, 15 nt, Human
cuucagcugacuuuu

SEQ ID NO: 1746715 - RNA, 14 nt, Human
cuucaguaagccgu

SEQ ID NO: 1746716 - RNA, 17 nt, Human
cuucaacugaccagccu

SEQ ID NO: 1746717 - RNA, 23 nt, Human
cuucaacugaccagccuccaugc

SEQ ID NO: 1746718 - RNA, 20 nt, Human
cuucaacugaccagccucca

SEQ ID NO: 1746719 - RNA, 20 nt, Human
cuucaaggauccugagccag

SEQ ID NO: 1746720 - RNA, 19 nt, Human
cuucaaggauccugagcca

SEQ ID NO: 1746721 - RNA, 18 nt, Human
cuucaaggauccugagcc

SEQ ID NO: 1746722 - RNA, 17 nt, Human
cuucaaggauccugagc

SEQ ID NO: 1746723 - RNA, 22 nt, Human
cuuagucacugagacagcccgg

SEQ ID NO: 1746724 - RNA, 20 nt, Human
cuuagucacugagacagccc

SEQ ID NO: 1746725 - RNA, 21 nt, Human
cuuagucacugagacagcccg

SEQ ID NO: 1746726 - RNA, 15 nt, Human
cuucaaauauuuccc

SEQ ID NO: 1746727 - RNA, 23 nt, Human
cuucaaggauccugagccagauu

SEQ ID NO: 1746728 - RNA, 22 nt, Human
cuucaaggauccugagccagau

SEQ ID NO: 1746729 - RNA, 21 nt, Human
cuucaaggauccugagccaga

SEQ ID NO: 1746730 - RNA, 14 nt, Human
cuucacauauugau

SEQ ID NO: 1746731 - RNA, 23 nt, Human
cuucacauauugauuuccguuaa

SEQ ID NO: 1746732 - RNA, 21 nt, Human
cuucucacugccaugccagcu

SEQ ID NO: 1746733 - RNA, 16 nt, Human
cuucucacugccaugc

SEQ ID NO: 1746734 - RNA, 20 nt, Human
cuucggccuccauccugagg

SEQ ID NO: 1746735 - RNA, 19 nt, Human
cuucgggaggucgaggcag

SEQ ID NO: 1746736 - RNA, 17 nt, Human
cuucgcuccugugucuu

SEQ ID NO: 1746737 - RNA, 15 nt, Human
cuucgccaccugggu

SEQ ID NO: 1746738 - RNA, 16 nt, Human
cuucgauacaccgggc

SEQ ID NO: 1746739 - RNA, 21 nt, Human
cuucgauacaccgggccugga

SEQ ID NO: 1746740 - RNA, 14 nt, Human
cuucgccaccuggg

SEQ ID NO: 1746741 - RNA, 16 nt, Human
cuuccacaagagccca

SEQ ID NO: 1746742 - RNA, 15 nt, Human
cuucccccuccaauc

SEQ ID NO: 1746743 - RNA, 12 nt, Human
cuucccccucca

SEQ ID NO: 1746744 - RNA, 16 nt, Human
cuuccugugacuucag

SEQ ID NO: 1746745 - RNA, 13 nt, Human
cuuccugugacuu

SEQ ID NO: 1746746 - RNA, 15 nt, Human
cugugaaaggaaaga

SEQ ID NO: 1746747 - RNA, 21 nt, Human
cugucuuuuuucuaaaguaaa

SEQ ID NO: 1746748 - RNA, 18 nt, Human
cugucuguuguauucauu

SEQ ID NO: 1746749 - RNA, 19 nt, Human
cugucuguuguauucauug

SEQ ID NO: 1746750 - RNA, 18 nt, Human
cugucuucaguaagccgu

SEQ ID NO: 1746751 - RNA, 14 nt, Human
cugucuuaauuuuc

SEQ ID NO: 1746752 - RNA, 22 nt, Human
cugucauuugagcagggcucag

SEQ ID NO: 1746753 - RNA, 21 nt, Human
cugucauuugagcagggcuca

SEQ ID NO: 1746754 - RNA, 18 nt, Human
cugucaauuacaggaagu

SEQ ID NO: 1746755 - RNA, 23 nt, Human
cugucauuugagcagggcucagc

SEQ ID NO: 1746756 - RNA, 22 nt, Human
cugugaaaggaaagagggaggu

SEQ ID NO: 1746757 - RNA, 16 nt, Human
cugugaaaggaaagag

SEQ ID NO: 1746758 - RNA, 21 nt, Human
cugugauggggcccugccucc

SEQ ID NO: 1746759 - RNA, 16 nt, Human
cugugauggggcccug

SEQ ID NO: 1746760 - RNA, 23 nt, Human
cugugauggggcccugccuccuu

SEQ ID NO: 1746761 - RNA, 15 nt, Human
cugugauggggcccu

SEQ ID NO: 1746762 - RNA, 15 nt, Human
cugugccaugugcca

SEQ ID NO: 1746763 - RNA, 19 nt, Human
cugugcccuaaaguguauu

SEQ ID NO: 1746764 - RNA, 14 nt, Human
cugugccaugugcc

SEQ ID NO: 1746765 - RNA, 22 nt, Human
cuguggguuucuaaagcugcca

SEQ ID NO: 1746766 - RNA, 21 nt, Human
cuguggguuucuaaagcugcc

SEQ ID NO: 1746767 - RNA, 17 nt, Human
cugugccucugccuguc

SEQ ID NO: 1746768 - RNA, 16 nt, Human
cugugccucugccugu

SEQ ID NO: 1746769 - RNA, 15 nt, Human
cugugccucugccug

SEQ ID NO: 1746770 - RNA, 14 nt, Human
cugugccucugccu

SEQ ID NO: 1746771 - RNA, 13 nt, Human
cugugccucugcc

SEQ ID NO: 1746772 - RNA, 12 nt, Human
cugugccucugc

SEQ ID NO: 1746773 - RNA, 24 nt, Human
cuguggaucaaauccagccugcug

SEQ ID NO: 1746774 - RNA, 14 nt, Human
cuguggaucaaauc

SEQ ID NO: 1746775 - RNA, 18 nt, Human
cugugugugcgccuacag

SEQ ID NO: 1746776 - RNA, 20 nt, Human
cugugucuuuuuucacuaca

SEQ ID NO: 1746777 - RNA, 14 nt, Human
cugugugcucagga

SEQ ID NO: 1746778 - RNA, 21 nt, Human
cugggauuacaagcgugagcc

SEQ ID NO: 1746779 - RNA, 18 nt, Human
cugggauuacaggcguga

SEQ ID NO: 1746780 - RNA, 23 nt, Human
cugggccccugccucucugcagg

SEQ ID NO: 1746781 - RNA, 20 nt, Human
cugggccccugccucucugc

SEQ ID NO: 1746782 - RNA, 23 nt, Human
cuggggguucuuucuuccucugc

SEQ ID NO: 1746783 - RNA, 20 nt, Human
cuggggguucuuucuuccuc

SEQ ID NO: 1746784 - RNA, 13 nt, Human
cugggucgcccug

SEQ ID NO: 1746785 - RNA, 16 nt, Human
cugggucgcccuggac

SEQ ID NO: 1746786 - RNA, 15 nt, Human
cugggucgcccugga

SEQ ID NO: 1746787 - RNA, 18 nt, Human
cugggcuugucuguagau

SEQ ID NO: 1746788 - RNA, 22 nt, Human
cugggcuuggggaccagagcug

SEQ ID NO: 1746789 - RNA, 15 nt, Human
cugggcuucaguggc

SEQ ID NO: 1746790 - RNA, 17 nt, Human
cugggcuucaguggcag

SEQ ID NO: 1746791 - RNA, 14 nt, Human
cugggggcugggca

SEQ ID NO: 1746792 - RNA, 18 nt, Human
cugggggcugggcagagg

SEQ ID NO: 1746793 - RNA, 16 nt, Human
cugggggccucuucug

SEQ ID NO: 1746794 - RNA, 21 nt, Human
cugguuagagguucccuuuga

SEQ ID NO: 1746795 - RNA, 22 nt, Human
cugguuagagguucccuuugac

SEQ ID NO: 1746796 - RNA, 19 nt, Human
cuguaauccuagcacuuug

SEQ ID NO: 1746797 - RNA, 22 nt, Human
cuguacagagcccacgccccca

SEQ ID NO: 1746798 - RNA, 18 nt, Human
cuguacagagcccacgcc

SEQ ID NO: 1746799 - RNA, 15 nt, Human
cuguacagagcccac

SEQ ID NO: 1746800 - RNA, 14 nt, Human
cuguacagagccca

SEQ ID NO: 1746801 - RNA, 14 nt, Human
cuguaauuugugau

SEQ ID NO: 1746802 - RNA, 15 nt, Human
cuguaauuugugaua

SEQ ID NO: 1746803 - RNA, 21 nt, Human
cugguggcagcucaccucucc

SEQ ID NO: 1746804 - RNA, 18 nt, Human
cugguggcagugggagcu

SEQ ID NO: 1746805 - RNA, 14 nt, Human
cugguggcaguggg

SEQ ID NO: 1746806 - RNA, 15 nt, Human
cugguggcagcugcg

SEQ ID NO: 1746807 - RNA, 20 nt, Human
cugguggcagcucaccucuc

SEQ ID NO: 1746808 - RNA, 18 nt, Human
cugguggcagcucaccuc

SEQ ID NO: 1746809 - RNA, 17 nt, Human
cugguggcagcucaccu

SEQ ID NO: 1746810 - RNA, 18 nt, Human
cuguacgucugacaggca

SEQ ID NO: 1746811 - RNA, 16 nt, Human
cuguacgucugacagg

SEQ ID NO: 1746812 - RNA, 15 nt, Human
cuguacgucugacag

SEQ ID NO: 1746813 - RNA, 14 nt, Human
cuguacgucugaca

SEQ ID NO: 1746814 - RNA, 17 nt, Human
cuguacaugaaaacaca

SEQ ID NO: 1746815 - RNA, 20 nt, Human
cuguacaugaaaacacauuu

SEQ ID NO: 1746816 - RNA, 21 nt, Human
cuguacaugaaaacacauuuu

SEQ ID NO: 1746817 - RNA, 20 nt, Human
cuguacgucugacaggcaau

SEQ ID NO: 1746818 - RNA, 19 nt, Human
cuguacgucugacaggcaa

SEQ ID NO: 1746819 - RNA, 14 nt, Human
cuguacuccuccca

SEQ ID NO: 1746820 - RNA, 21 nt, Human
cuguacuccucccaggcgccc

SEQ ID NO: 1746821 - RNA, 19 nt, Human
cuguacuccucccaggcgc

SEQ ID NO: 1746822 - RNA, 16 nt, Human
cuguacuccucccagg

SEQ ID NO: 1746823 - RNA, 15 nt, Human
cuguacuccucccag

SEQ ID NO: 1746824 - RNA, 16 nt, Human
cugucaauuacaggaa

SEQ ID NO: 1746825 - RNA, 15 nt, Human
cugucaauuacagga

SEQ ID NO: 1746826 - RNA, 20 nt, Human
cuguauuuuguuuuugucuu

SEQ ID NO: 1746827 - RNA, 20 nt, Human
cuguaucccaugagccucag

SEQ ID NO: 1746828 - RNA, 22 nt, Human
cuguaucccaugagccucagca

SEQ ID NO: 1746829 - RNA, 21 nt, Human
cuguaucccaugagccucagc

SEQ ID NO: 1746830 - RNA, 19 nt, Human
cuguauuagucacagagau

SEQ ID NO: 1746831 - RNA, 17 nt, Human
cuguauuagucacagag

SEQ ID NO: 1746832 - RNA, 22 nt, Human
ccuauauuguuuucaguguaca

SEQ ID NO: 1746833 - RNA, 18 nt, Human
ccuauauuguuuucagug

SEQ ID NO: 1746834 - RNA, 23 nt, Human
ccuaguuccaccaucaagccacc

SEQ ID NO: 1746835 - RNA, 21 nt, Human
ccuaguuccaccaucaagcca

SEQ ID NO: 1746836 - RNA, 13 nt, Human
ccuaguuccacca

SEQ ID NO: 1746837 - RNA, 15 nt, Human
ccuacuuccugugac

SEQ ID NO: 1746838 - RNA, 21 nt, Human
ccuacuuccccuuccuaauuc

SEQ ID NO: 1746839 - RNA, 13 nt, Human
ccuacuuccugug

SEQ ID NO: 1746840 - RNA, 23 nt, Human
ccuaccgagucucuucuccacug

SEQ ID NO: 1746841 - RNA, 22 nt, Human
ccuaccgagucucuucuccacu

SEQ ID NO: 1746842 - RNA, 18 nt, Human
ccuaaauauauuuuaaga

SEQ ID NO: 1746843 - RNA, 15 nt, Human
ccuaaaauucagugg

SEQ ID NO: 1746844 - RNA, 16 nt, Human
ccuaaauauauuuuaa

SEQ ID NO: 1746845 - RNA, 15 nt, Human
ccuacaagacacagu

SEQ ID NO: 1746846 - RNA, 16 nt, Human
ccgggcguggugguga

SEQ ID NO: 1746847 - RNA, 20 nt, Human
ccgggcgcgguggcucacgc

SEQ ID NO: 1746848 - RNA, 18 nt, Human
ccgggaccccgagccugg

SEQ ID NO: 1746849 - RNA, 13 nt, Human
ccgggcucugccu

SEQ ID NO: 1746850 - RNA, 22 nt, Human
ccgggcucugccucccaucacc

SEQ ID NO: 1746851 - RNA, 19 nt, Human
ccgggcugggagcucugca

SEQ ID NO: 1746852 - RNA, 18 nt, Human
ccgggcugggagcucugc

SEQ ID NO: 1746853 - RNA, 13 nt, Human
ccgggcugggagc

SEQ ID NO: 1746854 - RNA, 12 nt, Human
ccgcuuucuacc

SEQ ID NO: 1746855 - RNA, 22 nt, Human
ccgcucagcccucccugccccu

SEQ ID NO: 1746856 - RNA, 21 nt, Human
ccgcucagcccucccugcccc

SEQ ID NO: 1746857 - RNA, 19 nt, Human
ccgcucagcccucccugcc

SEQ ID NO: 1746858 - RNA, 15 nt, Human
ccgcucagcccuccc

SEQ ID NO: 1746859 - RNA, 18 nt, Human
ccggcuggccuggccccu

SEQ ID NO: 1746860 - RNA, 17 nt, Human
ccggcuggccuggcccc

SEQ ID NO: 1746861 - RNA, 23 nt, Human
ccgcuuucuacccagcgagcccu

SEQ ID NO: 1746862 - RNA, 19 nt, Human
ccgcuuucuacccagcgag

SEQ ID NO: 1746863 - RNA, 20 nt, Human
ccgggaagggggcugggaca

SEQ ID NO: 1746864 - RNA, 17 nt, Human
ccgggaccccgagccug

SEQ ID NO: 1746865 - RNA, 19 nt, Human
ccgcacugggcuuggggac

SEQ ID NO: 1746866 - RNA, 14 nt, Human
ccgcacugggcuug

SEQ ID NO: 1746867 - RNA, 23 nt, Human
ccgcuaagagggagggagggcuc

SEQ ID NO: 1746868 - RNA, 13 nt, Human
ccgcucagcccuc

SEQ ID NO: 1746869 - RNA, 12 nt, Human
ccgcucagcccu

SEQ ID NO: 1746870 - RNA, 11 nt, Human
ccgcucagccc

SEQ ID NO: 1746871 - RNA, 21 nt, Human
ccgcuaagagggagggagggc

SEQ ID NO: 1746872 - RNA, 17 nt, Human
ccgaguagcugggacua

SEQ ID NO: 1746873 - RNA, 17 nt, Human
ccgaggccuucucugaa

SEQ ID NO: 1746874 - RNA, 20 nt, Human
ccgaguagcugggacuacag

SEQ ID NO: 1746875 - RNA, 17 nt, Human
cccugguuuccugcccu

SEQ ID NO: 1746876 - RNA, 16 nt, Human
cccugguuuccugccc

SEQ ID NO: 1746877 - RNA, 20 nt, Human
cccugguggcagcucaccuc

SEQ ID NO: 1746878 - RNA, 14 nt, Human
ccgaggccuucucu

SEQ ID NO: 1746879 - RNA, 19 nt, Human
cccugguuuccugcccugg

SEQ ID NO: 1746880 - RNA, 18 nt, Human
cccugguuuccugcccug

SEQ ID NO: 1746881 - RNA, 21 nt, Human
ccuccaggugcacaagcucca

SEQ ID NO: 1746882 - RNA, 19 nt, Human
ccuccaggugcacaagcuc

SEQ ID NO: 1746883 - RNA, 22 nt, Human
ccuccaggugcacaagcuccaa

SEQ ID NO: 1746884 - RNA, 18 nt, Human
ccuccaucuaaacugccc

SEQ ID NO: 1746885 - RNA, 16 nt, Human
ccucccaaagugcugg

SEQ ID NO: 1746886 - RNA, 15 nt, Human
ccucccaaagugcug

SEQ ID NO: 1746887 - RNA, 15 nt, Human
ccuccaugcugccuc

SEQ ID NO: 1746888 - RNA, 23 nt, Human
ccuccaugugggcuaguugggcu

SEQ ID NO: 1746889 - RNA, 14 nt, Human
ccuccaugcugccu

SEQ ID NO: 1746890 - RNA, 14 nt, Human
ccucaucaccaacg

SEQ ID NO: 1746891 - RNA, 13 nt, Human
ccucaucaccaac

SEQ ID NO: 1746892 - RNA, 22 nt, Human
ccucauaguaugguggcugggu

SEQ ID NO: 1746893 - RNA, 21 nt, Human
ccucauaguaugguggcuggg

SEQ ID NO: 1746894 - RNA, 13 nt, Human
ccucauacccacc

SEQ ID NO: 1746895 - RNA, 18 nt, Human
ccucauagcccucacccu

SEQ ID NO: 1746896 - RNA, 17 nt, Human
ccucauagcccucaccc

SEQ ID NO: 1746897 - RNA, 20 nt, Human
ccucauaguaugguggcugg

SEQ ID NO: 1746898 - RNA, 22 nt, Human
ccucauagcccucacccugggg

SEQ ID NO: 1746899 - RNA, 21 nt, Human
ccucauagcccucacccuggg

SEQ ID NO: 1746900 - RNA, 11 nt, Human
ccucagugcca

SEQ ID NO: 1746901 - RNA, 20 nt, Human
ccucagucuggcccuuccuu

SEQ ID NO: 1746902 - RNA, 19 nt, Human
ccuaugcagagguccacaa

SEQ ID NO: 1746903 - RNA, 19 nt, Human
ccucagucuggcccuuccu

SEQ ID NO: 1746904 - RNA, 20 nt, Human
ccucauccucauacccaccc

SEQ ID NO: 1746905 - RNA, 13 nt, Human
ccucauccucaua

SEQ ID NO: 1746906 - RNA, 21 nt, Human
ccucaucuccccaucauuggu

SEQ ID NO: 1746907 - RNA, 23 nt, Human
ccuccaaucccaccaacccucag

SEQ ID NO: 1746908 - RNA, 10 nt, Human
ccucccuccc

SEQ ID NO: 1746909 - RNA, 21 nt, Human
ccucccugccccucccuucaa

SEQ ID NO: 1746910 - RNA, 18 nt, Human
ccucccugccccucccuu

SEQ ID NO: 1746911 - RNA, 14 nt, Human
ccuccucagaucuu

SEQ ID NO: 1746912 - RNA, 24 nt, Human
ccucccugccccucccuucaacca

SEQ ID NO: 1746913 - RNA, 22 nt, Human
ccucccugccccucccuucaac

SEQ ID NO: 1746914 - RNA, 21 nt, Human
ccucccgaguagcugggacua

SEQ ID NO: 1746915 - RNA, 20 nt, Human
ccucccgaguagcugggacu

SEQ ID NO: 1746916 - RNA, 14 nt, Human
ccuccugggcuaag

SEQ ID NO: 1746917 - RNA, 23 nt, Human
ccuccugccucgaacuggcugca

SEQ ID NO: 1746918 - RNA, 18 nt, Human
ccucgguguggagaagcg

SEQ ID NO: 1746919 - RNA, 14 nt, Human
ccucgguguggaga

SEQ ID NO: 1746920 - RNA, 16 nt, Human
ccucggugccuuccuc

SEQ ID NO: 1746921 - RNA, 16 nt, Human
ccucuaggaggucucu

SEQ ID NO: 1746922 - RNA, 17 nt, Human
ccucccgaauagcuggg

SEQ ID NO: 1746923 - RNA, 22 nt, Human
cccugcuggguguggcgcagca

SEQ ID NO: 1746924 - RNA, 17 nt, Human
cccugcuuugggcugcc

SEQ ID NO: 1746925 - RNA, 19 nt, Human
cccugcuuugggcugcccu

SEQ ID NO: 1746926 - RNA, 18 nt, Human
cccugcuuugggcugccc

SEQ ID NO: 1746927 - RNA, 22 nt, Human
cccugcuuugggcugcccuggu

SEQ ID NO: 1746928 - RNA, 20 nt, Human
cccugcuuugggcugcccug

SEQ ID NO: 1746929 - RNA, 17 nt, Human
cccugcccaccuggccu

SEQ ID NO: 1746930 - RNA, 14 nt, Human
cccugcccaccugg

SEQ ID NO: 1746931 - RNA, 13 nt, Human
cccugcccaccug

SEQ ID NO: 1746932 - RNA, 21 nt, Human
cccugcuggguguggcgcagc

SEQ ID NO: 1746933 - RNA, 16 nt, Human
cccugcuggguguggc

SEQ ID NO: 1746934 - RNA, 18 nt, Human
cccugcccaccuggccuc

SEQ ID NO: 1746935 - RNA, 17 nt, Human
cccugguggcagcucac

SEQ ID NO: 1746936 - RNA, 16 nt, Human
cccugguggcagcuca

SEQ ID NO: 1746937 - RNA, 15 nt, Human
cccugguggcagcuc

SEQ ID NO: 1746938 - RNA, 15 nt, Human
cccugggaggcucug

SEQ ID NO: 1746939 - RNA, 15 nt, Human
cccuggacugugugc

SEQ ID NO: 1746940 - RNA, 21 nt, Human
cccuggacugugugcucagga

SEQ ID NO: 1746941 - RNA, 18 nt, Human
cccuggcuuuucacugcu

SEQ ID NO: 1746942 - RNA, 18 nt, Human
cccugggaggcagugaug

SEQ ID NO: 1746943 - RNA, 22 nt, Human
cccuggcuuuucacugcuggcu

SEQ ID NO: 1746944 - RNA, 19 nt, Human
cccuggcuuuucacugcug

SEQ ID NO: 1746945 - RNA, 22 nt, Human
cccuauccuacuuccccuuccu

SEQ ID NO: 1746946 - RNA, 23 nt, Human
cccugaggcccagagggccugca

SEQ ID NO: 1746947 - RNA, 20 nt, Human
cccugaggcccagagggccu

SEQ ID NO: 1746948 - RNA, 19 nt, Human
cccugaggcccagagggcc

SEQ ID NO: 1746949 - RNA, 18 nt, Human
cccugaggcccagagggc

SEQ ID NO: 1746950 - RNA, 17 nt, Human
cccugaggcccagaggg

SEQ ID NO: 1746951 - RNA, 16 nt, Human
cccugaggcccagagg

SEQ ID NO: 1746952 - RNA, 15 nt, Human
cccugaggcccagag

SEQ ID NO: 1746953 - RNA, 14 nt, Human
cccugaggcccaga

SEQ ID NO: 1746954 - RNA, 16 nt, Human
cccugaaagcccugag

SEQ ID NO: 1746955 - RNA, 13 nt, Human
cccugaggcccag

SEQ ID NO: 1746956 - RNA, 15 nt, Human
cccugaaagcccuga

SEQ ID NO: 1746957 - RNA, 16 nt, Human
cccucuggggcuguuc

SEQ ID NO: 1746958 - RNA, 12 nt, Human
cccugcacuugc

SEQ ID NO: 1746959 - RNA, 19 nt, Human
cccugcacuugcagacucu

SEQ ID NO: 1746960 - RNA, 22 nt, Human
cccugcacuugcagacucuaca

SEQ ID NO: 1746961 - RNA, 15 nt, Human
cccugcaaagcccag

SEQ ID NO: 1746962 - RNA, 23 nt, Human
cccugcacaaagcccuuccaugu

SEQ ID NO: 1746963 - RNA, 20 nt, Human
cccugcaaagcccagcuuga

SEQ ID NO: 1746964 - RNA, 19 nt, Human
cccugcaaagcccagcuug

SEQ ID NO: 1746965 - RNA, 17 nt, Human
cccugcaaagcccagcu

SEQ ID NO: 1746966 - RNA, 16 nt, Human
cccugcaaagcccagc

SEQ ID NO: 1746967 - RNA, 15 nt, Human
cccgugggguuccuc

SEQ ID NO: 1746968 - RNA, 22 nt, Human
cccgucucugguuccuccccuc

SEQ ID NO: 1746969 - RNA, 17 nt, Human
cccgucgacguagaacc

SEQ ID NO: 1746970 - RNA, 18 nt, Human
cccggugcccaagaauag

SEQ ID NO: 1746971 - RNA, 16 nt, Human
cccgggcucugccucc

SEQ ID NO: 1746972 - RNA, 20 nt, Human
cccuacaguugaaaaacagc

SEQ ID NO: 1746973 - RNA, 23 nt, Human
cccuaaugcgcaggcuggcccug

SEQ ID NO: 1746974 - RNA, 17 nt, Human
cccuaaugcgcaggcug

SEQ ID NO: 1746975 - RNA, 22 nt, Human
cccuaaugcgcaggcuggcccu

SEQ ID NO: 1746976 - RNA, 21 nt, Human
cccuaaugcgcaggcuggccc

SEQ ID NO: 1746977 - RNA, 18 nt, Human
cccuaccgagucucuucu

SEQ ID NO: 1746978 - RNA, 21 nt, Human
cccuaccgagucucuucucca

SEQ ID NO: 1746979 - RNA, 22 nt, Human
cccgaguagcugggacuacagg

SEQ ID NO: 1746980 - RNA, 20 nt, Human
cccgcugucagccauuccug

SEQ ID NO: 1746981 - RNA, 19 nt, Human
cccgcugucagccauuccu

SEQ ID NO: 1746982 - RNA, 15 nt, Human
cccgggcucugccuc

SEQ ID NO: 1746983 - RNA, 14 nt, Human
cccgggcucugccu

SEQ ID NO: 1746984 - RNA, 12 nt, Human
cccgggcucugc

SEQ ID NO: 1746985 - RNA, 21 nt, Human
cccgaguagcugggacuacag

SEQ ID NO: 1746986 - RNA, 18 nt, Human
cccgaguagcugggacua

SEQ ID NO: 1746987 - RNA, 17 nt, Human
cccgaguagcugggacu

SEQ ID NO: 1746988 - RNA, 16 nt, Human
cccgaguagcugggac

SEQ ID NO: 1746989 - RNA, 15 nt, Human
cccgaguagcuggga

SEQ ID NO: 1746990 - RNA, 14 nt, Human
cccgaguagcuggg

SEQ ID NO: 1746991 - RNA, 13 nt, Human
cccgaguagcugg

SEQ ID NO: 1746992 - RNA, 18 nt, Human
cccagagggccugcaagg

SEQ ID NO: 1746993 - RNA, 15 nt, Human
cccagagggccugca

SEQ ID NO: 1746994 - RNA, 14 nt, Human
cccagagggccugc

SEQ ID NO: 1746995 - RNA, 20 nt, Human
cccacaagaaaugaaagcag

SEQ ID NO: 1746996 - RNA, 13 nt, Human
cccacaagaaaug

SEQ ID NO: 1746997 - RNA, 23 nt, Human
cccaaugcacuuuguucuggcuc

SEQ ID NO: 1746998 - RNA, 20 nt, Human
cccaaugcacuuuguucugg

SEQ ID NO: 1746999 - RNA, 16 nt, Human
cccaaugcacuuuguu

SEQ ID NO: 1747000 - RNA, 19 nt, Human
cccacagcgcuggccggga

SEQ ID NO: 1747001 - RNA, 21 nt, Human
cccacgacugcccggcagggu

SEQ ID NO: 1747002 - RNA, 20 nt, Human
cccacgacugcccggcaggg

SEQ ID NO: 1747003 - RNA, 21 nt, Human
cccaccuggccucugcacucc

SEQ ID NO: 1747004 - RNA, 19 nt, Human
cccaccuggccucugcacu

SEQ ID NO: 1747005 - RNA, 17 nt, Human
cccaccuggccucugca

SEQ ID NO: 1747006 - RNA, 12 nt, Human
cccacuucugcc

SEQ ID NO: 1747007 - RNA, 23 nt, Human
cccacuugagaauuacccuuuug

SEQ ID NO: 1747008 - RNA, 21 nt, Human
cccacgcuggagugcagugag

SEQ ID NO: 1747009 - RNA, 20 nt, Human
cccacgcuggagugcaguga

SEQ ID NO: 1747010 - RNA, 19 nt, Human
cccacgcuggagugcagug

SEQ ID NO: 1747011 - RNA, 20 nt, Human
cccaccgcagacaggaccag

SEQ ID NO: 1747012 - RNA, 19 nt, Human
cccaccgcagacaggacca

SEQ ID NO: 1747013 - RNA, 18 nt, Human
cccaccaucaugucuggc

SEQ ID NO: 1747014 - RNA, 22 nt, Human
cccaccucucucacuccuugaa

SEQ ID NO: 1747015 - RNA, 23 nt, Human
cccaccgggcugggagcucugca

SEQ ID NO: 1747016 - RNA, 15 nt, Human
cgaauagcugggacu

SEQ ID NO: 1747017 - RNA, 14 nt, Human
cgaauagcugggac

SEQ ID NO: 1747018 - RNA, 13 nt, Human
cgaauagcuggga

SEQ ID NO: 1747019 - RNA, 17 nt, Human
cgagaucacgccacugc

SEQ ID NO: 1747020 - RNA, 18 nt, Human
cgagauagccaaggccaa

SEQ ID NO: 1747021 - RNA, 20 nt, Human
cgagcaggcuucuucccccc

SEQ ID NO: 1747022 - RNA, 17 nt, Human
cgagcaugccuggaugg

SEQ ID NO: 1747023 - RNA, 16 nt, Human
cgagcaugccuggaug

SEQ ID NO: 1747024 - RNA, 13 nt, Human
cgagcaugccugg

SEQ ID NO: 1747025 - RNA, 14 nt, Human
cgagcaugccugga

SEQ ID NO: 1747026 - RNA, 20 nt, Human
cgagauugcaccacugcacu

SEQ ID NO: 1747027 - RNA, 20 nt, Human
cgagaucacgccacugcacu

SEQ ID NO: 1747028 - RNA, 18 nt, Human
cgagaucacgccacugca

SEQ ID NO: 1747029 - RNA, 21 nt, Human
ccuuugacgccaucccagccc

SEQ ID NO: 1747030 - RNA, 20 nt, Human
ccuuugacgccaucccagcc

SEQ ID NO: 1747031 - RNA, 22 nt, Human
ccuuugacgccaucccagcccc

SEQ ID NO: 1747032 - RNA, 23 nt, Human
ccuuugacgccaucccagcccca

SEQ ID NO: 1747033 - RNA, 19 nt, Human
cgaaaacguggcugcuuca

SEQ ID NO: 1747034 - RNA, 18 nt, Human
cgaaaacguggcugcuuc

SEQ ID NO: 1747035 - RNA, 15 nt, Human
cgaaaacguggcugc

SEQ ID NO: 1747036 - RNA, 20 nt, Human
cgaaaacguggcugcuucaa

SEQ ID NO: 1747037 - RNA, 14 nt, Human
cgaacuggcugcaa

SEQ ID NO: 1747038 - RNA, 12 nt, Human
cgaacuggcugc

SEQ ID NO: 1747039 - RNA, 14 nt, Human
cgaacuccugaccu

SEQ ID NO: 1747040 - RNA, 19 nt, Human
cgaaagggacuuggaagcu

SEQ ID NO: 1747041 - RNA, 20 nt, Human
cgaaaggaugaaagugacca

SEQ ID NO: 1747042 - RNA, 22 nt, Human
cgaaagggacuuggaagcuccg

SEQ ID NO: 1747043 - RNA, 12 nt, Human
cgaaagaacagu

SEQ ID NO: 1747044 - RNA, 21 nt, Human
cgaaagaacaguccauugaaa

SEQ ID NO: 1747045 - RNA, 17 nt, Human
cgccaugcuccuggccc

SEQ ID NO: 1747046 - RNA, 14 nt, Human
cgcagcccugcaga

SEQ ID NO: 1747047 - RNA, 10 nt, Human
cgcagcccug

SEQ ID NO: 1747048 - RNA, 16 nt, Human
cgcagacaggaccagg

SEQ ID NO: 1747049 - RNA, 15 nt, Human
cgcagacaggaccag

SEQ ID NO: 1747050 - RNA, 21 nt, Human
cgccagauucuuuccugaggc

SEQ ID NO: 1747051 - RNA, 20 nt, Human
cgccagauucuuuccugagg

SEQ ID NO: 1747052 - RNA, 19 nt, Human
cgccagauucuuuccugag

SEQ ID NO: 1747053 - RNA, 22 nt, Human
cgccaggggaaaaucagccugc

SEQ ID NO: 1747054 - RNA, 16 nt, Human
cgagcccugguggcag

SEQ ID NO: 1747055 - RNA, 15 nt, Human
cgagcccugguggca

SEQ ID NO: 1747056 - RNA, 18 nt, Human
cgagcaugccuggauggg

SEQ ID NO: 1747057 - RNA, 18 nt, Human
cgagcccugguggcagug

SEQ ID NO: 1747058 - RNA, 20 nt, Human
cgauuucuguuuagauaaua

SEQ ID NO: 1747059 - RNA, 23 nt, Human
ccuugaccauucuccaccugcca

SEQ ID NO: 1747060 - RNA, 13 nt, Human
ccuugacucuuuc

SEQ ID NO: 1747061 - RNA, 20 nt, Human
ccuugaguugauucagcucu

SEQ ID NO: 1747062 - RNA, 20 nt, Human
ccuugaaaacuuuaugcuaa

SEQ ID NO: 1747063 - RNA, 13 nt, Human
ccuugaacuagga

SEQ ID NO: 1747064 - RNA, 16 nt, Human
ccuucggccuccaucc

SEQ ID NO: 1747065 - RNA, 15 nt, Human
ccuucggcgccuuaa

SEQ ID NO: 1747066 - RNA, 19 nt, Human
ccuucuccuucaccuuugu

SEQ ID NO: 1747067 - RNA, 15 nt, Human
ccuucuccuucaccu

SEQ ID NO: 1747068 - RNA, 14 nt, Human
ccuucuguggcuca

SEQ ID NO: 1747069 - RNA, 21 nt, Human
ccuucuguggcucacagaacc

SEQ ID NO: 1747070 - RNA, 18 nt, Human
ccuuugacgccaucccag

SEQ ID NO: 1747071 - RNA, 17 nt, Human
ccuuugacgccauccca

SEQ ID NO: 1747072 - RNA, 16 nt, Human
ccuuugacgccauccc

SEQ ID NO: 1747073 - RNA, 12 nt, Human
ccuugggacccc

SEQ ID NO: 1747074 - RNA, 22 nt, Human
ccuugguuaggcauugugggaa

SEQ ID NO: 1747075 - RNA, 21 nt, Human
ccuugguuaggcauuguggga

SEQ ID NO: 1747076 - RNA, 22 nt, Human
ccuuggugucgggcaugacacg

SEQ ID NO: 1747077 - RNA, 12 nt, Human
ccuucagccuga

SEQ ID NO: 1747078 - RNA, 14 nt, Human
ccuucagugccaaa

SEQ ID NO: 1747079 - RNA, 19 nt, Human
ccuucauuuggcauucccc

SEQ ID NO: 1747080 - RNA, 11 nt, Human
ccuucagugcc

SEQ ID NO: 1747081 - RNA, 20 nt, Human
ccuucaccuuuguccccacc

SEQ ID NO: 1747082 - RNA, 19 nt, Human
ccuucaccuuuguccccac

SEQ ID NO: 1747083 - RNA, 17 nt, Human
ccuucacagaugggugc

SEQ ID NO: 1747084 - RNA, 14 nt, Human
ccuuagacaguccc

SEQ ID NO: 1747085 - RNA, 21 nt, Human
ccuucaccuuuguccccaccg

SEQ ID NO: 1747086 - RNA, 14 nt, Human
ccuucacuuaggaa

SEQ ID NO: 1747087 - RNA, 14 nt, Human
ccuucggccuccau

SEQ ID NO: 1747088 - RNA, 19 nt, Human
ccuucggccuccauccuga

SEQ ID NO: 1747089 - RNA, 20 nt, Human
ccuucggccuccauccugag

SEQ ID NO: 1747090 - RNA, 22 nt, Human
ccuucauuuggcauuccccacu

SEQ ID NO: 1747091 - RNA, 14 nt, Human
ccuuccucugaggc

SEQ ID NO: 1747092 - RNA, 13 nt, Human
ccuuccucugagg

SEQ ID NO: 1747093 - RNA, 20 nt, Human
ccuuccucugagccuuggga

SEQ ID NO: 1747094 - RNA, 21 nt, Human
ccuuccucuccacugccuucg

SEQ ID NO: 1747095 - RNA, 16 nt, Human
ccuuccucugagccuu

SEQ ID NO: 1747096 - RNA, 15 nt, Human
ccuuccucugagccu

SEQ ID NO: 1747097 - RNA, 18 nt, Human
ccuguuucagaggcucag

SEQ ID NO: 1747098 - RNA, 16 nt, Human
ccuguuucugcagcca

SEQ ID NO: 1747099 - RNA, 18 nt, Human
ccuguuuguuucugaaag

SEQ ID NO: 1747100 - RNA, 14 nt, Human
ccuguuuguuucug

SEQ ID NO: 1747101 - RNA, 15 nt, Human
ccuguuuaagagaca

SEQ ID NO: 1747102 - RNA, 12 nt, Human
ccuguuuaagag

SEQ ID NO: 1747103 - RNA, 23 nt, Human
ccuguugggccaggagccuccug

SEQ ID NO: 1747104 - RNA, 21 nt, Human
ccugugucuugcaauggcagc

SEQ ID NO: 1747105 - RNA, 19 nt, Human
ccugugucuugcaauggca

SEQ ID NO: 1747106 - RNA, 17 nt, Human
ccugugucuugcaaugg

SEQ ID NO: 1747107 - RNA, 22 nt, Human
ccugugucuugcaauggcagcc

SEQ ID NO: 1747108 - RNA, 21 nt, Human
ccugugugugcgccuacagga

SEQ ID NO: 1747109 - RNA, 20 nt, Human
ccugugugugcgccuacagg

SEQ ID NO: 1747110 - RNA, 20 nt, Human
ccuuacacaaugguuuucuu

SEQ ID NO: 1747111 - RNA, 14 nt, Human
ccuuacacaauggu

SEQ ID NO: 1747112 - RNA, 20 nt, Human
ccuuaccagcagagcaccuu

SEQ ID NO: 1747113 - RNA, 20 nt, Human
ccuuaccacugcucugauga

SEQ ID NO: 1747114 - RNA, 15 nt, Human
ccuuacccucauguu

SEQ ID NO: 1747115 - RNA, 13 nt, Human
ccuuaccagcaga

SEQ ID NO: 1747116 - RNA, 17 nt, Human
ccuuaccacugcucuga

SEQ ID NO: 1747117 - RNA, 19 nt, Human
ccuuaccugccaggaagcc

SEQ ID NO: 1747118 - RNA, 19 nt, Human
ccuuacccucauguucuua

SEQ ID NO: 1747119 - RNA, 18 nt, Human
ccuuagaagucacacagu

SEQ ID NO: 1747120 - RNA, 14 nt, Human
ccuuagaaguggaa

SEQ ID NO: 1747121 - RNA, 17 nt, Human
ccuuagaagucacacag

SEQ ID NO: 1747122 - RNA, 12 nt, Human
ccuucagugccu

SEQ ID NO: 1747123 - RNA, 17 nt, Human
ccugcggugcuaucucc

SEQ ID NO: 1747124 - RNA, 16 nt, Human
ccugcggugcuaucuc

SEQ ID NO: 1747125 - RNA, 22 nt, Human
ccugcgggucacaggagggagg

SEQ ID NO: 1747126 - RNA, 18 nt, Human
ccugcgggucacaggagg

SEQ ID NO: 1747127 - RNA, 22 nt, Human
ccugccccucaacucuccucca

SEQ ID NO: 1747128 - RNA, 23 nt, Human
ccugccuguugggccaggagccu

SEQ ID NO: 1747129 - RNA, 11 nt, Human
ccugccucagc

SEQ ID NO: 1747130 - RNA, 14 nt, Human
ccugcuucaaauau

SEQ ID NO: 1747131 - RNA, 15 nt, Human
ccugcugagucccag

SEQ ID NO: 1747132 - RNA, 23 nt, Human
ccugcuuugggcugcccuggugc

SEQ ID NO: 1747133 - RNA, 22 nt, Human
ccugcuuugggcugcccuggug

SEQ ID NO: 1747134 - RNA, 21 nt, Human
ccugcuuugggcugcccuggu

SEQ ID NO: 1747135 - RNA, 20 nt, Human
ccugcuuugggcugcccugg

SEQ ID NO: 1747136 - RNA, 22 nt, Human
ccugcucuccgaccagacaccu

SEQ ID NO: 1747137 - RNA, 21 nt, Human
ccugcucuccucuugccacug

SEQ ID NO: 1747138 - RNA, 19 nt, Human
ccugcucuccucuugccac

SEQ ID NO: 1747139 - RNA, 18 nt, Human
ccugcucuccucuugcca

SEQ ID NO: 1747140 - RNA, 16 nt, Human
ccugcucuccucuugc

SEQ ID NO: 1747141 - RNA, 22 nt, Human
ccugcucuccucuugccacugc

SEQ ID NO: 1747142 - RNA, 21 nt, Human
ccugcucuccgaccagacacc

SEQ ID NO: 1747143 - RNA, 22 nt, Human
ccugcggugcuaucucccccag

SEQ ID NO: 1747144 - RNA, 21 nt, Human
ccuggucacaggacucugccu

SEQ ID NO: 1747145 - RNA, 23 nt, Human
ccuggucacaggacucugccucc

SEQ ID NO: 1747146 - RNA, 22 nt, Human
ccuggucacaggacucugccuc

SEQ ID NO: 1747147 - RNA, 18 nt, Human
ccuggggguucuuucuuc

SEQ ID NO: 1747148 - RNA, 23 nt, Human
ccuggggguucuuucuuccucug

SEQ ID NO: 1747149 - RNA, 22 nt, Human
ccuggggguucuuucuuccucu

SEQ ID NO: 1747150 - RNA, 21 nt, Human
ccuggggguucuuucuuccuc

SEQ ID NO: 1747151 - RNA, 24 nt, Human
ccuggcuuuucacugcuggcugcc

SEQ ID NO: 1747152 - RNA, 23 nt, Human
ccuggcuuuucacugcuggcugc

SEQ ID NO: 1747153 - RNA, 22 nt, Human
ccuggcuuuucacugcuggcug

SEQ ID NO: 1747154 - RNA, 21 nt, Human
ccuggcuuuucacugcuggcu

SEQ ID NO: 1747155 - RNA, 20 nt, Human
ccuggcuuuucacugcuggc

SEQ ID NO: 1747156 - RNA, 20 nt, Human
ccuggccagaugcaccagcc

SEQ ID NO: 1747157 - RNA, 15 nt, Human
ccuggccagaugcac

SEQ ID NO: 1747158 - RNA, 22 nt, Human
ccuggcagccgugccuucagcu

SEQ ID NO: 1747159 - RNA, 21 nt, Human
ccuggcagccgugccuucagc

SEQ ID NO: 1747160 - RNA, 23 nt, Human
ccuggcucccacaggcccuuccu

SEQ ID NO: 1747161 - RNA, 17 nt, Human
ccuggcucccacaggcc

SEQ ID NO: 1747162 - RNA, 22 nt, Human
ccuggcuccaaacccucgaggc

SEQ ID NO: 1747163 - RNA, 13 nt, Human
ccuggcagccccu

SEQ ID NO: 1747164 - RNA, 14 nt, Human
ccuggcagccccug

SEQ ID NO: 1747165 - RNA, 12 nt, Human
ccuggcagcccc

SEQ ID NO: 1747166 - RNA, 22 nt, Human
ccuggcacuauaauguaagcuc

SEQ ID NO: 1747167 - RNA, 23 nt, Human
ccuggcacccggccccugcuggu

SEQ ID NO: 1747168 - RNA, 22 nt, Human
ccuggcacccggccccugcugg

SEQ ID NO: 1747169 - RNA, 18 nt, Human
ccuggaauauauaaccag

SEQ ID NO: 1747170 - RNA, 16 nt, Human
ccugacagaaggacuc

SEQ ID NO: 1747171 - RNA, 11 nt, Human
ccugagcccca

SEQ ID NO: 1747172 - RNA, 14 nt, Human
ccugagcuuucugc

SEQ ID NO: 1747173 - RNA, 12 nt, Human
ccugagccagau

SEQ ID NO: 1747174 - RNA, 16 nt, Human
ccugagcuuucugcua

SEQ ID NO: 1747175 - RNA, 21 nt, Human
ccugaggcccagagggccugc

SEQ ID NO: 1747176 - RNA, 14 nt, Human
ccugcaagaacaag

SEQ ID NO: 1747177 - RNA, 20 nt, Human
ccugcaguacuuuaccuccu

SEQ ID NO: 1747178 - RNA, 18 nt, Human
ccugcaguacuuuaccuc

SEQ ID NO: 1747179 - RNA, 15 nt, Human
ccugcagggccaagc

SEQ ID NO: 1747180 - RNA, 15 nt, Human
ccugauugugucucu

SEQ ID NO: 1747181 - RNA, 14 nt, Human
ccugaggcccuucu

SEQ ID NO: 1747182 - RNA, 22 nt, Human
ccugaugcuucuucagagacuc

SEQ ID NO: 1747183 - RNA, 21 nt, Human
ccugaugcuucuucagagacu

SEQ ID NO: 1747184 - RNA, 20 nt, Human
ccugaugcuucuucagagac

SEQ ID NO: 1747185 - RNA, 19 nt, Human
ccugaugcuucuucagaga

SEQ ID NO: 1747186 - RNA, 12 nt, Human
ccugaggcccuu

SEQ ID NO: 1747187 - RNA, 11 nt, Human
ccugaggcccu

SEQ ID NO: 1747188 - RNA, 21 nt, Human
ccugcaaccugauugugucuc

SEQ ID NO: 1747189 - RNA, 22 nt, Human
ccugcaaccugauugugucucu

SEQ ID NO: 1747190 - RNA, 19 nt, Human
ccugauugugucucuuggu

SEQ ID NO: 1747191 - RNA, 17 nt, Human
ccugauugugucucuug

SEQ ID NO: 1747192 - RNA, 22 nt, Human
ccugccaggaagccagcaggcu

SEQ ID NO: 1747193 - RNA, 21 nt, Human
ccugccaggaagccagcaggc

SEQ ID NO: 1747194 - RNA, 19 nt, Human
ccugccaggaagccagcag

SEQ ID NO: 1747195 - RNA, 18 nt, Human
ccugccaggaagccagca

SEQ ID NO: 1747196 - RNA, 11 nt, Human
ccugccaggga

SEQ ID NO: 1747197 - RNA, 16 nt, Human
ccugccaggcauggug

SEQ ID NO: 1747198 - RNA, 23 nt, Human
ccugccaggaagccagcaggcuc

SEQ ID NO: 1747199 - RNA, 15 nt, Human
ccugccagggacaga

SEQ ID NO: 1747200 - RNA, 14 nt, Human
ccugccagggacag

SEQ ID NO: 1747201 - RNA, 13 nt, Human
ccugccagggaca

SEQ ID NO: 1747202 - RNA, 12 nt, Human
ccugccagggac

SEQ ID NO: 1747203 - RNA, 16 nt, Human
ccugccagggacagag

SEQ ID NO: 1747204 - RNA, 22 nt, Human
ccugccagggacagagggggug

SEQ ID NO: 1747205 - RNA, 17 nt, Human
ccugccaggaagccagc

SEQ ID NO: 1747206 - RNA, 15 nt, Human
ccugccaggaagcca

SEQ ID NO: 1747207 - RNA, 14 nt, Human
ccugccaggaagcc

SEQ ID NO: 1747208 - RNA, 13 nt, Human
ccugccaggaagc

SEQ ID NO: 1747209 - RNA, 11 nt, Human
ccacugcucug

SEQ ID NO: 1747210 - RNA, 16 nt, Human
ccacugcgaccacaag

SEQ ID NO: 1747211 - RNA, 11 nt, Human
ccacugccucu

SEQ ID NO: 1747212 - RNA, 20 nt, Human
ccacugcacuccagccuggg

SEQ ID NO: 1747213 - RNA, 19 nt, Human
ccacugcacuccagccugg

SEQ ID NO: 1747214 - RNA, 15 nt, Human
ccacucccugcaacc

SEQ ID NO: 1747215 - RNA, 23 nt, Human
ccacugcacuccagccuggguga

SEQ ID NO: 1747216 - RNA, 22 nt, Human
ccacuacggaauaguuggcuag

SEQ ID NO: 1747217 - RNA, 18 nt, Human
ccacuacauucuguuaau

SEQ ID NO: 1747218 - RNA, 23 nt, Human
ccacuacggaauaguuggcuagg

SEQ ID NO: 1747219 - RNA, 13 nt, Human
ccacucccugcaa

SEQ ID NO: 1747220 - RNA, 12 nt, Human
ccacucccugca

SEQ ID NO: 1747221 - RNA, 19 nt, Human
ccacuccagaccccuggcu

SEQ ID NO: 1747222 - RNA, 17 nt, Human
ccacuccagaccccugg

SEQ ID NO: 1747223 - RNA, 13 nt, Human
ccacguuucuaaa

SEQ ID NO: 1747224 - RNA, 17 nt, Human
ccaccucccacaaagga

SEQ ID NO: 1747225 - RNA, 20 nt, Human
ccaccugccuguugggccag

SEQ ID NO: 1747226 - RNA, 17 nt, Human
ccaccugccuguugggc

SEQ ID NO: 1747227 - RNA, 12 nt, Human
ccaccugccagg

SEQ ID NO: 1747228 - RNA, 14 nt, Human
ccaccugcccaacc

SEQ ID NO: 1747229 - RNA, 15 nt, Human
ccacggccaggccag

SEQ ID NO: 1747230 - RNA, 14 nt, Human
ccacggccaggcca

SEQ ID NO: 1747231 - RNA, 13 nt, Human
ccacggccaggcc

SEQ ID NO: 1747232 - RNA, 12 nt, Human
ccacggccaggc

SEQ ID NO: 1747233 - RNA, 17 nt, Human
ccaccuggccucugcac

SEQ ID NO: 1747234 - RNA, 16 nt, Human
ccaccuggccucugca

SEQ ID NO: 1747235 - RNA, 15 nt, Human
ccaccuggccucugc

SEQ ID NO: 1747236 - RNA, 22 nt, Human
ccaccugcggugcuaucucccc

SEQ ID NO: 1747237 - RNA, 14 nt, Human
ccacccaggagccc

SEQ ID NO: 1747238 - RNA, 12 nt, Human
ccacccaggagc

SEQ ID NO: 1747239 - RNA, 15 nt, Human
ccaccucagccuccc

SEQ ID NO: 1747240 - RNA, 14 nt, Human
ccaccucagccucc

SEQ ID NO: 1747241 - RNA, 13 nt, Human
ccaccucagccuc

SEQ ID NO: 1747242 - RNA, 12 nt, Human
ccaccucagccu

SEQ ID NO: 1747243 - RNA, 18 nt, Human
ccacccugaaagcccuga

SEQ ID NO: 1747244 - RNA, 17 nt, Human
ccacccugaaagcccug

SEQ ID NO: 1747245 - RNA, 16 nt, Human
ccacccugaaagcccu

SEQ ID NO: 1747246 - RNA, 19 nt, Human
ccaccccucaacaccucug

SEQ ID NO: 1747247 - RNA, 21 nt, Human
ccacccaggagccccgaggcc

SEQ ID NO: 1747248 - RNA, 23 nt, Human
ccacaucuugcucugcugacaga

SEQ ID NO: 1747249 - RNA, 22 nt, Human
ccacaucuugcucugcugacag

SEQ ID NO: 1747250 - RNA, 16 nt, Human
ccacaucuugcucugc

SEQ ID NO: 1747251 - RNA, 18 nt, Human
ccaccaacauacucccau

SEQ ID NO: 1747252 - RNA, 14 nt, Human
ccaccaacauacuc

SEQ ID NO: 1747253 - RNA, 14 nt, Human
ccacaucuugcucu

SEQ ID NO: 1747254 - RNA, 23 nt, Human
ccacauagugaugguuccccugu

SEQ ID NO: 1747255 - RNA, 22 nt, Human
ccacauagugaugguuccccug

SEQ ID NO: 1747256 - RNA, 21 nt, Human
ccacauagugaugguuccccu

SEQ ID NO: 1747257 - RNA, 19 nt, Human
ccacauagugaugguuccc

SEQ ID NO: 1747258 - RNA, 13 nt, Human
ccacccaccucag

SEQ ID NO: 1747259 - RNA, 22 nt, Human
ccacccaagggccuggccugag

SEQ ID NO: 1747260 - RNA, 21 nt, Human
ccacccaagggccuggccuga

SEQ ID NO: 1747261 - RNA, 20 nt, Human
ccacccaagggccuggccug

SEQ ID NO: 1747262 - RNA, 15 nt, Human
ccacccaccucagcc

SEQ ID NO: 1747263 - RNA, 14 nt, Human
ccacccaccucagc

SEQ ID NO: 1747264 - RNA, 16 nt, Human
ccacccaccucagccu

SEQ ID NO: 1747265 - RNA, 16 nt, Human
ccaccacacccagccc

SEQ ID NO: 1747266 - RNA, 14 nt, Human
ccaccacacccagc

SEQ ID NO: 1747267 - RNA, 20 nt, Human
ccaccaacauacucccaucu

SEQ ID NO: 1747268 - RNA, 19 nt, Human
ccacccaagggccuggccu

SEQ ID NO: 1747269 - RNA, 17 nt, Human
ccacccaagggccuggc

SEQ ID NO: 1747270 - RNA, 16 nt, Human
ccacccaagggccugg

SEQ ID NO: 1747271 - RNA, 14 nt, Human
ccacacccagccca

SEQ ID NO: 1747272 - RNA, 13 nt, Human
ccacacccagccc

SEQ ID NO: 1747273 - RNA, 13 nt, Human
ccacacuccagcu

SEQ ID NO: 1747274 - RNA, 17 nt, Human
ccacacuccagcuggga

SEQ ID NO: 1747275 - RNA, 14 nt, Human
ccacacuccagcug

SEQ ID NO: 1747276 - RNA, 12 nt, Human
ccacacccagcc

SEQ ID NO: 1747277 - RNA, 17 nt, Human
ccacuguacuugcucuu

SEQ ID NO: 1747278 - RNA, 19 nt, Human
ccacuguacuugcucuuga

SEQ ID NO: 1747279 - RNA, 18 nt, Human
ccacuguacuugcucuug

SEQ ID NO: 1747280 - RNA, 19 nt, Human
ccagacaccuugacagggc

SEQ ID NO: 1747281 - RNA, 17 nt, Human
ccagacaccuugacagg

SEQ ID NO: 1747282 - RNA, 20 nt, Human
ccacuguacuugcucuugau

SEQ ID NO: 1747283 - RNA, 14 nt, Human
ccagagaggguggu

SEQ ID NO: 1747284 - RNA, 23 nt, Human
ccagagaggguggugaccucugc

SEQ ID NO: 1747285 - RNA, 21 nt, Human
ccagagaggguggugaccucu

SEQ ID NO: 1747286 - RNA, 20 nt, Human
ccagacaccuugacagggca

SEQ ID NO: 1747287 - RNA, 22 nt, Human
ccagaggagagaggacccccug

SEQ ID NO: 1747288 - RNA, 21 nt, Human
ccagaggagagaggacccccu

SEQ ID NO: 1747289 - RNA, 21 nt, Human
ccagagggagugacagaggca

SEQ ID NO: 1747290 - RNA, 20 nt, Human
ccagagggagugacagaggc

SEQ ID NO: 1747291 - RNA, 19 nt, Human
ccagagggagugacagagg

SEQ ID NO: 1747292 - RNA, 18 nt, Human
ccagagggagugacagag

SEQ ID NO: 1747293 - RNA, 17 nt, Human
ccagagggagugacaga

SEQ ID NO: 1747294 - RNA, 16 nt, Human
ccagagggagugacag

SEQ ID NO: 1747295 - RNA, 19 nt, Human
ccagagcugccaccugccu

SEQ ID NO: 1747296 - RNA, 16 nt, Human
ccagagcugccaccug

SEQ ID NO: 1747297 - RNA, 15 nt, Human
ccagagcugccaccu

SEQ ID NO: 1747298 - RNA, 14 nt, Human
ccagagcugccacc

SEQ ID NO: 1747299 - RNA, 13 nt, Human
ccagagcugccac

SEQ ID NO: 1747300 - RNA, 12 nt, Human
ccagagcugcca

SEQ ID NO: 1747301 - RNA, 11 nt, Human
ccagagcugcc

SEQ ID NO: 1747302 - RNA, 22 nt, Human
ccagauucuuuccugaggcugg

SEQ ID NO: 1747303 - RNA, 21 nt, Human
ccagauucuuuccugaggcug

SEQ ID NO: 1747304 - RNA, 20 nt, Human
ccagauucuuuccugaggcu

SEQ ID NO: 1747305 - RNA, 19 nt, Human
ccagauucuuuccugaggc

SEQ ID NO: 1747306 - RNA, 18 nt, Human
ccagauucuuuccugagg

SEQ ID NO: 1747307 - RNA, 23 nt, Human
ccagagggagugacagaggcagc

SEQ ID NO: 1747308 - RNA, 22 nt, Human
ccagagggagugacagaggcag

SEQ ID NO: 1747309 - RNA, 13 nt, Human
ccagagggccugc

SEQ ID NO: 1747310 - RNA, 16 nt, Human
ccagagggccugcaag

SEQ ID NO: 1747311 - RNA, 15 nt, Human
ccagagggccugcaa

SEQ ID NO: 1747312 - RNA, 20 nt, Human
ccagauugcaacaggcuggg

SEQ ID NO: 1747313 - RNA, 19 nt, Human
ccagauugcaacaggcugg

SEQ ID NO: 1747314 - RNA, 23 nt, Human
ccagauucuuuccugaggcuggg

SEQ ID NO: 1747315 - RNA, 21 nt, Human
ccagauugcaacaggcugggc

SEQ ID NO: 1747316 - RNA, 13 nt, Human
ccagauuuaugca

SEQ ID NO: 1747317 - RNA, 12 nt, Human
ccagauuucacu

SEQ ID NO: 1747318 - RNA, 22 nt, Human
ccagauuuaugcauauuauuuu

SEQ ID NO: 1747319 - RNA, 23 nt, Human
ccagcauaauacuugcuuuggaa

SEQ ID NO: 1747320 - RNA, 19 nt, Human
ccagccaaagccuccucca

SEQ ID NO: 1747321 - RNA, 18 nt, Human
ccagccaaagccuccucc

SEQ ID NO: 1747322 - RNA, 15 nt, Human
ccagccaaagccucc

SEQ ID NO: 1747323 - RNA, 15 nt, Human
ccagccccagugccc

SEQ ID NO: 1747324 - RNA, 13 nt, Human
ccagccccagugc

SEQ ID NO: 1747325 - RNA, 23 nt, Human
ccagccccaaaacucuccucugc

SEQ ID NO: 1747326 - RNA, 17 nt, Human
ccagcccuuagcaggga

SEQ ID NO: 1747327 - RNA, 16 nt, Human
ccagcccuuagcaggg

SEQ ID NO: 1747328 - RNA, 21 nt, Human
ccagcccuccuuaucaaagga

SEQ ID NO: 1747329 - RNA, 16 nt, Human
ccagccccagugccca

SEQ ID NO: 1747330 - RNA, 19 nt, Human
ccagccgccaugcuccugg

SEQ ID NO: 1747331 - RNA, 18 nt, Human
ccagccgccaugcuccug

SEQ ID NO: 1747332 - RNA, 14 nt, Human
ccagccgccaugcu

SEQ ID NO: 1747333 - RNA, 21 nt, Human
ccagccuccaagcuccaucuc

SEQ ID NO: 1747334 - RNA, 19 nt, Human
ccagccucaucucuuuguu

SEQ ID NO: 1747335 - RNA, 15 nt, Human
ccagcaagugagagc

SEQ ID NO: 1747336 - RNA, 14 nt, Human
ccagauuucacucu

SEQ ID NO: 1747337 - RNA, 22 nt, Human
ccagcaagugagagcugggugu

SEQ ID NO: 1747338 - RNA, 21 nt, Human
ccagcaagugagagcugggug

SEQ ID NO: 1747339 - RNA, 20 nt, Human
ccagcaagugagagcugggu

SEQ ID NO: 1747340 - RNA, 16 nt, Human
ccagcaagugagagcu

SEQ ID NO: 1747341 - RNA, 18 nt, Human
ccagcaauucuccugccu

SEQ ID NO: 1747342 - RNA, 16 nt, Human
ccagcaauucuccugc

SEQ ID NO: 1747343 - RNA, 21 nt, Human
ccagcaauucuccugccucag

SEQ ID NO: 1747344 - RNA, 20 nt, Human
ccagcaauucuccugccuca

SEQ ID NO: 1747345 - RNA, 19 nt, Human
ccagcaauucuccugccuc

SEQ ID NO: 1747346 - RNA, 14 nt, Human
ccauuuguguuuau

SEQ ID NO: 1747347 - RNA, 20 nt, Human
ccauucuccaccugccaggg

SEQ ID NO: 1747348 - RNA, 19 nt, Human
ccauucuccaccugccagg

SEQ ID NO: 1747349 - RNA, 18 nt, Human
cccaaaacucuccucugc

SEQ ID NO: 1747350 - RNA, 16 nt, Human
cccaaaacucuccucu

SEQ ID NO: 1747351 - RNA, 20 nt, Human
cccaaaacucuccucugcug

SEQ ID NO: 1747352 - RNA, 15 nt, Human
cccaaagugcuggga

SEQ ID NO: 1747353 - RNA, 13 nt, Human
cccaaagugcugg

SEQ ID NO: 1747354 - RNA, 22 nt, Human
cccaaauggaaaugggcagagc

SEQ ID NO: 1747355 - RNA, 18 nt, Human
cccaaauggaaaugggca

SEQ ID NO: 1747356 - RNA, 23 nt, Human
cccaaauggaaaugggcagagca

SEQ ID NO: 1747357 - RNA, 16 nt, Human
cccaaagugcugggau

SEQ ID NO: 1747358 - RNA, 20 nt, Human
cccaaagugguauagaaaug

SEQ ID NO: 1747359 - RNA, 21 nt, Human
cccaaagugguauagaaaugc

SEQ ID NO: 1747360 - RNA, 15 nt, Human
cccaacccuggcacc

SEQ ID NO: 1747361 - RNA, 17 nt, Human
cccaaggcucugagcaa

SEQ ID NO: 1747362 - RNA, 16 nt, Human
ccaugggacagggagg

SEQ ID NO: 1747363 - RNA, 19 nt, Human
ccaugggacagggaggacg

SEQ ID NO: 1747364 - RNA, 16 nt, Human
ccauguuggccaggcu

SEQ ID NO: 1747365 - RNA, 17 nt, Human
ccauguuggccaggcug

SEQ ID NO: 1747366 - RNA, 21 nt, Human
ccauguuggccaggcugcucu

SEQ ID NO: 1747367 - RNA, 18 nt, Human
ccauguuggccaggcugc

SEQ ID NO: 1747368 - RNA, 16 nt, Human
ccaucuaaacugcccc

SEQ ID NO: 1747369 - RNA, 15 nt, Human
ccaucuaaacugccc

SEQ ID NO: 1747370 - RNA, 21 nt, Human
ccaugggaaaugucaacaagu

SEQ ID NO: 1747371 - RNA, 14 nt, Human
ccaucuaaacugcc

SEQ ID NO: 1747372 - RNA, 23 nt, Human
ccauauucuguuggccaguguga

SEQ ID NO: 1747373 - RNA, 21 nt, Human
ccauaguaugggacuggccuc

SEQ ID NO: 1747374 - RNA, 12 nt, Human
ccauaggucacc

SEQ ID NO: 1747375 - RNA, 22 nt, Human
ccaguguuguggauuuaacaga

SEQ ID NO: 1747376 - RNA, 17 nt, Human
ccagugaggcucugccc

SEQ ID NO: 1747377 - RNA, 20 nt, Human
ccagugccgagaaggaagcc

SEQ ID NO: 1747378 - RNA, 22 nt, Human
ccagugguuccuaauccucuag

SEQ ID NO: 1747379 - RNA, 15 nt, Human
ccagugaggcucugc

SEQ ID NO: 1747380 - RNA, 14 nt, Human
ccagugaggcucug

SEQ ID NO: 1747381 - RNA, 16 nt, Human
ccagugaggcucugcc

SEQ ID NO: 1747382 - RNA, 13 nt, Human
ccaucuacccucc

SEQ ID NO: 1747383 - RNA, 21 nt, Human
ccaggcccucugcccacuccc

SEQ ID NO: 1747384 - RNA, 20 nt, Human
ccaggcccucugcccacucc

SEQ ID NO: 1747385 - RNA, 23 nt, Human
ccaggcccucugcccacucccug

SEQ ID NO: 1747386 - RNA, 22 nt, Human
ccaggcccucugcccacucccu

SEQ ID NO: 1747387 - RNA, 24 nt, Human
ccaggcuguaucccaugagccuca

SEQ ID NO: 1747388 - RNA, 17 nt, Human
ccaggcuuagucacuga

SEQ ID NO: 1747389 - RNA, 19 nt, Human
ccaggcgccccuucccccu

SEQ ID NO: 1747390 - RNA, 18 nt, Human
ccaggcgccccuuccccc

SEQ ID NO: 1747391 - RNA, 21 nt, Human
ccaggcauuccccaggaggcc

SEQ ID NO: 1747392 - RNA, 19 nt, Human
ccaggcauuccccaggagg

SEQ ID NO: 1747393 - RNA, 18 nt, Human
ccaggcauuccccaggag

SEQ ID NO: 1747394 - RNA, 12 nt, Human
ccaggagccucc

SEQ ID NO: 1747395 - RNA, 20 nt, Human
ccaggagccccgaggccuuc

SEQ ID NO: 1747396 - RNA, 19 nt, Human
ccaggagccccgaggccuu

SEQ ID NO: 1747397 - RNA, 16 nt, Human
ccagccuccaugcugc

SEQ ID NO: 1747398 - RNA, 15 nt, Human
ccagccuccaugcug

SEQ ID NO: 1747399 - RNA, 22 nt, Human
ccagggacagaggggguggccu

SEQ ID NO: 1747400 - RNA, 21 nt, Human
ccagggacagaggggguggcc

SEQ ID NO: 1747401 - RNA, 15 nt, Human
ccagggacagagggg

SEQ ID NO: 1747402 - RNA, 14 nt, Human
ccagggacagaggg

SEQ ID NO: 1747403 - RNA, 20 nt, Human
ccaggcuuagucacugagac

SEQ ID NO: 1747404 - RNA, 18 nt, Human
ccaggugcacaagcucca

SEQ ID NO: 1747405 - RNA, 20 nt, Human
ccaggugcacaagcuccaag

SEQ ID NO: 1747406 - RNA, 19 nt, Human
ccaggugcacaagcuccaa

SEQ ID NO: 1747407 - RNA, 21 nt, Human
ccagggcuggaaugauuucag

SEQ ID NO: 1747408 - RNA, 20 nt, Human
ccagucuggaaugcaguggu

SEQ ID NO: 1747409 - RNA, 19 nt, Human
ccagucuggaaugcagugg

SEQ ID NO: 1747410 - RNA, 18 nt, Human
ccagucuggaaugcagug

SEQ ID NO: 1747411 - RNA, 24 nt, Human
ccaggugcacaagcuccaagcucc

SEQ ID NO: 1747412 - RNA, 15 nt, Human
ccagguuccacagag

SEQ ID NO: 1747413 - RNA, 18 nt, Human
ccagguuccacagaggac

SEQ ID NO: 1747414 - RNA, 17 nt, Human
ccagguuuuuggucuga

SEQ ID NO: 1747415 - RNA, 22 nt, Human
cauuccugaugcuucuucagag

SEQ ID NO: 1747416 - RNA, 19 nt, Human
cauuccugaugcuucuuca

SEQ ID NO: 1747417 - RNA, 16 nt, Human
cauuccugaugcuucu

SEQ ID NO: 1747418 - RNA, 14 nt, Human
cauuccugaugcuu

SEQ ID NO: 1747419 - RNA, 23 nt, Human
cauuccugaugcuucuucagaga

SEQ ID NO: 1747420 - RNA, 17 nt, Human
cauucuguuaaucauua

SEQ ID NO: 1747421 - RNA, 13 nt, Human
cauucuggaauaa

SEQ ID NO: 1747422 - RNA, 20 nt, Human
cauucugccugcccaggccc

SEQ ID NO: 1747423 - RNA, 19 nt, Human
cauucugccugcccaggcc

SEQ ID NO: 1747424 - RNA, 18 nt, Human
cauucugccugcccaggc

SEQ ID NO: 1747425 - RNA, 17 nt, Human
cauucugccugcccagg

SEQ ID NO: 1747426 - RNA, 16 nt, Human
cauucugccugcccag

SEQ ID NO: 1747427 - RNA, 15 nt, Human
cauucugccugccca

SEQ ID NO: 1747428 - RNA, 13 nt, Human
cauucugccugcc

SEQ ID NO: 1747429 - RNA, 12 nt, Human
cauucugccugc

SEQ ID NO: 1747430 - RNA, 23 nt, Human
cauucuucuguacgucugacagg

SEQ ID NO: 1747431 - RNA, 17 nt, Human
cauuccaccuucccaug

SEQ ID NO: 1747432 - RNA, 22 nt, Human
cauuccaccuucccaugcccug

SEQ ID NO: 1747433 - RNA, 19 nt, Human
cauucauuuucuggguguu

SEQ ID NO: 1747434 - RNA, 19 nt, Human
cauuccccaggaggccagc

SEQ ID NO: 1747435 - RNA, 18 nt, Human
cauuccccaggaggccag

SEQ ID NO: 1747436 - RNA, 20 nt, Human
cauuccccaggaggccagcc

SEQ ID NO: 1747437 - RNA, 13 nt, Human
cauuccccauggg

SEQ ID NO: 1747438 - RNA, 17 nt, Human
cauuccccgucucuggu

SEQ ID NO: 1747439 - RNA, 17 nt, Human
cauuccccaggaggcca

SEQ ID NO: 1747440 - RNA, 15 nt, Human
cauuccccaggaggc

SEQ ID NO: 1747441 - RNA, 13 nt, Human
cauuccccaggag

SEQ ID NO: 1747442 - RNA, 21 nt, Human
cauuuuuaagugcugcauuua

SEQ ID NO: 1747443 - RNA, 17 nt, Human
cauuuuuaguagagaca

SEQ ID NO: 1747444 - RNA, 18 nt, Human
cauuuuuaguagagacag

SEQ ID NO: 1747445 - RNA, 16 nt, Human
ccaaacccuucagugc

SEQ ID NO: 1747446 - RNA, 23 nt, Human
cauuuuaccuuugacaaagguaa

SEQ ID NO: 1747447 - RNA, 23 nt, Human
cauuuuauuuuauuaugcaugaa

SEQ ID NO: 1747448 - RNA, 17 nt, Human
cauuuuacuuuuuccug

SEQ ID NO: 1747449 - RNA, 20 nt, Human
cauuuuacuuuuuccuggcu

SEQ ID NO: 1747450 - RNA, 22 nt, Human
cauuuuacuuuuuccuggcuca

SEQ ID NO: 1747451 - RNA, 14 nt, Human
cauuugcuuuggaa

SEQ ID NO: 1747452 - RNA, 15 nt, Human
cauuugcuuuggaag

SEQ ID NO: 1747453 - RNA, 15 nt, Human
cauugugggaagggg

SEQ ID NO: 1747454 - RNA, 15 nt, Human
cauuuaaaaaaaauc

SEQ ID NO: 1747455 - RNA, 19 nt, Human
cauuuaaaacauuaaaaua

SEQ ID NO: 1747456 - RNA, 17 nt, Human
cauugaccugaggcccu

SEQ ID NO: 1747457 - RNA, 15 nt, Human
cauugaccugaggcc

SEQ ID NO: 1747458 - RNA, 14 nt, Human
cauugaccugaggc

SEQ ID NO: 1747459 - RNA, 18 nt, Human
cauugaccugaggcccuu

SEQ ID NO: 1747460 - RNA, 17 nt, Human
cauuugaaaauuuugau

SEQ ID NO: 1747461 - RNA, 19 nt, Human
cauuugaaaauuuugaugu

SEQ ID NO: 1747462 - RNA, 22 nt, Human
cauuuacccuucuuuucugacu

SEQ ID NO: 1747463 - RNA, 14 nt, Human
caugcagcaucuaa

SEQ ID NO: 1747464 - RNA, 17 nt, Human
caugcgggcuuccuccu

SEQ ID NO: 1747465 - RNA, 15 nt, Human
caugcugucccuuac

SEQ ID NO: 1747466 - RNA, 13 nt, Human
caugcugucccuu

SEQ ID NO: 1747467 - RNA, 17 nt, Human
caugcugucccuuacgu

SEQ ID NO: 1747468 - RNA, 15 nt, Human
cauggacuuccacug

SEQ ID NO: 1747469 - RNA, 22 nt, Human
cauggacuucugccagcauaau

SEQ ID NO: 1747470 - RNA, 18 nt, Human
caugggccuccugugugu

SEQ ID NO: 1747471 - RNA, 23 nt, Human
caugggacagggaggacgcucuc

SEQ ID NO: 1747472 - RNA, 23 nt, Human
cauggucggaaaacaugcuacac

SEQ ID NO: 1747473 - RNA, 17 nt, Human
cauggucggaaaacaug

SEQ ID NO: 1747474 - RNA, 19 nt, Human
cauggucggaaaacaugcu

SEQ ID NO: 1747475 - RNA, 18 nt, Human
cauguguuggcagccucu

SEQ ID NO: 1747476 - RNA, 14 nt, Human
cauguguuccaagg

SEQ ID NO: 1747477 - RNA, 14 nt, Human
caugugcacaugca

SEQ ID NO: 1747478 - RNA, 21 nt, Human
caugugaugagaggaaaucac

SEQ ID NO: 1747479 - RNA, 20 nt, Human
caugugaugagaggaaauca

SEQ ID NO: 1747480 - RNA, 18 nt, Human
caugugaugagaggaaau

SEQ ID NO: 1747481 - RNA, 17 nt, Human
caugugaugagaggaaa

SEQ ID NO: 1747482 - RNA, 16 nt, Human
caugugaugagaggaa

SEQ ID NO: 1747483 - RNA, 15 nt, Human
caugugaugagagga

SEQ ID NO: 1747484 - RNA, 12 nt, Human
caugucuggcua

SEQ ID NO: 1747485 - RNA, 14 nt, Human
caugucucgacuca

SEQ ID NO: 1747486 - RNA, 15 nt, Human
cauguuugugauuga

SEQ ID NO: 1747487 - RNA, 22 nt, Human
cauuaaaaaaaaaaaaaaaagu

SEQ ID NO: 1747488 - RNA, 20 nt, Human
cauguuuuucuucucccuca

SEQ ID NO: 1747489 - RNA, 19 nt, Human
cauguuuuucuucucccuc

SEQ ID NO: 1747490 - RNA, 12 nt, Human
cauguuugugau

SEQ ID NO: 1747491 - RNA, 14 nt, Human
cauguuugugauug

SEQ ID NO: 1747492 - RNA, 20 nt, Human
cauguuucuuuguaaugaaa

SEQ ID NO: 1747493 - RNA, 11 nt, Human
cauuaaaauau

SEQ ID NO: 1747494 - RNA, 14 nt, Human
cauuaaaauauaau

SEQ ID NO: 1747495 - RNA, 23 nt, Human
cauccacugugccaugugccagg

SEQ ID NO: 1747496 - RNA, 17 nt, Human
cauccacugugccaugu

SEQ ID NO: 1747497 - RNA, 14 nt, Human
cauccacugugcca

SEQ ID NO: 1747498 - RNA, 12 nt, Human
cauccauccagg

SEQ ID NO: 1747499 - RNA, 13 nt, Human
caucccuccuggg

SEQ ID NO: 1747500 - RNA, 15 nt, Human
caucccucuggggcu

SEQ ID NO: 1747501 - RNA, 12 nt, Human
caucacccgcua

SEQ ID NO: 1747502 - RNA, 20 nt, Human
caucaccaacgucugugcca

SEQ ID NO: 1747503 - RNA, 15 nt, Human
caucaugucuggcua

SEQ ID NO: 1747504 - RNA, 14 nt, Human
caucaugucuggcu

SEQ ID NO: 1747505 - RNA, 13 nt, Human
caucaugucuggc

SEQ ID NO: 1747506 - RNA, 16 nt, Human
caucauccuaagcuau

SEQ ID NO: 1747507 - RNA, 23 nt, Human
cauauaagauucauauuuacuuc

SEQ ID NO: 1747508 - RNA, 16 nt, Human
cauauaagugauugcu

SEQ ID NO: 1747509 - RNA, 19 nt, Human
cauagugaugguuccccug

SEQ ID NO: 1747510 - RNA, 18 nt, Human
cauagugaugguuccccu

SEQ ID NO: 1747511 - RNA, 15 nt, Human
cauaguaugguggcu

SEQ ID NO: 1747512 - RNA, 17 nt, Human
cauaguaugguggcugg

SEQ ID NO: 1747513 - RNA, 16 nt, Human
cauaguaugguggcug

SEQ ID NO: 1747514 - RNA, 22 nt, Human
cauauucuguuggccaguguga

SEQ ID NO: 1747515 - RNA, 17 nt, Human
cauauugauuuccguua

SEQ ID NO: 1747516 - RNA, 21 nt, Human
cauauugauuuccguuaaaau

SEQ ID NO: 1747517 - RNA, 19 nt, Human
cauauuguuacugguacca

SEQ ID NO: 1747518 - RNA, 13 nt, Human
cauauuguuacug

SEQ ID NO: 1747519 - RNA, 14 nt, Human
caucaacaucuugg

SEQ ID NO: 1747520 - RNA, 16 nt, Human
cauauuuuaaacagag

SEQ ID NO: 1747521 - RNA, 17 nt, Human
cauauuuuaaacagagg

SEQ ID NO: 1747522 - RNA, 18 nt, Human
cauauuuuaaacagagga

SEQ ID NO: 1747523 - RNA, 12 nt, Human
caugaagacaga

SEQ ID NO: 1747524 - RNA, 19 nt, Human
caugaaaacacauuuuucu

SEQ ID NO: 1747525 - RNA, 21 nt, Human
caugaaaacacauuuuucuua

SEQ ID NO: 1747526 - RNA, 13 nt, Human
caugaaaacacau

SEQ ID NO: 1747527 - RNA, 14 nt, Human
caugaaaacacauu

SEQ ID NO: 1747528 - RNA, 15 nt, Human
caugaaaacacauuu

SEQ ID NO: 1747529 - RNA, 16 nt, Human
caugaaaacacauuuu

SEQ ID NO: 1747530 - RNA, 17 nt, Human
caugaaaacacauuuuu

SEQ ID NO: 1747531 - RNA, 18 nt, Human
caugaagauguagaggag

SEQ ID NO: 1747532 - RNA, 19 nt, Human
caugaagauguagaggaga

SEQ ID NO: 1747533 - RNA, 20 nt, Human
caugacucguauaugucuca

SEQ ID NO: 1747534 - RNA, 23 nt, Human
caugacucguauaugucucaggu

SEQ ID NO: 1747535 - RNA, 13 nt, Human
caugagcaucagg

SEQ ID NO: 1747536 - RNA, 21 nt, Human
caugagccucagcauccuggc

SEQ ID NO: 1747537 - RNA, 20 nt, Human
caugagccucagcauccugg

SEQ ID NO: 1747538 - RNA, 19 nt, Human
caugagccucagcauccug

SEQ ID NO: 1747539 - RNA, 18 nt, Human
caugagccucagcauccu

SEQ ID NO: 1747540 - RNA, 17 nt, Human
caugagccucagcaucc

SEQ ID NO: 1747541 - RNA, 15 nt, Human
caugagccucagcau

SEQ ID NO: 1747542 - RNA, 12 nt, Human
caugagccucag

SEQ ID NO: 1747543 - RNA, 23 nt, Human
caugagcaucaggccaggcccuc

SEQ ID NO: 1747544 - RNA, 22 nt, Human
caugagcaucaggccaggcccu

SEQ ID NO: 1747545 - RNA, 21 nt, Human
caugagcaucaggccaggccc

SEQ ID NO: 1747546 - RNA, 20 nt, Human
caugagcaucaggccaggcc

SEQ ID NO: 1747547 - RNA, 18 nt, Human
caugagcaucaggccagg

SEQ ID NO: 1747548 - RNA, 17 nt, Human
caugagcaucaggccag

SEQ ID NO: 1747549 - RNA, 16 nt, Human
caugagcaucaggcca

SEQ ID NO: 1747550 - RNA, 15 nt, Human
caugagcaucaggcc

SEQ ID NO: 1747551 - RNA, 19 nt, Human
caugagguacugagaguga

SEQ ID NO: 1747552 - RNA, 13 nt, Human
caugaguccccug

SEQ ID NO: 1747553 - RNA, 15 nt, Human
caugaguccccuguu

SEQ ID NO: 1747554 - RNA, 14 nt, Human
caugaguccccugu

SEQ ID NO: 1747555 - RNA, 23 nt, Human
caugaguccccuguuuguuucug

SEQ ID NO: 1747556 - RNA, 16 nt, Human
caugagguacugagag

SEQ ID NO: 1747557 - RNA, 23 nt, Human
caugaggaacaaggcaaggcugu

SEQ ID NO: 1747558 - RNA, 21 nt, Human
caugaggaacaaggcaaggcu

SEQ ID NO: 1747559 - RNA, 20 nt, Human
caugaggaacaaggcaaggc

SEQ ID NO: 1747560 - RNA, 17 nt, Human
caugaggaacaaggcaa

SEQ ID NO: 1747561 - RNA, 16 nt, Human
caugaggaacaaggca

SEQ ID NO: 1747562 - RNA, 23 nt, Human
caugagccucagcauccuggcac

SEQ ID NO: 1747563 - RNA, 22 nt, Human
caugagccucagcauccuggca

SEQ ID NO: 1747564 - RNA, 15 nt, Human
caucucuccuccuuu

SEQ ID NO: 1747565 - RNA, 16 nt, Human
caucucuacaaaaagc

SEQ ID NO: 1747566 - RNA, 17 nt, Human
caucucccuuuuccaug

SEQ ID NO: 1747567 - RNA, 19 nt, Human
cauccuacaagacacagug

SEQ ID NO: 1747568 - RNA, 18 nt, Human
cauccuacaagacacagu

SEQ ID NO: 1747569 - RNA, 21 nt, Human
caucuugaauuguaaggaaug

SEQ ID NO: 1747570 - RNA, 16 nt, Human
caucuugaauuguaag

SEQ ID NO: 1747571 - RNA, 17 nt, Human
caucuugcucugcugac

SEQ ID NO: 1747572 - RNA, 16 nt, Human
caucuugcucugcuga

SEQ ID NO: 1747573 - RNA, 19 nt, Human
caucuugcucugcugacag

SEQ ID NO: 1747574 - RNA, 22 nt, Human
cagggaaacagcuaaugggaca

SEQ ID NO: 1747575 - RNA, 20 nt, Human
cagggacagaggggguggcc

SEQ ID NO: 1747576 - RNA, 14 nt, Human
cagggacagagggg

SEQ ID NO: 1747577 - RNA, 13 nt, Human
cagggacagaggg

SEQ ID NO: 1747578 - RNA, 17 nt, Human
cagggaaggggacaagg

SEQ ID NO: 1747579 - RNA, 15 nt, Human
cagggaaggggacaa

SEQ ID NO: 1747580 - RNA, 15 nt, Human
cagggccuggcucag

SEQ ID NO: 1747581 - RNA, 14 nt, Human
cagggccuggcuca

SEQ ID NO: 1747582 - RNA, 13 nt, Human
cagggccuggcuc

SEQ ID NO: 1747583 - RNA, 19 nt, Human
cagggccuggcucaggugg

SEQ ID NO: 1747584 - RNA, 16 nt, Human
cagggccuggcucagg

SEQ ID NO: 1747585 - RNA, 19 nt, Human
caggggaggguagagcgga

SEQ ID NO: 1747586 - RNA, 20 nt, Human
cagggcauggccagguggcc

SEQ ID NO: 1747587 - RNA, 23 nt, Human
cagggacagaggggguggccucc

SEQ ID NO: 1747588 - RNA, 14 nt, Human
cagggcacaccggg

SEQ ID NO: 1747589 - RNA, 21 nt, Human
cagggcacaccgggcacucag

SEQ ID NO: 1747590 - RNA, 19 nt, Human
cagggcacaccgggcacuc

SEQ ID NO: 1747591 - RNA, 17 nt, Human
cagggcacaccgggcac

SEQ ID NO: 1747592 - RNA, 15 nt, Human
cagggcacaccgggc

SEQ ID NO: 1747593 - RNA, 23 nt, Human
cagggcacaccgggcacucagaa

SEQ ID NO: 1747594 - RNA, 22 nt, Human
cagggcacaccgggcacucaga

SEQ ID NO: 1747595 - RNA, 20 nt, Human
caggcuccuuuagcgcccag

SEQ ID NO: 1747596 - RNA, 19 nt, Human
caggcuccuuuagcgccca

SEQ ID NO: 1747597 - RNA, 14 nt, Human
caggcuccuuuagc

SEQ ID NO: 1747598 - RNA, 18 nt, Human
caggcuccugccaccacg

SEQ ID NO: 1747599 - RNA, 16 nt, Human
caggcuccugccacca

SEQ ID NO: 1747600 - RNA, 15 nt, Human
caggcuccugccacc

SEQ ID NO: 1747601 - RNA, 14 nt, Human
caggcuccugccac

SEQ ID NO: 1747602 - RNA, 13 nt, Human
caggcuccugcca

SEQ ID NO: 1747603 - RNA, 20 nt, Human
caggcucucaggccagcugc

SEQ ID NO: 1747604 - RNA, 19 nt, Human
caggcucucaggccagcug

SEQ ID NO: 1747605 - RNA, 18 nt, Human
caggcucucaggccagcu

SEQ ID NO: 1747606 - RNA, 17 nt, Human
caggcucucaggccagc

SEQ ID NO: 1747607 - RNA, 23 nt, Human
caggcucucaggccagcugcuug

SEQ ID NO: 1747608 - RNA, 21 nt, Human
caggcucucaggccagcugcu

SEQ ID NO: 1747609 - RNA, 16 nt, Human
caggcucucaggccag

SEQ ID NO: 1747610 - RNA, 15 nt, Human
caggcucucaggcca

SEQ ID NO: 1747611 - RNA, 14 nt, Human
caggcucucaggcc

SEQ ID NO: 1747612 - RNA, 13 nt, Human
caggcucucaggc

SEQ ID NO: 1747613 - RNA, 12 nt, Human
caggcucucagg

SEQ ID NO: 1747614 - RNA, 20 nt, Human
caggcucgggcuccccagcc

SEQ ID NO: 1747615 - RNA, 21 nt, Human
caggcuccuuuagcgcccagu

SEQ ID NO: 1747616 - RNA, 19 nt, Human
caggcccggcuccaggcuc

SEQ ID NO: 1747617 - RNA, 18 nt, Human
caggcccggcuccaggcu

SEQ ID NO: 1747618 - RNA, 17 nt, Human
caggcccggcuccaggc

SEQ ID NO: 1747619 - RNA, 15 nt, Human
caggcccucugccca

SEQ ID NO: 1747620 - RNA, 14 nt, Human
caggcccucugccc

SEQ ID NO: 1747621 - RNA, 13 nt, Human
caggcccucugcc

SEQ ID NO: 1747622 - RNA, 21 nt, Human
caggcccggcuccaggcuccu

SEQ ID NO: 1747623 - RNA, 20 nt, Human
caggcccggcuccaggcucc

SEQ ID NO: 1747624 - RNA, 22 nt, Human
caggcccggcuccaggcuccuu

SEQ ID NO: 1747625 - RNA, 22 nt, Human
caggcccucugcccacucccug

SEQ ID NO: 1747626 - RNA, 21 nt, Human
caggcccucugcccacucccu

SEQ ID NO: 1747627 - RNA, 20 nt, Human
caggcccucugcccacuccc

SEQ ID NO: 1747628 - RNA, 19 nt, Human
caggcccucugcccacucc

SEQ ID NO: 1747629 - RNA, 17 nt, Human
caggcccucugcccacu

SEQ ID NO: 1747630 - RNA, 16 nt, Human
caggcccucugcccac

SEQ ID NO: 1747631 - RNA, 15 nt, Human
caggcccuuccucuc

SEQ ID NO: 1747632 - RNA, 17 nt, Human
caggcccuuccucucca

SEQ ID NO: 1747633 - RNA, 16 nt, Human
caggcccuuccucucc

SEQ ID NO: 1747634 - RNA, 23 nt, Human
caggcccuuccucuccacugccu

SEQ ID NO: 1747635 - RNA, 21 nt, Human
caggcccuuccucuccacugc

SEQ ID NO: 1747636 - RNA, 20 nt, Human
caggcccuuccucuccacug

SEQ ID NO: 1747637 - RNA, 19 nt, Human
caggcccuuccucuccacu

SEQ ID NO: 1747638 - RNA, 23 nt, Human
caggcuuagucacugagacagcc

SEQ ID NO: 1747639 - RNA, 22 nt, Human
caggcuuagucacugagacagc

SEQ ID NO: 1747640 - RNA, 23 nt, Human
caggcuuuuuuaucaugugaaau

SEQ ID NO: 1747641 - RNA, 16 nt, Human
cagggaaacagcuaau

SEQ ID NO: 1747642 - RNA, 21 nt, Human
caggcuguaucccaugagccu

SEQ ID NO: 1747643 - RNA, 20 nt, Human
caggcuguaucccaugagcc

SEQ ID NO: 1747644 - RNA, 14 nt, Human
caggcuguauccca

SEQ ID NO: 1747645 - RNA, 23 nt, Human
caggcuggucucgaacuccugac

SEQ ID NO: 1747646 - RNA, 19 nt, Human
caggcuggucucaaacucu

SEQ ID NO: 1747647 - RNA, 22 nt, Human
caggcuggucucgaacuccuga

SEQ ID NO: 1747648 - RNA, 20 nt, Human
caggcuggucucgaacuccu

SEQ ID NO: 1747649 - RNA, 12 nt, Human
caggcuggucuc

SEQ ID NO: 1747650 - RNA, 23 nt, Human
caggcuggucucaaacuccugac

SEQ ID NO: 1747651 - RNA, 21 nt, Human
caggcuuagucacugagacag

SEQ ID NO: 1747652 - RNA, 20 nt, Human
caggcuuagucacugagaca

SEQ ID NO: 1747653 - RNA, 17 nt, Human
caggcuuagucacugag

SEQ ID NO: 1747654 - RNA, 16 nt, Human
caggcuuagucacuga

SEQ ID NO: 1747655 - RNA, 23 nt, Human
caggcuguaucccaugagccuca

SEQ ID NO: 1747656 - RNA, 22 nt, Human
caggcuguaucccaugagccuc

SEQ ID NO: 1747657 - RNA, 14 nt, Human
caggcugugaguuu

SEQ ID NO: 1747658 - RNA, 21 nt, Human
caggcugggucgcccuggacu

SEQ ID NO: 1747659 - RNA, 23 nt, Human
caggcugggcuucaguggcagcu

SEQ ID NO: 1747660 - RNA, 23 nt, Human
caggcugggucgcccuggacugu

SEQ ID NO: 1747661 - RNA, 16 nt, Human
caggcuggcccugccc

SEQ ID NO: 1747662 - RNA, 15 nt, Human
caggcuggcccugcc

SEQ ID NO: 1747663 - RNA, 14 nt, Human
caggcuggcccugc

SEQ ID NO: 1747664 - RNA, 12 nt, Human
caggcuggcccu

SEQ ID NO: 1747665 - RNA, 20 nt, Human
caggcugcucuugaacuccu

SEQ ID NO: 1747666 - RNA, 12 nt, Human
caggcugcucuu

SEQ ID NO: 1747667 - RNA, 23 nt, Human
caggcugcucuugaacuccugac

SEQ ID NO: 1747668 - RNA, 21 nt, Human
caggcugagccucagucuccc

SEQ ID NO: 1747669 - RNA, 17 nt, Human
caggcugagccucaguc

SEQ ID NO: 1747670 - RNA, 16 nt, Human
caggcugagccucagu

SEQ ID NO: 1747671 - RNA, 15 nt, Human
caggcugagccucag

SEQ ID NO: 1747672 - RNA, 14 nt, Human
caggcugagccuca

SEQ ID NO: 1747673 - RNA, 13 nt, Human
caggcugagccuc

SEQ ID NO: 1747674 - RNA, 12 nt, Human
caggcucuucuc

SEQ ID NO: 1747675 - RNA, 15 nt, Human
caggcucuucuccuu

SEQ ID NO: 1747676 - RNA, 14 nt, Human
caggcucuucuccu

SEQ ID NO: 1747677 - RNA, 22 nt, Human
caggcucuucuccuuucacaac

SEQ ID NO: 1747678 - RNA, 18 nt, Human
caggcucuucuccuuuca

SEQ ID NO: 1747679 - RNA, 12 nt, Human
caggcugagccu

SEQ ID NO: 1747680 - RNA, 18 nt, Human
caggauucuuccucccuc

SEQ ID NO: 1747681 - RNA, 17 nt, Human
caggauucuuccucccu

SEQ ID NO: 1747682 - RNA, 19 nt, Human
caggauguacaaggacagc

SEQ ID NO: 1747683 - RNA, 23 nt, Human
caggauggccgggcgcgguggcu

SEQ ID NO: 1747684 - RNA, 22 nt, Human
caggaugaugacuauggaaaga

SEQ ID NO: 1747685 - RNA, 20 nt, Human
caggaugaugacuauggaaa

SEQ ID NO: 1747686 - RNA, 18 nt, Human
caggaugaugacuaugga

SEQ ID NO: 1747687 - RNA, 14 nt, Human
caggaucagucuga

SEQ ID NO: 1747688 - RNA, 13 nt, Human
caggaucagucug

SEQ ID NO: 1747689 - RNA, 20 nt, Human
caggauucuuccucccuccc

SEQ ID NO: 1747690 - RNA, 21 nt, Human
caggcaagcaccuccugccuc

SEQ ID NO: 1747691 - RNA, 16 nt, Human
caggcaagcaccuccu

SEQ ID NO: 1747692 - RNA, 15 nt, Human
caggcaagcaccucc

SEQ ID NO: 1747693 - RNA, 14 nt, Human
caggcaagcaccuc

SEQ ID NO: 1747694 - RNA, 15 nt, Human
caggcagccaggcca

SEQ ID NO: 1747695 - RNA, 14 nt, Human
caggcagccaggcc

SEQ ID NO: 1747696 - RNA, 14 nt, Human
caggcaaugcuggc

SEQ ID NO: 1747697 - RNA, 17 nt, Human
caggcagccaggccaca

SEQ ID NO: 1747698 - RNA, 16 nt, Human
caggcagccaggccac

SEQ ID NO: 1747699 - RNA, 20 nt, Human
caggcaggaaggcugagagg

SEQ ID NO: 1747700 - RNA, 13 nt, Human
caggcagguccag

SEQ ID NO: 1747701 - RNA, 17 nt, Human
caggcauuccccaggag

SEQ ID NO: 1747702 - RNA, 16 nt, Human
caggcauuccccagga

SEQ ID NO: 1747703 - RNA, 15 nt, Human
caggcauuccccagg

SEQ ID NO: 1747704 - RNA, 13 nt, Human
caggcauucccca

SEQ ID NO: 1747705 - RNA, 20 nt, Human
caggcauguucucugaggac

SEQ ID NO: 1747706 - RNA, 19 nt, Human
caggcauguucucugagga

SEQ ID NO: 1747707 - RNA, 18 nt, Human
caggcauguucucugagg

SEQ ID NO: 1747708 - RNA, 15 nt, Human
caggcauguucucug

SEQ ID NO: 1747709 - RNA, 21 nt, Human
caggcauuccccaggaggcca

SEQ ID NO: 1747710 - RNA, 20 nt, Human
caggcauuccccaggaggcc

SEQ ID NO: 1747711 - RNA, 19 nt, Human
caggcauuccccaggaggc

SEQ ID NO: 1747712 - RNA, 18 nt, Human
caggcauuccccaggagg

SEQ ID NO: 1747713 - RNA, 23 nt, Human
caggcauuccccaggaggccagc

SEQ ID NO: 1747714 - RNA, 22 nt, Human
caggcauuccccaggaggccag

SEQ ID NO: 1747715 - RNA, 24 nt, Human
caggcauuccccaggaggccagcc

SEQ ID NO: 1747716 - RNA, 15 nt, Human
caggcaggugggaug

SEQ ID NO: 1747717 - RNA, 23 nt, Human
caggcaggucuugaacuccuggc

SEQ ID NO: 1747718 - RNA, 22 nt, Human
caggcaggucuugaacuccugg

SEQ ID NO: 1747719 - RNA, 13 nt, Human
caggcaggucuug

SEQ ID NO: 1747720 - RNA, 12 nt, Human
caggcaggucuu

SEQ ID NO: 1747721 - RNA, 19 nt, Human
caggcagguccaggguuug

SEQ ID NO: 1747722 - RNA, 15 nt, Human
caggcagguccaggg

SEQ ID NO: 1747723 - RNA, 14 nt, Human
caggcagguccagg

SEQ ID NO: 1747724 - RNA, 17 nt, Human
caggcaugguggcccac

SEQ ID NO: 1747725 - RNA, 13 nt, Human
caggccccugcca

SEQ ID NO: 1747726 - RNA, 21 nt, Human
caggccauuccccgucucugg

SEQ ID NO: 1747727 - RNA, 22 nt, Human
caggccaggcccucugcccacu

SEQ ID NO: 1747728 - RNA, 21 nt, Human
caggccaggcccucugcccac

SEQ ID NO: 1747729 - RNA, 20 nt, Human
caggccacaagacccuugug

SEQ ID NO: 1747730 - RNA, 18 nt, Human
caggccauuccccgucuc

SEQ ID NO: 1747731 - RNA, 18 nt, Human
caggccacaagacccuug

SEQ ID NO: 1747732 - RNA, 17 nt, Human
caggccacaagacccuu

SEQ ID NO: 1747733 - RNA, 13 nt, Human
caggccacaagac

SEQ ID NO: 1747734 - RNA, 23 nt, Human
caggccaaacucaccugccccuc

SEQ ID NO: 1747735 - RNA, 18 nt, Human
caggccaaacucaccugc

SEQ ID NO: 1747736 - RNA, 16 nt, Human
caggcccggcuccagg

SEQ ID NO: 1747737 - RNA, 20 nt, Human
caggccccugccacccuggg

SEQ ID NO: 1747738 - RNA, 19 nt, Human
caggccccugccacccugg

SEQ ID NO: 1747739 - RNA, 17 nt, Human
caggccccugccacccu

SEQ ID NO: 1747740 - RNA, 15 nt, Human
caggccccugccacc

SEQ ID NO: 1747741 - RNA, 15 nt, Human
caggcccggcuccag

SEQ ID NO: 1747742 - RNA, 14 nt, Human
caggcccggcucca

SEQ ID NO: 1747743 - RNA, 13 nt, Human
caggcccggcucc

SEQ ID NO: 1747744 - RNA, 16 nt, Human
caggacucugccuccu

SEQ ID NO: 1747745 - RNA, 15 nt, Human
caggacucugccucc

SEQ ID NO: 1747746 - RNA, 13 nt, Human
caggacucugccu

SEQ ID NO: 1747747 - RNA, 12 nt, Human
caggacucugcc

SEQ ID NO: 1747748 - RNA, 21 nt, Human
caggagcccugggaggcucug

SEQ ID NO: 1747749 - RNA, 17 nt, Human
caggagccuccugcccu

SEQ ID NO: 1747750 - RNA, 14 nt, Human
caggagccuccugc

SEQ ID NO: 1747751 - RNA, 20 nt, Human
caggagccuccugcccuuac

SEQ ID NO: 1747752 - RNA, 12 nt, Human
caggagugagca

SEQ ID NO: 1747753 - RNA, 19 nt, Human
caggagcagccacauuccu

SEQ ID NO: 1747754 - RNA, 14 nt, Human
caggagcagccaca

SEQ ID NO: 1747755 - RNA, 13 nt, Human
caggagcagccac

SEQ ID NO: 1747756 - RNA, 12 nt, Human
caggagcagcca

SEQ ID NO: 1747757 - RNA, 18 nt, Human
caggagccccgaggccuu

SEQ ID NO: 1747758 - RNA, 16 nt, Human
caggagccccgaggcc

SEQ ID NO: 1747759 - RNA, 15 nt, Human
caggagccccgaggc

SEQ ID NO: 1747760 - RNA, 22 nt, Human
caggagccccgaggccuucucu

SEQ ID NO: 1747761 - RNA, 20 nt, Human
caggagccccgaggccuucu

SEQ ID NO: 1747762 - RNA, 23 nt, Human
caggagccccgaggccuucucug

SEQ ID NO: 1747763 - RNA, 11 nt, Human
caggagcccug

SEQ ID NO: 1747764 - RNA, 19 nt, Human
caggagcccugggaggcuc

SEQ ID NO: 1747765 - RNA, 18 nt, Human
caggagcccugggaggcu

SEQ ID NO: 1747766 - RNA, 16 nt, Human
caggagcccugggagg

SEQ ID NO: 1747767 - RNA, 14 nt, Human
caggagcccuggga

SEQ ID NO: 1747768 - RNA, 23 nt, Human
caggaguuugagaccaaccuggg

SEQ ID NO: 1747769 - RNA, 22 nt, Human
caggaguuugagaccaaccugg

SEQ ID NO: 1747770 - RNA, 13 nt, Human
caggauagacuuu

SEQ ID NO: 1747771 - RNA, 21 nt, Human
caggaguuugagaccaaccug

SEQ ID NO: 1747772 - RNA, 19 nt, Human
caggaguuucguuuucaaa

SEQ ID NO: 1747773 - RNA, 16 nt, Human
caggaguuggaagugu

SEQ ID NO: 1747774 - RNA, 17 nt, Human
caggaguggguugauuu

SEQ ID NO: 1747775 - RNA, 13 nt, Human
caguaauaacucu

SEQ ID NO: 1747776 - RNA, 12 nt, Human
caguaauaacuc

SEQ ID NO: 1747777 - RNA, 23 nt, Human
caguaccauuuaauggggaggac

SEQ ID NO: 1747778 - RNA, 13 nt, Human
cagguucagcuug

SEQ ID NO: 1747779 - RNA, 15 nt, Human
cagguuccacagagg

SEQ ID NO: 1747780 - RNA, 19 nt, Human
cagguuccacagaggacac

SEQ ID NO: 1747781 - RNA, 12 nt, Human
cagguucagcuu

SEQ ID NO: 1747782 - RNA, 22 nt, Human
caguaaaugggggugcauuuga

SEQ ID NO: 1747783 - RNA, 21 nt, Human
caguaaaugggggugcauuug

SEQ ID NO: 1747784 - RNA, 12 nt, Human
caggugugaacc

SEQ ID NO: 1747785 - RNA, 19 nt, Human
caggugucccugcacuugc

SEQ ID NO: 1747786 - RNA, 18 nt, Human
caggugucccugcacuug

SEQ ID NO: 1747787 - RNA, 16 nt, Human
caggugucccugcacu

SEQ ID NO: 1747788 - RNA, 15 nt, Human
caggugucccugcac

SEQ ID NO: 1747789 - RNA, 23 nt, Human
caggugugaaccaccacacccag

SEQ ID NO: 1747790 - RNA, 22 nt, Human
caggugugaaccaccacaccca

SEQ ID NO: 1747791 - RNA, 19 nt, Human
caggugugaaccaccacac

SEQ ID NO: 1747792 - RNA, 16 nt, Human
caggugugaaccacca

SEQ ID NO: 1747793 - RNA, 21 nt, Human
caggugugagucaccaagccc

SEQ ID NO: 1747794 - RNA, 20 nt, Human
caggugugagucaccaagcc

SEQ ID NO: 1747795 - RNA, 16 nt, Human
caggugugagucacca

SEQ ID NO: 1747796 - RNA, 18 nt, Human
caggugugagccaccacg

SEQ ID NO: 1747797 - RNA, 23 nt, Human
caggugugagucaccaagcccag

SEQ ID NO: 1747798 - RNA, 22 nt, Human
caggugugagucaccaagccca

SEQ ID NO: 1747799 - RNA, 21 nt, Human
caggugugagccaccacgccc

SEQ ID NO: 1747800 - RNA, 14 nt, Human
caggugucccugca

SEQ ID NO: 1747801 - RNA, 11 nt, Human
caggugucccu

SEQ ID NO: 1747802 - RNA, 20 nt, Human
caggugguuauggagagggu

SEQ ID NO: 1747803 - RNA, 22 nt, Human
cagguggggucacucuggcagc

SEQ ID NO: 1747804 - RNA, 21 nt, Human
cagguggggucacucuggcag

SEQ ID NO: 1747805 - RNA, 20 nt, Human
cagguggggucacucuggca

SEQ ID NO: 1747806 - RNA, 19 nt, Human
cagguggggucacucuggc

SEQ ID NO: 1747807 - RNA, 18 nt, Human
caggugguuauggagagg

SEQ ID NO: 1747808 - RNA, 23 nt, Human
cagguggggucacucuggcagcu

SEQ ID NO: 1747809 - RNA, 18 nt, Human
cagguggggucacucugg

SEQ ID NO: 1747810 - RNA, 17 nt, Human
cagguggggcagcuuga

SEQ ID NO: 1747811 - RNA, 16 nt, Human
cagguggggcagcuug

SEQ ID NO: 1747812 - RNA, 15 nt, Human
cagguggggcagcuu

SEQ ID NO: 1747813 - RNA, 14 nt, Human
cagguggggcagcu

SEQ ID NO: 1747814 - RNA, 13 nt, Human
cagguggggcagc

SEQ ID NO: 1747815 - RNA, 20 nt, Human
caggguauuccagagugggg

SEQ ID NO: 1747816 - RNA, 21 nt, Human
caggguauuccagagugggga

SEQ ID NO: 1747817 - RNA, 22 nt, Human
cagggucccugguggcagcuca

SEQ ID NO: 1747818 - RNA, 19 nt, Human
cagggucccugguggcagc

SEQ ID NO: 1747819 - RNA, 18 nt, Human
cagggucccugguggcag

SEQ ID NO: 1747820 - RNA, 15 nt, Human
cagggucccuggugg

SEQ ID NO: 1747821 - RNA, 14 nt, Human
cagggucccuggug

SEQ ID NO: 1747822 - RNA, 12 nt, Human
cagggucccugg

SEQ ID NO: 1747823 - RNA, 15 nt, Human
cagggucucacucug

SEQ ID NO: 1747824 - RNA, 23 nt, Human
cagggucucacuauguugcccag

SEQ ID NO: 1747825 - RNA, 22 nt, Human
cagggucucacuauguugccca

SEQ ID NO: 1747826 - RNA, 21 nt, Human
cagggucucacuauguugccc

SEQ ID NO: 1747827 - RNA, 18 nt, Human
caggguccuguagcccua

SEQ ID NO: 1747828 - RNA, 23 nt, Human
cagggucccugguggcagcucac

SEQ ID NO: 1747829 - RNA, 17 nt, Human
cagguaacaggcagaua

SEQ ID NO: 1747830 - RNA, 16 nt, Human
cagguaacaggcagau

SEQ ID NO: 1747831 - RNA, 15 nt, Human
cagguaacaggcaga

SEQ ID NO: 1747832 - RNA, 14 nt, Human
cagguaacaggcag

SEQ ID NO: 1747833 - RNA, 16 nt, Human
cagggucucacucugu

SEQ ID NO: 1747834 - RNA, 17 nt, Human
cagggucucacucuguc

SEQ ID NO: 1747835 - RNA, 16 nt, Human
caggguuuugccaugu

SEQ ID NO: 1747836 - RNA, 21 nt, Human
caggggugggacacccuguga

SEQ ID NO: 1747837 - RNA, 20 nt, Human
caggggugggacacccugug

SEQ ID NO: 1747838 - RNA, 15 nt, Human
caggggugggacacc

SEQ ID NO: 1747839 - RNA, 14 nt, Human
caggggugggacac

SEQ ID NO: 1747840 - RNA, 18 nt, Human
caggucccuaauaaagcu

SEQ ID NO: 1747841 - RNA, 17 nt, Human
caggucccuaauaaagc

SEQ ID NO: 1747842 - RNA, 16 nt, Human
caggucccuaauaaag

SEQ ID NO: 1747843 - RNA, 15 nt, Human
caggucccuaauaaa

SEQ ID NO: 1747844 - RNA, 14 nt, Human
caggucccuaauaa

SEQ ID NO: 1747845 - RNA, 13 nt, Human
caggucccuaaua

SEQ ID NO: 1747846 - RNA, 12 nt, Human
caggucccuaau

SEQ ID NO: 1747847 - RNA, 11 nt, Human
caggucccuaa

SEQ ID NO: 1747848 - RNA, 21 nt, Human
cagguaacaggcagauacagg

SEQ ID NO: 1747849 - RNA, 20 nt, Human
cagguaacaggcagauacag

SEQ ID NO: 1747850 - RNA, 20 nt, Human
cagguaaucgaccugccucg

SEQ ID NO: 1747851 - RNA, 19 nt, Human
cagguaaucgaccugccuc

SEQ ID NO: 1747852 - RNA, 18 nt, Human
cagguaaucgaccugccu

SEQ ID NO: 1747853 - RNA, 17 nt, Human
cagguaaucgaccugcc

SEQ ID NO: 1747854 - RNA, 20 nt, Human
caggugagaagcagaggaag

SEQ ID NO: 1747855 - RNA, 13 nt, Human
caggugagaagca

SEQ ID NO: 1747856 - RNA, 21 nt, Human
caggugagaagcagaggaagg

SEQ ID NO: 1747857 - RNA, 21 nt, Human
cagguggccacuccagacccc

SEQ ID NO: 1747858 - RNA, 19 nt, Human
cagguggccacuccagacc

SEQ ID NO: 1747859 - RNA, 16 nt, Human
cagguggccacuccag

SEQ ID NO: 1747860 - RNA, 15 nt, Human
cagguggccacucca

SEQ ID NO: 1747861 - RNA, 23 nt, Human
caggucuugaacuccuggccuca

SEQ ID NO: 1747862 - RNA, 22 nt, Human
caggucuugaacuccuggccuc

SEQ ID NO: 1747863 - RNA, 21 nt, Human
caggucuugaacuccuggccu

SEQ ID NO: 1747864 - RNA, 20 nt, Human
caggucuugaacuccuggcc

SEQ ID NO: 1747865 - RNA, 19 nt, Human
caggucuugaacuccuggc

SEQ ID NO: 1747866 - RNA, 18 nt, Human
caggucuugaacuccugg

SEQ ID NO: 1747867 - RNA, 22 nt, Human
caggucccuaauaaagcugugu

SEQ ID NO: 1747868 - RNA, 21 nt, Human
caggucccuaauaaagcugug

SEQ ID NO: 1747869 - RNA, 20 nt, Human
caggucccuaauaaagcugu

SEQ ID NO: 1747870 - RNA, 19 nt, Human
caggucccuaauaaagcug

SEQ ID NO: 1747871 - RNA, 16 nt, Human
cagugaaagaaaauaa

SEQ ID NO: 1747872 - RNA, 20 nt, Human
cagugaaagaaaauaacaau

SEQ ID NO: 1747873 - RNA, 16 nt, Human
cagucuuggcucacug

SEQ ID NO: 1747874 - RNA, 17 nt, Human
cagucuuguauuaaguu

SEQ ID NO: 1747875 - RNA, 19 nt, Human
cagucuggaaugcaguggu

SEQ ID NO: 1747876 - RNA, 21 nt, Human
caguccuuaccagcagagcac

SEQ ID NO: 1747877 - RNA, 20 nt, Human
caguccuuaccagcagagca

SEQ ID NO: 1747878 - RNA, 19 nt, Human
caguccuuaccagcagagc

SEQ ID NO: 1747879 - RNA, 18 nt, Human
caguccuuaccagcagag

SEQ ID NO: 1747880 - RNA, 15 nt, Human
caguccuuaccagca

SEQ ID NO: 1747881 - RNA, 17 nt, Human
caguccucccaucucac

SEQ ID NO: 1747882 - RNA, 16 nt, Human
caguccucccaucuca

SEQ ID NO: 1747883 - RNA, 15 nt, Human
cagugagacagcucu

SEQ ID NO: 1747884 - RNA, 20 nt, Human
cagugaggcucugcccuugg

SEQ ID NO: 1747885 - RNA, 19 nt, Human
cagugaggcucugcccuug

SEQ ID NO: 1747886 - RNA, 18 nt, Human
cagugaggcucugcccuu

SEQ ID NO: 1747887 - RNA, 17 nt, Human
cagugaggcucugcccu

SEQ ID NO: 1747888 - RNA, 18 nt, Human
cagugagucgaggacagg

SEQ ID NO: 1747889 - RNA, 17 nt, Human
cagugagucgaggacag

SEQ ID NO: 1747890 - RNA, 21 nt, Human
cagugaggcucugcccuuggu

SEQ ID NO: 1747891 - RNA, 23 nt, Human
cagugaggguaaguauuuuccug

SEQ ID NO: 1747892 - RNA, 16 nt, Human
cagugaggcucugccc

SEQ ID NO: 1747893 - RNA, 15 nt, Human
cagugaggcucugcc

SEQ ID NO: 1747894 - RNA, 14 nt, Human
cagugaggcucugc

SEQ ID NO: 1747895 - RNA, 13 nt, Human
cagugaggcucug

SEQ ID NO: 1747896 - RNA, 12 nt, Human
cagugaggcucu

SEQ ID NO: 1747897 - RNA, 24 nt, Human
cagugagccgagauugcaccacug

SEQ ID NO: 1747898 - RNA, 17 nt, Human
cagugauuaccagggac

SEQ ID NO: 1747899 - RNA, 18 nt, Human
cagugauuaccagggacu

SEQ ID NO: 1747900 - RNA, 15 nt, Human
cagugcccuccagga

SEQ ID NO: 1747901 - RNA, 23 nt, Human
cagugagucgaggacagggaggu

SEQ ID NO: 1747902 - RNA, 22 nt, Human
cagugagucgaggacagggagg

SEQ ID NO: 1747903 - RNA, 20 nt, Human
cagugagucgaggacaggga

SEQ ID NO: 1747904 - RNA, 19 nt, Human
cagugagucgaggacaggg

SEQ ID NO: 1747905 - RNA, 22 nt, Human
cagugccuuauggaacacucug

SEQ ID NO: 1747906 - RNA, 21 nt, Human
cagugccuuauggaacacucu

SEQ ID NO: 1747907 - RNA, 20 nt, Human
cagugccuuauggaacacuc

SEQ ID NO: 1747908 - RNA, 19 nt, Human
cagugccuuauggaacacu

SEQ ID NO: 1747909 - RNA, 18 nt, Human
cagugccuuauggaacac

SEQ ID NO: 1747910 - RNA, 17 nt, Human
cagugccuuauggaaca

SEQ ID NO: 1747911 - RNA, 16 nt, Human
cagugccuuauggaac

SEQ ID NO: 1747912 - RNA, 15 nt, Human
cagugccuuauggaa

SEQ ID NO: 1747913 - RNA, 13 nt, Human
cagugccuuaugg

SEQ ID NO: 1747914 - RNA, 11 nt, Human
cagugccuuau

SEQ ID NO: 1747915 - RNA, 18 nt, Human
cagugccgagaaggaagc

SEQ ID NO: 1747916 - RNA, 15 nt, Human
cagugccgagaagga

SEQ ID NO: 1747917 - RNA, 23 nt, Human
cagugccuuauggaacacucuga

SEQ ID NO: 1747918 - RNA, 13 nt, Human
caguaucucaggg

SEQ ID NO: 1747919 - RNA, 12 nt, Human
caguauggcagc

SEQ ID NO: 1747920 - RNA, 21 nt, Human
caguaucuugaagacuuuucu

SEQ ID NO: 1747921 - RNA, 18 nt, Human
caguaucuugaagacuuu

SEQ ID NO: 1747922 - RNA, 12 nt, Human
caguaucuugaa

SEQ ID NO: 1747923 - RNA, 15 nt, Human
caguaucucagggcc

SEQ ID NO: 1747924 - RNA, 12 nt, Human
caguagugauag

SEQ ID NO: 1747925 - RNA, 19 nt, Human
caguauuacuucugcuaca

SEQ ID NO: 1747926 - RNA, 18 nt, Human
caguauuacuucugcuac

SEQ ID NO: 1747927 - RNA, 16 nt, Human
caguauuacuucugcu

SEQ ID NO: 1747928 - RNA, 13 nt, Human
caguccaugaaga

SEQ ID NO: 1747929 - RNA, 14 nt, Human
caguccauugaaag

SEQ ID NO: 1747930 - RNA, 16 nt, Human
caguccauagcagaga

SEQ ID NO: 1747931 - RNA, 16 nt, Human
cagucccugccaaugg

SEQ ID NO: 1747932 - RNA, 15 nt, Human
cagucccugccaaug

SEQ ID NO: 1747933 - RNA, 14 nt, Human
cagucccugccaau

SEQ ID NO: 1747934 - RNA, 13 nt, Human
cagucccugccaa

SEQ ID NO: 1747935 - RNA, 12 nt, Human
cagucccugcca

SEQ ID NO: 1747936 - RNA, 15 nt, Human
caguccucccaucuc

SEQ ID NO: 1747937 - RNA, 14 nt, Human
caguccucccaucu

SEQ ID NO: 1747938 - RNA, 13 nt, Human
caguccucccauc

SEQ ID NO: 1747939 - RNA, 12 nt, Human
caguccucccau

SEQ ID NO: 1747940 - RNA, 17 nt, Human
cagucccugccaaugga

SEQ ID NO: 1747941 - RNA, 17 nt, Human
cagucccccugccccag

SEQ ID NO: 1747942 - RNA, 16 nt, Human
cagucccccugcccca

SEQ ID NO: 1747943 - RNA, 23 nt, Human
caguccccgugaaggagagcccu

SEQ ID NO: 1747944 - RNA, 14 nt, Human
cagcuuugauauuu

SEQ ID NO: 1747945 - RNA, 23 nt, Human
cagcuuuguuuguugucagcuga

SEQ ID NO: 1747946 - RNA, 22 nt, Human
cagcuuuguuuguugucagcug

SEQ ID NO: 1747947 - RNA, 21 nt, Human
cagcuuuguuuguugucagcu

SEQ ID NO: 1747948 - RNA, 12 nt, Human
cagcuuuguuug

SEQ ID NO: 1747949 - RNA, 23 nt, Human
cagcuuuccucaaaacuucagac

SEQ ID NO: 1747950 - RNA, 23 nt, Human
cagcuuuccccaugucucgacuc

SEQ ID NO: 1747951 - RNA, 22 nt, Human
cagcuuuaaaaaauuaaucugg

SEQ ID NO: 1747952 - RNA, 20 nt, Human
cagcuuguaaauagcucagg

SEQ ID NO: 1747953 - RNA, 19 nt, Human
cagcuuguaaauagcucag

SEQ ID NO: 1747954 - RNA, 18 nt, Human
cagcuuguaaauagcuca

SEQ ID NO: 1747955 - RNA, 22 nt, Human
cagcuuguaaauagcucaggug

SEQ ID NO: 1747956 - RNA, 21 nt, Human
cagcuuguaaauagcucaggu

SEQ ID NO: 1747957 - RNA, 21 nt, Human
cagcuucauuuccugugucuu

SEQ ID NO: 1747958 - RNA, 20 nt, Human
cagcuucauuuccugugucu

SEQ ID NO: 1747959 - RNA, 21 nt, Human
cagcuugaccgugaggccaga

SEQ ID NO: 1747960 - RNA, 20 nt, Human
cagcuugaccgugaggccag

SEQ ID NO: 1747961 - RNA, 19 nt, Human
cagcuugaccgugaggcca

SEQ ID NO: 1747962 - RNA, 18 nt, Human
cagcuugaccgugaggcc

SEQ ID NO: 1747963 - RNA, 15 nt, Human
cagcuugaggguugg

SEQ ID NO: 1747964 - RNA, 14 nt, Human
cagcuugaggguug

SEQ ID NO: 1747965 - RNA, 21 nt, Human
cagcuugaggguugggcuggu

SEQ ID NO: 1747966 - RNA, 20 nt, Human
cagcuugaggguugggcugg

SEQ ID NO: 1747967 - RNA, 19 nt, Human
cagcuugaggguugggcug

SEQ ID NO: 1747968 - RNA, 18 nt, Human
cagcuugaggguugggcu

SEQ ID NO: 1747969 - RNA, 14 nt, Human
caggaagcagcuuu

SEQ ID NO: 1747970 - RNA, 18 nt, Human
caggaagccagcaggcuc

SEQ ID NO: 1747971 - RNA, 17 nt, Human
caggaagccagcaggcu

SEQ ID NO: 1747972 - RNA, 16 nt, Human
caggaagccagcaggc

SEQ ID NO: 1747973 - RNA, 14 nt, Human
caggaagccagcag

SEQ ID NO: 1747974 - RNA, 21 nt, Human
caggaagccagcaggcucuca

SEQ ID NO: 1747975 - RNA, 19 nt, Human
caggaagccagcaggcucu

SEQ ID NO: 1747976 - RNA, 22 nt, Human
caggaagccagcaggcucucag

SEQ ID NO: 1747977 - RNA, 19 nt, Human
caggaagcucagggccugg

SEQ ID NO: 1747978 - RNA, 18 nt, Human
caggaagcucagggccug

SEQ ID NO: 1747979 - RNA, 17 nt, Human
caggaagcucagggccu

SEQ ID NO: 1747980 - RNA, 16 nt, Human
caggaagcucagggcc

SEQ ID NO: 1747981 - RNA, 15 nt, Human
caggaagcucagggc

SEQ ID NO: 1747982 - RNA, 14 nt, Human
caggaagcucaggg

SEQ ID NO: 1747983 - RNA, 13 nt, Human
caggaagcucagg

SEQ ID NO: 1747984 - RNA, 21 nt, Human
caggaagcucagggccuggcu

SEQ ID NO: 1747985 - RNA, 20 nt, Human
caggaagcucagggccuggc

SEQ ID NO: 1747986 - RNA, 23 nt, Human
caggaagcucagggccuggcuca

SEQ ID NO: 1747987 - RNA, 17 nt, Human
caggaccuguggccaag

SEQ ID NO: 1747988 - RNA, 16 nt, Human
caggaaguagaggagg

SEQ ID NO: 1747989 - RNA, 15 nt, Human
caggaaguagaggag

SEQ ID NO: 1747990 - RNA, 20 nt, Human
caggaaguacuggagaaaau

SEQ ID NO: 1747991 - RNA, 18 nt, Human
caggaaguacuggagaaa

SEQ ID NO: 1747992 - RNA, 17 nt, Human
caggaaguacuggagaa

SEQ ID NO: 1747993 - RNA, 15 nt, Human
caggaaggcuaaagg

SEQ ID NO: 1747994 - RNA, 19 nt, Human
caggaaggcugagaggaga

SEQ ID NO: 1747995 - RNA, 16 nt, Human
caggaaguacuggaga

SEQ ID NO: 1747996 - RNA, 14 nt, Human
caggaaguacugga

SEQ ID NO: 1747997 - RNA, 12 nt, Human
caggaaguacug

SEQ ID NO: 1747998 - RNA, 17 nt, Human
cagcuggguuggaaaac

SEQ ID NO: 1747999 - RNA, 16 nt, Human
cagcuggguuggaaaa

SEQ ID NO: 1748000 - RNA, 18 nt, Human
cagcugguugagguuuca

SEQ ID NO: 1748001 - RNA, 23 nt, Human
cagcugggguggggaccucaggc

SEQ ID NO: 1748002 - RNA, 22 nt, Human
cagcugggguggggaccucagg

SEQ ID NO: 1748003 - RNA, 21 nt, Human
cagcugggguggggaccucag

SEQ ID NO: 1748004 - RNA, 22 nt, Human
cagcuggggccaggcugggucg

SEQ ID NO: 1748005 - RNA, 21 nt, Human
cagcuggggccaggcuggguc

SEQ ID NO: 1748006 - RNA, 22 nt, Human
cagcugcuuuugucuaugggac

SEQ ID NO: 1748007 - RNA, 23 nt, Human
cagcugcuuuugucuaugggacu

SEQ ID NO: 1748008 - RNA, 19 nt, Human
cagcuggccgggagccuga

SEQ ID NO: 1748009 - RNA, 18 nt, Human
cagcuggagaaauauggu

SEQ ID NO: 1748010 - RNA, 20 nt, Human
cagcuggggccaggcugggu

SEQ ID NO: 1748011 - RNA, 19 nt, Human
cagcuggggccaggcuggg

SEQ ID NO: 1748012 - RNA, 18 nt, Human
cagcuggggccaggcugg

SEQ ID NO: 1748013 - RNA, 23 nt, Human
cagcugggaucacauguggacuu

SEQ ID NO: 1748014 - RNA, 17 nt, Human
cagcugcuacuacuccu

SEQ ID NO: 1748015 - RNA, 21 nt, Human
cagcugcucaauaaaguacaa

SEQ ID NO: 1748016 - RNA, 22 nt, Human
cagcugcuugggcuucauccuc

SEQ ID NO: 1748017 - RNA, 21 nt, Human
cagcugcuugggcuucauccu

SEQ ID NO: 1748018 - RNA, 19 nt, Human
cagcugcuugggcuucauc

SEQ ID NO: 1748019 - RNA, 18 nt, Human
cagcugcuugggcuucau

SEQ ID NO: 1748020 - RNA, 16 nt, Human
cagcugcuugggcuuc

SEQ ID NO: 1748021 - RNA, 15 nt, Human
cagcugcuugggcuu

SEQ ID NO: 1748022 - RNA, 14 nt, Human
cagcugcuugggcu

SEQ ID NO: 1748023 - RNA, 13 nt, Human
cagcugcuugggc

SEQ ID NO: 1748024 - RNA, 24 nt, Human
cagcugcgguccacccaggagccc

SEQ ID NO: 1748025 - RNA, 23 nt, Human
cagcugcgguccacccaggagcc

SEQ ID NO: 1748026 - RNA, 22 nt, Human
cagcugcgguccacccaggagc

SEQ ID NO: 1748027 - RNA, 21 nt, Human
cagcugcgguccacccaggag

SEQ ID NO: 1748028 - RNA, 20 nt, Human
cagcugcgguccacccagga

SEQ ID NO: 1748029 - RNA, 19 nt, Human
cagcugcgguccacccagg

SEQ ID NO: 1748030 - RNA, 18 nt, Human
cagcugcgguccacccag

SEQ ID NO: 1748031 - RNA, 23 nt, Human
cagcugccugggaucccucaucc

SEQ ID NO: 1748032 - RNA, 18 nt, Human
cagcugccugggaucccu

SEQ ID NO: 1748033 - RNA, 20 nt, Human
cagcucugcauacucauuag

SEQ ID NO: 1748034 - RNA, 21 nt, Human
cagcucugcaagaauugaagc

SEQ ID NO: 1748035 - RNA, 16 nt, Human
cagcucugcaagaauu

SEQ ID NO: 1748036 - RNA, 15 nt, Human
cagcucugcaagaau

SEQ ID NO: 1748037 - RNA, 23 nt, Human
cagcuccuucuguccuacucugu

SEQ ID NO: 1748038 - RNA, 21 nt, Human
cagcuccuucuguccuacucu

SEQ ID NO: 1748039 - RNA, 17 nt, Human
cagcuccuucuguccua

SEQ ID NO: 1748040 - RNA, 16 nt, Human
cagcuccuucuguccu

SEQ ID NO: 1748041 - RNA, 20 nt, Human
cagcucagagagggugggag

SEQ ID NO: 1748042 - RNA, 19 nt, Human
cagcucagagaggguggga

SEQ ID NO: 1748043 - RNA, 17 nt, Human
cagcucagagagggugg

SEQ ID NO: 1748044 - RNA, 13 nt, Human
cagcucagagagg

SEQ ID NO: 1748045 - RNA, 23 nt, Human
cagcucuucuccaggcuguaucc

SEQ ID NO: 1748046 - RNA, 19 nt, Human
cagcucuucuccaggcugu

SEQ ID NO: 1748047 - RNA, 18 nt, Human
cagcucuucuccaggcug

SEQ ID NO: 1748048 - RNA, 17 nt, Human
cagcucuucuccaggcu

SEQ ID NO: 1748049 - RNA, 16 nt, Human
cagcucuucuccaggc

SEQ ID NO: 1748050 - RNA, 15 nt, Human
cagcucuucuccagg

SEQ ID NO: 1748051 - RNA, 14 nt, Human
cagcucuucuccag

SEQ ID NO: 1748052 - RNA, 13 nt, Human
cagcucuucucca

SEQ ID NO: 1748053 - RNA, 21 nt, Human
cagcucuuauauugccauuuc

SEQ ID NO: 1748054 - RNA, 10 nt, Human
cagcucuuau

SEQ ID NO: 1748055 - RNA, 23 nt, Human
cagcucuguccugggagugagcu

SEQ ID NO: 1748056 - RNA, 18 nt, Human
cagcucuguccugggagu

SEQ ID NO: 1748057 - RNA, 17 nt, Human
cagcucuguccugggag

SEQ ID NO: 1748058 - RNA, 16 nt, Human
cagcucuguccuggga

SEQ ID NO: 1748059 - RNA, 14 nt, Human
cagcucuguccugg

SEQ ID NO: 1748060 - RNA, 13 nt, Human
cagcucuguccug

SEQ ID NO: 1748061 - RNA, 12 nt, Human
cagcucuguccu

SEQ ID NO: 1748062 - RNA, 23 nt, Human
cagcucugguccauagagagcaa

SEQ ID NO: 1748063 - RNA, 22 nt, Human
cagcucugguccauagagagca

SEQ ID NO: 1748064 - RNA, 21 nt, Human
cagcucugguccauagagagc

SEQ ID NO: 1748065 - RNA, 18 nt, Human
cagcucugguccauagag

SEQ ID NO: 1748066 - RNA, 17 nt, Human
cagcucugguccauaga

SEQ ID NO: 1748067 - RNA, 16 nt, Human
cagcucugguccauag

SEQ ID NO: 1748068 - RNA, 13 nt, Human
cagcucuggucca

SEQ ID NO: 1748069 - RNA, 10 nt, Human
cagcucuggu

SEQ ID NO: 1748070 - RNA, 22 nt, Human
caggaagcucagggccuggcuc

SEQ ID NO: 1748071 - RNA, 23 nt, Human
cagccucccgaguagcugggacu

SEQ ID NO: 1748072 - RNA, 22 nt, Human
cagccucccgaguagcugggac

SEQ ID NO: 1748073 - RNA, 21 nt, Human
cagccucccgaguagcuggga

SEQ ID NO: 1748074 - RNA, 20 nt, Human
cagccucccgaguagcuggg

SEQ ID NO: 1748075 - RNA, 19 nt, Human
cagccucccgaguagcugg

SEQ ID NO: 1748076 - RNA, 23 nt, Human
cagccucccgaauagcugggacu

SEQ ID NO: 1748077 - RNA, 20 nt, Human
cagccugcuccagcuguuca

SEQ ID NO: 1748078 - RNA, 15 nt, Human
cagccuccugaguag

SEQ ID NO: 1748079 - RNA, 20 nt, Human
cagccuccugaguagcugga

SEQ ID NO: 1748080 - RNA, 19 nt, Human
cagccuggacccuguggau

SEQ ID NO: 1748081 - RNA, 15 nt, Human
cagccuggacccugu

SEQ ID NO: 1748082 - RNA, 10 nt, Human
cagccuggca

SEQ ID NO: 1748083 - RNA, 21 nt, Human
cagccuggcacagggcagugg

SEQ ID NO: 1748084 - RNA, 20 nt, Human
cagccuggcacagggcagug

SEQ ID NO: 1748085 - RNA, 13 nt, Human
cagccuggcacag

SEQ ID NO: 1748086 - RNA, 19 nt, Human
cagccugggcaaugugaua

SEQ ID NO: 1748087 - RNA, 16 nt, Human
cagccugggcaaugug

SEQ ID NO: 1748088 - RNA, 24 nt, Human
cagccuugaccauucuccaccugc

SEQ ID NO: 1748089 - RNA, 23 nt, Human
cagccuugaccauucuccaccug

SEQ ID NO: 1748090 - RNA, 22 nt, Human
cagccuugaccauucuccaccu

SEQ ID NO: 1748091 - RNA, 21 nt, Human
cagccuugaccauucuccacc

SEQ ID NO: 1748092 - RNA, 20 nt, Human
cagccuugaccauucuccac

SEQ ID NO: 1748093 - RNA, 17 nt, Human
cagccuugaccauucuc

SEQ ID NO: 1748094 - RNA, 19 nt, Human
cagcuacuugggaggcuga

SEQ ID NO: 1748095 - RNA, 16 nt, Human
cagcuaaugggacacu

SEQ ID NO: 1748096 - RNA, 15 nt, Human
cagcuaaugggacac

SEQ ID NO: 1748097 - RNA, 19 nt, Human
cagcuaaucagcauucuca

SEQ ID NO: 1748098 - RNA, 20 nt, Human
cagcuaacauggaaguacua

SEQ ID NO: 1748099 - RNA, 20 nt, Human
cagcgagcccugguggcagu

SEQ ID NO: 1748100 - RNA, 19 nt, Human
cagcgagcccugguggcag

SEQ ID NO: 1748101 - RNA, 17 nt, Human
cagcgagcccugguggc

SEQ ID NO: 1748102 - RNA, 16 nt, Human
cagcgagcccuggugg

SEQ ID NO: 1748103 - RNA, 13 nt, Human
cagcgagcccugg

SEQ ID NO: 1748104 - RNA, 18 nt, Human
cagcuaacauggaaguac

SEQ ID NO: 1748105 - RNA, 19 nt, Human
cagcuaacauggaaguacu

SEQ ID NO: 1748106 - RNA, 21 nt, Human
cagcgagcccugguggcagug

SEQ ID NO: 1748107 - RNA, 19 nt, Human
cagcucaccagccccagug

SEQ ID NO: 1748108 - RNA, 17 nt, Human
cagcucaccagccccag

SEQ ID NO: 1748109 - RNA, 16 nt, Human
cagcucaccagcccca

SEQ ID NO: 1748110 - RNA, 15 nt, Human
cagcucaccagcccc

SEQ ID NO: 1748111 - RNA, 13 nt, Human
cagcucaccagcc

SEQ ID NO: 1748112 - RNA, 17 nt, Human
cagcucaccucucccuu

SEQ ID NO: 1748113 - RNA, 16 nt, Human
cagcucaccucucccu

SEQ ID NO: 1748114 - RNA, 15 nt, Human
cagcucaccucuccc

SEQ ID NO: 1748115 - RNA, 13 nt, Human
cagcucaccucuc

SEQ ID NO: 1748116 - RNA, 21 nt, Human
cagcucaccagccccagugcc

SEQ ID NO: 1748117 - RNA, 20 nt, Human
cagcucaccagccccagugc

SEQ ID NO: 1748118 - RNA, 22 nt, Human
cagcucaccagccccagugccc

SEQ ID NO: 1748119 - RNA, 20 nt, Human
cagcucaccucucccuugga

SEQ ID NO: 1748120 - RNA, 19 nt, Human
cagcucaccucucccuugg

SEQ ID NO: 1748121 - RNA, 14 nt, Human
cagcucacugcaac

SEQ ID NO: 1748122 - RNA, 12 nt, Human
cagcucacugca

SEQ ID NO: 1748123 - RNA, 12 nt, Human
cagcucagagag

SEQ ID NO: 1748124 - RNA, 15 nt, Human
cagcucacugcaacc

SEQ ID NO: 1748125 - RNA, 21 nt, Human
cagcucacugcaaccuucgcc

SEQ ID NO: 1748126 - RNA, 18 nt, Human
cagccucaaccuccuggg

SEQ ID NO: 1748127 - RNA, 17 nt, Human
cagccucaaccuccugg

SEQ ID NO: 1748128 - RNA, 21 nt, Human
cagccucaaccuccugggcua

SEQ ID NO: 1748129 - RNA, 20 nt, Human
cagccucaaccuccugggcu

SEQ ID NO: 1748130 - RNA, 19 nt, Human
cagccucaaccuccugggc

SEQ ID NO: 1748131 - RNA, 20 nt, Human
cagccucacaguccuuacca

SEQ ID NO: 1748132 - RNA, 15 nt, Human
cagccucacaguccu

SEQ ID NO: 1748133 - RNA, 14 nt, Human
cagccucacagucc

SEQ ID NO: 1748134 - RNA, 20 nt, Human
cagccuccaagcuccaucuc

SEQ ID NO: 1748135 - RNA, 14 nt, Human
cagccuccaagcuc

SEQ ID NO: 1748136 - RNA, 22 nt, Human
cagccucccgaauagcugggac

SEQ ID NO: 1748137 - RNA, 21 nt, Human
cagccucccgaauagcuggga

SEQ ID NO: 1748138 - RNA, 20 nt, Human
cagccucccgaauagcuggg

SEQ ID NO: 1748139 - RNA, 23 nt, Human
cagccucccaaagugcugggauu

SEQ ID NO: 1748140 - RNA, 21 nt, Human
cagccucccaaagugcuggga

SEQ ID NO: 1748141 - RNA, 20 nt, Human
cagccucccaaagugcuggg

SEQ ID NO: 1748142 - RNA, 19 nt, Human
cagccucccaaagugcugg

SEQ ID NO: 1748143 - RNA, 14 nt, Human
cagccuccaugcug

SEQ ID NO: 1748144 - RNA, 20 nt, Human
cagccuccaugcugccucca

SEQ ID NO: 1748145 - RNA, 17 nt, Human
cagccuccaugcugccu

SEQ ID NO: 1748146 - RNA, 15 nt, Human
cagccuccaugcugc

SEQ ID NO: 1748147 - RNA, 21 nt, Human
cagccguguaaccauggaccc

SEQ ID NO: 1748148 - RNA, 20 nt, Human
cagccgugccuucagcucua

SEQ ID NO: 1748149 - RNA, 18 nt, Human
cagccgugccuucagcuc

SEQ ID NO: 1748150 - RNA, 16 nt, Human
cagccgugccuucagc

SEQ ID NO: 1748151 - RNA, 14 nt, Human
cagccgugccuuca

SEQ ID NO: 1748152 - RNA, 9 nt, Human
cagccgugc

SEQ ID NO: 1748153 - RNA, 23 nt, Human
cagcccugcuuugggcugcccug

SEQ ID NO: 1748154 - RNA, 22 nt, Human
cagcccugcuuugggcugcccu

SEQ ID NO: 1748155 - RNA, 21 nt, Human
cagcccugcuuugggcugccc

SEQ ID NO: 1748156 - RNA, 20 nt, Human
cagcccugcuuugggcugcc

SEQ ID NO: 1748157 - RNA, 19 nt, Human
cagcccugcuuugggcugc

SEQ ID NO: 1748158 - RNA, 13 nt, Human
cagcccugcuuug

SEQ ID NO: 1748159 - RNA, 11 nt, Human
cagcccugcuu

SEQ ID NO: 1748160 - RNA, 16 nt, Human
cagcccugcagagggc

SEQ ID NO: 1748161 - RNA, 15 nt, Human
cagcccugcagaggg

SEQ ID NO: 1748162 - RNA, 14 nt, Human
cagcccugcagagg

SEQ ID NO: 1748163 - RNA, 13 nt, Human
cagcccugcagag

SEQ ID NO: 1748164 - RNA, 20 nt, Human
cagcccugcagagggcacag

SEQ ID NO: 1748165 - RNA, 18 nt, Human
cagcccugcagagggcac

SEQ ID NO: 1748166 - RNA, 22 nt, Human
cagcccucccugccccucccuu

SEQ ID NO: 1748167 - RNA, 18 nt, Human
cagcccucccugccccuc

SEQ ID NO: 1748168 - RNA, 17 nt, Human
cagcccucccugccccu

SEQ ID NO: 1748169 - RNA, 16 nt, Human
cagcccucccugcccc

SEQ ID NO: 1748170 - RNA, 14 nt, Human
cagccccauucugc

SEQ ID NO: 1748171 - RNA, 13 nt, Human
cagccccauucug

SEQ ID NO: 1748172 - RNA, 22 nt, Human
cagccccauccucuguacagag

SEQ ID NO: 1748173 - RNA, 16 nt, Human
cagccccauccucugu

SEQ ID NO: 1748174 - RNA, 14 nt, Human
cagccccauccucu

SEQ ID NO: 1748175 - RNA, 13 nt, Human
cagccccauccuc

SEQ ID NO: 1748176 - RNA, 12 nt, Human
cagccccauccu

SEQ ID NO: 1748177 - RNA, 22 nt, Human
cagccccaucccaaacccuuca

SEQ ID NO: 1748178 - RNA, 23 nt, Human
cagccccuggaugcagccucaca

SEQ ID NO: 1748179 - RNA, 18 nt, Human
cagccccauucugccugc

SEQ ID NO: 1748180 - RNA, 17 nt, Human
cagccccauucugccug

SEQ ID NO: 1748181 - RNA, 16 nt, Human
cagccccauucugccu

SEQ ID NO: 1748182 - RNA, 21 nt, Human
cagccccuguucuggcagagu

SEQ ID NO: 1748183 - RNA, 20 nt, Human
cagccccuguucuggcagag

SEQ ID NO: 1748184 - RNA, 21 nt, Human
cagccccaucccaaacccuuc

SEQ ID NO: 1748185 - RNA, 11 nt, Human
cagccccaucc

SEQ ID NO: 1748186 - RNA, 18 nt, Human
cagccccagugcccacag

SEQ ID NO: 1748187 - RNA, 17 nt, Human
cagccccagugcccaca

SEQ ID NO: 1748188 - RNA, 16 nt, Human
cagccccagugcccac

SEQ ID NO: 1748189 - RNA, 15 nt, Human
cagccccagugccca

SEQ ID NO: 1748190 - RNA, 14 nt, Human
cagccccagugccc

SEQ ID NO: 1748191 - RNA, 13 nt, Human
cagccccagugcc

SEQ ID NO: 1748192 - RNA, 16 nt, Human
cagcccgggcucugcc

SEQ ID NO: 1748193 - RNA, 15 nt, Human
cagcccgggcucugc

SEQ ID NO: 1748194 - RNA, 14 nt, Human
cagcccgggcucug

SEQ ID NO: 1748195 - RNA, 13 nt, Human
cagcccgggcucu

SEQ ID NO: 1748196 - RNA, 21 nt, Human
cagccccuucugacccaugcu

SEQ ID NO: 1748197 - RNA, 19 nt, Human
cagccccuucugacccaug

SEQ ID NO: 1748198 - RNA, 17 nt, Human
cagccccuucugaccca

SEQ ID NO: 1748199 - RNA, 16 nt, Human
cagccccuucugaccc

SEQ ID NO: 1748200 - RNA, 23 nt, Human
cagccccuucugacccaugcugc

SEQ ID NO: 1748201 - RNA, 22 nt, Human
cagccccuucugacccaugcug

SEQ ID NO: 1748202 - RNA, 24 nt, Human
cagccccuucugacccaugcugcc

SEQ ID NO: 1748203 - RNA, 22 nt, Human
cagcccuccaucuaaacugccc

SEQ ID NO: 1748204 - RNA, 23 nt, Human
cagcccuccaucuaaacugcccc

SEQ ID NO: 1748205 - RNA, 15 nt, Human
cagcccucccugccc

SEQ ID NO: 1748206 - RNA, 13 nt, Human
cagcccucccugc

SEQ ID NO: 1748207 - RNA, 20 nt, Human
cagcccgggcucugccuccc

SEQ ID NO: 1748208 - RNA, 19 nt, Human
cagcccgggcucugccucc

SEQ ID NO: 1748209 - RNA, 18 nt, Human
cagcccgggcucugccuc

SEQ ID NO: 1748210 - RNA, 17 nt, Human
cagcccgggcucugccu

SEQ ID NO: 1748211 - RNA, 22 nt, Human
cagcccgggcucugccucccau

SEQ ID NO: 1748212 - RNA, 21 nt, Human
cagcccgggcucugccuccca

SEQ ID NO: 1748213 - RNA, 20 nt, Human
cagcauccuggcacccggcc

SEQ ID NO: 1748214 - RNA, 19 nt, Human
cagcauccuggcacccggc

SEQ ID NO: 1748215 - RNA, 21 nt, Human
cagcauccuggcacccggccc

SEQ ID NO: 1748216 - RNA, 14 nt, Human
cagcauucucacuc

SEQ ID NO: 1748217 - RNA, 15 nt, Human
cagcauucucacucc

SEQ ID NO: 1748218 - RNA, 16 nt, Human
cagccaaagccuccuc

SEQ ID NO: 1748219 - RNA, 15 nt, Human
cagccaaagccuccu

SEQ ID NO: 1748220 - RNA, 21 nt, Human
cagccaaagccuccuccagcc

SEQ ID NO: 1748221 - RNA, 18 nt, Human
cagccaaagccuccucca

SEQ ID NO: 1748222 - RNA, 18 nt, Human
cagccaacuauggccugu

SEQ ID NO: 1748223 - RNA, 15 nt, Human
cagcaggcucucagg

SEQ ID NO: 1748224 - RNA, 14 nt, Human
cagcaggcucucag

SEQ ID NO: 1748225 - RNA, 12 nt, Human
cagcaggcucuc

SEQ ID NO: 1748226 - RNA, 18 nt, Human
cagcagccuggacccugu

SEQ ID NO: 1748227 - RNA, 15 nt, Human
cagcagccuggaccc

SEQ ID NO: 1748228 - RNA, 14 nt, Human
cagcagccuggacc

SEQ ID NO: 1748229 - RNA, 12 nt, Human
cagcagccugga

SEQ ID NO: 1748230 - RNA, 22 nt, Human
cagcagccuggacccuguggau

SEQ ID NO: 1748231 - RNA, 19 nt, Human
cagcagccuggacccugug

SEQ ID NO: 1748232 - RNA, 18 nt, Human
cagcagggagggcuucug

SEQ ID NO: 1748233 - RNA, 22 nt, Human
cagcaggcucucaggccagcug

SEQ ID NO: 1748234 - RNA, 20 nt, Human
cagcaggcucucaggccagc

SEQ ID NO: 1748235 - RNA, 19 nt, Human
cagcaggcucucaggccag

SEQ ID NO: 1748236 - RNA, 18 nt, Human
cagcaggcucucaggcca

SEQ ID NO: 1748237 - RNA, 17 nt, Human
cagcaggcucucaggcc

SEQ ID NO: 1748238 - RNA, 16 nt, Human
cagcaggcucucaggc

SEQ ID NO: 1748239 - RNA, 17 nt, Human
cagcauccuggcacccg

SEQ ID NO: 1748240 - RNA, 16 nt, Human
cagcauccuggcaccc

SEQ ID NO: 1748241 - RNA, 15 nt, Human
cagcauccuggcacc

SEQ ID NO: 1748242 - RNA, 14 nt, Human
cagcauccuggcac

SEQ ID NO: 1748243 - RNA, 20 nt, Human
cagcagggagggcuucugcc

SEQ ID NO: 1748244 - RNA, 17 nt, Human
cagccacauuccugaug

SEQ ID NO: 1748245 - RNA, 15 nt, Human
cagccacauuccuga

SEQ ID NO: 1748246 - RNA, 19 nt, Human
cagccacauuccugaugcu

SEQ ID NO: 1748247 - RNA, 14 nt, Human
cagccacauuccug

SEQ ID NO: 1748248 - RNA, 22 nt, Human
cagccacggccaggccagaggg

SEQ ID NO: 1748249 - RNA, 21 nt, Human
cagccacggccaggccagagg

SEQ ID NO: 1748250 - RNA, 19 nt, Human
cagccacggccaggccaga

SEQ ID NO: 1748251 - RNA, 18 nt, Human
cagccacggccaggccag

SEQ ID NO: 1748252 - RNA, 17 nt, Human
cagccacggccaggcca

SEQ ID NO: 1748253 - RNA, 16 nt, Human
cagccacggccaggcc

SEQ ID NO: 1748254 - RNA, 15 nt, Human
cagccacggccaggc

SEQ ID NO: 1748255 - RNA, 14 nt, Human
cagccacggccagg

SEQ ID NO: 1748256 - RNA, 22 nt, Human
cagccaguaaaugggggugcau

SEQ ID NO: 1748257 - RNA, 23 nt, Human
cagccacggccaggccagaggga

SEQ ID NO: 1748258 - RNA, 18 nt, Human
cagcccacuucugccaua

SEQ ID NO: 1748259 - RNA, 21 nt, Human
cagccccaaaacucuccucug

SEQ ID NO: 1748260 - RNA, 20 nt, Human
cagccccaaaacucuccucu

SEQ ID NO: 1748261 - RNA, 22 nt, Human
cagccccaaaacucuccucugc

SEQ ID NO: 1748262 - RNA, 15 nt, Human
cagcccacuucugcc

SEQ ID NO: 1748263 - RNA, 15 nt, Human
cagcccaccccucaa

SEQ ID NO: 1748264 - RNA, 19 nt, Human
cagcccacauagugauggu

SEQ ID NO: 1748265 - RNA, 18 nt, Human
cagcaaaagaugcuucuc

SEQ ID NO: 1748266 - RNA, 22 nt, Human
cagauuuuuuacagcugccugc

SEQ ID NO: 1748267 - RNA, 19 nt, Human
cagauuuuuuacagcugcc

SEQ ID NO: 1748268 - RNA, 14 nt, Human
cagauucuuuccug

SEQ ID NO: 1748269 - RNA, 23 nt, Human
cagaugggugcuuggaggaagga

SEQ ID NO: 1748270 - RNA, 18 nt, Human
cagaugggugcuuggagg

SEQ ID NO: 1748271 - RNA, 15 nt, Human
cagaugcugugcaaa

SEQ ID NO: 1748272 - RNA, 23 nt, Human
cagcagccccugcacaaagcccu

SEQ ID NO: 1748273 - RNA, 16 nt, Human
cagcagccccugcaca

SEQ ID NO: 1748274 - RNA, 13 nt, Human
cagcagccccugc

SEQ ID NO: 1748275 - RNA, 19 nt, Human
cagcagaaaugccuuaccc

SEQ ID NO: 1748276 - RNA, 22 nt, Human
cagcagaaaugccuuacccuca

SEQ ID NO: 1748277 - RNA, 13 nt, Human
cagcagagcaccu

SEQ ID NO: 1748278 - RNA, 11 nt, Human
cagcagagcac

SEQ ID NO: 1748279 - RNA, 15 nt, Human
cagcagaaaugccuu

SEQ ID NO: 1748280 - RNA, 17 nt, Human
cagcagaaaugccuuac

SEQ ID NO: 1748281 - RNA, 17 nt, Human
cagcaaggagauuuaca

SEQ ID NO: 1748282 - RNA, 18 nt, Human
cagcaaggagauuuacaa

SEQ ID NO: 1748283 - RNA, 12 nt, Human
cagcaagugaga

SEQ ID NO: 1748284 - RNA, 17 nt, Human
cagcaagugagagcugg

SEQ ID NO: 1748285 - RNA, 16 nt, Human
cagcaagugagagcug

SEQ ID NO: 1748286 - RNA, 15 nt, Human
cagcaagugagagcu

SEQ ID NO: 1748287 - RNA, 14 nt, Human
cagcaagugagagc

SEQ ID NO: 1748288 - RNA, 21 nt, Human
cagcaagugagagcugggugu

SEQ ID NO: 1748289 - RNA, 19 nt, Human
cagcaagugagagcugggu

SEQ ID NO: 1748290 - RNA, 13 nt, Human
cagcaauaaagca

SEQ ID NO: 1748291 - RNA, 21 nt, Human
cagcaauaaagcagcguuucu

SEQ ID NO: 1748292 - RNA, 22 nt, Human
cagcaauaaagcagcguuucua

SEQ ID NO: 1748293 - RNA, 20 nt, Human
cagcaauucuccugccucag

SEQ ID NO: 1748294 - RNA, 19 nt, Human
cagcaauucuccugccuca

SEQ ID NO: 1748295 - RNA, 18 nt, Human
cagcaauucuccugccuc

SEQ ID NO: 1748296 - RNA, 17 nt, Human
cagcaauucuccugccu

SEQ ID NO: 1748297 - RNA, 16 nt, Human
cagcaauucuccugcc

SEQ ID NO: 1748298 - RNA, 15 nt, Human
cagcaauucuccugc

SEQ ID NO: 1748299 - RNA, 14 nt, Human
cagcucaccagccc

SEQ ID NO: 1748300 - RNA, 18 nt, Human
cagccuccaugcugccuc

SEQ ID NO: 1748301 - RNA, 20 nt, Human
cagaccacaaaacuuuucua

SEQ ID NO: 1748302 - RNA, 14 nt, Human
cagaccacaaaacu

SEQ ID NO: 1748303 - RNA, 18 nt, Human
cagaccccuggcuuuuca

SEQ ID NO: 1748304 - RNA, 16 nt, Human
cagaccccuggcuuuu

SEQ ID NO: 1748305 - RNA, 15 nt, Human
cagaccccuggcuuu

SEQ ID NO: 1748306 - RNA, 14 nt, Human
cagaccccuggcuu

SEQ ID NO: 1748307 - RNA, 13 nt, Human
cagaccccuggcu

SEQ ID NO: 1748308 - RNA, 21 nt, Human
cagacccugcccugugggccc

SEQ ID NO: 1748309 - RNA, 17 nt, Human
cagacccugcccugugg

SEQ ID NO: 1748310 - RNA, 16 nt, Human
cagacccugcccugug

SEQ ID NO: 1748311 - RNA, 15 nt, Human
cagacccugcccugu

SEQ ID NO: 1748312 - RNA, 22 nt, Human
cagacccugcccugugggcccc

SEQ ID NO: 1748313 - RNA, 14 nt, Human
cagacccggcugcg

SEQ ID NO: 1748314 - RNA, 12 nt, Human
cagacccggcug

SEQ ID NO: 1748315 - RNA, 23 nt, Human
cagaccccuggcuuuucacugcu

SEQ ID NO: 1748316 - RNA, 22 nt, Human
cagaccccuggcuuuucacugc

SEQ ID NO: 1748317 - RNA, 21 nt, Human
cagaccccuggcuuuucacug

SEQ ID NO: 1748318 - RNA, 12 nt, Human
cagacccugccc

SEQ ID NO: 1748319 - RNA, 16 nt, Human
cagacccggcugcgug

SEQ ID NO: 1748320 - RNA, 14 nt, Human
cagacccugcccug

SEQ ID NO: 1748321 - RNA, 13 nt, Human
cagacccugcccu

SEQ ID NO: 1748322 - RNA, 23 nt, Human
cagagaaaguacuucuccacccu

SEQ ID NO: 1748323 - RNA, 19 nt, Human
cagagaaaguacuucucca

SEQ ID NO: 1748324 - RNA, 20 nt, Human
cagacuuuuuuuaaauagua

SEQ ID NO: 1748325 - RNA, 17 nt, Human
cagacauagaauuaaca

SEQ ID NO: 1748326 - RNA, 19 nt, Human
cagacauagaauuaacaca

SEQ ID NO: 1748327 - RNA, 19 nt, Human
cagacauacuaaccagcag

SEQ ID NO: 1748328 - RNA, 22 nt, Human
cagacaccuugacagggcacac

SEQ ID NO: 1748329 - RNA, 20 nt, Human
cagacaccuugacagggcac

SEQ ID NO: 1748330 - RNA, 19 nt, Human
cagacaccuugacagggca

SEQ ID NO: 1748331 - RNA, 20 nt, Human
cagacaguuaagagaaauga

SEQ ID NO: 1748332 - RNA, 23 nt, Human
cagacacaggcccggcuccaggc

SEQ ID NO: 1748333 - RNA, 22 nt, Human
cagacacaggcccggcuccagg

SEQ ID NO: 1748334 - RNA, 21 nt, Human
cagacacaggcccggcuccag

SEQ ID NO: 1748335 - RNA, 18 nt, Human
cagacacaggcccggcuc

SEQ ID NO: 1748336 - RNA, 17 nt, Human
cagacacaggcccggcu

SEQ ID NO: 1748337 - RNA, 15 nt, Human
cagacacaggcccgg

SEQ ID NO: 1748338 - RNA, 14 nt, Human
cagacacaggcccg

SEQ ID NO: 1748339 - RNA, 13 nt, Human
cagacacaggccc

SEQ ID NO: 1748340 - RNA, 23 nt, Human
cagacacauguccaagaagccca

SEQ ID NO: 1748341 - RNA, 22 nt, Human
cagacacauguccaagaagccc

SEQ ID NO: 1748342 - RNA, 21 nt, Human
cagacacauguccaagaagcc

SEQ ID NO: 1748343 - RNA, 17 nt, Human
cagacacauguccaaga

SEQ ID NO: 1748344 - RNA, 14 nt, Human
cagacacaugucca

SEQ ID NO: 1748345 - RNA, 22 nt, Human
cagacaaagcgugguggacaug

SEQ ID NO: 1748346 - RNA, 20 nt, Human
cagacaacaaaccuguuucu

SEQ ID NO: 1748347 - RNA, 20 nt, Human
cagaauuucccaaagcagug

SEQ ID NO: 1748348 - RNA, 19 nt, Human
cagaauuucccaaagcagu

SEQ ID NO: 1748349 - RNA, 18 nt, Human
cagaauuucccaaagcag

SEQ ID NO: 1748350 - RNA, 17 nt, Human
cagaauuucccaaagca

SEQ ID NO: 1748351 - RNA, 12 nt, Human
cagacaaagcgu

SEQ ID NO: 1748352 - RNA, 24 nt, Human
cagaauuucccaaagcagugcaug

SEQ ID NO: 1748353 - RNA, 15 nt, Human
cagaauucucuaguu

SEQ ID NO: 1748354 - RNA, 18 nt, Human
cagaauucucuaguuuga

SEQ ID NO: 1748355 - RNA, 11 nt, Human
cagaauucuca

SEQ ID NO: 1748356 - RNA, 14 nt, Human
cagaauuucccaaa

SEQ ID NO: 1748357 - RNA, 15 nt, Human
cagaaucucgcucug

SEQ ID NO: 1748358 - RNA, 22 nt, Human
cagaacccuuggagccaaugga

SEQ ID NO: 1748359 - RNA, 19 nt, Human
cagaagcaacccaaauguu

SEQ ID NO: 1748360 - RNA, 20 nt, Human
cagaagcaacccaaauguuc

SEQ ID NO: 1748361 - RNA, 13 nt, Human
cagaagcagcucu

SEQ ID NO: 1748362 - RNA, 14 nt, Human
cagaagcagcucuu

SEQ ID NO: 1748363 - RNA, 21 nt, Human
cagaagacacugaugggcaac

SEQ ID NO: 1748364 - RNA, 19 nt, Human
cagaaggaagacuucaucc

SEQ ID NO: 1748365 - RNA, 18 nt, Human
cagaaggaagacuucauc

SEQ ID NO: 1748366 - RNA, 17 nt, Human
cagaaggaagacuucau

SEQ ID NO: 1748367 - RNA, 16 nt, Human
cagaaggaagacuuca

SEQ ID NO: 1748368 - RNA, 18 nt, Human
cagaaucucaaauaacua

SEQ ID NO: 1748369 - RNA, 17 nt, Human
cagaaucucaaauaacu

SEQ ID NO: 1748370 - RNA, 22 nt, Human
cacuuuuguucuugguuuguaa

SEQ ID NO: 1748371 - RNA, 14 nt, Human
cacuuuuguucuug

SEQ ID NO: 1748372 - RNA, 18 nt, Human
cacuuuuauuuagcacca

SEQ ID NO: 1748373 - RNA, 23 nt, Human
cacuuuguucuggcucuuccagg

SEQ ID NO: 1748374 - RNA, 16 nt, Human
cacuuuguucuggcuc

SEQ ID NO: 1748375 - RNA, 14 nt, Human
cacuuuguucuggc

SEQ ID NO: 1748376 - RNA, 13 nt, Human
cacuuuguucugg

SEQ ID NO: 1748377 - RNA, 13 nt, Human
cacuuugggaggc

SEQ ID NO: 1748378 - RNA, 12 nt, Human
cacuuugggagg

SEQ ID NO: 1748379 - RNA, 16 nt, Human
cacuuugggaggccaa

SEQ ID NO: 1748380 - RNA, 22 nt, Human
cacuuucuagccagaggagaga

SEQ ID NO: 1748381 - RNA, 12 nt, Human
cacuuugcauaa

SEQ ID NO: 1748382 - RNA, 18 nt, Human
cagaaagcagaacaguga

SEQ ID NO: 1748383 - RNA, 24 nt, Human
cagaaagaaguggggacagagcag

SEQ ID NO: 1748384 - RNA, 19 nt, Human
cagaaagcagaacagugau

SEQ ID NO: 1748385 - RNA, 23 nt, Human
cagaacagugauuaccagggacu

SEQ ID NO: 1748386 - RNA, 23 nt, Human
cagaaaauggaagacagcucuua

SEQ ID NO: 1748387 - RNA, 22 nt, Human
cagaaaauggaagacagcucuu

SEQ ID NO: 1748388 - RNA, 21 nt, Human
cagaaaauggaagacagcucu

SEQ ID NO: 1748389 - RNA, 20 nt, Human
cagaaaauggaagacagcuc

SEQ ID NO: 1748390 - RNA, 16 nt, Human
cagaaaauggaagaca

SEQ ID NO: 1748391 - RNA, 16 nt, Human
cagacaacaaaccugu

SEQ ID NO: 1748392 - RNA, 16 nt, Human
cagaugcaccagcccu

SEQ ID NO: 1748393 - RNA, 14 nt, Human
cagaugcaccagcc

SEQ ID NO: 1748394 - RNA, 13 nt, Human
cagaugcaccagc

SEQ ID NO: 1748395 - RNA, 22 nt, Human
cagaugcaccagcccuuagcag

SEQ ID NO: 1748396 - RNA, 17 nt, Human
cagaugcaccagcccuu

SEQ ID NO: 1748397 - RNA, 20 nt, Human
cagaucucuaacuucaccau

SEQ ID NO: 1748398 - RNA, 22 nt, Human
cagauacaggaaaagcugcuga

SEQ ID NO: 1748399 - RNA, 21 nt, Human
cagauacaggaaaagcugcug

SEQ ID NO: 1748400 - RNA, 20 nt, Human
cagauacaggaaaagcugcu

SEQ ID NO: 1748401 - RNA, 23 nt, Human
cagauaaauaguuuaugauucca

SEQ ID NO: 1748402 - RNA, 22 nt, Human
cagauaaagguucaugcaaacu

SEQ ID NO: 1748403 - RNA, 14 nt, Human
cagauaaacaguag

SEQ ID NO: 1748404 - RNA, 15 nt, Human
cagaguuguuacauu

SEQ ID NO: 1748405 - RNA, 18 nt, Human
cagaguuguuacauuuuu

SEQ ID NO: 1748406 - RNA, 19 nt, Human
cagaguuguuacauuuuua

SEQ ID NO: 1748407 - RNA, 16 nt, Human
cagaguugaagacaga

SEQ ID NO: 1748408 - RNA, 15 nt, Human
cagaguugaagacag

SEQ ID NO: 1748409 - RNA, 14 nt, Human
cagaguugaagaca

SEQ ID NO: 1748410 - RNA, 20 nt, Human
cagaguugaagacagagcua

SEQ ID NO: 1748411 - RNA, 19 nt, Human
cagaguugaagacagagcu

SEQ ID NO: 1748412 - RNA, 18 nt, Human
cagaguugaagacagagc

SEQ ID NO: 1748413 - RNA, 17 nt, Human
cagaguugaagacagag

SEQ ID NO: 1748414 - RNA, 14 nt, Human
cagaguuguuacau

SEQ ID NO: 1748415 - RNA, 22 nt, Human
cagaguugaagacagagcuaca

SEQ ID NO: 1748416 - RNA, 20 nt, Human
cagagugagacucugucuca

SEQ ID NO: 1748417 - RNA, 19 nt, Human
cagagugagacucugucuc

SEQ ID NO: 1748418 - RNA, 18 nt, Human
cagagugagacucugucu

SEQ ID NO: 1748419 - RNA, 17 nt, Human
cagagugagacucuguc

SEQ ID NO: 1748420 - RNA, 16 nt, Human
cagagugagacucugu

SEQ ID NO: 1748421 - RNA, 23 nt, Human
cagagucucacuguugcccaggc

SEQ ID NO: 1748422 - RNA, 22 nt, Human
cagagucucacuguugcccagg

SEQ ID NO: 1748423 - RNA, 23 nt, Human
cagagucucgcucuguugcccag

SEQ ID NO: 1748424 - RNA, 23 nt, Human
cagagggagugacagaggcagcc

SEQ ID NO: 1748425 - RNA, 22 nt, Human
cagagggagugacagaggcagc

SEQ ID NO: 1748426 - RNA, 21 nt, Human
cagagggagugacagaggcag

SEQ ID NO: 1748427 - RNA, 20 nt, Human
cagagggagugacagaggca

SEQ ID NO: 1748428 - RNA, 19 nt, Human
cagagggccugcaagggag

SEQ ID NO: 1748429 - RNA, 15 nt, Human
cagagggccugcaag

SEQ ID NO: 1748430 - RNA, 21 nt, Human
cagagucucacuguugcccag

SEQ ID NO: 1748431 - RNA, 20 nt, Human
cagagucucacuguugccca

SEQ ID NO: 1748432 - RNA, 19 nt, Human
cagagucucacuguugccc

SEQ ID NO: 1748433 - RNA, 17 nt, Human
cagagucucacuguugc

SEQ ID NO: 1748434 - RNA, 13 nt, Human
cagagucucacug

SEQ ID NO: 1748435 - RNA, 22 nt, Human
cagaggcagccccauucugccu

SEQ ID NO: 1748436 - RNA, 20 nt, Human
cagaggcagccccauucugc

SEQ ID NO: 1748437 - RNA, 19 nt, Human
cagaggcagccccauucug

SEQ ID NO: 1748438 - RNA, 18 nt, Human
cagaggcagccccauucu

SEQ ID NO: 1748439 - RNA, 15 nt, Human
cagaggcagccccau

SEQ ID NO: 1748440 - RNA, 14 nt, Human
cagaggcagcccca

SEQ ID NO: 1748441 - RNA, 13 nt, Human
cagaggcagcccc

SEQ ID NO: 1748442 - RNA, 12 nt, Human
cagaggcagccc

SEQ ID NO: 1748443 - RNA, 21 nt, Human
cagaggccaugggccuccugu

SEQ ID NO: 1748444 - RNA, 20 nt, Human
cagaggccaugggccuccug

SEQ ID NO: 1748445 - RNA, 19 nt, Human
cagaggccaugggccuccu

SEQ ID NO: 1748446 - RNA, 23 nt, Human
cagaggcagccccauucugccug

SEQ ID NO: 1748447 - RNA, 19 nt, Human
cagagggagugacagaggc

SEQ ID NO: 1748448 - RNA, 18 nt, Human
cagagggagugacagagg

SEQ ID NO: 1748449 - RNA, 16 nt, Human
cagagggagugacaga

SEQ ID NO: 1748450 - RNA, 14 nt, Human
cagagggagugaca

SEQ ID NO: 1748451 - RNA, 23 nt, Human
cagaggcugccucucccaucacu

SEQ ID NO: 1748452 - RNA, 13 nt, Human
cagaggcugccuc

SEQ ID NO: 1748453 - RNA, 21 nt, Human
cagaggcucagauuguaauau

SEQ ID NO: 1748454 - RNA, 23 nt, Human
cagaggcgcaugaauuugugaag

SEQ ID NO: 1748455 - RNA, 19 nt, Human
cagagacuccugcaggcag

SEQ ID NO: 1748456 - RNA, 18 nt, Human
cagagacuccugcaggca

SEQ ID NO: 1748457 - RNA, 17 nt, Human
cagagacuccugcaggc

SEQ ID NO: 1748458 - RNA, 16 nt, Human
cagagacuccugcagg

SEQ ID NO: 1748459 - RNA, 15 nt, Human
cagagacuccugcag

SEQ ID NO: 1748460 - RNA, 14 nt, Human
cagagacuccugca

SEQ ID NO: 1748461 - RNA, 13 nt, Human
cagagacuccugc

SEQ ID NO: 1748462 - RNA, 20 nt, Human
cagagaccaucccugaaggc

SEQ ID NO: 1748463 - RNA, 19 nt, Human
cagagaccaucccugaagg

SEQ ID NO: 1748464 - RNA, 18 nt, Human
cagagaccaucccugaag

SEQ ID NO: 1748465 - RNA, 17 nt, Human
cagagaccaucccugaa

SEQ ID NO: 1748466 - RNA, 21 nt, Human
cagagaccaucccugaaggcc

SEQ ID NO: 1748467 - RNA, 20 nt, Human
cagagcaagugagacccugu

SEQ ID NO: 1748468 - RNA, 14 nt, Human
cagagcaagugaga

SEQ ID NO: 1748469 - RNA, 16 nt, Human
cagagcaccuuagaca

SEQ ID NO: 1748470 - RNA, 18 nt, Human
cagagcacagcagccccu

SEQ ID NO: 1748471 - RNA, 18 nt, Human
cagagaguggcuccuccc

SEQ ID NO: 1748472 - RNA, 15 nt, Human
cagagaguggcuccu

SEQ ID NO: 1748473 - RNA, 14 nt, Human
cagagaguggcucc

SEQ ID NO: 1748474 - RNA, 13 nt, Human
cagagaguggcuc

SEQ ID NO: 1748475 - RNA, 16 nt, Human
cagagaccaucccuga

SEQ ID NO: 1748476 - RNA, 14 nt, Human
cagagaccaucccu

SEQ ID NO: 1748477 - RNA, 13 nt, Human
cagagaccauccc

SEQ ID NO: 1748478 - RNA, 15 nt, Human
cagagacacaagccu

SEQ ID NO: 1748479 - RNA, 14 nt, Human
cagagacacaagcc

SEQ ID NO: 1748480 - RNA, 17 nt, Human
cagagacacaagccuuc

SEQ ID NO: 1748481 - RNA, 16 nt, Human
cagagacacaagccuu

SEQ ID NO: 1748482 - RNA, 15 nt, Human
cagagaauucucuua

SEQ ID NO: 1748483 - RNA, 21 nt, Human
cagagaaugaaagggcccaga

SEQ ID NO: 1748484 - RNA, 20 nt, Human
cagagaaugaaagggcccag

SEQ ID NO: 1748485 - RNA, 19 nt, Human
cagagaaugaaagggccca

SEQ ID NO: 1748486 - RNA, 19 nt, Human
cagaggagagaggaccccc

SEQ ID NO: 1748487 - RNA, 15 nt, Human
cagaggagagaggac

SEQ ID NO: 1748488 - RNA, 13 nt, Human
cagaggagagagg

SEQ ID NO: 1748489 - RNA, 15 nt, Human
cagaggacacagaga

SEQ ID NO: 1748490 - RNA, 17 nt, Human
cagaggacacagagaag

SEQ ID NO: 1748491 - RNA, 11 nt, Human
cagaggcagcc

SEQ ID NO: 1748492 - RNA, 20 nt, Human
cagaggagagaggacccccu

SEQ ID NO: 1748493 - RNA, 21 nt, Human
cagagcccacgcccccacugg

SEQ ID NO: 1748494 - RNA, 20 nt, Human
cagagcccacgcccccacug

SEQ ID NO: 1748495 - RNA, 19 nt, Human
cagagcccacgcccccacu

SEQ ID NO: 1748496 - RNA, 17 nt, Human
cagagcccacgccccca

SEQ ID NO: 1748497 - RNA, 23 nt, Human
cagagcccacgcccccacuggug

SEQ ID NO: 1748498 - RNA, 13 nt, Human
cagagccugcagu

SEQ ID NO: 1748499 - RNA, 13 nt, Human
cagaggaaggaga

SEQ ID NO: 1748500 - RNA, 12 nt, Human
cagagccugcag

SEQ ID NO: 1748501 - RNA, 21 nt, Human
cagagcagagaccaucccuga

SEQ ID NO: 1748502 - RNA, 19 nt, Human
cagagcagagaccaucccu

SEQ ID NO: 1748503 - RNA, 18 nt, Human
cagagcagagaccauccc

SEQ ID NO: 1748504 - RNA, 17 nt, Human
cagagcagagaccaucc

SEQ ID NO: 1748505 - RNA, 15 nt, Human
cagagcagagaccau

SEQ ID NO: 1748506 - RNA, 14 nt, Human
cagagcagagacca

SEQ ID NO: 1748507 - RNA, 13 nt, Human
cagagcagagacc

SEQ ID NO: 1748508 - RNA, 22 nt, Human
cagagcaccuuagacagucccu

SEQ ID NO: 1748509 - RNA, 21 nt, Human
cagagcaccuuagacaguccc

SEQ ID NO: 1748510 - RNA, 19 nt, Human
cagagcaccuuagacaguc

SEQ ID NO: 1748511 - RNA, 18 nt, Human
cagagcaccuuagacagu

SEQ ID NO: 1748512 - RNA, 12 nt, Human
cagagcagagac

SEQ ID NO: 1748513 - RNA, 11 nt, Human
cagagcagaga

SEQ ID NO: 1748514 - RNA, 23 nt, Human
cagagcaccuuagacagucccug

SEQ ID NO: 1748515 - RNA, 16 nt, Human
cagagcccacgccccc

SEQ ID NO: 1748516 - RNA, 20 nt, Human
cagagcccaccuuggcucaa

SEQ ID NO: 1748517 - RNA, 19 nt, Human
cagagcccaccuuggcuca

SEQ ID NO: 1748518 - RNA, 17 nt, Human
cagagcccaccuuggcu

SEQ ID NO: 1748519 - RNA, 15 nt, Human
cagagcccaccuugg

SEQ ID NO: 1748520 - RNA, 22 nt, Human
cagagccaccccuaaagagaua

SEQ ID NO: 1748521 - RNA, 16 nt, Human
cagaggccaugggccu

SEQ ID NO: 1748522 - RNA, 14 nt, Human
caccggcuggccug

SEQ ID NO: 1748523 - RNA, 16 nt, Human
caccggcuggccuggc

SEQ ID NO: 1748524 - RNA, 15 nt, Human
caccggcuggccugg

SEQ ID NO: 1748525 - RNA, 14 nt, Human
caccgggcacucag

SEQ ID NO: 1748526 - RNA, 20 nt, Human
caccggcuggccuggccccu

SEQ ID NO: 1748527 - RNA, 18 nt, Human
caccggcuggccuggccc

SEQ ID NO: 1748528 - RNA, 17 nt, Human
caccggcuggccuggcc

SEQ ID NO: 1748529 - RNA, 21 nt, Human
caccgcagacaggaccaggga

SEQ ID NO: 1748530 - RNA, 18 nt, Human
caccgggccacagagaaa

SEQ ID NO: 1748531 - RNA, 15 nt, Human
caccgggccacagag

SEQ ID NO: 1748532 - RNA, 22 nt, Human
caccgggcacucagaagacacu

SEQ ID NO: 1748533 - RNA, 15 nt, Human
caccgggcacucaga

SEQ ID NO: 1748534 - RNA, 13 nt, Human
caccgggccugga

SEQ ID NO: 1748535 - RNA, 15 nt, Human
caccggggccucgga

SEQ ID NO: 1748536 - RNA, 20 nt, Human
caccgugccuggccacgccc

SEQ ID NO: 1748537 - RNA, 15 nt, Human
caccgugccuggcca

SEQ ID NO: 1748538 - RNA, 21 nt, Human
caccucccccaucucuucugg

SEQ ID NO: 1748539 - RNA, 14 nt, Human
caccucccccaucu

SEQ ID NO: 1748540 - RNA, 11 nt, Human
caccuccugcc

SEQ ID NO: 1748541 - RNA, 13 nt, Human
caccuccugccuc

SEQ ID NO: 1748542 - RNA, 14 nt, Human
caccuccugccucg

SEQ ID NO: 1748543 - RNA, 17 nt, Human
caccucucccuuggauu

SEQ ID NO: 1748544 - RNA, 14 nt, Human
caccucucccuugg

SEQ ID NO: 1748545 - RNA, 13 nt, Human
caccucucccuug

SEQ ID NO: 1748546 - RNA, 19 nt, Human
caccucugcacaagcugca

SEQ ID NO: 1748547 - RNA, 18 nt, Human
caccucugcacaagcugc

SEQ ID NO: 1748548 - RNA, 19 nt, Human
caccucucucacuccuuga

SEQ ID NO: 1748549 - RNA, 18 nt, Human
caccucucucacuccuug

SEQ ID NO: 1748550 - RNA, 17 nt, Human
caccucucucacuccuu

SEQ ID NO: 1748551 - RNA, 15 nt, Human
caccucucucacucc

SEQ ID NO: 1748552 - RNA, 15 nt, Human
caccugaagacucau

SEQ ID NO: 1748553 - RNA, 14 nt, Human
caccugaagacuca

SEQ ID NO: 1748554 - RNA, 23 nt, Human
caccugaagacucauucuucugu

SEQ ID NO: 1748555 - RNA, 23 nt, Human
caccugcggugcuaucuccccca

SEQ ID NO: 1748556 - RNA, 20 nt, Human
caccuggaauauauaaccag

SEQ ID NO: 1748557 - RNA, 15 nt, Human
caccuggccucugca

SEQ ID NO: 1748558 - RNA, 14 nt, Human
caccuggccucugc

SEQ ID NO: 1748559 - RNA, 13 nt, Human
caccuggccucug

SEQ ID NO: 1748560 - RNA, 12 nt, Human
caccuggccucu

SEQ ID NO: 1748561 - RNA, 20 nt, Human
caccuggccucugcacuccc

SEQ ID NO: 1748562 - RNA, 19 nt, Human
caccuggccucugcacucc

SEQ ID NO: 1748563 - RNA, 18 nt, Human
caccuggccucugcacuc

SEQ ID NO: 1748564 - RNA, 17 nt, Human
caccuggccucugcacu

SEQ ID NO: 1748565 - RNA, 23 nt, Human
caccuggccucugcacuccccug

SEQ ID NO: 1748566 - RNA, 20 nt, Human
cacauauugauuuccguuaa

SEQ ID NO: 1748567 - RNA, 20 nt, Human
caccccucaacaccucugca

SEQ ID NO: 1748568 - RNA, 13 nt, Human
cacauauugauuu

SEQ ID NO: 1748569 - RNA, 21 nt, Human
cacccggccccugcugguuca

SEQ ID NO: 1748570 - RNA, 18 nt, Human
cacccggccccugcuggu

SEQ ID NO: 1748571 - RNA, 17 nt, Human
cacccggccccugcugg

SEQ ID NO: 1748572 - RNA, 16 nt, Human
cacccggccccugcug

SEQ ID NO: 1748573 - RNA, 14 nt, Human
cacccggccccugc

SEQ ID NO: 1748574 - RNA, 13 nt, Human
cacccggccccug

SEQ ID NO: 1748575 - RNA, 12 nt, Human
cacccggccccu

SEQ ID NO: 1748576 - RNA, 19 nt, Human
cacccgcuaagagggaggg

SEQ ID NO: 1748577 - RNA, 23 nt, Human
cacccugugauggggcccugccu

SEQ ID NO: 1748578 - RNA, 22 nt, Human
cacccugugauggggcccugcc

SEQ ID NO: 1748579 - RNA, 21 nt, Human
cacccugugauggggcccugc

SEQ ID NO: 1748580 - RNA, 20 nt, Human
cacccugugauggggcccug

SEQ ID NO: 1748581 - RNA, 18 nt, Human
cacccugugauggggccc

SEQ ID NO: 1748582 - RNA, 15 nt, Human
cacccugugaugggg

SEQ ID NO: 1748583 - RNA, 12 nt, Human
cacccugugaug

SEQ ID NO: 1748584 - RNA, 11 nt, Human
cacccugugau

SEQ ID NO: 1748585 - RNA, 21 nt, Human
caccgaaaacguggcugcuuc

SEQ ID NO: 1748586 - RNA, 19 nt, Human
caccgaaaacguggcugcu

SEQ ID NO: 1748587 - RNA, 22 nt, Human
caccgaaaacguggcugcuuca

SEQ ID NO: 1748588 - RNA, 18 nt, Human
caccgaaaacguggcugc

SEQ ID NO: 1748589 - RNA, 15 nt, Human
caccgaaaacguggc

SEQ ID NO: 1748590 - RNA, 18 nt, Human
caccgcagacaggaccag

SEQ ID NO: 1748591 - RNA, 17 nt, Human
caccgcagacaggacca

SEQ ID NO: 1748592 - RNA, 15 nt, Human
caccgcagacaggac

SEQ ID NO: 1748593 - RNA, 14 nt, Human
caccgcagacagga

SEQ ID NO: 1748594 - RNA, 13 nt, Human
caccgcagacagg

SEQ ID NO: 1748595 - RNA, 12 nt, Human
caccgcagacag

SEQ ID NO: 1748596 - RNA, 16 nt, Human
cacgccagauucuuuc

SEQ ID NO: 1748597 - RNA, 14 nt, Human
cacucuacuuagca

SEQ ID NO: 1748598 - RNA, 14 nt, Human
cacucuggcagcuc

SEQ ID NO: 1748599 - RNA, 13 nt, Human
cacucuggcagcu

SEQ ID NO: 1748600 - RNA, 12 nt, Human
cacucuggcagc

SEQ ID NO: 1748601 - RNA, 23 nt, Human
cacucugagacucgcgacaaugc

SEQ ID NO: 1748602 - RNA, 12 nt, Human
cacucugagacu

SEQ ID NO: 1748603 - RNA, 12 nt, Human
cacucuccuugg

SEQ ID NO: 1748604 - RNA, 21 nt, Human
cacuccuucacagaugggugc

SEQ ID NO: 1748605 - RNA, 14 nt, Human
cacuccuucacaga

SEQ ID NO: 1748606 - RNA, 17 nt, Human
cacucccugcaaccuga

SEQ ID NO: 1748607 - RNA, 14 nt, Human
cacuccuaccuggu

SEQ ID NO: 1748608 - RNA, 13 nt, Human
cacuccuaccugg

SEQ ID NO: 1748609 - RNA, 16 nt, Human
cacucccugcaaccug

SEQ ID NO: 1748610 - RNA, 13 nt, Human
cacucccugcaac

SEQ ID NO: 1748611 - RNA, 12 nt, Human
cacucccugcaa

SEQ ID NO: 1748612 - RNA, 22 nt, Human
cacucauugaccugaggcccuu

SEQ ID NO: 1748613 - RNA, 20 nt, Human
cacucauugaccugaggccc

SEQ ID NO: 1748614 - RNA, 19 nt, Human
cacucauugaccugaggcc

SEQ ID NO: 1748615 - RNA, 18 nt, Human
cacucauugaccugaggc

SEQ ID NO: 1748616 - RNA, 16 nt, Human
cacucaguccauagca

SEQ ID NO: 1748617 - RNA, 16 nt, Human
cacucaggucuguuuu

SEQ ID NO: 1748618 - RNA, 15 nt, Human
cacucauugaccuga

SEQ ID NO: 1748619 - RNA, 18 nt, Human
cacuaaccacgcuggacc

SEQ ID NO: 1748620 - RNA, 18 nt, Human
cacuaaggugugcucuga

SEQ ID NO: 1748621 - RNA, 17 nt, Human
cacuaaggugugcucug

SEQ ID NO: 1748622 - RNA, 21 nt, Human
cacuaaauugacacuuaaaaa

SEQ ID NO: 1748623 - RNA, 16 nt, Human
cacuaacaugauuugg

SEQ ID NO: 1748624 - RNA, 16 nt, Human
cacuaaccacgcugga

SEQ ID NO: 1748625 - RNA, 15 nt, Human
cacuaaccacgcugg

SEQ ID NO: 1748626 - RNA, 14 nt, Human
cacuaaccacgcug

SEQ ID NO: 1748627 - RNA, 14 nt, Human
cacuauaauguaag

SEQ ID NO: 1748628 - RNA, 21 nt, Human
cacuauagccuaggugacaga

SEQ ID NO: 1748629 - RNA, 14 nt, Human
cacuauagccuagg

SEQ ID NO: 1748630 - RNA, 18 nt, Human
cacuauaauguaagcucu

SEQ ID NO: 1748631 - RNA, 19 nt, Human
cacuauguugcccaggcag

SEQ ID NO: 1748632 - RNA, 18 nt, Human
cacuauguugcccaggca

SEQ ID NO: 1748633 - RNA, 17 nt, Human
cacuauguugcccaggc

SEQ ID NO: 1748634 - RNA, 16 nt, Human
cacuauguugcccagg

SEQ ID NO: 1748635 - RNA, 15 nt, Human
cacuauguugcccag

SEQ ID NO: 1748636 - RNA, 19 nt, Human
cacuaucccggcugcccuu

SEQ ID NO: 1748637 - RNA, 18 nt, Human
cacuaucccggcugcccu

SEQ ID NO: 1748638 - RNA, 20 nt, Human
cacucaaaagcugggcaggu

SEQ ID NO: 1748639 - RNA, 19 nt, Human
cacucaaaagcugggcagg

SEQ ID NO: 1748640 - RNA, 18 nt, Human
cacucaaaagcugggcag

SEQ ID NO: 1748641 - RNA, 17 nt, Human
cacucaaaagcugggca

SEQ ID NO: 1748642 - RNA, 15 nt, Human
cacucaaaagcuggg

SEQ ID NO: 1748643 - RNA, 21 nt, Human
cacuauguugcccaggcaggu

SEQ ID NO: 1748644 - RNA, 20 nt, Human
cacuauguugcccaggcagg

SEQ ID NO: 1748645 - RNA, 17 nt, Human
cacucagaagacacuga

SEQ ID NO: 1748646 - RNA, 16 nt, Human
cacucagaagacacug

SEQ ID NO: 1748647 - RNA, 12 nt, Human
cacucagaagac

SEQ ID NO: 1748648 - RNA, 20 nt, Human
cacucacauuuauucugcuc

SEQ ID NO: 1748649 - RNA, 19 nt, Human
cacucacauuuauucugcu

SEQ ID NO: 1748650 - RNA, 19 nt, Human
cacucagaagacacugaug

SEQ ID NO: 1748651 - RNA, 18 nt, Human
cacucagaagacacugau

SEQ ID NO: 1748652 - RNA, 22 nt, Human
cacucagaagacacugaugggc

SEQ ID NO: 1748653 - RNA, 13 nt, Human
cacuaaacaaaga

SEQ ID NO: 1748654 - RNA, 12 nt, Human
cacguuucuaaa

SEQ ID NO: 1748655 - RNA, 14 nt, Human
cacguuucuaaagg

SEQ ID NO: 1748656 - RNA, 23 nt, Human
cacguuucuaaaggcuaccuuug

SEQ ID NO: 1748657 - RNA, 22 nt, Human
cacguucuuacuaguuucccuu

SEQ ID NO: 1748658 - RNA, 19 nt, Human
cacgugguccuaaucuucu

SEQ ID NO: 1748659 - RNA, 16 nt, Human
cacgugguccuaaucu

SEQ ID NO: 1748660 - RNA, 14 nt, Human
cacguacacacaca

SEQ ID NO: 1748661 - RNA, 19 nt, Human
cacguacacacacauacac

SEQ ID NO: 1748662 - RNA, 18 nt, Human
cacguacacacacauaca

SEQ ID NO: 1748663 - RNA, 13 nt, Human
cacgugacagccg

SEQ ID NO: 1748664 - RNA, 15 nt, Human
cacgggggccaagga

SEQ ID NO: 1748665 - RNA, 20 nt, Human
cacggcucacugcagccuca

SEQ ID NO: 1748666 - RNA, 19 nt, Human
cacggcucacugcagccuc

SEQ ID NO: 1748667 - RNA, 17 nt, Human
cacggcucacugcagcc

SEQ ID NO: 1748668 - RNA, 16 nt, Human
cacggcucacugcagc

SEQ ID NO: 1748669 - RNA, 17 nt, Human
cacgcuggaccuugaac

SEQ ID NO: 1748670 - RNA, 14 nt, Human
cacgcuccuuccuc

SEQ ID NO: 1748671 - RNA, 20 nt, Human
cacgcuggaccuugaacugg

SEQ ID NO: 1748672 - RNA, 21 nt, Human
cacgcgugcacacaccagagc

SEQ ID NO: 1748673 - RNA, 16 nt, Human
cacgcgugcacacacc

SEQ ID NO: 1748674 - RNA, 15 nt, Human
cacgcgugcacacac

SEQ ID NO: 1748675 - RNA, 23 nt, Human
cacgcgugcacacaccagagccc

SEQ ID NO: 1748676 - RNA, 20 nt, Human
cacgccuguaauccuagcac

SEQ ID NO: 1748677 - RNA, 19 nt, Human
cacgccuguaauccuagca

SEQ ID NO: 1748678 - RNA, 19 nt, Human
caccuuagacagucccugc

SEQ ID NO: 1748679 - RNA, 18 nt, Human
caccuuagacagucccug

SEQ ID NO: 1748680 - RNA, 16 nt, Human
caccuuagacaguccc

SEQ ID NO: 1748681 - RNA, 14 nt, Human
caccuuagacaguc

SEQ ID NO: 1748682 - RNA, 23 nt, Human
caccuuagacagucccugccaau

SEQ ID NO: 1748683 - RNA, 21 nt, Human
caccuuagacagucccugcca

SEQ ID NO: 1748684 - RNA, 22 nt, Human
caccuuagccugcccuccuuuc

SEQ ID NO: 1748685 - RNA, 22 nt, Human
cacgaauauugcugauggugca

SEQ ID NO: 1748686 - RNA, 19 nt, Human
cacgaauauugcugauggu

SEQ ID NO: 1748687 - RNA, 16 nt, Human
cacgaauauugcugau

SEQ ID NO: 1748688 - RNA, 17 nt, Human
cacgacugcccggcagg

SEQ ID NO: 1748689 - RNA, 16 nt, Human
cacgacugcccggcag

SEQ ID NO: 1748690 - RNA, 13 nt, Human
caccuugacaggg

SEQ ID NO: 1748691 - RNA, 14 nt, Human
caccuucccaugcc

SEQ ID NO: 1748692 - RNA, 13 nt, Human
caccuucccaugc

SEQ ID NO: 1748693 - RNA, 16 nt, Human
caccuugacagggcac

SEQ ID NO: 1748694 - RNA, 15 nt, Human
caccuugacagggca

SEQ ID NO: 1748695 - RNA, 18 nt, Human
caccuugacagggcacac

SEQ ID NO: 1748696 - RNA, 17 nt, Human
cacgcacuucgggaggu

SEQ ID NO: 1748697 - RNA, 12 nt, Human
cacgauuucugu

SEQ ID NO: 1748698 - RNA, 14 nt, Human
cacgauuucuguuu

SEQ ID NO: 1748699 - RNA, 16 nt, Human
cacgauuucuguuuag

SEQ ID NO: 1748700 - RNA, 18 nt, Human
cacgcccccacuggugac

SEQ ID NO: 1748701 - RNA, 17 nt, Human
cacgcccccacugguga

SEQ ID NO: 1748702 - RNA, 15 nt, Human
cacgcccccacuggu

SEQ ID NO: 1748703 - RNA, 13 nt, Human
cacgcccccacug

SEQ ID NO: 1748704 - RNA, 23 nt, Human
cacgccagauucuuuccugaggc

SEQ ID NO: 1748705 - RNA, 22 nt, Human
cacgccagauucuuuccugagg

SEQ ID NO: 1748706 - RNA, 20 nt, Human
cacgccagauucuuuccuga

SEQ ID NO: 1748707 - RNA, 19 nt, Human
cacgccagauucuuuccug

SEQ ID NO: 1748708 - RNA, 15 nt, Human
cacgccacugcacua

SEQ ID NO: 1748709 - RNA, 13 nt, Human
cacgccacugcac

SEQ ID NO: 1748710 - RNA, 14 nt, Human
cacuguugcccagg

SEQ ID NO: 1748711 - RNA, 21 nt, Human
cacuucagcugacuuuucugu

SEQ ID NO: 1748712 - RNA, 12 nt, Human
cacuucagcuga

SEQ ID NO: 1748713 - RNA, 20 nt, Human
cacuucaggcucuucuccuu

SEQ ID NO: 1748714 - RNA, 16 nt, Human
cacuucaggcucuucu

SEQ ID NO: 1748715 - RNA, 15 nt, Human
cacuucaggcucuuc

SEQ ID NO: 1748716 - RNA, 14 nt, Human
cacuucaggcucuu

SEQ ID NO: 1748717 - RNA, 23 nt, Human
cacuucaggcucuucuccuuuca

SEQ ID NO: 1748718 - RNA, 16 nt, Human
cacuucccuacaugga

SEQ ID NO: 1748719 - RNA, 20 nt, Human
cacuuccauaaucuggacuc

SEQ ID NO: 1748720 - RNA, 23 nt, Human
cacuucgggaggucgaggcagga

SEQ ID NO: 1748721 - RNA, 21 nt, Human
cacuucgggaggucgaggcag

SEQ ID NO: 1748722 - RNA, 22 nt, Human
cacuucugccauauucuguugg

SEQ ID NO: 1748723 - RNA, 15 nt, Human
cacuuggucugugag

SEQ ID NO: 1748724 - RNA, 20 nt, Human
cacuuucuagccagaggaga

SEQ ID NO: 1748725 - RNA, 19 nt, Human
cacuuucuagccagaggag

SEQ ID NO: 1748726 - RNA, 22 nt, Human
cacuugcagacucuacagaggc

SEQ ID NO: 1748727 - RNA, 19 nt, Human
cacuugcagacucuacaga

SEQ ID NO: 1748728 - RNA, 18 nt, Human
cacuugcagacucuacag

SEQ ID NO: 1748729 - RNA, 14 nt, Human
cacuugcagacucu

SEQ ID NO: 1748730 - RNA, 24 nt, Human
cacuugcagacucuacagaggcca

SEQ ID NO: 1748731 - RNA, 20 nt, Human
cacuugaacccgggaggcag

SEQ ID NO: 1748732 - RNA, 21 nt, Human
cacuugaacccgggaggcaga

SEQ ID NO: 1748733 - RNA, 23 nt, Human
cacuugaacccgggaggcagagg

SEQ ID NO: 1748734 - RNA, 16 nt, Human
cacuugacaucaacug

SEQ ID NO: 1748735 - RNA, 20 nt, Human
cacuugagaauuacccuuuu

SEQ ID NO: 1748736 - RNA, 17 nt, Human
cacuugagaauuacccu

SEQ ID NO: 1748737 - RNA, 19 nt, Human
cacuugacaucaacugcau

SEQ ID NO: 1748738 - RNA, 13 nt, Human
cacuugaguccag

SEQ ID NO: 1748739 - RNA, 19 nt, Human
cacuugaugacccccaacc

SEQ ID NO: 1748740 - RNA, 13 nt, Human
cacuugcagacuc

SEQ ID NO: 1748741 - RNA, 22 nt, Human
cacugugcugagucugaaggcu

SEQ ID NO: 1748742 - RNA, 21 nt, Human
cacugugcugagucugaaggc

SEQ ID NO: 1748743 - RNA, 20 nt, Human
cacugugcugagucugaagg

SEQ ID NO: 1748744 - RNA, 17 nt, Human
cacugugcugagucuga

SEQ ID NO: 1748745 - RNA, 15 nt, Human
cacugugcugagucu

SEQ ID NO: 1748746 - RNA, 13 nt, Human
cacugugcugagu

SEQ ID NO: 1748747 - RNA, 16 nt, Human
cacugugccaugugcc

SEQ ID NO: 1748748 - RNA, 15 nt, Human
cacugugccaugugc

SEQ ID NO: 1748749 - RNA, 18 nt, Human
cacugugccaugugccag

SEQ ID NO: 1748750 - RNA, 22 nt, Human
cacuguucucugcccuccaaga

SEQ ID NO: 1748751 - RNA, 21 nt, Human
cacuguucucugcccuccaag

SEQ ID NO: 1748752 - RNA, 19 nt, Human
cacuguucucugcccucca

SEQ ID NO: 1748753 - RNA, 17 nt, Human
cacuguucucugcccuc

SEQ ID NO: 1748754 - RNA, 16 nt, Human
cacuguucucugcccu

SEQ ID NO: 1748755 - RNA, 15 nt, Human
cacuguucucugccc

SEQ ID NO: 1748756 - RNA, 14 nt, Human
cacuguucucugcc

SEQ ID NO: 1748757 - RNA, 13 nt, Human
cacuguucucugc

SEQ ID NO: 1748758 - RNA, 14 nt, Human
cacugugccaugug

SEQ ID NO: 1748759 - RNA, 13 nt, Human
cacugugaagaga

SEQ ID NO: 1748760 - RNA, 19 nt, Human
cacuguacuugcucuugau

SEQ ID NO: 1748761 - RNA, 18 nt, Human
cacuguacuugcucuuga

SEQ ID NO: 1748762 - RNA, 15 nt, Human
cacuguacuugcucu

SEQ ID NO: 1748763 - RNA, 23 nt, Human
cacugagacagcccgggcucugc

SEQ ID NO: 1748764 - RNA, 23 nt, Human
cacugagaccccaggcuguuagg

SEQ ID NO: 1748765 - RNA, 24 nt, Human
cacugaugggcaacccccagccug

SEQ ID NO: 1748766 - RNA, 18 nt, Human
cacugaugggcaaccccc

SEQ ID NO: 1748767 - RNA, 14 nt, Human
cacugaugggcaac

SEQ ID NO: 1748768 - RNA, 13 nt, Human
cacugcaaccucc

SEQ ID NO: 1748769 - RNA, 16 nt, Human
cacugcaaccuccgcc

SEQ ID NO: 1748770 - RNA, 14 nt, Human
cacugcaaccuccg

SEQ ID NO: 1748771 - RNA, 23 nt, Human
cacugcaaccuccgccucuuggg

SEQ ID NO: 1748772 - RNA, 22 nt, Human
cacugcacagugcaucucagcc

SEQ ID NO: 1748773 - RNA, 21 nt, Human
cacugcacagugcaucucagc

SEQ ID NO: 1748774 - RNA, 19 nt, Human
cacugcacagugcaucuca

SEQ ID NO: 1748775 - RNA, 18 nt, Human
cacugcacagugcaucuc

SEQ ID NO: 1748776 - RNA, 23 nt, Human
cacugcaaccuucgccaccuggg

SEQ ID NO: 1748777 - RNA, 16 nt, Human
cacugcaacuucugcc

SEQ ID NO: 1748778 - RNA, 22 nt, Human
cacugcaaccuucgccaccugg

SEQ ID NO: 1748779 - RNA, 14 nt, Human
cacugcaaccuucg

SEQ ID NO: 1748780 - RNA, 17 nt, Human
cacugcaacuucugccu

SEQ ID NO: 1748781 - RNA, 20 nt, Human
cacucugucgcccagucugg

SEQ ID NO: 1748782 - RNA, 23 nt, Human
cacugacauuguuggccaaagcc

SEQ ID NO: 1748783 - RNA, 19 nt, Human
cacucugucgcccagucug

SEQ ID NO: 1748784 - RNA, 16 nt, Human
cacucugucgcccagu

SEQ ID NO: 1748785 - RNA, 15 nt, Human
cacucugucgcccag

SEQ ID NO: 1748786 - RNA, 19 nt, Human
cacucuggcagcucagaga

SEQ ID NO: 1748787 - RNA, 17 nt, Human
cacucuggcagcucaga

SEQ ID NO: 1748788 - RNA, 16 nt, Human
cacucuggcagcucag

SEQ ID NO: 1748789 - RNA, 15 nt, Human
cacucuggcagcuca

SEQ ID NO: 1748790 - RNA, 21 nt, Human
cacucuggcagcucagagagg

SEQ ID NO: 1748791 - RNA, 20 nt, Human
cacucuggcagcucagagag

SEQ ID NO: 1748792 - RNA, 23 nt, Human
cacucuggcagcucagagagggu

SEQ ID NO: 1748793 - RNA, 13 nt, Human
cacugagacagcc

SEQ ID NO: 1748794 - RNA, 12 nt, Human
cacugagacagc

SEQ ID NO: 1748795 - RNA, 22 nt, Human
cacugagacagcccgggcucug

SEQ ID NO: 1748796 - RNA, 19 nt, Human
cacugagacagcccgggcu

SEQ ID NO: 1748797 - RNA, 17 nt, Human
cacugagacagcccggg

SEQ ID NO: 1748798 - RNA, 14 nt, Human
cacugagacagccc

SEQ ID NO: 1748799 - RNA, 22 nt, Human
cacugccuucgauacaccgggc

SEQ ID NO: 1748800 - RNA, 20 nt, Human
cacugccuucgauacaccgg

SEQ ID NO: 1748801 - RNA, 12 nt, Human
cacugcucuggu

SEQ ID NO: 1748802 - RNA, 20 nt, Human
cacugcucugaugaagagga

SEQ ID NO: 1748803 - RNA, 17 nt, Human
cacugcugcccagccuc

SEQ ID NO: 1748804 - RNA, 15 nt, Human
cacugcugcccagcc

SEQ ID NO: 1748805 - RNA, 18 nt, Human
cacugcacuauagccuag

SEQ ID NO: 1748806 - RNA, 19 nt, Human
cacugcaccgggccacaga

SEQ ID NO: 1748807 - RNA, 18 nt, Human
cacugcaccgggccacag

SEQ ID NO: 1748808 - RNA, 16 nt, Human
cacugcaccgggccac

SEQ ID NO: 1748809 - RNA, 15 nt, Human
cacugcaccgggcca

SEQ ID NO: 1748810 - RNA, 14 nt, Human
cacugcaccgggcc

SEQ ID NO: 1748811 - RNA, 23 nt, Human
cacugcacagugcaucucagccc

SEQ ID NO: 1748812 - RNA, 16 nt, Human
cacugccucuuccucc

SEQ ID NO: 1748813 - RNA, 16 nt, Human
cacugcuuccagugag

SEQ ID NO: 1748814 - RNA, 15 nt, Human
cacugcuuccaguga

SEQ ID NO: 1748815 - RNA, 14 nt, Human
cacugcuuccagug

SEQ ID NO: 1748816 - RNA, 13 nt, Human
cacugcuuaacuu

SEQ ID NO: 1748817 - RNA, 21 nt, Human
cacugcuggcugccuuagaac

SEQ ID NO: 1748818 - RNA, 16 nt, Human
cacugcuggcugccuu

SEQ ID NO: 1748819 - RNA, 15 nt, Human
cacugcuggcugccu

SEQ ID NO: 1748820 - RNA, 14 nt, Human
cacugcuggcugcc

SEQ ID NO: 1748821 - RNA, 13 nt, Human
cacugcuggcugc

SEQ ID NO: 1748822 - RNA, 12 nt, Human
cacugcuggcug

SEQ ID NO: 1748823 - RNA, 21 nt, Human
cacugcuuccagugaggcucu

SEQ ID NO: 1748824 - RNA, 20 nt, Human
cacugcuuccagugaggcuc

SEQ ID NO: 1748825 - RNA, 19 nt, Human
cacugcuuccagugaggcu

SEQ ID NO: 1748826 - RNA, 18 nt, Human
cacugcuuccagugaggc

SEQ ID NO: 1748827 - RNA, 20 nt, Human
cacugcuuuuggucugugug

SEQ ID NO: 1748828 - RNA, 22 nt, Human
cacugcuuccagugaggcucug

SEQ ID NO: 1748829 - RNA, 17 nt, Human
cacuggaacacuaauga

SEQ ID NO: 1748830 - RNA, 21 nt, Human
cacugcuuuuggucuguguga

SEQ ID NO: 1748831 - RNA, 15 nt, Human
cacuggacucaccuc

SEQ ID NO: 1748832 - RNA, 18 nt, Human
cacuggacucaccucccc

SEQ ID NO: 1748833 - RNA, 14 nt, Human
gaauccgcccaucu

SEQ ID NO: 1748834 - RNA, 15 nt, Human
gacagacagcccucc

SEQ ID NO: 1748835 - RNA, 18 nt, Human
gacagcccgggcucugcc

SEQ ID NO: 1748836 - RNA, 13 nt, Human
gacagucccugcc

SEQ ID NO: 1748837 - RNA, 16 nt, Human
gcaggcuggcccugcc

SEQ ID NO: 1748838 - RNA, 22 nt, Human
gcaagacgcugugcugcccugc

SEQ ID NO: 1748839 - RNA, 15 nt, Human
gccuggccugagcug

SEQ ID NO: 1748840 - RNA, 13 nt, Human
gccagucaccccg

SEQ ID NO: 1748841 - RNA, 15 nt, Human
gccagucccccugcc

SEQ ID NO: 1748842 - RNA, 22 nt, Human
cuggacugugugcucaggagcc

SEQ ID NO: 1748843 - RNA, 23 nt, Human
cuggagcagauggagaccccuug

SEQ ID NO: 1748844 - RNA, 15 nt, Human
cuuggcugcagggag

SEQ ID NO: 1748845 - RNA, 22 nt, Human
gaaagauggcugugccucugcc

SEQ ID NO: 1748846 - RNA, 16 nt, Human
cucaggccugggggcu

SEQ ID NO: 1748847 - RNA, 21 nt, Human
aaggaagacuucaucccucug

SEQ ID NO: 1748848 - RNA, 18 nt, Human
aacuuacuuaguguuaug

SEQ ID NO: 1748849 - RNA, 18 nt, Human
acacgaauauugcugaug

SEQ ID NO: 1748850 - RNA, 15 nt, Human
acacgcgugcacaca

SEQ ID NO: 1748851 - RNA, 14 nt, Human
acacuuguguuaug

SEQ ID NO: 1748852 - RNA, 14 nt, Human
agcaagugagagcu

SEQ ID NO: 1748853 - RNA, 16 nt, Human
gucagguggggcagcu

SEQ ID NO: 1748854 - RNA, 20 nt, Human
gugccuguaaucacagcuac

SEQ ID NO: 1748855 - RNA, 11 nt, Human
gugcugggccc

SEQ ID NO: 1748856 - RNA, 13 nt, Human
guucagccugggu

SEQ ID NO: 1748857 - RNA, 19 nt, Human
guuggcaaaauauuuuaaa

SEQ ID NO: 1748858 - RNA, 19 nt, Human
ucccccagcagccuggggu

SEQ ID NO: 1748859 - RNA, 22 nt, Human
uccaggugcacaagcuccaagc

SEQ ID NO: 1748860 - RNA, 12 nt, Human
aacccguggcgc

SEQ ID NO: 1748861 - RNA, 13 nt, Human
aacuauguugaua

SEQ ID NO: 1748862 - RNA, 13 nt, Human
agaggacccccug

SEQ ID NO: 1748863 - RNA, 12 nt, Human
aguagagacagg

SEQ ID NO: 1748864 - RNA, 22 nt, Human
auuacaggugugaaccaccaca

SEQ ID NO: 1748865 - RNA, 15 nt, Human
auucuccaccugcca

SEQ ID NO: 1748866 - RNA, 11 nt, Human
accucgagcca

SEQ ID NO: 1748867 - RNA, 21 nt, Human
cuuuuuuuuuuuugagacaga

SEQ ID NO: 1748868 - RNA, 13 nt, Human
gaaaaaaaauuag

SEQ ID NO: 1748869 - RNA, 15 nt, Human
cucuugagccuggga

SEQ ID NO: 1748870 - RNA, 15 nt, Human
gaaaaugaaaauuag

SEQ ID NO: 1748871 - RNA, 21 nt, Human
cuccucuucaacugaccagcc

SEQ ID NO: 1748872 - RNA, 16 nt, Human
cucccaacucacccca

SEQ ID NO: 1748873 - RNA, 14 nt, Human
ccucaggccugggg

SEQ ID NO: 1748874 - RNA, 22 nt, Human
cccgaccaccugcccaaccugc

SEQ ID NO: 1748875 - RNA, 15 nt, Human
cccucacccuggggc

SEQ ID NO: 1748876 - RNA, 23 nt, Human
ccccagcuggggccaggcugggu

SEQ ID NO: 1748877 - RNA, 22 nt, Human
ccaggccagagggagugacaga

SEQ ID NO: 1748878 - RNA, 13 nt, Human
ccagugagacagc

SEQ ID NO: 1748879 - RNA, 24 nt, Human
cagcgcuggccgggaccccgagcc

SEQ ID NO: 1748880 - RNA, 19 nt, Human
caucuuccaacucaaacuc

SEQ ID NO: 1748881 - RNA, 18 nt, Human
caugggacagggaggacg

SEQ ID NO: 1748882 - RNA, 11 nt, Human
caugugcacau

SEQ ID NO: 1748883 - RNA, 21 nt, Human
ccacugcacuccagccugggu

SEQ ID NO: 1748884 - RNA, 13 nt, Human
cuggccgggaccc

SEQ ID NO: 1748885 - RNA, 19 nt, Human
ccugcugguucaggguugg

SEQ ID NO: 1748886 - RNA, 21 nt, Human
ccuggcuccaaacccucgagg

SEQ ID NO: 1748887 - RNA, 24 nt, Human
cgagcccugguggcagugggagcu

SEQ ID NO: 1748888 - RNA, 20 nt, Human
cgcuacccgggaagggggcu

SEQ ID NO: 1748889 - RNA, 17 nt, Human
cgugaguccuggcaugg

SEQ ID NO: 1748890 - RNA, 15 nt, Human
cuaucguaaaauuaa

SEQ ID NO: 1748891 - RNA, 18 nt, Human
cucccacagcgcuggccg

SEQ ID NO: 1748892 - RNA, 13 nt, Human
cacuggugacaug

SEQ ID NO: 1748893 - RNA, 20 nt, Human
cacuguacuugcucuugaug

SEQ ID NO: 1748894 - RNA, 10 nt, Human
cagagacaga

SEQ ID NO: 1748895 - RNA, 13 nt, Human
cagcacgggggcc

SEQ ID NO: 1748896 - RNA, 16 nt, Human
auuuuuuugagacaga

SEQ ID NO: 1748897 - RNA, 15 nt, Human
caaacucuuaaaacc

SEQ ID NO: 1748898 - RNA, 14 nt, Human
caagcaggacaugg

SEQ ID NO: 1748899 - RNA, 21 nt, Human
caaacccauuuuagagacaga

SEQ ID NO: 1748900 - RNA, 18 nt, Human
cacuggaggcaugugaug

SEQ ID NO: 1748901 - RNA, 17 nt, Human
cagcuuuaaaaaauuaa

SEQ ID NO: 1748902 - RNA, 21 nt, Human
cagggaggacgcucucuggcc

SEQ ID NO: 1748903 - RNA, 19 nt, Human
caucucacacaugagcauc

SEQ ID NO: 1748904 - RNA, 16 nt, Human
ccagcaggcucucagg

SEQ ID NO: 1748905 - RNA, 20 nt, Human
ccacgcuggagugcagugag

SEQ ID NO: 1748906 - RNA, 17 nt, Human
ccagcuggccgggagcc

SEQ ID NO: 1748907 - RNA, 15 nt, Human
cagcuugaggguugg

SEQ ID NO: 1748908 - RNA, 15 nt, Human
cacugaggaccagcc

SEQ ID NO: 1748909 - RNA, 18 nt, Human
cacuuggucugugagaug

SEQ ID NO: 1748910 - RNA, 16 nt, Human
ccaggcugggucgccc

SEQ ID NO: 1748911 - RNA, 20 nt, Human
cauuuaggccaugggacagg

SEQ ID NO: 1748912 - RNA, 22 nt, Human
cauuugauaaaguaaggcaugg

SEQ ID NO: 1748913 - RNA, 15 nt, Human
cacagcgcuggccgg

SEQ ID NO: 1748914 - RNA, 22 nt, Human
cccugggaggcucuggagccca

SEQ ID NO: 1748915 - RNA, 19 nt, Human
ccgcuuucuacccagcgag

SEQ ID NO: 1748916 - RNA, 14 nt, Human
ccgggaccccgagc

SEQ ID NO: 1748917 - RNA, 14 nt, Human
ccccaggaggccag

SEQ ID NO: 1748918 - RNA, 15 nt, Human
cccauaugccugggc

SEQ ID NO: 1748919 - RNA, 23 nt, Human
cacugcuuuuggucugugugaug

SEQ ID NO: 1748920 - RNA, 16 nt, Human
cagcauucucacuccu

SEQ ID NO: 1748921 - RNA, 16 nt, Human
agcgcuggccgggacc

SEQ ID NO: 1748922 - RNA, 13 nt, Human
agaugcagccggu

SEQ ID NO: 1748923 - RNA, 22 nt, Human
agaugcugacuguacuccuccc

SEQ ID NO: 1748924 - RNA, 20 nt, Human
agauggaaaaaccaccccca

SEQ ID NO: 1748925 - RNA, 11 nt, Human
uggccuggggc

SEQ ID NO: 1748926 - RNA, 18 nt, Human
uggcuccucccggugccc

SEQ ID NO: 1748927 - RNA, 15 nt, Human
ugccuggccacgccc

SEQ ID NO: 1748928 - RNA, 15 nt, Human
uuaaaugcccagccc

SEQ ID NO: 1748929 - RNA, 13 nt, Human
ugagucccaggcu

SEQ ID NO: 1748930 - RNA, 16 nt, Human
ugcacaagcugcaccc

SEQ ID NO: 1748931 - RNA, 17 nt, Human
ucuuggaauccugggga

SEQ ID NO: 1748932 - RNA, 20 nt, Human
acacuaacgauuuguuaaug

SEQ ID NO: 1748933 - RNA, 21 nt, Human
aaugauccccagcuguuuaug

SEQ ID NO: 1748934 - RNA, 14 nt, Human
aauaguuguugauu

SEQ ID NO: 1748935 - RNA, 21 nt, Human
accaaaagcuuaccaagggga

SEQ ID NO: 1748936 - RNA, 19 nt, Human
accagccccagugcccaca

SEQ ID NO: 1748937 - RNA, 17 nt, Human
ggucacucuggcagcuc

SEQ ID NO: 1748938 - RNA, 21 nt, Human
gccaccaacauacucccaucu

SEQ ID NO: 1748939 - RNA, 19 nt, Human
gcagcuugaggguugggcu

SEQ ID NO: 1748940 - RNA, 16 nt, Human
gcugcccugcccaccu

SEQ ID NO: 1748941 - RNA, 21 nt, Human
gccucugccugucucccccac

SEQ ID NO: 1748942 - RNA, 17 nt, Human
gcccccucugcccugcg

SEQ ID NO: 1748943 - RNA, 19 nt, Human
guuugauucagacagcugc

SEQ ID NO: 1748944 - RNA, 16 nt, Human
guuaacauggacauga

SEQ ID NO: 1748945 - RNA, 14 nt, Human
uaguuucuccaagc

SEQ ID NO: 1748946 - RNA, 17 nt, Human
ucaccauguuggccagg

SEQ ID NO: 1748947 - RNA, 23 nt, Human
ucaacucccugccccccagcccu

SEQ ID NO: 1748948 - RNA, 11 nt, Human
ucacaaaggau

SEQ ID NO: 1748949 - RNA, 18 nt, Human
ggucccugguggcagcuc

SEQ ID NO: 1748950 - RNA, 15 nt, Human
gggccuggcucaggu

SEQ ID NO: 1748951 - RNA, 21 nt, Human
uccacaagagcccaggccucc

SEQ ID NO: 1748952 - RNA, 13 nt, Human
ggcacaccgggca

SEQ ID NO: 1748953 - RNA, 21 nt, Human
gucucacucugucgcccaguc

SEQ ID NO: 1748954 - RNA, 17 nt, Human
uggcaaggacugcaggg

SEQ ID NO: 1748955 - RNA, 17 nt, Human
uggcccgacagccuggc

SEQ ID NO: 1748956 - RNA, 23 nt, Human
ugggccccugccucucugcaggu

SEQ ID NO: 1748957 - RNA, 23 nt, Human
ugccagccgagauagccaaggcc

SEQ ID NO: 1748958 - RNA, 11 nt, Human
ugccaggggag

SEQ ID NO: 1748959 - RNA, 16 nt, Human
guuggucccccuucca

SEQ ID NO: 1748960 - RNA, 19 nt, Human
guuugagaucagccugggc

SEQ ID NO: 1748961 - RNA, 12 nt, Human
uacaggcaccca

SEQ ID NO: 1748962 - RNA, 23 nt, Human
uacaggcuccugccaccacgccc

SEQ ID NO: 1748963 - RNA, 23 nt, Human
uagacgagcaggcuucuuccccc

SEQ ID NO: 1748964 - RNA, 14 nt, Human
guggacacagcucu

SEQ ID NO: 1748965 - RNA, 13 nt, Human
gugagacagcucu

SEQ ID NO: 1748966 - RNA, 16 nt, Human
gugcuaggaacacucc

SEQ ID NO: 1748967 - RNA, 15 nt, Human
gugcugcccugccca

SEQ ID NO: 1748968 - RNA, 14 nt, Human
cgugguggacaugc

SEQ ID NO: 1748969 - RNA, 19 nt, Human
ugcacaaacagaggccgcc

SEQ ID NO: 1748970 - RNA, 23 nt, Human
cggccuccauccugaggcuccac

SEQ ID NO: 1748971 - RNA, 22 nt, Human
cgggaagggggcugggacaugg

SEQ ID NO: 1748972 - RNA, 18 nt, Human
cgggaccccgagccuggc

SEQ ID NO: 1748973 - RNA, 16 nt, Human
ucugccugcccaggcc

SEQ ID NO: 1748974 - RNA, 14 nt, Human
ucuggggcuguuca

SEQ ID NO: 1748975 - RNA, 22 nt, Human
uccaaggcauuuuagcggggag

SEQ ID NO: 1748976 - RNA, 18 nt, Human
ucaggguuggccccugcc

SEQ ID NO: 1748977 - RNA, 20 nt, Human
uccuccaggugcacaagcuc

SEQ ID NO: 1748978 - RNA, 13 nt, Human
gaacccaaaccca

SEQ ID NO: 1748979 - RNA, 23 nt, Human
gaagacuucaucccucuggggcu

SEQ ID NO: 1748980 - RNA, 17 nt, Human
cuccaagcucccaggca

SEQ ID NO: 1748981 - RNA, 16 nt, Human
cugcccaccuggccuc

SEQ ID NO: 1748982 - RNA, 20 nt, Human
cuguuuuucuaggccugggg

SEQ ID NO: 1748983 - RNA, 14 nt, Human
gagccuggcuccaa

SEQ ID NO: 1748984 - RNA, 17 nt, Human
gagcccugggaggcucu

SEQ ID NO: 1748985 - RNA, 21 nt, Human
gagguaaggaauaccuguccc

SEQ ID NO: 1748986 - RNA, 17 nt, Human
gccagucaccccggcca

SEQ ID NO: 1748987 - RNA, 19 nt, Human
gcacuuugggaggccaagg

SEQ ID NO: 1748988 - RNA, 21 nt, Human
gcaccagggaaggggacaagg

SEQ ID NO: 1748989 - RNA, 20 nt, Human
gcaccccagcuggggccagg

SEQ ID NO: 1748990 - RNA, 20 nt, Human
gccuggcuccaaacccucga

SEQ ID NO: 1748991 - RNA, 21 nt, Human
uuugauguucuuucacccuuu

SEQ ID NO: 1748992 - RNA, 23 nt, Human
uuugauguucuuucacccuuuuc

SEQ ID NO: 1748993 - RNA, 22 nt, Human
ugccauuucuuccacaagagcc

SEQ ID NO: 1748994 - RNA, 21 nt, Human
uggccacuccagaccccuggc

SEQ ID NO: 1748995 - RNA, 19 nt, Human
uggccgggaccccgagccu

SEQ ID NO: 1748996 - RNA, 14 nt, Human
cccuuugacgccau

SEQ ID NO: 1748997 - RNA, 16 nt, Human
ccccagcagccugggg

SEQ ID NO: 1748998 - RNA, 18 nt, Human
ccggagaggccucgaccc

SEQ ID NO: 1748999 - RNA, 15 nt, Human
ccgggaccccgagcc

SEQ ID NO: 1749000 - RNA, 18 nt, Human
ggguuggccccugcccgg

SEQ ID NO: 1749001 - RNA, 13 nt, Human
ggucccugcaggg

SEQ ID NO: 1749002 - RNA, 22 nt, Human
uucggcgccuuaaggauguucu

SEQ ID NO: 1749003 - RNA, 16 nt, Human
gucacugagacagccc

SEQ ID NO: 1749004 - RNA, 22 nt, Human
ggauggaccacacagaggcugc

SEQ ID NO: 1749005 - RNA, 14 nt, Human
ggcccacugcaucg

SEQ ID NO: 1749006 - RNA, 13 nt, Human
ggccuucggccuc

SEQ ID NO: 1749007 - RNA, 22 nt, Human
gggccaggcugggucgcccugg

SEQ ID NO: 1749008 - RNA, 21 nt, Human
gggcuucaguggcagcugcuu

SEQ ID NO: 1749009 - RNA, 18 nt, Human
ggggagaaaguacuucuu

SEQ ID NO: 1749010 - RNA, 21 nt, Human
cgagcaugccuggauggggcu

SEQ ID NO: 1749011 - RNA, 11 nt, Human
cgcgugcacac

SEQ ID NO: 1749012 - RNA, 23 nt, Human
ccuacucugugucagguggggca

SEQ ID NO: 1749013 - RNA, 16 nt, Human
uuugcugucccuuuuc

SEQ ID NO: 1749014 - RNA, 14 nt, Human
cccacacacgccag

SEQ ID NO: 1749015 - RNA, 20 nt, Human
ccccagauagcuggcugggu

SEQ ID NO: 1749016 - RNA, 14 nt, Human
ccccgagccuggcu

SEQ ID NO: 1749017 - RNA, 13 nt, Human
cccggccaccugc

SEQ ID NO: 1749018 - RNA, 13 nt, Human
cccugcaaccuga

SEQ ID NO: 1749019 - RNA, 20 nt, Human
acuuggucugugagaugcua

SEQ ID NO: 1749020 - RNA, 16 nt, Human
aggcugggucgcccug

SEQ ID NO: 1749021 - RNA, 13 nt, Human
aggagugagcacu

SEQ ID NO: 1749022 - RNA, 18 nt, Human
aggcaugugccacccacc

SEQ ID NO: 1749023 - RNA, 22 nt, Human
aggcugggcuucaguggcagcu

SEQ ID NO: 1749024 - RNA, 21 nt, Human
agaaguuucugccgcagcccu

SEQ ID NO: 1749025 - RNA, 13 nt, Human
agcggggacagcu

SEQ ID NO: 1749026 - RNA, 13 nt, Human
ggccaggcccucu

SEQ ID NO: 1749027 - RNA, 14 nt, Human
ggguggaugccugg

SEQ ID NO: 1749028 - RNA, 17 nt, Human
gcgucacaacaaccugg

SEQ ID NO: 1749029 - RNA, 22 nt, Human
gcgugagccacugcaccgggcc

SEQ ID NO: 1749030 - RNA, 12 nt, Human
gcuccaaacccu

SEQ ID NO: 1749031 - RNA, 21 nt, Human
gcugcugaaggcucgagcaug

SEQ ID NO: 1749032 - RNA, 19 nt, Human
gcucagcggggacagcucc

SEQ ID NO: 1749033 - RNA, 18 nt, Human
gaugaaccacauuauaaa

SEQ ID NO: 1749034 - RNA, 14 nt, Human
gcugggucgcccug

SEQ ID NO: 1749035 - RNA, 19 nt, Human
gcugggucgcccuggacug

SEQ ID NO: 1749036 - RNA, 19 nt, Human
ggcuccagacacaugucca

SEQ ID NO: 1749037 - RNA, 21 nt, Human
gggcagaggaaagcaaaggag

SEQ ID NO: 1749038 - RNA, 14 nt, Human
ggggacagcuccuu

SEQ ID NO: 1749039 - RNA, 16 nt, Human
gcgcccagccucaucu

SEQ ID NO: 1749040 - RNA, 9 nt, Human
ggagacaga

SEQ ID NO: 1749041 - RNA, 21 nt, Human
ucagcauccuggcacccggcc

SEQ ID NO: 1749042 - RNA, 14 nt, Human
uaggguccugggga

SEQ ID NO: 1749043 - RNA, 23 nt, Human
uauaggcaccuaccaccacgccc

SEQ ID NO: 1749044 - RNA, 17 nt, Human
uccuuuagcgcccaguu

SEQ ID NO: 1749045 - RNA, 17 nt, Human
ucucuccuucuuccccc

SEQ ID NO: 1749046 - RNA, 19 nt, Human
ugagccugggaggucaagg

SEQ ID NO: 1749047 - RNA, 21 nt, Human
ugccuucgauacaccgggccu

SEQ ID NO: 1749048 - RNA, 15 nt, Human
ugguccugcugcagu

SEQ ID NO: 1749049 - RNA, 16 nt, Human
uacagagcccacgccc

SEQ ID NO: 1749050 - RNA, 14 nt, Human
guuuccuggcacug

SEQ ID NO: 1749051 - RNA, 15 nt, Human
guggacacagcucuu

SEQ ID NO: 1749052 - RNA, 21 nt, Human
guauccugcuucugauaugca

SEQ ID NO: 1749053 - RNA, 16 nt, Human
gucaccaagcccaguu

SEQ ID NO: 1749054 - RNA, 22 nt, Human
guccaggcacugcugcccagcc

SEQ ID NO: 1749055 - RNA, 21 nt, Human
gucccaacuuguaaaaauuaa

SEQ ID NO: 1749056 - RNA, 17 nt, Human
ugugagccaccacgccc

SEQ ID NO: 1749057 - RNA, 18 nt, Human
gcacaugccucucucagg

SEQ ID NO: 1749058 - RNA, 18 nt, Human
cugggaggcucuggagcc

SEQ ID NO: 1749059 - RNA, 19 nt, Human
gccucugacacacagcucu

SEQ ID NO: 1749060 - RNA, 22 nt, Human
gagauagccaaggccaaaggaa

SEQ ID NO: 1749061 - RNA, 14 nt, Human
gauggggcccugcc

SEQ ID NO: 1749062 - RNA, 16 nt, Human
gauacuugaaaauuaa

SEQ ID NO: 1749063 - RNA, 13 nt, Human
gacagcccgggcu

SEQ ID NO: 1749064 - RNA, 15 nt, Human
gagacuccugcaggc

SEQ ID NO: 1749065 - RNA, 19 nt, Human
gaauaucaauagauauuua

SEQ ID NO: 1749066 - RNA, 22 nt, Human
gaccaucccugaaggccccgcc

SEQ ID NO: 1749067 - RNA, 13 nt, Human herpesvirus 1
caguguacccugg

SEQ ID NO: 1749068 - RNA, 14 nt, Human herpesvirus 1
caaacgccagccug

SEQ ID NO: 1749069 - RNA, 16 nt, Human herpesvirus 1
caaagugccccgaccc

SEQ ID NO: 1749070 - RNA, 14 nt, Human herpesvirus 1
gcagucccugaguu

SEQ ID NO: 1749071 - RNA, 22 nt, Human herpesvirus 1
cuagccaaccuguggcagaccg

SEQ ID NO: 1749072 - RNA, 13 nt, Human herpesvirus 1
gagccccccgcug

SEQ ID NO: 1749073 - RNA, 15 nt, Human herpesvirus 1
gccucucgcugcugg

SEQ ID NO: 1749074 - RNA, 15 nt, Human herpesvirus 1
ucccucccccuccgc

SEQ ID NO: 1749075 - RNA, 22 nt, Human herpesvirus 1
cggcaccuauggcgccugacgc

SEQ ID NO: 1749076 - RNA, 22 nt, Human herpesvirus 1
auguguguaaaauaaauuauug

SEQ ID NO: 1749077 - RNA, 16 nt, Human herpesvirus 1
aacucucgcaccaucc

SEQ ID NO: 1749078 - RNA, 20 nt, Human herpesvirus 1
uggcacaccaccgaccucaa

SEQ ID NO: 1749079 - RNA, 23 nt, Human herpesvirus 1
cggacgcgcggcgcgagcucccu

SEQ ID NO: 1749080 - RNA, 18 nt, Human herpesvirus 1
uccacgaacccagcgacc

SEQ ID NO: 1749081 - RNA, 15 nt, Human herpesvirus 1
cgacguccugggcca

SEQ ID NO: 1749082 - RNA, 18 nt, Human herpesvirus 1
ccgaucccaacuccucag

SEQ ID NO: 1749083 - RNA, 14 nt, Human herpesvirus 1
uacacgagcacccu

SEQ ID NO: 1749084 - RNA, 16 nt, Human herpesvirus 1
uaugccccccuggcga

SEQ ID NO: 1749085 - RNA, 23 nt, Human herpesvirus 1
cgguuccucccgcucggcggcag

SEQ ID NO: 1749086 - RNA, 13 nt, Human herpesvirus 1
gggaccuccugga

SEQ ID NO: 1749087 - RNA, 22 nt, Human herpesvirus 1
gucacggugaccgcgugcccac

SEQ ID NO: 1749088 - RNA, 17 nt, Human herpesvirus 1
cagacccaacccccggc

SEQ ID NO: 1749089 - RNA, 15 nt, Human herpesvirus 1
caccugcgcucccuc

SEQ ID NO: 1749090 - RNA, 20 nt, Human herpesvirus 1
acuucccgguaugguaauua

SEQ ID NO: 1749091 - RNA, 15 nt, Human herpesvirus 1
auguuuaugggauuu

SEQ ID NO: 1749092 - RNA, 15 nt, Human herpesvirus 1
gaaccccaacgccau

SEQ ID NO: 1749093 - RNA, 19 nt, Human herpesvirus 1
cacggcuaccuggccccag

SEQ ID NO: 1749094 - RNA, 17 nt, Human herpesvirus 1
gccgugcuccugugagc

SEQ ID NO: 1749095 - RNA, 22 nt, Human herpesvirus 1
accccgcaauuugcacccagcc

SEQ ID NO: 1749096 - RNA, 13 nt, Human herpesvirus 1
ucacagccccgca

SEQ ID NO: 1749097 - RNA, 18 nt, Human herpesvirus 1
cauaccuggguguguuua

SEQ ID NO: 1749098 - RNA, 21 nt, Human herpesvirus 1
cagccugccucuccccccagg

SEQ ID NO: 1749099 - RNA, 20 nt, Human herpesvirus 1
ucgcggagggcggccagccg

SEQ ID NO: 1749100 - RNA, 17 nt, Human herpesvirus 1
uccgcaagccccuagcc

SEQ ID NO: 1749101 - RNA, 16 nt, Human herpesvirus 1
uccgcccgugcugccg

SEQ ID NO: 1749102 - RNA, 19 nt, Human herpesvirus 1
cgccgcuaccgacgcuccc

SEQ ID NO: 1749103 - RNA, 13 nt, Human herpesvirus 1
cuggggagcugua

SEQ ID NO: 1749104 - RNA, 16 nt, Human herpesvirus 1
ucccccacaccaccua

SEQ ID NO: 1749105 - RNA, 21 nt, Human herpesvirus 1
cuggccggccuggcggcggcc

SEQ ID NO: 1749106 - RNA, 23 nt, Human herpesvirus 1
cgugggcgacugcgaccccagcc

SEQ ID NO: 1749107 - RNA, 21 nt, Human herpesvirus 1
cgacaaccccggucucccagg

SEQ ID NO: 1749108 - RNA, 23 nt, Human herpesvirus 1
ccgcagucccugaguugggaaua

SEQ ID NO: 1749109 - RNA, 22 nt, Human herpesvirus 1
ccaaagcugcuggcgcgcaccc

SEQ ID NO: 1749110 - RNA, 17 nt, Human herpesvirus 1
cucuacugcagaugcag

SEQ ID NO: 1749111 - RNA, 20 nt, Human herpesvirus 1
uguacugcggucugucucgu

SEQ ID NO: 1749112 - RNA, 19 nt, Human herpesvirus 1
gaggcaguuaacugucugg

SEQ ID NO: 1749113 - RNA, 16 nt, Human herpesvirus 1
ggcgcgcuucuacccg

SEQ ID NO: 1749114 - RNA, 15 nt, Human herpesvirus 1
aucaccccgcaauuu

SEQ ID NO: 1749115 - RNA, 14 nt, Human herpesvirus 1
uucaucgaccucaa

SEQ ID NO: 1749116 - RNA, 13 nt, Human herpesvirus 1
gcugcgugucaaa

SEQ ID NO: 1749117 - RNA, 16 nt, Human herpesvirus 1
gcguggaucggcgcca

SEQ ID NO: 1749118 - RNA, 17 nt, Human herpesvirus 1
uggugcgauggcgacac

SEQ ID NO: 1749119 - RNA, 15 nt, Human herpesvirus 1
gacucucccaccgcc

SEQ ID NO: 1749120 - RNA, 21 nt, Human herpesvirus 1
cugcugcccccggagcugucc

SEQ ID NO: 1749121 - RNA, 16 nt, Human herpesvirus 1
ggaacuacuaugacag

SEQ ID NO: 1749122 - RNA, 16 nt, Human herpesvirus 1
cccccggccaccccga

SEQ ID NO: 1749123 - RNA, 21 nt, Human herpesvirus 1
ucccccuccgcaucccaggau

SEQ ID NO: 1749124 - RNA, 21 nt, Human herpesvirus 1
ucacgcgggaggccgcccagc

SEQ ID NO: 1749125 - RNA, 16 nt, Human herpesvirus 1
gcugcccuucugucug

SEQ ID NO: 1749126 - RNA, 17 nt, Human herpesvirus 1
cccuacucucccuccag

SEQ ID NO: 1749127 - RNA, 16 nt, Human herpesvirus 1
ccgccguugagccccu

SEQ ID NO: 1749128 - RNA, 14 nt, Human herpesvirus 1
ugucugugggccaa

SEQ ID NO: 1749129 - RNA, 12 nt, Human herpesvirus 1
ggaacccagagu

SEQ ID NO: 1749130 - RNA, 17 nt, Human herpesvirus 1
ccacaacaacgaccagg

SEQ ID NO: 1749131 - RNA, 19 nt, Human herpesvirus 1
uggugcgucgggccucccg

SEQ ID NO: 1749132 - RNA, 13 nt, Human herpesvirus 1
ugcggucugucuc

SEQ ID NO: 1749133 - RNA, 16 nt, Human herpesvirus 1
uccgggagggcgucgc

SEQ ID NO: 1749134 - RNA, 16 nt, Human herpesvirus 1
cacccucacgcgcauc

SEQ ID NO: 1749135 - RNA, 19 nt, Human herpesvirus 1
ucccacgcucuccccugcu

SEQ ID NO: 1749136 - RNA, 23 nt, Human herpesvirus 1
cuuuccgagggcgagcucagcuu

SEQ ID NO: 1749137 - RNA, 21 nt, Human herpesvirus 1
ucccgccaacacccccuuccc

SEQ ID NO: 1749138 - RNA, 12 nt, Human herpesvirus 1
ccgcagccuggu

SEQ ID NO: 1749139 - RNA, 22 nt, Human herpesvirus 1
cgagccgugcaccgugggacac

SEQ ID NO: 1749140 - RNA, 19 nt, Human herpesvirus 1
ggauggggagagcccacau

SEQ ID NO: 1749141 - RNA, 21 nt, Human herpesvirus 1
gccgcgccccgccggcgacaa

SEQ ID NO: 1749142 - RNA, 16 nt, Human herpesvirus 1
gccgcccccuggucag

SEQ ID NO: 1749143 - RNA, 16 nt, Human herpesvirus 1
acggccacuggccggg

SEQ ID NO: 1749144 - RNA, 10 nt, Human herpesvirus 1
uccaucgccc

SEQ ID NO: 1749145 - RNA, 19 nt, Human herpesvirus 1
cggcggucgcgcuccucug

SEQ ID NO: 1749146 - RNA, 17 nt, Human herpesvirus 1
cuuuaagcgcugcugcg

SEQ ID NO: 1749147 - RNA, 14 nt, Human herpesvirus 1
gaccgcagucccug

SEQ ID NO: 1749148 - RNA, 14 nt, Human herpesvirus 1
ccgaccgcaguccc

SEQ ID NO: 1749149 - RNA, 22 nt, Human herpesvirus 1
uuucguccaccaaagucucugu

SEQ ID NO: 1749150 - RNA, 14 nt, Human herpesvirus 1
guggaucuuagccu

SEQ ID NO: 1749151 - RNA, 13 nt, Human herpesvirus 1
auggggagagccc

SEQ ID NO: 1749152 - RNA, 16 nt, Human herpesvirus 1
uacgugugcccacccc

SEQ ID NO: 1749153 - RNA, 23 nt, Human herpesvirus 1
uggggacccggcccuaaccccac

SEQ ID NO: 1749154 - RNA, 17 nt, Human herpesvirus 1
cgagccaacgcccugac

SEQ ID NO: 1749155 - RNA, 21 nt, Human herpesvirus 1
gccccgcuucauccccgagaa

SEQ ID NO: 1749156 - RNA, 15 nt, Human herpesvirus 1
cgcgauguggauaaa

SEQ ID NO: 1749157 - RNA, 13 nt, Human herpesvirus 1
gccgcggcucccg

SEQ ID NO: 1749158 - RNA, 16 nt, Human herpesvirus 1
cucuggacgcccgggc

SEQ ID NO: 1749159 - RNA, 18 nt, Human herpesvirus 1
ucagcuuuuaccgcuucc

SEQ ID NO: 1749160 - RNA, 10 nt, Human herpesvirus 1
caugcgggcu

SEQ ID NO: 1749161 - RNA, 17 nt, Human herpesvirus 1
aucgccgguuccucccg

SEQ ID NO: 1749162 - RNA, 23 nt, Human herpesvirus 1
ccaucgagccaacgcccugacca

SEQ ID NO: 1749163 - RNA, 12 nt, Human herpesvirus 1
cggccccagccc

SEQ ID NO: 1749164 - RNA, 20 nt, Human herpesvirus 1
augcagcgccggccuccccg

SEQ ID NO: 1749165 - RNA, 18 nt, Human herpesvirus 1
ccccgcaauuugcaccca

SEQ ID NO: 1749166 - RNA, 13 nt, Human herpesvirus 1
ccgccggcgaggu

SEQ ID NO: 1749167 - RNA, 18 nt, Human herpesvirus 1
gcgaagacccccccggag

SEQ ID NO: 1749168 - RNA, 15 nt, Human herpesvirus 1
cacaccggucaacga

SEQ ID NO: 1749169 - RNA, 23 nt, Human herpesvirus 1
gacgcguggcggccccugaugga

SEQ ID NO: 1749170 - RNA, 20 nt, Human herpesvirus 1
cuguucaaccccagggaccu

SEQ ID NO: 1749171 - RNA, 19 nt, Human herpesvirus 1
ugccucuccccccaggccu

SEQ ID NO: 1749172 - RNA, 22 nt, Human herpesvirus 1
ccagacgcgggcgacgcacaca

SEQ ID NO: 1749173 - RNA, 13 nt, Human herpesvirus 1
ccagagaccccag

SEQ ID NO: 1749174 - RNA, 13 nt, Human herpesvirus 1
guccagaccacgg

SEQ ID NO: 1749175 - RNA, 13 nt, Human herpesvirus 1
cgaggcggccacg

SEQ ID NO: 1749176 - RNA, 13 nt, Human herpesvirus 1
ccgcaaaucccac

SEQ ID NO: 1749177 - RNA, 21 nt, Human herpesvirus 1
cgcccaccggaagcccaaccc

SEQ ID NO: 1749178 - RNA, 18 nt, Human herpesvirus 1
cggccacuggccgggagc

SEQ ID NO: 1749179 - RNA, 15 nt, Human herpesvirus 1
gauggggagagccca

SEQ ID NO: 1749180 - RNA, 16 nt, Human herpesvirus 1
cacuacaccagccaau

SEQ ID NO: 1749181 - RNA, 20 nt, Human herpesvirus 1
acgagcacccugcugccccc

SEQ ID NO: 1749182 - RNA, 22 nt, Human herpesvirus 1
gcccauuuacguggcuggguuu

SEQ ID NO: 1749183 - RNA, 20 nt, Human herpesvirus 1
ggccugccugcggcucgucg

SEQ ID NO: 1749184 - RNA, 12 nt, Human herpesvirus 1
accccccuggcc

SEQ ID NO: 1749185 - RNA, 15 nt, Human herpesvirus 1
cccacgcccccgccg

SEQ ID NO: 1749186 - RNA, 13 nt, Human herpesvirus 1
cguggagcaggaa

SEQ ID NO: 1749187 - RNA, 17 nt, Human herpesvirus 1
ggugaacgccuccgccc

SEQ ID NO: 1749188 - RNA, 18 nt, Human herpesvirus 1
ccccuguggcccuggcgg

SEQ ID NO: 1749189 - RNA, 17 nt, Human herpesvirus 1
aaccucgggugcauauc

SEQ ID NO: 1749190 - RNA, 13 nt, Human herpesvirus 1
gggccgggccgcc

SEQ ID NO: 1749191 - RNA, 23 nt, Human herpesvirus 1
ggaaaccguaacggcauaugcaa

SEQ ID NO: 1749192 - RNA, 19 nt, Human herpesvirus 1
ccuggccgugguccucgag

SEQ ID NO: 1749193 - RNA, 20 nt, Human herpesvirus 1
ucgggccugccugcggcucg

SEQ ID NO: 1749194 - RNA, 23 nt, Human herpesvirus 1
gacccccccucgcgccacacuca

SEQ ID NO: 1749195 - RNA, 22 nt, Human herpesvirus 1
ggaacuacuaugacagcuucag

SEQ ID NO: 1749196 - RNA, 22 nt, Human herpesvirus 1
acgacccucgagauccccgggg

SEQ ID NO: 1749197 - RNA, 20 nt, Human herpesvirus 1
ucaaccacccggccauccgc

SEQ ID NO: 1749198 - RNA, 19 nt, Human herpesvirus 1
ggaccccggggcucagcca

SEQ ID NO: 1749199 - RNA, 23 nt, Human herpesvirus 1
cgaggugcgguuggggaggcugu

SEQ ID NO: 1749200 - RNA, 14 nt, Human herpesvirus 1
ccugugcuuucugg

SEQ ID NO: 1749201 - RNA, 20 nt, Human herpesvirus 1
agcucgcggagggcggccag

SEQ ID NO: 1749202 - RNA, 22 nt, Human herpesvirus 1
cccaguccccgggcccagccuu

SEQ ID NO: 1749203 - RNA, 18 nt, Human herpesvirus 1
gcagucccugaguuggga

SEQ ID NO: 1749204 - RNA, 13 nt, Human herpesvirus 1
augugauaugcua

SEQ ID NO: 1749205 - RNA, 18 nt, Human herpesvirus 1
cgcaagcuaugcagcccc

SEQ ID NO: 1749206 - RNA, 20 nt, Human herpesvirus 1
cgcgggguuacgcgggcccc

SEQ ID NO: 1749207 - RNA, 14 nt, Human herpesvirus 1
aggacaaacccaac

SEQ ID NO: 1749208 - RNA, 19 nt, Human herpesvirus 1
gcagacgguggugcccagc

SEQ ID NO: 1749209 - RNA, 12 nt, Human herpesvirus 1
cgagcgcgcugc

SEQ ID NO: 1749210 - RNA, 18 nt, Human herpesvirus 1
cagcgccggccuccccgu

SEQ ID NO: 1749211 - RNA, 13 nt, Human herpesvirus 1
acggcauaugcaa

SEQ ID NO: 1749212 - RNA, 12 nt, Human herpesvirus 1
uggcgccccggc

SEQ ID NO: 1749213 - RNA, 12 nt, Human herpesvirus 1
uccagcccccca

SEQ ID NO: 1749214 - RNA, 16 nt, Human herpesvirus 1
gcccaccgcugggcgc

SEQ ID NO: 1749215 - RNA, 14 nt, Human herpesvirus 1
cuccaccacccaac

SEQ ID NO: 1749216 - RNA, 14 nt, Human herpesvirus 1
aucgucgaggaggu

SEQ ID NO: 1749217 - RNA, 19 nt, Human herpesvirus 1
ggccgcgcccacuacacca

SEQ ID NO: 1749218 - RNA, 12 nt, Human herpesvirus 1
gaggaucacgag

SEQ ID NO: 1749219 - RNA, 16 nt, Human herpesvirus 1
cgaggauaaccugggg

SEQ ID NO: 1749220 - RNA, 19 nt, Human herpesvirus 1
gcgggguuacgcgggcccc

SEQ ID NO: 1749221 - RNA, 19 nt, Human herpesvirus 1
ggcucucggggccgcagga

SEQ ID NO: 1749222 - RNA, 21 nt, Human herpesvirus 1
cgcgguacagaucggcgccgc

SEQ ID NO: 1749223 - RNA, 22 nt, Human herpesvirus 1
acgggcgucaccaugcagcgcc

SEQ ID NO: 1749224 - RNA, 21 nt, Human herpesvirus 1
cccaccggaagcccaacccac

SEQ ID NO: 1749225 - RNA, 21 nt, Human herpesvirus 1
gauugguccuugucugugccg

SEQ ID NO: 1749226 - RNA, 21 nt, Human herpesvirus 1
agcauucgcucucgccuuucc

SEQ ID NO: 1749227 - RNA, 18 nt, Human herpesvirus 1
gcgcauacgccuccccca

SEQ ID NO: 1749228 - RNA, 15 nt, Human herpesvirus 1
aacaugacccagacc

SEQ ID NO: 1749229 - RNA, 21 nt, Human herpesvirus 1
ucgcccagacgcccuccgagg

SEQ ID NO: 1749230 - RNA, 14 nt, Human herpesvirus 1
agaccuauguguuu

SEQ ID NO: 1749231 - RNA, 23 nt, Human herpesvirus 1
gagcaaaacgccucccccugagc

SEQ ID NO: 1749232 - RNA, 16 nt, Human herpesvirus 1
uccacuacuacgugga

SEQ ID NO: 1749233 - RNA, 20 nt, Human herpesvirus 1
cuaucacggcaaggagcgcc

SEQ ID NO: 1749234 - RNA, 22 nt, Human herpesvirus 1
ggugccgaccgggucccuccuu

SEQ ID NO: 1749235 - RNA, 20 nt, Human herpesvirus 1
gaugacgucccggcucuccg

SEQ ID NO: 1749236 - RNA, 20 nt, Human herpesvirus 1
ucggccccgcgucuggcccc

SEQ ID NO: 1749237 - RNA, 20 nt, Human herpesvirus 1
gugcccuuccaggucccacc

SEQ ID NO: 1749238 - RNA, 13 nt, Human herpesvirus 1
cgccgccacacuc

SEQ ID NO: 1749239 - RNA, 16 nt, Human herpesvirus 1
uguggacccaaagccc

SEQ ID NO: 1749240 - RNA, 15 nt, Human herpesvirus 1
ccacuacaccagcca

SEQ ID NO: 1749241 - RNA, 13 nt, Human herpesvirus 1
gacgggcagugag

SEQ ID NO: 1749242 - RNA, 20 nt, Human herpesvirus 1
ccauguuugcgggccugggc

SEQ ID NO: 1749243 - RNA, 23 nt, Human herpesvirus 1
acgcacaugggggaggugccccc

SEQ ID NO: 1749244 - RNA, 15 nt, Human herpesvirus 1
uucacgugcugcugc

SEQ ID NO: 1749245 - RNA, 17 nt, Human herpesvirus 1
uccagccuccccuccag

SEQ ID NO: 1749246 - RNA, 21 nt, Human herpesvirus 1
augccccccuggcgagcccag

SEQ ID NO: 1749247 - RNA, 23 nt, Human herpesvirus 1
gacggaccuuggucuggcccacg

SEQ ID NO: 1749248 - RNA, 16 nt, Human herpesvirus 1
aucccgacuccccgga

SEQ ID NO: 1749249 - RNA, 22 nt, Human herpesvirus 1
cacucaccggcggacccccgga

SEQ ID NO: 1749250 - RNA, 16 nt, Human herpesvirus 1
cgucuuuaaccucccc

SEQ ID NO: 1749251 - RNA, 13 nt, Human herpesvirus 1
acgcuuggagcca

SEQ ID NO: 1749252 - RNA, 20 nt, Human herpesvirus 1
cgcguccggggagggcgagg

SEQ ID NO: 1749253 - RNA, 23 nt, Human herpesvirus 1
gccacccgacaacagcccccggg

SEQ ID NO: 1749254 - RNA, 14 nt, Human herpesvirus 1
ccaucuaaugccac

SEQ ID NO: 1749255 - RNA, 15 nt, Human herpesvirus 1
cugcuacgccgcuga

SEQ ID NO: 1749256 - RNA, 15 nt, Human herpesvirus 1
acuugcggcaagacc

SEQ ID NO: 1749257 - RNA, 13 nt, Human herpesvirus 1
agcagcgcccggc

SEQ ID NO: 1749258 - RNA, 13 nt, Human herpesvirus 1
gcucuacugcaga

SEQ ID NO: 1749259 - RNA, 15 nt, Human herpesvirus 1
gccgacggcccgaag

SEQ ID NO: 1749260 - RNA, 20 nt, Human herpesvirus 1
uccccccgucagccugccuc

SEQ ID NO: 1749261 - RNA, 19 nt, Human herpesvirus 1
gcggacgccguggcgcccc

SEQ ID NO: 1749262 - RNA, 14 nt, Human herpesvirus 1
gggggauggggaga

SEQ ID NO: 1749263 - RNA, 19 nt, Human herpesvirus 1
agacgagcgcgcuuguccc

SEQ ID NO: 1749264 - RNA, 14 nt, Human herpesvirus 1
guacauguccccgu

SEQ ID NO: 1749265 - RNA, 14 nt, Human herpesvirus 1
acggcggaccuggc

SEQ ID NO: 1749266 - RNA, 22 nt, Human herpesvirus 1
ccaucgaguucgccaggcugca

SEQ ID NO: 1749267 - RNA, 23 nt, Human herpesvirus 1
caugaagccacuguuuuccgccc

SEQ ID NO: 1749268 - RNA, 13 nt, Human herpesvirus 1
cccauacucccgc

SEQ ID NO: 1749269 - RNA, 20 nt, Human herpesvirus 1
gccccccguggaccccacga

SEQ ID NO: 1749270 - RNA, 14 nt, Human herpesvirus 1
ccaaaauaaaagac

SEQ ID NO: 1749271 - RNA, 13 nt, Human herpesvirus 1
ucggucugcacca

SEQ ID NO: 1749272 - RNA, 19 nt, Human herpesvirus 1
augcgccagggcgcccccg

SEQ ID NO: 1749273 - RNA, 23 nt, Human herpesvirus 1
gacucucccccaccgcccacaga

SEQ ID NO: 1749274 - RNA, 18 nt, Human herpesvirus 1
cagagguguucacgcacc

SEQ ID NO: 1749275 - RNA, 14 nt, Human herpesvirus 1
aaagaccaaaauca

SEQ ID NO: 1749276 - RNA, 16 nt, Human herpesvirus 1
uggcccccggacccgg

SEQ ID NO: 1749277 - RNA, 16 nt, Human herpesvirus 1
cccaauccgacgggga

SEQ ID NO: 1749278 - RNA, 19 nt, Human herpesvirus 1
accccaacgccuccccugu

SEQ ID NO: 1749279 - RNA, 19 nt, Human herpesvirus 1
cugcguucaucggaccccc

SEQ ID NO: 1749280 - RNA, 18 nt, Human herpesvirus 1
gucccgaagaccgccggu

SEQ ID NO: 1749281 - RNA, 15 nt, Human herpesvirus 1
cgcccaaugggccgg

SEQ ID NO: 1749282 - RNA, 20 nt, Human herpesvirus 1
aggacgucuccaagcuuucc

SEQ ID NO: 1749283 - RNA, 16 nt, Human herpesvirus 1
accucaacaucaccau

SEQ ID NO: 1749284 - RNA, 15 nt, Human herpesvirus 1
caagaccccccuggc

SEQ ID NO: 1749285 - RNA, 12 nt, Human herpesvirus 1
acuaccuaggca

SEQ ID NO: 1749286 - RNA, 19 nt, Human herpesvirus 1
cagcccgcccucacagggc

SEQ ID NO: 1749287 - RNA, 14 nt, Human herpesvirus 1
ccccaccccggagg

SEQ ID NO: 1749288 - RNA, 12 nt, Human herpesvirus 1
gggaacccagag

SEQ ID NO: 1749289 - RNA, 19 nt, Human herpesvirus 1
cgcgcggcgcgagcucccu

SEQ ID NO: 1749290 - RNA, 18 nt, Human herpesvirus 1
gcccacaugcggaaagca

SEQ ID NO: 1749291 - RNA, 21 nt, Human herpesvirus 1
ccacacucaccggcggacccc

SEQ ID NO: 1749292 - RNA, 20 nt, Human herpesvirus 1
cgucgcuagaccacgccccu

SEQ ID NO: 1749293 - RNA, 17 nt, Human herpesvirus 1
ggaccggggucccagcg

SEQ ID NO: 1749294 - RNA, 13 nt, Human herpesvirus 1
ggggacccggccc

SEQ ID NO: 1749295 - RNA, 16 nt, Human herpesvirus 1
gccaagauggcccagu

SEQ ID NO: 1749296 - RNA, 15 nt, Human herpesvirus 1
cgaugagccaaccuc

SEQ ID NO: 1749297 - RNA, 16 nt, Human herpesvirus 1
uaaagccgccacccuc

SEQ ID NO: 1749298 - RNA, 15 nt, Human herpesvirus 1
ccucucuucccucag

SEQ ID NO: 1749299 - RNA, 20 nt, Human herpesvirus 1
cauccgaacgcagccccgcu

SEQ ID NO: 1749300 - RNA, 22 nt, Human herpesvirus 1
ugcccauuuacguggcuggguu

SEQ ID NO: 1749301 - RNA, 23 nt, Human herpesvirus 1
ggagccccggucuccccgggagc

SEQ ID NO: 1749302 - RNA, 17 nt, Human herpesvirus 1
ccuggugcucgugggcc

SEQ ID NO: 1749303 - RNA, 17 nt, Human herpesvirus 1
gugcgauucagcgcgga

SEQ ID NO: 1749304 - RNA, 15 nt, Human herpesvirus 1
cgcggaggagggcgu

SEQ ID NO: 1749305 - RNA, 21 nt, Human herpesvirus 1
ggagccccggaccccacgcac

SEQ ID NO: 1749306 - RNA, 17 nt, Human herpesvirus 1
uggccaucgguccccuc

SEQ ID NO: 1749307 - RNA, 19 nt, Human herpesvirus 1
gucgccgcgggccacgcca

SEQ ID NO: 1749308 - RNA, 22 nt, Human herpesvirus 1
uggcguucgucgcccuccacca

SEQ ID NO: 1749309 - RNA, 23 nt, Human herpesvirus 1
cgcacgcucccaucgcgggcgcc

SEQ ID NO: 1749310 - RNA, 14 nt, Human herpesvirus 1
uacuauccccgcag

SEQ ID NO: 1749311 - RNA, 14 nt, Human herpesvirus 1
gccuuuaacuacau

SEQ ID NO: 1749312 - RNA, 17 nt, Human herpesvirus 1
uggcgcgcaccccguuc

SEQ ID NO: 1749313 - RNA, 18 nt, Human herpesvirus 1
ccggaggcgccugccccg

SEQ ID NO: 1749314 - RNA, 21 nt, Human herpesvirus 1
gacucaagcacacacggggga

SEQ ID NO: 1749315 - RNA, 13 nt, Human herpesvirus 1
gguccggcacgga

SEQ ID NO: 1749316 - RNA, 21 nt, Human herpesvirus 1
agacgcugcuccgccuggccu

SEQ ID NO: 1749317 - RNA, 16 nt, Human herpesvirus 1
gggcucuacccucugg

SEQ ID NO: 1749318 - RNA, 18 nt, Human herpesvirus 1
cucuggacgcccgggcgc

SEQ ID NO: 1749319 - RNA, 16 nt, Human herpesvirus 1
ggaccggggucccagc

SEQ ID NO: 1749320 - RNA, 19 nt, Human herpesvirus 1
ccagggggaugcuagccug

SEQ ID NO: 1749321 - RNA, 20 nt, Human herpesvirus 1
acaacccuacaaccugacca

SEQ ID NO: 1749322 - RNA, 14 nt, Human herpesvirus 1
ggaccccagcgacc

SEQ ID NO: 1749323 - RNA, 19 nt, Human herpesvirus 1
gcggcccacccuggcgcca

SEQ ID NO: 1749324 - RNA, 13 nt, Human herpesvirus 1
gccguugucuccc

SEQ ID NO: 1749325 - RNA, 16 nt, Human herpesvirus 1
ggaugggcgaccuggg

SEQ ID NO: 1749326 - RNA, 23 nt, Human herpesvirus 1
aguuguucggucauaagcuucag

SEQ ID NO: 1749327 - RNA, 14 nt, Human herpesvirus 1
gacgacgcccgccg

SEQ ID NO: 1749328 - RNA, 14 nt, Human herpesvirus 1
gagggccgggcccc

SEQ ID NO: 1749329 - RNA, 17 nt, Human herpesvirus 1
ccuguuugucgccuggc

SEQ ID NO: 1749330 - RNA, 21 nt, Human herpesvirus 1
ggccggggagggcagggccgc

SEQ ID NO: 1749331 - RNA, 14 nt, Human herpesvirus 1
gacgcguggcggcc

SEQ ID NO: 1749332 - RNA, 19 nt, Human herpesvirus 1
gucgcccgauuuacagccc

SEQ ID NO: 1749333 - RNA, 14 nt, Human herpesvirus 1
gaccaccccaaaua

SEQ ID NO: 1749334 - RNA, 19 nt, Human herpesvirus 1
cccuccgcaucccaggauc

SEQ ID NO: 1749335 - RNA, 21 nt, Human herpesvirus 1
ggcgggcuccagucccggccc

SEQ ID NO: 1749336 - RNA, 23 nt, Human herpesvirus 1
gcgggacuggccaaucggcggcc

SEQ ID NO: 1749337 - RNA, 18 nt, Human herpesvirus 1
accgcauacuccggccgc

SEQ ID NO: 1749338 - RNA, 15 nt, Human herpesvirus 1
ggagucccgaggacg

SEQ ID NO: 1749339 - RNA, 19 nt, Human herpesvirus 1
gcuggguggucucuggccg

SEQ ID NO: 1749340 - RNA, 17 nt, Human herpesvirus 1
cgccccuaaccaggccu

SEQ ID NO: 1749341 - RNA, 18 nt, Human herpesvirus 1
cguuccuucccccucccc

SEQ ID NO: 1749342 - RNA, 12 nt, Human herpesvirus 1
cuuggcggccgc

SEQ ID NO: 1749343 - RNA, 22 nt, Human herpesvirus 1
gccuggaucccaacgaccccgc

SEQ ID NO: 1749344 - RNA, 14 nt, Human herpesvirus 1
cccagcugggcccg

SEQ ID NO: 1749345 - RNA, 22 nt, Human herpesvirus 1
uccgccggcaacugacgcuggc

SEQ ID NO: 1749346 - RNA, 14 nt, Human herpesvirus 1
cguccccuggggcg

SEQ ID NO: 1749347 - RNA, 19 nt, Human herpesvirus 1
gcccaacucucgcaccauc

SEQ ID NO: 1749348 - RNA, 17 nt, Human herpesvirus 1
cgccagguugggggccg

SEQ ID NO: 1749349 - RNA, 13 nt, Human herpesvirus 1
cuggguggucucu

SEQ ID NO: 1749350 - RNA, 17 nt, Human herpesvirus 1
uucgcaccaacaaccuu

SEQ ID NO: 1749351 - RNA, 17 nt, Human herpesvirus 1
gcggcauaacuccgacc

SEQ ID NO: 1749352 - RNA, 16 nt, Human herpesvirus 1
uggggggggcugccgc

SEQ ID NO: 1749353 - RNA, 14 nt, Human herpesvirus 1
cccgcuggggcggc

SEQ ID NO: 1749354 - RNA, 18 nt, Human herpesvirus 1
cgcuaugacggcaauaaa

SEQ ID NO: 1749355 - RNA, 19 nt, Human herpesvirus 1
gacacacggcguggagcaa

SEQ ID NO: 1749356 - RNA, 15 nt, Human herpesvirus 1
gccccgacccccuug

SEQ ID NO: 1749357 - RNA, 16 nt, Human herpesvirus 1
gccgugauuccucucc

SEQ ID NO: 1749358 - RNA, 14 nt, Human herpesvirus 1
ccaccaccuccacc

SEQ ID NO: 1749359 - RNA, 20 nt, Human herpesvirus 1
gcgggaguuucuccgcgguc

SEQ ID NO: 1749360 - RNA, 14 nt, Human herpesvirus 1
ucgccugcccccug

SEQ ID NO: 1749361 - RNA, 22 nt, Human herpesvirus 1
cgggucuuuuguguuggcccua

SEQ ID NO: 1749362 - RNA, 13 nt, Human herpesvirus 1
cagggcgggccgc

SEQ ID NO: 1749363 - RNA, 18 nt, Human herpesvirus 1
aaugggcggccccggccg

SEQ ID NO: 1749364 - RNA, 21 nt, Human herpesvirus 1
gccugggucuuccgcggagcu

SEQ ID NO: 1749365 - RNA, 21 nt, Human herpesvirus 1
gccugccucuccccccaggcc

SEQ ID NO: 1749366 - RNA, 15 nt, Human herpesvirus 1
caagccgccccagca

SEQ ID NO: 1749367 - RNA, 19 nt, Human herpesvirus 1
cguguuggagcgcgccugc

SEQ ID NO: 1749368 - RNA, 20 nt, Human herpesvirus 1
ggguuggggggguccggcac

SEQ ID NO: 1749369 - RNA, 13 nt, Human herpesvirus 1
gcccccgccccuc

SEQ ID NO: 1749370 - RNA, 19 nt, Human herpesvirus 1
acgcccgaccacacacccc

SEQ ID NO: 1749371 - RNA, 13 nt, Human herpesvirus 1
uccagcacacccc

SEQ ID NO: 1749372 - RNA, 21 nt, Human herpesvirus 1
cgcucgcucucggugccccug

SEQ ID NO: 1749373 - RNA, 18 nt, Human herpesvirus 1
agggcggccagccgcgcg

SEQ ID NO: 1749374 - RNA, 20 nt, Human herpesvirus 1
ccagaauaaugaccaccaca

SEQ ID NO: 1749375 - RNA, 21 nt, Human herpesvirus 1
ggacgcgcggcgcgagcuccc

SEQ ID NO: 1749376 - RNA, 17 nt, Human herpesvirus 1
ccgggccgcaccgggcc

SEQ ID NO: 1749377 - RNA, 13 nt, Human herpesvirus 1
ccugggguuccug

SEQ ID NO: 1749378 - RNA, 14 nt, Human herpesvirus 1
ugaaccagacccua

SEQ ID NO: 1749379 - RNA, 16 nt, Human herpesvirus 1
ggcgccugugugucuu

SEQ ID NO: 1749380 - RNA, 12 nt, Human herpesvirus 1
gcaccgggcccc

SEQ ID NO: 1749381 - RNA, 19 nt, Human herpesvirus 1
ccucucuucccucagguca

SEQ ID NO: 1749382 - RNA, 13 nt, Human herpesvirus 1
gccccgccaccca

SEQ ID NO: 1749383 - RNA, 22 nt, Human herpesvirus 1
ucgggcgcuggguggucucugg

SEQ ID NO: 1749384 - RNA, 19 nt, Human herpesvirus 1
ccguggcgccccggccccu

SEQ ID NO: 1749385 - RNA, 16 nt, Human herpesvirus 1
gcauuuauugacccaa

SEQ ID NO: 1749386 - RNA, 23 nt, Human herpesvirus 1
ccaucccggguuaauguaaauaa

SEQ ID NO: 1749387 - RNA, 20 nt, Human herpesvirus 1
gcccucuuggaggaccccgu

SEQ ID NO: 1749388 - RNA, 15 nt, Human herpesvirus 1
ccuccgaagacgucc

SEQ ID NO: 1749389 - RNA, 16 nt, Human herpesvirus 1
ucgcuucccgaccucc

SEQ ID NO: 1749390 - RNA, 15 nt, Human herpesvirus 1
gugggggugggcauc

SEQ ID NO: 1749391 - RNA, 16 nt, Human herpesvirus 1
ggcccugcugcugccg

SEQ ID NO: 1749392 - RNA, 17 nt, Human herpesvirus 1
aaccuccgggggcggcg

SEQ ID NO: 1749393 - RNA, 21 nt, Human herpesvirus 1
agcaaccccaugaaggcccug

SEQ ID NO: 1749394 - RNA, 19 nt, Human herpesvirus 1
cgccucccccugagccgcu

SEQ ID NO: 1749395 - RNA, 15 nt, Human herpesvirus 1
ggcggcaggcgccag

SEQ ID NO: 1749396 - RNA, 19 nt, Human herpesvirus 1
caccuuugacggcgcggcc

SEQ ID NO: 1749397 - RNA, 23 nt, Human herpesvirus 1
agcgggucuuuuguguuggcccu

SEQ ID NO: 1749398 - RNA, 12 nt, Human herpesvirus 1
uggcccuggcuc

SEQ ID NO: 1749399 - RNA, 15 nt, Human herpesvirus 1
gcagaccuauguguu

SEQ ID NO: 1749400 - RNA, 18 nt, Human herpesvirus 1
guuucuuggccccugggg

SEQ ID NO: 1749401 - RNA, 16 nt, Human herpesvirus 1
cgcgaccucaccacca

SEQ ID NO: 1749402 - RNA, 15 nt, Human herpesvirus 1
cccuaaggcccggcu

SEQ ID NO: 1749403 - RNA, 20 nt, Human herpesvirus 1
gacagcacucacagccccgc

SEQ ID NO: 1749404 - RNA, 17 nt, Human herpesvirus 1
uggcgcggugccugacg

SEQ ID NO: 1749405 - RNA, 13 nt, Human herpesvirus 1
ccuuagcgcggcc

SEQ ID NO: 1749406 - RNA, 14 nt, Human herpesvirus 1
ggucaccugccagu

SEQ ID NO: 1749407 - RNA, 12 nt, Human herpesvirus 1
gacgccccccgu

SEQ ID NO: 1749408 - RNA, 17 nt, Human herpesvirus 1
ccuggcgagcccagacc

SEQ ID NO: 1749409 - RNA, 15 nt, Human herpesvirus 1
ccccggucucccagg

SEQ ID NO: 1749410 - RNA, 19 nt, Human herpesvirus 1
ggaccacgugcacagccug

SEQ ID NO: 1749411 - RNA, 18 nt, Human herpesvirus 1
acgaacgcggaccccccc

SEQ ID NO: 1749412 - RNA, 23 nt, Human herpesvirus 1
cagggccggcggcgcuccucgcc

SEQ ID NO: 1749413 - RNA, 14 nt, Human herpesvirus 1
gccgcaaccagcug

SEQ ID NO: 1749414 - RNA, 20 nt, Human herpesvirus 1
ugaugucccucauuuuacaa

SEQ ID NO: 1749415 - RNA, 18 nt, Human herpesvirus 1
accagguaauaccaaaua

SEQ ID NO: 1749416 - RNA, 21 nt, Human herpesvirus 1
ucacggugaccgcgugcccac

SEQ ID NO: 1749417 - RNA, 15 nt, Human herpesvirus 1
uggcugacccacgcg

SEQ ID NO: 1749418 - RNA, 22 nt, Human herpesvirus 1
caccuccacccccucgaccacc

SEQ ID NO: 1749419 - RNA, 15 nt, Human herpesvirus 1
ggggccuuggggccc

SEQ ID NO: 1749420 - RNA, 13 nt, Human herpesvirus 1
caaaauaaaagac

SEQ ID NO: 1749421 - RNA, 11 nt, Human herpesvirus 1
aaccccaggga

SEQ ID NO: 1749422 - RNA, 17 nt, Human herpesvirus 1
uaccgcgagcucccaga

SEQ ID NO: 1749423 - RNA, 13 nt, Human herpesvirus 1
ucaccaccaaggc

SEQ ID NO: 1749424 - RNA, 17 nt, Human herpesvirus 1
accacgccccuuucccc

SEQ ID NO: 1749425 - RNA, 14 nt, Human herpesvirus 1
gcgcaccuggugau

SEQ ID NO: 1749426 - RNA, 15 nt, Human herpesvirus 1
cccaaaacacacgga

SEQ ID NO: 1749427 - RNA, 13 nt, Human herpesvirus 1
cgucaaaaguugu

SEQ ID NO: 1749428 - RNA, 19 nt, Human herpesvirus 1
ucaccaccauggccccccg

SEQ ID NO: 1749429 - RNA, 16 nt, Human herpesvirus 1
uggucccccggggacc

SEQ ID NO: 1749430 - RNA, 16 nt, Human herpesvirus 1
aucgcaucuuuccugu

SEQ ID NO: 1749431 - RNA, 22 nt, Human herpesvirus 1
gcgggugaacgagccgacggcc

SEQ ID NO: 1749432 - RNA, 15 nt, Human herpesvirus 1
acaacggcucggccu

SEQ ID NO: 1749433 - RNA, 14 nt, Human herpesvirus 1
agcgcccuccugac

SEQ ID NO: 1749434 - RNA, 19 nt, Human herpesvirus 1
ccaggccuaccagcagggg

SEQ ID NO: 1749435 - RNA, 16 nt, Human herpesvirus 1
gcccccagaugcccac

SEQ ID NO: 1749436 - RNA, 18 nt, Human herpesvirus 1
cggcugguccacacccag

SEQ ID NO: 1749437 - RNA, 21 nt, Human herpesvirus 1
guccccgaggaccccgugggc

SEQ ID NO: 1749438 - RNA, 20 nt, Human herpesvirus 1
aggugcccccgcgccucccg

SEQ ID NO: 1749439 - RNA, 15 nt, Human herpesvirus 1
gagcgaaggcugccg

SEQ ID NO: 1749440 - RNA, 13 nt, Human herpesvirus 1
cagcgaccugggg

SEQ ID NO: 1749441 - RNA, 21 nt, Human herpesvirus 1
acaauccccaggacaccgcgu

SEQ ID NO: 1749442 - RNA, 15 nt, Human herpesvirus 1
gggaccgcagccugg

SEQ ID NO: 1749443 - RNA, 20 nt, Human herpesvirus 1
gcgccguuggcccccgccuc

SEQ ID NO: 1749444 - RNA, 13 nt, Human herpesvirus 1
cccucugggcccg

SEQ ID NO: 1749445 - RNA, 15 nt, Human herpesvirus 1
ugcgggucaccugcc

SEQ ID NO: 1749446 - RNA, 16 nt, Human herpesvirus 1
cgcggguugcugcgcg

SEQ ID NO: 1749447 - RNA, 14 nt, Human herpesvirus 1
ugucacgcgggagg

SEQ ID NO: 1749448 - RNA, 20 nt, Human herpesvirus 1
gggacacuuguccggagaac

SEQ ID NO: 1749449 - RNA, 14 nt, Human herpesvirus 1
ccugggucagcucc

SEQ ID NO: 1749450 - RNA, 13 nt, Human herpesvirus 1
agcgcucuugucu

SEQ ID NO: 1749451 - RNA, 16 nt, Human herpesvirus 1
cggcaagcggagcggc

SEQ ID NO: 1749452 - RNA, 14 nt, Human herpesvirus 1
cauauccaccaccu

SEQ ID NO: 1749453 - RNA, 18 nt, Human herpesvirus 1
gagcuguacgugcgggaa

SEQ ID NO: 1749454 - RNA, 22 nt, Human herpesvirus 1
gacuggccaaucggcggccgcc

SEQ ID NO: 1749455 - RNA, 19 nt, Human herpesvirus 1
cccuggacgugggccucac

SEQ ID NO: 1749456 - RNA, 18 nt, Human herpesvirus 1
cucgcaugaagcccccaa

SEQ ID NO: 1749457 - RNA, 10 nt, Human herpesvirus 1
gaccuggggg

SEQ ID NO: 1749458 - RNA, 18 nt, Human herpesvirus 1
cgaaaucguggcgcggcu

SEQ ID NO: 1749459 - RNA, 12 nt, Human herpesvirus 1
cgagaugagcca

SEQ ID NO: 1749460 - RNA, 16 nt, Human herpesvirus 1
accacccaaccccaac

SEQ ID NO: 1749461 - RNA, 22 nt, Human herpesvirus 1
ugcacaacacaaacaucuggag

SEQ ID NO: 1749462 - RNA, 11 nt, Human herpesvirus 1
ccuggccagga

SEQ ID NO: 1749463 - RNA, 14 nt, Human herpesvirus 1
gucccugcgucgcc

SEQ ID NO: 1749464 - RNA, 12 nt, Human herpesvirus 1
ggagagcccaca

SEQ ID NO: 1749465 - RNA, 18 nt, Human herpesvirus 1
aaguucaccguggccugg

SEQ ID NO: 1749466 - RNA, 20 nt, Human herpesvirus 1
ccaaguacgccgccaccgug

SEQ ID NO: 1749467 - RNA, 18 nt, Human herpesvirus 1
cacccggaaccugcucac

SEQ ID NO: 1749468 - RNA, 22 nt, Human herpesvirus 1
ggcgggcccgcgggaggccgcc

SEQ ID NO: 1749469 - RNA, 13 nt, Human herpesvirus 1
ccuagccgcagca

SEQ ID NO: 1749470 - RNA, 14 nt, Human herpesvirus 1
cuccuggccaggau

SEQ ID NO: 1749471 - RNA, 18 nt, Human herpesvirus 1
acgacgacgacgcccgcc

SEQ ID NO: 1749472 - RNA, 11 nt, Human herpesvirus 1
cacccaacaac

SEQ ID NO: 1749473 - RNA, 19 nt, Human herpesvirus 1
cgagcucccagagacccca

SEQ ID NO: 1749474 - RNA, 22 nt, Human herpesvirus 1
uccaggcugucgacgcccccuc

SEQ ID NO: 1749475 - RNA, 23 nt, Human herpesvirus 1
cggaguccugucccugcgucgcc

SEQ ID NO: 1749476 - RNA, 19 nt, Human herpesvirus 1
gcaggcgguugucgggggu

SEQ ID NO: 1749477 - RNA, 15 nt, Human herpesvirus 1
ugggcggccucuccg

SEQ ID NO: 1749478 - RNA, 17 nt, Human herpesvirus 1
ggcccgcguuuggccug

SEQ ID NO: 1749479 - RNA, 15 nt, Human herpesvirus 1
cccgcaucccccguc

SEQ ID NO: 1749480 - RNA, 22 nt, Human herpesvirus 1
cgccgcuaccgacgcucccguc

SEQ ID NO: 1749481 - RNA, 16 nt, Human herpesvirus 1
agcucaaucuggccca

SEQ ID NO: 1749482 - RNA, 16 nt, Human herpesvirus 1
cgggccacggcgccga

SEQ ID NO: 1749483 - RNA, 19 nt, Human herpesvirus 1
gggcucgccagcgacccgc

SEQ ID NO: 1749484 - RNA, 21 nt, Human herpesvirus 1
gccgcgggcccccggccgccg

SEQ ID NO: 1749485 - RNA, 13 nt, Human herpesvirus 1
gucgucagcaccg

SEQ ID NO: 1749486 - RNA, 15 nt, Human herpesvirus 1
agcccggccguguga

SEQ ID NO: 1749487 - RNA, 20 nt, Human herpesvirus 1
cccaacccccuaagacccac

SEQ ID NO: 1749488 - RNA, 14 nt, Human herpesvirus 1
acccucucuucccu

SEQ ID NO: 1749489 - RNA, 14 nt, Human herpesvirus 1
ugaaccccaacgcc

SEQ ID NO: 1749490 - RNA, 17 nt, Human herpesvirus 1
ccgaacaaacgacccac

SEQ ID NO: 1749491 - RNA, 13 nt, Human herpesvirus 1
uacuugcgcggcu

SEQ ID NO: 1749492 - RNA, 11 nt, Human herpesvirus 1
aaauaaagcca

SEQ ID NO: 1749493 - RNA, 16 nt, Human herpesvirus 1
gaucccaacaacuccc

SEQ ID NO: 1749494 - RNA, 19 nt, Human herpesvirus 1
cccuacaccggccacccag

SEQ ID NO: 1749495 - RNA, 19 nt, Human herpesvirus 1
ccgagucuucggggcccgg

SEQ ID NO: 1749496 - RNA, 15 nt, Human herpesvirus 1
agauguccaauccac

SEQ ID NO: 1749497 - RNA, 19 nt, Human herpesvirus 1
ugcguucaucggacccccc

SEQ ID NO: 1749498 - RNA, 13 nt, Human herpesvirus 1
guugguccagacg

SEQ ID NO: 1749499 - RNA, 19 nt, Human herpesvirus 1
ucccaucccccgaucccaa

SEQ ID NO: 1749500 - RNA, 15 nt, Human herpesvirus 1
ggcgaccgccagccg

SEQ ID NO: 1749501 - RNA, 15 nt, Human herpesvirus 1
uggaggcgcggcgcc

SEQ ID NO: 1749502 - RNA, 19 nt, Human herpesvirus 1
ccgcaauuugcacccagcc

SEQ ID NO: 1749503 - RNA, 14 nt, Human herpesvirus 1
ucuuuccugugugu

SEQ ID NO: 1749504 - RNA, 14 nt, Human herpesvirus 1
caagagcgcucccc

SEQ ID NO: 1749505 - RNA, 17 nt, Human herpesvirus 1
ccccggcccccaauaaa

SEQ ID NO: 1749506 - RNA, 14 nt, Human herpesvirus 1
cggcggcgcuccuc

SEQ ID NO: 1749507 - RNA, 22 nt, Human herpesvirus 1
acccgaggcggccugggucuuc

SEQ ID NO: 1749508 - RNA, 11 nt, Human herpesvirus 1
uuaacagacga

SEQ ID NO: 1749509 - RNA, 13 nt, Human herpesvirus 1
agccucuguguca

SEQ ID NO: 1749510 - RNA, 19 nt, Human herpesvirus 1
aaguucaccguggccuggg

SEQ ID NO: 1749511 - RNA, 16 nt, Human herpesvirus 1
ggcucgucuuggccac

SEQ ID NO: 1749512 - RNA, 17 nt, Human herpesvirus 1
ccuccgcuggggccccc

SEQ ID NO: 1749513 - RNA, 22 nt, Human herpesvirus 1
ggcuccggggggcuuccggccu

SEQ ID NO: 1749514 - RNA, 16 nt, Human herpesvirus 1
ugcccccgcgccuccc

SEQ ID NO: 1749515 - RNA, 20 nt, Human herpesvirus 1
ucggccguuucuccgcccga

SEQ ID NO: 1749516 - RNA, 14 nt, Human herpesvirus 1
ggugggcguccugg

SEQ ID NO: 1749517 - RNA, 12 nt, Human herpesvirus 1
uauccugagccc

SEQ ID NO: 1749518 - RNA, 18 nt, Human herpesvirus 1
uggugcugucugacacac

SEQ ID NO: 1749519 - RNA, 22 nt, Human herpesvirus 1
ccauuaucgggccgcuggcaac

SEQ ID NO: 1749520 - RNA, 19 nt, Human herpesvirus 1
gagaaccuagggaacccag

SEQ ID NO: 1749521 - RNA, 16 nt, Human herpesvirus 1
gccaacaauccccagg

SEQ ID NO: 1749522 - RNA, 14 nt, Human herpesvirus 1
uacucgacccacug

SEQ ID NO: 1749523 - RNA, 13 nt, Human herpesvirus 1
ccaagauggccca

SEQ ID NO: 1749524 - RNA, 19 nt, Human herpesvirus 1
cccuccgcuggggccccca

SEQ ID NO: 1749525 - RNA, 12 nt, Human herpesvirus 1
gauggcccugga

SEQ ID NO: 1749526 - RNA, 19 nt, Human herpesvirus 1
caucuuuuuugccgccucg

SEQ ID NO: 1749527 - RNA, 15 nt, Human herpesvirus 1
guagggugguuccug

SEQ ID NO: 1749528 - RNA, 21 nt, Human herpesvirus 1
caucgacacgcgcguccuucu

SEQ ID NO: 1749529 - RNA, 15 nt, Human herpesvirus 1
cucuggacuggacca

SEQ ID NO: 1749530 - RNA, 23 nt, Human herpesvirus 1
gcuccuguaaguacgcccucccg

SEQ ID NO: 1749531 - RNA, 20 nt, Human herpesvirus 1
cggagcuuucuuccggccuc

SEQ ID NO: 1749532 - RNA, 13 nt, Human herpesvirus 1
uuucaccgggacg

SEQ ID NO: 1749533 - RNA, 14 nt, Human herpesvirus 1
accagcgcaccguc

SEQ ID NO: 1749534 - RNA, 20 nt, Human herpesvirus 1
ucgggcauggccccggggcg

SEQ ID NO: 1749535 - RNA, 14 nt, Human herpesvirus 1
cuaagaaauuccaa

SEQ ID NO: 1749536 - RNA, 23 nt, Human herpesvirus 1
gauccgcggcgacaacgcgggcg

SEQ ID NO: 1749537 - RNA, 17 nt, Human herpesvirus 1
aaccccaacuccagacc

SEQ ID NO: 1749538 - RNA, 13 nt, Human herpesvirus 1
gacggcggggcag

SEQ ID NO: 1749539 - RNA, 16 nt, Human herpesvirus 1
ccauaaggucauccga

SEQ ID NO: 1749540 - RNA, 19 nt, Human herpesvirus 1
gaacaauaaaggcgguggu

SEQ ID NO: 1749541 - RNA, 14 nt, Human herpesvirus 1
cgcgccgcugcccg

SEQ ID NO: 1749542 - RNA, 18 nt, Human herpesvirus 1
uauagccuaugccacgcc

SEQ ID NO: 1749543 - RNA, 20 nt, Human herpesvirus 1
accgucccguagucccaucc

SEQ ID NO: 1749544 - RNA, 19 nt, Human herpesvirus 1
caguaacaugcgcacguga

SEQ ID NO: 1749545 - RNA, 21 nt, Human herpesvirus 1
gcugcccuucugucuggacca

SEQ ID NO: 1749546 - RNA, 11 nt, Human herpesvirus 1
cgguccugacg

SEQ ID NO: 1749547 - RNA, 16 nt, Human herpesvirus 1
cccggcacgccugggg

SEQ ID NO: 1749548 - RNA, 15 nt, Human herpesvirus 1
ccgcaccaagccgcu

SEQ ID NO: 1749549 - RNA, 20 nt, Human herpesvirus 1
ccugagcgcccuccugacca

SEQ ID NO: 1749550 - RNA, 22 nt, Human herpesvirus 1
cccggccggauucccgggccgg

SEQ ID NO: 1749551 - RNA, 16 nt, Human herpesvirus 1
cccuguucaaccccag

SEQ ID NO: 1749552 - RNA, 19 nt, Human herpesvirus 1
cgacgccgugggcaauggc

SEQ ID NO: 1749553 - RNA, 23 nt, Human herpesvirus 1
gugcccccccucguucugcugca

SEQ ID NO: 1749554 - RNA, 16 nt, Human herpesvirus 1
cacacaccccccaugc

SEQ ID NO: 1749555 - RNA, 12 nt, Human herpesvirus 1
ggccccgcgucu

SEQ ID NO: 1749556 - RNA, 18 nt, Human herpesvirus 1
ucaccccgcaauuugcac

SEQ ID NO: 1749557 - RNA, 15 nt, Human herpesvirus 1
ggucgggaggccgca

SEQ ID NO: 1749558 - RNA, 23 nt, Human herpesvirus 1
guaauuucuacgugcccccggau

SEQ ID NO: 1749559 - RNA, 17 nt, Human herpesvirus 1
gaccgccugccgcgcgg

SEQ ID NO: 1749560 - RNA, 22 nt, Human herpesvirus 1
cgucuugguggguggguggcug

SEQ ID NO: 1749561 - RNA, 13 nt, Human herpesvirus 1
cgggcccccggcc

SEQ ID NO: 1749562 - RNA, 13 nt, Human herpesvirus 1
ggcacggacccaa

SEQ ID NO: 1749563 - RNA, 17 nt, Human herpesvirus 1
cccgccgcccggggcca

SEQ ID NO: 1749564 - RNA, 12 nt, Human herpesvirus 1
cgccacccaggc

SEQ ID NO: 1749565 - RNA, 21 nt, Human herpesvirus 1
gccccguacaaguucaaggcc

SEQ ID NO: 1749566 - RNA, 16 nt, Human herpesvirus 1
gcccccagcugggccc

SEQ ID NO: 1749567 - RNA, 22 nt, Human herpesvirus 1
cgacccccuuguauguccccaa

SEQ ID NO: 1749568 - RNA, 20 nt, Human herpesvirus 1
cgcagacgaaaagccccggg

SEQ ID NO: 1749569 - RNA, 12 nt, Human herpesvirus 1
ccccgcccgggg

SEQ ID NO: 1749570 - RNA, 19 nt, Human herpesvirus 1
uccguggccccggccccca

SEQ ID NO: 1749571 - RNA, 17 nt, Human herpesvirus 1
ucuuuuguguuggcccu

SEQ ID NO: 1749572 - RNA, 18 nt, Human herpesvirus 1
ccagggaccuccuggacu

SEQ ID NO: 1749573 - RNA, 18 nt, Human herpesvirus 1
ccccagggaccuccugga

SEQ ID NO: 1749574 - RNA, 13 nt, Human herpesvirus 1
cccgcacccccag

SEQ ID NO: 1749575 - RNA, 19 nt, Human herpesvirus 1
gggccccauaaaacccaag

SEQ ID NO: 1749576 - RNA, 14 nt, Human herpesvirus 1
ccaggcgcugggcg

SEQ ID NO: 1749577 - RNA, 14 nt, Human herpesvirus 1
acggcacgcccccu

SEQ ID NO: 1749578 - RNA, 21 nt, Human herpesvirus 1
uggccaggggcauccgggacc

SEQ ID NO: 1749579 - RNA, 19 nt, Human herpesvirus 1
gccccacacagcccucccg

SEQ ID NO: 1749580 - RNA, 15 nt, Human herpesvirus 1
uucgcuggaccucac

SEQ ID NO: 1749581 - RNA, 14 nt, Human herpesvirus 1
ucgaggggcagcug

SEQ ID NO: 1749582 - RNA, 11 nt, Human herpesvirus 1
cuuccccuucc

SEQ ID NO: 1749583 - RNA, 22 nt, Human herpesvirus 1
cuguccugucuuggggcccacc

SEQ ID NO: 1749584 - RNA, 23 nt, Human herpesvirus 1
auggcacgaguucaaccucgggu

SEQ ID NO: 1749585 - RNA, 21 nt, Human herpesvirus 1
ggggguccggcacggacccaa

SEQ ID NO: 1749586 - RNA, 12 nt, Human herpesvirus 1
ccccggccaccu

SEQ ID NO: 1749587 - RNA, 14 nt, Human herpesvirus 1
cucgcaccaucccg

SEQ ID NO: 1749588 - RNA, 23 nt, Human herpesvirus 1
auuuccgacgaacgcggaccccc

SEQ ID NO: 1749589 - RNA, 18 nt, Human herpesvirus 1
gaacaauaaaggcggugg

SEQ ID NO: 1749590 - RNA, 23 nt, Human herpesvirus 1
gcagacgguggugcccagcggcc

SEQ ID NO: 1749591 - RNA, 14 nt, Human herpesvirus 1
cucgaccaccaccu

SEQ ID NO: 1749592 - RNA, 20 nt, Human herpesvirus 1
cugugggccaagauggccca

SEQ ID NO: 1749593 - RNA, 14 nt, Human herpesvirus 1
cucccugcggcugg

SEQ ID NO: 1749594 - RNA, 12 nt, Human herpesvirus 1
uagcgggggacg

SEQ ID NO: 1749595 - RNA, 15 nt, Human herpesvirus 1
cgggcagugagggug

SEQ ID NO: 1749596 - RNA, 20 nt, Human herpesvirus 1
cuaagcgucccugggcccug

SEQ ID NO: 1749597 - RNA, 17 nt, Human herpesvirus 1
cgggcgacgccccggcc

SEQ ID NO: 1749598 - RNA, 20 nt, Human herpesvirus 1
agcgcacggaacacaaggcc

SEQ ID NO: 1749599 - RNA, 21 nt, Human herpesvirus 1
ggacccgcaucccccgucugg

SEQ ID NO: 1749600 - RNA, 15 nt, Human herpesvirus 1
caacagcccccgggu

SEQ ID NO: 1749601 - RNA, 23 nt, Human herpesvirus 1
gaccaucacccgagucucugggc

SEQ ID NO: 1749602 - RNA, 18 nt, Human herpesvirus 1
ccauuuacguggcugggu

SEQ ID NO: 1749603 - RNA, 13 nt, Human herpesvirus 1
cuucggugccagu

SEQ ID NO: 1749604 - RNA, 17 nt, Human herpesvirus 1
acagagggccacucacg

SEQ ID NO: 1749605 - RNA, 14 nt, Human herpesvirus 1
cuguaugacagcgg

SEQ ID NO: 1749606 - RNA, 20 nt, Human herpesvirus 1
cggcccucuuggaggacccc

SEQ ID NO: 1749607 - RNA, 15 nt, Human herpesvirus 1
ggaccuccuggacuu

SEQ ID NO: 1749608 - RNA, 19 nt, Human herpesvirus 1
cccagagguguucacgcac

SEQ ID NO: 1749609 - RNA, 15 nt, Human herpesvirus 1
cuguaggucugggaa

SEQ ID NO: 1749610 - RNA, 14 nt, Human herpesvirus 1
gaccgaguacccgc

SEQ ID NO: 1749611 - RNA, 12 nt, Human herpesvirus 1
cgccccuguggc

SEQ ID NO: 1749612 - RNA, 16 nt, Human herpesvirus 1
gccccggcccccaaua

SEQ ID NO: 1749613 - RNA, 15 nt, Human herpesvirus 1
cccugaucccccgcg

SEQ ID NO: 1749614 - RNA, 22 nt, Human herpesvirus 1
gaccuguugauggccugugcuu

SEQ ID NO: 1749615 - RNA, 12 nt, Human herpesvirus 1
gucucucuuccc

SEQ ID NO: 1749616 - RNA, 20 nt, Human herpesvirus 1
cgcgguuuaccgccaccagc

SEQ ID NO: 1749617 - RNA, 16 nt, Human herpesvirus 1
uuuguguuccgugucu

SEQ ID NO: 1749618 - RNA, 14 nt, Human herpesvirus 1
gccugcggcgcacc

SEQ ID NO: 1749619 - RNA, 20 nt, Human herpesvirus 1
ucagagacaacgcgacaggc

SEQ ID NO: 1749620 - RNA, 14 nt, Human herpesvirus 1
accucgaggacacc

SEQ ID NO: 1749621 - RNA, 16 nt, Human herpesvirus 1
cugucgcacccacagc

SEQ ID NO: 1749622 - RNA, 13 nt, Human herpesvirus 1
cgccucggagccg

SEQ ID NO: 1749623 - RNA, 14 nt, Human herpesvirus 1
acccaccccaacgc

SEQ ID NO: 1749624 - RNA, 23 nt, Human herpesvirus 1
gugguuuuuauuuacaacaaacc

SEQ ID NO: 1749625 - RNA, 16 nt, Human herpesvirus 1
cggagggaaccaccau

SEQ ID NO: 1749626 - RNA, 17 nt, Human herpesvirus 1
aguaugccccccuggcg

SEQ ID NO: 1749627 - RNA, 22 nt, Human herpesvirus 1
cgccggguagcguacggaccgc

SEQ ID NO: 1749628 - RNA, 12 nt, Human herpesvirus 1
cccaacaacacc

SEQ ID NO: 1749629 - RNA, 20 nt, Human herpesvirus 1
gucucccagggagccccggu

SEQ ID NO: 1749630 - RNA, 20 nt, Human herpesvirus 1
ccacgccccuuucccccugu

SEQ ID NO: 1749631 - RNA, 20 nt, Human herpesvirus 1
caguggcuccgggccaacca

SEQ ID NO: 1749632 - RNA, 16 nt, Human herpesvirus 1
gguccccucugggccc

SEQ ID NO: 1749633 - RNA, 15 nt, Human herpesvirus 1
cucgcuuugccggga

SEQ ID NO: 1749634 - RNA, 23 nt, Human herpesvirus 1
gugcguagcauaccugggugugu

SEQ ID NO: 1749635 - RNA, 14 nt, Human herpesvirus 1
caggaccgccugcc

SEQ ID NO: 1749636 - RNA, 19 nt, Human herpesvirus 1
ccuugguuccgacgccuca

SEQ ID NO: 1749637 - RNA, 14 nt, Human herpesvirus 1
uuugcccauaauaa

SEQ ID NO: 1749638 - RNA, 21 nt, Human herpesvirus 1
caggugggugcuuuggaaacu

SEQ ID NO: 1749639 - RNA, 22 nt, Human herpesvirus 1
ucccgguaugguaauuaaaaac

SEQ ID NO: 1749640 - RNA, 13 nt, Human herpesvirus 1
accaccaaggccc

SEQ ID NO: 1749641 - RNA, 23 nt, Human herpesvirus 1
cccuuaauaaauuuuacaaacag

SEQ ID NO: 1749642 - RNA, 13 nt, Human herpesvirus 1
aaacgccagccug

SEQ ID NO: 1749643 - RNA, 17 nt, Human herpesvirus 1
ggcgccacaccacgcca

SEQ ID NO: 1749644 - RNA, 21 nt, Human herpesvirus 1
cgcgcucaaccaccgcucccc

SEQ ID NO: 1749645 - RNA, 18 nt, Human herpesvirus 1
acgcgcaccuguuccgcc

SEQ ID NO: 1749646 - RNA, 11 nt, Human herpesvirus 1
ccaugcuggcg

SEQ ID NO: 1749647 - RNA, 23 nt, Human herpesvirus 1
cgugcccauuuacguggcugggu

SEQ ID NO: 1749648 - RNA, 21 nt, Human herpesvirus 1
cggggacggggaggcgggccc

SEQ ID NO: 1749649 - RNA, 13 nt, Human herpesvirus 1
agugccccgaccc

SEQ ID NO: 1749650 - RNA, 12 nt, Human herpesvirus 1
ggaccaccgccc

SEQ ID NO: 1749651 - RNA, 22 nt, Human herpesvirus 1
gagcccgcuggggcggcugggc

SEQ ID NO: 1749652 - RNA, 23 nt, Human herpesvirus 1
cggaaaaccugggcggccucucc

SEQ ID NO: 1749653 - RNA, 20 nt, Human herpesvirus 1
cgccagcuuuccgcugagcc

SEQ ID NO: 1749654 - RNA, 18 nt, Human herpesvirus 1
gacucucccccaccgccc

SEQ ID NO: 1749655 - RNA, 22 nt, Human herpesvirus 1
agacggcauucgggccugccug

SEQ ID NO: 1749656 - RNA, 14 nt, Human herpesvirus 1
ggcccuggcucccg

SEQ ID NO: 1749657 - RNA, 12 nt, Human herpesvirus 1
cguucugcugca

SEQ ID NO: 1749658 - RNA, 19 nt, Human herpesvirus 1
cgcccgcgacgccauggac

SEQ ID NO: 1749659 - RNA, 17 nt, Human herpesvirus 1
guggcacgggcccaagg

SEQ ID NO: 1749660 - RNA, 11 nt, Human herpesvirus 1
gcccgcccccc

SEQ ID NO: 1749661 - RNA, 14 nt, Human herpesvirus 1
uuuccgcugagccu

SEQ ID NO: 1749662 - RNA, 23 nt, Human herpesvirus 1
ggcacaccgguccccggaggcgu

SEQ ID NO: 1749663 - RNA, 19 nt, Human herpesvirus 1
cgagcagccgcgccgcugc

SEQ ID NO: 1749664 - RNA, 18 nt, Human herpesvirus 1
ccccucgaccaccauccc

SEQ ID NO: 1749665 - RNA, 22 nt, Human herpesvirus 1
gccgcgacccaggcggcgaacg

SEQ ID NO: 1749666 - RNA, 14 nt, Human herpesvirus 1
ggggcauuucagug

SEQ ID NO: 1749667 - RNA, 13 nt, Human herpesvirus 1
ugcaccccagagg

SEQ ID NO: 1749668 - RNA, 23 nt, Human herpesvirus 1
guccccucugggcccgccuggau

SEQ ID NO: 1749669 - RNA, 15 nt, Human herpesvirus 1
cccggcuagacccac

SEQ ID NO: 1749670 - RNA, 19 nt, Human herpesvirus 1
cagagacaacgcgacaggc

SEQ ID NO: 1749671 - RNA, 14 nt, Human herpesvirus 1
caaguucaaggcca

SEQ ID NO: 1749672 - RNA, 19 nt, Human herpesvirus 1
cagccuguuuguccugggg

SEQ ID NO: 1749673 - RNA, 13 nt, Human herpesvirus 1
gcccuccugacca

SEQ ID NO: 1749674 - RNA, 20 nt, Human herpesvirus 1
ggcggacccccggaggcgcc

SEQ ID NO: 1749675 - RNA, 19 nt, Human herpesvirus 1
cgcgacccaccgggcccgg

SEQ ID NO: 1749676 - RNA, 18 nt, Human herpesvirus 1
augcgccagggcgccccc

SEQ ID NO: 1749677 - RNA, 13 nt, Human herpesvirus 1
ccgaggggccaag

SEQ ID NO: 1749678 - RNA, 14 nt, Human herpesvirus 1
cccacgcucucccc

SEQ ID NO: 1749679 - RNA, 19 nt, Human herpesvirus 1
ggcguacaacggcucggcc

SEQ ID NO: 1749680 - RNA, 17 nt, Human herpesvirus 1
cgacggcgucucccggg

SEQ ID NO: 1749681 - RNA, 17 nt, Human herpesvirus 1
cugggauggcuccuggc

SEQ ID NO: 1749682 - RNA, 15 nt, Human herpesvirus 1
aggaggccgccacgc

SEQ ID NO: 1749683 - RNA, 20 nt, Human herpesvirus 1
gaccagccguccucgcacca

SEQ ID NO: 1749684 - RNA, 17 nt, Human herpesvirus 1
cggccgaagccacgccc

SEQ ID NO: 1749685 - RNA, 15 nt, Human herpesvirus 1
uccgcggccccagcc

SEQ ID NO: 1749686 - RNA, 23 nt, Human herpesvirus 1
cgccacgguggugcaguucgagc

SEQ ID NO: 1749687 - RNA, 15 nt, Human herpesvirus 1
cagauagccaucccc

SEQ ID NO: 1749688 - RNA, 19 nt, Human herpesvirus 1
uccacgguaggcccagcau

SEQ ID NO: 1749689 - RNA, 19 nt, Human herpesvirus 1
cccgccaacacccccuucc

SEQ ID NO: 1749690 - RNA, 20 nt, Human herpesvirus 1
auaaagccgccacccucucu

SEQ ID NO: 1749691 - RNA, 21 nt, Human herpesvirus 1
aaagacacgggcaccacacac

SEQ ID NO: 1749692 - RNA, 10 nt, Human herpesvirus 1
gcccggggcc

SEQ ID NO: 1749693 - RNA, 15 nt, Human herpesvirus 1
gaaaagugaaagaca

SEQ ID NO: 1749694 - RNA, 18 nt, Human herpesvirus 1
gagcugcagaaucacgag

SEQ ID NO: 1749695 - RNA, 12 nt, Human herpesvirus 1
acguccuuuggg

SEQ ID NO: 1749696 - RNA, 22 nt, Human herpesvirus 1
caguacauguucuuuaugcgcc

SEQ ID NO: 1749697 - RNA, 13 nt, Human herpesvirus 1
uacacgagcaccc

SEQ ID NO: 1749698 - RNA, 17 nt, Human herpesvirus 1
ggucuguugguccuggc

SEQ ID NO: 1749699 - RNA, 21 nt, Human herpesvirus 1
cggccaacgccgcgacccgca

SEQ ID NO: 1749700 - RNA, 21 nt, Human herpesvirus 1
aaagcugcuggcgcgcacccc

SEQ ID NO: 1749701 - RNA, 22 nt, Human herpesvirus 1
gggggcugcgaguccugcgccc

SEQ ID NO: 1749702 - RNA, 16 nt, Human herpesvirus 1
ccgacucucccaccgc

SEQ ID NO: 1749703 - RNA, 14 nt, Human herpesvirus 1
caccgcugggcgcu

SEQ ID NO: 1749704 - RNA, 21 nt, Human herpesvirus 1
uuggcccccggacccgggccg

SEQ ID NO: 1749705 - RNA, 14 nt, Human herpesvirus 1
agccggccccggca

SEQ ID NO: 1749706 - RNA, 16 nt, Human herpesvirus 1
gcaauuugcacccagc

SEQ ID NO: 1749707 - RNA, 15 nt, Human herpesvirus 1
accgcaucuucgccc

SEQ ID NO: 1749708 - RNA, 21 nt, Human herpesvirus 1
uaaagggccggugguccgccu

SEQ ID NO: 1749709 - RNA, 19 nt, Human herpesvirus 1
cggggcucucggggccgca

SEQ ID NO: 1749710 - RNA, 14 nt, Human herpesvirus 1
cgagcccagacccc

SEQ ID NO: 1749711 - RNA, 18 nt, Human herpesvirus 1
cuccccccaggccuacca

SEQ ID NO: 1749712 - RNA, 22 nt, Human herpesvirus 1
aggaacccgcgcuaugacggca

SEQ ID NO: 1749713 - RNA, 15 nt, Human herpesvirus 1
cccuaaccaggccuc

SEQ ID NO: 1749714 - RNA, 19 nt, Human herpesvirus 1
cagauuccaaagugccccg

SEQ ID NO: 1749715 - RNA, 22 nt, Human herpesvirus 1
caucccacaaacacaaaacaca

SEQ ID NO: 1749716 - RNA, 21 nt, Human herpesvirus 1
cgcccaacucucgcaccaucc

SEQ ID NO: 1749717 - RNA, 14 nt, Human herpesvirus 1
acacggagcugcuc

SEQ ID NO: 1749718 - RNA, 20 nt, Human herpesvirus 1
cugggucugugccaccagcc

SEQ ID NO: 1749719 - RNA, 18 nt, Human herpesvirus 1
cacucgacccccgcgucc

SEQ ID NO: 1749720 - RNA, 16 nt, Human herpesvirus 1
acacccccgugacuca

SEQ ID NO: 1749721 - RNA, 18 nt, Human herpesvirus 1
ccguccucgcaccagccc

SEQ ID NO: 1749722 - RNA, 19 nt, Human herpesvirus 1
cccucacagggcgggccgc

SEQ ID NO: 1749723 - RNA, 22 nt, Human herpesvirus 1
acgcccgccgcaaagccaccca

SEQ ID NO: 1749724 - RNA, 13 nt, Human herpesvirus 1
acgccugccaacc

SEQ ID NO: 1749725 - RNA, 13 nt, Human herpesvirus 1
cucuuccccccca

SEQ ID NO: 1749726 - RNA, 23 nt, Human herpesvirus 1
ggacuacacggagguccagcgcc

SEQ ID NO: 1749727 - RNA, 17 nt, Human herpesvirus 1
cgagucuucggggcccg

SEQ ID NO: 1749728 - RNA, 17 nt, Human herpesvirus 1
cacgauuccgguuuggg

SEQ ID NO: 1749729 - RNA, 16 nt, Human herpesvirus 1
gcacgaucgagguggc

SEQ ID NO: 1749730 - RNA, 13 nt, Human herpesvirus 1
cuagagacagccg

SEQ ID NO: 1749731 - RNA, 12 nt, Human herpesvirus 1
caugcuggagga

SEQ ID NO: 1749732 - RNA, 17 nt, Human herpesvirus 1
ucgcgucccgcccaccg

SEQ ID NO: 1749733 - RNA, 23 nt, Human herpesvirus 1
ccgggccccauaaaacccaagcc

SEQ ID NO: 1749734 - RNA, 16 nt, Human herpesvirus 1
gccgggaacgcuagcc

SEQ ID NO: 1749735 - RNA, 23 nt, Human herpesvirus 1
ggcgcgcgaaaucguggcgcggc

SEQ ID NO: 1749736 - RNA, 20 nt, Human herpesvirus 1
ggcgucuccucugggggcga

SEQ ID NO: 1749737 - RNA, 20 nt, Human herpesvirus 1
accgcgguucgcgucccgcc

SEQ ID NO: 1749738 - RNA, 20 nt, Human herpesvirus 1
acgccuaccggccccugggc

SEQ ID NO: 1749739 - RNA, 15 nt, Human herpesvirus 1
cgccucccccugagc

SEQ ID NO: 1749740 - RNA, 12 nt, Human herpesvirus 1
gcucgucgccug

SEQ ID NO: 1749741 - RNA, 18 nt, Human herpesvirus 1
gccccgguguccgagccc

SEQ ID NO: 1749742 - RNA, 20 nt, Human herpesvirus 1
gaacccccaucuaaugccac

SEQ ID NO: 1749743 - RNA, 13 nt, Human herpesvirus 1
ucgccccaguggc

SEQ ID NO: 1749744 - RNA, 14 nt, Human herpesvirus 1
caccccccaugucc

SEQ ID NO: 1749745 - RNA, 20 nt, Human herpesvirus 1
gacagaccuccccgcgcaug

SEQ ID NO: 1749746 - RNA, 15 nt, Human herpesvirus 1
aauuagaaacucauu

SEQ ID NO: 1749747 - RNA, 17 nt, Human herpesvirus 1
aguacgcccucccgcug

SEQ ID NO: 1749748 - RNA, 21 nt, Human herpesvirus 1
ccccuucuccccacaacaugg

SEQ ID NO: 1749749 - RNA, 14 nt, Human herpesvirus 1
cccuccccccgcgu

SEQ ID NO: 1749750 - RNA, 13 nt, Human herpesvirus 1
cgcggaggagcca

SEQ ID NO: 1749751 - RNA, 17 nt, Human herpesvirus 1
ggauggggagagcccac

SEQ ID NO: 1749752 - RNA, 14 nt, Human herpesvirus 1
gacugcaucggcaa

SEQ ID NO: 1749753 - RNA, 16 nt, Human herpesvirus 1
cgggcaccacacacca

SEQ ID NO: 1749754 - RNA, 13 nt, Human herpesvirus 1
uuggggggguccg

SEQ ID NO: 1749755 - RNA, 17 nt, Human herpesvirus 1
ccuugcggcagcgcucc

SEQ ID NO: 1749756 - RNA, 16 nt, Human herpesvirus 1
aaccccaccccugugc

SEQ ID NO: 1749757 - RNA, 13 nt, Human herpesvirus 1
gcgggggcgccgg

SEQ ID NO: 1749758 - RNA, 16 nt, Human herpesvirus 1
cggccaguugagccgc

SEQ ID NO: 1749759 - RNA, 22 nt, Human herpesvirus 1
gacccgcacgagccggggcugg

SEQ ID NO: 1749760 - RNA, 14 nt, Human herpesvirus 1
ccacgguaggccca

SEQ ID NO: 1749761 - RNA, 16 nt, Human herpesvirus 1
cacggcgucgcuguga

SEQ ID NO: 1749762 - RNA, 13 nt, Human herpesvirus 1
gcacgcccccgcg

SEQ ID NO: 1749763 - RNA, 16 nt, Human herpesvirus 1
ggaugcugccccgcuu

SEQ ID NO: 1749764 - RNA, 15 nt, Human herpesvirus 1
cccacgucgucucgg

SEQ ID NO: 1749765 - RNA, 18 nt, Human herpesvirus 1
uccgccugucgcacccac

SEQ ID NO: 1749766 - RNA, 16 nt, Human herpesvirus 1
cugcucacgaccccca

SEQ ID NO: 1749767 - RNA, 19 nt, Human herpesvirus 1
cgcggacggcgcggggccc

SEQ ID NO: 1749768 - RNA, 18 nt, Human herpesvirus 1
ccuuccuaacccagaccc

SEQ ID NO: 1749769 - RNA, 14 nt, Human herpesvirus 1
gaagaccagggccc

SEQ ID NO: 1749770 - RNA, 13 nt, Human herpesvirus 1
ccucgaggacacc

SEQ ID NO: 1749771 - RNA, 19 nt, Human herpesvirus 1
ucccccuccgcaucccagg

SEQ ID NO: 1749772 - RNA, 14 nt, Human herpesvirus 1
cucuacccucugga

SEQ ID NO: 1749773 - RNA, 13 nt, Human herpesvirus 1
caugcacgaccug

SEQ ID NO: 1749774 - RNA, 14 nt, Human herpesvirus 1
cgccucggccaccg

SEQ ID NO: 1749775 - RNA, 18 nt, Human herpesvirus 1
ggccaggggcauccggga

SEQ ID NO: 1749776 - RNA, 14 nt, Human herpesvirus 1
gcaacggggcgccg

SEQ ID NO: 1749777 - RNA, 17 nt, Human herpesvirus 1
ccaucugggauggcucc

SEQ ID NO: 1749778 - RNA, 23 nt, Human herpesvirus 1
ugccccuggugaagaccacuccc

SEQ ID NO: 1749779 - RNA, 16 nt, Human herpesvirus 1
ccacgcucuccccugc

SEQ ID NO: 1749780 - RNA, 17 nt, Human herpesvirus 1
cgcugcccuucugucug

SEQ ID NO: 1749781 - RNA, 23 nt, Human herpesvirus 1
cccaggcggcgaacgggggcccu

SEQ ID NO: 1749782 - RNA, 22 nt, Human herpesvirus 1
gauuccgccaacgcacuguggc

SEQ ID NO: 1749783 - RNA, 15 nt, Human herpesvirus 1
cacccucucuucccu

SEQ ID NO: 1749784 - RNA, 14 nt, Human herpesvirus 1
gcgggccucguggg

SEQ ID NO: 1749785 - RNA, 17 nt, Human herpesvirus 1
gcaucccccgucugggu

SEQ ID NO: 1749786 - RNA, 15 nt, Human herpesvirus 1
ucaaaaguuguuagc

SEQ ID NO: 1749787 - RNA, 15 nt, Human herpesvirus 1
uggacgcgccucccg

SEQ ID NO: 1749788 - RNA, 20 nt, Human herpesvirus 1
cacccccgaguucccccggg

SEQ ID NO: 1749789 - RNA, 19 nt, Human herpesvirus 1
cggggcuguacucgaccca

SEQ ID NO: 1749790 - RNA, 20 nt, Human herpesvirus 1
ccugcugcaggccccccgcc

SEQ ID NO: 1749791 - RNA, 14 nt, Human herpesvirus 1
agccccccagccuc

SEQ ID NO: 1749792 - RNA, 14 nt, Human herpesvirus 1
cuucuccccuuccc

SEQ ID NO: 1749793 - RNA, 17 nt, Human herpesvirus 1
cugcuuauucucgggga

SEQ ID NO: 1749794 - RNA, 16 nt, Human herpesvirus 1
cgagccggggcuggca

SEQ ID NO: 1749795 - RNA, 22 nt, Human herpesvirus 1
cccgcaauuugcacccagccuu

SEQ ID NO: 1749796 - RNA, 21 nt, Human herpesvirus 1
ccucccggaagagccugccgc

SEQ ID NO: 1749797 - RNA, 17 nt, Human herpesvirus 1
ucccagagaccccaggg

SEQ ID NO: 1749798 - RNA, 16 nt, Human herpesvirus 1
cucacccacgccggca

SEQ ID NO: 1749799 - RNA, 20 nt, Human herpesvirus 1
cucauuuguggacgccgggg

SEQ ID NO: 1749800 - RNA, 21 nt, Human herpesvirus 1
gcaccacggguauaaggacau

SEQ ID NO: 1749801 - RNA, 19 nt, Human herpesvirus 1
ucgagcagccgcgccgcug

SEQ ID NO: 1749802 - RNA, 17 nt, Human herpesvirus 1
cgcggcauaacuccgac

SEQ ID NO: 1749803 - RNA, 19 nt, Human herpesvirus 1
cggccacuggccgggagca

SEQ ID NO: 1749804 - RNA, 13 nt, Human herpesvirus 1
ugacagcggggac

SEQ ID NO: 1749805 - RNA, 21 nt, Human herpesvirus 1
cccucuuuuucuuuaaccgcg

SEQ ID NO: 1749806 - RNA, 23 nt, Human herpesvirus 1
agggaaagcaaagaggggcuggg

SEQ ID NO: 1749807 - RNA, 11 nt, Human herpesvirus 1
uccacggccac

SEQ ID NO: 1749808 - RNA, 23 nt, Human herpesvirus 1
gcggcgaccucggcgccucugga

SEQ ID NO: 1749809 - RNA, 13 nt, Human herpesvirus 1
cuucccucccccu

SEQ ID NO: 1749810 - RNA, 15 nt, Human herpesvirus 1
acgugcucgacagcc

SEQ ID NO: 1749811 - RNA, 11 nt, Human herpesvirus 1
ggauggggccc

SEQ ID NO: 1749812 - RNA, 20 nt, Human herpesvirus 1
gcucgcggagggcggccagc

SEQ ID NO: 1749813 - RNA, 13 nt, Human herpesvirus 1
gcgggggccccgc

SEQ ID NO: 1749814 - RNA, 18 nt, Human herpesvirus 1
gaguccugcgccccgccg

SEQ ID NO: 1749815 - RNA, 24 nt, Human herpesvirus 1
auggcacgaguucaaccucgggug

SEQ ID NO: 1749816 - RNA, 12 nt, Human herpesvirus 1
uuuccccucccg

SEQ ID NO: 1749817 - RNA, 13 nt, Human herpesvirus 1
uggcaggagccgc

SEQ ID NO: 1749818 - RNA, 21 nt, Human herpesvirus 1
gacgagacgaacucguggacg

SEQ ID NO: 1749819 - RNA, 19 nt, Human herpesvirus 1
cgcaugaucuccggacccc

SEQ ID NO: 1749820 - RNA, 18 nt, Human herpesvirus 1
cgaacaaacgacccacca

SEQ ID NO: 1749821 - RNA, 12 nt, Human herpesvirus 1
cgacaacugccu

SEQ ID NO: 1749822 - RNA, 18 nt, Human herpesvirus 1
ccuggucagaggcccacg

SEQ ID NO: 1749823 - RNA, 18 nt, Human herpesvirus 1
aauuugcacccagccuuu

SEQ ID NO: 1749824 - RNA, 14 nt, Human herpesvirus 1
ccucgcgggccucg

SEQ ID NO: 1749825 - RNA, 14 nt, Human herpesvirus 1
gaccucggcgccuc

SEQ ID NO: 1749826 - RNA, 22 nt, Human herpesvirus 1
ccacccaggugacgccuucgag

SEQ ID NO: 1749827 - RNA, 22 nt, Human herpesvirus 1
gcaggcgacggcgucucccggg

SEQ ID NO: 1749828 - RNA, 20 nt, Human herpesvirus 1
uuuaacuacauuaaauuggg

SEQ ID NO: 1749829 - RNA, 21 nt, Human herpesvirus 1
uacaaccacauacagcgccau

SEQ ID NO: 1749830 - RNA, 17 nt, Human herpesvirus 1
gcgggccccggggagac

SEQ ID NO: 1749831 - RNA, 15 nt, Human herpesvirus 1
ccacauacagcgcca

SEQ ID NO: 1749832 - RNA, 18 nt, Human herpesvirus 1
uuccagccccccagccuc

SEQ ID NO: 1749833 - RNA, 13 nt, Human herpesvirus 1
gauguaggcuggu

SEQ ID NO: 1749834 - RNA, 13 nt, Human herpesvirus 1
agggcgaggaggg

SEQ ID NO: 1749835 - RNA, 16 nt, Human herpesvirus 1
ccgacaccaccagcug

SEQ ID NO: 1749836 - RNA, 20 nt, Human herpesvirus 1
aaccucggaugacucagggc

SEQ ID NO: 1749837 - RNA, 13 nt, Human herpesvirus 1
gccgcccagcuca

SEQ ID NO: 1749838 - RNA, 20 nt, Human herpesvirus 1
cuggcgcggugccugacgcc

SEQ ID NO: 1749839 - RNA, 14 nt, Human herpesvirus 1
ggcgucgggcaugg

SEQ ID NO: 1749840 - RNA, 23 nt, Human herpesvirus 1
cgccggcggcgacgugcccccuc

SEQ ID NO: 1749841 - RNA, 19 nt, Human herpesvirus 1
ccgcaucccccgucugggu

SEQ ID NO: 1749842 - RNA, 14 nt, Human herpesvirus 1
gccccggcccccaa

SEQ ID NO: 1749843 - RNA, 21 nt, Human herpesvirus 1
acgguggugcccagcggccug

SEQ ID NO: 1749844 - RNA, 19 nt, Human herpesvirus 1
cucaacaucaccaugcugg

SEQ ID NO: 1749845 - RNA, 17 nt, Human herpesvirus 1
gccccggucuccccggg

SEQ ID NO: 1749846 - RNA, 17 nt, Human herpesvirus 1
cgccccucccccgaccu

SEQ ID NO: 1749847 - RNA, 23 nt, Human herpesvirus 1
caggaucacaccggucaacgagg

SEQ ID NO: 1749848 - RNA, 10 nt, Human herpesvirus 1
cugcgcggcg

SEQ ID NO: 1749849 - RNA, 15 nt, Human herpesvirus 1
gucccuccuuagcac

SEQ ID NO: 1749850 - RNA, 22 nt, Human herpesvirus 1
gccugggaucccacguccccgg

SEQ ID NO: 1749851 - RNA, 22 nt, Human herpesvirus 1
gcggccaucgaaaacuacgugc

SEQ ID NO: 1749852 - RNA, 16 nt, Human herpesvirus 1
acgcacccccugaccc

SEQ ID NO: 1749853 - RNA, 19 nt, Human herpesvirus 1
cccagcauguccgccggga

SEQ ID NO: 1749854 - RNA, 15 nt, Human herpesvirus 1
agccguaacccaacc

SEQ ID NO: 1749855 - RNA, 15 nt, Human herpesvirus 1
gugccgcuguggccu

SEQ ID NO: 1749856 - RNA, 19 nt, Human herpesvirus 1
acaaacccaaccgucccgu

SEQ ID NO: 1749857 - RNA, 18 nt, Human herpesvirus 1
gccgccucacgcccgcaa

SEQ ID NO: 1749858 - RNA, 18 nt, Human herpesvirus 1
gccguccucgcaccagcc

SEQ ID NO: 1749859 - RNA, 16 nt, Human herpesvirus 1
cccuuaauaaauuuua

SEQ ID NO: 1749860 - RNA, 15 nt, Human herpesvirus 1
ccacugccugcaucu

SEQ ID NO: 1749861 - RNA, 18 nt, Human herpesvirus 1
cacccggagguuccggag

SEQ ID NO: 1749862 - RNA, 13 nt, Human herpesvirus 1
cacgagcgccagc

SEQ ID NO: 1749863 - RNA, 16 nt, Human herpesvirus 1
cgagaucaaggacagc

SEQ ID NO: 1749864 - RNA, 18 nt, Human herpesvirus 1
gcgccaaacgccagccug

SEQ ID NO: 1749865 - RNA, 16 nt, Human herpesvirus 1
guaugacagcggggac

SEQ ID NO: 1749866 - RNA, 15 nt, Human herpesvirus 1
gcagacgcacccgcu

SEQ ID NO: 1749867 - RNA, 12 nt, Human herpesvirus 1
aucuugucccca

SEQ ID NO: 1749868 - RNA, 20 nt, Human herpesvirus 1
cagacucaagcacacacggg

SEQ ID NO: 1749869 - RNA, 13 nt, Human herpesvirus 1
ccugauggagccu

SEQ ID NO: 1749870 - RNA, 15 nt, Human herpesvirus 1
ucagccgggacgagg

SEQ ID NO: 1749871 - RNA, 11 nt, Human herpesvirus 1
ggucaccugcc

SEQ ID NO: 1749872 - RNA, 17 nt, Human herpesvirus 1
gcccgcaaacaggagcu

SEQ ID NO: 1749873 - RNA, 11 nt, Human herpesvirus 1
gguccccccuc

SEQ ID NO: 1749874 - RNA, 18 nt, Human herpesvirus 1
ccaccaaggcccgggcca

SEQ ID NO: 1749875 - RNA, 13 nt, Human herpesvirus 1
ugcuucccacgcg

SEQ ID NO: 1749876 - RNA, 16 nt, Human herpesvirus 1
acggccguugucuccc

SEQ ID NO: 1749877 - RNA, 13 nt, Human herpesvirus 1
gccaccagccugg

SEQ ID NO: 1749878 - RNA, 14 nt, Human herpesvirus 1
cccagcgaccccac

SEQ ID NO: 1749879 - RNA, 16 nt, Human herpesvirus 1
ucccguagucccaucc

SEQ ID NO: 1749880 - RNA, 20 nt, Human herpesvirus 1
ugcucuggggucccugucgc

SEQ ID NO: 1749881 - RNA, 15 nt, Human herpesvirus 1
uccacaccugcacca

SEQ ID NO: 1749882 - RNA, 20 nt, Human herpesvirus 1
aaagcaagaacaauaaaggc

SEQ ID NO: 1749883 - RNA, 18 nt, Human herpesvirus 1
ugguccgcggggccuccc

SEQ ID NO: 1749884 - RNA, 12 nt, Human herpesvirus 1
acggaccgucug

SEQ ID NO: 1749885 - RNA, 19 nt, Human herpesvirus 1
ccuggcggacggcggccau

SEQ ID NO: 1749886 - RNA, 13 nt, Human herpesvirus 1
cucaacaucacca

SEQ ID NO: 1749887 - RNA, 17 nt, Human herpesvirus 1
gccaacaauccccagga

SEQ ID NO: 1749888 - RNA, 19 nt, Human herpesvirus 1
ucagcuguggacccgagcu

SEQ ID NO: 1749889 - RNA, 22 nt, Human herpesvirus 1
cggucuccccgggagccccgga

SEQ ID NO: 1749890 - RNA, 17 nt, Human herpesvirus 1
cgcgucucuggggagcc

SEQ ID NO: 1749891 - RNA, 24 nt, Human herpesvirus 1
ccagaucuacugcugggccaugga

SEQ ID NO: 1749892 - RNA, 14 nt, Human herpesvirus 1
gcaagaacaauaaa

SEQ ID NO: 1749893 - RNA, 19 nt, Human herpesvirus 1
acuacauuaaauuggguuc

SEQ ID NO: 1749894 - RNA, 22 nt, Human herpesvirus 1
cuguaccggugggcguccugga

SEQ ID NO: 1749895 - RNA, 12 nt, Human herpesvirus 1
gugcccccgcgc

SEQ ID NO: 1749896 - RNA, 12 nt, Human herpesvirus 1
acgaccacgaga

SEQ ID NO: 1749897 - RNA, 21 nt, Human herpesvirus 1
ccuccgcgccaggcccgccgc

SEQ ID NO: 1749898 - RNA, 21 nt, Human herpesvirus 1
ccggggcucucggggccgcag

SEQ ID NO: 1749899 - RNA, 14 nt, Human herpesvirus 1
gcauacgcucgggc

SEQ ID NO: 1749900 - RNA, 17 nt, Human herpesvirus 1
uggccggggagggcagg

SEQ ID NO: 1749901 - RNA, 16 nt, Human herpesvirus 1
guuccguuuuccggaa

SEQ ID NO: 1749902 - RNA, 12 nt, Human herpesvirus 1
augguugcagug

SEQ ID NO: 1749903 - RNA, 20 nt, Human herpesvirus 1
ggccggggagggcagggccg

SEQ ID NO: 1749904 - RNA, 17 nt, Human herpesvirus 1
ggaccaccgccccccug

SEQ ID NO: 1749905 - RNA, 23 nt, Human herpesvirus 1
ugggccauggacagcgaccuggg

SEQ ID NO: 1749906 - RNA, 14 nt, Human herpesvirus 1
ccuccgaggagauc

SEQ ID NO: 1749907 - RNA, 15 nt, Human herpesvirus 1
caucgccucggccac

SEQ ID NO: 1749908 - RNA, 22 nt, Human herpesvirus 1
ccccguccccuucgaggaggug

SEQ ID NO: 1749909 - RNA, 18 nt, Human herpesvirus 1
caucagccucgucccgcc

SEQ ID NO: 1749910 - RNA, 22 nt, Human herpesvirus 1
cuggggucgcggccgcgaccca

SEQ ID NO: 1749911 - RNA, 12 nt, Human herpesvirus 1
cgggaggaagcc

SEQ ID NO: 1749912 - RNA, 23 nt, Human herpesvirus 1
ggcgcguguacugcggucugucu

SEQ ID NO: 1749913 - RNA, 22 nt, Human herpesvirus 1
ccugggauccgacccccaugga

SEQ ID NO: 1749914 - RNA, 15 nt, Human herpesvirus 1
cccaacuccagacca

SEQ ID NO: 1749915 - RNA, 14 nt, Human herpesvirus 1
guauggggggggcu

SEQ ID NO: 1749916 - RNA, 15 nt, Human herpesvirus 1
gcaguucgagcagcc

SEQ ID NO: 1749917 - RNA, 17 nt, Human herpesvirus 1
cacauaaccgaccgcag

SEQ ID NO: 1749918 - RNA, 12 nt, Human herpesvirus 1
ccgacgccucaa

SEQ ID NO: 1749919 - RNA, 16 nt, Human herpesvirus 1
aucaaggugggccagc

SEQ ID NO: 1749920 - RNA, 15 nt, Human herpesvirus 1
guccugcgccccgcc

SEQ ID NO: 1749921 - RNA, 12 nt, Human herpesvirus 1
ucccugggcccu

SEQ ID NO: 1749922 - RNA, 16 nt, Human herpesvirus 1
gggagcgcucuugucu

SEQ ID NO: 1749923 - RNA, 14 nt, Human herpesvirus 1
cagagccgcccguc

SEQ ID NO: 1749924 - RNA, 18 nt, Human herpesvirus 1
aggucaaaugccgggcca

SEQ ID NO: 1749925 - RNA, 17 nt, Human herpesvirus 1
cccagagaccccagggu

SEQ ID NO: 1749926 - RNA, 14 nt, Human herpesvirus 1
gcgcccuccugacc

SEQ ID NO: 1749927 - RNA, 23 nt, Human herpesvirus 1
cucggggccgcaggacccagcaa

SEQ ID NO: 1749928 - RNA, 15 nt, Human herpesvirus 1
uccgugucggggagg

SEQ ID NO: 1749929 - RNA, 20 nt, Human herpesvirus 1
gaccgggucccuccuuagca

SEQ ID NO: 1749930 - RNA, 23 nt, Human herpesvirus 1
ucugggccaccgacagccugaac

SEQ ID NO: 1749931 - RNA, 17 nt, Human herpesvirus 1
cggcaauucccgcggcc

SEQ ID NO: 1749932 - RNA, 18 nt, Human herpesvirus 1
auggugaucgccugucuc

SEQ ID NO: 1749933 - RNA, 17 nt, Human herpesvirus 1
ccgacaacagcccccgg

SEQ ID NO: 1749934 - RNA, 16 nt, Human herpesvirus 1
cgaccucaacaucacc

SEQ ID NO: 1749935 - RNA, 21 nt, Human herpesvirus 1
gacgcugcuccgccuggccug

SEQ ID NO: 1749936 - RNA, 16 nt, Human herpesvirus 1
ccgcgagauggccgcc

SEQ ID NO: 1749937 - RNA, 19 nt, Human herpesvirus 1
gccgaccgcuucaagcagg

SEQ ID NO: 1749938 - RNA, 22 nt, Human herpesvirus 1
gagaucuauaaggccauccagc

SEQ ID NO: 1749939 - RNA, 21 nt, Human herpesvirus 1
cgcugggcgagguggagcugc

SEQ ID NO: 1749940 - RNA, 14 nt, Human herpesvirus 1
accaccgaccucaa

SEQ ID NO: 1749941 - RNA, 13 nt, Human herpesvirus 1
uacaaccugacca

SEQ ID NO: 1749942 - RNA, 20 nt, Human herpesvirus 1
ccuuugcgcucccgccuucc

SEQ ID NO: 1749943 - RNA, 15 nt, Human herpesvirus 1
cuaucgcucgaccuc

SEQ ID NO: 1749944 - RNA, 19 nt, Human herpesvirus 1
ccaagcuagccgaggcccg

SEQ ID NO: 1749945 - RNA, 23 nt, Human herpesvirus 1
cugacccucuccgggaugggcua

SEQ ID NO: 1749946 - RNA, 15 nt, Human herpesvirus 1
ccuccccgcacagau

SEQ ID NO: 1749947 - RNA, 17 nt, Human herpesvirus 1
agccccucgcccguccu

SEQ ID NO: 1749948 - RNA, 19 nt, Human herpesvirus 1
ccggcggucgcgcuccucu

SEQ ID NO: 1749949 - RNA, 17 nt, Human herpesvirus 1
cgcaucuuuccugugug

SEQ ID NO: 1749950 - RNA, 20 nt, Human herpesvirus 1
cacaaacaucuggaggcuuu

SEQ ID NO: 1749951 - RNA, 15 nt, Human herpesvirus 1
caaccagcugcacga

SEQ ID NO: 1749952 - RNA, 18 nt, Human herpesvirus 1
ucuucggggcccggccca

SEQ ID NO: 1749953 - RNA, 12 nt, Human herpesvirus 1
caguggcuccgg

SEQ ID NO: 1749954 - RNA, 13 nt, Human herpesvirus 1
uuuaaccuccccc

SEQ ID NO: 1749955 - RNA, 15 nt, Human herpesvirus 1
uggucagaggcccac

SEQ ID NO: 1749956 - RNA, 15 nt, Human herpesvirus 1
cacgaacccccaucu

SEQ ID NO: 1749957 - RNA, 14 nt, Human herpesvirus 1
cgggcgcugggugg

SEQ ID NO: 1749958 - RNA, 19 nt, Human herpesvirus 1
cgccccgacccccuuguau

SEQ ID NO: 1749959 - RNA, 20 nt, Human herpesvirus 1
gaguuuguggacccaaagcc

SEQ ID NO: 1749960 - RNA, 12 nt, Human herpesvirus 1
gcgcggcugcca

SEQ ID NO: 1749961 - RNA, 16 nt, Human herpesvirus 1
accaccauccccgcuc

SEQ ID NO: 1749962 - RNA, 20 nt, Human herpesvirus 1
accacgcccgaccacacacc

SEQ ID NO: 1749963 - RNA, 20 nt, Human herpesvirus 1
ucggggaggggaaaagugaa

SEQ ID NO: 1749964 - RNA, 18 nt, Human herpesvirus 1
ccgaacugggcgaccgcc

SEQ ID NO: 1749965 - RNA, 21 nt, Human herpesvirus 1
ccggcgggguuauaggccacg

SEQ ID NO: 1749966 - RNA, 18 nt, Human herpesvirus 1
ccgcguggaucggcgcca

SEQ ID NO: 1749967 - RNA, 19 nt, Human herpesvirus 1
cacccgccccuccauccca

SEQ ID NO: 1749968 - RNA, 19 nt, Human herpesvirus 1
acggggaccgggacugggu

SEQ ID NO: 1749969 - RNA, 20 nt, Human herpesvirus 1
cgaacaaacgacccaccaau

SEQ ID NO: 1749970 - RNA, 22 nt, Human herpesvirus 1
ucugggauggcuccuggccagg

SEQ ID NO: 1749971 - RNA, 14 nt, Human herpesvirus 1
gcggguccagaggg

SEQ ID NO: 1749972 - RNA, 14 nt, Human herpesvirus 1
cucccggaagagcc

SEQ ID NO: 1749973 - RNA, 20 nt, Human herpesvirus 1
ucuuccacgaacccagcgac

SEQ ID NO: 1749974 - RNA, 15 nt, Human herpesvirus 1
ccccgcgcggcugcc

SEQ ID NO: 1749975 - RNA, 23 nt, Human herpesvirus 1
ggucucccagggagccccggucu

SEQ ID NO: 1749976 - RNA, 19 nt, Human herpesvirus 1
ucaacgauauguugggccg

SEQ ID NO: 1749977 - RNA, 15 nt, Human herpesvirus 1
ccuugcggcagcgcu

SEQ ID NO: 1749978 - RNA, 16 nt, Human herpesvirus 1
cgguagcgggggacgc

SEQ ID NO: 1749979 - RNA, 23 nt, Human herpesvirus 1
acagaugucaacgccgcuaccga

SEQ ID NO: 1749980 - RNA, 14 nt, Human herpesvirus 1
ucgagcgccaccug

SEQ ID NO: 1749981 - RNA, 17 nt, Human herpesvirus 1
ugaaaccggccaacgcc

SEQ ID NO: 1749982 - RNA, 22 nt, Human herpesvirus 1
gcugccgucgcuagaccacgcc

SEQ ID NO: 1749983 - RNA, 17 nt, Human herpesvirus 1
uuccaggucccaccuga

SEQ ID NO: 1749984 - RNA, 11 nt, Human herpesvirus 1
cuccuuagcac

SEQ ID NO: 1749985 - RNA, 17 nt, Human herpesvirus 1
ccuuugacggcgcggcc

SEQ ID NO: 1749986 - RNA, 14 nt, Human herpesvirus 1
cccaacuccagacc

SEQ ID NO: 1749987 - RNA, 23 nt, Human herpesvirus 1
gcugcagaaucacgagcugaccc

SEQ ID NO: 1749988 - RNA, 13 nt, Human herpesvirus 1
gauaaaaagccag

SEQ ID NO: 1749989 - RNA, 14 nt, Human herpesvirus 1
cgccccggccgccu

SEQ ID NO: 1749990 - RNA, 22 nt, Human herpesvirus 1
gccccguacaaguucaaggcca

SEQ ID NO: 1749991 - RNA, 10 nt, Human herpesvirus 1
gcgccaggcc

SEQ ID NO: 1749992 - RNA, 21 nt, Human herpesvirus 1
cggaaacugccuccaccgggc

SEQ ID NO: 1749993 - RNA, 17 nt, Human herpesvirus 1
cuuugggcgggaggaag

SEQ ID NO: 1749994 - RNA, 12 nt, Human herpesvirus 1
ggccccccgccg

SEQ ID NO: 1749995 - RNA, 13 nt, Human herpesvirus 1
gcccccagggucc

SEQ ID NO: 1749996 - RNA, 14 nt, Human herpesvirus 1
ucccaggaucacac

SEQ ID NO: 1749997 - RNA, 13 nt, Human herpesvirus 1
ggggccggggacg

SEQ ID NO: 1749998 - RNA, 18 nt, Human herpesvirus 1
agcuugcgucccuccccg

SEQ ID NO: 1749999 - RNA, 19 nt, Human herpesvirus 1
ggccuccgcguacgaggac

SEQ ID NO: 1750000 - RNA, 12 nt, Human herpesvirus 1
cgcgcgcgcuuu

SEQ ID NO: 1750001 - RNA, 15 nt, Human herpesvirus 1
ccgggucuguugggg

SEQ ID NO: 1750002 - RNA, 21 nt, Human herpesvirus 1
guuccgccugucgcacccaca

SEQ ID NO: 1750003 - RNA, 23 nt, Human herpesvirus 1
ggcucaagaucuuucggugucua

SEQ ID NO: 1750004 - RNA, 23 nt, Human herpesvirus 1
gccgcgguacagaucggcgccgc

SEQ ID NO: 1750005 - RNA, 21 nt, Human herpesvirus 1
ggggccccgacgcaccccccc

SEQ ID NO: 1750006 - RNA, 15 nt, Human herpesvirus 1
ggcaugcaccccaga

SEQ ID NO: 1750007 - RNA, 18 nt, Human herpesvirus 1
cgggcgacgcacacaccc

SEQ ID NO: 1750008 - RNA, 13 nt, Human herpesvirus 1
augcacgcccccg

SEQ ID NO: 1750009 - RNA, 18 nt, Human herpesvirus 1
ccgacggcguaguggagg

SEQ ID NO: 1750010 - RNA, 14 nt, Human herpesvirus 1
gcccuaaccccacc

SEQ ID NO: 1750011 - RNA, 23 nt, Human herpesvirus 1
cacgcgcggcugguccacaccca

SEQ ID NO: 1750012 - RNA, 14 nt, Human herpesvirus 1
aucgccugucuccu

SEQ ID NO: 1750013 - RNA, 17 nt, Human herpesvirus 1
aucagcuguggacccga

SEQ ID NO: 1750014 - RNA, 19 nt, Human herpesvirus 1
acccccucgaccaccaucc

SEQ ID NO: 1750015 - RNA, 17 nt, Human herpesvirus 1
ccgcuaucuccuggggg

SEQ ID NO: 1750016 - RNA, 12 nt, Human herpesvirus 1
uuaauguaaaua

SEQ ID NO: 1750017 - RNA, 14 nt, Human herpesvirus 1
guugcagggccugg

SEQ ID NO: 1750018 - RNA, 16 nt, Human herpesvirus 1
agucccgaagaccgcc

SEQ ID NO: 1750019 - RNA, 21 nt, Human herpesvirus 1
agcgccggcggucgcgcuccu

SEQ ID NO: 1750020 - RNA, 13 nt, Human herpesvirus 1
cuuggagccagcc

SEQ ID NO: 1750021 - RNA, 14 nt, Human herpesvirus 1
cuuggucuggccca

SEQ ID NO: 1750022 - RNA, 18 nt, Human herpesvirus 1
ccugcccgacagggccgu

SEQ ID NO: 1750023 - RNA, 18 nt, Human herpesvirus 1
gcccagcggccuggacgu

SEQ ID NO: 1750024 - RNA, 19 nt, Human herpesvirus 1
ccucccccgcccuggacac

SEQ ID NO: 1750025 - RNA, 23 nt, Human herpesvirus 1
cagccuucucccggugccuuucc

SEQ ID NO: 1750026 - RNA, 14 nt, Human herpesvirus 1
cucccgacaccacc

SEQ ID NO: 1750027 - RNA, 20 nt, Human herpesvirus 1
cagcaaauaugccuuggugg

SEQ ID NO: 1750028 - RNA, 12 nt, Human herpesvirus 1
aagcuagccgag

SEQ ID NO: 1750029 - RNA, 14 nt, Human herpesvirus 1
gaccuugccccggc

SEQ ID NO: 1750030 - RNA, 14 nt, Human herpesvirus 1
ggcccgccucggag

SEQ ID NO: 1750031 - RNA, 14 nt, Human herpesvirus 1
caaugggccgggcc

SEQ ID NO: 1750032 - RNA, 22 nt, Human herpesvirus 1
cgcgaagacccccccggagccg

SEQ ID NO: 1750033 - RNA, 18 nt, Human herpesvirus 1
ggcguccuggaugcugug

SEQ ID NO: 1750034 - RNA, 23 nt, Human herpesvirus 1
caaccucgggugcauauccuggg

SEQ ID NO: 1750035 - RNA, 16 nt, Human herpesvirus 1
agccacccacgccgcc

SEQ ID NO: 1750036 - RNA, 19 nt, Human herpesvirus 1
cgcgcgucucuggggagcc

SEQ ID NO: 1750037 - RNA, 17 nt, Human herpesvirus 1
cugcgaguccugcgccc

SEQ ID NO: 1750038 - RNA, 15 nt, Human herpesvirus 1
cuacaccagccaauc

SEQ ID NO: 1750039 - RNA, 13 nt, Human herpesvirus 1
cggaggagccagu

SEQ ID NO: 1750040 - RNA, 13 nt, Human herpesvirus 1
gaaagcaagaaca

SEQ ID NO: 1750041 - RNA, 22 nt, Human herpesvirus 1
ccguccgccggcaugcacccca

SEQ ID NO: 1750042 - RNA, 14 nt, Human herpesvirus 1
cgccguccuugcau

SEQ ID NO: 1750043 - RNA, 21 nt, Human herpesvirus 1
gcugcgcggcguccgcgcccc

SEQ ID NO: 1750044 - RNA, 14 nt, Human herpesvirus 1
caugacccagaccg

SEQ ID NO: 1750045 - RNA, 22 nt, Human herpesvirus 1
gccagaucuacugcugggccau

SEQ ID NO: 1750046 - RNA, 12 nt, Human herpesvirus 1
caauccccagga

SEQ ID NO: 1750047 - RNA, 15 nt, Human herpesvirus 1
cgucgccgcgggcca

SEQ ID NO: 1750048 - RNA, 14 nt, Human herpesvirus 1
ggcgggacuggcca

SEQ ID NO: 1750049 - RNA, 18 nt, Human herpesvirus 1
ugaacgaagcggccaugg

SEQ ID NO: 1750050 - RNA, 19 nt, Human herpesvirus 1
agcggcacgaccggcucca

SEQ ID NO: 1750051 - RNA, 21 nt, Human herpesvirus 1
cgcuauaaagccgccacccuc

SEQ ID NO: 1750052 - RNA, 19 nt, Human herpesvirus 1
uauucccaaacagggccuu

SEQ ID NO: 1750053 - RNA, 19 nt, Human herpesvirus 1
gcugcgaguccugcgcccc

SEQ ID NO: 1750054 - RNA, 23 nt, Human herpesvirus 1
gcacaacacaaacaucuggaggc

SEQ ID NO: 1750055 - RNA, 18 nt, Human herpesvirus 1
cguuccucacugccuccc

SEQ ID NO: 1750056 - RNA, 19 nt, Human herpesvirus 1
cggggaccuugccccggcc

SEQ ID NO: 1750057 - RNA, 16 nt, Human herpesvirus 1
ccgccugucgcucguc

SEQ ID NO: 1750058 - RNA, 14 nt, Human herpesvirus 1
ccggcgccgacacg

SEQ ID NO: 1750059 - RNA, 16 nt, Human herpesvirus 1
ccgauggcccuccagg

SEQ ID NO: 1750060 - RNA, 15 nt, Human herpesvirus 1
agcgccccggcgacc

SEQ ID NO: 1750061 - RNA, 15 nt, Human herpesvirus 1
cucggcgggcacgcc

SEQ ID NO: 1750062 - RNA, 20 nt, Human herpesvirus 1
ucccgcaauuucaccgcccc

SEQ ID NO: 1750063 - RNA, 15 nt, Human herpesvirus 1
gcacgccaaugcccu

SEQ ID NO: 1750064 - RNA, 20 nt, Human herpesvirus 1
ccgucgccgcgggccacgcc

SEQ ID NO: 1750065 - RNA, 15 nt, Human herpesvirus 1
cagccuucucccggu

SEQ ID NO: 1750066 - RNA, 16 nt, Human herpesvirus 1
gaccgcaucgacacgc

SEQ ID NO: 1750067 - RNA, 13 nt, Human herpesvirus 1
cucaaucuggccc

SEQ ID NO: 1750068 - RNA, 22 nt, Human herpesvirus 1
ccuugguuccgacgccucaaca

SEQ ID NO: 1750069 - RNA, 21 nt, Human herpesvirus 1
acgcccccgccgcccggggcc

SEQ ID NO: 1750070 - RNA, 13 nt, Human herpesvirus 1
uccggccugggcc

SEQ ID NO: 1750071 - RNA, 22 nt, Human herpesvirus 1
cggccguuucuccgcccgaccg

SEQ ID NO: 1750072 - RNA, 15 nt, Human herpesvirus 1
ugcucgacagccacu

SEQ ID NO: 1750073 - RNA, 16 nt, Human herpesvirus 1
caggccgacugccagc

SEQ ID NO: 1750074 - RNA, 14 nt, Human herpesvirus 1
cucggaaacugccu

SEQ ID NO: 1750075 - RNA, 18 nt, Human herpesvirus 1
cgucauagugggccucca

SEQ ID NO: 1750076 - RNA, 17 nt, Human herpesvirus 1
uggcgagcccagacccc

SEQ ID NO: 1750077 - RNA, 15 nt, Human herpesvirus 1
ugcacucccugccgc

SEQ ID NO: 1750078 - RNA, 15 nt, Human herpesvirus 1
gcgggauccucggcc

SEQ ID NO: 1750079 - RNA, 20 nt, Human herpesvirus 1
aacucucaguuuaucaugga

SEQ ID NO: 1750080 - RNA, 17 nt, Human herpesvirus 1
gaccccacgacacccac

SEQ ID NO: 1750081 - RNA, 14 nt, Human herpesvirus 1
gaaagcaagaacaa

SEQ ID NO: 1750082 - RNA, 20 nt, Human herpesvirus 1
ccagcccucucccccgcucu

SEQ ID NO: 1750083 - RNA, 22 nt, Human herpesvirus 1
cccaacucucgcaccaucccgg

SEQ ID NO: 1750084 - RNA, 14 nt, Human herpesvirus 1
ccccccgcugcggc

SEQ ID NO: 1750085 - RNA, 17 nt, Human herpesvirus 1
gccaaacgccagccugu

SEQ ID NO: 1750086 - RNA, 18 nt, Human herpesvirus 1
augucggguccaaacucc

SEQ ID NO: 1750087 - RNA, 20 nt, Human herpesvirus 1
ccgcaucccccgucuggguu

SEQ ID NO: 1750088 - RNA, 15 nt, Human herpesvirus 1
cggcucggccuaugg

SEQ ID NO: 1750089 - RNA, 14 nt, Human herpesvirus 1
ccccaaggcgcugc

SEQ ID NO: 1750090 - RNA, 20 nt, Human herpesvirus 1
gcccgacagaccuccccgcg

SEQ ID NO: 1750091 - RNA, 23 nt, Human herpesvirus 1
accccgagaaccuagggaaccca

SEQ ID NO: 1750092 - RNA, 11 nt, Human herpesvirus 1
gauuuggguug

SEQ ID NO: 1750093 - RNA, 17 nt, Human herpesvirus 1
cagggccucgcugacca

SEQ ID NO: 1750094 - RNA, 17 nt, Human herpesvirus 1
ccaccgccaucagccuu

SEQ ID NO: 1750095 - RNA, 17 nt, Human herpesvirus 1
ucccugucgccucccaa

SEQ ID NO: 1750096 - RNA, 21 nt, Human herpesvirus 1
ccuucgacguggaggaaggcg

SEQ ID NO: 1750097 - RNA, 15 nt, Human herpesvirus 1
cucuucuccccuucc

SEQ ID NO: 1750098 - RNA, 14 nt, Human herpesvirus 1
ucccugucgccucc

SEQ ID NO: 1750099 - RNA, 21 nt, Human herpesvirus 1
cagcgacguccugggccaccu

SEQ ID NO: 1750100 - RNA, 22 nt, Human herpesvirus 1
cagccccgcauaucccacccug

SEQ ID NO: 1750101 - RNA, 17 nt, Human herpesvirus 1
uccggagacauggcccc

SEQ ID NO: 1750102 - RNA, 17 nt, Human herpesvirus 1
gccuucacgugcugcug

SEQ ID NO: 1750103 - RNA, 15 nt, Human herpesvirus 1
agggcagggccgcgg

SEQ ID NO: 1750104 - RNA, 12 nt, Human herpesvirus 1
ucucccuguuca

SEQ ID NO: 1750105 - RNA, 19 nt, Human herpesvirus 1
ucccucauuuuacaauaaa

SEQ ID NO: 1750106 - RNA, 23 nt, Human herpesvirus 1
accccccaccauuaucgggccgc

SEQ ID NO: 1750107 - RNA, 22 nt, Human herpesvirus 1
ccgcaauuucaccgccccagca

SEQ ID NO: 1750108 - RNA, 15 nt, Human herpesvirus 1
acgagaugcugcgcu

SEQ ID NO: 1750109 - RNA, 15 nt, Human herpesvirus 1
accgacagcacucac

SEQ ID NO: 1750110 - RNA, 13 nt, Human herpesvirus 1
gacccccuuguau

SEQ ID NO: 1750111 - RNA, 14 nt, Human herpesvirus 1
accgcccgccccuc

SEQ ID NO: 1750112 - RNA, 22 nt, Human herpesvirus 1
gcuccuuagcgcggccgugggc

SEQ ID NO: 1750113 - RNA, 17 nt, Human herpesvirus 1
aggggggaaagguggac

SEQ ID NO: 1750114 - RNA, 23 nt, Human herpesvirus 1
ggccccggggagacagcgccugc

SEQ ID NO: 1750115 - RNA, 22 nt, Human herpesvirus 1
ugcugcaggccccccgccgucc

SEQ ID NO: 1750116 - RNA, 19 nt, Human herpesvirus 1
ccucugggcccgccuggau

SEQ ID NO: 1750117 - RNA, 12 nt, Human herpesvirus 1
caucgccccugg

SEQ ID NO: 1750118 - RNA, 20 nt, Human herpesvirus 1
ccaccgugggccggcgggug

SEQ ID NO: 1750119 - RNA, 21 nt, Human herpesvirus 1
ggagcuguccgagacccccaa

SEQ ID NO: 1750120 - RNA, 14 nt, Human herpesvirus 1
cagcccccccaagc

SEQ ID NO: 1750121 - RNA, 19 nt, Human herpesvirus 1
cugcuccgcaacggggcgc

SEQ ID NO: 1750122 - RNA, 21 nt, Human herpesvirus 1
cggugguccgccuagccgcag

SEQ ID NO: 1750123 - RNA, 14 nt, Human herpesvirus 1
agugggccuccaug

SEQ ID NO: 1750124 - RNA, 14 nt, Human herpesvirus 1
agccacccacccac

SEQ ID NO: 1750125 - RNA, 13 nt, Human herpesvirus 1
cggcgucugggcc

SEQ ID NO: 1750126 - RNA, 21 nt, Human herpesvirus 1
cuccggggggcuuccggccug

SEQ ID NO: 1750127 - RNA, 20 nt, Human herpesvirus 1
gccucugggucugugccacc

SEQ ID NO: 1750128 - RNA, 21 nt, Human herpesvirus 1
accggcaccaccgacucuccc

SEQ ID NO: 1750129 - RNA, 22 nt, Human herpesvirus 1
cgaagcugcucucgcacucgag

SEQ ID NO: 1750130 - RNA, 13 nt, Human herpesvirus 1
ccacccgaaccac

SEQ ID NO: 1750131 - RNA, 21 nt, Human herpesvirus 1
gcgugcuccuaaacgcaccgu

SEQ ID NO: 1750132 - RNA, 18 nt, Human herpesvirus 1
gcccacgucgccccgccg

SEQ ID NO: 1750133 - RNA, 14 nt, Human herpesvirus 1
cugggaccccggcg

SEQ ID NO: 1750134 - RNA, 18 nt, Human herpesvirus 1
uagucccaucccccgauc

SEQ ID NO: 1750135 - RNA, 17 nt, Human herpesvirus 1
uacaccggccacccagg

SEQ ID NO: 1750136 - RNA, 15 nt, Human herpesvirus 1
gugcgggcggcccug

SEQ ID NO: 1750137 - RNA, 19 nt, Human herpesvirus 1
ccggcggcgacgugccccc

SEQ ID NO: 1750138 - RNA, 20 nt, Human herpesvirus 1
uguuggagcgcgccugccgc

SEQ ID NO: 1750139 - RNA, 20 nt, Human herpesvirus 1
ggggcauccgggaccugaac

SEQ ID NO: 1750140 - RNA, 14 nt, Human herpesvirus 1
ggcgcuuggccggg

SEQ ID NO: 1750141 - RNA, 16 nt, Human herpesvirus 1
gggcccgggggccugg

SEQ ID NO: 1750142 - RNA, 17 nt, Human herpesvirus 1
cgcccccagcugggccc

SEQ ID NO: 1750143 - RNA, 21 nt, Human herpesvirus 1
gccgccaccguggccggccug

SEQ ID NO: 1750144 - RNA, 21 nt, Human herpesvirus 1
ucuaacgguccucaccgagcc

SEQ ID NO: 1750145 - RNA, 18 nt, Human herpesvirus 1
cugccgucgcuagaccac

SEQ ID NO: 1750146 - RNA, 15 nt, Human herpesvirus 1
cgcgcgaccucacca

SEQ ID NO: 1750147 - RNA, 16 nt, Human herpesvirus 1
ggcgguucgccgccac

SEQ ID NO: 1750148 - RNA, 17 nt, Human herpesvirus 1
cgugcucgugugguaca

SEQ ID NO: 1750149 - RNA, 21 nt, Human herpesvirus 1
cacucaaaaagccccaaagcg

SEQ ID NO: 1750150 - RNA, 16 nt, Human herpesvirus 1
gcgagcucccagagac

SEQ ID NO: 1750151 - RNA, 19 nt, Human herpesvirus 1
gcccacuacaccagccaau

SEQ ID NO: 1750152 - RNA, 15 nt, Human herpesvirus 1
cacccaguggcuccg

SEQ ID NO: 1750153 - RNA, 13 nt, Human herpesvirus 1
ccugucgcaccca

SEQ ID NO: 1750154 - RNA, 16 nt, Human herpesvirus 1
cgcaucaagaccaccu

SEQ ID NO: 1750155 - RNA, 18 nt, Human herpesvirus 1
cgccggguggcacgggcc

SEQ ID NO: 1750156 - RNA, 15 nt, Human herpesvirus 1
ggaaagcaagaacaa

SEQ ID NO: 1750157 - RNA, 21 nt, Human herpesvirus 1
uauagccuaugccacgccagg

SEQ ID NO: 1750158 - RNA, 21 nt, Human herpesvirus 1
cguuauucccaaacagggccu

SEQ ID NO: 1750159 - RNA, 21 nt, Human herpesvirus 1
cuaaacgcaccgucggaggcc

SEQ ID NO: 1750160 - RNA, 15 nt, Human herpesvirus 1
acgccaacgccgcca

SEQ ID NO: 1750161 - RNA, 19 nt, Human herpesvirus 1
guccaccaaagucucugug

SEQ ID NO: 1750162 - RNA, 22 nt, Human herpesvirus 1
ccugcucgggcaggugcagacc

SEQ ID NO: 1750163 - RNA, 23 nt, Human herpesvirus 1
ggccauuaacuuuaucaccacca

SEQ ID NO: 1750164 - RNA, 18 nt, Human herpesvirus 1
ccagccagggcggcggua

SEQ ID NO: 1750165 - RNA, 15 nt, Human herpesvirus 1
gugcgccaggucggc

SEQ ID NO: 1750166 - RNA, 12 nt, Human herpesvirus 1
uccgcgccccuc

SEQ ID NO: 1750167 - RNA, 21 nt, Human herpesvirus 1
ccgcaauuugcacccagccuu

SEQ ID NO: 1750168 - RNA, 21 nt, Human herpesvirus 1
gugguccgcggggccuccccc

SEQ ID NO: 1750169 - RNA, 17 nt, Human herpesvirus 1
acgccucccccacaucc

SEQ ID NO: 1750170 - RNA, 15 nt, Human herpesvirus 1
uaaaauaaauuauug

SEQ ID NO: 1750171 - RNA, 16 nt, Human herpesvirus 1
cucaacgagcuccugg

SEQ ID NO: 1750172 - RNA, 14 nt, Human herpesvirus 1
cuacugcugggcca

SEQ ID NO: 1750173 - RNA, 18 nt, Human herpesvirus 1
uacgcuucggccgccacc

SEQ ID NO: 1750174 - RNA, 21 nt, Human herpesvirus 1
ugcccucgcgggccucguggg

SEQ ID NO: 1750175 - RNA, 17 nt, Human herpesvirus 1
ucgcagggcgccaugcg

SEQ ID NO: 1750176 - RNA, 18 nt, Human herpesvirus 1
gcccgggccacggcgccg

SEQ ID NO: 1750177 - RNA, 20 nt, Human herpesvirus 1
gccccauacacgagcacccu

SEQ ID NO: 1750178 - RNA, 18 nt, Human herpesvirus 1
acgugcgcgaucccccgc

SEQ ID NO: 1750179 - RNA, 15 nt, Human herpesvirus 1
cccaucagccucguc

SEQ ID NO: 1750180 - RNA, 17 nt, Human herpesvirus 1
ccccgcuucauccccga

SEQ ID NO: 1750181 - RNA, 15 nt, Human herpesvirus 1
gacccgacucaccuc

SEQ ID NO: 1750182 - RNA, 16 nt, Human herpesvirus 1
cgucaccaugcagcgc

SEQ ID NO: 1750183 - RNA, 18 nt, Human herpesvirus 1
ccauccgaacgcagcccc

SEQ ID NO: 1750184 - RNA, 22 nt, Human herpesvirus 1
acgcacaugggggaggugcccc

SEQ ID NO: 1750185 - RNA, 23 nt, Human herpesvirus 1
cccguggggacgguggcgccgca

SEQ ID NO: 1750186 - RNA, 14 nt, Human herpesvirus 1
cgugcgcucgcucu

SEQ ID NO: 1750187 - RNA, 17 nt, Human herpesvirus 1
gccaguccgcugcaccg

SEQ ID NO: 1750188 - RNA, 12 nt, Human herpesvirus 1
aggggggguccg

SEQ ID NO: 1750189 - RNA, 15 nt, Human herpesvirus 1
ccgcgagcagagccg

SEQ ID NO: 1750190 - RNA, 15 nt, Human herpesvirus 1
gucggaccaccgccc

SEQ ID NO: 1750191 - RNA, 20 nt, Human herpesvirus 1
aucacccgagucucugggcg

SEQ ID NO: 1750192 - RNA, 16 nt, Human herpesvirus 1
uccucgcaccagcccu

SEQ ID NO: 1750193 - RNA, 19 nt, Human herpesvirus 1
cgccuccgcccgugcugcc

SEQ ID NO: 1750194 - RNA, 16 nt, Human herpesvirus 1
ccauguccggcagggg

SEQ ID NO: 1750195 - RNA, 22 nt, Human herpesvirus 1
cagaccccuucuccccacaaca

SEQ ID NO: 1750196 - RNA, 18 nt, Human herpesvirus 1
ggcgccucggucacccca

SEQ ID NO: 1750197 - RNA, 12 nt, Human herpesvirus 1
cgcaccugguga

SEQ ID NO: 1750198 - RNA, 18 nt, Human herpesvirus 1
ugcgguuggggaggcugu

SEQ ID NO: 1750199 - RNA, 14 nt, Human herpesvirus 1
ccucgaccaccacc

SEQ ID NO: 1750200 - RNA, 14 nt, Human herpesvirus 1
cgccagcaccccgg

SEQ ID NO: 1750201 - RNA, 14 nt, Human herpesvirus 1
gcccgggggccugg

SEQ ID NO: 1750202 - RNA, 19 nt, Human herpesvirus 1
agcagguccgcggugggcu

SEQ ID NO: 1750203 - RNA, 23 nt, Human herpesvirus 1
ggaccccacgacacccaccccaa

SEQ ID NO: 1750204 - RNA, 21 nt, Human herpesvirus 1
uggccccccgcguccaaaccc

SEQ ID NO: 1750205 - RNA, 19 nt, Human herpesvirus 1
accacugcacucccugccg

SEQ ID NO: 1750206 - RNA, 20 nt, Human herpesvirus 1
gcgggaguuaccgcccaaug

SEQ ID NO: 1750207 - RNA, 14 nt, Human herpesvirus 1
ccuugugugucaau

SEQ ID NO: 1750208 - RNA, 23 nt, Human herpesvirus 1
cugucgggcggauuuggggcgcu

SEQ ID NO: 1750209 - RNA, 14 nt, Human herpesvirus 1
acgccccuuucccc

SEQ ID NO: 1750210 - RNA, 15 nt, Human herpesvirus 1
cccugcugcccccgg

SEQ ID NO: 1750211 - RNA, 18 nt, Human herpesvirus 1
acgugguccgcggggccu

SEQ ID NO: 1750212 - RNA, 14 nt, Human herpesvirus 1
ccccaaccccuucc

SEQ ID NO: 1750213 - RNA, 15 nt, Human herpesvirus 1
agcgggggggcggcc

SEQ ID NO: 1750214 - RNA, 18 nt, Human herpesvirus 1
cacgccuaccggccccug

SEQ ID NO: 1750215 - RNA, 13 nt, Human herpesvirus 1
cagccgcgccgcu

SEQ ID NO: 1750216 - RNA, 18 nt, Human herpesvirus 1
gcccggaggcgcccgcgg

SEQ ID NO: 1750217 - RNA, 22 nt, Human herpesvirus 1
ccacgcucuccccugcugccau

SEQ ID NO: 1750218 - RNA, 15 nt, Human herpesvirus 1
ccaacgccuccccug

SEQ ID NO: 1750219 - RNA, 23 nt, Human herpesvirus 1
gccccgcauaucccacccuggag

SEQ ID NO: 1750220 - RNA, 18 nt, Human herpesvirus 1
ccguggccggccugcgcg

SEQ ID NO: 1750221 - RNA, 22 nt, Human herpesvirus 1
ccaucgccggggaccgcagccu

SEQ ID NO: 1750222 - RNA, 16 nt, Human herpesvirus 1
ucauagugggccucca

SEQ ID NO: 1750223 - RNA, 16 nt, Human herpesvirus 1
ccgauggccgucccgc

SEQ ID NO: 1750224 - RNA, 16 nt, Human herpesvirus 1
ugccgcuuuacgaggc

SEQ ID NO: 1750225 - RNA, 17 nt, Human herpesvirus 1
gccucggagccgagcuc

SEQ ID NO: 1750226 - RNA, 16 nt, Human herpesvirus 1
agacgcugcuccgccu

SEQ ID NO: 1750227 - RNA, 12 nt, Human herpesvirus 1
ggaccacgugca

SEQ ID NO: 1750228 - RNA, 15 nt, Human herpesvirus 1
ugaccgcccacgacu

SEQ ID NO: 1750229 - RNA, 16 nt, Human herpesvirus 1
ggccauggcccgccuc

SEQ ID NO: 1750230 - RNA, 21 nt, Human herpesvirus 1
uauccgaucccaggcgccgac

SEQ ID NO: 1750231 - RNA, 16 nt, Human herpesvirus 1
uacaaccccucgcggg

SEQ ID NO: 1750232 - RNA, 12 nt, Human herpesvirus 1
uguuggggacac

SEQ ID NO: 1750233 - RNA, 14 nt, Human herpesvirus 1
caguaccgccaggg

SEQ ID NO: 1750234 - RNA, 19 nt, Human herpesvirus 1
gcgggccaacuaggagaca

SEQ ID NO: 1750235 - RNA, 23 nt, Human herpesvirus 1
guacuggaugcgccgccacacuc

SEQ ID NO: 1750236 - RNA, 23 nt, Human herpesvirus 1
gcugacccccaccgcgcuccucc

SEQ ID NO: 1750237 - RNA, 14 nt, Human herpesvirus 1
agggccgugcccau

SEQ ID NO: 1750238 - RNA, 14 nt, Human herpesvirus 1
acucucccaccgcc

SEQ ID NO: 1750239 - RNA, 12 nt, Human herpesvirus 1
ccucgcgcggcg

SEQ ID NO: 1750240 - RNA, 13 nt, Human herpesvirus 1
aucgccccuggcg

SEQ ID NO: 1750241 - RNA, 12 nt, Human herpesvirus 1
ugccccugguga

SEQ ID NO: 1750242 - RNA, 14 nt, Human herpesvirus 1
cugauguggcugcu

SEQ ID NO: 1750243 - RNA, 16 nt, Human herpesvirus 1
cugugccaccagccug

SEQ ID NO: 1750244 - RNA, 13 nt, Human herpesvirus 1
ccgcgcggcugcc

SEQ ID NO: 1750245 - RNA, 17 nt, Human herpesvirus 1
cuacgccguguuggagc

SEQ ID NO: 1750246 - RNA, 23 nt, Human herpesvirus 1
cgccaucugggauggcuccuggc

SEQ ID NO: 1750247 - RNA, 17 nt, Human herpesvirus 1
ccaagggggaggggcca

SEQ ID NO: 1750248 - RNA, 21 nt, Human herpesvirus 1
gccacccgaaccaccacugca

SEQ ID NO: 1750249 - RNA, 19 nt, Human herpesvirus 1
ccgcgggcccccggccgcc

SEQ ID NO: 1750250 - RNA, 23 nt, Human herpesvirus 1
gacgccagcuuuccgcugagccu

SEQ ID NO: 1750251 - RNA, 15 nt, Human herpesvirus 1
cgaagagggggaccc

SEQ ID NO: 1750252 - RNA, 14 nt, Human herpesvirus 1
cgcgaucccccgcc

SEQ ID NO: 1750253 - RNA, 15 nt, Human herpesvirus 1
gccgggagcaccaca

SEQ ID NO: 1750254 - RNA, 16 nt, Human herpesvirus 1
ccuccgcgccaggccc

SEQ ID NO: 1750255 - RNA, 15 nt, Human herpesvirus 1
gcucggaaacugccu

SEQ ID NO: 1750256 - RNA, 18 nt, Human herpesvirus 1
cuuaauaaauuuuacaaa

SEQ ID NO: 1750257 - RNA, 14 nt, Human herpesvirus 1
ccaacuccagacca

SEQ ID NO: 1750258 - RNA, 14 nt, Human herpesvirus 1
ccaccgacucuccc

SEQ ID NO: 1750259 - RNA, 19 nt, Human herpesvirus 1
cccucguucugcugcaccg

SEQ ID NO: 1750260 - RNA, 14 nt, Human herpesvirus 1
gguggugcccagcg

SEQ ID NO: 1750261 - RNA, 15 nt, Human herpesvirus 1
ccacgguaggcccag

SEQ ID NO: 1750262 - RNA, 16 nt, Human herpesvirus 1
ccacgguaggcccagc

SEQ ID NO: 1750263 - RNA, 18 nt, Human herpesvirus 1
gccucugggguuugcccu

SEQ ID NO: 1750264 - RNA, 19 nt, Human herpesvirus 1
aggcgcucgucgccuggcu

SEQ ID NO: 1750265 - RNA, 21 nt, Human herpesvirus 1
gccgcccugagcgcccuccug

SEQ ID NO: 1750266 - RNA, 16 nt, Human herpesvirus 1
cggugguccgccuagc

SEQ ID NO: 1750267 - RNA, 13 nt, Human herpesvirus 1
ugccagaccucaa

SEQ ID NO: 1750268 - RNA, 20 nt, Human herpesvirus 1
acuggccgggagcaccacau

SEQ ID NO: 1750269 - RNA, 16 nt, Human herpesvirus 1
guacgccccaccggca

SEQ ID NO: 1750270 - RNA, 17 nt, Human herpesvirus 1
agacgaccagccguccu

SEQ ID NO: 1750271 - RNA, 16 nt, Human herpesvirus 1
ugcggagggcacccaa

SEQ ID NO: 1750272 - RNA, 21 nt, Human herpesvirus 1
agcccugguguuucuggggag

SEQ ID NO: 1750273 - RNA, 12 nt, Human herpesvirus 1
ggggagcuucgc

SEQ ID NO: 1750274 - RNA, 14 nt, Human herpesvirus 1
cgcggcggggcccg

SEQ ID NO: 1750275 - RNA, 19 nt, Human herpesvirus 1
guucgagcagccgcgccgc

SEQ ID NO: 1750276 - RNA, 13 nt, Human herpesvirus 1
ccaucgguccccu

SEQ ID NO: 1750277 - RNA, 13 nt, Human herpesvirus 1
cgcgcauggcagc

SEQ ID NO: 1750278 - RNA, 19 nt, Human herpesvirus 1
cuaucacacccgccccucc

SEQ ID NO: 1750279 - RNA, 19 nt, Human herpesvirus 1
cggcaggcaccgcaccagc

SEQ ID NO: 1750280 - RNA, 17 nt, Human herpesvirus 1
gccgccacgcgcccgag

SEQ ID NO: 1750281 - RNA, 19 nt, Human herpesvirus 1
cacuggccgggagcaccac

SEQ ID NO: 1750282 - RNA, 15 nt, Human herpesvirus 1
acccuccgcuggggc

SEQ ID NO: 1750283 - RNA, 12 nt, Human herpesvirus 1
uugcccgggccg

SEQ ID NO: 1750284 - RNA, 13 nt, Human herpesvirus 1
gcaccaucccggg

SEQ ID NO: 1750285 - RNA, 16 nt, Human herpesvirus 1
cgccacaacagcccug

SEQ ID NO: 1750286 - RNA, 18 nt, Human herpesvirus 1
ggccgucccggggcaggc

SEQ ID NO: 1750287 - RNA, 13 nt, Human herpesvirus 1
uggacccaaagcc

SEQ ID NO: 1750288 - RNA, 16 nt, Human herpesvirus 1
agcuucagcgccguca

SEQ ID NO: 1750289 - RNA, 17 nt, Human herpesvirus 1
agcccccagaugcccac

SEQ ID NO: 1750290 - RNA, 17 nt, Human herpesvirus 1
caccucccagugucccg

SEQ ID NO: 1750291 - RNA, 21 nt, Human herpesvirus 1
ggggcuggcgcaaccacgccc

SEQ ID NO: 1750292 - RNA, 17 nt, Human herpesvirus 1
gggaaaagugaaagaca

SEQ ID NO: 1750293 - RNA, 19 nt, Human herpesvirus 1
ggcccuaaccccaccccug

SEQ ID NO: 1750294 - RNA, 15 nt, Human herpesvirus 1
cgccucagggccucc

SEQ ID NO: 1750295 - RNA, 22 nt, Human herpesvirus 1
gaccccaucagccucgucccgc

SEQ ID NO: 1750296 - RNA, 21 nt, Human herpesvirus 1
ccgcauaucccacccuggagc

SEQ ID NO: 1750297 - RNA, 14 nt, Human herpesvirus 1
cugugccaccagcc

SEQ ID NO: 1750298 - RNA, 16 nt, Human herpesvirus 1
cgagggccgggcccca

SEQ ID NO: 1750299 - RNA, 16 nt, Human herpesvirus 1
cuccucuucuccccuu

SEQ ID NO: 1750300 - RNA, 15 nt, Human herpesvirus 1
cagcuucagcgccgu

SEQ ID NO: 1750301 - RNA, 19 nt, Human herpesvirus 1
acaagaucaacgccaaggg

SEQ ID NO: 1750302 - RNA, 23 nt, Human herpesvirus 1
ggcgucgcugugaugaagcagcg

SEQ ID NO: 1750303 - RNA, 15 nt, Human herpesvirus 1
gguccauuaaagaca

SEQ ID NO: 1750304 - RNA, 17 nt, Human herpesvirus 1
acgccucccccugagcc

SEQ ID NO: 1750305 - RNA, 14 nt, Human herpesvirus 1
ccaccauccccgcu

SEQ ID NO: 1750306 - RNA, 19 nt, Human herpesvirus 1
gcccuccccccgcccccgg

SEQ ID NO: 1750307 - RNA, 15 nt, Human herpesvirus 1
gauagagcugcuccg

SEQ ID NO: 1750308 - RNA, 20 nt, Human herpesvirus 1
gacccccaacgccacgcagc

SEQ ID NO: 1750309 - RNA, 23 nt, Human herpesvirus 1
aggcgacggcgucucccgggggc

SEQ ID NO: 1750310 - RNA, 22 nt, Human herpesvirus 1
gguccgcggggccucccccgga

SEQ ID NO: 1750311 - RNA, 20 nt, Human herpesvirus 1
ccaaggccccauacacgagc

SEQ ID NO: 1750312 - RNA, 21 nt, Human herpesvirus 1
gccgccgaagggacucuggcg

SEQ ID NO: 1750313 - RNA, 22 nt, Human herpesvirus 1
ugggcccugcuccggcggggcc

SEQ ID NO: 1750314 - RNA, 19 nt, Human herpesvirus 1
ugguccuguggagccuguu

SEQ ID NO: 1750315 - RNA, 18 nt, Human herpesvirus 1
ccaucccccggccacccc

SEQ ID NO: 1750316 - RNA, 14 nt, Human herpesvirus 1
cgggaccugaaccc

SEQ ID NO: 1750317 - RNA, 15 nt, Human herpesvirus 1
cuuuaaccucccccg

SEQ ID NO: 1750318 - RNA, 15 nt, Human herpesvirus 1
cccgccgccacuguc

SEQ ID NO: 1750319 - RNA, 22 nt, Human herpesvirus 1
cgcaacaaccuggagaccaccg

SEQ ID NO: 1750320 - RNA, 14 nt, Human herpesvirus 1
augccccccuggcg

SEQ ID NO: 1750321 - RNA, 18 nt, Human herpesvirus 1
ggggaugggcgaccuggg

SEQ ID NO: 1750322 - RNA, 21 nt, Human herpesvirus 1
gcucgcggagggcggccagcc

SEQ ID NO: 1750323 - RNA, 13 nt, Human herpesvirus 1
ccgcgacccccgg

SEQ ID NO: 1750324 - RNA, 15 nt, Human herpesvirus 1
ggguuucacugaaac

SEQ ID NO: 1750325 - RNA, 17 nt, Human herpesvirus 1
cgcggcucguggccagg

SEQ ID NO: 1750326 - RNA, 16 nt, Human herpesvirus 1
cgggggauggggagag

SEQ ID NO: 1750327 - RNA, 22 nt, Human herpesvirus 1
gcggagguccggccugggccgc

SEQ ID NO: 1750328 - RNA, 17 nt, Human herpesvirus 1
cgcucccucgaccacca

SEQ ID NO: 1750329 - RNA, 11 nt, Human herpesvirus 1
guaugucccca

SEQ ID NO: 1750330 - RNA, 19 nt, Human herpesvirus 1
gggcggccucuccggccug

SEQ ID NO: 1750331 - RNA, 12 nt, Human herpesvirus 1
gagagcccacau

SEQ ID NO: 1750332 - RNA, 19 nt, Human herpesvirus 1
ccccaacgccacgcagcca

SEQ ID NO: 1750333 - RNA, 19 nt, Human herpesvirus 1
gggccugccugcggcucgu

SEQ ID NO: 1750334 - RNA, 18 nt, Human herpesvirus 1
gaggucaaaugccgggcc

SEQ ID NO: 1750335 - RNA, 17 nt, Human herpesvirus 1
aucucugggcgggccgu

SEQ ID NO: 1750336 - RNA, 19 nt, Human herpesvirus 1
gacauuaaccaccugcgcu

SEQ ID NO: 1750337 - RNA, 22 nt, Human herpesvirus 1
agcgacguccugggccaccuga

SEQ ID NO: 1750338 - RNA, 13 nt, Human herpesvirus 1
acccccggcccca

SEQ ID NO: 1750339 - RNA, 23 nt, Human herpesvirus 1
ggccgugguccucgaggaggcgg

SEQ ID NO: 1750340 - RNA, 23 nt, Human herpesvirus 1
agcccucccgaccgacaccccca

SEQ ID NO: 1750341 - RNA, 22 nt, Human herpesvirus 1
gccgagucuucggggcccggcc

SEQ ID NO: 1750342 - RNA, 18 nt, Human herpesvirus 1
ccuaugccacgccagggc

SEQ ID NO: 1750343 - RNA, 12 nt, Human herpesvirus 1
cgcgggggcgcc

SEQ ID NO: 1750344 - RNA, 19 nt, Human herpesvirus 1
gacgagaugcugcgcuccg

SEQ ID NO: 1750345 - RNA, 17 nt, Human herpesvirus 1
ccugcucacgaccccca

SEQ ID NO: 1750346 - RNA, 21 nt, Human herpesvirus 1
cgcgcggacggcgcggggccc

SEQ ID NO: 1750347 - RNA, 15 nt, Human herpesvirus 1
acccaaaccccggau

SEQ ID NO: 1750348 - RNA, 15 nt, Human herpesvirus 1
caccguggccuggga

SEQ ID NO: 1750349 - RNA, 16 nt, Human herpesvirus 1
ccgcaagccccuagcc

SEQ ID NO: 1750350 - RNA, 18 nt, Human herpesvirus 1
ccgacuccccgccuccgg

SEQ ID NO: 1750351 - RNA, 21 nt, Human herpesvirus 1
gagaaacggccgaagccacgc

SEQ ID NO: 1750352 - RNA, 17 nt, Human herpesvirus 1
cuugguucggggccgcc

SEQ ID NO: 1750353 - RNA, 18 nt, Human herpesvirus 1
cggucgccccgacccccu

SEQ ID NO: 1750354 - RNA, 20 nt, Human herpesvirus 1
gaccaccggucgucccucgc

SEQ ID NO: 1750355 - RNA, 18 nt, Human herpesvirus 1
ucccccgucuggguuuuc

SEQ ID NO: 1750356 - RNA, 21 nt, Human herpesvirus 1
gugcgcucgcucucggugccc

SEQ ID NO: 1750357 - RNA, 19 nt, Human herpesvirus 1
gcagcaugggacccacaga

SEQ ID NO: 1750358 - RNA, 16 nt, Human herpesvirus 1
gccacggcgccgacca

SEQ ID NO: 1750359 - RNA, 16 nt, Human herpesvirus 1
cuacaccucccagugu

SEQ ID NO: 1750360 - RNA, 23 nt, Human herpesvirus 1
accccgcaauuugcacccagccu

SEQ ID NO: 1750361 - RNA, 19 nt, Human herpesvirus 1
gcaccccccucgucccccu

SEQ ID NO: 1750362 - RNA, 11 nt, Human herpesvirus 1
uucccuccccc

SEQ ID NO: 1750363 - RNA, 19 nt, Human herpesvirus 1
gucgucgggcgccaaagcc

SEQ ID NO: 1750364 - RNA, 17 nt, Human herpesvirus 1
uggcaacucgccccacg

SEQ ID NO: 1750365 - RNA, 17 nt, Human herpesvirus 1
cuucccccccaucaccc

SEQ ID NO: 1750366 - RNA, 19 nt, Human herpesvirus 1
uggaacgaggccgcagccu

SEQ ID NO: 1750367 - RNA, 21 nt, Human herpesvirus 1
acccccucgaccaccaccucc

SEQ ID NO: 1750368 - RNA, 19 nt, Human herpesvirus 1
gacccccaacgccacgcag

SEQ ID NO: 1750369 - RNA, 20 nt, Human herpesvirus 1
cucgccgcccuagaggcugg

SEQ ID NO: 1750370 - RNA, 14 nt, Human herpesvirus 1
gacacaaaugccca

SEQ ID NO: 1750371 - RNA, 14 nt, Human herpesvirus 1
caccgacacaugca

SEQ ID NO: 1750372 - RNA, 14 nt, Human herpesvirus 1
ggggagggcagggc

SEQ ID NO: 1750373 - RNA, 21 nt, Human herpesvirus 1
acaaccccggucucccaggga

SEQ ID NO: 1750374 - RNA, 17 nt, Human herpesvirus 1
ccgcagccuucucccgg

SEQ ID NO: 1750375 - RNA, 16 nt, Human herpesvirus 1
gcccaguguacccugg

SEQ ID NO: 1750376 - RNA, 16 nt, Human herpesvirus 1
guccacgggggggagc

SEQ ID NO: 1750377 - RNA, 19 nt, Human herpesvirus 1
ggccccacggucagucugg

SEQ ID NO: 1750378 - RNA, 14 nt, Human herpesvirus 1
cugacgccucaggg

SEQ ID NO: 1750379 - RNA, 20 nt, Human herpesvirus 1
ucaccgggacgaccacgaga

SEQ ID NO: 1750380 - RNA, 14 nt, Human herpesvirus 1
cagcuaugggcccu

SEQ ID NO: 1750381 - RNA, 15 nt, Human herpesvirus 1
ggauggggagagccc

SEQ ID NO: 1750382 - RNA, 14 nt, Human herpesvirus 1
cgaggggcagcugg

SEQ ID NO: 1750383 - RNA, 21 nt, Human herpesvirus 1
cggacagccauauccugagcc

SEQ ID NO: 1750384 - RNA, 16 nt, Human herpesvirus 1
cggccgccaccauccu

SEQ ID NO: 1750385 - RNA, 19 nt, Human herpesvirus 1
guccccugccccccccacc

SEQ ID NO: 1750386 - RNA, 23 nt, Human herpesvirus 1
cucagagacaacgcgacaggcca

SEQ ID NO: 1750387 - RNA, 13 nt, Human herpesvirus 1
gagccgcuuuccu

SEQ ID NO: 1750388 - RNA, 20 nt, Human herpesvirus 1
cagcuugaagaucgccgggu

SEQ ID NO: 1750389 - RNA, 18 nt, Human herpesvirus 1
cacgagcgcgcugcucag

SEQ ID NO: 1750390 - RNA, 18 nt, Human herpesvirus 1
gcaguccacgggggggag

SEQ ID NO: 1750391 - RNA, 16 nt, Human herpesvirus 1
ucgcauccgagcaccc

SEQ ID NO: 1750392 - RNA, 15 nt, Human herpesvirus 1
cuccuccaccaccca

SEQ ID NO: 1750393 - RNA, 14 nt, Human herpesvirus 1
ugcggcggcgcugc

SEQ ID NO: 1750394 - RNA, 13 nt, Human herpesvirus 1
accgcagccuggu

SEQ ID NO: 1750395 - RNA, 15 nt, Human herpesvirus 1
ucaccaccaaggccc

SEQ ID NO: 1750396 - RNA, 19 nt, Human herpesvirus 1
cucagggccuccgacccca

SEQ ID NO: 1750397 - RNA, 13 nt, Human herpesvirus 1
ccuggcgccgccu

SEQ ID NO: 1750398 - RNA, 13 nt, Human herpesvirus 1
gagggcggccagc

SEQ ID NO: 1750399 - RNA, 15 nt, Human herpesvirus 1
gacggugagcgagga

SEQ ID NO: 1750400 - RNA, 21 nt, Human herpesvirus 1
guggacgggcucgccagcgac

SEQ ID NO: 1750401 - RNA, 15 nt, Human herpesvirus 1
ccggcacgccugggg

SEQ ID NO: 1750402 - RNA, 22 nt, Human herpesvirus 1
gacacguugggguuguugcugg

SEQ ID NO: 1750403 - RNA, 21 nt, Human herpesvirus 1
gccugacgccugccaaccuga

SEQ ID NO: 1750404 - RNA, 16 nt, Human herpesvirus 1
cggugcgucugggccc

SEQ ID NO: 1750405 - RNA, 13 nt, Human herpesvirus 1
aggcgccugcccc

SEQ ID NO: 1750406 - RNA, 16 nt, Human herpesvirus 1
cugcgcgagcaccugc

SEQ ID NO: 1750407 - RNA, 16 nt, Human herpesvirus 1
uucaucgcgccccucg

SEQ ID NO: 1750408 - RNA, 19 nt, Human herpesvirus 1
gcuccggggaucugguccg

SEQ ID NO: 1750409 - RNA, 18 nt, Human herpesvirus 1
cgugacacccuaccccag

SEQ ID NO: 1750410 - RNA, 12 nt, Human herpesvirus 1
gcaccccagagg

SEQ ID NO: 1750411 - RNA, 23 nt, Human herpesvirus 1
uccuuacgcuaaucccccggcuc

SEQ ID NO: 1750412 - RNA, 23 nt, Human herpesvirus 1
gaccagccguccucgcaccagcc

SEQ ID NO: 1750413 - RNA, 21 nt, Human herpesvirus 1
gaccaccauccccgcucccca

SEQ ID NO: 1750414 - RNA, 23 nt, Human herpesvirus 1
cugcaagaggucgucgggggacg

SEQ ID NO: 1750415 - RNA, 12 nt, Human herpesvirus 1
uuagccagcaga

SEQ ID NO: 1750416 - RNA, 14 nt, Human herpesvirus 1
ccgaguucccccgg

SEQ ID NO: 1750417 - RNA, 20 nt, Human herpesvirus 1
caguugggccgggcgaccca

SEQ ID NO: 1750418 - RNA, 23 nt, Human herpesvirus 1
aauucccgcggcccuuaaugggc

SEQ ID NO: 1750419 - RNA, 17 nt, Human herpesvirus 1
aggcgccugccccgcca

SEQ ID NO: 1750420 - RNA, 14 nt, Human herpesvirus 1
guuccguuuggaaa

SEQ ID NO: 1750421 - RNA, 22 nt, Human herpesvirus 1
ucccgacaccaccagcuggcau

SEQ ID NO: 1750422 - RNA, 15 nt, Human herpesvirus 1
auggcccuccaggcu

SEQ ID NO: 1750423 - RNA, 18 nt, Human herpesvirus 1
cuacacccuuguguguca

SEQ ID NO: 1750424 - RNA, 18 nt, Human herpesvirus 1
gcgccccgccgccccaca

SEQ ID NO: 1750425 - RNA, 18 nt, Human herpesvirus 1
uccccaaaauaaaagacc

SEQ ID NO: 1750426 - RNA, 17 nt, Human herpesvirus 1
aggccgcagccuucucc

SEQ ID NO: 1750427 - RNA, 18 nt, Human herpesvirus 1
acacuggguucuccugga

SEQ ID NO: 1750428 - RNA, 14 nt, Human herpesvirus 1
caacgaggguuggg

SEQ ID NO: 1750429 - RNA, 16 nt, Human herpesvirus 1
gugagucacagcgacc

SEQ ID NO: 1750430 - RNA, 13 nt, Human herpesvirus 1
cggccugcuggac

SEQ ID NO: 1750431 - RNA, 13 nt, Human herpesvirus 1
ucgugcccuucca

SEQ ID NO: 1750432 - RNA, 12 nt, Human herpesvirus 1
gcgcuccugaug

SEQ ID NO: 1750433 - RNA, 21 nt, Human herpesvirus 1
gagccagacccaacccccggc

SEQ ID NO: 1750434 - RNA, 22 nt, Human herpesvirus 1
gcauccgucgggaggccacaga

SEQ ID NO: 1750435 - RNA, 22 nt, Human herpesvirus 1
acuacgcuucggccgccaccca

SEQ ID NO: 1750436 - RNA, 19 nt, Human herpesvirus 1
gaggccuuguuccgcuucc

SEQ ID NO: 1750437 - RNA, 18 nt, Human herpesvirus 1
gaccucggcgccucugga

SEQ ID NO: 1750438 - RNA, 16 nt, Human herpesvirus 1
ucaccggcggaccccc

SEQ ID NO: 1750439 - RNA, 23 nt, Human herpesvirus 1
cccgcauaucccacccuggagcu

SEQ ID NO: 1750440 - RNA, 14 nt, Human herpesvirus 1
augggcgaccuggg

SEQ ID NO: 1750441 - RNA, 16 nt, Human herpesvirus 1
uuuuacaaacagauuu

SEQ ID NO: 1750442 - RNA, 21 nt, Human herpesvirus 1
cggcgacgugcccccuccucg

SEQ ID NO: 1750443 - RNA, 17 nt, Human herpesvirus 1
cccgacagaccuccccg

SEQ ID NO: 1750444 - RNA, 16 nt, Human herpesvirus 1
uggugaucgccugucu

SEQ ID NO: 1750445 - RNA, 15 nt, Human herpesvirus 1
ucccaaacagggccu

SEQ ID NO: 1750446 - RNA, 17 nt, Human herpesvirus 1
ccacuacaccagccaau

SEQ ID NO: 1750447 - RNA, 18 nt, Human herpesvirus 1
uccccgauggcccuccag

SEQ ID NO: 1750448 - RNA, 18 nt, Human herpesvirus 1
acgguucgcgaacccuuu

SEQ ID NO: 1750449 - RNA, 15 nt, Human herpesvirus 1
gcggcccacccuggc

SEQ ID NO: 1750450 - RNA, 15 nt, Human herpesvirus 1
aguccgaagaggaag

SEQ ID NO: 1750451 - RNA, 17 nt, Human herpesvirus 1
ggcccggcuagacccac

SEQ ID NO: 1750452 - RNA, 21 nt, Human herpesvirus 1
ugccccggccggauucccggg

SEQ ID NO: 1750453 - RNA, 20 nt, Human herpesvirus 1
cuguacccgcuaaccaccaa

SEQ ID NO: 1750454 - RNA, 21 nt, Human herpesvirus 1
ggcgacccugaucccccgcgc

SEQ ID NO: 1750455 - RNA, 13 nt, Human herpesvirus 1
uaaugaccaccac

SEQ ID NO: 1750456 - RNA, 14 nt, Human herpesvirus 1
gcucgguggcuccg

SEQ ID NO: 1750457 - RNA, 23 nt, Human herpesvirus 1
ugcccucgcgggccucgugggca

SEQ ID NO: 1750458 - RNA, 16 nt, Human herpesvirus 1
ccauccccgcucccca

SEQ ID NO: 1750459 - RNA, 18 nt, Human herpesvirus 1
ggagagcccacaugcgga

SEQ ID NO: 1750460 - RNA, 19 nt, Human herpesvirus 1
cgcgggguuacgcgggccc

SEQ ID NO: 1750461 - RNA, 22 nt, Human herpesvirus 1
acuggaggaggaggaagaggag

SEQ ID NO: 1750462 - RNA, 22 nt, Human herpesvirus 1
cccccguguuuguggggagggg

SEQ ID NO: 1750463 - RNA, 12 nt, Human herpesvirus 1
ccaaccugaccg

SEQ ID NO: 1750464 - RNA, 14 nt, Human herpesvirus 1
ccucagggccuccg

SEQ ID NO: 1750465 - RNA, 17 nt, Human herpesvirus 1
cguacucccaccagcug

SEQ ID NO: 1750466 - RNA, 15 nt, Human herpesvirus 1
ucuguuucuuggccc

SEQ ID NO: 1750467 - RNA, 14 nt, Human herpesvirus 1
ggcgggugggccuu

SEQ ID NO: 1750468 - RNA, 11 nt, Human herpesvirus 1
cccccaaacac

SEQ ID NO: 1750469 - RNA, 20 nt, Human herpesvirus 1
ccguuggcccccgccucugg

SEQ ID NO: 1750470 - RNA, 14 nt, Human herpesvirus 1
acacugaaaugccc

SEQ ID NO: 1750471 - RNA, 22 nt, Human herpesvirus 1
cgugggcgccuugcggcagcgc

SEQ ID NO: 1750472 - RNA, 16 nt, Human herpesvirus 1
ucuccggggcccggcc

SEQ ID NO: 1750473 - RNA, 18 nt, Human herpesvirus 1
caccacccaaccccaacu

SEQ ID NO: 1750474 - RNA, 13 nt, Human herpesvirus 1
ugcccauaauaaa

SEQ ID NO: 1750475 - RNA, 19 nt, Human herpesvirus 1
ccauguuugcgggccuggg

SEQ ID NO: 1750476 - RNA, 17 nt, Human herpesvirus 1
aacacgcucgcggagcu

SEQ ID NO: 1750477 - RNA, 17 nt, Human herpesvirus 1
cugcccgucgcgcgugu

SEQ ID NO: 1750478 - RNA, 18 nt, Human herpesvirus 1
gcguuucugaccugcacc

SEQ ID NO: 1750479 - RNA, 17 nt, Human herpesvirus 1
gcucaagaaccccacca

SEQ ID NO: 1750480 - RNA, 13 nt, Human herpesvirus 1
ggcggaccuggcg

SEQ ID NO: 1750481 - RNA, 18 nt, Human herpesvirus 1
aacugccugacccucucc

SEQ ID NO: 1750482 - RNA, 22 nt, Human herpesvirus 1
uauggggcgggggauggggaga

SEQ ID NO: 1750483 - RNA, 13 nt, Human herpesvirus 1
ccacaugcggaaa

SEQ ID NO: 1750484 - RNA, 16 nt, Human herpesvirus 1
agggcaucgcgguggu

SEQ ID NO: 1750485 - RNA, 23 nt, Human herpesvirus 1
aggcgccugccccgccacccagu

SEQ ID NO: 1750486 - RNA, 19 nt, Human herpesvirus 1
ucuguuggggacacugggu

SEQ ID NO: 1750487 - RNA, 19 nt, Human herpesvirus 1
ccaccgccccgaacccugc

SEQ ID NO: 1750488 - RNA, 15 nt, Human herpesvirus 1
cggcagcgcuccgac

SEQ ID NO: 1750489 - RNA, 17 nt, Human herpesvirus 1
ucccccgcgcgccccga

SEQ ID NO: 1750490 - RNA, 12 nt, Human herpesvirus 1
cagucuccuggc

SEQ ID NO: 1750491 - RNA, 23 nt, Human herpesvirus 1
aucgccggggaccgcagccuggu

SEQ ID NO: 1750492 - RNA, 17 nt, Human herpesvirus 1
uccccaaaauaaaagac

SEQ ID NO: 1750493 - RNA, 16 nt, Human herpesvirus 1
acccaagccgccccag

SEQ ID NO: 1750494 - RNA, 16 nt, Human herpesvirus 1
ucgcgggccucguggg

SEQ ID NO: 1750495 - RNA, 12 nt, Human herpesvirus 1
gcgcguccccgg

SEQ ID NO: 1750496 - RNA, 20 nt, Human herpesvirus 1
cgccauguuugcgggccugg

SEQ ID NO: 1750497 - RNA, 15 nt, Human herpesvirus 1
cagccugccucuccc

SEQ ID NO: 1750498 - RNA, 15 nt, Human herpesvirus 1
ccuggggucgcucug

SEQ ID NO: 1750499 - RNA, 12 nt, Human herpesvirus 1
ccuucuucgccu

SEQ ID NO: 1750500 - RNA, 19 nt, Human herpesvirus 1
aucccggguuaauguaaau

SEQ ID NO: 1750501 - RNA, 22 nt, Human herpesvirus 1
cgcucccaaccgcgacccuccg

SEQ ID NO: 1750502 - RNA, 15 nt, Human herpesvirus 1
cacacggagcugcuc

SEQ ID NO: 1750503 - RNA, 13 nt, Human herpesvirus 1
cacccuaccccag

SEQ ID NO: 1750504 - RNA, 18 nt, Human herpesvirus 1
ccaaaauaaaagaccaaa

SEQ ID NO: 1750505 - RNA, 12 nt, Human herpesvirus 1
gccucacccacg

SEQ ID NO: 1750506 - RNA, 23 nt, Human herpesvirus 1
aacccacacgcacuugcggcaag

SEQ ID NO: 1750507 - RNA, 16 nt, Human herpesvirus 1
aguggcaggaggugga

SEQ ID NO: 1750508 - RNA, 14 nt, Human herpesvirus 1
ccuauguguuucag

SEQ ID NO: 1750509 - RNA, 21 nt, Human herpesvirus 1
cggacgccguggcgccccggc

SEQ ID NO: 1750510 - RNA, 15 nt, Human herpesvirus 1
ggaggaagaccugcu

SEQ ID NO: 1750511 - RNA, 22 nt, Human herpesvirus 1
gccccgcccccuuuguccccgc

SEQ ID NO: 1750512 - RNA, 15 nt, Human herpesvirus 1
gcaggcgccuccggg

SEQ ID NO: 1750513 - RNA, 20 nt, Human herpesvirus 1
gccccuaaccaggccuccac

SEQ ID NO: 1750514 - RNA, 12 nt, Human herpesvirus 1
guaggcccagca

SEQ ID NO: 1750515 - RNA, 15 nt, Human herpesvirus 1
ggaugccagccaggg

SEQ ID NO: 1750516 - RNA, 13 nt, Human herpesvirus 1
guccccgaggacc

SEQ ID NO: 1750517 - RNA, 15 nt, Human herpesvirus 1
ccggugaacgccucc

SEQ ID NO: 1750518 - RNA, 14 nt, Human herpesvirus 1
cccuaaccaccgcu

SEQ ID NO: 1750519 - RNA, 14 nt, Human herpesvirus 1
ccacgugcacagcc

SEQ ID NO: 1750520 - RNA, 19 nt, Human herpesvirus 1
cccggcauggcgcagcugg

SEQ ID NO: 1750521 - RNA, 12 nt, Human herpesvirus 1
uauuauuuaccu

SEQ ID NO: 1750522 - RNA, 15 nt, Human herpesvirus 1
cggucaccccaaucc

SEQ ID NO: 1750523 - RNA, 22 nt, Human herpesvirus 1
cgcgccguuggcccccgccucu

SEQ ID NO: 1750524 - RNA, 20 nt, Human herpesvirus 1
caccuuugacggcgcggccg

SEQ ID NO: 1750525 - RNA, 14 nt, Human herpesvirus 1
ccgcgacccuccgg

SEQ ID NO: 1750526 - RNA, 15 nt, Human herpesvirus 1
aacagcccccggguu

SEQ ID NO: 1750527 - RNA, 13 nt, Human herpesvirus 1
ucugggggccugu

SEQ ID NO: 1750528 - RNA, 20 nt, Human herpesvirus 1
gguucgcgucccgcccaccg

SEQ ID NO: 1750529 - RNA, 13 nt, Human herpesvirus 1
cucgucuccucuu

SEQ ID NO: 1750530 - RNA, 16 nt, Human herpesvirus 1
cggcgccgacacgcgg

SEQ ID NO: 1750531 - RNA, 14 nt, Human herpesvirus 1
cagccgcgccgcug

SEQ ID NO: 1750532 - RNA, 21 nt, Human herpesvirus 1
uucccgaaacuucaucacccc

SEQ ID NO: 1750533 - RNA, 13 nt, Human herpesvirus 1
cgcggggccuccg

SEQ ID NO: 1750534 - RNA, 17 nt, Human herpesvirus 1
uucgcaacaccuccccc

SEQ ID NO: 1750535 - RNA, 20 nt, Human herpesvirus 1
gacggcccuuacggaccaga

SEQ ID NO: 1750536 - RNA, 23 nt, Human herpesvirus 1
ccugcgggacaucaaggcggaga

SEQ ID NO: 1750537 - RNA, 16 nt, Human herpesvirus 1
accuuccgguccugga

SEQ ID NO: 1750538 - RNA, 18 nt, Human herpesvirus 1
cccguuccagccccccag

SEQ ID NO: 1750539 - RNA, 22 nt, Human herpesvirus 1
gggggcuuccggccugggggcc

SEQ ID NO: 1750540 - RNA, 22 nt, Human herpesvirus 1
acauguccgugccgcuuuaucc

SEQ ID NO: 1750541 - RNA, 19 nt, Human herpesvirus 1
ucggccgucccggggcagg

SEQ ID NO: 1750542 - RNA, 14 nt, Human herpesvirus 1
agcgcggaggaggg

SEQ ID NO: 1750543 - RNA, 21 nt, Human herpesvirus 1
cgacccccauggagcacgagc

SEQ ID NO: 1750544 - RNA, 18 nt, Human herpesvirus 1
uggcgccugacgcgccgc

SEQ ID NO: 1750545 - RNA, 16 nt, Human herpesvirus 1
ucagcgacguccuggg

SEQ ID NO: 1750546 - RNA, 18 nt, Human herpesvirus 1
gcgcgcgcaccuccuccg

SEQ ID NO: 1750547 - RNA, 23 nt, Human herpesvirus 1
cggacccucucuucucucccggg

SEQ ID NO: 1750548 - RNA, 12 nt, Human herpesvirus 1
ggguucuccugg

SEQ ID NO: 1750549 - RNA, 18 nt, Human herpesvirus 1
cccgcgucuggccccggc

SEQ ID NO: 1750550 - RNA, 20 nt, Human herpesvirus 1
ccugucuuggggcccaccca

SEQ ID NO: 1750551 - RNA, 23 nt, Human herpesvirus 1
caacucucgcaccaucccggguu

SEQ ID NO: 1750552 - RNA, 20 nt, Human herpesvirus 1
gggccccgggacacccccca

SEQ ID NO: 1750553 - RNA, 19 nt, Human herpesvirus 1
gccccuaaccaggccucca

SEQ ID NO: 1750554 - RNA, 19 nt, Human herpesvirus 1
gcaugaagcccccaacaug

SEQ ID NO: 1750555 - RNA, 13 nt, Human herpesvirus 1
caggcggcgaacg

SEQ ID NO: 1750556 - RNA, 22 nt, Human herpesvirus 1
gaaggaacccgcgcuaugacgg

SEQ ID NO: 1750557 - RNA, 12 nt, Human herpesvirus 1
guucccuggccg

SEQ ID NO: 1750558 - RNA, 14 nt, Human herpesvirus 1
gacggcggaccugg

SEQ ID NO: 1750559 - RNA, 13 nt, Human herpesvirus 1
gauucagcgggcg

SEQ ID NO: 1750560 - RNA, 16 nt, Human herpesvirus 1
gugggcgaggggggag

SEQ ID NO: 1750561 - RNA, 13 nt, Human herpesvirus 1
cgacgaccugggg

SEQ ID NO: 1750562 - RNA, 18 nt, Human herpesvirus 1
cacuggguucuccuggaa

SEQ ID NO: 1750563 - RNA, 17 nt, Human herpesvirus 1
cccuggcggacggcggc

SEQ ID NO: 1750564 - RNA, 21 nt, Human herpesvirus 1
agccaauccgugucggggagg

SEQ ID NO: 1750565 - RNA, 20 nt, Human herpesvirus 1
gcaacggcgggagcuggguu

SEQ ID NO: 1750566 - RNA, 12 nt, Human herpesvirus 1
aggcggccgagg

SEQ ID NO: 1750567 - RNA, 11 nt, Human herpesvirus 1
ccggaaggaac

SEQ ID NO: 1750568 - RNA, 15 nt, Human herpesvirus 1
ucggucgaagccuac

SEQ ID NO: 1750569 - RNA, 19 nt, Human herpesvirus 1
cgcgggcucgucuuggcca

SEQ ID NO: 1750570 - RNA, 17 nt, Human herpesvirus 1
gggcgcuuggucgggag

SEQ ID NO: 1750571 - RNA, 19 nt, Human herpesvirus 1
cggccuguuugagcagaag

SEQ ID NO: 1750572 - RNA, 16 nt, Human herpesvirus 1
uaucccgcccaccgcu

SEQ ID NO: 1750573 - RNA, 19 nt, Human herpesvirus 1
aguuuguggacccaaagcc

SEQ ID NO: 1750574 - RNA, 23 nt, Human herpesvirus 1
ggcaugcaccccagagguguuca

SEQ ID NO: 1750575 - RNA, 23 nt, Human herpesvirus 1
ucuuggaggaccccguggggacg

SEQ ID NO: 1750576 - RNA, 19 nt, Human herpesvirus 1
ggccggauucccgggccgg

SEQ ID NO: 1750577 - RNA, 19 nt, Human herpesvirus 1
accuccuccgacgcccagc

SEQ ID NO: 1750578 - RNA, 17 nt, Human herpesvirus 1
cucccaccgccaucagc

SEQ ID NO: 1750579 - RNA, 22 nt, Human herpesvirus 1
cgucacgcacgccaaugcccuc

SEQ ID NO: 1750580 - RNA, 17 nt, Human herpesvirus 1
caaaucccggcgccggu

SEQ ID NO: 1750581 - RNA, 16 nt, Human herpesvirus 1
cgaggcccgcaagcug

SEQ ID NO: 1750582 - RNA, 13 nt, Human herpesvirus 1
cgcaccgggcccc

SEQ ID NO: 1750583 - RNA, 19 nt, Human herpesvirus 1
ccaaauaaagccacugaaa

SEQ ID NO: 1750584 - RNA, 16 nt, Human herpesvirus 1
gcaccgguucucccug

SEQ ID NO: 1750585 - RNA, 11 nt, Human herpesvirus 1
gaggggggcaa

SEQ ID NO: 1750586 - RNA, 14 nt, Human herpesvirus 1
acuacauuaaauug

SEQ ID NO: 1750587 - RNA, 18 nt, Human herpesvirus 1
gcccacuacaccagccaa

SEQ ID NO: 1750588 - RNA, 22 nt, Human herpesvirus 1
cucguucuccggggcccggccc

SEQ ID NO: 1750589 - RNA, 18 nt, Human herpesvirus 1
cacggcgaaugcagcgcc

SEQ ID NO: 1750590 - RNA, 12 nt, Human herpesvirus 1
ugaccugcaccg

SEQ ID NO: 1750591 - RNA, 19 nt, Human herpesvirus 1
auaaauuuuacaaacagau

SEQ ID NO: 1750592 - RNA, 18 nt, Human herpesvirus 1
cggguuccgcgaccaccc

SEQ ID NO: 1750593 - RNA, 15 nt, Human herpesvirus 1
cacgcaaaaccaggc

SEQ ID NO: 1750594 - RNA, 19 nt, Human herpesvirus 1
cgucucugcuacgccgcug

SEQ ID NO: 1750595 - RNA, 15 nt, Human herpesvirus 1
gccacccgaaccacc

SEQ ID NO: 1750596 - RNA, 19 nt, Human herpesvirus 1
gccgcaguacuaccuggcc

SEQ ID NO: 1750597 - RNA, 23 nt, Human herpesvirus 1
gucuccgugcuguaccggugggc

SEQ ID NO: 1750598 - RNA, 14 nt, Human herpesvirus 1
ccucaggucauccu

SEQ ID NO: 1750599 - RNA, 16 nt, Human herpesvirus 1
gggugacgguggacag

SEQ ID NO: 1750600 - RNA, 23 nt, Human herpesvirus 1
aguacgcguacucccaccagcug

SEQ ID NO: 1750601 - RNA, 13 nt, Human herpesvirus 1
gcgacccuccggg

SEQ ID NO: 1750602 - RNA, 21 nt, Human herpesvirus 1
ggucgaucccgaagcccagcg

SEQ ID NO: 1750603 - RNA, 15 nt, Human herpesvirus 1
gccaacgccgcgacc

SEQ ID NO: 1750604 - RNA, 17 nt, Human herpesvirus 1
cuccugggucagcuccu

SEQ ID NO: 1750605 - RNA, 15 nt, Human herpesvirus 1
uguggacccaaagcc

SEQ ID NO: 1750606 - RNA, 13 nt, Human herpesvirus 1
ugcgaccccagcc

SEQ ID NO: 1750607 - RNA, 21 nt, Human herpesvirus 1
gaucccccgcgcggcugccaa

SEQ ID NO: 1750608 - RNA, 19 nt, Human herpesvirus 1
agucccaucccccgauccc

SEQ ID NO: 1750609 - RNA, 15 nt, Human herpesvirus 1
gcccucuuuuucuuu

SEQ ID NO: 1750610 - RNA, 15 nt, Human herpesvirus 1
cauccagcuggugcu

SEQ ID NO: 1750611 - RNA, 17 nt, Human herpesvirus 1
acgccaucgccucggcc

SEQ ID NO: 1750612 - RNA, 19 nt, Human herpesvirus 1
ucgcgguggucuucaagga

SEQ ID NO: 1750613 - RNA, 13 nt, Human herpesvirus 1
acaccaccagcug

SEQ ID NO: 1750614 - RNA, 20 nt, Human herpesvirus 1
cugcaccgaucgcagcgucc

SEQ ID NO: 1750615 - RNA, 12 nt, Human herpesvirus 1
cccguggcucuc

SEQ ID NO: 1750616 - RNA, 14 nt, Human herpesvirus 1
ggcccggggccugc

SEQ ID NO: 1750617 - RNA, 17 nt, Human herpesvirus 1
gaugucggguccaaacu

SEQ ID NO: 1750618 - RNA, 16 nt, Human herpesvirus 1
acaacaagucucuggg

SEQ ID NO: 1750619 - RNA, 16 nt, Human herpesvirus 1
ccgcuaaaagaccgca

SEQ ID NO: 1750620 - RNA, 13 nt, Human herpesvirus 1
aacaucaaacacg

SEQ ID NO: 1750621 - RNA, 17 nt, Human herpesvirus 1
cggggcggggacgggga

SEQ ID NO: 1750622 - RNA, 23 nt, Human herpesvirus 1
cuacaggggccauguugggccgc

SEQ ID NO: 1750623 - RNA, 19 nt, Human herpesvirus 1
guucgcgucccgcccaccg

SEQ ID NO: 1750624 - RNA, 17 nt, Human herpesvirus 1
gcuggcaacucgcccca

SEQ ID NO: 1750625 - RNA, 20 nt, Human herpesvirus 1
cgccuaccggccccugggcc

SEQ ID NO: 1750626 - RNA, 21 nt, Human herpesvirus 1
agcaccucuaccagcaggucc

SEQ ID NO: 1750627 - RNA, 19 nt, Human herpesvirus 1
caaccgcgacccuccggga

SEQ ID NO: 1750628 - RNA, 17 nt, Human herpesvirus 1
ccacgaugaccgccccc

SEQ ID NO: 1750629 - RNA, 14 nt, Human herpesvirus 1
cgcccagacgcccu

SEQ ID NO: 1750630 - RNA, 21 nt, Human herpesvirus 1
uggccgcucgguggcuccggg

SEQ ID NO: 1750631 - RNA, 15 nt, Human herpesvirus 1
ccguggccccggccc

SEQ ID NO: 1750632 - RNA, 18 nt, Human herpesvirus 1
gggcuguuccgccaggcg

SEQ ID NO: 1750633 - RNA, 18 nt, Human herpesvirus 1
agacggcauucgggccug

SEQ ID NO: 1750634 - RNA, 13 nt, Human herpesvirus 1
gccggcggcgacg

SEQ ID NO: 1750635 - RNA, 20 nt, Human herpesvirus 1
cggcgacuuugacgaggcca

SEQ ID NO: 1750636 - RNA, 17 nt, Human herpesvirus 1
cgucuccucuucucccc

SEQ ID NO: 1750637 - RNA, 16 nt, Human herpesvirus 1
ccggggagggcagggc

SEQ ID NO: 1750638 - RNA, 15 nt, Human herpesvirus 1
gaugcacgcccccgc

SEQ ID NO: 1750639 - RNA, 21 nt, Human herpesvirus 1
cccuaaccaggccuccacccc

SEQ ID NO: 1750640 - RNA, 15 nt, Human herpesvirus 1
acgcccagcagcucc

SEQ ID NO: 1750641 - RNA, 15 nt, Human herpesvirus 1
cagugauguaaaugg

SEQ ID NO: 1750642 - RNA, 19 nt, Human herpesvirus 1
cgcggcgcgagcucccugc

SEQ ID NO: 1750643 - RNA, 17 nt, Human herpesvirus 1
uccgcggagcucccggg

SEQ ID NO: 1750644 - RNA, 21 nt, Human herpesvirus 1
acccaaaacacacggagcugc

SEQ ID NO: 1750645 - RNA, 14 nt, Human herpesvirus 1
cuuccggccucgau

SEQ ID NO: 1750646 - RNA, 16 nt, Human herpesvirus 1
cguccaucaccacgcc

SEQ ID NO: 1750647 - RNA, 19 nt, Human herpesvirus 1
caauccgugucggggaggg

SEQ ID NO: 1750648 - RNA, 13 nt, Human herpesvirus 1
cgggcccaaggcc

SEQ ID NO: 1750649 - RNA, 13 nt, Human herpesvirus 1
cccgccgccccac

SEQ ID NO: 1750650 - RNA, 12 nt, Human herpesvirus 1
guucccccccgu

SEQ ID NO: 1750651 - RNA, 13 nt, Human herpesvirus 1
ccuggcugaccca

SEQ ID NO: 1750652 - RNA, 14 nt, Human herpesvirus 1
cuaccggccccugg

SEQ ID NO: 1750653 - RNA, 14 nt, Human herpesvirus 1
cccaacuccucagc

SEQ ID NO: 1750654 - RNA, 14 nt, Human herpesvirus 1
aacucucgcaccau

SEQ ID NO: 1750655 - RNA, 16 nt, Human herpesvirus 1
ccacugcacucccugc

SEQ ID NO: 1750656 - RNA, 16 nt, Human herpesvirus 1
gacacugaaaugcccc

SEQ ID NO: 1750657 - RNA, 16 nt, Human herpesvirus 1
ugcgcccggcggaccc

SEQ ID NO: 1750658 - RNA, 15 nt, Human herpesvirus 1
uccuggaccagcuga

SEQ ID NO: 1750659 - RNA, 19 nt, Human herpesvirus 1
cgaccgcagucccugaguu

SEQ ID NO: 1750660 - RNA, 23 nt, Human herpesvirus 1
ucgccccguacaaguucaaggcc

SEQ ID NO: 1750661 - RNA, 23 nt, Human herpesvirus 1
cgacgccuuaccaucccccggcc

SEQ ID NO: 1750662 - RNA, 18 nt, Human herpesvirus 1
ugccagcuaugggcccug

SEQ ID NO: 1750663 - RNA, 12 nt, Human herpesvirus 1
gcggggcagagc

SEQ ID NO: 1750664 - RNA, 15 nt, Human herpesvirus 1
cgccucggcccgcga

SEQ ID NO: 1750665 - RNA, 16 nt, Human herpesvirus 1
cuauuuucccccccgg

SEQ ID NO: 1750666 - RNA, 13 nt, Human herpesvirus 1
cccagaugcccac

SEQ ID NO: 1750667 - RNA, 23 nt, Human herpesvirus 1
ggccucgaugacgucccggcucu

SEQ ID NO: 1750668 - RNA, 22 nt, Human herpesvirus 1
cggucagcgagacgaccucccc

SEQ ID NO: 1750669 - RNA, 13 nt, Human herpesvirus 1
ucgggcgcugggu

SEQ ID NO: 1750670 - RNA, 23 nt, Human herpesvirus 1
ccaagauggcccaguguacccug

SEQ ID NO: 1750671 - RNA, 21 nt, Human herpesvirus 1
cguagcgucgcgacagaacug

SEQ ID NO: 1750672 - RNA, 13 nt, Human herpesvirus 1
ccgggcguugggg

SEQ ID NO: 1750673 - RNA, 23 nt, Human herpesvirus 1
cgaccaacgucgccgcccugagc

SEQ ID NO: 1750674 - RNA, 14 nt, Human herpesvirus 1
uuaacuacauuaaa

SEQ ID NO: 1750675 - RNA, 22 nt, Human herpesvirus 1
ccaggucggcgaccgccagccg

SEQ ID NO: 1750676 - RNA, 13 nt, Human herpesvirus 1
gcgcugcccuccc

SEQ ID NO: 1750677 - RNA, 15 nt, Human herpesvirus 1
ggagccugagcuggc

SEQ ID NO: 1750678 - RNA, 11 nt, Human herpesvirus 1
ggauggggaga

SEQ ID NO: 1750679 - RNA, 21 nt, Human herpesvirus 1
accccuuuggggcgcuggccg

SEQ ID NO: 1750680 - RNA, 15 nt, Human herpesvirus 1
gccguuggcccccgc

SEQ ID NO: 1750681 - RNA, 13 nt, Human herpesvirus 1
cggggcucagcca

SEQ ID NO: 1750682 - RNA, 21 nt, Human herpesvirus 1
gaaccacguacggcucgcggg

SEQ ID NO: 1750683 - RNA, 22 nt, Human herpesvirus 1
ccacgacaaccccggucuccca

SEQ ID NO: 1750684 - RNA, 19 nt, Human herpesvirus 1
ccuggccgaggacaccccu

SEQ ID NO: 1750685 - RNA, 15 nt, Human herpesvirus 1
gcuggcaacucgccc

SEQ ID NO: 1750686 - RNA, 17 nt, Human herpesvirus 1
cgcgcguggaccugggg

SEQ ID NO: 1750687 - RNA, 18 nt, Human herpesvirus 1
agcucgcggagggcggcc

SEQ ID NO: 1750688 - RNA, 13 nt, Human herpesvirus 1
gcauucgggccug

SEQ ID NO: 1750689 - RNA, 14 nt, Human herpesvirus 1
cggcgucugggcca

SEQ ID NO: 1750690 - RNA, 12 nt, Human herpesvirus 1
ggcagcuggggg

SEQ ID NO: 1750691 - RNA, 22 nt, Human herpesvirus 1
cccgcguuugagaccgccggca

SEQ ID NO: 1750692 - RNA, 21 nt, Human herpesvirus 1
ccguccccuucgaggagguga

SEQ ID NO: 1750693 - RNA, 20 nt, Human herpesvirus 1
gcaacaaggccguggacggc

SEQ ID NO: 1750694 - RNA, 17 nt, Human herpesvirus 1
gagcacccugcugcccc

SEQ ID NO: 1750695 - RNA, 20 nt, Human herpesvirus 1
auucucgucuguccucggga

SEQ ID NO: 1750696 - RNA, 12 nt, Human herpesvirus 1
gugugcccaccc

SEQ ID NO: 1750697 - RNA, 21 nt, Human herpesvirus 1
ccugugugucguauguuuaug

SEQ ID NO: 1750698 - RNA, 20 nt, Human herpesvirus 1
ugccuugguggaugccucuc

SEQ ID NO: 1750699 - RNA, 15 nt, Human herpesvirus 1
ggaccgcagccuggu

SEQ ID NO: 1750700 - RNA, 16 nt, Human herpesvirus 1
uggcgcagcugggacc

SEQ ID NO: 1750701 - RNA, 16 nt, Human herpesvirus 1
cuccccgccgcggccu

SEQ ID NO: 1750702 - RNA, 15 nt, Human herpesvirus 1
auucgcuggaccuca

SEQ ID NO: 1750703 - RNA, 13 nt, Human herpesvirus 1
gccuccacccccu

SEQ ID NO: 1750704 - RNA, 20 nt, Human herpesvirus 1
cccacgacccgacucaccuc

SEQ ID NO: 1750705 - RNA, 21 nt, Human herpesvirus 1
ucugggcccgacagaccuccc

SEQ ID NO: 1750706 - RNA, 19 nt, Human herpesvirus 1
uaaaugguguccgcggucc

SEQ ID NO: 1750707 - RNA, 20 nt, Human herpesvirus 1
cgagcucccagagaccccag

SEQ ID NO: 1750708 - RNA, 14 nt, Human herpesvirus 1
ccgacauuaaccac

SEQ ID NO: 1750709 - RNA, 19 nt, Human herpesvirus 1
cgccacccaggcgcugggc

SEQ ID NO: 1750710 - RNA, 14 nt, Human herpesvirus 1
uccucguggccguu

SEQ ID NO: 1750711 - RNA, 18 nt, Human herpesvirus 1
gaaucccccaagggggag

SEQ ID NO: 1750712 - RNA, 16 nt, Human herpesvirus 1
cacaacacaaacaucu

SEQ ID NO: 1750713 - RNA, 18 nt, Human herpesvirus 1
ccggaccccacgcacccc

SEQ ID NO: 1750714 - RNA, 14 nt, Human herpesvirus 1
cggcgcugcagcgc

SEQ ID NO: 1750715 - RNA, 16 nt, Human herpesvirus 1
gcuguacucgacccac

SEQ ID NO: 1750716 - RNA, 13 nt, Human herpesvirus 1
acgccucccccug

SEQ ID NO: 1750717 - RNA, 12 nt, Human herpesvirus 1
cccaacagccgc

SEQ ID NO: 1750718 - RNA, 16 nt, Human herpesvirus 1
cggcccgaagccugcu

SEQ ID NO: 1750719 - RNA, 23 nt, Human herpesvirus 1
ccacauccaggcgggccuaccgg

SEQ ID NO: 1750720 - RNA, 17 nt, Human herpesvirus 1
accgcagucccugaguu

SEQ ID NO: 1750721 - RNA, 21 nt, Human herpesvirus 1
cgggccccggggagacagcgc

SEQ ID NO: 1750722 - RNA, 14 nt, Human herpesvirus 1
ccgcuuccaucgcc

SEQ ID NO: 1750723 - RNA, 13 nt, Human herpesvirus 1
ccugcggcuggcg

SEQ ID NO: 1750724 - RNA, 15 nt, Human herpesvirus 1
guaaccccccccaaa

SEQ ID NO: 1750725 - RNA, 17 nt, Human herpesvirus 1
ccgcuguucucguuccu

SEQ ID NO: 1750726 - RNA, 13 nt, Human herpesvirus 1
cuccuccaccacc

SEQ ID NO: 1750727 - RNA, 12 nt, Human herpesvirus 1
gucuccucuucu

SEQ ID NO: 1750728 - RNA, 23 nt, Human herpesvirus 1
ggguauaaauuccggaaggggac

SEQ ID NO: 1750729 - RNA, 16 nt, Human herpesvirus 1
cgcgcgaaaucguggc

SEQ ID NO: 1750730 - RNA, 14 nt, Human herpesvirus 1
cgcggggcccccgc

SEQ ID NO: 1750731 - RNA, 16 nt, Human herpesvirus 1
gaacaacaugggccug

SEQ ID NO: 1750732 - RNA, 16 nt, Human herpesvirus 1
gguucucccuguucaa

SEQ ID NO: 1750733 - RNA, 17 nt, Human herpesvirus 1
cguuggcccccgccucu

SEQ ID NO: 1750734 - RNA, 15 nt, Human herpesvirus 1
ucuaaugccacgcga

SEQ ID NO: 1750735 - RNA, 18 nt, Human herpesvirus 1
ccgacccccauggagcac

SEQ ID NO: 1750736 - RNA, 15 nt, Human herpesvirus 1
ucuucuccccuuccc

SEQ ID NO: 1750737 - RNA, 17 nt, Human herpesvirus 1
ugucgcagggcgccaug

SEQ ID NO: 1750738 - RNA, 17 nt, Human herpesvirus 1
ucaaggugggccagccg

SEQ ID NO: 1750739 - RNA, 19 nt, Human herpesvirus 1
cuuaauaaauuuuacaaac

SEQ ID NO: 1750740 - RNA, 18 nt, Human herpesvirus 1
ccaacgucuccuccacca

SEQ ID NO: 1750741 - RNA, 15 nt, Human herpesvirus 1
caccccgaagccccg

SEQ ID NO: 1750742 - RNA, 16 nt, Human herpesvirus 1
uccaccaccuucacca

SEQ ID NO: 1750743 - RNA, 22 nt, Human herpesvirus 1
gcggcaaagaccuuccgguccu

SEQ ID NO: 1750744 - RNA, 21 nt, Human herpesvirus 1
cacccgacaacagcccccggg

SEQ ID NO: 1750745 - RNA, 12 nt, Human herpesvirus 1
cgacacccccau

SEQ ID NO: 1750746 - RNA, 16 nt, Human herpesvirus 1
guaucugacgcgcccc

SEQ ID NO: 1750747 - RNA, 15 nt, Human herpesvirus 1
guguuuguggggagg

SEQ ID NO: 1750748 - RNA, 20 nt, Human herpesvirus 1
gcccccgccgcccggggcca

SEQ ID NO: 1750749 - RNA, 12 nt, Human herpesvirus 1
uucuguggccuc

SEQ ID NO: 1750750 - RNA, 22 nt, Human herpesvirus 1
acacacgggggagcgcucuugu

SEQ ID NO: 1750751 - RNA, 21 nt, Human herpesvirus 1
accacaggugggugcuuugga

SEQ ID NO: 1750752 - RNA, 16 nt, Human herpesvirus 1
caccgccaucagccuu

SEQ ID NO: 1750753 - RNA, 23 nt, Human herpesvirus 1
gccaugcgccagggcgcccccgc

SEQ ID NO: 1750754 - RNA, 18 nt, Human herpesvirus 1
cuauaagacucuccccca

SEQ ID NO: 1750755 - RNA, 17 nt, Human herpesvirus 1
ggggcccacccacccga

SEQ ID NO: 1750756 - RNA, 16 nt, Human herpesvirus 1
caugccucugcgggca

SEQ ID NO: 1750757 - RNA, 18 nt, Human herpesvirus 1
ggcccuguacagcucgcg

SEQ ID NO: 1750758 - RNA, 14 nt, Human herpesvirus 1
ccacggccucgcca

SEQ ID NO: 1750759 - RNA, 17 nt, Human herpesvirus 1
ccaacgucgccgcccug

SEQ ID NO: 1750760 - RNA, 21 nt, Human herpesvirus 1
ggacacuggguucuccuggaa

SEQ ID NO: 1750761 - RNA, 16 nt, Human herpesvirus 1
cacuggccgggagcac

SEQ ID NO: 1750762 - RNA, 15 nt, Human herpesvirus 1
augccccccuggcga

SEQ ID NO: 1750763 - RNA, 22 nt, Human herpesvirus 1
guauggggcgggggauggggag

SEQ ID NO: 1750764 - RNA, 13 nt, Human herpesvirus 1
cgccccgauggcc

SEQ ID NO: 1750765 - RNA, 15 nt, Human herpesvirus 1
gucuccacgugcgug

SEQ ID NO: 1750766 - RNA, 15 nt, Human herpesvirus 1
gaagacccccccgga

SEQ ID NO: 1750767 - RNA, 14 nt, Human herpesvirus 1
cugcagaugcagag

SEQ ID NO: 1750768 - RNA, 18 nt, Human herpesvirus 1
aacgucuccuccaccacc

SEQ ID NO: 1750769 - RNA, 12 nt, Human herpesvirus 1
cgucgauccagg

SEQ ID NO: 1750770 - RNA, 22 nt, Human herpesvirus 1
uccuguaaguacgcccucccgc

SEQ ID NO: 1750771 - RNA, 16 nt, Human herpesvirus 1
ccgcggucaucacccg

SEQ ID NO: 1750772 - RNA, 14 nt, Human herpesvirus 1
gucuggagacccua

SEQ ID NO: 1750773 - RNA, 13 nt, Human herpesvirus 1
gacccggcccgag

SEQ ID NO: 1750774 - RNA, 13 nt, Human herpesvirus 1
acagcggccugcu

SEQ ID NO: 1750775 - RNA, 14 nt, Human herpesvirus 1
ccucccccacaucc

SEQ ID NO: 1750776 - RNA, 16 nt, Human herpesvirus 1
ucccagagaccccagg

SEQ ID NO: 1750777 - RNA, 22 nt, Human herpesvirus 1
uacuccggccgcgguacagauc

SEQ ID NO: 1750778 - RNA, 15 nt, Human herpesvirus 1
ggagggcggccagcc

SEQ ID NO: 1750779 - RNA, 15 nt, Human herpesvirus 1
gggccgggccccaua

SEQ ID NO: 1750780 - RNA, 16 nt, Human herpesvirus 1
ccccggggcucagcca

SEQ ID NO: 1750781 - RNA, 18 nt, Human herpesvirus 1
cgcuccugugcacccuca

SEQ ID NO: 1750782 - RNA, 14 nt, Human herpesvirus 1
auccaccaccuuca

SEQ ID NO: 1750783 - RNA, 18 nt, Human herpesvirus 1
ggccgcccuggccgcgga

SEQ ID NO: 1750784 - RNA, 23 nt, Human herpesvirus 1
gagcccagaccccuucuccccac

SEQ ID NO: 1750785 - RNA, 16 nt, Human herpesvirus 1
cagccgcgccgcugcc

SEQ ID NO: 1750786 - RNA, 18 nt, Human herpesvirus 1
cgcgcuaugacggcaaua

SEQ ID NO: 1750787 - RNA, 22 nt, Human herpesvirus 1
cugggaacggacacgcggggac

SEQ ID NO: 1750788 - RNA, 19 nt, Human herpesvirus 1
gcuccgaguacggcggcuc

SEQ ID NO: 1750789 - RNA, 13 nt, Human herpesvirus 1
gggcgguucgccg

SEQ ID NO: 1750790 - RNA, 16 nt, Human herpesvirus 1
gccgggcgacccagau

SEQ ID NO: 1750791 - RNA, 14 nt, Human herpesvirus 1
cgcuaucuccuggg

SEQ ID NO: 1750792 - RNA, 14 nt, Human herpesvirus 1
gccaucccguggau

SEQ ID NO: 1750793 - RNA, 16 nt, Human herpesvirus 1
cugucggaccaccgcc

SEQ ID NO: 1750794 - RNA, 14 nt, Human herpesvirus 1
gccacccucucuuc

SEQ ID NO: 1750795 - RNA, 23 nt, Human herpesvirus 1
gccaccugcgcggguugcugcgc

SEQ ID NO: 1750796 - RNA, 18 nt, Human herpesvirus 1
gaaaaugaaccagacccu

SEQ ID NO: 1750797 - RNA, 16 nt, Human herpesvirus 1
acgcaagaccaggccu

SEQ ID NO: 1750798 - RNA, 13 nt, Human herpesvirus 1
ccggucucccagg

SEQ ID NO: 1750799 - RNA, 18 nt, Human herpesvirus 1
ggaggccgcaucgaacgc

SEQ ID NO: 1750800 - RNA, 13 nt, Human herpesvirus 1
ggguggcacagaa

SEQ ID NO: 1750801 - RNA, 17 nt, Human herpesvirus 1
ugcgucgggccucccgg

SEQ ID NO: 1750802 - RNA, 19 nt, Human herpesvirus 1
gccccauaaaacccaagcc

SEQ ID NO: 1750803 - RNA, 17 nt, Human herpesvirus 1
cuggcaacucgccccac

SEQ ID NO: 1750804 - RNA, 12 nt, Human herpesvirus 1
cggcccugcugc

SEQ ID NO: 1750805 - RNA, 17 nt, Human herpesvirus 1
gagcccacaugcggaaa

SEQ ID NO: 1750806 - RNA, 21 nt, Human herpesvirus 1
gccacccgacaacagcccccg

SEQ ID NO: 1750807 - RNA, 22 nt, Human herpesvirus 1
cucgaugacgucccggcucucc

SEQ ID NO: 1750808 - RNA, 22 nt, Human herpesvirus 1
ggcgcgacaacgagcccccgcc

SEQ ID NO: 1750809 - RNA, 19 nt, Human herpesvirus 1
gguagcccggccgugugac

SEQ ID NO: 1750810 - RNA, 21 nt, Human herpesvirus 1
guccacgguaggcccagcaug

SEQ ID NO: 1750811 - RNA, 20 nt, Human herpesvirus 1
gccuucccccggccaccucg

SEQ ID NO: 1750812 - RNA, 19 nt, Human herpesvirus 1
gcggccccagcccucuccc

SEQ ID NO: 1750813 - RNA, 14 nt, Human herpesvirus 1
cagcaucccccgcc

SEQ ID NO: 1750814 - RNA, 14 nt, Human herpesvirus 1
gugcuuucuggugc

SEQ ID NO: 1750815 - RNA, 15 nt, Human herpesvirus 1
aacccaaccaaacca

SEQ ID NO: 1750816 - RNA, 21 nt, Human herpesvirus 1
gucaccgguucguauccacaa

SEQ ID NO: 1750817 - RNA, 14 nt, Human herpesvirus 1
caagaccaccuccu

SEQ ID NO: 1750818 - RNA, 15 nt, Human herpesvirus 1
aucaccaugcuggag

SEQ ID NO: 1750819 - RNA, 23 nt, Human herpesvirus 1
gccaucgcguggugcgagcugca

SEQ ID NO: 1750820 - RNA, 14 nt, Human herpesvirus 1
ggagagcccacaug

SEQ ID NO: 1750821 - RNA, 18 nt, Human herpesvirus 1
cgagcccaccguggcccg

SEQ ID NO: 1750822 - RNA, 16 nt, Human herpesvirus 1
uggcgagcccagaccc

SEQ ID NO: 1750823 - RNA, 14 nt, Human herpesvirus 1
accacacaccagcg

SEQ ID NO: 1750824 - RNA, 16 nt, Human herpesvirus 1
accuccacccccucga

SEQ ID NO: 1750825 - RNA, 17 nt, Human herpesvirus 1
cccuacaaccugaccau

SEQ ID NO: 1750826 - RNA, 18 nt, Human herpesvirus 1
cacgcccgaccacacacc

SEQ ID NO: 1750827 - RNA, 18 nt, Human herpesvirus 1
gaagaacagaaaaccgaa

SEQ ID NO: 1750828 - RNA, 16 nt, Human herpesvirus 1
ggaggcgccgcgcgga

SEQ ID NO: 1750829 - RNA, 19 nt, Human herpesvirus 1
gccauguuugcgggccugg

SEQ ID NO: 1750830 - RNA, 16 nt, Human herpesvirus 1
agucccugaguuggga

SEQ ID NO: 1750831 - RNA, 16 nt, Human herpesvirus 1
ugguaauuagaaacuc

SEQ ID NO: 1750832 - RNA, 12 nt, Human herpesvirus 1
cuccccuucccu

SEQ ID NO: 1750833 - RNA, 21 nt, Human herpesvirus 1
gcgagauuuuucuguaucuga

SEQ ID NO: 1750834 - RNA, 22 nt, Human herpesvirus 1
cgugcccucgcgggccucgugg

SEQ ID NO: 1750835 - RNA, 18 nt, Human herpesvirus 1
accuccgcgagcagagcc

SEQ ID NO: 1750836 - RNA, 18 nt, Human herpesvirus 1
cacgccaaugcccucccu

SEQ ID NO: 1750837 - RNA, 22 nt, Human herpesvirus 1
cccggcucuccgaucccaacuc

SEQ ID NO: 1750838 - RNA, 19 nt, Human herpesvirus 1
ggucugucucgucuccucu

SEQ ID NO: 1750839 - RNA, 20 nt, Human herpesvirus 1
cgcuggggcccccagggucc

SEQ ID NO: 1750840 - RNA, 21 nt, Human herpesvirus 1
accaccccgagaaccuaggga

SEQ ID NO: 1750841 - RNA, 23 nt, Human herpesvirus 1
ccgcuggcuggaaaccgagcuug

SEQ ID NO: 1750842 - RNA, 14 nt, Human herpesvirus 1
cuuccgguccugga

SEQ ID NO: 1750843 - RNA, 14 nt, Human herpesvirus 1
cucucaagauggcc

SEQ ID NO: 1750844 - RNA, 13 nt, Human herpesvirus 1
aguccccgggccc

SEQ ID NO: 1750845 - RNA, 21 nt, Human herpesvirus 1
uguacaacaucauccagcugg

SEQ ID NO: 1750846 - RNA, 22 nt, Human herpesvirus 1
agcugcucgagaugggccaggg

SEQ ID NO: 1750847 - RNA, 17 nt, Human herpesvirus 1
cagcugcacgaccugcg

SEQ ID NO: 1750848 - RNA, 18 nt, Human herpesvirus 1
acccaccgacacaugcac

SEQ ID NO: 1750849 - RNA, 19 nt, Human herpesvirus 1
cgcuggcaacucgccccac

SEQ ID NO: 1750850 - RNA, 21 nt, Human herpesvirus 1
cugcgaguccugcgccccgcc

SEQ ID NO: 1750851 - RNA, 17 nt, Human herpesvirus 1
ccccucgccccauacuc

SEQ ID NO: 1750852 - RNA, 14 nt, Human herpesvirus 1
ugguccgccuagcc

SEQ ID NO: 1750853 - RNA, 16 nt, Human herpesvirus 1
cagucuucggcgguga

SEQ ID NO: 1750854 - RNA, 13 nt, Human herpesvirus 1
guccccucugggc

SEQ ID NO: 1750855 - RNA, 21 nt, Human herpesvirus 1
caacucucgcaccaucccggg

SEQ ID NO: 1750856 - RNA, 18 nt, Human herpesvirus 1
uguccuggggauggccau

SEQ ID NO: 1750857 - RNA, 19 nt, Human herpesvirus 1
cccacuacaccagccaauc

SEQ ID NO: 1750858 - RNA, 19 nt, Human herpesvirus 1
ucgcccgauuuacagcccc

SEQ ID NO: 1750859 - RNA, 20 nt, Human herpesvirus 1
cugggcuuccgacgcccccc

SEQ ID NO: 1750860 - RNA, 21 nt, Human herpesvirus 1
ccgccugucgcacccacagcu

SEQ ID NO: 1750861 - RNA, 19 nt, Human herpesvirus 1
gaaagcaagaacaauaaag

SEQ ID NO: 1750862 - RNA, 21 nt, Human herpesvirus 1
ccgcgacgccuuaccaucccc

SEQ ID NO: 1750863 - RNA, 15 nt, Human herpesvirus 1
gggcucguccccugg

SEQ ID NO: 1750864 - RNA, 15 nt, Human herpesvirus 1
cagaugcccacgggc

SEQ ID NO: 1750865 - RNA, 14 nt, Human herpesvirus 1
aaccccggucuccc

SEQ ID NO: 1750866 - RNA, 20 nt, Human herpesvirus 1
gccuggucagaggcccacgc

SEQ ID NO: 1750867 - RNA, 15 nt, Human herpesvirus 1
ccauauccaccaccu

SEQ ID NO: 1750868 - RNA, 21 nt, Human herpesvirus 1
cgcgaccucaccaccaaggcc

SEQ ID NO: 1750869 - RNA, 22 nt, Human herpesvirus 1
ugggcauccagggagaaacccc

SEQ ID NO: 1750870 - RNA, 15 nt, Human herpesvirus 1
ccggcccugcugcug

SEQ ID NO: 1750871 - RNA, 14 nt, Human herpesvirus 1
ggccauggcccgcc

SEQ ID NO: 1750872 - RNA, 15 nt, Human herpesvirus 1
gggccguggcggcca

SEQ ID NO: 1750873 - RNA, 16 nt, Human herpesvirus 1
ccgcguccaaacccac

SEQ ID NO: 1750874 - RNA, 17 nt, Human herpesvirus 1
ggggcgggggccccgcc

SEQ ID NO: 1750875 - RNA, 16 nt, Human herpesvirus 1
cugcaccgaucgcagc

SEQ ID NO: 1750876 - RNA, 16 nt, Human herpesvirus 1
ccuaccggccccuggg

SEQ ID NO: 1750877 - RNA, 16 nt, Human herpesvirus 1
cggacgacggcggcga

SEQ ID NO: 1750878 - RNA, 23 nt, Human herpesvirus 1
ggucuccccgggagccccggacc

SEQ ID NO: 1750879 - RNA, 16 nt, Human herpesvirus 1
gauccucgggcuacug

SEQ ID NO: 1750880 - RNA, 18 nt, Human herpesvirus 1
guccccggcccggaggag

SEQ ID NO: 1750881 - RNA, 15 nt, Human herpesvirus 1
ccaaggucaccgaca

SEQ ID NO: 1750882 - RNA, 21 nt, Human herpesvirus 1
cauuuauugacccaaaacaca

SEQ ID NO: 1750883 - RNA, 11 nt, Human herpesvirus 1
ggcgccgcgag

SEQ ID NO: 1750884 - RNA, 16 nt, Human herpesvirus 1
cuugguucggggccgc

SEQ ID NO: 1750885 - RNA, 23 nt, Human herpesvirus 1
cucuucuccccuucccucccccu

SEQ ID NO: 1750886 - RNA, 19 nt, Human herpesvirus 1
cagucccugaguugggaau

SEQ ID NO: 1750887 - RNA, 12 nt, Human herpesvirus 1
agggcagggccg

SEQ ID NO: 1750888 - RNA, 14 nt, Human herpesvirus 1
aggaccgcgccccc

SEQ ID NO: 1750889 - RNA, 17 nt, Human herpesvirus 1
cgagauccccggggccc

SEQ ID NO: 1750890 - RNA, 18 nt, Human herpesvirus 1
cacccaguuuccaccccc

SEQ ID NO: 1750891 - RNA, 15 nt, Human herpesvirus 1
uccccgggcccagcc

SEQ ID NO: 1750892 - RNA, 20 nt, Human herpesvirus 1
gggcaaguaugccccccugg

SEQ ID NO: 1750893 - RNA, 13 nt, Human herpesvirus 1
ggcccggccaggc

SEQ ID NO: 1750894 - RNA, 18 nt, Human herpesvirus 1
ggcagcaugggacccaca

SEQ ID NO: 1750895 - RNA, 17 nt, Human herpesvirus 1
acgugcugcugcggccc

SEQ ID NO: 1750896 - RNA, 18 nt, Human herpesvirus 1
cccgccguugagccccuc

SEQ ID NO: 1750897 - RNA, 13 nt, Human herpesvirus 1
ccgccgcccgggg

SEQ ID NO: 1750898 - RNA, 19 nt, Human herpesvirus 1
gccaccccgaacaacaugg

SEQ ID NO: 1750899 - RNA, 13 nt, Human herpesvirus 1
uguucacaggggg

SEQ ID NO: 1750900 - RNA, 16 nt, Human herpesvirus 1
cgacgucgcgccuggg

SEQ ID NO: 1750901 - RNA, 20 nt, Human herpesvirus 1
acccugaucccccgcgcggc

SEQ ID NO: 1750902 - RNA, 12 nt, Human herpesvirus 1
ugaaccccagcc

SEQ ID NO: 1750903 - RNA, 16 nt, Human herpesvirus 1
cccucccccuccgcau

SEQ ID NO: 1750904 - RNA, 19 nt, Human herpesvirus 1
gccaucugggauggcuccu

SEQ ID NO: 1750905 - RNA, 18 nt, Human herpesvirus 1
ugcgucccuccccgguuu

SEQ ID NO: 1750906 - RNA, 13 nt, Human herpesvirus 1
ccgacagaccucc

SEQ ID NO: 1750907 - RNA, 18 nt, Human herpesvirus 1
accucggcgggcacgcca

SEQ ID NO: 1750908 - RNA, 14 nt, Human herpesvirus 1
agccuuuaacuaca

SEQ ID NO: 1750909 - RNA, 19 nt, Human herpesvirus 1
cgacagcacucacagcccc

SEQ ID NO: 1750910 - RNA, 16 nt, Human herpesvirus 1
gcgcggaugcucggcg

SEQ ID NO: 1750911 - RNA, 19 nt, Human herpesvirus 1
cggccgccacccaggcgcu

SEQ ID NO: 1750912 - RNA, 20 nt, Human herpesvirus 1
ccagcagacgcugcuccgcc

SEQ ID NO: 1750913 - RNA, 22 nt, Human herpesvirus 1
uacaccucccagugucccgaca

SEQ ID NO: 1750914 - RNA, 17 nt, Human herpesvirus 1
gacauggucaugcgcaa

SEQ ID NO: 1750915 - RNA, 17 nt, Human herpesvirus 1
uguccccgaacaaacga

SEQ ID NO: 1750916 - RNA, 18 nt, Human herpesvirus 1
cgaucccccgcccccggc

SEQ ID NO: 1750917 - RNA, 21 nt, Human herpesvirus 1
uuccgcggccccagcccucuc

SEQ ID NO: 1750918 - RNA, 18 nt, Human herpesvirus 1
acuuccccgacugccccc

SEQ ID NO: 1750919 - RNA, 17 nt, Human herpesvirus 1
ggcauggcgcagcuggg

SEQ ID NO: 1750920 - RNA, 14 nt, Human herpesvirus 1
cacaaccucccggg

SEQ ID NO: 1750921 - RNA, 15 nt, Human herpesvirus 1
agguccagcgccgca

SEQ ID NO: 1750922 - RNA, 18 nt, Human herpesvirus 1
guccccucugggcccgcc

SEQ ID NO: 1750923 - RNA, 19 nt, Human herpesvirus 1
cgcgaucguccaccuccgg

SEQ ID NO: 1750924 - RNA, 12 nt, Human herpesvirus 1
ccaccggaagcc

SEQ ID NO: 1750925 - RNA, 21 nt, Human herpesvirus 1
cacaaacacaaaacacacggg

SEQ ID NO: 1750926 - RNA, 12 nt, Human herpesvirus 1
cgccgcgggcca

SEQ ID NO: 1750927 - RNA, 20 nt, Human herpesvirus 1
gaagcccaacccacacgcac

SEQ ID NO: 1750928 - RNA, 13 nt, Human herpesvirus 1
cggagcucccggg

SEQ ID NO: 1750929 - RNA, 14 nt, Human herpesvirus 1
ggacggcgccgggg

SEQ ID NO: 1750930 - RNA, 22 nt, Human herpesvirus 1
ccggaagcccaacccacacgca

SEQ ID NO: 1750931 - RNA, 12 nt, Human herpesvirus 1
uaaaaggcauua

SEQ ID NO: 1750932 - RNA, 17 nt, Human herpesvirus 1
ccaacgucuccuccacc

SEQ ID NO: 1750933 - RNA, 16 nt, Human herpesvirus 1
cccaugcgacagcgga

SEQ ID NO: 1750934 - RNA, 16 nt, Human herpesvirus 1
caaaugccgggccaag

SEQ ID NO: 1750935 - RNA, 18 nt, Human herpesvirus 1
uggcggggcaggcgccuc

SEQ ID NO: 1750936 - RNA, 14 nt, Human herpesvirus 1
ccgggcgcgucccc

SEQ ID NO: 1750937 - RNA, 19 nt, Human herpesvirus 1
ccaacgaccccgcccaugg

SEQ ID NO: 1750938 - RNA, 23 nt, Human herpesvirus 1
caccgguuuccgcgacccaccgg

SEQ ID NO: 1750939 - RNA, 20 nt, Human herpesvirus 1
caacgucuccuccaccaccc

SEQ ID NO: 1750940 - RNA, 18 nt, Human herpesvirus 1
ggggaccuugccccggcc

SEQ ID NO: 1750941 - RNA, 22 nt, Human herpesvirus 1
aaauacagcauggcgccacacc

SEQ ID NO: 1750942 - RNA, 12 nt, Human herpesvirus 1
ucaucccacccc

SEQ ID NO: 1750943 - RNA, 18 nt, Human herpesvirus 1
aagcgacggacgugcgcc

SEQ ID NO: 1750944 - RNA, 17 nt, Human herpesvirus 1
auaaccgaccgcagucc

SEQ ID NO: 1750945 - RNA, 14 nt, Human herpesvirus 1
cuggccgcgcccac

SEQ ID NO: 1750946 - RNA, 23 nt, Human herpesvirus 1
agucuucggggcccggcccauug

SEQ ID NO: 1750947 - RNA, 16 nt, Human herpesvirus 1
gcgcagguggugcaug

SEQ ID NO: 1750948 - RNA, 14 nt, Human herpesvirus 1
gccuaccagcaggg

SEQ ID NO: 1750949 - RNA, 15 nt, Human herpesvirus 1
accgccaucagccuu

SEQ ID NO: 1750950 - RNA, 17 nt, Human herpesvirus 1
agcgaccccacggccuc

SEQ ID NO: 1750951 - RNA, 13 nt, Human herpesvirus 1
ccgcgccucccgg

SEQ ID NO: 1750952 - RNA, 12 nt, Human herpesvirus 1
gacgccgcgcag

SEQ ID NO: 1750953 - RNA, 24 nt, Human herpesvirus 1
acggcauucgggccugccugcggc

SEQ ID NO: 1750954 - RNA, 20 nt, Human herpesvirus 1
guccgcggggccucccccgg

SEQ ID NO: 1750955 - RNA, 21 nt, Human herpesvirus 1
gccacacucaaaaagccccaa

SEQ ID NO: 1750956 - RNA, 18 nt, Human herpesvirus 1
uggggauggccauagccg

SEQ ID NO: 1750957 - RNA, 13 nt, Human herpesvirus 1
uaucccacggccu

SEQ ID NO: 1750958 - RNA, 18 nt, Human herpesvirus 1
gggagaacaacgagcugc

SEQ ID NO: 1750959 - RNA, 19 nt, Human herpesvirus 1
acggcccgaagccugcugu

SEQ ID NO: 1750960 - RNA, 16 nt, Human herpesvirus 1
cucccccguguccugg

SEQ ID NO: 1750961 - RNA, 20 nt, Human herpesvirus 1
gcucgucgggguggcacaga

SEQ ID NO: 1750962 - RNA, 15 nt, Human herpesvirus 1
agacacgggcaccac

SEQ ID NO: 1750963 - RNA, 14 nt, Human herpesvirus 1
cuucccucagguca

SEQ ID NO: 1750964 - RNA, 11 nt, Human herpesvirus 1
gcgucuggccc

SEQ ID NO: 1750965 - RNA, 17 nt, Human herpesvirus 1
gacgucaauugcccgag

SEQ ID NO: 1750966 - RNA, 22 nt, Human herpesvirus 1
ccagucgcccgaagacaccccc

SEQ ID NO: 1750967 - RNA, 14 nt, Human herpesvirus 1
cuaggagacaccuu

SEQ ID NO: 1750968 - RNA, 14 nt, Human herpesvirus 1
ugcacagccuggcc

SEQ ID NO: 1750969 - RNA, 21 nt, Human herpesvirus 1
cagccucgucccgcccguguu

SEQ ID NO: 1750970 - RNA, 13 nt, Human herpesvirus 1
ggccccacgguca

SEQ ID NO: 1750971 - RNA, 20 nt, Human herpesvirus 1
uaaaccagguaauaccaaau

SEQ ID NO: 1750972 - RNA, 14 nt, Human herpesvirus 1
ccugggccaccuga

SEQ ID NO: 1750973 - RNA, 16 nt, Human herpesvirus 1
cccggucucccaggga

SEQ ID NO: 1750974 - RNA, 15 nt, Human herpesvirus 1
agccagacccaaccc

SEQ ID NO: 1750975 - RNA, 21 nt, Human herpesvirus 1
gcagggccgcggggggggcgg

SEQ ID NO: 1750976 - RNA, 15 nt, Human herpesvirus 1
ccagcagacgcugcu

SEQ ID NO: 1750977 - RNA, 13 nt, Human herpesvirus 1
ccgcggccugggu

SEQ ID NO: 1750978 - RNA, 20 nt, Human herpesvirus 1
gguccguguuucucgcccca

SEQ ID NO: 1750979 - RNA, 19 nt, Human herpesvirus 1
agccgccccagcaccgaca

SEQ ID NO: 1750980 - RNA, 15 nt, Human herpesvirus 1
cgggcuacacggccg

SEQ ID NO: 1750981 - RNA, 17 nt, Human herpesvirus 1
gcgcaguccacgggggg

SEQ ID NO: 1750982 - RNA, 23 nt, Human herpesvirus 1
cggcugguccacacccaguggcu

SEQ ID NO: 1750983 - RNA, 19 nt, Human herpesvirus 1
cgccccggcgacccugauc

SEQ ID NO: 1750984 - RNA, 16 nt, Human herpesvirus 1
gcguggugcgagcugc

SEQ ID NO: 1750985 - RNA, 20 nt, Human herpesvirus 1
gguggucucuggccgcgccc

SEQ ID NO: 1750986 - RNA, 12 nt, Human herpesvirus 1
caccuccacccc

SEQ ID NO: 1750987 - RNA, 12 nt, Human herpesvirus 1
cggacccgcauc

SEQ ID NO: 1750988 - RNA, 23 nt, Human herpesvirus 1
guggaacgaggcccgcaagcuga

SEQ ID NO: 1750989 - RNA, 12 nt, Human herpesvirus 1
ucccgaagccca

SEQ ID NO: 1750990 - RNA, 22 nt, Human herpesvirus 1
guccggcacggacccaaaauaa

SEQ ID NO: 1750991 - RNA, 18 nt, Human herpesvirus 1
auguggauaaaaagccag

SEQ ID NO: 1750992 - RNA, 13 nt, Human herpesvirus 1
gcaacaaccugga

SEQ ID NO: 1750993 - RNA, 13 nt, Human herpesvirus 1
ugcccucgcgggc

SEQ ID NO: 1750994 - RNA, 17 nt, Human herpesvirus 1
gcggaccggcggcgcug

SEQ ID NO: 1750995 - RNA, 19 nt, Human herpesvirus 1
gcccccagaugcccacggg

SEQ ID NO: 1750996 - RNA, 19 nt, Human herpesvirus 1
cagucgcccgaagacaccc

SEQ ID NO: 1750997 - RNA, 18 nt, Human herpesvirus 1
uggggacgguggcgccgc

SEQ ID NO: 1750998 - RNA, 21 nt, Human herpesvirus 1
agcccacaugcggaaagcaag

SEQ ID NO: 1750999 - RNA, 20 nt, Human herpesvirus 1
ucaaggacagcggccugcug

SEQ ID NO: 1751000 - RNA, 23 nt, Human herpesvirus 1
ugggaacggacacgcggggacac

SEQ ID NO: 1751001 - RNA, 21 nt, Human herpesvirus 1
cggcgaccucggcgccucugg

SEQ ID NO: 1751002 - RNA, 19 nt, Human herpesvirus 1
cucaagauggccgacccca

SEQ ID NO: 1751003 - RNA, 14 nt, Human herpesvirus 1
cgcgccccucuggc

SEQ ID NO: 1751004 - RNA, 15 nt, Human herpesvirus 1
uggccgugggucugu

SEQ ID NO: 1751005 - RNA, 23 nt, Human herpesvirus 1
uccgcuuccaucgccccuggcgc

SEQ ID NO: 1751006 - RNA, 20 nt, Human herpesvirus 1
acgcucuccccugcugccau

SEQ ID NO: 1751007 - RNA, 11 nt, Human herpesvirus 1
cgcaagccccu

SEQ ID NO: 1751008 - RNA, 15 nt, Human herpesvirus 1
ggccggccuggcggc

SEQ ID NO: 1751009 - RNA, 21 nt, Human herpesvirus 1
cccgcgcgccccgagaccagu

SEQ ID NO: 1751010 - RNA, 14 nt, Human herpesvirus 1
guccugcgccccgc

SEQ ID NO: 1751011 - RNA, 23 nt, Human herpesvirus 1
uaccacgcccgaccacacacccc

SEQ ID NO: 1751012 - RNA, 22 nt, Human herpesvirus 1
ggagggcgccucggucacccca

SEQ ID NO: 1751013 - RNA, 21 nt, Human herpesvirus 1
cgaggcgcauaaagggccggu

SEQ ID NO: 1751014 - RNA, 17 nt, Human herpesvirus 1
gcaaaucccaccaaacu

SEQ ID NO: 1751015 - RNA, 17 nt, Human herpesvirus 1
acugugcuauccccauc

SEQ ID NO: 1751016 - RNA, 17 nt, Human herpesvirus 1
ggagccccggaccccac

SEQ ID NO: 1751017 - RNA, 13 nt, Human herpesvirus 1
acucucccaccgc

SEQ ID NO: 1751018 - RNA, 15 nt, Human herpesvirus 1
cgaccaccauccccg

SEQ ID NO: 1751019 - RNA, 16 nt, Human herpesvirus 1
caguuuauccuggagc

SEQ ID NO: 1751020 - RNA, 13 nt, Human herpesvirus 1
aagcgcugcugcg

SEQ ID NO: 1751021 - RNA, 18 nt, Human herpesvirus 1
cagacgagcgcgcuuguc

SEQ ID NO: 1751022 - RNA, 16 nt, Human herpesvirus 1
gcaucuucgcccgcag

SEQ ID NO: 1751023 - RNA, 13 nt, Human herpesvirus 1
cugccagaccuca

SEQ ID NO: 1751024 - RNA, 20 nt, Human herpesvirus 1
cccccuggagguguacaccc

SEQ ID NO: 1751025 - RNA, 13 nt, Human herpesvirus 1
ccacgccacccug

SEQ ID NO: 1751026 - RNA, 13 nt, Human herpesvirus 1
gcgcuccucugcg

SEQ ID NO: 1751027 - RNA, 22 nt, Human herpesvirus 1
ugggugcgggggggucaggucu

SEQ ID NO: 1751028 - RNA, 17 nt, Human herpesvirus 1
gccagggcgcccccgcg

SEQ ID NO: 1751029 - RNA, 15 nt, Human herpesvirus 1
ccugggcccuggccg

SEQ ID NO: 1751030 - RNA, 18 nt, Human herpesvirus 1
ggccuuguuccgcuuccc

SEQ ID NO: 1751031 - RNA, 23 nt, Human herpesvirus 1
cgaggggaugggcgaccuggggc

SEQ ID NO: 1751032 - RNA, 22 nt, Human herpesvirus 1
gccgguugcgguucguucugga

SEQ ID NO: 1751033 - RNA, 17 nt, Human herpesvirus 1
cauccugcggcucgugg

SEQ ID NO: 1751034 - RNA, 19 nt, Human herpesvirus 1
cccucucuucccucagguc

SEQ ID NO: 1751035 - RNA, 16 nt, Human herpesvirus 1
cguggcggccccugau

SEQ ID NO: 1751036 - RNA, 20 nt, Human herpesvirus 1
ggaucuuugaggaccgcgcc

SEQ ID NO: 1751037 - RNA, 11 nt, Human herpesvirus 1
ccggaccccac

SEQ ID NO: 1751038 - RNA, 15 nt, Human herpesvirus 1
gcguccaaacccacc

SEQ ID NO: 1751039 - RNA, 20 nt, Human herpesvirus 1
uggucuucaaggagaacauc

SEQ ID NO: 1751040 - RNA, 18 nt, Human herpesvirus 1
gcgcccacuacaccagcc

SEQ ID NO: 1751041 - RNA, 18 nt, Human herpesvirus 1
gguggagggugucccagg

SEQ ID NO: 1751042 - RNA, 15 nt, Human herpesvirus 1
cgggcucguccccug

SEQ ID NO: 1751043 - RNA, 22 nt, Human herpesvirus 1
caccgucggaggccccccagau

SEQ ID NO: 1751044 - RNA, 19 nt, Human herpesvirus 1
uggcgcgucguucgggcgg

SEQ ID NO: 1751045 - RNA, 15 nt, Human herpesvirus 1
acucucccaccgcca

SEQ ID NO: 1751046 - RNA, 16 nt, Human herpesvirus 1
agaacucgccccggaa

SEQ ID NO: 1751047 - RNA, 19 nt, Human herpesvirus 1
uaccaacccgccccuaacc

SEQ ID NO: 1751048 - RNA, 18 nt, Human herpesvirus 1
gaccccauggaccccagc

SEQ ID NO: 1751049 - RNA, 22 nt, Human herpesvirus 1
gggcacgccaagcccccgcccg

SEQ ID NO: 1751050 - RNA, 13 nt, Human herpesvirus 1
cgccgcugacccc

SEQ ID NO: 1751051 - RNA, 16 nt, Human herpesvirus 1
ccucaagcaggccauc

SEQ ID NO: 1751052 - RNA, 16 nt, Human herpesvirus 1
ucagccugccucuccc

SEQ ID NO: 1751053 - RNA, 14 nt, Human herpesvirus 1
gccaccucgcccac

SEQ ID NO: 1751054 - RNA, 20 nt, Human herpesvirus 1
gaucuacugcugggccaugg

SEQ ID NO: 1751055 - RNA, 12 nt, Human herpesvirus 1
gcagaugcagag

SEQ ID NO: 1751056 - RNA, 19 nt, Human herpesvirus 1
accguaacggcauaugcaa

SEQ ID NO: 1751057 - RNA, 21 nt, Human herpesvirus 1
ccaggguaccgcgugacccca

SEQ ID NO: 1751058 - RNA, 12 nt, Human herpesvirus 1
ccguccccugcc

SEQ ID NO: 1751059 - RNA, 20 nt, Human herpesvirus 1
gcacgccaaugcccucccug

SEQ ID NO: 1751060 - RNA, 18 nt, Human herpesvirus 1
gccugugugucuucucuu

SEQ ID NO: 1751061 - RNA, 13 nt, Human herpesvirus 1
ggaugcugccccg

SEQ ID NO: 1751062 - RNA, 14 nt, Human herpesvirus 1
agguccggccuggg

SEQ ID NO: 1751063 - RNA, 12 nt, Human herpesvirus 1
cacgggcgccac

SEQ ID NO: 1751064 - RNA, 14 nt, Human herpesvirus 1
gacguccugggcca

SEQ ID NO: 1751065 - RNA, 13 nt, Human herpesvirus 1
cuuccccgcuguc

SEQ ID NO: 1751066 - RNA, 15 nt, Human herpesvirus 1
acaacucccccgcgc

SEQ ID NO: 1751067 - RNA, 14 nt, Human herpesvirus 1
gcucacgaccccca

SEQ ID NO: 1751068 - RNA, 19 nt, Human herpesvirus 1
ggaucaccaaccacccggg

SEQ ID NO: 1751069 - RNA, 23 nt, Human herpesvirus 1
acucccccgcgcgccccgagacc

SEQ ID NO: 1751070 - RNA, 18 nt, Human herpesvirus 1
uuguccccgaacaaacga

SEQ ID NO: 1751071 - RNA, 19 nt, Human herpesvirus 1
ccaggaaauccguggcccc

SEQ ID NO: 1751072 - RNA, 22 nt, Human herpesvirus 1
acgcgccgcgggcccccggccg

SEQ ID NO: 1751073 - RNA, 20 nt, Human herpesvirus 1
ucggccgccgacgaccuggu

SEQ ID NO: 1751074 - RNA, 22 nt, Human herpesvirus 1
cccuguuugucgccuggcuggc

SEQ ID NO: 1751075 - RNA, 14 nt, Human herpesvirus 1
guccucgcaccagc

SEQ ID NO: 1751076 - RNA, 16 nt, Human herpesvirus 1
guauccacccccgccc

SEQ ID NO: 1751077 - RNA, 19 nt, Human herpesvirus 1
ugcaugucgucacggugac

SEQ ID NO: 1751078 - RNA, 14 nt, Human herpesvirus 1
cuguggccucccga

SEQ ID NO: 1751079 - RNA, 20 nt, Human herpesvirus 1
ggacugguuggaagcgcggg

SEQ ID NO: 1751080 - RNA, 21 nt, Human herpesvirus 1
ccauggagcacgagcaggcgg

SEQ ID NO: 1751081 - RNA, 22 nt, Human herpesvirus 1
cgaggucaaaugccgggccaag

SEQ ID NO: 1751082 - RNA, 21 nt, Human herpesvirus 1
cguggagcgcaucaagaccac

SEQ ID NO: 1751083 - RNA, 21 nt, Human herpesvirus 1
ccuaccggccccugggccccg

SEQ ID NO: 1751084 - RNA, 19 nt, Human herpesvirus 1
ggcccucuuggaggacccc

SEQ ID NO: 1751085 - RNA, 19 nt, Human herpesvirus 1
cgggggauggggagagccc

SEQ ID NO: 1751086 - RNA, 22 nt, Human herpesvirus 1
ggcggcgugugggggugcccca

SEQ ID NO: 1751087 - RNA, 13 nt, Human herpesvirus 1
cgacgcacacacc

SEQ ID NO: 1751088 - RNA, 18 nt, Human herpesvirus 1
gccggcaugcaccccaga

SEQ ID NO: 1751089 - RNA, 16 nt, Human herpesvirus 1
caucggcaaggacgcc

SEQ ID NO: 1751090 - RNA, 14 nt, Human herpesvirus 1
uccuaacccagacc

SEQ ID NO: 1751091 - RNA, 15 nt, Human herpesvirus 1
accugcgcuucgccg

SEQ ID NO: 1751092 - RNA, 15 nt, Human herpesvirus 1
ccccugauggagccu

SEQ ID NO: 1751093 - RNA, 19 nt, Human herpesvirus 1
acuuccuauaagacucucc

SEQ ID NO: 1751094 - RNA, 21 nt, Human herpesvirus 1
guacauguucuuuaugcgccc

SEQ ID NO: 1751095 - RNA, 18 nt, Human herpesvirus 1
gagucgacgaccugggga

SEQ ID NO: 1751096 - RNA, 18 nt, Human herpesvirus 1
acaccccccaugcgggcu

SEQ ID NO: 1751097 - RNA, 20 nt, Human herpesvirus 1
uggucgucgggcgccaaagc

SEQ ID NO: 1751098 - RNA, 17 nt, Human herpesvirus 1
caauuugcacccagccu

SEQ ID NO: 1751099 - RNA, 19 nt, Human herpesvirus 1
ggacccccccucgcgccac

SEQ ID NO: 1751100 - RNA, 15 nt, Human herpesvirus 1
ugaccgcccccagcu

SEQ ID NO: 1751101 - RNA, 17 nt, Human herpesvirus 1
ugcgggguugggauggg

SEQ ID NO: 1751102 - RNA, 15 nt, Human herpesvirus 1
ggacuuugagcuugc

SEQ ID NO: 1751103 - RNA, 19 nt, Human herpesvirus 1
ccgccaaauaaagccacug

SEQ ID NO: 1751104 - RNA, 17 nt, Human herpesvirus 1
gccgggagcgccaggac

SEQ ID NO: 1751105 - RNA, 15 nt, Human herpesvirus 1
accauggccccccgc

SEQ ID NO: 1751106 - RNA, 16 nt, Human herpesvirus 1
ccagaccggcaccacc

SEQ ID NO: 1751107 - RNA, 21 nt, Human herpesvirus 1
caacggcaugccucugcgggc

SEQ ID NO: 1751108 - RNA, 13 nt, Human herpesvirus 1
gccccgacgcacc

SEQ ID NO: 1751109 - RNA, 23 nt, Human herpesvirus 1
gguggucucuggccgcgcccacu

SEQ ID NO: 1751110 - RNA, 18 nt, Human herpesvirus 1
gccagaacucgccccgga

SEQ ID NO: 1751111 - RNA, 21 nt, Human herpesvirus 1
acgcgcgcgaccucaccacca

SEQ ID NO: 1751112 - RNA, 18 nt, Human herpesvirus 1
cugccugacccucuccgg

SEQ ID NO: 1751113 - RNA, 21 nt, Human herpesvirus 1
ccgcuucucuuuggccauccc

SEQ ID NO: 1751114 - RNA, 18 nt, Human herpesvirus 1
ggcacaccgguccccgga

SEQ ID NO: 1751115 - RNA, 21 nt, Human herpesvirus 1
cuugguucggggccgcccugg

SEQ ID NO: 1751116 - RNA, 20 nt, Human herpesvirus 1
gccucacgaccgcauccacc

SEQ ID NO: 1751117 - RNA, 16 nt, Human herpesvirus 1
acgcgagcgacccgcg

SEQ ID NO: 1751118 - RNA, 15 nt, Human herpesvirus 1
gcaacgcgcuggggc

SEQ ID NO: 1751119 - RNA, 21 nt, Human herpesvirus 1
gaaacuguccugucuuggggc

SEQ ID NO: 1751120 - RNA, 16 nt, Human herpesvirus 1
gacacgggcaccacac

SEQ ID NO: 1751121 - RNA, 21 nt, Human herpesvirus 1
gcuagaccacgccccuuuccc

SEQ ID NO: 1751122 - RNA, 23 nt, Human herpesvirus 1
gcugggggagaacaacgagcugc

SEQ ID NO: 1751123 - RNA, 17 nt, Human herpesvirus 1
ccgguaccaucaaccac

SEQ ID NO: 1751124 - RNA, 23 nt, Human herpesvirus 1
uagaccagaggcgcgcgcaccuc

SEQ ID NO: 1751125 - RNA, 15 nt, Human herpesvirus 1
uccagccccccagcc

SEQ ID NO: 1751126 - RNA, 19 nt, Human herpesvirus 1
acccaguggcuccgggcca

SEQ ID NO: 1751127 - RNA, 22 nt, Human herpesvirus 1
gggcguaacguuccgccuggag

SEQ ID NO: 1751128 - RNA, 19 nt, Human herpesvirus 1
cccucugggcccgccugga

SEQ ID NO: 1751129 - RNA, 11 nt, Human herpesvirus 1
cagggagaaac

SEQ ID NO: 1751130 - RNA, 14 nt, Human herpesvirus 1
cuggggucgcggcc

SEQ ID NO: 1751131 - RNA, 22 nt, Human herpesvirus 1
cuccacuacuacguggagcagg

SEQ ID NO: 1751132 - RNA, 18 nt, Human herpesvirus 1
ugagcccggcggcgcugg

SEQ ID NO: 1751133 - RNA, 19 nt, Human herpesvirus 1
gcacgagcgcgcugcucag

SEQ ID NO: 1751134 - RNA, 18 nt, Human herpesvirus 1
cgggcgucaccaugcagc

SEQ ID NO: 1751135 - RNA, 21 nt, Human herpesvirus 1
aacgccucccccugagccgcu

SEQ ID NO: 1751136 - RNA, 13 nt, Human herpesvirus 1
cgugcaccguggg

SEQ ID NO: 1751137 - RNA, 13 nt, Human herpesvirus 1
agagcaaccccau

SEQ ID NO: 1751138 - RNA, 19 nt, Human herpesvirus 1
cguguacugcggucugucu

SEQ ID NO: 1751139 - RNA, 23 nt, Human herpesvirus 1
ggccuccacccccucgaccacca

SEQ ID NO: 1751140 - RNA, 19 nt, Human herpesvirus 1
cucguacgcaugggccgcc

SEQ ID NO: 1751141 - RNA, 19 nt, Human herpesvirus 1
gcgcucaaccaccgcuccc

SEQ ID NO: 1751142 - RNA, 16 nt, Human herpesvirus 1
cacccuaccccagucc

SEQ ID NO: 1751143 - RNA, 11 nt, Human herpesvirus 1
agggggacccc

SEQ ID NO: 1751144 - RNA, 13 nt, Human herpesvirus 1
cguaaccuccggg

SEQ ID NO: 1751145 - RNA, 23 nt, Human herpesvirus 1
gcuccuggccaggaucaccaacc

SEQ ID NO: 1751146 - RNA, 12 nt, Human herpesvirus 1
aauccccaggac

SEQ ID NO: 1751147 - RNA, 21 nt, Human herpesvirus 1
cacaccaucucccccgugucc

SEQ ID NO: 1751148 - RNA, 21 nt, Human herpesvirus 1
gcccgauuuacagcccccaga

SEQ ID NO: 1751149 - RNA, 18 nt, Human herpesvirus 1
ccacgugaucagcacgcc

SEQ ID NO: 1751150 - RNA, 17 nt, Human herpesvirus 1
uaacaaccacccgcacc

SEQ ID NO: 1751151 - RNA, 21 nt, Human herpesvirus 1
cagucaaacgaccucaucagc

SEQ ID NO: 1751152 - RNA, 14 nt, Human herpesvirus 1
cgggcuccaguccc

SEQ ID NO: 1751153 - RNA, 18 nt, Human herpesvirus 1
cggugaccgcgugcccac

SEQ ID NO: 1751154 - RNA, 16 nt, Human herpesvirus 1
guacccuuaauaaauu

SEQ ID NO: 1751155 - RNA, 18 nt, Human herpesvirus 1
ugaacgacugggccgagg

SEQ ID NO: 1751156 - RNA, 21 nt, Human herpesvirus 1
ccauccgaacgcagccccgcu

SEQ ID NO: 1751157 - RNA, 15 nt, Human herpesvirus 1
cuggguggucucugg

SEQ ID NO: 1751158 - RNA, 15 nt, Human herpesvirus 1
ccggggccagcgcca

SEQ ID NO: 1751159 - RNA, 12 nt, Human herpesvirus 1
gaggauuacuuu

SEQ ID NO: 1751160 - RNA, 13 nt, Human herpesvirus 1
cgagucuggaagg

SEQ ID NO: 1751161 - RNA, 17 nt, Human herpesvirus 1
cauacacgagcacccug

SEQ ID NO: 1751162 - RNA, 12 nt, Human herpesvirus 1
ccgcaacaccaa

SEQ ID NO: 1751163 - RNA, 15 nt, Human herpesvirus 1
acgccugccaaccug

SEQ ID NO: 1751164 - RNA, 21 nt, Human herpesvirus 1
acaccagcagcuugcggggcu

SEQ ID NO: 1751165 - RNA, 20 nt, Human herpesvirus 1
uggagagcgaaggcugccgc

SEQ ID NO: 1751166 - RNA, 20 nt, Human herpesvirus 1
aguguuucguuccuuccccc

SEQ ID NO: 1751167 - RNA, 18 nt, Human herpesvirus 1
ggcugguccacacccagu

SEQ ID NO: 1751168 - RNA, 24 nt, Human herpesvirus 1
acgaggcggccaacgacuuccucg

SEQ ID NO: 1751169 - RNA, 20 nt, Human herpesvirus 1
gucgaccgcgcccucgccac

SEQ ID NO: 1751170 - RNA, 22 nt, Human herpesvirus 1
gaccuccccgcgcaugcucugg

SEQ ID NO: 1751171 - RNA, 23 nt, Human herpesvirus 1
gcccaccggaagcccaacccaca

SEQ ID NO: 1751172 - RNA, 23 nt, Human herpesvirus 1
uggaccccagcgaccccacggcc

SEQ ID NO: 1751173 - RNA, 17 nt, Human herpesvirus 1
ugggccucacccacgcc

SEQ ID NO: 1751174 - RNA, 20 nt, Human herpesvirus 1
cggggcucucggggccgcag

SEQ ID NO: 1751175 - RNA, 20 nt, Human herpesvirus 1
ugcgcgggguuacgcgggcc

SEQ ID NO: 1751176 - RNA, 19 nt, Human herpesvirus 1
augggcuacuaccuaggca

SEQ ID NO: 1751177 - RNA, 14 nt, Human herpesvirus 1
gugggcguccugga

SEQ ID NO: 1751178 - RNA, 13 nt, Human herpesvirus 1
accaccauggccc

SEQ ID NO: 1751179 - RNA, 11 nt, Human herpesvirus 1
gacgcuggggg

SEQ ID NO: 1751180 - RNA, 23 nt, Human herpesvirus 1
aauguuuuuauuggucaaacuca

SEQ ID NO: 1751181 - RNA, 14 nt, Human herpesvirus 1
ugggggccuguccc

SEQ ID NO: 1751182 - RNA, 13 nt, Human herpesvirus 1
cccugcgucgccc

SEQ ID NO: 1751183 - RNA, 16 nt, Human herpesvirus 1
cucucgcaccaucccg

SEQ ID NO: 1751184 - RNA, 21 nt, Human herpesvirus 1
caggugacgccuucgaggguc

SEQ ID NO: 1751185 - RNA, 20 nt, Human herpesvirus 1
caucagcuguggacccgagc

SEQ ID NO: 1751186 - RNA, 20 nt, Human herpesvirus 1
ccgccugucgcacccacagc

SEQ ID NO: 1751187 - RNA, 18 nt, Human herpesvirus 1
cccaacaacucccccgcg

SEQ ID NO: 1751188 - RNA, 18 nt, Human herpesvirus 1
ccggcaauucccgcggcc

SEQ ID NO: 1751189 - RNA, 13 nt, Human herpesvirus 1
cccagcaaggcgu

SEQ ID NO: 1751190 - RNA, 19 nt, Human herpesvirus 1
ccccuucccucccccuccg

SEQ ID NO: 1751191 - RNA, 15 nt, Human herpesvirus 1
ccaaugcccucccug

SEQ ID NO: 1751192 - RNA, 18 nt, Human herpesvirus 1
accgcccgccccucgcca

SEQ ID NO: 1751193 - RNA, 22 nt, Human herpesvirus 1
ucacgcgggaggccgcccagcu

SEQ ID NO: 1751194 - RNA, 16 nt, Human herpesvirus 1
gaucgcguaccagccc

SEQ ID NO: 1751195 - RNA, 23 nt, Human herpesvirus 1
accgccggcggcgacgugccccc

SEQ ID NO: 1751196 - RNA, 13 nt, Human herpesvirus 1
ggucguccgcgga

SEQ ID NO: 1751197 - RNA, 21 nt, Human herpesvirus 1
ugcagaaucacgagcugaccc

SEQ ID NO: 1751198 - RNA, 23 nt, Human herpesvirus 1
uggagcgcacggaacacaaggcc

SEQ ID NO: 1751199 - RNA, 14 nt, Human herpesvirus 1
caauuugcacccag

SEQ ID NO: 1751200 - RNA, 15 nt, Human herpesvirus 1
ggcuccgggccaacc

SEQ ID NO: 1751201 - RNA, 20 nt, Human herpesvirus 1
cgcgaaggacgccggagccg

SEQ ID NO: 1751202 - RNA, 18 nt, Human herpesvirus 1
auaaccacgcccagcgca

SEQ ID NO: 1751203 - RNA, 21 nt, Human herpesvirus 1
ugcggccggcgggacucuggg

SEQ ID NO: 1751204 - RNA, 14 nt, Human herpesvirus 1
uguggggacccgcc

SEQ ID NO: 1751205 - RNA, 21 nt, Human herpesvirus 1
gugcgccaggucggcgaccgc

SEQ ID NO: 1751206 - RNA, 18 nt, Human herpesvirus 1
gggcccccgcccccgccg

SEQ ID NO: 1751207 - RNA, 14 nt, Human herpesvirus 1
accacaggugggug

SEQ ID NO: 1751208 - RNA, 18 nt, Human herpesvirus 1
uccgucuucggccccgcg

SEQ ID NO: 1751209 - RNA, 21 nt, Human herpesvirus 1
gccgaggcgauuagccagcag

SEQ ID NO: 1751210 - RNA, 23 nt, Human herpesvirus 1
aaccuucugcgggucaccugcca

SEQ ID NO: 1751211 - RNA, 23 nt, Human herpesvirus 1
guuccggacgccuucgccccaca

SEQ ID NO: 1751212 - RNA, 20 nt, Human herpesvirus 1
cgaggaccacgugcacagcc

SEQ ID NO: 1751213 - RNA, 16 nt, Human herpesvirus 1
ccuuggucgaucccga

SEQ ID NO: 1751214 - RNA, 20 nt, Human herpesvirus 1
acgguacauggcccuggugu

SEQ ID NO: 1751215 - RNA, 20 nt, Human herpesvirus 1
accccggggcucagccagac

SEQ ID NO: 1751216 - RNA, 13 nt, Human herpesvirus 1
gucuccgugcugu

SEQ ID NO: 1751217 - RNA, 21 nt, Human herpesvirus 1
ccucuucuccccuucccuccc

SEQ ID NO: 1751218 - RNA, 17 nt, Human herpesvirus 1
gcauauccgggggcacg

SEQ ID NO: 1751219 - RNA, 17 nt, Human herpesvirus 1
gcaccagcgcggaggag

SEQ ID NO: 1751220 - RNA, 16 nt, Human herpesvirus 1
acgcacacacccuagc

SEQ ID NO: 1751221 - RNA, 23 nt, Human herpesvirus 1
cccgcaacgcgcuggggcugccg

SEQ ID NO: 1751222 - RNA, 22 nt, Human herpesvirus 1
ugcagggccuggugcucguggg

SEQ ID NO: 1751223 - RNA, 23 nt, Human herpesvirus 1
ccccccacgugaucagcacgcca

SEQ ID NO: 1751224 - RNA, 17 nt, Human herpesvirus 1
cgcaaccagcugcacga

SEQ ID NO: 1751225 - RNA, 24 nt, Human herpesvirus 1
gccucccggggggucggcaggcga

SEQ ID NO: 1751226 - RNA, 13 nt, Human herpesvirus 1
gaugccugugggu

SEQ ID NO: 1751227 - RNA, 14 nt, Human herpesvirus 1
ccuuggcggccgcc

SEQ ID NO: 1751228 - RNA, 23 nt, Human herpesvirus 1
acgccuccgcccgugcugccguc

SEQ ID NO: 1751229 - RNA, 14 nt, Human herpesvirus 1
caacgcgcuggggc

SEQ ID NO: 1751230 - RNA, 22 nt, Human herpesvirus 1
cagucggcaagauccucgggcu

SEQ ID NO: 1751231 - RNA, 19 nt, Human herpesvirus 1
gcguguuccccgggagccc

SEQ ID NO: 1751232 - RNA, 15 nt, Human herpesvirus 1
cgaccggcacccggc

SEQ ID NO: 1751233 - RNA, 13 nt, Human herpesvirus 1
ggguucuccugga

SEQ ID NO: 1751234 - RNA, 23 nt, Human herpesvirus 1
uggucucuggccgcgcccacuac

SEQ ID NO: 1751235 - RNA, 23 nt, Human herpesvirus 1
gcguccaaacccaccgacacaug

SEQ ID NO: 1751236 - RNA, 22 nt, Human herpesvirus 1
gcccgucuuuaaccucccccgg

SEQ ID NO: 1751237 - RNA, 20 nt, Human herpesvirus 1
uccacccccucgaccaccau

SEQ ID NO: 1751238 - RNA, 12 nt, Human herpesvirus 1
uucccacgcuuc

SEQ ID NO: 1751239 - RNA, 18 nt, Human herpesvirus 1
gccccggucuccccggga

SEQ ID NO: 1751240 - RNA, 15 nt, Human herpesvirus 1
ccggcggacccaagc

SEQ ID NO: 1751241 - RNA, 18 nt, Human herpesvirus 1
cacggccacuggccggga

SEQ ID NO: 1751242 - RNA, 12 nt, Human herpesvirus 1
gugcacagccug

SEQ ID NO: 1751243 - RNA, 22 nt, Human herpesvirus 1
ggcccuuccuaacccagacccc

SEQ ID NO: 1751244 - RNA, 17 nt, Human herpesvirus 1
cgcggcguccgcgcccc

SEQ ID NO: 1751245 - RNA, 15 nt, Human herpesvirus 1
gagcaccccccccaa

SEQ ID NO: 1751246 - RNA, 22 nt, Human herpesvirus 1
caagccgcgauuccgagggccg

SEQ ID NO: 1751247 - RNA, 14 nt, Human herpesvirus 1
cgcagccccgcugg

SEQ ID NO: 1751248 - RNA, 15 nt, Human herpesvirus 1
gcgggugucugcucc

SEQ ID NO: 1751249 - RNA, 16 nt, Human herpesvirus 1
ugaccccgcuccugug

SEQ ID NO: 1751250 - RNA, 15 nt, Human herpesvirus 1
caccaaggcccgggc

SEQ ID NO: 1751251 - RNA, 13 nt, Human herpesvirus 1
cugcugggccaug

SEQ ID NO: 1751252 - RNA, 15 nt, Human herpesvirus 1
ccggucggcgggccc

SEQ ID NO: 1751253 - RNA, 19 nt, Human herpesvirus 1
acuacucggaaagcgaaga

SEQ ID NO: 1751254 - RNA, 21 nt, Human herpesvirus 1
cggccgcgacccaggcggcga

SEQ ID NO: 1751255 - RNA, 13 nt, Human herpesvirus 1
cugccauggagcg

SEQ ID NO: 1751256 - RNA, 19 nt, Human herpesvirus 1
cggcaccaccgacucuccc

SEQ ID NO: 1751257 - RNA, 16 nt, Human herpesvirus 1
ccuucccccucccccc

SEQ ID NO: 1751258 - RNA, 20 nt, Human herpesvirus 1
gcccggcccugcugcugccg

SEQ ID NO: 1751259 - RNA, 16 nt, Human herpesvirus 1
aaccccacgcccccgc

SEQ ID NO: 1751260 - RNA, 14 nt, Human herpesvirus 1
uccguggccccggc

SEQ ID NO: 1751261 - RNA, 23 nt, Human herpesvirus 1
gauuuggguugggguuucugugu

SEQ ID NO: 1751262 - RNA, 18 nt, Human herpesvirus 1
cgaucugugagugucgcg

SEQ ID NO: 1751263 - RNA, 16 nt, Human herpesvirus 1
uggccccggcccccaa

SEQ ID NO: 1751264 - RNA, 19 nt, Human herpesvirus 1
cgguaugccgcggccaugg

SEQ ID NO: 1751265 - RNA, 14 nt, Human herpesvirus 1
gccaaagccccgga

SEQ ID NO: 1751266 - RNA, 22 nt, Human herpesvirus 1
ccccggcauggcgcagcuggga

SEQ ID NO: 1751267 - RNA, 18 nt, Human herpesvirus 1
gagcaggcggucggcggc

SEQ ID NO: 1751268 - RNA, 23 nt, Human herpesvirus 1
gucaccgguuuccgcgacccacc

SEQ ID NO: 1751269 - RNA, 15 nt, Human herpesvirus 1
gaggggggagauggg

SEQ ID NO: 1751270 - RNA, 15 nt, Human herpesvirus 1
ccagccccccagccu

SEQ ID NO: 1751271 - RNA, 18 nt, Human herpesvirus 1
cggggaccuugccccggc

SEQ ID NO: 1751272 - RNA, 21 nt, Human herpesvirus 1
cggugccaguccgcugcaccg

SEQ ID NO: 1751273 - RNA, 23 nt, Human herpesvirus 1
ccggggcucucggggccgcagga

SEQ ID NO: 1751274 - RNA, 16 nt, Human herpesvirus 1
cccaacccacacgcac

SEQ ID NO: 1751275 - RNA, 17 nt, Human herpesvirus 1
uccgccugucgcaccca

SEQ ID NO: 1751276 - RNA, 17 nt, Human herpesvirus 1
gucgcgggacccgacag

SEQ ID NO: 1751277 - RNA, 18 nt, Human herpesvirus 1
acugccugacccucuccg

SEQ ID NO: 1751278 - RNA, 20 nt, Human herpesvirus 1
acacaaaaggcguaccaaac

SEQ ID NO: 1751279 - RNA, 16 nt, Human herpesvirus 1
gcguagcauaccuggg

SEQ ID NO: 1751280 - RNA, 14 nt, Human herpesvirus 1
gaugagccagaccc

SEQ ID NO: 1751281 - RNA, 15 nt, Human herpesvirus 1
gucugggcccgacag

SEQ ID NO: 1751282 - RNA, 19 nt, Human herpesvirus 1
cgggauccucggccagcuc

SEQ ID NO: 1751283 - RNA, 21 nt, Human herpesvirus 1
gccguggcgccccggccccuc

SEQ ID NO: 1751284 - RNA, 13 nt, Human herpesvirus 1
ggcggccccggcc

SEQ ID NO: 1751285 - RNA, 17 nt, Human herpesvirus 1
auggggcgggggauggg

SEQ ID NO: 1751286 - RNA, 13 nt, Human herpesvirus 1
gcuaucuccuggg

SEQ ID NO: 1751287 - RNA, 21 nt, Human herpesvirus 1
cgcccucacagggcgggccgc

SEQ ID NO: 1751288 - RNA, 15 nt, Human herpesvirus 1
ccccuggacgugggc

SEQ ID NO: 1751289 - RNA, 16 nt, Human herpesvirus 1
uaacccagaccccggg

SEQ ID NO: 1751290 - RNA, 18 nt, Human herpesvirus 1
ccggugguccguguggag

SEQ ID NO: 1751291 - RNA, 17 nt, Human herpesvirus 1
uuaaaaaucgugaguca

SEQ ID NO: 1751292 - RNA, 18 nt, Human herpesvirus 1
acgugcacagccuggccg

SEQ ID NO: 1751293 - RNA, 18 nt, Human herpesvirus 1
gcuccugauguggcugcu

SEQ ID NO: 1751294 - RNA, 18 nt, Human herpesvirus 1
accccagggaccuccugg

SEQ ID NO: 1751295 - RNA, 15 nt, Human herpesvirus 1
gccucgggggcggga

SEQ ID NO: 1751296 - RNA, 20 nt, Human herpesvirus 1
cguugucuccccgauggccc

SEQ ID NO: 1751297 - RNA, 21 nt, Human herpesvirus 1
cggccggauucccgggccgga

SEQ ID NO: 1751298 - RNA, 11 nt, Human herpesvirus 1
ggccccacggu

SEQ ID NO: 1751299 - RNA, 19 nt, Human herpesvirus 1
cgccaucagccuuaccacg

SEQ ID NO: 1751300 - RNA, 21 nt, Human herpesvirus 1
cgugcugcgccuugggcccgg

SEQ ID NO: 1751301 - RNA, 14 nt, Human herpesvirus 1
cguccaccaaaguc

SEQ ID NO: 1751302 - RNA, 20 nt, Human herpesvirus 1
cgccuccgcccgugcugccg

SEQ ID NO: 1751303 - RNA, 16 nt, Human herpesvirus 1
ggcccuguaugacagc

SEQ ID NO: 1751304 - RNA, 14 nt, Human herpesvirus 1
ucgaccaccauccc

SEQ ID NO: 1751305 - RNA, 18 nt, Human herpesvirus 1
cagcucgcggaggagcca

SEQ ID NO: 1751306 - RNA, 22 nt, Human herpesvirus 1
ucccagcggcacgaccggcucc

SEQ ID NO: 1751307 - RNA, 22 nt, Human herpesvirus 1
aaccuuuaggaugccagccagg

SEQ ID NO: 1751308 - RNA, 13 nt, Human herpesvirus 1
cuacauuaaauug

SEQ ID NO: 1751309 - RNA, 20 nt, Human herpesvirus 1
cuccggggcccggcccugcu

SEQ ID NO: 1751310 - RNA, 12 nt, Human herpesvirus 1
uguuggcccuaa

SEQ ID NO: 1751311 - RNA, 17 nt, Human herpesvirus 1
accaucccccggccacc

SEQ ID NO: 1751312 - RNA, 21 nt, Human herpesvirus 1
gaggccacguguagccuggau

SEQ ID NO: 1751313 - RNA, 19 nt, Human herpesvirus 1
acauucuccacuacuacgu

SEQ ID NO: 1751314 - RNA, 19 nt, Human herpesvirus 1
caggcgacggcgucucccg

SEQ ID NO: 1751315 - RNA, 14 nt, Human herpesvirus 1
gcauccacccuccg

SEQ ID NO: 1751316 - RNA, 23 nt, Human herpesvirus 1
ucccgccuuccggaccugcucuc

SEQ ID NO: 1751317 - RNA, 19 nt, Human herpesvirus 1
cgcgccaaacgccagccug

SEQ ID NO: 1751318 - RNA, 17 nt, Human herpesvirus 1
cggguguggggacccgc

SEQ ID NO: 1751319 - RNA, 23 nt, Human herpesvirus 1
ugcucuggggucccugucgccuc

SEQ ID NO: 1751320 - RNA, 15 nt, Human herpesvirus 1
gcggguagggucgug

SEQ ID NO: 1751321 - RNA, 19 nt, Human herpesvirus 1
aggauggagagcgaaggcu

SEQ ID NO: 1751322 - RNA, 23 nt, Human herpesvirus 1
aguaacaugcgcacgugauguag

SEQ ID NO: 1751323 - RNA, 20 nt, Human herpesvirus 1
cuaaggcccggcuagaccca

SEQ ID NO: 1751324 - RNA, 14 nt, Human herpesvirus 1
cacgugcugcugcg

SEQ ID NO: 1751325 - RNA, 21 nt, Human herpesvirus 1
cgugacacccuaccccagucc

SEQ ID NO: 1751326 - RNA, 19 nt, Human herpesvirus 1
gccaggggcauccgggacc

SEQ ID NO: 1751327 - RNA, 23 nt, Human herpesvirus 1
cguguacaacaucauccagcugg

SEQ ID NO: 1751328 - RNA, 16 nt, Human herpesvirus 1
ggcgagcccagacccc

SEQ ID NO: 1751329 - RNA, 17 nt, Human herpesvirus 1
ccgcauaucccacccug

SEQ ID NO: 1751330 - RNA, 20 nt, Human herpesvirus 1
gccgcccggggccagcgcca

SEQ ID NO: 1751331 - RNA, 16 nt, Human herpesvirus 1
caccauccccgcuccc

SEQ ID NO: 1751332 - RNA, 21 nt, Human herpesvirus 1
ucagcgcgauccgacaugucc

SEQ ID NO: 1751333 - RNA, 13 nt, Human herpesvirus 1
ccugggccaccug

SEQ ID NO: 1751334 - RNA, 18 nt, Human herpesvirus 1
accacccaaccccaacuc

SEQ ID NO: 1751335 - RNA, 15 nt, Human herpesvirus 1
cugcccggcggccag

SEQ ID NO: 1751336 - RNA, 14 nt, Human herpesvirus 1
ccccggagccgggc

SEQ ID NO: 1751337 - RNA, 16 nt, Human herpesvirus 1
uacgcuuggagccagc

SEQ ID NO: 1751338 - RNA, 20 nt, Human herpesvirus 1
ccgaaccaccacugcacucc

SEQ ID NO: 1751339 - RNA, 20 nt, Human herpesvirus 1
ggaucccaacgaccccgccc

SEQ ID NO: 1751340 - RNA, 16 nt, Human herpesvirus 1
ggcggccccggccgcc

SEQ ID NO: 1751341 - RNA, 19 nt, Human herpesvirus 1
uaaauuuuacaaacagauu

SEQ ID NO: 1751342 - RNA, 23 nt, Human herpesvirus 1
cccaucugugcggggaggggggc

SEQ ID NO: 1751343 - RNA, 19 nt, Human herpesvirus 1
gucgccuggcugacccacg

SEQ ID NO: 1751344 - RNA, 21 nt, Human herpesvirus 1
gugcugcugcggcccacccug

SEQ ID NO: 1751345 - RNA, 20 nt, Human herpesvirus 1
cagacgcugcuccgccuggc

SEQ ID NO: 1751346 - RNA, 20 nt, Human herpesvirus 1
ucgacgucgcgccugggugc

SEQ ID NO: 1751347 - RNA, 16 nt, Human herpesvirus 1
acgugcgauucagcgc

SEQ ID NO: 1751348 - RNA, 22 nt, Human herpesvirus 1
cugcagaaucacgagcugaccc

SEQ ID NO: 1751349 - RNA, 16 nt, Human herpesvirus 1
agcccccgccccuccc

SEQ ID NO: 1751350 - RNA, 17 nt, Human herpesvirus 1
acgccaagggggucugu

SEQ ID NO: 1751351 - RNA, 20 nt, Human herpesvirus 1
ccuccgacgcccagcagcuc

SEQ ID NO: 1751352 - RNA, 15 nt, Human herpesvirus 1
gaccccgggcgcgcc

SEQ ID NO: 1751353 - RNA, 16 nt, Human herpesvirus 1
cgggacgaggccgugc

SEQ ID NO: 1751354 - RNA, 21 nt, Human herpesvirus 1
ugcccuccccccgcccccggc

SEQ ID NO: 1751355 - RNA, 16 nt, Human herpesvirus 1
gacaucagcuguggac

SEQ ID NO: 1751356 - RNA, 15 nt, Human herpesvirus 1
uucggacagacucaa

SEQ ID NO: 1751357 - RNA, 13 nt, Human herpesvirus 1
accgaagaggugc

SEQ ID NO: 1751358 - RNA, 18 nt, Human herpesvirus 1
cguccccuuacaguucca

SEQ ID NO: 1751359 - RNA, 16 nt, Human herpesvirus 1
agccauccccgcgucc

SEQ ID NO: 1751360 - RNA, 18 nt, Human herpesvirus 1
gucaucacccgggugcuu

SEQ ID NO: 1751361 - RNA, 15 nt, Human herpesvirus 1
guccuggaccagcug

SEQ ID NO: 1751362 - RNA, 14 nt, Human herpesvirus 1
ccagcccucucccc

SEQ ID NO: 1751363 - RNA, 16 nt, Human herpesvirus 1
gccgccgcgccccgcc

SEQ ID NO: 1751364 - RNA, 16 nt, Human herpesvirus 1
uuguggacccaaagcc

SEQ ID NO: 1751365 - RNA, 11 nt, Human herpesvirus 1
acccccggccc

SEQ ID NO: 1751366 - RNA, 18 nt, Human herpesvirus 1
ggagggugguuccccccc

SEQ ID NO: 1751367 - RNA, 19 nt, Human herpesvirus 1
cccccggcauggcgcagcu

SEQ ID NO: 1751368 - RNA, 16 nt, Human herpesvirus 1
ccagcggcacgaccgg

SEQ ID NO: 1751369 - RNA, 21 nt, Human herpesvirus 1
ggccccccgcguccaaaccca

SEQ ID NO: 1751370 - RNA, 12 nt, Human herpesvirus 1
cacgccgccucg

SEQ ID NO: 1751371 - RNA, 20 nt, Human herpesvirus 1
gcguccuggaugcuguggac

SEQ ID NO: 1751372 - RNA, 14 nt, Human herpesvirus 1
aucuccggaccccc

SEQ ID NO: 1751373 - RNA, 14 nt, Human herpesvirus 1
ugggccugaucgcc

SEQ ID NO: 1751374 - RNA, 22 nt, Human herpesvirus 1
ccggcguuucugaccugcaccg

SEQ ID NO: 1751375 - RNA, 15 nt, Human herpesvirus 1
caccaccaaccugac

SEQ ID NO: 1751376 - RNA, 19 nt, Human herpesvirus 1
cguacggccucgugcucgu

SEQ ID NO: 1751377 - RNA, 12 nt, Human herpesvirus 1
gagcgacccgcg

SEQ ID NO: 1751378 - RNA, 21 nt, Human herpesvirus 1
gcgccgacaucaccaccguca

SEQ ID NO: 1751379 - RNA, 16 nt, Human herpesvirus 1
uccccgggagccccgg

SEQ ID NO: 1751380 - RNA, 18 nt, Human herpesvirus 1
cgcgacccaccgggcccg

SEQ ID NO: 1751381 - RNA, 19 nt, Human herpesvirus 1
cacaacgccagccugcggc

SEQ ID NO: 1751382 - RNA, 15 nt, Human herpesvirus 1
cgcggcguccgcgcc

SEQ ID NO: 1751383 - RNA, 16 nt, Human herpesvirus 1
ggggcuuccggccugg

SEQ ID NO: 1751384 - RNA, 18 nt, Human herpesvirus 1
ccucgcgccacacucacc

SEQ ID NO: 1751385 - RNA, 20 nt, Human herpesvirus 1
cuccugggggcacccacgcc

SEQ ID NO: 1751386 - RNA, 16 nt, Human herpesvirus 1
ucuacugcugggccau

SEQ ID NO: 1751387 - RNA, 14 nt, Human herpesvirus 1
cgacaccgcccucg

SEQ ID NO: 1751388 - RNA, 23 nt, Human herpesvirus 1
cccgcgucgggauccacaccgcg

SEQ ID NO: 1751389 - RNA, 21 nt, Human herpesvirus 1
caagagacgucgccccugugg

SEQ ID NO: 1751390 - RNA, 16 nt, Human herpesvirus 1
ucccagggagccccgg

SEQ ID NO: 1751391 - RNA, 23 nt, Human herpesvirus 1
ccucggcccgcgaacggcacgcc

SEQ ID NO: 1751392 - RNA, 18 nt, Human herpesvirus 1
agcucccagagaccccag

SEQ ID NO: 1751393 - RNA, 13 nt, Human herpesvirus 1
cugaaccccagcc

SEQ ID NO: 1751394 - RNA, 14 nt, Human herpesvirus 1
cggcgggagcuggg

SEQ ID NO: 1751395 - RNA, 17 nt, Human herpesvirus 1
ccucgaugacgucccgg

SEQ ID NO: 1751396 - RNA, 18 nt, Human herpesvirus 1
cucgccacgucgaccgcg

SEQ ID NO: 1751397 - RNA, 19 nt, Human herpesvirus 1
cagggccuccgaccccaga

SEQ ID NO: 1751398 - RNA, 15 nt, Human herpesvirus 1
aggccugggauccca

SEQ ID NO: 1751399 - RNA, 23 nt, Human herpesvirus 1
caaccccagggaccuccuggacu

SEQ ID NO: 1751400 - RNA, 16 nt, Human herpesvirus 1
cccuucccucccccuc

SEQ ID NO: 1751401 - RNA, 16 nt, Human herpesvirus 1
acacccuaccccaguc

SEQ ID NO: 1751402 - RNA, 22 nt, Human herpesvirus 1
gagcucccagagaccccagggu

SEQ ID NO: 1751403 - RNA, 14 nt, Human herpesvirus 1
gcgaaugcagcgcc

SEQ ID NO: 1751404 - RNA, 13 nt, Human herpesvirus 1
cgcuggaccucac

SEQ ID NO: 1751405 - RNA, 15 nt, Human herpesvirus 1
gccuccgaccccaga

SEQ ID NO: 1751406 - RNA, 17 nt, Human herpesvirus 1
aagcugaugucccucau

SEQ ID NO: 1751407 - RNA, 23 nt, Human herpesvirus 1
cgccgagucuucggggcccggcc

SEQ ID NO: 1751408 - RNA, 22 nt, Human herpesvirus 1
gcccguugcagggccuggugcu

SEQ ID NO: 1751409 - RNA, 23 nt, Human herpesvirus 1
cagcaccgacaccgcacugcggc

SEQ ID NO: 1751410 - RNA, 11 nt, Human herpesvirus 1
cucgccccgga

SEQ ID NO: 1751411 - RNA, 17 nt, Human herpesvirus 1
cgaggucccgugcaacc

SEQ ID NO: 1751412 - RNA, 19 nt, Human herpesvirus 1
cgaccgcaacuucccaccc

SEQ ID NO: 1751413 - RNA, 15 nt, Human herpesvirus 1
cuccgacgacgcgca

SEQ ID NO: 1751414 - RNA, 20 nt, Human herpesvirus 1
cuaagacccaccccccgucc

SEQ ID NO: 1751415 - RNA, 14 nt, Human herpesvirus 1
ccccccccacccca

SEQ ID NO: 1751416 - RNA, 13 nt, Human herpesvirus 1
cgguucgccgcca

SEQ ID NO: 1751417 - RNA, 13 nt, Human herpesvirus 1
ccuccgcgccagg

SEQ ID NO: 1751418 - RNA, 17 nt, Human herpesvirus 1
gcggccaacgacuuccu

SEQ ID NO: 1751419 - RNA, 13 nt, Human herpesvirus 1
ccacacccagugg

SEQ ID NO: 1751420 - RNA, 17 nt, Human herpesvirus 1
gaucccaacgaccccgc

SEQ ID NO: 1751421 - RNA, 15 nt, Human herpesvirus 1
cugagcgcccuccug

SEQ ID NO: 1751422 - RNA, 15 nt, Human herpesvirus 1
ugcgguccggagaca

SEQ ID NO: 1751423 - RNA, 13 nt, Human herpesvirus 1
gauacccccccuu

SEQ ID NO: 1751424 - RNA, 17 nt, Human herpesvirus 1
gccgccuggucccccgg

SEQ ID NO: 1751425 - RNA, 12 nt, Human herpesvirus 1
uugcacccagcc

SEQ ID NO: 1751426 - RNA, 13 nt, Human herpesvirus 1
cgcccgucucugc

SEQ ID NO: 1751427 - RNA, 13 nt, Human herpesvirus 1
caggccuccaccc

SEQ ID NO: 1751428 - RNA, 17 nt, Human herpesvirus 1
aucugggauggcuccug

SEQ ID NO: 1751429 - RNA, 21 nt, Human herpesvirus 1
cagggcuacgugcucgacagc

SEQ ID NO: 1751430 - RNA, 21 nt, Human herpesvirus 1
acgccuccgcccgugcugccg

SEQ ID NO: 1751431 - RNA, 17 nt, Human herpesvirus 1
acccagaccccgggcgc

SEQ ID NO: 1751432 - RNA, 18 nt, Human herpesvirus 1
uccgcccgugcugccguc

SEQ ID NO: 1751433 - RNA, 22 nt, Human herpesvirus 1
gacagcccccccaagcgccccc

SEQ ID NO: 1751434 - RNA, 22 nt, Human herpesvirus 1
uguccggcagggggaugggggg

SEQ ID NO: 1751435 - RNA, 18 nt, Human herpesvirus 1
ccccaucuaaugccacgc

SEQ ID NO: 1751436 - RNA, 14 nt, Human herpesvirus 1
gugauuccucuccg

SEQ ID NO: 1751437 - RNA, 22 nt, Human herpesvirus 1
ggggacugcaucggcaaggacg

SEQ ID NO: 1751438 - RNA, 18 nt, Human herpesvirus 1
cuccgcgccaggcccgcc

SEQ ID NO: 1751439 - RNA, 14 nt, Human herpesvirus 1
ccgcgcccucgcca

SEQ ID NO: 1751440 - RNA, 22 nt, Human herpesvirus 1
gggccgugcgauggacaccgca

SEQ ID NO: 1751441 - RNA, 17 nt, Human herpesvirus 1
cccacacagcccucccg

SEQ ID NO: 1751442 - RNA, 12 nt, Human herpesvirus 1
acgcccccgccg

SEQ ID NO: 1751443 - RNA, 14 nt, Human herpesvirus 1
cggugccuuucccc

SEQ ID NO: 1751444 - RNA, 17 nt, Human herpesvirus 1
acccucucuucucuccc

SEQ ID NO: 1751445 - RNA, 16 nt, Human herpesvirus 1
aaccccuuuggggcgc

SEQ ID NO: 1751446 - RNA, 15 nt, Human herpesvirus 1
gcgcaucagcucgcg

SEQ ID NO: 1751447 - RNA, 20 nt, Human herpesvirus 1
ccaacaauccccaggacacc

SEQ ID NO: 1751448 - RNA, 15 nt, Human herpesvirus 1
ggccugggccgcgag

SEQ ID NO: 1751449 - RNA, 19 nt, Human herpesvirus 1
cauaaccgaccgcaguccc

SEQ ID NO: 1751450 - RNA, 19 nt, Human herpesvirus 1
cggcgcguguaccacaucc

SEQ ID NO: 1751451 - RNA, 20 nt, Human herpesvirus 1
cuccggagagacgauggcag

SEQ ID NO: 1751452 - RNA, 16 nt, Human herpesvirus 1
cggcaagauccucggg

SEQ ID NO: 1751453 - RNA, 19 nt, Human herpesvirus 1
cggggcccggcccugcugc

SEQ ID NO: 1751454 - RNA, 19 nt, Human herpesvirus 1
caccgguucguauccacaa

SEQ ID NO: 1751455 - RNA, 21 nt, Human herpesvirus 1
cgcuggguggucucuggccgc

SEQ ID NO: 1751456 - RNA, 14 nt, Human herpesvirus 1
cagcauggcgccac

SEQ ID NO: 1751457 - RNA, 22 nt, Human herpesvirus 1
ggcugccgccagguugggggcc

SEQ ID NO: 1751458 - RNA, 17 nt, Human herpesvirus 1
ccuuguuccgcuucccg

SEQ ID NO: 1751459 - RNA, 18 nt, Human herpesvirus 1
gucgccgugcuccuguga

SEQ ID NO: 1751460 - RNA, 13 nt, Human herpesvirus 1
uucuuccggccuc

SEQ ID NO: 1751461 - RNA, 15 nt, Human herpesvirus 1
ugccgucgcuagacc

SEQ ID NO: 1751462 - RNA, 23 nt, Human herpesvirus 1
cgucgccgcccugagcgcccucc

SEQ ID NO: 1751463 - RNA, 16 nt, Human herpesvirus 1
cacgacaaccccgguc

SEQ ID NO: 1751464 - RNA, 17 nt, Human herpesvirus 1
gcggucugucucgucuc

SEQ ID NO: 1751465 - RNA, 21 nt, Human herpesvirus 1
cagcaccuucaucgaccucaa

SEQ ID NO: 1751466 - RNA, 13 nt, Human herpesvirus 1
cuccaccacccaa

SEQ ID NO: 1751467 - RNA, 14 nt, Human herpesvirus 1
ugcugcgcggcgcc

SEQ ID NO: 1751468 - RNA, 13 nt, Human herpesvirus 1
cgugaccccaggg

SEQ ID NO: 1751469 - RNA, 21 nt, Human herpesvirus 1
ccuaucgcucgaccucuccac

SEQ ID NO: 1751470 - RNA, 21 nt, Human herpesvirus 1
gcccacccacuccuccccgcg

SEQ ID NO: 1751471 - RNA, 15 nt, Human herpesvirus 1
agcucgcggcccggg

SEQ ID NO: 1751472 - RNA, 18 nt, Human herpesvirus 1
cauaucgcuucccgaccu

SEQ ID NO: 1751473 - RNA, 19 nt, Human herpesvirus 1
gagcccccgccccuccccc

SEQ ID NO: 1751474 - RNA, 13 nt, Human herpesvirus 1
ccugggggcaccc

SEQ ID NO: 1751475 - RNA, 19 nt, Human herpesvirus 1
gccggggaccgcagccugg

SEQ ID NO: 1751476 - RNA, 13 nt, Human herpesvirus 1
gccacccccccgg

SEQ ID NO: 1751477 - RNA, 17 nt, Human herpesvirus 1
ucccgcccaccgcuggg

SEQ ID NO: 1751478 - RNA, 19 nt, Human herpesvirus 1
ggucucgcuuugccgggaa

SEQ ID NO: 1751479 - RNA, 23 nt, Human herpesvirus 1
caccggguacggcgucugggcca

SEQ ID NO: 1751480 - RNA, 15 nt, Human herpesvirus 1
uaccccaguccccgg

SEQ ID NO: 1751481 - RNA, 21 nt, Human herpesvirus 1
cgcaugaucuccggacccccg

SEQ ID NO: 1751482 - RNA, 22 nt, Human herpesvirus 1
ccaucgguccccucugggcccg

SEQ ID NO: 1751483 - RNA, 15 nt, Human herpesvirus 1
ugucuguuucuuggc

SEQ ID NO: 1751484 - RNA, 18 nt, Human herpesvirus 1
ccugaugcacgcccccgc

SEQ ID NO: 1751485 - RNA, 14 nt, Human herpesvirus 1
cccggcccugcugc

SEQ ID NO: 1751486 - RNA, 23 nt, Human herpesvirus 1
gccagccuguuuguccuggggau

SEQ ID NO: 1751487 - RNA, 19 nt, Human herpesvirus 1
ccuccucguccggcgcgcg

SEQ ID NO: 1751488 - RNA, 20 nt, Human herpesvirus 1
gcaucggaacacgccuaccg

SEQ ID NO: 1751489 - RNA, 21 nt, Human herpesvirus 1
cugccagcuaugggcccugcu

SEQ ID NO: 1751490 - RNA, 21 nt, Human herpesvirus 1
cggacccgcaucccccgucug

SEQ ID NO: 1751491 - RNA, 18 nt, Human herpesvirus 1
ccaccggaagcccaaccc

SEQ ID NO: 1751492 - RNA, 17 nt, Human herpesvirus 1
gcccucgccacacccgc

SEQ ID NO: 1751493 - RNA, 14 nt, Human herpesvirus 1
gcgcuuccccgcgg

SEQ ID NO: 1751494 - RNA, 20 nt, Human herpesvirus 1
uguuccccgggagccccggg

SEQ ID NO: 1751495 - RNA, 20 nt, Human herpesvirus 1
gcuggggcccccaggguccg

SEQ ID NO: 1751496 - RNA, 18 nt, Human herpesvirus 1
accgguaugccgcggcca

SEQ ID NO: 1751497 - RNA, 20 nt, Human herpesvirus 1
uccccaagaccccccuggcc

SEQ ID NO: 1751498 - RNA, 15 nt, Human herpesvirus 1
ccccgacccucccau

SEQ ID NO: 1751499 - RNA, 17 nt, Human herpesvirus 1
gccccaucccgaggccc

SEQ ID NO: 1751500 - RNA, 17 nt, Human herpesvirus 1
cgcgucuggccccggcg

SEQ ID NO: 1751501 - RNA, 20 nt, Human herpesvirus 1
gcgccuagccaaccuguggc

SEQ ID NO: 1751502 - RNA, 22 nt, Human herpesvirus 1
ggccaucgguccccucugggcc

SEQ ID NO: 1751503 - RNA, 13 nt, Human herpesvirus 1
guuguugcuggcg

SEQ ID NO: 1751504 - RNA, 22 nt, Human herpesvirus 1
caccccgcaauuugcacccagc

SEQ ID NO: 1751505 - RNA, 12 nt, Human herpesvirus 1
cauggaaggaac

SEQ ID NO: 1751506 - RNA, 17 nt, Human herpesvirus 1
cgccugcccccuggacg

SEQ ID NO: 1751507 - RNA, 16 nt, Human herpesvirus 1
ggccuggucagaggcc

SEQ ID NO: 1751508 - RNA, 13 nt, Human herpesvirus 1
auggcgacacacc

SEQ ID NO: 1751509 - RNA, 22 nt, Human herpesvirus 1
gugaacacggcgaaugcagcgc

SEQ ID NO: 1751510 - RNA, 20 nt, Human herpesvirus 1
ccacaugcggaaagcaagaa

SEQ ID NO: 1751511 - RNA, 23 nt, Human herpesvirus 1
uccaccacccaaccccaacucca

SEQ ID NO: 1751512 - RNA, 18 nt, Human herpesvirus 1
gccagacccaacccccgg

SEQ ID NO: 1751513 - RNA, 21 nt, Human herpesvirus 1
cguccuuugggcgggaggaag

SEQ ID NO: 1751514 - RNA, 17 nt, Human herpesvirus 1
ccaccgggaagcagggc

SEQ ID NO: 1751515 - RNA, 20 nt, Human herpesvirus 1
gcgcgcuuguccccgaacaa

SEQ ID NO: 1751516 - RNA, 19 nt, Human herpesvirus 1
gacccagaccggcaccacc

SEQ ID NO: 1751517 - RNA, 14 nt, Human herpesvirus 1
gcgucugggccacc

SEQ ID NO: 1751518 - RNA, 23 nt, Human herpesvirus 1
cgaggacaccccucguggccccg

SEQ ID NO: 1751519 - RNA, 20 nt, Human herpesvirus 1
cgcauccccccgucagccug

SEQ ID NO: 1751520 - RNA, 15 nt, Human herpesvirus 1
ucgggcgcugggugg

SEQ ID NO: 1751521 - RNA, 22 nt, Human herpesvirus 1
cgcacgcauacgggcggccacc

SEQ ID NO: 1751522 - RNA, 15 nt, Human herpesvirus 1
cuccgaaagccacca

SEQ ID NO: 1751523 - RNA, 15 nt, Human herpesvirus 1
gcgacgcacacaccc

SEQ ID NO: 1751524 - RNA, 14 nt, Human herpesvirus 1
gccugccugcggcu

SEQ ID NO: 1751525 - RNA, 15 nt, Human herpesvirus 1
cguuccucacugccu

SEQ ID NO: 1751526 - RNA, 16 nt, Human herpesvirus 1
gcccagcagcucccca

SEQ ID NO: 1751527 - RNA, 20 nt, Human herpesvirus 1
ccaggaaauccguggccccg

SEQ ID NO: 1751528 - RNA, 11 nt, Human herpesvirus 1
cgauggcagga

SEQ ID NO: 1751529 - RNA, 20 nt, Human herpesvirus 1
ccaaacucccgacaccacca

SEQ ID NO: 1751530 - RNA, 17 nt, Human herpesvirus 1
cccccggccgccgcgga

SEQ ID NO: 1751531 - RNA, 22 nt, Human herpesvirus 1
accgccggcggcgacgugcccc

SEQ ID NO: 1751532 - RNA, 13 nt, Human herpesvirus 1
gccauggagcgca

SEQ ID NO: 1751533 - RNA, 19 nt, Human herpesvirus 1
gaauaaaccgguauuauuu

SEQ ID NO: 1751534 - RNA, 22 nt, Human herpesvirus 1
acccggggggcugcgaguccug

SEQ ID NO: 1751535 - RNA, 22 nt, Human herpesvirus 1
gugggggaaccuagggcggggc

SEQ ID NO: 1751536 - RNA, 19 nt, Human herpesvirus 1
cgccgcgcguugggcccug

SEQ ID NO: 1751537 - RNA, 20 nt, Human herpesvirus 1
gcaagaggucgucgggggac

SEQ ID NO: 1751538 - RNA, 22 nt, Human herpesvirus 1
ccuggagcucaaucuggcccaa

SEQ ID NO: 1751539 - RNA, 14 nt, Human herpesvirus 1
cuggccgggagcac

SEQ ID NO: 1751540 - RNA, 17 nt, Human herpesvirus 1
ccagcaucgcgcgcguc

SEQ ID NO: 1751541 - RNA, 20 nt, Human herpesvirus 1
uggcgcgucguucgggcgga

SEQ ID NO: 1751542 - RNA, 23 nt, Human herpesvirus 1
cacgcgccgccgacucccggcuu

SEQ ID NO: 1751543 - RNA, 19 nt, Human herpesvirus 1
ggggccauguugggccgcc

SEQ ID NO: 1751544 - RNA, 20 nt, Human herpesvirus 1
cucugggggccugucccauc

SEQ ID NO: 1751545 - RNA, 18 nt, Human herpesvirus 1
guuccgggaugccgugcc

SEQ ID NO: 1751546 - RNA, 22 nt, Human herpesvirus 1
cgcgcccacuacaccagccaau

SEQ ID NO: 1751547 - RNA, 18 nt, Human herpesvirus 1
cccucuggacgcccgggc

SEQ ID NO: 1751548 - RNA, 18 nt, Human herpesvirus 1
cccggccaccccgaacaa

SEQ ID NO: 1751549 - RNA, 13 nt, Human herpesvirus 1
aguuuauccugga

SEQ ID NO: 1751550 - RNA, 17 nt, Human herpesvirus 1
cccguccucgcccgcca

SEQ ID NO: 1751551 - RNA, 23 nt, Human herpesvirus 1
cgcgguacgccccaccggcacca

SEQ ID NO: 1751552 - RNA, 17 nt, Human herpesvirus 1
caucccaggaucacacc

SEQ ID NO: 1751553 - RNA, 19 nt, Human herpesvirus 1
cgccgcgacccgcacgagc

SEQ ID NO: 1751554 - RNA, 16 nt, Human herpesvirus 1
cgcccgccccucgcca

SEQ ID NO: 1751555 - RNA, 15 nt, Human herpesvirus 1
ccagagaccccaggg

SEQ ID NO: 1751556 - RNA, 16 nt, Human herpesvirus 1
cgcgcccacuacacca

SEQ ID NO: 1751557 - RNA, 22 nt, Human herpesvirus 1
guggcucucgagaugagccaga

SEQ ID NO: 1751558 - RNA, 14 nt, Human herpesvirus 1
gcgccacacucacc

SEQ ID NO: 1751559 - RNA, 15 nt, Human herpesvirus 1
acacaccagcggguc

SEQ ID NO: 1751560 - RNA, 22 nt, Human herpesvirus 1
ucccaccgccaucagccuuacc

SEQ ID NO: 1751561 - RNA, 16 nt, Human herpesvirus 1
cugcgggucaccugcc

SEQ ID NO: 1751562 - RNA, 14 nt, Human herpesvirus 1
cugccucccccgcc

SEQ ID NO: 1751563 - RNA, 23 nt, Human herpesvirus 1
ccccgucuggguuuuccccuccc

SEQ ID NO: 1751564 - RNA, 13 nt, Human herpesvirus 1
guuccgccuggag

SEQ ID NO: 1751565 - RNA, 17 nt, Human herpesvirus 1
ggcaccuccccagcggc

SEQ ID NO: 1751566 - RNA, 16 nt, Human herpesvirus 1
gugcccacgucgcccc

SEQ ID NO: 1751567 - RNA, 19 nt, Human herpesvirus 1
augauccucaucgagggca

SEQ ID NO: 1751568 - RNA, 17 nt, Human herpesvirus 1
agagucgacgaccuggg

SEQ ID NO: 1751569 - RNA, 14 nt, Human herpesvirus 1
gcggcgcgagcucc

SEQ ID NO: 1751570 - RNA, 18 nt, Human herpesvirus 1
ggucucuggccgcgccca

SEQ ID NO: 1751571 - RNA, 13 nt, Human herpesvirus 1
ccacgccucgggc

SEQ ID NO: 1751572 - RNA, 19 nt, Human herpesvirus 1
ccagaggcgcgcgcaccuc

SEQ ID NO: 1751573 - RNA, 18 nt, Human herpesvirus 1
cacaucaaggugggccag

SEQ ID NO: 1751574 - RNA, 20 nt, Human herpesvirus 1
cugcuccgcuaaaagaccgc

SEQ ID NO: 1751575 - RNA, 20 nt, Human herpesvirus 1
accccagcgaccccacggcc

SEQ ID NO: 1751576 - RNA, 16 nt, Human herpesvirus 1
ccauggaccccagcga

SEQ ID NO: 1751577 - RNA, 21 nt, Human herpesvirus 1
cuuggagccagcccgcccuca

SEQ ID NO: 1751578 - RNA, 24 nt, Human herpesvirus 1
ucgcgggacccgacaggcgaccgc

SEQ ID NO: 1751579 - RNA, 19 nt, Human herpesvirus 1
gaaaugcccccccccccuu

SEQ ID NO: 1751580 - RNA, 17 nt, Human herpesvirus 1
gugggcgacugcgaccc

SEQ ID NO: 1751581 - RNA, 22 nt, Human herpesvirus 1
caucagcuguggacccgagcuc

SEQ ID NO: 1751582 - RNA, 21 nt, Human herpesvirus 1
cgcccguguucgagggccaag

SEQ ID NO: 1751583 - RNA, 20 nt, Human herpesvirus 1
ccuucugcgggucaccugcc

SEQ ID NO: 1751584 - RNA, 18 nt, Human herpesvirus 1
acacggccguugucuccc

SEQ ID NO: 1751585 - RNA, 15 nt, Human herpesvirus 1
ccacccccgcccggg

SEQ ID NO: 1751586 - RNA, 19 nt, Human herpesvirus 1
ugccgcccguugcagggcc

SEQ ID NO: 1751587 - RNA, 22 nt, Human herpesvirus 1
ggcagucuccuggcagcccugg

SEQ ID NO: 1751588 - RNA, 13 nt, Human herpesvirus 1
gucucccagggag

SEQ ID NO: 1751589 - RNA, 16 nt, Human herpesvirus 1
gcguagagcuguggca

SEQ ID NO: 1751590 - RNA, 12 nt, Human herpesvirus 1
ccacuguuuucc

SEQ ID NO: 1751591 - RNA, 18 nt, Human herpesvirus 1
uugccgugguccugugga

SEQ ID NO: 1751592 - RNA, 20 nt, Human herpesvirus 1
ccgcucggcggcagcccgga

SEQ ID NO: 1751593 - RNA, 20 nt, Human herpesvirus 1
uguaucgcaucuuuccugug

SEQ ID NO: 1751594 - RNA, 18 nt, Human herpesvirus 1
aaaugguguccgcggucc

SEQ ID NO: 1751595 - RNA, 21 nt, Human herpesvirus 1
gggccccgggacaccccccau

SEQ ID NO: 1751596 - RNA, 19 nt, Human herpesvirus 1
ggucggcgagcuggauggc

SEQ ID NO: 1751597 - RNA, 21 nt, Human herpesvirus 1
ccugcgguccggagccgcgcg

SEQ ID NO: 1751598 - RNA, 21 nt, Human herpesvirus 1
ggcagucuccuggcagcccug

SEQ ID NO: 1751599 - RNA, 14 nt, Human herpesvirus 1
aggucccaccugac

SEQ ID NO: 1751600 - RNA, 17 nt, Human herpesvirus 1
aucuguguucccuggcc

SEQ ID NO: 1751601 - RNA, 19 nt, Human herpesvirus 1
gucccggcucuccgauccc

SEQ ID NO: 1751602 - RNA, 14 nt, Human herpesvirus 1
ggcgcuuaccgcca

SEQ ID NO: 1751603 - RNA, 16 nt, Human herpesvirus 1
gucuccaagcuuuccg

SEQ ID NO: 1751604 - RNA, 16 nt, Human herpesvirus 1
cggcccgggggacuca

SEQ ID NO: 1751605 - RNA, 16 nt, Human herpesvirus 1
cccugaucccccgcgc

SEQ ID NO: 1751606 - RNA, 19 nt, Human herpesvirus 1
ggccaaguuggcccccgga

SEQ ID NO: 1751607 - RNA, 16 nt, Human herpesvirus 1
uucaccccgaagcccc

SEQ ID NO: 1751608 - RNA, 21 nt, Human herpesvirus 1
cgccgagcugcgaucgcuggu

SEQ ID NO: 1751609 - RNA, 15 nt, Human herpesvirus 1
uccccgauggcccuc

SEQ ID NO: 1751610 - RNA, 14 nt, Human herpesvirus 1
cauaccgaccacac

SEQ ID NO: 1751611 - RNA, 20 nt, Human herpesvirus 1
agcaucgaccacgcccuucc

SEQ ID NO: 1751612 - RNA, 23 nt, Human herpesvirus 1
uguauguccccaaaauaaaagac

SEQ ID NO: 1751613 - RNA, 16 nt, Human herpesvirus 1
gcaccgagccaagggc

SEQ ID NO: 1751614 - RNA, 15 nt, Human herpesvirus 1
cgacaccaccagcug

SEQ ID NO: 1751615 - RNA, 22 nt, Human herpesvirus 1
gggcggggacggggaggcgggc

SEQ ID NO: 1751616 - RNA, 20 nt, Human herpesvirus 1
gcccggcccauugggcggga

SEQ ID NO: 1751617 - RNA, 19 nt, Human herpesvirus 1
caaccccggucucccaggg

SEQ ID NO: 1751618 - RNA, 12 nt, Human herpesvirus 1
cagggaccuccu

SEQ ID NO: 1751619 - RNA, 19 nt, Human herpesvirus 1
uagaaacucauuaaugggc

SEQ ID NO: 1751620 - RNA, 22 nt, Human herpesvirus 1
gcugcgcggcguccgcgccccu

SEQ ID NO: 1751621 - RNA, 15 nt, Human herpesvirus 1
ggggacggcggggca

SEQ ID NO: 1751622 - RNA, 22 nt, Human herpesvirus 1
gagcaaccccaugaaggcccug

SEQ ID NO: 1751623 - RNA, 14 nt, Human herpesvirus 1
cuaagcgucccugg

SEQ ID NO: 1751624 - RNA, 19 nt, Human herpesvirus 1
acggcgucugggccaccga

SEQ ID NO: 1751625 - RNA, 21 nt, Human herpesvirus 1
ucacggcuaccuggccccagu

SEQ ID NO: 1751626 - RNA, 16 nt, Human herpesvirus 1
gaccugcaccgaucgc

SEQ ID NO: 1751627 - RNA, 21 nt, Human herpesvirus 1
cucccccuccgcaucccagga

SEQ ID NO: 1751628 - RNA, 16 nt, Human herpesvirus 1
gugccuuuguuuccca

SEQ ID NO: 1751629 - RNA, 17 nt, Human herpesvirus 1
cuuaccaucccccggcc

SEQ ID NO: 1751630 - RNA, 14 nt, Human herpesvirus 1
ccuccccgcacaga

SEQ ID NO: 1751631 - RNA, 20 nt, Human herpesvirus 1
cccucccccuccgcauccca

SEQ ID NO: 1751632 - RNA, 19 nt, Human herpesvirus 1
ucccaccaaacuggcacau

SEQ ID NO: 1751633 - RNA, 14 nt, Human herpesvirus 1
caggcgggccuacc

SEQ ID NO: 1751634 - RNA, 19 nt, Human herpesvirus 1
cugcgccuugggcccgggg

SEQ ID NO: 1751635 - RNA, 14 nt, Human herpesvirus 1
cgggagccccggac

SEQ ID NO: 1751636 - RNA, 17 nt, Human herpesvirus 1
ucgaguucgccaggcug

SEQ ID NO: 1751637 - RNA, 13 nt, Human herpesvirus 1
cguacugcccauu

SEQ ID NO: 1751638 - RNA, 22 nt, Human herpesvirus 1
auggaguccacgguaggcccag

SEQ ID NO: 1751639 - RNA, 14 nt, Human herpesvirus 1
ggauccgaccccca

SEQ ID NO: 1751640 - RNA, 13 nt, Human herpesvirus 1
acccaccgggccc

SEQ ID NO: 1751641 - RNA, 22 nt, Human herpesvirus 1
gcccccggcauggcgcagcugg

SEQ ID NO: 1751642 - RNA, 11 nt, Human herpesvirus 1
ccgcgccaggc

SEQ ID NO: 1751643 - RNA, 17 nt, Human herpesvirus 1
cacaccaccgaccucaa

SEQ ID NO: 1751644 - RNA, 15 nt, Human herpesvirus 1
cucugggcgggccgu

SEQ ID NO: 1751645 - RNA, 20 nt, Human herpesvirus 1
caauguuuuuauuggucaaa

SEQ ID NO: 1751646 - RNA, 23 nt, Human herpesvirus 1
cugcggcucaacgagcuccuggc

SEQ ID NO: 1751647 - RNA, 24 nt, Human herpesvirus 1
cauugccgcguugguccucgugcc

SEQ ID NO: 1751648 - RNA, 15 nt, Human herpesvirus 1
cagaucggcgccgcg

SEQ ID NO: 1751649 - RNA, 15 nt, Human herpesvirus 1
cugcugcggccaguc

SEQ ID NO: 1751650 - RNA, 21 nt, Human herpesvirus 1
acccgcaacgcgcuggggcug

SEQ ID NO: 1751651 - RNA, 16 nt, Human herpesvirus 1
acgucgcgccugggug

SEQ ID NO: 1751652 - RNA, 23 nt, Human herpesvirus 1
gacucagggcucuacccucugga

SEQ ID NO: 1751653 - RNA, 16 nt, Human herpesvirus 1
gcucgucgccuggcug

SEQ ID NO: 1751654 - RNA, 15 nt, Human herpesvirus 1
guacggggccgggag

SEQ ID NO: 1751655 - RNA, 21 nt, Human herpesvirus 1
gcgcucgcucucggugccccu

SEQ ID NO: 1751656 - RNA, 20 nt, Human herpesvirus 1
cgcguguuccccgggagccc

SEQ ID NO: 1751657 - RNA, 11 nt, Human herpesvirus 1
ccaccgggccu

SEQ ID NO: 1751658 - RNA, 16 nt, Human herpesvirus 1
ccccccguggacccca

SEQ ID NO: 1751659 - RNA, 18 nt, Human herpesvirus 1
gcuggcacaccaccgacc

SEQ ID NO: 1751660 - RNA, 16 nt, Human herpesvirus 1
cgucccacgcucuccc

SEQ ID NO: 1751661 - RNA, 15 nt, Human herpesvirus 1
cggcacgccuggggu

SEQ ID NO: 1751662 - RNA, 14 nt, Human herpesvirus 1
gcacuguggcucuc

SEQ ID NO: 1751663 - RNA, 13 nt, Human herpesvirus 1
accagcguccgcc

SEQ ID NO: 1751664 - RNA, 21 nt, Human herpesvirus 1
agacccgggcgaugagccaac

SEQ ID NO: 1751665 - RNA, 16 nt, Human herpesvirus 1
gcacgggcccaaggcc

SEQ ID NO: 1751666 - RNA, 16 nt, Human herpesvirus 1
ggcccgcguuuggccu

SEQ ID NO: 1751667 - RNA, 21 nt, Human herpesvirus 1
ugaacgcaacggcgggagcug

SEQ ID NO: 1751668 - RNA, 15 nt, Human herpesvirus 1
aucccccgcgcggcu

SEQ ID NO: 1751669 - RNA, 14 nt, Human herpesvirus 1
agccccggacccca

SEQ ID NO: 1751670 - RNA, 17 nt, Human herpesvirus 1
gaggggcugggggagcg

SEQ ID NO: 1751671 - RNA, 15 nt, Human herpesvirus 1
gaacgcagccccgcu

SEQ ID NO: 1751672 - RNA, 19 nt, Human herpesvirus 1
gaccgcguguacgggcugu

SEQ ID NO: 1751673 - RNA, 12 nt, Human herpesvirus 1
guccaccaaagu

SEQ ID NO: 1751674 - RNA, 19 nt, Human herpesvirus 1
cgcgcaccuguuccgccug

SEQ ID NO: 1751675 - RNA, 13 nt, Human herpesvirus 1
gccccgacccccu

SEQ ID NO: 1751676 - RNA, 17 nt, Human herpesvirus 1
accccagggaccuccug

SEQ ID NO: 1751677 - RNA, 19 nt, Human herpesvirus 1
ugccggucggcgggcccgc

SEQ ID NO: 1751678 - RNA, 18 nt, Human herpesvirus 1
cuggugcugucugacaca

SEQ ID NO: 1751679 - RNA, 17 nt, Human herpesvirus 1
gagacccccaacgccac

SEQ ID NO: 1751680 - RNA, 17 nt, Human herpesvirus 1
gcuggguggucucuggc

SEQ ID NO: 1751681 - RNA, 22 nt, Human herpesvirus 1
agcauggcgccacaccacgcca

SEQ ID NO: 1751682 - RNA, 14 nt, Human herpesvirus 1
caacaacucccccg

SEQ ID NO: 1751683 - RNA, 18 nt, Human herpesvirus 1
cguggccgguaccaucaa

SEQ ID NO: 1751684 - RNA, 17 nt, Human herpesvirus 1
cggugacgccgacgagg

SEQ ID NO: 1751685 - RNA, 13 nt, Human herpesvirus 1
gagcucccagaga

SEQ ID NO: 1751686 - RNA, 14 nt, Human herpesvirus 1
cgggcgacgcacac

SEQ ID NO: 1751687 - RNA, 18 nt, Human herpesvirus 1
ucgaaacuuaacacacca

SEQ ID NO: 1751688 - RNA, 14 nt, Human herpesvirus 1
cggccccugggccc

SEQ ID NO: 1751689 - RNA, 17 nt, Human herpesvirus 1
ugacacccuaccccagu

SEQ ID NO: 1751690 - RNA, 18 nt, Human herpesvirus 1
aggggcgcuuaccgccac

SEQ ID NO: 1751691 - RNA, 12 nt, Human herpesvirus 1
guccuguggagc

SEQ ID NO: 1751692 - RNA, 19 nt, Human herpesvirus 1
acgcccgcaaacaggagcu

SEQ ID NO: 1751693 - RNA, 24 nt, Human herpesvirus 1
ucccgcugcgcauccccccgucag

SEQ ID NO: 1751694 - RNA, 17 nt, Human herpesvirus 1
gcauggggggggggcgg

SEQ ID NO: 1751695 - RNA, 18 nt, Human herpesvirus 1
cggccccagcccucuccc

SEQ ID NO: 1751696 - RNA, 13 nt, Human herpesvirus 1
gcccgugcugccg

SEQ ID NO: 1751697 - RNA, 18 nt, Human herpesvirus 1
cagucgcccgaagacacc

SEQ ID NO: 1751698 - RNA, 21 nt, Human herpesvirus 1
aaacuguccugucuuggggcc

SEQ ID NO: 1751699 - RNA, 15 nt, Human herpesvirus 1
cacaugcggaaagca

SEQ ID NO: 1751700 - RNA, 21 nt, Human herpesvirus 1
ccagagguguucacgcaccuc

SEQ ID NO: 1751701 - RNA, 13 nt, Human herpesvirus 1
cgaccaccaccuc

SEQ ID NO: 1751702 - RNA, 17 nt, Human herpesvirus 1
ccgucuggguuuucccc

SEQ ID NO: 1751703 - RNA, 15 nt, Human herpesvirus 1
cggccgugggcgccu

SEQ ID NO: 1751704 - RNA, 22 nt, Human herpesvirus 1
uucccacgcgaaucgucgccug

SEQ ID NO: 1751705 - RNA, 14 nt, Human herpesvirus 1
gaucguccaccucc

SEQ ID NO: 1751706 - RNA, 20 nt, Human herpesvirus 1
ggcggauuuggggcgcuccu

SEQ ID NO: 1751707 - RNA, 16 nt, Human herpesvirus 1
uucuccggggcccggc

SEQ ID NO: 1751708 - RNA, 23 nt, Human herpesvirus 1
ggcuccuguaaguacgcccuccc

SEQ ID NO: 1751709 - RNA, 19 nt, Human herpesvirus 1
cagcaccguuaccaccgau

SEQ ID NO: 1751710 - RNA, 15 nt, Human herpesvirus 1
accgcagucccugag

SEQ ID NO: 1751711 - RNA, 17 nt, Human herpesvirus 1
cucgccagcgacccgca

SEQ ID NO: 1751712 - RNA, 16 nt, Human herpesvirus 1
gugggguccucaugga

SEQ ID NO: 1751713 - RNA, 17 nt, Human herpesvirus 1
gcucccgggagcuccgc

SEQ ID NO: 1751714 - RNA, 15 nt, Human herpesvirus 1
gcggauuuggggcgc

SEQ ID NO: 1751715 - RNA, 20 nt, Human herpesvirus 1
guccacggccacuggccggg

SEQ ID NO: 1751716 - RNA, 19 nt, Human herpesvirus 1
caucugaagccguccgacc

SEQ ID NO: 1751717 - RNA, 21 nt, Human herpesvirus 1
agacggcauucgggccugccu

SEQ ID NO: 1751718 - RNA, 13 nt, Human herpesvirus 1
cagcugagccgcg

SEQ ID NO: 1751719 - RNA, 16 nt, Human herpesvirus 1
cgaccacgggcuguca

SEQ ID NO: 1751720 - RNA, 15 nt, Human herpesvirus 1
ccgccgacgaccugg

SEQ ID NO: 1751721 - RNA, 22 nt, Human herpesvirus 1
cggcucaacgagcuccuggccu

SEQ ID NO: 1751722 - RNA, 21 nt, Human herpesvirus 1
gauggcacaccgguccccgga

SEQ ID NO: 1751723 - RNA, 17 nt, Human herpesvirus 1
gguguccgagcccaccg

SEQ ID NO: 1751724 - RNA, 20 nt, Human herpesvirus 1
uccagggagaaaccccagca

SEQ ID NO: 1751725 - RNA, 13 nt, Human herpesvirus 1
gcaaacaggagcu

SEQ ID NO: 1751726 - RNA, 13 nt, Human herpesvirus 1
ggccccugggccc

SEQ ID NO: 1751727 - RNA, 18 nt, Human herpesvirus 1
uggagccugagcuggcga

SEQ ID NO: 1751728 - RNA, 20 nt, Human herpesvirus 1
cgccccccguguuugugggg

SEQ ID NO: 1751729 - RNA, 19 nt, Human herpesvirus 1
gaccuauguguuucagaua

SEQ ID NO: 1751730 - RNA, 16 nt, Human herpesvirus 1
auggcugcccccccgc

SEQ ID NO: 1751731 - RNA, 15 nt, Human herpesvirus 1
cauaccgaccacacc

SEQ ID NO: 1751732 - RNA, 17 nt, Human herpesvirus 1
cgugcacagccuggccg

SEQ ID NO: 1751733 - RNA, 12 nt, Human herpesvirus 1
ggcgccgcgaga

SEQ ID NO: 1751734 - RNA, 14 nt, Human herpesvirus 1
gcccaccgcugggc

SEQ ID NO: 1751735 - RNA, 16 nt, Human herpesvirus 1
gccgcaggacccagca

SEQ ID NO: 1751736 - RNA, 14 nt, Human herpesvirus 1
gcggcagucuccug

SEQ ID NO: 1751737 - RNA, 20 nt, Human herpesvirus 1
ggcgccgcgagauggccgcc

SEQ ID NO: 1751738 - RNA, 20 nt, Human herpesvirus 1
auaaauuuuacaaacagauu

SEQ ID NO: 1751739 - RNA, 13 nt, Human herpesvirus 1
cuggcuggccgcu

SEQ ID NO: 1751740 - RNA, 17 nt, Human herpesvirus 1
ccgcgacccccgggcua

SEQ ID NO: 1751741 - RNA, 23 nt, Human herpesvirus 1
uggucguccgcggaccggcggcg

SEQ ID NO: 1751742 - RNA, 15 nt, Human herpesvirus 1
cgcuucauccccgag

SEQ ID NO: 1751743 - RNA, 22 nt, Human herpesvirus 1
caugcgggcucggcuccccgcc

SEQ ID NO: 1751744 - RNA, 20 nt, Human herpesvirus 1
augcgggauccucggccagc

SEQ ID NO: 1751745 - RNA, 17 nt, Human herpesvirus 1
ggacgggcucgccagcg

SEQ ID NO: 1751746 - RNA, 15 nt, Human herpesvirus 1
cucccagagacccca

SEQ ID NO: 1751747 - RNA, 15 nt, Human herpesvirus 1
cgugggccucaccca

SEQ ID NO: 1751748 - RNA, 20 nt, Human herpesvirus 1
ccugcuuauucucggggagc

SEQ ID NO: 1751749 - RNA, 14 nt, Human herpesvirus 1
ggccucccccggac

SEQ ID NO: 1751750 - RNA, 22 nt, Human herpesvirus 1
cugccgucgcuagaccacgccc

SEQ ID NO: 1751751 - RNA, 20 nt, Human herpesvirus 1
cgcgguggacagccaggagc

SEQ ID NO: 1751752 - RNA, 14 nt, Human herpesvirus 1
gguagcgggggacg

SEQ ID NO: 1751753 - RNA, 13 nt, Human herpesvirus 1
caccgcccacaga

SEQ ID NO: 1751754 - RNA, 20 nt, Human herpesvirus 1
aggaugccagccagggcggc

SEQ ID NO: 1751755 - RNA, 16 nt, Human herpesvirus 1
ucaccaugcuggagga

SEQ ID NO: 1751756 - RNA, 11 nt, Human herpesvirus 1
gucauaugcaa

SEQ ID NO: 1751757 - RNA, 12 nt, Human herpesvirus 1
gcaucccaggau

SEQ ID NO: 1751758 - RNA, 17 nt, Human herpesvirus 1
guccccaaaauaaaaga

SEQ ID NO: 1751759 - RNA, 15 nt, Human herpesvirus 1
cagggagccccgguc

SEQ ID NO: 1751760 - RNA, 17 nt, Human herpesvirus 1
aacgcguccguggagcg

SEQ ID NO: 1751761 - RNA, 16 nt, Human herpesvirus 1
cuuuaacuacauuaaa

SEQ ID NO: 1751762 - RNA, 23 nt, Human herpesvirus 1
ccuccggagcgugacgcaccccc

SEQ ID NO: 1751763 - RNA, 15 nt, Human herpesvirus 1
aggaccgcgcccccg

SEQ ID NO: 1751764 - RNA, 14 nt, Human herpesvirus 1
gucgcccuccacca

SEQ ID NO: 1751765 - RNA, 22 nt, Human herpesvirus 1
ucaccccgaagccccggcccug

SEQ ID NO: 1751766 - RNA, 19 nt, Human herpesvirus 1
cugggcgagguggagcugc

SEQ ID NO: 1751767 - RNA, 18 nt, Human herpesvirus 1
cuggucccccggggaccu

SEQ ID NO: 1751768 - RNA, 17 nt, Human herpesvirus 1
uggccagcggcccgggg

SEQ ID NO: 1751769 - RNA, 17 nt, Human herpesvirus 1
caccgucauccacaccu

SEQ ID NO: 1751770 - RNA, 12 nt, Human herpesvirus 1
ucuuugugccug

SEQ ID NO: 1751771 - RNA, 12 nt, Human herpesvirus 1
ccccccagccuc

SEQ ID NO: 1751772 - RNA, 13 nt, Human herpesvirus 1
cuccccgggagcc

SEQ ID NO: 1751773 - RNA, 14 nt, Human herpesvirus 1
cgccgcgggccacg

SEQ ID NO: 1751774 - RNA, 19 nt, Human herpesvirus 1
gucgaccgcgcccucgcca

SEQ ID NO: 1751775 - RNA, 14 nt, Human herpesvirus 1
ggcggcagcccgga

SEQ ID NO: 1751776 - RNA, 17 nt, Human herpesvirus 1
ucagccagacgccgggu

SEQ ID NO: 1751777 - RNA, 17 nt, Human herpesvirus 1
ggacagcaaccagaagc

SEQ ID NO: 1751778 - RNA, 21 nt, Human herpesvirus 1
auggcacaccgguccccggag

SEQ ID NO: 1751779 - RNA, 14 nt, Human herpesvirus 1
cgcucccgccuucc

SEQ ID NO: 1751780 - RNA, 15 nt, Human herpesvirus 1
guucgagcagccgcg

SEQ ID NO: 1751781 - RNA, 17 nt, Human herpesvirus 1
cucuggggucccugucg

SEQ ID NO: 1751782 - RNA, 12 nt, Human herpesvirus 1
gggaccuccugg

SEQ ID NO: 1751783 - RNA, 15 nt, Human herpesvirus 1
ccgggacgaggccgu

SEQ ID NO: 1751784 - RNA, 12 nt, Human herpesvirus 1
ccccccgcgcuc

SEQ ID NO: 1751785 - RNA, 12 nt, Human herpesvirus 1
aguugccccacc

SEQ ID NO: 1751786 - RNA, 16 nt, Human herpesvirus 1
cccaggaucacaccgg

SEQ ID NO: 1751787 - RNA, 12 nt, Human herpesvirus 1
uucccgaaacuu

SEQ ID NO: 1751788 - RNA, 14 nt, Human herpesvirus 1
cggcuacaggggcc

SEQ ID NO: 1751789 - RNA, 19 nt, Human herpesvirus 1
ggccgccacgcgcccgagu

SEQ ID NO: 1751790 - RNA, 12 nt, Human herpesvirus 1
cgcgccaucugg

SEQ ID NO: 1751791 - RNA, 11 nt, Human herpesvirus 1
ggccugguggc

SEQ ID NO: 1751792 - RNA, 14 nt, Human herpesvirus 1
aacacaaacaucug

SEQ ID NO: 1751793 - RNA, 22 nt, Human herpesvirus 1
cacgcacuugcggcaagacccg

SEQ ID NO: 1751794 - RNA, 12 nt, Human herpesvirus 1
uagagacagccg

SEQ ID NO: 1751795 - RNA, 16 nt, Human herpesvirus 1
gccccugggccccggg

SEQ ID NO: 1751796 - RNA, 22 nt, Human herpesvirus 1
gcucggccuauggcuccugcga

SEQ ID NO: 1751797 - RNA, 14 nt, Human herpesvirus 1
ccccggggcgggug

SEQ ID NO: 1751798 - RNA, 21 nt, Human herpesvirus 1
gcgcgucgacgucgcgccugg

SEQ ID NO: 1751799 - RNA, 18 nt, Human herpesvirus 1
gagaguuugaucguggac

SEQ ID NO: 1751800 - RNA, 13 nt, Human herpesvirus 1
acgacggccucgu

SEQ ID NO: 1751801 - RNA, 21 nt, Human herpesvirus 1
cgggcgcuugcgcaccuggug

SEQ ID NO: 1751802 - RNA, 18 nt, Human herpesvirus 1
ccucccccguagaucucu

SEQ ID NO: 1751803 - RNA, 17 nt, Human herpesvirus 1
ccgaccauccgccggca

SEQ ID NO: 1751804 - RNA, 17 nt, Human herpesvirus 1
cagacgagcgcgcuugu

SEQ ID NO: 1751805 - RNA, 16 nt, Human herpesvirus 1
cgcaccaucccggguu

SEQ ID NO: 1751806 - RNA, 16 nt, Human herpesvirus 1
cuaugacggcaauaaa

SEQ ID NO: 1751807 - RNA, 21 nt, Human herpesvirus 1
ggcguaccaaacaaacaaacc

SEQ ID NO: 1751808 - RNA, 19 nt, Human herpesvirus 1
ggccgcaggacccagcaag

SEQ ID NO: 1751809 - RNA, 16 nt, Human herpesvirus 1
ccgcaacuucccaccc

SEQ ID NO: 1751810 - RNA, 13 nt, Human herpesvirus 1
cgccacacccgcg

SEQ ID NO: 1751811 - RNA, 19 nt, Human herpesvirus 1
acacaacggcaugccucug

SEQ ID NO: 1751812 - RNA, 19 nt, Human herpesvirus 1
caccaucccggguuaaugu

SEQ ID NO: 1751813 - RNA, 14 nt, Human herpesvirus 1
cgggggccuggugg

SEQ ID NO: 1751814 - RNA, 23 nt, Human herpesvirus 1
agucccuccaaucgccgguuccu

SEQ ID NO: 1751815 - RNA, 15 nt, Human herpesvirus 1
ggucuaucacacccg

SEQ ID NO: 1751816 - RNA, 19 nt, Human herpesvirus 1
gggguccggcacggaccca

SEQ ID NO: 1751817 - RNA, 19 nt, Human herpesvirus 1
aucccaccaaacuggcaca

SEQ ID NO: 1751818 - RNA, 14 nt, Human herpesvirus 1
aggcgccugccccg

SEQ ID NO: 1751819 - RNA, 20 nt, Human herpesvirus 1
cggcgggugucugcucccca

SEQ ID NO: 1751820 - RNA, 17 nt, Human herpesvirus 1
cggaaggggacacgggc

SEQ ID NO: 1751821 - RNA, 21 nt, Human herpesvirus 1
ggugccugacgccugccaacc

SEQ ID NO: 1751822 - RNA, 20 nt, Human herpesvirus 1
uggcuggguuuuuggcccug

SEQ ID NO: 1751823 - RNA, 17 nt, Human herpesvirus 1
gcagccgaugccccggg

SEQ ID NO: 1751824 - RNA, 14 nt, Human herpesvirus 1
ugucucgucuccuc

SEQ ID NO: 1751825 - RNA, 15 nt, Human herpesvirus 1
gccgcgguacagauc

SEQ ID NO: 1751826 - RNA, 21 nt, Human herpesvirus 1
accgacagcacucacagcccc

SEQ ID NO: 1751827 - RNA, 15 nt, Human herpesvirus 1
acccagccuuuaacu

SEQ ID NO: 1751828 - RNA, 21 nt, Human herpesvirus 1
cccauaaaacccaagccggga

SEQ ID NO: 1751829 - RNA, 13 nt, Human herpesvirus 1
ugcacucccugcc

SEQ ID NO: 1751830 - RNA, 18 nt, Human herpesvirus 1
cgcggcccggggccugcu

SEQ ID NO: 1751831 - RNA, 14 nt, Human herpesvirus 1
guucggccaccgcu

SEQ ID NO: 1751832 - RNA, 22 nt, Human herpesvirus 1
gccgcgcccacuacaccagcca

SEQ ID NO: 1751833 - RNA, 17 nt, Human herpesvirus 1
gcacccccugaccccgc

SEQ ID NO: 1751834 - RNA, 18 nt, Human herpesvirus 1
gcacaucaaggugggcca

SEQ ID NO: 1751835 - RNA, 18 nt, Human herpesvirus 1
gagccccggucuccccgg

SEQ ID NO: 1751836 - RNA, 17 nt, Human herpesvirus 1
caaccugauccgcggcg

SEQ ID NO: 1751837 - RNA, 18 nt, Human herpesvirus 1
cgcggccgcgacccaggc

SEQ ID NO: 1751838 - RNA, 14 nt, Human herpesvirus 1
ucacgugcugcugc

SEQ ID NO: 1751839 - RNA, 18 nt, Human herpesvirus 1
ccuguuugucgccuggcu

SEQ ID NO: 1751840 - RNA, 15 nt, Human herpesvirus 1
gcgcgccugccgcag

SEQ ID NO: 1751841 - RNA, 15 nt, Human herpesvirus 1
ccgacugccagcuau

SEQ ID NO: 1751842 - RNA, 17 nt, Human herpesvirus 1
acacgagcgccagcgcu

SEQ ID NO: 1751843 - RNA, 20 nt, Human herpesvirus 1
auggcacaccgguccccgga

SEQ ID NO: 1751844 - RNA, 16 nt, Human herpesvirus 1
gccgucgcuagaccac

SEQ ID NO: 1751845 - RNA, 17 nt, Human herpesvirus 1
uguccgcgcauccgacc

SEQ ID NO: 1751846 - RNA, 14 nt, Human herpesvirus 1
ccgcuggggccccc

SEQ ID NO: 1751847 - RNA, 22 nt, Human herpesvirus 1
ccgcagcaccucuaccagcagg

SEQ ID NO: 1751848 - RNA, 16 nt, Human herpesvirus 1
ccaaugggccgggccg

SEQ ID NO: 1751849 - RNA, 15 nt, Human herpesvirus 1
cgcugcugcggccag

SEQ ID NO: 1751850 - RNA, 15 nt, Human herpesvirus 1
cuccccgggagcccc

SEQ ID NO: 1751851 - RNA, 22 nt, Human herpesvirus 1
ccacccccccggaggaaacccc

SEQ ID NO: 1751852 - RNA, 21 nt, Human herpesvirus 1
gucagccugccucucccccca

SEQ ID NO: 1751853 - RNA, 14 nt, Human herpesvirus 1
cuccgacgcccagc

SEQ ID NO: 1751854 - RNA, 16 nt, Human herpesvirus 1
gguggaugccucucuc

SEQ ID NO: 1751855 - RNA, 17 nt, Human herpesvirus 1
cuccgcuggggccccca

SEQ ID NO: 1751856 - RNA, 16 nt, Human herpesvirus 1
acgucaugcggcugca

SEQ ID NO: 1751857 - RNA, 17 nt, Human herpesvirus 1
ccacaugaagccacugu

SEQ ID NO: 1751858 - RNA, 19 nt, Human herpesvirus 1
cacgcaagaccaggccugg

SEQ ID NO: 1751859 - RNA, 16 nt, Human herpesvirus 1
guccugcgccccgccg

SEQ ID NO: 1751860 - RNA, 14 nt, Human herpesvirus 1
cuucuacaccuccc

SEQ ID NO: 1751861 - RNA, 23 nt, Human herpesvirus 1
cuccuggccuacgucuccgugcu

SEQ ID NO: 1751862 - RNA, 22 nt, Human herpesvirus 1
uaagcgucccugggcccuggcc

SEQ ID NO: 1751863 - RNA, 20 nt, Human herpesvirus 1
cgccaagguggacugguugg

SEQ ID NO: 1751864 - RNA, 20 nt, Human herpesvirus 1
cguaacgucgcgggacccga

SEQ ID NO: 1751865 - RNA, 20 nt, Human herpesvirus 1
cgcccccggcuacaggggcc

SEQ ID NO: 1751866 - RNA, 15 nt, Human herpesvirus 1
cuggacgcccgggcg

SEQ ID NO: 1751867 - RNA, 17 nt, Human herpesvirus 1
auguuugcgggccuggg

SEQ ID NO: 1751868 - RNA, 17 nt, Human herpesvirus 1
ccggaagcccaacccac

SEQ ID NO: 1751869 - RNA, 11 nt, Human herpesvirus 1
ucggcauggug

SEQ ID NO: 1751870 - RNA, 21 nt, Human herpesvirus 1
aggagccccugcccgacaggg

SEQ ID NO: 1751871 - RNA, 19 nt, Human herpesvirus 1
caaccuggagaccaccgcg

SEQ ID NO: 1751872 - RNA, 17 nt, Human herpesvirus 1
cggcccuaaccccaccc

SEQ ID NO: 1751873 - RNA, 12 nt, Human herpesvirus 1
uccgcuggggcc

SEQ ID NO: 1751874 - RNA, 18 nt, Human herpesvirus 1
ccgucgggaggccacaga

SEQ ID NO: 1751875 - RNA, 14 nt, Human herpesvirus 1
caccguggccuggg

SEQ ID NO: 1751876 - RNA, 16 nt, Human herpesvirus 1
gcccacuacaccagcc

SEQ ID NO: 1751877 - RNA, 16 nt, Human herpesvirus 1
acauguccgugccgcu

SEQ ID NO: 1751878 - RNA, 20 nt, Human herpesvirus 1
ggaucuuagccuccccgggc

SEQ ID NO: 1751879 - RNA, 13 nt, Human herpesvirus 1
cauuuuacaauaa

SEQ ID NO: 1751880 - RNA, 12 nt, Human herpesvirus 1
aggaacacaccc

SEQ ID NO: 1751881 - RNA, 20 nt, Human herpesvirus 1
acgcacuugcggcaagaccc

SEQ ID NO: 1751882 - RNA, 14 nt, Human herpesvirus 1
cacgguaggcccag

SEQ ID NO: 1751883 - RNA, 21 nt, Human herpesvirus 1
gcaucggcaaggacgcccgcg

SEQ ID NO: 1751884 - RNA, 15 nt, Human herpesvirus 1
cagccccccagccuc

SEQ ID NO: 1751885 - RNA, 17 nt, Human herpesvirus 1
cgcccgccccccgaccg

SEQ ID NO: 1751886 - RNA, 13 nt, Human herpesvirus 1
accagcgcaccgu

SEQ ID NO: 1751887 - RNA, 16 nt, Human herpesvirus 1
gcacgagcaggcgguc

SEQ ID NO: 1751888 - RNA, 15 nt, Human herpesvirus 1
gcgcguuugcacaac

SEQ ID NO: 1751889 - RNA, 14 nt, Human herpesvirus 1
gacccccccgacau

SEQ ID NO: 1751890 - RNA, 22 nt, Human herpesvirus 1
ccguggggacgguggcgccgca

SEQ ID NO: 1751891 - RNA, 20 nt, Human herpesvirus 1
acgcacccgcugcgucggca

SEQ ID NO: 1751892 - RNA, 13 nt, Human herpesvirus 1
cgggcggagaaac

SEQ ID NO: 1751893 - RNA, 18 nt, Human herpesvirus 1
ugcaugucgucacgguga

SEQ ID NO: 1751894 - RNA, 17 nt, Human herpesvirus 1
ucuggccgcgcccacua

SEQ ID NO: 1751895 - RNA, 13 nt, Human herpesvirus 1
ccgcgcgccccga

SEQ ID NO: 1751896 - RNA, 19 nt, Human herpesvirus 1
accauggccccccgcgucc

SEQ ID NO: 1751897 - RNA, 18 nt, Human herpesvirus 1
cggucggcaaggugguga

SEQ ID NO: 1751898 - RNA, 18 nt, Human herpesvirus 1
gcguguaccacauccagg

SEQ ID NO: 1751899 - RNA, 20 nt, Human herpesvirus 1
ugaguuuguggacccaaagc

SEQ ID NO: 1751900 - RNA, 16 nt, Human herpesvirus 1
ugaaggcccuguaccc

SEQ ID NO: 1751901 - RNA, 13 nt, Human herpesvirus 1
cuuccccacggga

SEQ ID NO: 1751902 - RNA, 16 nt, Human herpesvirus 1
cgcuacuucaccuucg

SEQ ID NO: 1751903 - RNA, 12 nt, Human herpesvirus 1
cuccggaccccc

SEQ ID NO: 1751904 - RNA, 18 nt, Human herpesvirus 1
acccgaaacugcuuccgu

SEQ ID NO: 1751905 - RNA, 15 nt, Human herpesvirus 1
caccuguuccgccug

SEQ ID NO: 1751906 - RNA, 17 nt, Human herpesvirus 1
cuucgacguggaggaag

SEQ ID NO: 1751907 - RNA, 16 nt, Human herpesvirus 1
cacacagcccucccga

SEQ ID NO: 1751908 - RNA, 14 nt, Human herpesvirus 1
guuugcccauaaua

SEQ ID NO: 1751909 - RNA, 13 nt, Human herpesvirus 1
ccgaagaggugcu

SEQ ID NO: 1751910 - RNA, 20 nt, Human herpesvirus 1
gccggcacguaccugcggcu

SEQ ID NO: 1751911 - RNA, 12 nt, Human herpesvirus 1
caccaccagcug

SEQ ID NO: 1751912 - RNA, 15 nt, Human herpesvirus 1
gcacacacccuagcg

SEQ ID NO: 1751913 - RNA, 17 nt, Human herpesvirus 1
cgaccagcgccgggugg

SEQ ID NO: 1751914 - RNA, 17 nt, Human herpesvirus 1
ccgaacccggcccgggg

SEQ ID NO: 1751915 - RNA, 16 nt, Human herpesvirus 1
aucccccggccacccc

SEQ ID NO: 1751916 - RNA, 16 nt, Human herpesvirus 1
ccgugguccuguggag

SEQ ID NO: 1751917 - RNA, 15 nt, Human herpesvirus 1
uccacccccucgacc

SEQ ID NO: 1751918 - RNA, 19 nt, Human herpesvirus 1
cgccugcggcgaccucggc

SEQ ID NO: 1751919 - RNA, 15 nt, Human herpesvirus 1
uggucggcgagcugg

SEQ ID NO: 1751920 - RNA, 16 nt, Human herpesvirus 1
gugaaagacacgggca

SEQ ID NO: 1751921 - RNA, 13 nt, Human herpesvirus 1
cgaccuguugaug

SEQ ID NO: 1751922 - RNA, 16 nt, Human herpesvirus 1
ccuccgacgcccagca

SEQ ID NO: 1751923 - RNA, 17 nt, Human herpesvirus 1
gaccaccaccuccaccc

SEQ ID NO: 1751924 - RNA, 21 nt, Human herpesvirus 1
gcaccaccgacucucccaccg

SEQ ID NO: 1751925 - RNA, 20 nt, Human herpesvirus 1
uccgcgccaggcccgccgcc

SEQ ID NO: 1751926 - RNA, 21 nt, Human herpesvirus 1
ucgaccccauggaccccagcg

SEQ ID NO: 1751927 - RNA, 13 nt, Human herpesvirus 1
gucuggccccggc

SEQ ID NO: 1751928 - RNA, 18 nt, Human herpesvirus 1
cgggcccagccuucccgu

SEQ ID NO: 1751929 - RNA, 21 nt, Human herpesvirus 1
ccugagcccggcggcgcuggc

SEQ ID NO: 1751930 - RNA, 14 nt, Human herpesvirus 1
cuggcugacccacg

SEQ ID NO: 1751931 - RNA, 16 nt, Human herpesvirus 1
ggaucggcgccaugcu

SEQ ID NO: 1751932 - RNA, 13 nt, Human herpesvirus 1
gcagucuccuggc

SEQ ID NO: 1751933 - RNA, 17 nt, Human herpesvirus 1
ugccggucggcgggccc

SEQ ID NO: 1751934 - RNA, 17 nt, Human herpesvirus 1
cgcgaccgacagcacuc

SEQ ID NO: 1751935 - RNA, 11 nt, Human herpesvirus 1
cggaagcccaa

SEQ ID NO: 1751936 - RNA, 14 nt, Human herpesvirus 1
cgacuugccccccu

SEQ ID NO: 1751937 - RNA, 16 nt, Human herpesvirus 1
ccgaacgacacacggc

SEQ ID NO: 1751938 - RNA, 16 nt, Human herpesvirus 1
cugcgcgacgcccucc

SEQ ID NO: 1751939 - RNA, 16 nt, Human herpesvirus 1
cgcgucuggccccggc

SEQ ID NO: 1751940 - RNA, 16 nt, Human herpesvirus 1
cgacggcggaccuggc

SEQ ID NO: 1751941 - RNA, 13 nt, Human herpesvirus 1
cgcaccagcccuu

SEQ ID NO: 1751942 - RNA, 18 nt, Human herpesvirus 1
cugucgaucguccaucac

SEQ ID NO: 1751943 - RNA, 16 nt, Human herpesvirus 1
uuaacuacauuaaauu

SEQ ID NO: 1751944 - RNA, 19 nt, Human herpesvirus 1
cugguuguccguggcccca

SEQ ID NO: 1751945 - RNA, 12 nt, Human herpesvirus 1
acuccccggacc

SEQ ID NO: 1751946 - RNA, 21 nt, Human herpesvirus 1
acccguuccagccccccagcc

SEQ ID NO: 1751947 - RNA, 16 nt, Human herpesvirus 1
cccccaucaccccgca

SEQ ID NO: 1751948 - RNA, 15 nt, Human herpesvirus 1
cccuuccccacggga

SEQ ID NO: 1751949 - RNA, 12 nt, Human herpesvirus 1
uuuguggggagg

SEQ ID NO: 1751950 - RNA, 17 nt, Human herpesvirus 1
ucccucgaccaccaucc

SEQ ID NO: 1751951 - RNA, 17 nt, Human herpesvirus 1
cccaccgacacaugcac

SEQ ID NO: 1751952 - RNA, 17 nt, Human herpesvirus 1
ccagaugcccacgggca

SEQ ID NO: 1751953 - RNA, 21 nt, Human herpesvirus 1
cauccgaacgcagccccgcug

SEQ ID NO: 1751954 - RNA, 20 nt, Human herpesvirus 1
gaucccccgcgcggcugcca

SEQ ID NO: 1751955 - RNA, 18 nt, Human herpesvirus 1
cggccgccacccaggcgc

SEQ ID NO: 1751956 - RNA, 15 nt, Human herpesvirus 1
ggcgucugggccacc

SEQ ID NO: 1751957 - RNA, 14 nt, Human herpesvirus 1
cccaaccccaacuc

SEQ ID NO: 1751958 - RNA, 18 nt, Human herpesvirus 1
gccgggccgcccacuucc

SEQ ID NO: 1751959 - RNA, 18 nt, Human herpesvirus 1
caucccccgccuuuuugg

SEQ ID NO: 1751960 - RNA, 17 nt, Human herpesvirus 1
cacacacgggggagcgc

SEQ ID NO: 1751961 - RNA, 15 nt, Human herpesvirus 1
cgcccaccuccuggc

SEQ ID NO: 1751962 - RNA, 13 nt, Human herpesvirus 1
ucaacauaccccg

SEQ ID NO: 1751963 - RNA, 22 nt, Human herpesvirus 1
uacacucgcgcguguacaacau

SEQ ID NO: 1751964 - RNA, 13 nt, Human herpesvirus 1
gccuucucccggu

SEQ ID NO: 1751965 - RNA, 12 nt, Human herpesvirus 1
gccccgaccccc

SEQ ID NO: 1751966 - RNA, 13 nt, Human herpesvirus 1
ccugccgcgcgga

SEQ ID NO: 1751967 - RNA, 21 nt, Human herpesvirus 1
accugacgcgccuagccaacc

SEQ ID NO: 1751968 - RNA, 20 nt, Human herpesvirus 1
gauaacaaccacccgcaccc

SEQ ID NO: 1751969 - RNA, 14 nt, Human herpesvirus 1
uacagcccccagau

SEQ ID NO: 1751970 - RNA, 16 nt, Human herpesvirus 1
cggcggcagcccggag

SEQ ID NO: 1751971 - RNA, 15 nt, Human herpesvirus 1
gcgcgcgaccucacc

SEQ ID NO: 1751972 - RNA, 14 nt, Human herpesvirus 1
ccaacgcccugacc

SEQ ID NO: 1751973 - RNA, 15 nt, Human herpesvirus 1
ucgaggcggccgagg

SEQ ID NO: 1751974 - RNA, 18 nt, Human herpesvirus 1
ugccaccagccugguugu

SEQ ID NO: 1751975 - RNA, 14 nt, Human herpesvirus 1
uugcacccagccuu

SEQ ID NO: 1751976 - RNA, 23 nt, Human herpesvirus 1
cugcgguccggagccgcgcggcc

SEQ ID NO: 1751977 - RNA, 13 nt, Human herpesvirus 1
gaccccuucuccc

SEQ ID NO: 1751978 - RNA, 13 nt, Human herpesvirus 1
ggcccccaggguc

SEQ ID NO: 1751979 - RNA, 21 nt, Human herpesvirus 1
ccaaacccaccgacacaugca

SEQ ID NO: 1751980 - RNA, 18 nt, Human herpesvirus 1
guaccaucaaccacccgg

SEQ ID NO: 1751981 - RNA, 17 nt, Human herpesvirus 1
uaaacccccaaacaccc

SEQ ID NO: 1751982 - RNA, 19 nt, Human herpesvirus 1
gcaaccccaugaaggcccu

SEQ ID NO: 1751983 - RNA, 16 nt, Human herpesvirus 1
cccgggucuguugggg

SEQ ID NO: 1751984 - RNA, 14 nt, Human herpesvirus 1
ccuuuucgccgccc

SEQ ID NO: 1751985 - RNA, 14 nt, Human herpesvirus 1
cggccgcgguacag

SEQ ID NO: 1751986 - RNA, 16 nt, Human herpesvirus 1
cgcucgucgccuggcu

SEQ ID NO: 1751987 - RNA, 15 nt, Human herpesvirus 1
cccggggcucagcca

SEQ ID NO: 1751988 - RNA, 18 nt, Human herpesvirus 1
gugcugccgucgcuagac

SEQ ID NO: 1751989 - RNA, 15 nt, Human herpesvirus 1
caaccccaacuccag

SEQ ID NO: 1751990 - RNA, 13 nt, Human herpesvirus 1
auaaggccuggga

SEQ ID NO: 1751991 - RNA, 17 nt, Human herpesvirus 1
cgcaaagccacccacgc

SEQ ID NO: 1751992 - RNA, 16 nt, Human herpesvirus 1
cggggccuuggcggcc

SEQ ID NO: 1751993 - RNA, 14 nt, Human herpesvirus 1
gcugccaaacagcu

SEQ ID NO: 1751994 - RNA, 15 nt, Human herpesvirus 1
gcggucggcaaggug

SEQ ID NO: 1751995 - RNA, 23 nt, Human herpesvirus 1
ggaugaaaaugaaccagacccua

SEQ ID NO: 1751996 - RNA, 21 nt, Human herpesvirus 1
cgccucggucaccccaauccc

SEQ ID NO: 1751997 - RNA, 15 nt, Human herpesvirus 1
gcccaccgcugggcg

SEQ ID NO: 1751998 - RNA, 11 nt, Human herpesvirus 1
gcgccaaagcc

SEQ ID NO: 1751999 - RNA, 20 nt, Human herpesvirus 1
ccgcgaacggcacgcccccu

SEQ ID NO: 1752000 - RNA, 15 nt, Human herpesvirus 1
gcccgccccucgcca

SEQ ID NO: 1752001 - RNA, 23 nt, Human herpesvirus 1
ccugcgcgacgcccuccaucgga

SEQ ID NO: 1752002 - RNA, 22 nt, Human herpesvirus 1
gacguuuaucggcaggcaccgc

SEQ ID NO: 1752003 - RNA, 18 nt, Human herpesvirus 1
caccgggaagcagggccc

SEQ ID NO: 1752004 - RNA, 13 nt, Human herpesvirus 1
caccuuggcccug

SEQ ID NO: 1752005 - RNA, 15 nt, Human herpesvirus 1
cgucccggcucuccg

SEQ ID NO: 1752006 - RNA, 15 nt, Human herpesvirus 1
ccgguccuggaccag

SEQ ID NO: 1752007 - RNA, 15 nt, Human herpesvirus 1
ccgcgagcucccaga

SEQ ID NO: 1752008 - RNA, 15 nt, Human herpesvirus 1
caacuccagaccacc

SEQ ID NO: 1752009 - RNA, 18 nt, Human herpesvirus 1
gcuacgaguugccccacc

SEQ ID NO: 1752010 - RNA, 15 nt, Human herpesvirus 1
guacgaccaucaccc

SEQ ID NO: 1752011 - RNA, 14 nt, Human herpesvirus 1
acaacggcaugccu

SEQ ID NO: 1752012 - RNA, 16 nt, Human herpesvirus 1
gccgugguccugugga

SEQ ID NO: 1752013 - RNA, 20 nt, Human herpesvirus 1
ccauggacagcgaccugggg

SEQ ID NO: 1752014 - RNA, 22 nt, Human herpesvirus 1
uccuggaacgaggccgcagccu

SEQ ID NO: 1752015 - RNA, 20 nt, Human herpesvirus 1
aggggcuccuuagcgcggcc

SEQ ID NO: 1752016 - RNA, 22 nt, Human herpesvirus 1
cuccugauguggcugcuccgcu

SEQ ID NO: 1752017 - RNA, 23 nt, Human herpesvirus 1
ggccagccgcaguacuaccuggc

SEQ ID NO: 1752018 - RNA, 15 nt, Human herpesvirus 1
gaagacgaggcggcc

SEQ ID NO: 1752019 - RNA, 17 nt, Human herpesvirus 1
gcucuccgaucccaacu

SEQ ID NO: 1752020 - RNA, 21 nt, Human herpesvirus 1
cauaaccgaccgcagucccug

SEQ ID NO: 1752021 - RNA, 17 nt, Human herpesvirus 1
ggcgccugccccgccac

SEQ ID NO: 1752022 - RNA, 17 nt, Human herpesvirus 1
ccucccgcucggcggca

SEQ ID NO: 1752023 - RNA, 13 nt, Human herpesvirus 1
cucccgccacccg

SEQ ID NO: 1752024 - RNA, 14 nt, Human herpesvirus 1
gucuucggccccgc

SEQ ID NO: 1752025 - RNA, 13 nt, Human herpesvirus 1
cgcuggggcugcc

SEQ ID NO: 1752026 - RNA, 13 nt, Human herpesvirus 1
agcagagccgcaa

SEQ ID NO: 1752027 - RNA, 18 nt, Human herpesvirus 1
cgaguucccccggcacgc

SEQ ID NO: 1752028 - RNA, 16 nt, Human herpesvirus 1
aaauuuuacaaacaga

SEQ ID NO: 1752029 - RNA, 18 nt, Human herpesvirus 1
ggccugaacaaacaaacc

SEQ ID NO: 1752030 - RNA, 18 nt, Human herpesvirus 1
gucugugccaccagccug

SEQ ID NO: 1752031 - RNA, 19 nt, Human herpesvirus 1
gcaucccccgucuggguuu

SEQ ID NO: 1752032 - RNA, 15 nt, Human herpesvirus 1
accucaccaccaagg

SEQ ID NO: 1752033 - RNA, 15 nt, Human herpesvirus 1
ggcgccgaccacccg

SEQ ID NO: 1752034 - RNA, 16 nt, Human herpesvirus 1
gacacgcgcguccuuc

SEQ ID NO: 1752035 - RNA, 11 nt, Human herpesvirus 1
ugcacccagcc

SEQ ID NO: 1752036 - RNA, 15 nt, Human herpesvirus 1
ccucguuugccgcca

SEQ ID NO: 1752037 - RNA, 12 nt, Human herpesvirus 1
ucgggaggccac

SEQ ID NO: 1752038 - RNA, 12 nt, Human herpesvirus 1
uccggggguccg

SEQ ID NO: 1752039 - RNA, 15 nt, Human herpesvirus 1
uggaccccagcgacc

SEQ ID NO: 1752040 - RNA, 23 nt, Human herpesvirus 1
gcucgaccucuccacaccugcac

SEQ ID NO: 1752041 - RNA, 17 nt, Human herpesvirus 1
cccguagucccaucccc

SEQ ID NO: 1752042 - RNA, 23 nt, Human herpesvirus 1
ucugggcccgacagaccuccccg

SEQ ID NO: 1752043 - RNA, 16 nt, Human herpesvirus 1
ucguauccacaauaaa

SEQ ID NO: 1752044 - RNA, 18 nt, Human herpesvirus 1
ggcgucucgccggacgac

SEQ ID NO: 1752045 - RNA, 14 nt, Human herpesvirus 1
auguccccaaaaua

SEQ ID NO: 1752046 - RNA, 23 nt, Human herpesvirus 1
gcauaucccacccuggagcucaa

SEQ ID NO: 1752047 - RNA, 17 nt, Human herpesvirus 1
uggcccccgccucuggg

SEQ ID NO: 1752048 - RNA, 18 nt, Human herpesvirus 1
gcacggaacacaaggcca

SEQ ID NO: 1752049 - RNA, 21 nt, Human herpesvirus 1
uccaccacccaaccccaacuc

SEQ ID NO: 1752050 - RNA, 19 nt, Human herpesvirus 1
ucccgcccaccgcugggcg

SEQ ID NO: 1752051 - RNA, 14 nt, Human herpesvirus 1
uaaauuauugcuac

SEQ ID NO: 1752052 - RNA, 19 nt, Human herpesvirus 1
cuuaaccgcccaccuccug

SEQ ID NO: 1752053 - RNA, 18 nt, Human herpesvirus 1
cccgugugccgcgccugg

SEQ ID NO: 1752054 - RNA, 22 nt, Human herpesvirus 1
ggccuucuuucgaaccgugguc

SEQ ID NO: 1752055 - RNA, 19 nt, Human herpesvirus 1
aauaaaccgguauuauuua

SEQ ID NO: 1752056 - RNA, 13 nt, Human herpesvirus 1
acccgccacgaga

SEQ ID NO: 1752057 - RNA, 16 nt, Human herpesvirus 1
cuggccgcgcccacua

SEQ ID NO: 1752058 - RNA, 13 nt, Human herpesvirus 1
gacgagauuuaau

SEQ ID NO: 1752059 - RNA, 13 nt, Human herpesvirus 1
cccccgucugggu

SEQ ID NO: 1752060 - RNA, 17 nt, Human herpesvirus 1
gccccuguggcccuggc

SEQ ID NO: 1752061 - RNA, 15 nt, Human herpesvirus 1
cgguacauggcccug

SEQ ID NO: 1752062 - RNA, 18 nt, Human herpesvirus 1
gagcgcgauccggccggg

SEQ ID NO: 1752063 - RNA, 18 nt, Human herpesvirus 1
gaggccacguguagccug

SEQ ID NO: 1752064 - RNA, 21 nt, Human herpesvirus 1
cgccggggcucucggggccgc

SEQ ID NO: 1752065 - RNA, 18 nt, Human herpesvirus 1
ccacccccucgaccacca

SEQ ID NO: 1752066 - RNA, 18 nt, Human herpesvirus 1
agaucuacugcugggcca

SEQ ID NO: 1752067 - RNA, 19 nt, Human herpesvirus 1
gcguaucugguccccgcga

SEQ ID NO: 1752068 - RNA, 20 nt, Human herpesvirus 1
cuacacccuugugugucaau

SEQ ID NO: 1752069 - RNA, 19 nt, Human herpesvirus 1
ccgcgguggacagccagga

SEQ ID NO: 1752070 - RNA, 22 nt, Human herpesvirus 1
gcccgcaagggggggggggcau

SEQ ID NO: 1752071 - RNA, 22 nt, Human herpesvirus 1
cgccagccuguuuguccugggg

SEQ ID NO: 1752072 - RNA, 21 nt, Human herpesvirus 1
gcugccccgcuucauccccga

SEQ ID NO: 1752073 - RNA, 21 nt, Human herpesvirus 1
gcugacccuguggaacgaggc

SEQ ID NO: 1752074 - RNA, 21 nt, Human herpesvirus 1
cgcgguuuaccgccaccagca

SEQ ID NO: 1752075 - RNA, 13 nt, Human herpesvirus 1
ccgggucccuccu

SEQ ID NO: 1752076 - RNA, 23 nt, Human herpesvirus 1
gggccaauaucgcuagagacagc

SEQ ID NO: 1752077 - RNA, 21 nt, Human herpesvirus 1
cgccuggauucgcuggaccuc

SEQ ID NO: 1752078 - RNA, 17 nt, Human herpesvirus 1
caaccccggucucccag

SEQ ID NO: 1752079 - RNA, 19 nt, Human herpesvirus 1
cuggcguucgucgcccucc

SEQ ID NO: 1752080 - RNA, 16 nt, Human herpesvirus 1
cagcgaccccacggcc

SEQ ID NO: 1752081 - RNA, 16 nt, Human herpesvirus 1
gccggcaugcacccca

SEQ ID NO: 1752082 - RNA, 15 nt, Human herpesvirus 1
aaacugacaucgcga

SEQ ID NO: 1752083 - RNA, 21 nt, Human herpesvirus 1
gcagccagaacucgccccgga

SEQ ID NO: 1752084 - RNA, 21 nt, Human herpesvirus 1
caucgguccccucugggcccg

SEQ ID NO: 1752085 - RNA, 18 nt, Human herpesvirus 1
gccgcuaccgacgcuccc

SEQ ID NO: 1752086 - RNA, 21 nt, Human herpesvirus 1
auugcacccccgacgaggugc

SEQ ID NO: 1752087 - RNA, 20 nt, Human herpesvirus 1
cgggcucgucuuggccacca

SEQ ID NO: 1752088 - RNA, 15 nt, Human herpesvirus 1
ccgacaucaccaccg

SEQ ID NO: 1752089 - RNA, 22 nt, Human herpesvirus 1
acuccucagcgcgauccgacau

SEQ ID NO: 1752090 - RNA, 16 nt, Human herpesvirus 1
ugcccauuuacguggc

SEQ ID NO: 1752091 - RNA, 16 nt, Human herpesvirus 1
ggcggauuuggggcgc

SEQ ID NO: 1752092 - RNA, 14 nt, Human herpesvirus 1
augggcccugcucc

SEQ ID NO: 1752093 - RNA, 19 nt, Human herpesvirus 1
gcgcguccccggcccggag

SEQ ID NO: 1752094 - RNA, 21 nt, Human herpesvirus 1
ucgacccgcaacgcgcugggg

SEQ ID NO: 1752095 - RNA, 16 nt, Human herpesvirus 1
ucauccacaccuuauc

SEQ ID NO: 1752096 - RNA, 15 nt, Human herpesvirus 1
ggaggccacagaaac

SEQ ID NO: 1752097 - RNA, 16 nt, Human herpesvirus 1
gcgggugucugcuccc

SEQ ID NO: 1752098 - RNA, 21 nt, Human herpesvirus 1
ccugcaccacccccgccgucc

SEQ ID NO: 1752099 - RNA, 18 nt, Human herpesvirus 1
auggacagcgaccugggg

SEQ ID NO: 1752100 - RNA, 14 nt, Human herpesvirus 1
cgccccuggcgcgc

SEQ ID NO: 1752101 - RNA, 16 nt, Human herpesvirus 1
accacgccacaacagc

SEQ ID NO: 1752102 - RNA, 23 nt, Human herpesvirus 1
aucccacaaacacaaaacacacg

SEQ ID NO: 1752103 - RNA, 14 nt, Human herpesvirus 1
agcccggaggcgcc

SEQ ID NO: 1752104 - RNA, 16 nt, Human herpesvirus 1
gccgcucgguggcucc

SEQ ID NO: 1752105 - RNA, 13 nt, Human herpesvirus 1
guccagcgccgca

SEQ ID NO: 1752106 - RNA, 20 nt, Human herpesvirus 1
gcacaugggggaggugcccc

SEQ ID NO: 1752107 - RNA, 17 nt, Human herpesvirus 1
ccucgcacauccucacc

SEQ ID NO: 1752108 - RNA, 12 nt, Human herpesvirus 1
gaccuggggcgc

SEQ ID NO: 1752109 - RNA, 14 nt, Human herpesvirus 1
gccccuuucccccu

SEQ ID NO: 1752110 - RNA, 22 nt, Human herpesvirus 1
gaggacaccccucguggccccg

SEQ ID NO: 1752111 - RNA, 13 nt, Human herpesvirus 1
cggcggcgaggcc

SEQ ID NO: 1752112 - RNA, 15 nt, Human herpesvirus 1
cugccccccccaccc

SEQ ID NO: 1752113 - RNA, 23 nt, Human herpesvirus 1
ccaacaacucccccgcgcgcccc

SEQ ID NO: 1752114 - RNA, 15 nt, Human herpesvirus 1
ggacagcgaccuggg

SEQ ID NO: 1752115 - RNA, 11 nt, Human herpesvirus 1
agugaaagaca

SEQ ID NO: 1752116 - RNA, 22 nt, Human herpesvirus 1
ugaagcccccaacaugacccag

SEQ ID NO: 1752117 - RNA, 15 nt, Human herpesvirus 1
cccaucaccccgcaa

SEQ ID NO: 1752118 - RNA, 18 nt, Human herpesvirus 1
agauuguccgcggggccu

SEQ ID NO: 1752119 - RNA, 21 nt, Human herpesvirus 1
cucagcauccuuaaccgcugg

SEQ ID NO: 1752120 - RNA, 17 nt, Human herpesvirus 1
uaaaagaccaaaaucaa

SEQ ID NO: 1752121 - RNA, 23 nt, Human herpesvirus 1
accauguccggcagggggauggg

SEQ ID NO: 1752122 - RNA, 19 nt, Human herpesvirus 1
ggagguggggcgggggccc

SEQ ID NO: 1752123 - RNA, 23 nt, Human herpesvirus 1
gcugggaccccggcggccccugg

SEQ ID NO: 1752124 - RNA, 23 nt, Human herpesvirus 1
caguacuggaaguaccugcagac

SEQ ID NO: 1752125 - RNA, 14 nt, Human herpesvirus 1
auccccaggacacc

SEQ ID NO: 1752126 - RNA, 20 nt, Human herpesvirus 1
guggcuccggggggcuuccg

SEQ ID NO: 1752127 - RNA, 22 nt, Human herpesvirus 1
cccuccgcuggggcccccaggg

SEQ ID NO: 1752128 - RNA, 15 nt, Human herpesvirus 1
ggccgccacccaggc

SEQ ID NO: 1752129 - RNA, 21 nt, Human herpesvirus 1
gacucaccucaaagggacgac

SEQ ID NO: 1752130 - RNA, 17 nt, Human herpesvirus 1
ggcgacggcgucucccg

SEQ ID NO: 1752131 - RNA, 13 nt, Human herpesvirus 1
accccccaugcca

SEQ ID NO: 1752132 - RNA, 22 nt, Human herpesvirus 1
ucccgguaugguaauuagaaac

SEQ ID NO: 1752133 - RNA, 18 nt, Human herpesvirus 1
accacaccaacgcacgag

SEQ ID NO: 1752134 - RNA, 15 nt, Human herpesvirus 1
acagggcgggccgcc

SEQ ID NO: 1752135 - RNA, 17 nt, Human herpesvirus 1
cguccgaacccaggccu

SEQ ID NO: 1752136 - RNA, 17 nt, Human herpesvirus 1
gguaccgcgugacccca

SEQ ID NO: 1752137 - RNA, 23 nt, Human herpesvirus 1
cgaaugcagcgccggccuccccg

SEQ ID NO: 1752138 - RNA, 14 nt, Human herpesvirus 1
cucgugggccucug

SEQ ID NO: 1752139 - RNA, 23 nt, Human herpesvirus 1
aaacaagagccuccguuggguuu

SEQ ID NO: 1752140 - RNA, 14 nt, Human herpesvirus 1
guucgagcgccacc

SEQ ID NO: 1752141 - RNA, 13 nt, Human herpesvirus 1
ccccugagccgcu

SEQ ID NO: 1752142 - RNA, 15 nt, Human herpesvirus 1
cugguggcaccuccc

SEQ ID NO: 1752143 - RNA, 17 nt, Human herpesvirus 1
cgccgcgaguacguggc

SEQ ID NO: 1752144 - RNA, 17 nt, Human herpesvirus 1
cauggagcacgagcagg

SEQ ID NO: 1752145 - RNA, 16 nt, Human herpesvirus 1
cgcggccgugggcgcc

SEQ ID NO: 1752146 - RNA, 21 nt, Human herpesvirus 1
aucaccccgcaauuugcaccc

SEQ ID NO: 1752147 - RNA, 17 nt, Human herpesvirus 1
ccuugccccggccggau

SEQ ID NO: 1752148 - RNA, 17 nt, Human herpesvirus 1
aagcuaugcagccccgu

SEQ ID NO: 1752149 - RNA, 19 nt, Human herpesvirus 1
ucggggagcuucgcuuugu

SEQ ID NO: 1752150 - RNA, 15 nt, Human herpesvirus 1
agggagccccggucu

SEQ ID NO: 1752151 - RNA, 13 nt, Human herpesvirus 1
cuccgaguacggc

SEQ ID NO: 1752152 - RNA, 18 nt, Human herpesvirus 1
ggcgaccgccggcggcga

SEQ ID NO: 1752153 - RNA, 19 nt, Human herpesvirus 1
gcgcgaauugacccuagga

SEQ ID NO: 1752154 - RNA, 10 nt, Human herpesvirus 1
uggcgccccc

SEQ ID NO: 1752155 - RNA, 17 nt, Human herpesvirus 1
ucccaggaucacaccgg

SEQ ID NO: 1752156 - RNA, 19 nt, Human herpesvirus 1
uuucaccgccccagcaccg

SEQ ID NO: 1752157 - RNA, 17 nt, Human herpesvirus 1
cgcccgccccugcgcag

SEQ ID NO: 1752158 - RNA, 22 nt, Human herpesvirus 1
uaccggacccguuccagccccc

SEQ ID NO: 1752159 - RNA, 20 nt, Human herpesvirus 1
gaccccagcgaccccacggc

SEQ ID NO: 1752160 - RNA, 13 nt, Human herpesvirus 1
cccgaagccugcu

SEQ ID NO: 1752161 - RNA, 17 nt, Human herpesvirus 1
gcgggguugggauggga

SEQ ID NO: 1752162 - RNA, 15 nt, Human herpesvirus 1
uaccuuuuuaauauc

SEQ ID NO: 1752163 - RNA, 19 nt, Human herpesvirus 1
gcaacgcgcuggggcugcc

SEQ ID NO: 1752164 - RNA, 14 nt, Human herpesvirus 1
ggagccgagcucaa

SEQ ID NO: 1752165 - RNA, 21 nt, Human herpesvirus 1
caccguggccugggacugggu

SEQ ID NO: 1752166 - RNA, 19 nt, Human herpesvirus 1
caacccccuaagacccacc

SEQ ID NO: 1752167 - RNA, 14 nt, Human herpesvirus 1
ccgcugcgcauccc

SEQ ID NO: 1752168 - RNA, 21 nt, Human herpesvirus 1
gacagccaggagcguuucugu

SEQ ID NO: 1752169 - RNA, 23 nt, Human herpesvirus 1
cuggcuggccgcucgguggcucc

SEQ ID NO: 1752170 - RNA, 21 nt, Human herpesvirus 1
agcguauaccaacccgccccu

SEQ ID NO: 1752171 - RNA, 21 nt, Human herpesvirus 1
gcgccauggcgggacugggca

SEQ ID NO: 1752172 - RNA, 20 nt, Human herpesvirus 1
gccccccuggcgagcccaga

SEQ ID NO: 1752173 - RNA, 13 nt, Human herpesvirus 1
ggcccaaggcccc

SEQ ID NO: 1752174 - RNA, 16 nt, Human herpesvirus 1
aucauagcccuggugu

SEQ ID NO: 1752175 - RNA, 12 nt, Human herpesvirus 1
ccgaacccaggc

SEQ ID NO: 1752176 - RNA, 22 nt, Human herpesvirus 1
ugggccgggccgcccacuuccc

SEQ ID NO: 1752177 - RNA, 12 nt, Human herpesvirus 1
auaaaaagccag

SEQ ID NO: 1752178 - RNA, 15 nt, Human herpesvirus 1
gacgcccagcagcuc

SEQ ID NO: 1752179 - RNA, 21 nt, Human herpesvirus 1
uucgcaccaacaaccuucugc

SEQ ID NO: 1752180 - RNA, 14 nt, Human herpesvirus 1
cgcgcccacuacac

SEQ ID NO: 1752181 - RNA, 15 nt, Human herpesvirus 1
gugcgucugggcccg

SEQ ID NO: 1752182 - RNA, 16 nt, Human herpesvirus 1
cguugcagggccuggu

SEQ ID NO: 1752183 - RNA, 21 nt, Human herpesvirus 1
gcugguccacacccaguggcu

SEQ ID NO: 1752184 - RNA, 15 nt, Human herpesvirus 1
uggugcugucugaca

SEQ ID NO: 1752185 - RNA, 19 nt, Human herpesvirus 1
cguccgcgccccucuggcc

SEQ ID NO: 1752186 - RNA, 13 nt, Human herpesvirus 1
cagugaggguggc

SEQ ID NO: 1752187 - RNA, 14 nt, Human herpesvirus 1
ccgcgggccacgcc

SEQ ID NO: 1752188 - RNA, 19 nt, Human herpesvirus 1
cagacgaaaagccccgggc

SEQ ID NO: 1752189 - RNA, 17 nt, Human herpesvirus 1
ggguucgauuggcaaug

SEQ ID NO: 1752190 - RNA, 14 nt, Human herpesvirus 1
cgcguccccggccc

SEQ ID NO: 1752191 - RNA, 20 nt, Human herpesvirus 1
ccaguggcuccgggccaacc

SEQ ID NO: 1752192 - RNA, 17 nt, Human herpesvirus 1
gcgcguccuucuugucg

SEQ ID NO: 1752193 - RNA, 16 nt, Human herpesvirus 1
accgcagucccugagu

SEQ ID NO: 1752194 - RNA, 12 nt, Human herpesvirus 1
aacgccuccccc

SEQ ID NO: 1752195 - RNA, 20 nt, Human herpesvirus 1
gcgacaacgcgggcguuccc

SEQ ID NO: 1752196 - RNA, 12 nt, Human herpesvirus 1
caccagccuggu

SEQ ID NO: 1752197 - RNA, 15 nt, Human herpesvirus 1
uccauaccgaccaca

SEQ ID NO: 1752198 - RNA, 16 nt, Human herpesvirus 1
cagccuuuaacuacau

SEQ ID NO: 1752199 - RNA, 22 nt, Human herpesvirus 1
accuggggcgcgcggucggcaa

SEQ ID NO: 1752200 - RNA, 16 nt, Human herpesvirus 1
gucgacgucgcgccug

SEQ ID NO: 1752201 - RNA, 19 nt, Human herpesvirus 1
acgcuggggguccuggugg

SEQ ID NO: 1752202 - RNA, 23 nt, Human herpesvirus 1
ugcggacccucucuucucucccg

SEQ ID NO: 1752203 - RNA, 21 nt, Human herpesvirus 1
ccaccgugggccggcggguga

SEQ ID NO: 1752204 - RNA, 14 nt, Human herpesvirus 1
cgccucagggccuc

SEQ ID NO: 1752205 - RNA, 15 nt, Human herpesvirus 1
cucggcgccucugga

SEQ ID NO: 1752206 - RNA, 13 nt, Human herpesvirus 1
ccggugcgccccc

SEQ ID NO: 1752207 - RNA, 22 nt, Human herpesvirus 1
gcaggugugguucggccaccgc

SEQ ID NO: 1752208 - RNA, 21 nt, Human herpesvirus 1
ggccacucacgcauccccagu

SEQ ID NO: 1752209 - RNA, 17 nt, Human herpesvirus 1
cccgggagcuccgcacc

SEQ ID NO: 1752210 - RNA, 17 nt, Human herpesvirus 1
gguggagcugcccggcg

SEQ ID NO: 1752211 - RNA, 22 nt, Human herpesvirus 1
ccaguccaguuaucgcggcuuc

SEQ ID NO: 1752212 - RNA, 20 nt, Human herpesvirus 1
gcaacgcgcuggggcugccg

SEQ ID NO: 1752213 - RNA, 14 nt, Human herpesvirus 1
acgccggggccuug

SEQ ID NO: 1752214 - RNA, 20 nt, Human herpesvirus 1
uucuacgcgcgcgaccucac

SEQ ID NO: 1752215 - RNA, 18 nt, Human herpesvirus 1
ccacgcccccgccgcccg

SEQ ID NO: 1752216 - RNA, 22 nt, Human herpesvirus 1
aggacgcccgcgacgccaugga

SEQ ID NO: 1752217 - RNA, 22 nt, Human herpesvirus 1
cgagggcaucuuuuuugccgcc

SEQ ID NO: 1752218 - RNA, 23 nt, Human herpesvirus 1
ccccacgugaucagcacgccacc

SEQ ID NO: 1752219 - RNA, 20 nt, Human herpesvirus 1
ccaccugacgcgccuagcca

SEQ ID NO: 1752220 - RNA, 15 nt, Human herpesvirus 1
auccucaagcaggcc

SEQ ID NO: 1752221 - RNA, 21 nt, Human herpesvirus 1
cacaugcggaaagcaagaaca

SEQ ID NO: 1752222 - RNA, 16 nt, Human herpesvirus 1
gccaucgccucggcca

SEQ ID NO: 1752223 - RNA, 13 nt, Human herpesvirus 1
gcggcagcgcucc

SEQ ID NO: 1752224 - RNA, 12 nt, Human herpesvirus 1
cuucccuccccc

SEQ ID NO: 1752225 - RNA, 17 nt, Human herpesvirus 1
cgcacauccucacccuc

SEQ ID NO: 1752226 - RNA, 16 nt, Human herpesvirus 1
cucccggcccgggccc

SEQ ID NO: 1752227 - RNA, 15 nt, Human herpesvirus 1
gcgacgggcagugag

SEQ ID NO: 1752228 - RNA, 23 nt, Human herpesvirus 1
ccgucuggguuuuccccucccgu

SEQ ID NO: 1752229 - RNA, 22 nt, Human herpesvirus 1
acuucccgguaugguaauuaaa

SEQ ID NO: 1752230 - RNA, 22 nt, Human herpesvirus 1
cgccucaacauaccccgcuguu

SEQ ID NO: 1752231 - RNA, 19 nt, Human herpesvirus 1
uacgcuaaucccccggcuc

SEQ ID NO: 1752232 - RNA, 13 nt, Human herpesvirus 1
aagaggggcuggg

SEQ ID NO: 1752233 - RNA, 20 nt, Human herpesvirus 1
ggcgccugccccgccaccca

SEQ ID NO: 1752234 - RNA, 12 nt, Human herpesvirus 1
ccggcacggacc

SEQ ID NO: 1752235 - RNA, 17 nt, Human herpesvirus 1
gagcguuucugucggac

SEQ ID NO: 1752236 - RNA, 16 nt, Human herpesvirus 1
cugucucgucuccucu

SEQ ID NO: 1752237 - RNA, 22 nt, Human herpesvirus 1
guucgucgcccuccaccaacgc

SEQ ID NO: 1752238 - RNA, 15 nt, Human herpesvirus 1
cacccccccaacggg

SEQ ID NO: 1752239 - RNA, 13 nt, Human herpesvirus 1
ucccccccaucac

SEQ ID NO: 1752240 - RNA, 22 nt, Human herpesvirus 1
ucuggggucccugucgccuccc

SEQ ID NO: 1752241 - RNA, 18 nt, Human herpesvirus 1
cucuggccaucggucccc

SEQ ID NO: 1752242 - RNA, 17 nt, Human herpesvirus 1
ggcuguuccgccaggcg

SEQ ID NO: 1752243 - RNA, 16 nt, Human herpesvirus 1
aaaccccacgcccccg

SEQ ID NO: 1752244 - RNA, 19 nt, Human herpesvirus 1
cgggguuacgcgggccccg

SEQ ID NO: 1752245 - RNA, 14 nt, Human herpesvirus 1
cauggccagcggcc

SEQ ID NO: 1752246 - RNA, 17 nt, Human herpesvirus 1
ccucuucuccccuuccc

SEQ ID NO: 1752247 - RNA, 17 nt, Human herpesvirus 1
ccacccaggcgcugggc

SEQ ID NO: 1752248 - RNA, 23 nt, Human herpesvirus 1
auaaccgaccgcagucccugagu

SEQ ID NO: 1752249 - RNA, 21 nt, Human herpesvirus 1
ggccgccaccauccucaagca

SEQ ID NO: 1752250 - RNA, 20 nt, Human herpesvirus 1
cacccccucgaccaccaccu

SEQ ID NO: 1752251 - RNA, 12 nt, Human herpesvirus 1
uuucccacgcca

SEQ ID NO: 1752252 - RNA, 23 nt, Human herpesvirus 1
gcgccuggcgucuccucuggggg

SEQ ID NO: 1752253 - RNA, 18 nt, Human herpesvirus 1
ggcgggguuauaggccac

SEQ ID NO: 1752254 - RNA, 15 nt, Human herpesvirus 1
gaaacuggcccgcgc

SEQ ID NO: 1752255 - RNA, 21 nt, Human herpesvirus 1
gcaauuuguacccuuaauaaa

SEQ ID NO: 1752256 - RNA, 15 nt, Human herpesvirus 1
ccaaacgccagccug

SEQ ID NO: 1752257 - RNA, 15 nt, Human herpesvirus 1
gccucccccugagcc

SEQ ID NO: 1752258 - RNA, 22 nt, Human herpesvirus 1
ggacgccgaccgacuccccgcc

SEQ ID NO: 1752259 - RNA, 13 nt, Human herpesvirus 1
gccccauacacga

SEQ ID NO: 1752260 - RNA, 23 nt, Human herpesvirus 1
cucugugucagguggcccuuccu

SEQ ID NO: 1752261 - RNA, 23 nt, Human herpesvirus 1
caucugggauggcuccuggccag

SEQ ID NO: 1752262 - RNA, 17 nt, Human herpesvirus 1
agccccggcccugaugc

SEQ ID NO: 1752263 - RNA, 23 nt, Human herpesvirus 1
gcugccgucgcuagaccacgccc

SEQ ID NO: 1752264 - RNA, 23 nt, Human herpesvirus 1
acguucgcgcgccaucuggaccg

SEQ ID NO: 1752265 - RNA, 16 nt, Human herpesvirus 1
ugauccuuaggggccg

SEQ ID NO: 1752266 - RNA, 18 nt, Human herpesvirus 1
guguucguacgcggggcu

SEQ ID NO: 1752267 - RNA, 22 nt, Human herpesvirus 1
gacccucucuucucucccgggc

SEQ ID NO: 1752268 - RNA, 12 nt, Human herpesvirus 1
cuguggcccugg

SEQ ID NO: 1752269 - RNA, 12 nt, Human herpesvirus 1
ccguggccccgg

SEQ ID NO: 1752270 - RNA, 23 nt, Human herpesvirus 1
gagggcguaacguuccgccugga

SEQ ID NO: 1752271 - RNA, 22 nt, Human herpesvirus 1
ucccuguuugucgccuggcugg

SEQ ID NO: 1752272 - RNA, 20 nt, Human herpesvirus 1
cacgcgcgacgggcagugag

SEQ ID NO: 1752273 - RNA, 17 nt, Human herpesvirus 1
ccaccugcgcucccuca

SEQ ID NO: 1752274 - RNA, 11 nt, Human herpesvirus 1
ugcccucgcgg

SEQ ID NO: 1752275 - RNA, 23 nt, Human herpesvirus 1
gcgggaacaccuccgcgagcaga

SEQ ID NO: 1752276 - RNA, 19 nt, Human herpesvirus 1
ggucggcaagguggugaug

SEQ ID NO: 1752277 - RNA, 23 nt, Human herpesvirus 1
cucuccccccaggccuaccagca

SEQ ID NO: 1752278 - RNA, 21 nt, Human herpesvirus 1
uguccccgaacaaacgaccca

SEQ ID NO: 1752279 - RNA, 13 nt, Human herpesvirus 1
cccucgccacguc

SEQ ID NO: 1752280 - RNA, 14 nt, Human herpesvirus 1
cucguucugcugca

SEQ ID NO: 1752281 - RNA, 21 nt, Human herpesvirus 1
agcugggaccccggcggcccc

SEQ ID NO: 1752282 - RNA, 10 nt, Human herpesvirus 1
ggcgcccccc

SEQ ID NO: 1752283 - RNA, 13 nt, Human herpesvirus 1
gccacgccagggc

SEQ ID NO: 1752284 - RNA, 15 nt, Human herpesvirus 1
gcccgcccuguaccg

SEQ ID NO: 1752285 - RNA, 21 nt, Human herpesvirus 1
cagacgcccuccgaggagauc

SEQ ID NO: 1752286 - RNA, 19 nt, Human herpesvirus 1
gccacuggccgggagcacc

SEQ ID NO: 1752287 - RNA, 17 nt, Human herpesvirus 1
gggugcgggggggucag

SEQ ID NO: 1752288 - RNA, 13 nt, Human herpesvirus 1
guccaaacccacc

SEQ ID NO: 1752289 - RNA, 19 nt, Human herpesvirus 1
caacacaacggcaugccuc

SEQ ID NO: 1752290 - RNA, 17 nt, Human herpesvirus 1
gcagacgcugcuccgcc

SEQ ID NO: 1752291 - RNA, 22 nt, Human herpesvirus 1
cagggauccacgacaaccccgg

SEQ ID NO: 1752292 - RNA, 14 nt, Human herpesvirus 1
cucgcccacccacu

SEQ ID NO: 1752293 - RNA, 18 nt, Human herpesvirus 1
ugcggaaagcaagaacaa

SEQ ID NO: 1752294 - RNA, 20 nt, Human herpesvirus 1
agauuguccgcggggccucc

SEQ ID NO: 1752295 - RNA, 20 nt, Human herpesvirus 1
gcugccccgcuucauccccg

SEQ ID NO: 1752296 - RNA, 19 nt, Human herpesvirus 1
ggacccaagccgccccagc

SEQ ID NO: 1752297 - RNA, 13 nt, Human herpesvirus 1
cugcgugggccgc

SEQ ID NO: 1752298 - RNA, 11 nt, Human herpesvirus 1
aauaaagccac

SEQ ID NO: 1752299 - RNA, 16 nt, Human herpesvirus 1
gugcuugagucugucc

SEQ ID NO: 1752300 - RNA, 17 nt, Human herpesvirus 1
gacggccaacgaggacc

SEQ ID NO: 1752301 - RNA, 18 nt, Human herpesvirus 1
gcaucccccgucuggguu

SEQ ID NO: 1752302 - RNA, 23 nt, Human herpesvirus 1
cagacgcugcuccgccuggccug

SEQ ID NO: 1752303 - RNA, 15 nt, Human herpesvirus 1
ggggccucccccgga

SEQ ID NO: 1752304 - RNA, 15 nt, Human herpesvirus 1
cgcacauccucaccc

SEQ ID NO: 1752305 - RNA, 19 nt, Human herpesvirus 1
cucguuccucacugccucc

SEQ ID NO: 1752306 - RNA, 16 nt, Human herpesvirus 1
ggccaaguacgccgcc

SEQ ID NO: 1752307 - RNA, 21 nt, Human herpesvirus 1
aguugagccgcgccauccuca

SEQ ID NO: 1752308 - RNA, 16 nt, Human herpesvirus 1
cgauggcaggagccgc

SEQ ID NO: 1752309 - RNA, 15 nt, Human herpesvirus 1
gucgccccuguggcc

SEQ ID NO: 1752310 - RNA, 15 nt, Human herpesvirus 1
agcccaacccacacg

SEQ ID NO: 1752311 - RNA, 18 nt, Human herpesvirus 1
cgacgguaaacugcaucg

SEQ ID NO: 1752312 - RNA, 21 nt, Human herpesvirus 1
cacgcaguacuggaaguaccu

SEQ ID NO: 1752313 - RNA, 20 nt, Human herpesvirus 1
cccaucgccgcggcucccgg

SEQ ID NO: 1752314 - RNA, 18 nt, Human herpesvirus 1
acccuaggaggccgccac

SEQ ID NO: 1752315 - RNA, 16 nt, Human herpesvirus 1
agcccugcucgggcag

SEQ ID NO: 1752316 - RNA, 20 nt, Human herpesvirus 1
gaacaucuugaggggggaga

SEQ ID NO: 1752317 - RNA, 15 nt, Human herpesvirus 1
ccaaacucccgacac

SEQ ID NO: 1752318 - RNA, 12 nt, Human herpesvirus 1
caaagcugcugg

SEQ ID NO: 1752319 - RNA, 22 nt, Human herpesvirus 1
cgaggcggccugggucuuccgc

SEQ ID NO: 1752320 - RNA, 13 nt, Human herpesvirus 1
gggaugcugcccc

SEQ ID NO: 1752321 - RNA, 22 nt, Human herpesvirus 1
ggcgucaccaugcagcgccgga

SEQ ID NO: 1752322 - RNA, 19 nt, Human herpesvirus 1
acccgcacuacgaguacau

SEQ ID NO: 1752323 - RNA, 18 nt, Human herpesvirus 1
acgagcacccugcugccc

SEQ ID NO: 1752324 - RNA, 17 nt, Human herpesvirus 1
cccgccguugagccccu

SEQ ID NO: 1752325 - RNA, 17 nt, Human herpesvirus 1
cacggaacacaaggcca

SEQ ID NO: 1752326 - RNA, 18 nt, Human herpesvirus 1
cgguugcccccgaacacc

SEQ ID NO: 1752327 - RNA, 16 nt, Human herpesvirus 1
caccuuggcccuggcu

SEQ ID NO: 1752328 - RNA, 21 nt, Human herpesvirus 1
cgaacacggggacggcggggc

SEQ ID NO: 1752329 - RNA, 19 nt, Human herpesvirus 1
gacuuuuggaugucgcccg

SEQ ID NO: 1752330 - RNA, 15 nt, Human herpesvirus 1
ugccuccaccgggcc

SEQ ID NO: 1752331 - RNA, 19 nt, Human herpesvirus 1
guggcgccgcaaaucccac

SEQ ID NO: 1752332 - RNA, 23 nt, Human herpesvirus 1
agacccgggcgaugagccaaccu

SEQ ID NO: 1752333 - RNA, 20 nt, Human herpesvirus 1
ccuuauccacaugaagccac

SEQ ID NO: 1752334 - RNA, 17 nt, Human herpesvirus 1
gccccggaagaccccga

SEQ ID NO: 1752335 - RNA, 15 nt, Human herpesvirus 1
ccuggauucgcugga

SEQ ID NO: 1752336 - RNA, 18 nt, Human herpesvirus 1
gccucccccugagccgcu

SEQ ID NO: 1752337 - RNA, 21 nt, Human herpesvirus 1
ccaaccucggaugacucaggg

SEQ ID NO: 1752338 - RNA, 18 nt, Human herpesvirus 1
aucccggguuaauguaaa

SEQ ID NO: 1752339 - RNA, 18 nt, Human herpesvirus 1
gaggguuggggggguccg

SEQ ID NO: 1752340 - RNA, 20 nt, Human herpesvirus 1
ccgcguguuccccgggagcc

SEQ ID NO: 1752341 - RNA, 19 nt, Human herpesvirus 1
ccgggccguugcccgggcc

SEQ ID NO: 1752342 - RNA, 18 nt, Human herpesvirus 1
gggucuguugguccuggc

SEQ ID NO: 1752343 - RNA, 15 nt, Human herpesvirus 1
cgccgcggccugggu

SEQ ID NO: 1752344 - RNA, 22 nt, Human herpesvirus 1
cggccagaucuacugcugggcc

SEQ ID NO: 1752345 - RNA, 16 nt, Human herpesvirus 1
cgcugacccccaccgc

SEQ ID NO: 1752346 - RNA, 14 nt, Human herpesvirus 1
cggcacgccugggg

SEQ ID NO: 1752347 - RNA, 21 nt, Human herpesvirus 1
cgggucuuuuguguuggcccu

SEQ ID NO: 1752348 - RNA, 14 nt, Human herpesvirus 1
cacagccggccacg

SEQ ID NO: 1752349 - RNA, 13 nt, Human herpesvirus 1
cacuacaccagcc

SEQ ID NO: 1752350 - RNA, 13 nt, Human herpesvirus 1
aauaaaaacauug

SEQ ID NO: 1752351 - RNA, 23 nt, Human herpesvirus 1
ccgccucguuugccgccaucgcc

SEQ ID NO: 1752352 - RNA, 22 nt, Human herpesvirus 1
ccgcgagcgccgcuacugcgcg

SEQ ID NO: 1752353 - RNA, 22 nt, Human herpesvirus 1
accacccccgccguccgaaccc

SEQ ID NO: 1752354 - RNA, 14 nt, Human herpesvirus 1
gacgcacacacccu

SEQ ID NO: 1752355 - RNA, 13 nt, Human herpesvirus 1
gacaccaccagcu

SEQ ID NO: 1752356 - RNA, 18 nt, Human herpesvirus 1
gucaugcgcaagcgccgc

SEQ ID NO: 1752357 - RNA, 14 nt, Human herpesvirus 1
agcauaccugggug

SEQ ID NO: 1752358 - RNA, 22 nt, Human herpesvirus 1
cggggccuuuucgccgcccucg

SEQ ID NO: 1752359 - RNA, 15 nt, Human herpesvirus 1
ggcgccugccccgcc

SEQ ID NO: 1752360 - RNA, 17 nt, Human herpesvirus 1
ugcggggcggggacggg

SEQ ID NO: 1752361 - RNA, 11 nt, Human herpesvirus 1
guggcgccccg

SEQ ID NO: 1752362 - RNA, 13 nt, Human herpesvirus 1
cgacugccccccc

SEQ ID NO: 1752363 - RNA, 21 nt, Human herpesvirus 1
ggcgaccucggcgccucugga

SEQ ID NO: 1752364 - RNA, 19 nt, Human herpesvirus 1
cccauccggugguccgugu

SEQ ID NO: 1752365 - RNA, 14 nt, Human herpesvirus 1
acacucgacccccg

SEQ ID NO: 1752366 - RNA, 22 nt, Human herpesvirus 1
gcgagcucccagagaccccagg

SEQ ID NO: 1752367 - RNA, 11 nt, Human herpesvirus 1
acacacggguu

SEQ ID NO: 1752368 - RNA, 23 nt, Human herpesvirus 1
ggcgggacucugggcguggugcg

SEQ ID NO: 1752369 - RNA, 22 nt, Human herpesvirus 1
ugaucuuggcguuauucccaaa

SEQ ID NO: 1752370 - RNA, 17 nt, Human herpesvirus 1
accguugcccgggccgu

SEQ ID NO: 1752371 - RNA, 23 nt, Human herpesvirus 1
gggacgcgcaccuguuccgccug

SEQ ID NO: 1752372 - RNA, 14 nt, Human herpesvirus 1
cucacagggcgggc

SEQ ID NO: 1752373 - RNA, 14 nt, Human herpesvirus 1
ugcguagcauaccu

SEQ ID NO: 1752374 - RNA, 15 nt, Human herpesvirus 1
gugcaugucgucacg

SEQ ID NO: 1752375 - RNA, 12 nt, Human herpesvirus 1
ggccgccgcgga

SEQ ID NO: 1752376 - RNA, 17 nt, Human herpesvirus 1
cuagauacccccccuua

SEQ ID NO: 1752377 - RNA, 15 nt, Human herpesvirus 1
cuucgcuuugugggg

SEQ ID NO: 1752378 - RNA, 20 nt, Human herpesvirus 1
ccgggggccugguggcaccu

SEQ ID NO: 1752379 - RNA, 20 nt, Human herpesvirus 1
gcggccccggccgcccuucc

SEQ ID NO: 1752380 - RNA, 16 nt, Human herpesvirus 1
cucugggucugugcca

SEQ ID NO: 1752381 - RNA, 22 nt, Human herpesvirus 1
accuucugcgggucaccugcca

SEQ ID NO: 1752382 - RNA, 18 nt, Human herpesvirus 1
caaggacagcggccugcu

SEQ ID NO: 1752383 - RNA, 18 nt, Human herpesvirus 1
cacggcuaccuggcccca

SEQ ID NO: 1752384 - RNA, 14 nt, Human herpesvirus 1
ggccgaagccacgc

SEQ ID NO: 1752385 - RNA, 13 nt, Human herpesvirus 1
ccguggaccccac

SEQ ID NO: 1752386 - RNA, 21 nt, Human herpesvirus 1
cgcggcuucaucgcgccccuc

SEQ ID NO: 1752387 - RNA, 15 nt, Human herpesvirus 1
cccagcagcucccca

SEQ ID NO: 1752388 - RNA, 19 nt, Human herpesvirus 1
gacggcgcggggcccccgc

SEQ ID NO: 1752389 - RNA, 11 nt, Human herpesvirus 1
auuccucuccg

SEQ ID NO: 1752390 - RNA, 14 nt, Human herpesvirus 1
gauggccugugcuu

SEQ ID NO: 1752391 - RNA, 22 nt, Human herpesvirus 1
cgcuccucugcggccggcggga

SEQ ID NO: 1752392 - RNA, 15 nt, Human herpesvirus 1
cccaucuaaugccac

SEQ ID NO: 1752393 - RNA, 22 nt, Human herpesvirus 1
gcgcauccgucgggaggccaca

SEQ ID NO: 1752394 - RNA, 17 nt, Human herpesvirus 1
cguuucuccgcccgacc

SEQ ID NO: 1752395 - RNA, 21 nt, Human herpesvirus 1
accccgcaauuugcacccagc

SEQ ID NO: 1752396 - RNA, 17 nt, Human herpesvirus 1
cauggugaucgccuguc

SEQ ID NO: 1752397 - RNA, 15 nt, Human herpesvirus 1
accgaggggccaagu

SEQ ID NO: 1752398 - RNA, 17 nt, Human herpesvirus 1
ggucgggcgcugggugg

SEQ ID NO: 1752399 - RNA, 14 nt, Human herpesvirus 1
aggcccgccgccac

SEQ ID NO: 1752400 - RNA, 18 nt, Human herpesvirus 1
accucaccaccaaggccc

SEQ ID NO: 1752401 - RNA, 18 nt, Human herpesvirus 1
accaccaaggcccgggcc

SEQ ID NO: 1752402 - RNA, 13 nt, Human herpesvirus 1
cgggucccgaccg

SEQ ID NO: 1752403 - RNA, 22 nt, Human herpesvirus 1
gcccuggccgcggaucugcucc

SEQ ID NO: 1752404 - RNA, 22 nt, Human herpesvirus 1
aucgccggguggcacgggccca

SEQ ID NO: 1752405 - RNA, 14 nt, Human herpesvirus 1
cuggguuuuccccu

SEQ ID NO: 1752406 - RNA, 17 nt, Human herpesvirus 1
gcucgugggccucuggg

SEQ ID NO: 1752407 - RNA, 13 nt, Human herpesvirus 1
ugcauauccuggg

SEQ ID NO: 1752408 - RNA, 14 nt, Human herpesvirus 1
cccgcgacccggac

SEQ ID NO: 1752409 - RNA, 13 nt, Human herpesvirus 1
uccccgcacagau

SEQ ID NO: 1752410 - RNA, 14 nt, Human herpesvirus 1
ugcgccuugggccc

SEQ ID NO: 1752411 - RNA, 19 nt, Human herpesvirus 1
caggaaauccguggccccg

SEQ ID NO: 1752412 - RNA, 22 nt, Human herpesvirus 1
cacgaggcaguuaacugucugg

SEQ ID NO: 1752413 - RNA, 14 nt, Human herpesvirus 1
gaccgucugcaaga

SEQ ID NO: 1752414 - RNA, 21 nt, Human herpesvirus 1
agcuccuggccuacgucuccg

SEQ ID NO: 1752415 - RNA, 21 nt, Human herpesvirus 1
cggcucggccuauggcuccug

SEQ ID NO: 1752416 - RNA, 15 nt, Human herpesvirus 1
uaaaagaccacacca

SEQ ID NO: 1752417 - RNA, 15 nt, Human herpesvirus 1
ucgaggugucucgca

SEQ ID NO: 1752418 - RNA, 13 nt, Human herpesvirus 1
ccggccgcaccca

SEQ ID NO: 1752419 - RNA, 17 nt, Human herpesvirus 1
cuugcgcaccuggugau

SEQ ID NO: 1752420 - RNA, 13 nt, Human herpesvirus 1
gugcuuuggaaac

SEQ ID NO: 1752421 - RNA, 17 nt, Human herpesvirus 1
gcgcuccgacgacgcgc

SEQ ID NO: 1752422 - RNA, 17 nt, Human herpesvirus 1
gccacccacgccgccuc

SEQ ID NO: 1752423 - RNA, 15 nt, Human herpesvirus 1
ccaguccccgggccc

SEQ ID NO: 1752424 - RNA, 15 nt, Human herpesvirus 1
gcccccgaggccagc

SEQ ID NO: 1752425 - RNA, 14 nt, Human herpesvirus 1
cacugccucccccg

SEQ ID NO: 1752426 - RNA, 17 nt, Human herpesvirus 1
acaauccccaggacacc

SEQ ID NO: 1752427 - RNA, 23 nt, Human herpesvirus 1
uccgccaacgcacuguggcucuc

SEQ ID NO: 1752428 - RNA, 16 nt, Human herpesvirus 1
gcagccuucucccggu

SEQ ID NO: 1752429 - RNA, 20 nt, Human herpesvirus 1
acgggcuguuccgccaggcg

SEQ ID NO: 1752430 - RNA, 20 nt, Human herpesvirus 1
cggcgagcguauaccaaccc

SEQ ID NO: 1752431 - RNA, 14 nt, Human herpesvirus 1
caucgccgcggcuc

SEQ ID NO: 1752432 - RNA, 15 nt, Human herpesvirus 1
acgcgggaggccgcc

SEQ ID NO: 1752433 - RNA, 16 nt, Human herpesvirus 1
aacccgcgcuaugacg

SEQ ID NO: 1752434 - RNA, 15 nt, Human herpesvirus 1
gccgccugguccccc

SEQ ID NO: 1752435 - RNA, 16 nt, Human herpesvirus 1
cccggacgacauggcc

SEQ ID NO: 1752436 - RNA, 19 nt, Human herpesvirus 1
aagcuagccgaggcccggg

SEQ ID NO: 1752437 - RNA, 23 nt, Human herpesvirus 1
accagcagguccgcggugggcug

SEQ ID NO: 1752438 - RNA, 14 nt, Human herpesvirus 1
cgccaaacgccagc

SEQ ID NO: 1752439 - RNA, 20 nt, Human herpesvirus 1
cggcagcaugggacccacag

SEQ ID NO: 1752440 - RNA, 16 nt, Human herpesvirus 1
ucccauuaucccauuc

SEQ ID NO: 1752441 - RNA, 17 nt, Human herpesvirus 1
acaaucgcgaccacccc

SEQ ID NO: 1752442 - RNA, 19 nt, Human herpesvirus 1
aucuuugaggaccgcgccc

SEQ ID NO: 1752443 - RNA, 13 nt, Human herpesvirus 1
augccgugccgcc

SEQ ID NO: 1752444 - RNA, 15 nt, Human herpesvirus 1
caaaauaaaagacca

SEQ ID NO: 1752445 - RNA, 18 nt, Human herpesvirus 1
cugcugcaggccccccgc

SEQ ID NO: 1752446 - RNA, 20 nt, Human herpesvirus 1
ccagccccagaaaccccgga

SEQ ID NO: 1752447 - RNA, 17 nt, Human herpesvirus 1
aucacggcaaggagcgc

SEQ ID NO: 1752448 - RNA, 15 nt, Human herpesvirus 1
cgcgggcccccggcc

SEQ ID NO: 1752449 - RNA, 18 nt, Human herpesvirus 1
cgaucccgaacgacacac

SEQ ID NO: 1752450 - RNA, 15 nt, Human herpesvirus 1
aucccaggaucacac

SEQ ID NO: 1752451 - RNA, 23 nt, Human herpesvirus 1
ggguugacgcuggggguccuggu

SEQ ID NO: 1752452 - RNA, 12 nt, Human herpesvirus 1
guucguuccggg

SEQ ID NO: 1752453 - RNA, 17 nt, Human herpesvirus 1
cauccccgcuccccaag

SEQ ID NO: 1752454 - RNA, 19 nt, Human herpesvirus 1
ugcagcgccggccuccccg

SEQ ID NO: 1752455 - RNA, 19 nt, Human herpesvirus 1
gcgcccacuacaccagcca

SEQ ID NO: 1752456 - RNA, 17 nt, Human herpesvirus 1
ucccccggcacgccugg

SEQ ID NO: 1752457 - RNA, 21 nt, Human herpesvirus 1
ccgcaagcccccaaaccccac

SEQ ID NO: 1752458 - RNA, 16 nt, Human herpesvirus 1
ggccacccccccggag

SEQ ID NO: 1752459 - RNA, 22 nt, Human herpesvirus 1
cuagcucgcggagggcggccag

SEQ ID NO: 1752460 - RNA, 12 nt, Human herpesvirus 1
cgccggagccgg

SEQ ID NO: 1752461 - RNA, 16 nt, Human herpesvirus 1
cgguccugacggccaa

SEQ ID NO: 1752462 - RNA, 15 nt, Human herpesvirus 1
cucccagggagcccc

SEQ ID NO: 1752463 - RNA, 18 nt, Human herpesvirus 1
gcgucgccccgugucugu

SEQ ID NO: 1752464 - RNA, 13 nt, Human herpesvirus 1
cgccggggcucuc

SEQ ID NO: 1752465 - RNA, 23 nt, Human herpesvirus 1
aacuggguggcggggcaggcgcc

SEQ ID NO: 1752466 - RNA, 16 nt, Human herpesvirus 1
augccgcggccauggu

SEQ ID NO: 1752467 - RNA, 13 nt, Human herpesvirus 1
ccauggaccccag

SEQ ID NO: 1752468 - RNA, 12 nt, Human herpesvirus 1
cgagaaggacaa

SEQ ID NO: 1752469 - RNA, 17 nt, Human herpesvirus 1
gcuggggcggcugggcu

SEQ ID NO: 1752470 - RNA, 15 nt, Human herpesvirus 1
acggucacccugcug

SEQ ID NO: 1752471 - RNA, 16 nt, Human herpesvirus 1
ccuucauguccaaccc

SEQ ID NO: 1752472 - RNA, 19 nt, Human herpesvirus 1
aucgcgaccaccccaaaua

SEQ ID NO: 1752473 - RNA, 12 nt, Human herpesvirus 1
guccccuggggc

SEQ ID NO: 1752474 - RNA, 16 nt, Human herpesvirus 1
gccucaacauaccccg

SEQ ID NO: 1752475 - RNA, 23 nt, Human herpesvirus 1
agccgccacccucucuucccuca

SEQ ID NO: 1752476 - RNA, 20 nt, Human herpesvirus 1
guccagcgccgcaaccagcu

SEQ ID NO: 1752477 - RNA, 19 nt, Human herpesvirus 1
gcgaguccugcgccccgcc

SEQ ID NO: 1752478 - RNA, 17 nt, Human herpesvirus 1
ccgcccgugcugccguc

SEQ ID NO: 1752479 - RNA, 18 nt, Human herpesvirus 1
gccccuggcgccgccugg

SEQ ID NO: 1752480 - RNA, 17 nt, Human herpesvirus 1
acccaaccaaaccaggc

SEQ ID NO: 1752481 - RNA, 23 nt, Human herpesvirus 1
uaaccgaccgcagucccugaguu

SEQ ID NO: 1752482 - RNA, 12 nt, Human herpesvirus 1
ggcgacacaccu

SEQ ID NO: 1752483 - RNA, 23 nt, Human herpesvirus 1
gugccgcccguugcagggccugg

SEQ ID NO: 1752484 - RNA, 15 nt, Human herpesvirus 1
gcccacuacaccagc

SEQ ID NO: 1752485 - RNA, 15 nt, Human herpesvirus 1
cuugaggggggagau

SEQ ID NO: 1752486 - RNA, 13 nt, Human herpesvirus 1
cguguuugcccau

SEQ ID NO: 1752487 - RNA, 12 nt, Human herpesvirus 1
cgauuggcaaug

SEQ ID NO: 1752488 - RNA, 13 nt, Human herpesvirus 1
ccggcgccgcccg

SEQ ID NO: 1752489 - RNA, 17 nt, Human herpesvirus 1
cgcgaccucaccaccaa

SEQ ID NO: 1752490 - RNA, 15 nt, Human herpesvirus 1
cgaccgcagucccug

SEQ ID NO: 1752491 - RNA, 14 nt, Human herpesvirus 1
cauaucccacccug

SEQ ID NO: 1752492 - RNA, 21 nt, Human herpesvirus 1
gcccgggggacucacuaccca

SEQ ID NO: 1752493 - RNA, 13 nt, Human herpesvirus 1
cccaccccccguc

SEQ ID NO: 1752494 - RNA, 17 nt, Human herpesvirus 1
ccaggaaauccguggcc

SEQ ID NO: 1752495 - RNA, 12 nt, Human herpesvirus 1
gcugucauuccu

SEQ ID NO: 1752496 - RNA, 14 nt, Human herpesvirus 1
agggaccuccugga

SEQ ID NO: 1752497 - RNA, 20 nt, Human herpesvirus 1
uccacggccacuggccggga

SEQ ID NO: 1752498 - RNA, 17 nt, Human herpesvirus 1
uuuugugccuaccgcuu

SEQ ID NO: 1752499 - RNA, 12 nt, Human herpesvirus 1
agacccccccgg

SEQ ID NO: 1752500 - RNA, 13 nt, Human herpesvirus 1
gcccggggccugc

SEQ ID NO: 1752501 - RNA, 17 nt, Human herpesvirus 1
ugccaucgcgcccccuc

SEQ ID NO: 1752502 - RNA, 22 nt, Human herpesvirus 1
cagcgccgcaaccagcugcacg

SEQ ID NO: 1752503 - RNA, 20 nt, Human herpesvirus 1
caccgacgaaucccccaagg

SEQ ID NO: 1752504 - RNA, 14 nt, Human herpesvirus 1
cccagcgaccucgc

SEQ ID NO: 1752505 - RNA, 13 nt, Human herpesvirus 1
ggucucccaggga

SEQ ID NO: 1752506 - RNA, 15 nt, Human herpesvirus 1
cugguugcggcccgc

SEQ ID NO: 1752507 - RNA, 17 nt, Human herpesvirus 1
accuucaucgaccucaa

SEQ ID NO: 1752508 - RNA, 19 nt, Human herpesvirus 1
cgcguauagccuaugccac

SEQ ID NO: 1752509 - RNA, 20 nt, Human herpesvirus 1
cccaggcggcgaacgggggc

SEQ ID NO: 1752510 - RNA, 14 nt, Human herpesvirus 1
acgcaugggccgcc

SEQ ID NO: 1752511 - RNA, 12 nt, Human herpesvirus 1
gucccgcccacc

SEQ ID NO: 1752512 - RNA, 16 nt, Human herpesvirus 1
gaccagccguccucgc

SEQ ID NO: 1752513 - RNA, 18 nt, Human herpesvirus 1
gcuacgccgcugaccccc

SEQ ID NO: 1752514 - RNA, 22 nt, Human herpesvirus 1
ccgcaauuugcacccagccuuu

SEQ ID NO: 1752515 - RNA, 20 nt, Human herpesvirus 1
cgccucccccacauccggga

SEQ ID NO: 1752516 - RNA, 17 nt, Human herpesvirus 1
acgaugaccgcccccag

SEQ ID NO: 1752517 - RNA, 17 nt, Human herpesvirus 1
caucccccgucuggguu

SEQ ID NO: 1752518 - RNA, 13 nt, Human herpesvirus 1
cccuaccccaguc

SEQ ID NO: 1752519 - RNA, 22 nt, Human herpesvirus 1
gugucugcuccccaccccggag

SEQ ID NO: 1752520 - RNA, 17 nt, Human herpesvirus 1
ccacgugcacagccugg

SEQ ID NO: 1752521 - RNA, 15 nt, Human herpesvirus 1
caccggcggaccccc

SEQ ID NO: 1752522 - RNA, 17 nt, Human herpesvirus 1
gcagcaugggacccaca

SEQ ID NO: 1752523 - RNA, 11 nt, Human herpesvirus 1
gguggagggug

SEQ ID NO: 1752524 - RNA, 20 nt, Human herpesvirus 1
ccggucuccccgggagcccc

SEQ ID NO: 1752525 - RNA, 18 nt, Human herpesvirus 1
gcccgcaaacaggagcug

SEQ ID NO: 1752526 - RNA, 14 nt, Human herpesvirus 1
guccgcggaccggc

SEQ ID NO: 1752527 - RNA, 14 nt, Human herpesvirus 1
guuuucucuucccg

SEQ ID NO: 1752528 - RNA, 16 nt, Human herpesvirus 1
aguccgcugcaccgau

SEQ ID NO: 1752529 - RNA, 17 nt, Human herpesvirus 1
ugauggcacaccggucc

SEQ ID NO: 1752530 - RNA, 18 nt, Human herpesvirus 1
aaggugggccagccgcag

SEQ ID NO: 1752531 - RNA, 15 nt, Human herpesvirus 1
cuggaccgggguccc

SEQ ID NO: 1752532 - RNA, 14 nt, Human herpesvirus 1
guuugcccuccccc

SEQ ID NO: 1752533 - RNA, 21 nt, Human herpesvirus 1
ccaacgucgccgcccugagcg

SEQ ID NO: 1752534 - RNA, 14 nt, Human herpesvirus 1
ccggacgcgcggcg

SEQ ID NO: 1752535 - RNA, 23 nt, Human herpesvirus 1
cuugaggggggagaugggacccg

SEQ ID NO: 1752536 - RNA, 16 nt, Human herpesvirus 1
ccucauguccaccgac

SEQ ID NO: 1752537 - RNA, 22 nt, Human herpesvirus 1
ucuccuccaccacccaacccca

SEQ ID NO: 1752538 - RNA, 13 nt, Human herpesvirus 1
ugaccccagggau

SEQ ID NO: 1752539 - RNA, 15 nt, Human herpesvirus 1
gguccacggccacug

SEQ ID NO: 1752540 - RNA, 17 nt, Human herpesvirus 1
ugauuccucuccgcggu

SEQ ID NO: 1752541 - RNA, 22 nt, Human herpesvirus 1
gcgccaggcccgccgccacugu

SEQ ID NO: 1752542 - RNA, 19 nt, Human herpesvirus 1
acgcaagaccaggccuggu

SEQ ID NO: 1752543 - RNA, 22 nt, Human herpesvirus 1
ccucugggucugugccaccagc

SEQ ID NO: 1752544 - RNA, 14 nt, Human herpesvirus 1
gccaaccugauccg

SEQ ID NO: 1752545 - RNA, 20 nt, Human herpesvirus 1
caauaaaagaccacaccaac

SEQ ID NO: 1752546 - RNA, 17 nt, Human herpesvirus 1
accccaccccugugcua

SEQ ID NO: 1752547 - RNA, 23 nt, Human herpesvirus 1
ucuucggccccgcgucuggcccc

SEQ ID NO: 1752548 - RNA, 22 nt, Human herpesvirus 1
uccgguccuggaccagcugacc

SEQ ID NO: 1752549 - RNA, 23 nt, Human herpesvirus 1
uauguccccaaaauaaaagacca

SEQ ID NO: 1752550 - RNA, 13 nt, Human herpesvirus 1
uuaaccaccugcg

SEQ ID NO: 1752551 - RNA, 14 nt, Human herpesvirus 1
ggccaagcuagccg

SEQ ID NO: 1752552 - RNA, 14 nt, Human herpesvirus 1
uacacagccaccca

SEQ ID NO: 1752553 - RNA, 12 nt, Human herpesvirus 1
uauuccugccga

SEQ ID NO: 1752554 - RNA, 21 nt, Human herpesvirus 1
acaccagcgggucuuuugugu

SEQ ID NO: 1752555 - RNA, 15 nt, Human herpesvirus 1
ccgucggaggccccc

SEQ ID NO: 1752556 - RNA, 19 nt, Human herpesvirus 1
gcacuugcggcaagacccg

SEQ ID NO: 1752557 - RNA, 14 nt, Human herpesvirus 1
gcgccuagccaacc

SEQ ID NO: 1752558 - RNA, 14 nt, Human herpesvirus 1
cacacaccccccau

SEQ ID NO: 1752559 - RNA, 17 nt, Human herpesvirus 1
caggccaucgccgggga

SEQ ID NO: 1752560 - RNA, 23 nt, Human herpesvirus 1
cagggcgacgccgugggcaaugg

SEQ ID NO: 1752561 - RNA, 22 nt, Human herpesvirus 1
agcuguccgagacccccaacgc

SEQ ID NO: 1752562 - RNA, 13 nt, Human herpesvirus 1
gaggggggagggg

SEQ ID NO: 1752563 - RNA, 15 nt, Human herpesvirus 1
ucccccgaccucgcc

SEQ ID NO: 1752564 - RNA, 14 nt, Human herpesvirus 1
cuuaccgccacagg

SEQ ID NO: 1752565 - RNA, 20 nt, Human herpesvirus 1
gaacggacacgcggggacac

SEQ ID NO: 1752566 - RNA, 18 nt, Human herpesvirus 1
cgaagacaccccccacca

SEQ ID NO: 1752567 - RNA, 18 nt, Human herpesvirus 1
gggucugugccaccagcc

SEQ ID NO: 1752568 - RNA, 14 nt, Human herpesvirus 1
ggcccaacagccgc

SEQ ID NO: 1752569 - RNA, 16 nt, Human herpesvirus 1
cucgucgggguggcac

SEQ ID NO: 1752570 - RNA, 16 nt, Human herpesvirus 1
cgucgggccucccgga

SEQ ID NO: 1752571 - RNA, 22 nt, Human herpesvirus 1
ccuccgcgccaggcccgccgcc

SEQ ID NO: 1752572 - RNA, 21 nt, Human herpesvirus 1
gacccccaacgccacgcagcc

SEQ ID NO: 1752573 - RNA, 15 nt, Human herpesvirus 1
cuucaucgaccucaa

SEQ ID NO: 1752574 - RNA, 15 nt, Human herpesvirus 1
gucgucgggcgccaa

SEQ ID NO: 1752575 - RNA, 23 nt, Human herpesvirus 1
cagcucgcggcccggggccugcu

SEQ ID NO: 1752576 - RNA, 20 nt, Human herpesvirus 1
caacuucccacccggagcuu

SEQ ID NO: 1752577 - RNA, 22 nt, Human herpesvirus 1
ggauccgacccccauggagcac

SEQ ID NO: 1752578 - RNA, 15 nt, Human herpesvirus 1
gccacccacccacca

SEQ ID NO: 1752579 - RNA, 17 nt, Human herpesvirus 1
cccguaaaugguugcag

SEQ ID NO: 1752580 - RNA, 20 nt, Human herpesvirus 1
gaagaucgccggguggcacg

SEQ ID NO: 1752581 - RNA, 21 nt, Human herpesvirus 1
cgccggcaugcaccccagagg

SEQ ID NO: 1752582 - RNA, 22 nt, Human herpesvirus 1
cgccgagccccccgcugcggcc

SEQ ID NO: 1752583 - RNA, 12 nt, Human herpesvirus 1
cgcgccucccgg

SEQ ID NO: 1752584 - RNA, 22 nt, Human herpesvirus 1
aacucucgcaccaucccggguu

SEQ ID NO: 1752585 - RNA, 14 nt, Human herpesvirus 1
uuggcugaggacgu

SEQ ID NO: 1752586 - RNA, 21 nt, Human herpesvirus 1
gucuggguuuuccccucccgu

SEQ ID NO: 1752587 - RNA, 15 nt, Human herpesvirus 1
cguggacgggcucgc

SEQ ID NO: 1752588 - RNA, 16 nt, Human herpesvirus 1
gacgagccgcgcgccg

SEQ ID NO: 1752589 - RNA, 21 nt, Human herpesvirus 1
ggaacacacccccgugacuca

SEQ ID NO: 1752590 - RNA, 21 nt, Human herpesvirus 1
ccguugcccgggccuccucaa

SEQ ID NO: 1752591 - RNA, 19 nt, Human herpesvirus 1
cgcggcuucaucgcgcccc

SEQ ID NO: 1752592 - RNA, 15 nt, Human herpesvirus 1
gugggugaugucggg

SEQ ID NO: 1752593 - RNA, 17 nt, Human herpesvirus 1
uggacgcgccucccggg

SEQ ID NO: 1752594 - RNA, 19 nt, Human herpesvirus 1
ggucugggaacggacacgc

SEQ ID NO: 1752595 - RNA, 13 nt, Human herpesvirus 1
gcgccgcgggccc

SEQ ID NO: 1752596 - RNA, 21 nt, Human herpesvirus 1
auccaaaaccacaaccucccg

SEQ ID NO: 1752597 - RNA, 14 nt, Human herpesvirus 1
cauccaccacccgg

SEQ ID NO: 1752598 - RNA, 20 nt, Human herpesvirus 1
gaccgcccccagcugggccc

SEQ ID NO: 1752599 - RNA, 21 nt, Human herpesvirus 1
gggucgcucuguccaccggga

SEQ ID NO: 1752600 - RNA, 19 nt, Human herpesvirus 1
ccuuccccccccccccuua

SEQ ID NO: 1752601 - RNA, 16 nt, Human herpesvirus 1
aucccacguccccggg

SEQ ID NO: 1752602 - RNA, 19 nt, Human herpesvirus 1
gccuucacgugcugcugcg

SEQ ID NO: 1752603 - RNA, 15 nt, Human herpesvirus 1
accgcagccuggucg

SEQ ID NO: 1752604 - RNA, 18 nt, Human herpesvirus 1
cuuggccggggagggcag

SEQ ID NO: 1752605 - RNA, 20 nt, Human herpesvirus 1
gcauccccccgucagccugc

SEQ ID NO: 1752606 - RNA, 16 nt, Human herpesvirus 1
cugcccuucugucugg

SEQ ID NO: 1752607 - RNA, 22 nt, Human herpesvirus 1
acaaccccggucucccagggag

SEQ ID NO: 1752608 - RNA, 13 nt, Human herpesvirus 1
ccgacggacagcc

SEQ ID NO: 1752609 - RNA, 18 nt, Human herpesvirus 1
cgcuggggguccuggugg

SEQ ID NO: 1752610 - RNA, 16 nt, Human herpesvirus 1
uguggacgccggggcc

SEQ ID NO: 1752611 - RNA, 21 nt, Human herpesvirus 1
ggauacacaaacuuccccccc

SEQ ID NO: 1752612 - RNA, 15 nt, Human herpesvirus 1
acagcauggcgccac

SEQ ID NO: 1752613 - RNA, 19 nt, Human herpesvirus 1
cccugcgguccggagccgc

SEQ ID NO: 1752614 - RNA, 19 nt, Human herpesvirus 1
ugucggggaggggaaaagu

SEQ ID NO: 1752615 - RNA, 18 nt, Human herpesvirus 1
ucgcggagggcggccagc

SEQ ID NO: 1752616 - RNA, 14 nt, Human herpesvirus 1
uguccucgggacau

SEQ ID NO: 1752617 - RNA, 14 nt, Human herpesvirus 1
aaauuuuacaaaca

SEQ ID NO: 1752618 - RNA, 15 nt, Human herpesvirus 1
agcacccugcugccc

SEQ ID NO: 1752619 - RNA, 23 nt, Human herpesvirus 1
gacucaagcacacacgggggagc

SEQ ID NO: 1752620 - RNA, 19 nt, Human herpesvirus 1
cugccccccccaccccaga

SEQ ID NO: 1752621 - RNA, 17 nt, Human herpesvirus 1
cgaccuguugauggccu

SEQ ID NO: 1752622 - RNA, 23 nt, Human herpesvirus 1
gcucgucagggccggcggcgcuc

SEQ ID NO: 1752623 - RNA, 12 nt, Human herpesvirus 1
ccaccgggccca

SEQ ID NO: 1752624 - RNA, 20 nt, Human herpesvirus 1
gugugaguuuguggacccaa

SEQ ID NO: 1752625 - RNA, 13 nt, Human herpesvirus 1
cgcccggggccag

SEQ ID NO: 1752626 - RNA, 23 nt, Human herpesvirus 1
accaggaaauccguggccccggc

SEQ ID NO: 1752627 - RNA, 13 nt, Human herpesvirus 1
acgagcuccuggc

SEQ ID NO: 1752628 - RNA, 14 nt, Human herpesvirus 1
gcuuggagccagcc

SEQ ID NO: 1752629 - RNA, 18 nt, Human herpesvirus 1
cccaguccccgggcccag

SEQ ID NO: 1752630 - RNA, 13 nt, Human herpesvirus 1
cucgugugguaca

SEQ ID NO: 1752631 - RNA, 19 nt, Human herpesvirus 1
gacgucgagaaggacaaac

SEQ ID NO: 1752632 - RNA, 18 nt, Human herpesvirus 1
acgcccgcgacccggacg

SEQ ID NO: 1752633 - RNA, 14 nt, Human herpesvirus 1
ggaaggaacccgcg

SEQ ID NO: 1752634 - RNA, 20 nt, Human herpesvirus 1
cagcgaagcagccgccuggc

SEQ ID NO: 1752635 - RNA, 20 nt, Human herpesvirus 1
ccccgcgccucccggcccgu

SEQ ID NO: 1752636 - RNA, 19 nt, Human herpesvirus 1
ccccugccccccccacccc

SEQ ID NO: 1752637 - RNA, 14 nt, Human herpesvirus 1
ccucugggcccgcc

SEQ ID NO: 1752638 - RNA, 17 nt, Human herpesvirus 1
auuuguacccuuaauaa

SEQ ID NO: 1752639 - RNA, 16 nt, Human herpesvirus 1
uggaucuuagccuccc

SEQ ID NO: 1752640 - RNA, 23 nt, Human herpesvirus 1
gccccgacgcacccccccaacgg

SEQ ID NO: 1752641 - RNA, 16 nt, Human herpesvirus 1
cgccguugagccccuc

SEQ ID NO: 1752642 - RNA, 16 nt, Human herpesvirus 1
ucggucccccgaggcc

SEQ ID NO: 1752643 - RNA, 14 nt, Human herpesvirus 1
guuggcccccgccu

SEQ ID NO: 1752644 - RNA, 21 nt, Human herpesvirus 1
gacuaagcgucccugggcccu

SEQ ID NO: 1752645 - RNA, 21 nt, Human herpesvirus 1
ggccgcgguggacagccagga

SEQ ID NO: 1752646 - RNA, 13 nt, Human herpesvirus 1
uaaaagaccaaaa

SEQ ID NO: 1752647 - RNA, 13 nt, Human herpesvirus 1
gaccagauggaag

SEQ ID NO: 1752648 - RNA, 23 nt, Human herpesvirus 1
cgaggaggacgucuccaagcuuu

SEQ ID NO: 1752649 - RNA, 13 nt, Human herpesvirus 1
acccucucuucuc

SEQ ID NO: 1752650 - RNA, 18 nt, Human herpesvirus 1
ucucucccgggccgcccc

SEQ ID NO: 1752651 - RNA, 20 nt, Human herpesvirus 1
ggcgggccuaccggacccgu

SEQ ID NO: 1752652 - RNA, 23 nt, Human herpesvirus 1
cucugggggcgacccguaaaugg

SEQ ID NO: 1752653 - RNA, 20 nt, Human herpesvirus 1
ggcccagcauguccgccggg

SEQ ID NO: 1752654 - RNA, 18 nt, Human herpesvirus 1
gggucuccgaaagccacc

SEQ ID NO: 1752655 - RNA, 17 nt, Human herpesvirus 1
cuuccccccccccccuu

SEQ ID NO: 1752656 - RNA, 16 nt, Human herpesvirus 1
ggcacguacacgggug

SEQ ID NO: 1752657 - RNA, 14 nt, Human herpesvirus 1
gguugcggcccgcg

SEQ ID NO: 1752658 - RNA, 18 nt, Human herpesvirus 1
aggcccgcaagcugaacc

SEQ ID NO: 1752659 - RNA, 20 nt, Human herpesvirus 1
aucgcucgaccucuccacac

SEQ ID NO: 1752660 - RNA, 13 nt, Human herpesvirus 1
gcggcgugugggg

SEQ ID NO: 1752661 - RNA, 16 nt, Human herpesvirus 1
gccugccucucccccc

SEQ ID NO: 1752662 - RNA, 15 nt, Human herpesvirus 1
uauccuggagcaccg

SEQ ID NO: 1752663 - RNA, 17 nt, Human herpesvirus 1
ugcugcggcccacccug

SEQ ID NO: 1752664 - RNA, 23 nt, Human herpesvirus 1
gcccugguguuucuggggagcug

SEQ ID NO: 1752665 - RNA, 20 nt, Human herpesvirus 1
acgaugaccgcccccagcug

SEQ ID NO: 1752666 - RNA, 20 nt, Human herpesvirus 1
gaccgacagcacucacagcc

SEQ ID NO: 1752667 - RNA, 14 nt, Human herpesvirus 1
ccgccuagccgcag

SEQ ID NO: 1752668 - RNA, 23 nt, Human herpesvirus 1
accccaguccccgggcccagccu

SEQ ID NO: 1752669 - RNA, 13 nt, Human herpesvirus 1
ccgacgccagcuu

SEQ ID NO: 1752670 - RNA, 22 nt, Human herpesvirus 1
ccggcccuaaccccaccccugu

SEQ ID NO: 1752671 - RNA, 19 nt, Human herpesvirus 1
uugcacaacacaaacaucu

SEQ ID NO: 1752672 - RNA, 19 nt, Human herpesvirus 1
cuguacucgacccacugcc

SEQ ID NO: 1752673 - RNA, 14 nt, Human herpesvirus 1
guggugcgagcugc

SEQ ID NO: 1752674 - RNA, 21 nt, Human herpesvirus 1
cuaucccgcccaccgcugggc

SEQ ID NO: 1752675 - RNA, 22 nt, Human herpesvirus 1
acggcgaaugcagcgccggccu

SEQ ID NO: 1752676 - RNA, 17 nt, Human herpesvirus 1
uuuucgccgcccucgcc

SEQ ID NO: 1752677 - RNA, 13 nt, Human herpesvirus 1
ccguugcccgggc

SEQ ID NO: 1752678 - RNA, 20 nt, Human herpesvirus 1
caccaccgucagcaccuuca

SEQ ID NO: 1752679 - RNA, 16 nt, Human herpesvirus 1
caaaaaccgccccccc

SEQ ID NO: 1752680 - RNA, 19 nt, Human herpesvirus 1
gaaccccaacgccaucgcc

SEQ ID NO: 1752681 - RNA, 14 nt, Human herpesvirus 1
gcgcgaucccccgc

SEQ ID NO: 1752682 - RNA, 22 nt, Human herpesvirus 1
caccuccggagcgugacgcacc

SEQ ID NO: 1752683 - RNA, 20 nt, Human herpesvirus 1
cuccucuucuccccuucccu

SEQ ID NO: 1752684 - RNA, 20 nt, Human herpesvirus 1
ggguaccgcgugaccccagg

SEQ ID NO: 1752685 - RNA, 19 nt, Human herpesvirus 1
cuugggcccgggggccugg

SEQ ID NO: 1752686 - RNA, 20 nt, Human herpesvirus 1
ucgagccaacgcccugacca

SEQ ID NO: 1752687 - RNA, 20 nt, Human herpesvirus 1
ggcccgccaucugggauggc

SEQ ID NO: 1752688 - RNA, 20 nt, Human herpesvirus 1
cagcuggugcuuuuccacaa

SEQ ID NO: 1752689 - RNA, 12 nt, Human herpesvirus 1
uuccccucccgu

SEQ ID NO: 1752690 - RNA, 18 nt, Human herpesvirus 1
cagcuuuccgcugagccu

SEQ ID NO: 1752691 - RNA, 12 nt, Human herpesvirus 1
acgcgcuaacgg

SEQ ID NO: 1752692 - RNA, 12 nt, Human herpesvirus 1
ugugggguccuc

SEQ ID NO: 1752693 - RNA, 15 nt, Human herpesvirus 1
accgucauccacacc

SEQ ID NO: 1752694 - RNA, 15 nt, Human herpesvirus 1
uccacgaacccagcg

SEQ ID NO: 1752695 - RNA, 14 nt, Human herpesvirus 1
cgccccccccccgu

SEQ ID NO: 1752696 - RNA, 19 nt, Human herpesvirus 1
gccagcagacgcugcuccg

SEQ ID NO: 1752697 - RNA, 17 nt, Human herpesvirus 1
caggguaccgcgugacc

SEQ ID NO: 1752698 - RNA, 21 nt, Human herpesvirus 1
uccccuucccucccccuccgc

SEQ ID NO: 1752699 - RNA, 15 nt, Human herpesvirus 1
gccguccgaacccag

SEQ ID NO: 1752700 - RNA, 16 nt, Human herpesvirus 1
acgagcuccuggccua

SEQ ID NO: 1752701 - RNA, 22 nt, Human herpesvirus 1
ggacgacggcggcgaggccggc

SEQ ID NO: 1752702 - RNA, 18 nt, Human herpesvirus 1
gcaaccagcugcacgacc

SEQ ID NO: 1752703 - RNA, 15 nt, Human herpesvirus 1
cccugaguugggaau

SEQ ID NO: 1752704 - RNA, 14 nt, Human herpesvirus 1
cguguuugcccaua

SEQ ID NO: 1752705 - RNA, 22 nt, Human herpesvirus 1
ucaccggguacggcgucugggc

SEQ ID NO: 1752706 - RNA, 21 nt, Human herpesvirus 1
ccagccuucacgugcugcugc

SEQ ID NO: 1752707 - RNA, 20 nt, Human herpesvirus 1
aacgcaacggcgggagcugg

SEQ ID NO: 1752708 - RNA, 16 nt, Human herpesvirus 1
cgguacgaagaccagg

SEQ ID NO: 1752709 - RNA, 17 nt, Human herpesvirus 1
guuguuagcccugcucg

SEQ ID NO: 1752710 - RNA, 20 nt, Human herpesvirus 1
guagcgccccggcgacccug

SEQ ID NO: 1752711 - RNA, 16 nt, Human herpesvirus 1
gggaugcuagccugug

SEQ ID NO: 1752712 - RNA, 17 nt, Human herpesvirus 1
cuacaacaagucucugg

SEQ ID NO: 1752713 - RNA, 21 nt, Human herpesvirus 1
gcgaggugcgguuggggaggc

SEQ ID NO: 1752714 - RNA, 14 nt, Human herpesvirus 1
gcgcgggggcgccg

SEQ ID NO: 1752715 - RNA, 14 nt, Human herpesvirus 1
uacugcugggccau

SEQ ID NO: 1752716 - RNA, 16 nt, Human herpesvirus 1
gcaacucgccccacga

SEQ ID NO: 1752717 - RNA, 13 nt, Human herpesvirus 1
cagucccugaguu

SEQ ID NO: 1752718 - RNA, 20 nt, Human herpesvirus 1
gagccucugugucagguggc

SEQ ID NO: 1752719 - RNA, 19 nt, Human herpesvirus 1
ucccgacaccaccagcugg

SEQ ID NO: 1752720 - RNA, 18 nt, Human herpesvirus 1
gccggucggcgggcccgc

SEQ ID NO: 1752721 - RNA, 17 nt, Human herpesvirus 1
ggcccagcauguccgcc

SEQ ID NO: 1752722 - RNA, 16 nt, Human herpesvirus 1
aauuucaccgccccag

SEQ ID NO: 1752723 - RNA, 22 nt, Human herpesvirus 1
gcggcauaacuccgaccggcgg

SEQ ID NO: 1752724 - RNA, 13 nt, Human herpesvirus 1
uuacguacaacca

SEQ ID NO: 1752725 - RNA, 22 nt, Human herpesvirus 1
acccgccccuaaccaggccucc

SEQ ID NO: 1752726 - RNA, 12 nt, Human herpesvirus 1
cgacgaccuggg

SEQ ID NO: 1752727 - RNA, 15 nt, Human herpesvirus 1
caucucgcgccccga

SEQ ID NO: 1752728 - RNA, 19 nt, Human herpesvirus 1
ucgagccaacgcccugacc

SEQ ID NO: 1752729 - RNA, 21 nt, Human herpesvirus 1
gucgucucucuucccccccau

SEQ ID NO: 1752730 - RNA, 19 nt, Human herpesvirus 1
cggaggaaacccccgaccc

SEQ ID NO: 1752731 - RNA, 19 nt, Human herpesvirus 1
gccccccccaccccagacg

SEQ ID NO: 1752732 - RNA, 19 nt, Human herpesvirus 1
cgggcgccuucccccggcc

SEQ ID NO: 1752733 - RNA, 13 nt, Human herpesvirus 1
cgagggccgggcc

SEQ ID NO: 1752734 - RNA, 18 nt, Human herpesvirus 1
gcccguugcagggccugg

SEQ ID NO: 1752735 - RNA, 13 nt, Human herpesvirus 1
aauaaauuuuaca

SEQ ID NO: 1752736 - RNA, 21 nt, Human herpesvirus 1
cccgcugcgcauccccccguc

SEQ ID NO: 1752737 - RNA, 16 nt, Human herpesvirus 1
ggucugucucgucucc

SEQ ID NO: 1752738 - RNA, 20 nt, Human herpesvirus 1
agggaccuccuggacuuuga

SEQ ID NO: 1752739 - RNA, 17 nt, Human herpesvirus 1
agucccugaguugggaa

SEQ ID NO: 1752740 - RNA, 21 nt, Human herpesvirus 1
ggaggggaaaagugaaagaca

SEQ ID NO: 1752741 - RNA, 16 nt, Human herpesvirus 1
gcgaagacgaggcggc

SEQ ID NO: 1752742 - RNA, 21 nt, Human herpesvirus 1
gacaaccccggucucccaggg

SEQ ID NO: 1752743 - RNA, 23 nt, Human herpesvirus 1
cacgaccuguugauggccugugc

SEQ ID NO: 1752744 - RNA, 15 nt, Human herpesvirus 1
ccccacgacacccac

SEQ ID NO: 1752745 - RNA, 15 nt, Human herpesvirus 1
gcucgucgccuggcu

SEQ ID NO: 1752746 - RNA, 15 nt, Human herpesvirus 1
cuggaugcgccgcca

SEQ ID NO: 1752747 - RNA, 22 nt, Human herpesvirus 1
cagacgguggugcccagcggcc

SEQ ID NO: 1752748 - RNA, 18 nt, Human herpesvirus 1
gacgucuccaagcuuucc

SEQ ID NO: 1752749 - RNA, 15 nt, Human herpesvirus 1
ccaacgcguccgugg

SEQ ID NO: 1752750 - RNA, 15 nt, Human herpesvirus 1
agccuuuaacuacau

SEQ ID NO: 1752751 - RNA, 20 nt, Human herpesvirus 1
ugcuuauucucggggagcuu

SEQ ID NO: 1752752 - RNA, 13 nt, Human herpesvirus 1
accguggccuggg

SEQ ID NO: 1752753 - RNA, 20 nt, Human herpesvirus 1
ccuaugguacacacgggugc

SEQ ID NO: 1752754 - RNA, 21 nt, Human herpesvirus 1
ccgccagcgcggcggggcccg

SEQ ID NO: 1752755 - RNA, 17 nt, Human herpesvirus 1
gcgaguccugcgccccg

SEQ ID NO: 1752756 - RNA, 13 nt, Human herpesvirus 1
gccgacggcccga

SEQ ID NO: 1752757 - RNA, 14 nt, Human herpesvirus 1
ccgugcaccguggg

SEQ ID NO: 1752758 - RNA, 17 nt, Human herpesvirus 1
gccggucgccgugcucc

SEQ ID NO: 1752759 - RNA, 15 nt, Human herpesvirus 1
gaacgaggcccgcaa

SEQ ID NO: 1752760 - RNA, 21 nt, Human herpesvirus 1
guuaacugucuggagacccua

SEQ ID NO: 1752761 - RNA, 15 nt, Human herpesvirus 1
gccgcgcggaggcgu

SEQ ID NO: 1752762 - RNA, 20 nt, Human herpesvirus 1
cggacccucucuucucuccc

SEQ ID NO: 1752763 - RNA, 18 nt, Human herpesvirus 1
cgggggacucacuaccca

SEQ ID NO: 1752764 - RNA, 13 nt, Human herpesvirus 1
gcccgcuggggcg

SEQ ID NO: 1752765 - RNA, 15 nt, Human herpesvirus 1
auaugccuguguguc

SEQ ID NO: 1752766 - RNA, 17 nt, Human herpesvirus 1
ccgcccccaacaggugg

SEQ ID NO: 1752767 - RNA, 22 nt, Human herpesvirus 1
cgccggcggucgcgcuccucug

SEQ ID NO: 1752768 - RNA, 14 nt, Human herpesvirus 1
ggacaccccccaug

SEQ ID NO: 1752769 - RNA, 16 nt, Human herpesvirus 1
cucaugauccucaucg

SEQ ID NO: 1752770 - RNA, 19 nt, Human herpesvirus 1
acaaacgacccaccaauaa

SEQ ID NO: 1752771 - RNA, 13 nt, Human herpesvirus 1
cggcgcggggccc

SEQ ID NO: 1752772 - RNA, 21 nt, Human herpesvirus 1
ccugcucgggcaggugcagac

SEQ ID NO: 1752773 - RNA, 18 nt, Human herpesvirus 1
acggccacuggccgggag

SEQ ID NO: 1752774 - RNA, 24 nt, Human herpesvirus 1
cccggcgggguuauaggccacgca

SEQ ID NO: 1752775 - RNA, 18 nt, Human herpesvirus 1
gacgcucccgucgcccga

SEQ ID NO: 1752776 - RNA, 20 nt, Human herpesvirus 1
ugguggcaccuccccagcgg

SEQ ID NO: 1752777 - RNA, 18 nt, Human herpesvirus 1
ggcgcuggguggucucug

SEQ ID NO: 1752778 - RNA, 16 nt, Human herpesvirus 1
gaacacaaggccaaga

SEQ ID NO: 1752779 - RNA, 17 nt, Human herpesvirus 1
auggcccuggugucugc

SEQ ID NO: 1752780 - RNA, 15 nt, Human herpesvirus 1
ccgacagcacucaca

SEQ ID NO: 1752781 - RNA, 17 nt, Human herpesvirus 1
agccauauccugagccc

SEQ ID NO: 1752782 - RNA, 15 nt, Human herpesvirus 1
ccgagcuuguuuucg

SEQ ID NO: 1752783 - RNA, 17 nt, Human herpesvirus 1
cgacccccuuguauguc

SEQ ID NO: 1752784 - RNA, 22 nt, Human herpesvirus 1
augaagccacuguuuuccgccc

SEQ ID NO: 1752785 - RNA, 17 nt, Human herpesvirus 1
uacgggcuguuccgcca

SEQ ID NO: 1752786 - RNA, 19 nt, Human herpesvirus 1
ugucugccauggagcgcac

SEQ ID NO: 1752787 - RNA, 17 nt, Human herpesvirus 1
ccgggcgcuuggcaugc

SEQ ID NO: 1752788 - RNA, 18 nt, Human herpesvirus 1
ccagaccgaagaggugcu

SEQ ID NO: 1752789 - RNA, 13 nt, Human herpesvirus 1
cacgagccggggc

SEQ ID NO: 1752790 - RNA, 18 nt, Human herpesvirus 1
ccggggcccggcccugcu

SEQ ID NO: 1752791 - RNA, 16 nt, Human herpesvirus 1
guccucaccgagccuc

SEQ ID NO: 1752792 - RNA, 22 nt, Human herpesvirus 1
cgggcgguucgccgccaccagc

SEQ ID NO: 1752793 - RNA, 15 nt, Human herpesvirus 1
ccgccgcgccccgcc

SEQ ID NO: 1752794 - RNA, 20 nt, Human herpesvirus 1
cucccccguagaucucugua

SEQ ID NO: 1752795 - RNA, 19 nt, Human herpesvirus 1
cgccagcgcggcggggccc

SEQ ID NO: 1752796 - RNA, 14 nt, Human herpesvirus 1
cugguccacaccca

SEQ ID NO: 1752797 - RNA, 16 nt, Human herpesvirus 1
gaaggcgcuuccccgc

SEQ ID NO: 1752798 - RNA, 12 nt, Human herpesvirus 1
ggguaccacagg

SEQ ID NO: 1752799 - RNA, 13 nt, Human herpesvirus 1
cccggggccugcu

SEQ ID NO: 1752800 - RNA, 19 nt, Human herpesvirus 1
cacucaaaaagccccaaag

SEQ ID NO: 1752801 - RNA, 23 nt, Human herpesvirus 1
gugacgcgccaaacgccagccug

SEQ ID NO: 1752802 - RNA, 14 nt, Human herpesvirus 1
gccgcgggccacgc

SEQ ID NO: 1752803 - RNA, 18 nt, Human herpesvirus 1
uccagccuccccuccagg

SEQ ID NO: 1752804 - RNA, 19 nt, Human herpesvirus 1
agucccugaguugggaaua

SEQ ID NO: 1752805 - RNA, 17 nt, Human herpesvirus 1
gcgcccacuacaccagc

SEQ ID NO: 1752806 - RNA, 13 nt, Human herpesvirus 1
cacgaccugcgcu

SEQ ID NO: 1752807 - RNA, 13 nt, Human herpesvirus 1
cacacaccagcgg

SEQ ID NO: 1752808 - RNA, 19 nt, Human herpesvirus 1
gggcuguacucgacccacu

SEQ ID NO: 1752809 - RNA, 12 nt, Human herpesvirus 1
gccacacccgcg

SEQ ID NO: 1752810 - RNA, 15 nt, Human herpesvirus 1
aggugggccagccgc

SEQ ID NO: 1752811 - RNA, 13 nt, Human herpesvirus 1
gauuccgagggcc

SEQ ID NO: 1752812 - RNA, 18 nt, Human herpesvirus 1
ggugacgccgacgaggac

SEQ ID NO: 1752813 - RNA, 13 nt, Human herpesvirus 1
cgggccgcccacu

SEQ ID NO: 1752814 - RNA, 23 nt, Human herpesvirus 1
gcaccgagccaagggcuccugua

SEQ ID NO: 1752815 - RNA, 17 nt, Human herpesvirus 1
uccccuucccucccccu

SEQ ID NO: 1752816 - RNA, 23 nt, Human herpesvirus 1
gcauccacccuccgcuggggccc

SEQ ID NO: 1752817 - RNA, 12 nt, Human herpesvirus 1
ccccgccaccca

SEQ ID NO: 1752818 - RNA, 13 nt, Human herpesvirus 1
guccuucuugucg

SEQ ID NO: 1752819 - RNA, 23 nt, Human herpesvirus 1
ugggccucucguucuccggggcc

SEQ ID NO: 1752820 - RNA, 13 nt, Human herpesvirus 1
cgcgccucccggg

SEQ ID NO: 1752821 - RNA, 13 nt, Human herpesvirus 1
cgcggcucccggc

SEQ ID NO: 1752822 - RNA, 21 nt, Human herpesvirus 1
gcuccagucccggcccggcgg

SEQ ID NO: 1752823 - RNA, 16 nt, Human herpesvirus 1
gccccaguccccaaga

SEQ ID NO: 1752824 - RNA, 19 nt, Human herpesvirus 1
cugccccgcuucauccccg

SEQ ID NO: 1752825 - RNA, 18 nt, Human herpesvirus 1
cccacuacaccagccaau

SEQ ID NO: 1752826 - RNA, 15 nt, Human herpesvirus 1
gcaucggaacacgcc

SEQ ID NO: 1752827 - RNA, 22 nt, Human herpesvirus 1
ggccgccccgaagagggggacc

SEQ ID NO: 1752828 - RNA, 17 nt, Human herpesvirus 1
gaccuggggucgcucug

SEQ ID NO: 1752829 - RNA, 21 nt, Human herpesvirus 1
gggccauggacagcgaccugg

SEQ ID NO: 1752830 - RNA, 18 nt, Human herpesvirus 1
agccccggucuccccggg

SEQ ID NO: 1752831 - RNA, 21 nt, Human herpesvirus 1
cccggcccggaggaggcucuc

SEQ ID NO: 1752832 - RNA, 20 nt, Human herpesvirus 1
gccccggggagacagcgccu

SEQ ID NO: 1752833 - RNA, 22 nt, Human herpesvirus 1
uggucgaucccgaacgacacac

SEQ ID NO: 1752834 - RNA, 11 nt, Human herpesvirus 1
cguuggccccc

SEQ ID NO: 1752835 - RNA, 11 nt, Human herpesvirus 1
augccuguggg

SEQ ID NO: 1752836 - RNA, 16 nt, Human herpesvirus 1
auccgaacgcagcccc

SEQ ID NO: 1752837 - RNA, 19 nt, Human herpesvirus 1
caucgccucggccaccgug

SEQ ID NO: 1752838 - RNA, 19 nt, Human herpesvirus 1
ucggccuauggcuccugcg

SEQ ID NO: 1752839 - RNA, 23 nt, Human herpesvirus 1
ggaggugcuucuguuuggcgccc

SEQ ID NO: 1752840 - RNA, 16 nt, Human herpesvirus 1
cgaucccaacuccuca

SEQ ID NO: 1752841 - RNA, 19 nt, Human herpesvirus 1
acccuaugguacacacggg

SEQ ID NO: 1752842 - RNA, 15 nt, Human herpesvirus 1
gcagaggcggccaga

SEQ ID NO: 1752843 - RNA, 23 nt, Human herpesvirus 1
gaaccguggucgaggugucucgc

SEQ ID NO: 1752844 - RNA, 15 nt, Human herpesvirus 1
gcgccggucgucacg

SEQ ID NO: 1752845 - RNA, 16 nt, Human herpesvirus 1
ggguauauaaggccug

SEQ ID NO: 1752846 - RNA, 16 nt, Human herpesvirus 1
guggucuucaaggaga

SEQ ID NO: 1752847 - RNA, 13 nt, Human herpesvirus 1
gcgugggccgcgc

SEQ ID NO: 1752848 - RNA, 14 nt, Human herpesvirus 1
gaggcccacgccuc

SEQ ID NO: 1752849 - RNA, 18 nt, Human herpesvirus 1
ccgcaauuugcacccagc

SEQ ID NO: 1752850 - RNA, 13 nt, Human herpesvirus 1
gcugcggcccacc

SEQ ID NO: 1752851 - RNA, 19 nt, Human herpesvirus 1
cauguuugcgggccugggc

SEQ ID NO: 1752852 - RNA, 19 nt, Human herpesvirus 1
ccgccaucgagccaacgcc

SEQ ID NO: 1752853 - RNA, 18 nt, Human herpesvirus 1
gcuggccgcucgguggcu

SEQ ID NO: 1752854 - RNA, 15 nt, Human herpesvirus 1
gucccccacaccacc

SEQ ID NO: 1752855 - RNA, 14 nt, Human herpesvirus 1
cgugcuccugugag

SEQ ID NO: 1752856 - RNA, 21 nt, Human herpesvirus 1
gcccguugcagggccuggugc

SEQ ID NO: 1752857 - RNA, 13 nt, Human herpesvirus 1
auccacaccgcgg

SEQ ID NO: 1752858 - RNA, 10 nt, Human herpesvirus 1
ccgugucuau

SEQ ID NO: 1752859 - RNA, 19 nt, Human herpesvirus 1
ugggcgaccuggggcgcgc

SEQ ID NO: 1752860 - RNA, 18 nt, Human herpesvirus 1
ggugccccaaggagggcg

SEQ ID NO: 1752861 - RNA, 18 nt, Human herpesvirus 1
aaaacugauaaaacagcg

SEQ ID NO: 1752862 - RNA, 18 nt, Human herpesvirus 1
cccagcgaccccacggcc

SEQ ID NO: 1752863 - RNA, 17 nt, Human herpesvirus 1
cacgugcugcugcggcc

SEQ ID NO: 1752864 - RNA, 17 nt, Human herpesvirus 1
ucacgcaagaccaggcc

SEQ ID NO: 1752865 - RNA, 16 nt, Human herpesvirus 1
cgcaacaaccuggaga

SEQ ID NO: 1752866 - RNA, 19 nt, Human herpesvirus 1
acgcgccaaacgccagccu

SEQ ID NO: 1752867 - RNA, 16 nt, Human herpesvirus 1
gcgugaccccagggau

SEQ ID NO: 1752868 - RNA, 21 nt, Human herpesvirus 1
gcggccagaucuacugcuggg

SEQ ID NO: 1752869 - RNA, 14 nt, Human herpesvirus 1
ucggaggcccccca

SEQ ID NO: 1752870 - RNA, 14 nt, Human herpesvirus 1
uugagccccucgcc

SEQ ID NO: 1752871 - RNA, 21 nt, Human herpesvirus 1
aguucaccguggccugggacu

SEQ ID NO: 1752872 - RNA, 13 nt, Human herpesvirus 1
augcccucccuga

SEQ ID NO: 1752873 - RNA, 22 nt, Human herpesvirus 1
accgucgccgcgggccacgcca

SEQ ID NO: 1752874 - RNA, 16 nt, Human herpesvirus 1
cucaagaaccccacca

SEQ ID NO: 1752875 - RNA, 22 nt, Human herpesvirus 1
ggcccagcauguccgccgggac

SEQ ID NO: 1752876 - RNA, 16 nt, Human herpesvirus 1
cagcugaccgacccuc

SEQ ID NO: 1752877 - RNA, 16 nt, Human herpesvirus 1
cgucgggaggccacag

SEQ ID NO: 1752878 - RNA, 15 nt, Human herpesvirus 1
ggccucgugggcacu

SEQ ID NO: 1752879 - RNA, 13 nt, Human herpesvirus 1
ugcacagccuggc

SEQ ID NO: 1752880 - RNA, 21 nt, Human herpesvirus 1
cgugacgcacccccugacccc

SEQ ID NO: 1752881 - RNA, 14 nt, Human herpesvirus 1
gccccccagccucc

SEQ ID NO: 1752882 - RNA, 15 nt, Human herpesvirus 1
aauaaauuuuacaaa

SEQ ID NO: 1752883 - RNA, 18 nt, Human herpesvirus 1
ggcagugaggguggcaug

SEQ ID NO: 1752884 - RNA, 14 nt, Human herpesvirus 1
caacgucgccgccc

SEQ ID NO: 1752885 - RNA, 14 nt, Human herpesvirus 1
ccgucccacgcucu

SEQ ID NO: 1752886 - RNA, 21 nt, Human herpesvirus 1
gaggaggaagaggaggagggg

SEQ ID NO: 1752887 - RNA, 19 nt, Human herpesvirus 1
aucguccaucaccacgccc

SEQ ID NO: 1752888 - RNA, 14 nt, Human herpesvirus 1
acgagcugacccug

SEQ ID NO: 1752889 - RNA, 13 nt, Human herpesvirus 1
gggcccgccugga

SEQ ID NO: 1752890 - RNA, 13 nt, Human herpesvirus 1
guccguguggagg

SEQ ID NO: 1752891 - RNA, 20 nt, Human herpesvirus 1
uccugaugcacgcccccgcg

SEQ ID NO: 1752892 - RNA, 17 nt, Human herpesvirus 1
cgcgcuaacggugaccc

SEQ ID NO: 1752893 - RNA, 17 nt, Human herpesvirus 1
augcccacgggucgugc

SEQ ID NO: 1752894 - RNA, 13 nt, Human herpesvirus 1
ccacgcucucccc

SEQ ID NO: 1752895 - RNA, 20 nt, Human herpesvirus 1
ccuccaucgaguucgccagg

SEQ ID NO: 1752896 - RNA, 20 nt, Human herpesvirus 1
caccuccgcgagcagagccg

SEQ ID NO: 1752897 - RNA, 16 nt, Human herpesvirus 1
ucuucccccccaucac

SEQ ID NO: 1752898 - RNA, 16 nt, Human herpesvirus 1
gugggugcuuuggaaa

SEQ ID NO: 1752899 - RNA, 21 nt, Human herpesvirus 1
gggcguaacguuccgccugga

SEQ ID NO: 1752900 - RNA, 15 nt, Human herpesvirus 1
ggggcccggccaacc

SEQ ID NO: 1752901 - RNA, 16 nt, Human herpesvirus 1
accgcgugaccccagg

SEQ ID NO: 1752902 - RNA, 10 nt, Human herpesvirus 1
cacaccaccg

SEQ ID NO: 1752903 - RNA, 17 nt, Human herpesvirus 1
ccgucguauccacggug

SEQ ID NO: 1752904 - RNA, 13 nt, Human herpesvirus 1
gugagcgaggacg

SEQ ID NO: 1752905 - RNA, 16 nt, Human herpesvirus 1
acccguguuugcccau

SEQ ID NO: 1752906 - RNA, 21 nt, Human herpesvirus 1
uuugcggacccucucuucucu

SEQ ID NO: 1752907 - RNA, 22 nt, Human herpesvirus 1
accaacccgccccuaaccaggc

SEQ ID NO: 1752908 - RNA, 13 nt, Human herpesvirus 1
cggacccgggccg

SEQ ID NO: 1752909 - RNA, 21 nt, Human herpesvirus 1
ccccgagaaccagcgcaccgu

SEQ ID NO: 1752910 - RNA, 15 nt, Human herpesvirus 1
gugccaccagccugg

SEQ ID NO: 1752911 - RNA, 19 nt, Human herpesvirus 1
cuaccgcuuuauaggccgg

SEQ ID NO: 1752912 - RNA, 15 nt, Human herpesvirus 1
auucccaaacagggc

SEQ ID NO: 1752913 - RNA, 13 nt, Human herpesvirus 1
gaacgacugggcc

SEQ ID NO: 1752914 - RNA, 13 nt, Human herpesvirus 1
acgcacuguggcu

SEQ ID NO: 1752915 - RNA, 14 nt, Human herpesvirus 1
ggggccagcgccaa

SEQ ID NO: 1752916 - RNA, 19 nt, Human herpesvirus 1
ucugcggccggcgggacuc

SEQ ID NO: 1752917 - RNA, 24 nt, Human herpesvirus 1
cauggaccccagcgaccccacggc

SEQ ID NO: 1752918 - RNA, 15 nt, Human herpesvirus 1
accguggccggccug

SEQ ID NO: 1752919 - RNA, 23 nt, Human herpesvirus 1
gagcccacaugcggaaagcaaga

SEQ ID NO: 1752920 - RNA, 17 nt, Human herpesvirus 1
cccuuguauguccccaa

SEQ ID NO: 1752921 - RNA, 19 nt, Human herpesvirus 1
gcggccuggacguccccga

SEQ ID NO: 1752922 - RNA, 19 nt, Human herpesvirus 1
cggcugccaaacagcuggc

SEQ ID NO: 1752923 - RNA, 17 nt, Human herpesvirus 1
cgguuggggaggcugua

SEQ ID NO: 1752924 - RNA, 20 nt, Human herpesvirus 1
cugcggcccacccuggcgcc

SEQ ID NO: 1752925 - RNA, 14 nt, Human herpesvirus 1
uccccgcugucacu

SEQ ID NO: 1752926 - RNA, 18 nt, Human herpesvirus 1
gacccgccccggagggag

SEQ ID NO: 1752927 - RNA, 21 nt, Human herpesvirus 1
cggcggcuguagcgccccggc

SEQ ID NO: 1752928 - RNA, 16 nt, Human herpesvirus 1
cccgucgaagcugaug

SEQ ID NO: 1752929 - RNA, 22 nt, Human herpesvirus 1
cgcccucgcccagacgcccucc

SEQ ID NO: 1752930 - RNA, 23 nt, Human herpesvirus 1
ggccagaucuacugcugggccau

SEQ ID NO: 1752931 - RNA, 13 nt, Human herpesvirus 1
ccgaccggguccc

SEQ ID NO: 1752932 - RNA, 14 nt, Human herpesvirus 1
caacgucuccucca

SEQ ID NO: 1752933 - RNA, 21 nt, Human herpesvirus 1
aaacgacaucuugucgucaaa

SEQ ID NO: 1752934 - RNA, 20 nt, Human herpesvirus 1
ggcgcguccccggcccggag

SEQ ID NO: 1752935 - RNA, 15 nt, Human herpesvirus 1
cacgcacgcucccau

SEQ ID NO: 1752936 - RNA, 19 nt, Human herpesvirus 1
gccccccguguuugugggg

SEQ ID NO: 1752937 - RNA, 23 nt, Human herpesvirus 1
cuccaggcugucgacgcccccuc

SEQ ID NO: 1752938 - RNA, 15 nt, Human herpesvirus 1
gccccgccacccagu

SEQ ID NO: 1752939 - RNA, 16 nt, Human herpesvirus 1
cgugcuccugugagcu

SEQ ID NO: 1752940 - RNA, 23 nt, Human herpesvirus 1
caagccccuagccccgcccccuu

SEQ ID NO: 1752941 - RNA, 22 nt, Human herpesvirus 1
ugcggcuuaugaacgacugggc

SEQ ID NO: 1752942 - RNA, 22 nt, Human herpesvirus 1
ccacgucgaccgcgcccucgcc

SEQ ID NO: 1752943 - RNA, 21 nt, Human herpesvirus 1
guggccggccugcgcgacgcc

SEQ ID NO: 1752944 - RNA, 14 nt, Human herpesvirus 1
uguuccgccugucg

SEQ ID NO: 1752945 - RNA, 20 nt, Human herpesvirus 1
gcagucuccuggcagcccug

SEQ ID NO: 1752946 - RNA, 14 nt, Human herpesvirus 1
gccgcccggggcca

SEQ ID NO: 1752947 - RNA, 19 nt, Human herpesvirus 1
gucuccucuucuccccuuc

SEQ ID NO: 1752948 - RNA, 17 nt, Human herpesvirus 1
gagccaacgcccugacc

SEQ ID NO: 1752949 - RNA, 15 nt, Human herpesvirus 1
gucacgcacgccgcc

SEQ ID NO: 1752950 - RNA, 15 nt, Human herpesvirus 1
ccggguuccgcgacc

SEQ ID NO: 1752951 - RNA, 13 nt, Human herpesvirus 1
ccguccgaaccca

SEQ ID NO: 1752952 - RNA, 14 nt, Human herpesvirus 1
acagcgaccugggg

SEQ ID NO: 1752953 - RNA, 16 nt, Human herpesvirus 1
gccgcaaaucccacca

SEQ ID NO: 1752954 - RNA, 19 nt, Human herpesvirus 1
ccaggaucacaccggucaa

SEQ ID NO: 1752955 - RNA, 16 nt, Human herpesvirus 1
accaccgucagcaccu

SEQ ID NO: 1752956 - RNA, 14 nt, Human herpesvirus 1
gccacgccagggcc

SEQ ID NO: 1752957 - RNA, 15 nt, Human herpesvirus 1
ucccucgaccaccau

SEQ ID NO: 1752958 - RNA, 18 nt, Human herpesvirus 1
ccgccucgguccaccgca

SEQ ID NO: 1752959 - RNA, 16 nt, Human herpesvirus 1
agacgacaccgugguc

SEQ ID NO: 1752960 - RNA, 14 nt, Human herpesvirus 1
ggccccgacagccc

SEQ ID NO: 1752961 - RNA, 13 nt, Human herpesvirus 1
gggcgucccugga

SEQ ID NO: 1752962 - RNA, 19 nt, Human herpesvirus 1
ucccucccccuccgcaucc

SEQ ID NO: 1752963 - RNA, 15 nt, Human herpesvirus 1
uggcccuggcucccg

SEQ ID NO: 1752964 - RNA, 18 nt, Human herpesvirus 1
cugcugcggcccacccug

SEQ ID NO: 1752965 - RNA, 21 nt, Human herpesvirus 1
gucuggagacccuaugguaca

SEQ ID NO: 1752966 - RNA, 12 nt, Human herpesvirus 1
gcagggcccgcc

SEQ ID NO: 1752967 - RNA, 17 nt, Human herpesvirus 1
augucccucauuuuaca

SEQ ID NO: 1752968 - RNA, 18 nt, Human herpesvirus 1
guggacgccggggccuug

SEQ ID NO: 1752969 - RNA, 22 nt, Human herpesvirus 1
cagcagacgcugcuccgccugg

SEQ ID NO: 1752970 - RNA, 21 nt, Human herpesvirus 1
cgaccgccaacaauccccagg

SEQ ID NO: 1752971 - RNA, 17 nt, Human herpesvirus 1
cgggcccccggccgccg

SEQ ID NO: 1752972 - RNA, 23 nt, Human herpesvirus 1
acccgccccuaaccaggccucca

SEQ ID NO: 1752973 - RNA, 22 nt, Human herpesvirus 1
gaaggagacaauaccggaagga

SEQ ID NO: 1752974 - RNA, 20 nt, Human herpesvirus 1
cacaugggggaggugccccc

SEQ ID NO: 1752975 - RNA, 15 nt, Human herpesvirus 1
gggagggcagggccg

SEQ ID NO: 1752976 - RNA, 13 nt, Human herpesvirus 1
agcauaccugggu

SEQ ID NO: 1752977 - RNA, 21 nt, Human herpesvirus 1
gcaggcgccuccggggguccg

SEQ ID NO: 1752978 - RNA, 23 nt, Human herpesvirus 1
accggacccgcaucccccgucug

SEQ ID NO: 1752979 - RNA, 18 nt, Human herpesvirus 1
caauuugcacccagccuu

SEQ ID NO: 1752980 - RNA, 20 nt, Human herpesvirus 1
gccaccauccucaagcaggc

SEQ ID NO: 1752981 - RNA, 22 nt, Human herpesvirus 1
augggucccaauuggccguccc

SEQ ID NO: 1752982 - RNA, 18 nt, Human herpesvirus 1
cgguggugcccagcggcc

SEQ ID NO: 1752983 - RNA, 16 nt, Human herpesvirus 1
guggaggcgcggcgcc

SEQ ID NO: 1752984 - RNA, 12 nt, Human herpesvirus 1
ggccgggagcgc

SEQ ID NO: 1752985 - RNA, 16 nt, Human herpesvirus 1
cugauguggcugcucc

SEQ ID NO: 1752986 - RNA, 20 nt, Human herpesvirus 1
ccuaaacgcaccgucggagg

SEQ ID NO: 1752987 - RNA, 17 nt, Human herpesvirus 1
acagcuucagcgccguc

SEQ ID NO: 1752988 - RNA, 20 nt, Human herpesvirus 1
agugaaagacacgggcacca

SEQ ID NO: 1752989 - RNA, 20 nt, Human herpesvirus 1
ucugcuccgcaacggggcgc

SEQ ID NO: 1752990 - RNA, 17 nt, Human herpesvirus 1
cccuggugaagaccacu

SEQ ID NO: 1752991 - RNA, 14 nt, Human herpesvirus 1
ccuggaugcugugg

SEQ ID NO: 1752992 - RNA, 12 nt, Human herpesvirus 1
cgaaggcugccg

SEQ ID NO: 1752993 - RNA, 22 nt, Human herpesvirus 1
accgcccaaugggccgggccgc

SEQ ID NO: 1752994 - RNA, 16 nt, Human herpesvirus 1
ugcgguccggagccgc

SEQ ID NO: 1752995 - RNA, 13 nt, Human herpesvirus 1
cuccucuucuccc

SEQ ID NO: 1752996 - RNA, 14 nt, Human herpesvirus 1
cguaaacggcgggc

SEQ ID NO: 1752997 - RNA, 21 nt, Human herpesvirus 1
gccccauacucccgccagcac

SEQ ID NO: 1752998 - RNA, 18 nt, Human herpesvirus 1
gacacaaaugcccacggg

SEQ ID NO: 1752999 - RNA, 20 nt, Human herpesvirus 1
cccucgaccaccauccccgc

SEQ ID NO: 1753000 - RNA, 14 nt, Human herpesvirus 1
gccccuguggcccu

SEQ ID NO: 1753001 - RNA, 18 nt, Human herpesvirus 1
cgcggcggggcccggcca

SEQ ID NO: 1753002 - RNA, 17 nt, Human herpesvirus 1
ggcgaggccggcgccga

SEQ ID NO: 1753003 - RNA, 20 nt, Human herpesvirus 1
cgccucucgcugcuggcgga

SEQ ID NO: 1753004 - RNA, 12 nt, Human herpesvirus 1
ccaucagccucg

SEQ ID NO: 1753005 - RNA, 20 nt, Human herpesvirus 1
ccggcgcguguaccacaucc

SEQ ID NO: 1753006 - RNA, 11 nt, Human herpesvirus 1
gggacugggca

SEQ ID NO: 1753007 - RNA, 17 nt, Human herpesvirus 1
cccaacccccggcccca

SEQ ID NO: 1753008 - RNA, 22 nt, Human herpesvirus 1
ccggucgccccgacccccuugu

SEQ ID NO: 1753009 - RNA, 22 nt, Human herpesvirus 1
gcugaugucccucauuuuacaa

SEQ ID NO: 1753010 - RNA, 18 nt, Human herpesvirus 1
cacuucccgguaugguaa

SEQ ID NO: 1753011 - RNA, 19 nt, Human herpesvirus 1
gcgcggaugcucggcgacg

SEQ ID NO: 1753012 - RNA, 15 nt, Human herpesvirus 1
gcagccuucucccgg

SEQ ID NO: 1753013 - RNA, 20 nt, Human herpesvirus 1
ccaacucucgcaccaucccg

SEQ ID NO: 1753014 - RNA, 17 nt, Human herpesvirus 1
accgucggaggcccccc

SEQ ID NO: 1753015 - RNA, 16 nt, Human herpesvirus 1
cgcacgagccggggcu

SEQ ID NO: 1753016 - RNA, 17 nt, Human herpesvirus 1
gucagcuccucgcgcgg

SEQ ID NO: 1753017 - RNA, 20 nt, Human herpesvirus 1
ucugggauggcuccuggcca

SEQ ID NO: 1753018 - RNA, 21 nt, Human herpesvirus 1
guauguccccaaaauaaaaga

SEQ ID NO: 1753019 - RNA, 18 nt, Human herpesvirus 1
ucugggguuugcccuccc

SEQ ID NO: 1753020 - RNA, 21 nt, Human herpesvirus 1
accagcgggucuuuuguguug

SEQ ID NO: 1753021 - RNA, 18 nt, Human herpesvirus 1
guugcugcgcggcgcccg

SEQ ID NO: 1753022 - RNA, 15 nt, Human herpesvirus 1
acggcgucugggcca

SEQ ID NO: 1753023 - RNA, 20 nt, Human herpesvirus 1
gugccgcccguugcagggcc

SEQ ID NO: 1753024 - RNA, 17 nt, Human herpesvirus 1
acccccaacgccacgca

SEQ ID NO: 1753025 - RNA, 17 nt, Human herpesvirus 1
caccccgcaauuugcac

SEQ ID NO: 1753026 - RNA, 16 nt, Human herpesvirus 1
gagccuguuguggcuc

SEQ ID NO: 1753027 - RNA, 20 nt, Human herpesvirus 1
gcugaagcacaacgccagcc

SEQ ID NO: 1753028 - RNA, 15 nt, Human herpesvirus 1
ucugggggccugucc

SEQ ID NO: 1753029 - RNA, 14 nt, Human herpesvirus 1
uaccgaccacaccg

SEQ ID NO: 1753030 - RNA, 18 nt, Human herpesvirus 1
cucuggccgcgcccacua

SEQ ID NO: 1753031 - RNA, 22 nt, Human herpesvirus 1
guggguuuuuuaaaaacgacac

SEQ ID NO: 1753032 - RNA, 22 nt, Human herpesvirus 1
gagcuucgcuuugugggggacc

SEQ ID NO: 1753033 - RNA, 18 nt, Human herpesvirus 1
agcgcacugcccgacgcc

SEQ ID NO: 1753034 - RNA, 12 nt, Human herpesvirus 1
ccgggagccccg

SEQ ID NO: 1753035 - RNA, 20 nt, Human herpesvirus 1
ugggguggaucuuagccucc

SEQ ID NO: 1753036 - RNA, 22 nt, Human herpesvirus 1
gaacacggggacggcggggcag

SEQ ID NO: 1753037 - RNA, 13 nt, Human herpesvirus 1
gaucggcgccgcg

SEQ ID NO: 1753038 - RNA, 14 nt, Human herpesvirus 1
gcccugaugcagga

SEQ ID NO: 1753039 - RNA, 18 nt, Human herpesvirus 1
agacaccuuggcccuggc

SEQ ID NO: 1753040 - RNA, 11 nt, Human herpesvirus 1
ccuugccgugg

SEQ ID NO: 1753041 - RNA, 14 nt, Human herpesvirus 1
cugccagaccucaa

SEQ ID NO: 1753042 - RNA, 17 nt, Human herpesvirus 1
cgaccgcagucccugag

SEQ ID NO: 1753043 - RNA, 16 nt, Human herpesvirus 1
guuccggaggcgccgc

SEQ ID NO: 1753044 - RNA, 13 nt, Human herpesvirus 1
ccuggacgcggca

SEQ ID NO: 1753045 - RNA, 19 nt, Human herpesvirus 1
cgcgggcgacgccccggcc

SEQ ID NO: 1753046 - RNA, 23 nt, Human herpesvirus 1
ugucccauccgaacgcagccccg

SEQ ID NO: 1753047 - RNA, 19 nt, Human herpesvirus 1
cgcgcgggggcgccggugg

SEQ ID NO: 1753048 - RNA, 22 nt, Human herpesvirus 1
ggcccgggggacucacuaccca

SEQ ID NO: 1753049 - RNA, 16 nt, Human herpesvirus 1
acucgacccacugccu

SEQ ID NO: 1753050 - RNA, 11 nt, Human herpesvirus 1
acuccuccccg

SEQ ID NO: 1753051 - RNA, 18 nt, Human herpesvirus 1
aagucucugggggccugu

SEQ ID NO: 1753052 - RNA, 14 nt, Human herpesvirus 1
cggggcuggcacac

SEQ ID NO: 1753053 - RNA, 21 nt, Human herpesvirus 1
acggcgccggggcucucgggg

SEQ ID NO: 1753054 - RNA, 23 nt, Human herpesvirus 1
aggugcuucuguuuggcgccccc

SEQ ID NO: 1753055 - RNA, 16 nt, Human herpesvirus 1
ccacuacaccagccaa

SEQ ID NO: 1753056 - RNA, 18 nt, Human herpesvirus 1
cacaugcggaaagcaaga

SEQ ID NO: 1753057 - RNA, 14 nt, Human herpesvirus 1
cgccccuuuccccc

SEQ ID NO: 1753058 - RNA, 13 nt, Human herpesvirus 1
cgcgcgaccucac

SEQ ID NO: 1753059 - RNA, 19 nt, Human herpesvirus 1
cccuguggaacgaggcccg

SEQ ID NO: 1753060 - RNA, 19 nt, Human herpesvirus 1
ggcuuccgacgccccccgu

SEQ ID NO: 1753061 - RNA, 22 nt, Human herpesvirus 1
uggaacgaggccgcagccuucu

SEQ ID NO: 1753062 - RNA, 16 nt, Human herpesvirus 1
ccggcggggccucacg

SEQ ID NO: 1753063 - RNA, 15 nt, Human herpesvirus 1
ccaccaaggcccggg

SEQ ID NO: 1753064 - RNA, 16 nt, Human herpesvirus 1
gguuagacccaugggu

SEQ ID NO: 1753065 - RNA, 16 nt, Human herpesvirus 1
gacgaaaagccccggg

SEQ ID NO: 1753066 - RNA, 19 nt, Human herpesvirus 1
ccuggcgguccagggggau

SEQ ID NO: 1753067 - RNA, 20 nt, Human herpesvirus 1
cgcgcccacuacaccagcca

SEQ ID NO: 1753068 - RNA, 19 nt, Human herpesvirus 1
agccccggucuccccggga

SEQ ID NO: 1753069 - RNA, 17 nt, Human herpesvirus 1
acgccuaccggccccug

SEQ ID NO: 1753070 - RNA, 14 nt, Human herpesvirus 1
gcgccucuggacug

SEQ ID NO: 1753071 - RNA, 17 nt, Human herpesvirus 1
accccggagggcugcca

SEQ ID NO: 1753072 - RNA, 22 nt, Human herpesvirus 1
auaagcuugccguuaagaccau

SEQ ID NO: 1753073 - RNA, 19 nt, Human herpesvirus 1
cacgagcacccugcugccc

SEQ ID NO: 1753074 - RNA, 14 nt, Human herpesvirus 1
cauuaucccauucc

SEQ ID NO: 1753075 - RNA, 21 nt, Human herpesvirus 1
gacauuccgcuaucuccuggg

SEQ ID NO: 1753076 - RNA, 20 nt, Human herpesvirus 1
cacucccgucucgcugcccu

SEQ ID NO: 1753077 - RNA, 16 nt, Human herpesvirus 1
gugaucagcacgccac

SEQ ID NO: 1753078 - RNA, 19 nt, Human herpesvirus 1
cugucucgucuccucuucu

SEQ ID NO: 1753079 - RNA, 21 nt, Human herpesvirus 1
guggagcaaaacgccuccccc

SEQ ID NO: 1753080 - RNA, 19 nt, Human herpesvirus 1
cccccguguuuguggggag

SEQ ID NO: 1753081 - RNA, 14 nt, Human herpesvirus 1
gcaccccccccaaa

SEQ ID NO: 1753082 - RNA, 20 nt, Human herpesvirus 1
ccugcuacagccgcccccug

SEQ ID NO: 1753083 - RNA, 17 nt, Human herpesvirus 1
ccagcugagccgcgccg

SEQ ID NO: 1753084 - RNA, 19 nt, Human herpesvirus 1
gcgggguugggaugggacc

SEQ ID NO: 1753085 - RNA, 15 nt, Human herpesvirus 1
gaucgccugucuccu

SEQ ID NO: 1753086 - RNA, 14 nt, Human herpesvirus 1
cuccccccgcguca

SEQ ID NO: 1753087 - RNA, 14 nt, Human herpesvirus 1
acgacgcccgccgc

SEQ ID NO: 1753088 - RNA, 20 nt, Human herpesvirus 1
gccacccaggcgcugggcga

SEQ ID NO: 1753089 - RNA, 18 nt, Human herpesvirus 1
gaaacuuaacacaccaaa

SEQ ID NO: 1753090 - RNA, 15 nt, Human herpesvirus 1
uccugcgccccgccg

SEQ ID NO: 1753091 - RNA, 19 nt, Human herpesvirus 1
aaagggauacacaaacuuc

SEQ ID NO: 1753092 - RNA, 16 nt, Human herpesvirus 1
gccccauacacgagca

SEQ ID NO: 1753093 - RNA, 14 nt, Human herpesvirus 1
cgcagcugggaccc

SEQ ID NO: 1753094 - RNA, 17 nt, Human herpesvirus 1
uaaccgcgagcgccgcu

SEQ ID NO: 1753095 - RNA, 19 nt, Human herpesvirus 1
gcccccaacaugacccaga

SEQ ID NO: 1753096 - RNA, 17 nt, Human herpesvirus 1
ggacgaccugugauggg

SEQ ID NO: 1753097 - RNA, 23 nt, Human herpesvirus 1
cgucucccgggggcgcuuggccg

SEQ ID NO: 1753098 - RNA, 13 nt, Human herpesvirus 1
caggccccccgcc

SEQ ID NO: 1753099 - RNA, 19 nt, Human herpesvirus 1
ggggauggggagagcccac

SEQ ID NO: 1753100 - RNA, 17 nt, Human herpesvirus 1
gcccacgucgccccgcc

SEQ ID NO: 1753101 - RNA, 21 nt, Human herpesvirus 1
ggaguacgcguacucccacca

SEQ ID NO: 1753102 - RNA, 14 nt, Human herpesvirus 1
ccuaccccaguccc

SEQ ID NO: 1753103 - RNA, 14 nt, Human herpesvirus 1
ggcucggcuccccg

SEQ ID NO: 1753104 - RNA, 16 nt, Human herpesvirus 1
caccccgcaauuugca

SEQ ID NO: 1753105 - RNA, 20 nt, Human herpesvirus 1
ucuuccgcggagcucccggg

SEQ ID NO: 1753106 - RNA, 16 nt, Human herpesvirus 1
gcaucccaggaucaca

SEQ ID NO: 1753107 - RNA, 18 nt, Human herpesvirus 1
cuccgacgacgcgcagcc

SEQ ID NO: 1753108 - RNA, 17 nt, Human herpesvirus 1
gcuaagugcccaggacg

SEQ ID NO: 1753109 - RNA, 15 nt, Human herpesvirus 1
accccauggacccca

SEQ ID NO: 1753110 - RNA, 15 nt, Human herpesvirus 1
cgaccgacuccccgc

SEQ ID NO: 1753111 - RNA, 13 nt, Human herpesvirus 1
gccauccccgcgu

SEQ ID NO: 1753112 - RNA, 18 nt, Human herpesvirus 1
cuggccgggagcaccaca

SEQ ID NO: 1753113 - RNA, 13 nt, Human herpesvirus 1
cucccagggagcc

SEQ ID NO: 1753114 - RNA, 20 nt, Human herpesvirus 1
aguucaccguggccugggac

SEQ ID NO: 1753115 - RNA, 18 nt, Human herpesvirus 1
ggcuugguucggggccgc

SEQ ID NO: 1753116 - RNA, 23 nt, Human herpesvirus 1
ucacgcgggaggccgcccagcuc

SEQ ID NO: 1753117 - RNA, 17 nt, Human herpesvirus 1
accgggcccggccaggc

SEQ ID NO: 1753118 - RNA, 14 nt, Human herpesvirus 1
ucgagaugggccag

SEQ ID NO: 1753119 - RNA, 23 nt, Human herpesvirus 1
agggggucugucgguccacggcc

SEQ ID NO: 1753120 - RNA, 21 nt, Human herpesvirus 1
gccgagucuucggggcccggc

SEQ ID NO: 1753121 - RNA, 15 nt, Human herpesvirus 1
aacgccagccugcgg

SEQ ID NO: 1753122 - RNA, 17 nt, Human herpesvirus 1
cacccgggugcuuccca

SEQ ID NO: 1753123 - RNA, 23 nt, Human herpesvirus 1
ccgcgauuccgagggccgggccc

SEQ ID NO: 1753124 - RNA, 17 nt, Human herpesvirus 1
cggcguuaaccgcaccc

SEQ ID NO: 1753125 - RNA, 15 nt, Human herpesvirus 1
ccguuggcccccgcc

SEQ ID NO: 1753126 - RNA, 22 nt, Human herpesvirus 1
gccccgcauaucccacccugga

SEQ ID NO: 1753127 - RNA, 14 nt, Human herpesvirus 1
cccaugggucccaa

SEQ ID NO: 1753128 - RNA, 17 nt, Human herpesvirus 1
gcgcagaggcggccaga

SEQ ID NO: 1753129 - RNA, 16 nt, Human herpesvirus 1
cgguccccucugggcc

SEQ ID NO: 1753130 - RNA, 18 nt, Human herpesvirus 1
cagccauauccugagccc

SEQ ID NO: 1753131 - RNA, 22 nt, Human herpesvirus 1
ccaccugcgcucccucagcauc

SEQ ID NO: 1753132 - RNA, 13 nt, Human herpesvirus 1
ucaccguggccug

SEQ ID NO: 1753133 - RNA, 15 nt, Human herpesvirus 1
ccaggccuccacccc

SEQ ID NO: 1753134 - RNA, 17 nt, Human herpesvirus 1
gccgcggaucugcuccg

SEQ ID NO: 1753135 - RNA, 17 nt, Human herpesvirus 1
ugucgucucucuucccc

SEQ ID NO: 1753136 - RNA, 23 nt, Human herpesvirus 1
cggcuggcgcggugccugacgcc

SEQ ID NO: 1753137 - RNA, 21 nt, Human herpesvirus 1
uccgccgagucuucggggccc

SEQ ID NO: 1753138 - RNA, 21 nt, Human herpesvirus 1
cagucgcccgaagacaccccc

SEQ ID NO: 1753139 - RNA, 18 nt, Human herpesvirus 1
ucgaugacgucccggcuc

SEQ ID NO: 1753140 - RNA, 16 nt, Human herpesvirus 1
ucgccgcggcucccgg

SEQ ID NO: 1753141 - RNA, 22 nt, Human herpesvirus 1
ggcgacaacgcgaccgucgccg

SEQ ID NO: 1753142 - RNA, 22 nt, Human herpesvirus 1
cccggaagagccugccgccuca

SEQ ID NO: 1753143 - RNA, 19 nt, Human herpesvirus 1
cugggucugugccaccagc

SEQ ID NO: 1753144 - RNA, 16 nt, Human herpesvirus 1
gacgccguggcgcccc

SEQ ID NO: 1753145 - RNA, 15 nt, Human herpesvirus 1
acgaguccauccugc

SEQ ID NO: 1753146 - RNA, 22 nt, Human herpesvirus 1
aguacaaccccucgcgggugga

SEQ ID NO: 1753147 - RNA, 18 nt, Human herpesvirus 1
gcauggcgcagcugggac

SEQ ID NO: 1753148 - RNA, 15 nt, Human herpesvirus 1
cagggaccuccugga

SEQ ID NO: 1753149 - RNA, 15 nt, Human herpesvirus 1
ggacccgccccggag

SEQ ID NO: 1753150 - RNA, 14 nt, Human herpesvirus 1
cucgcggcccgggg

SEQ ID NO: 1753151 - RNA, 19 nt, Human herpesvirus 1
accacgugcacagccuggc

SEQ ID NO: 1753152 - RNA, 19 nt, Human herpesvirus 1
acggaacacaaggccaaga

SEQ ID NO: 1753153 - RNA, 11 nt, Human herpesvirus 1
gagcuaugggc

SEQ ID NO: 1753154 - RNA, 16 nt, Human herpesvirus 1
cgccccuaaccaggcc

SEQ ID NO: 1753155 - RNA, 16 nt, Human herpesvirus 1
guuuccgcgacccacc

SEQ ID NO: 1753156 - RNA, 13 nt, Human herpesvirus 1
accacacaccagc

SEQ ID NO: 1753157 - RNA, 17 nt, Human herpesvirus 1
gaaaccccagcauaccu

SEQ ID NO: 1753158 - RNA, 19 nt, Human herpesvirus 1
cugcaagaggucgucgggg

SEQ ID NO: 1753159 - RNA, 13 nt, Human herpesvirus 1
ugccgggaacgcu

SEQ ID NO: 1753160 - RNA, 20 nt, Human herpesvirus 1
ucccccuccgcaucccagga

SEQ ID NO: 1753161 - RNA, 16 nt, Human herpesvirus 1
acgcacgccaaugccc

SEQ ID NO: 1753162 - RNA, 16 nt, Human herpesvirus 1
acccagccuuuaacua

SEQ ID NO: 1753163 - RNA, 13 nt, Human herpesvirus 1
gcgggggaugggg

SEQ ID NO: 1753164 - RNA, 17 nt, Human herpesvirus 1
cugucgguccacggcca

SEQ ID NO: 1753165 - RNA, 16 nt, Human herpesvirus 1
uguuuucguggacucg

SEQ ID NO: 1753166 - RNA, 14 nt, Human herpesvirus 1
cgggcgcgcccucu

SEQ ID NO: 1753167 - RNA, 22 nt, Human herpesvirus 1
cgggcgggugaacgagccgacg

SEQ ID NO: 1753168 - RNA, 14 nt, Human herpesvirus 1
cgucgcgggacccg

SEQ ID NO: 1753169 - RNA, 17 nt, Human herpesvirus 1
gaaugugugcggagguc

SEQ ID NO: 1753170 - RNA, 16 nt, Human herpesvirus 1
ccucuggacuggacca

SEQ ID NO: 1753171 - RNA, 20 nt, Human herpesvirus 1
cgcacucgagcggcgugggc

SEQ ID NO: 1753172 - RNA, 13 nt, Human herpesvirus 1
ucgccgcggcucc

SEQ ID NO: 1753173 - RNA, 20 nt, Human herpesvirus 1
acccucuggacgcccgggcg

SEQ ID NO: 1753174 - RNA, 21 nt, Human herpesvirus 1
ggggacgcgcaccuguuccgc

SEQ ID NO: 1753175 - RNA, 21 nt, Human herpesvirus 1
gcccucgcgggccucgugggc

SEQ ID NO: 1753176 - RNA, 22 nt, Human herpesvirus 1
gccccuaaccaggccuccaccc

SEQ ID NO: 1753177 - RNA, 15 nt, Human herpesvirus 1
gcucggccuauggcu

SEQ ID NO: 1753178 - RNA, 20 nt, Human herpesvirus 1
cugcugcccccggagcuguc

SEQ ID NO: 1753179 - RNA, 19 nt, Human herpesvirus 1
cggcauucgggccugccug

SEQ ID NO: 1753180 - RNA, 20 nt, Human herpesvirus 1
aaccuucgcaacaccucccc

SEQ ID NO: 1753181 - RNA, 16 nt, Human herpesvirus 1
cuuaccgccacaggaa

SEQ ID NO: 1753182 - RNA, 16 nt, Human herpesvirus 1
cgaccgccagccgcgg

SEQ ID NO: 1753183 - RNA, 13 nt, Human herpesvirus 1
caccacccaaccc

SEQ ID NO: 1753184 - RNA, 23 nt, Human herpesvirus 1
caugggaugucuuacuguauauc

SEQ ID NO: 1753185 - RNA, 21 nt, Human herpesvirus 1
gcaacggcgggagcuggguua

SEQ ID NO: 1753186 - RNA, 18 nt, Human herpesvirus 1
guccuggaugcuguggac

SEQ ID NO: 1753187 - RNA, 15 nt, Human herpesvirus 1
gcaccgggcccccgc

SEQ ID NO: 1753188 - RNA, 19 nt, Human herpesvirus 1
aggcgcauaaagggccggu

SEQ ID NO: 1753189 - RNA, 17 nt, Human herpesvirus 1
cuuccggaccugcucuc

SEQ ID NO: 1753190 - RNA, 13 nt, Human herpesvirus 1
cccccgcgcggcu

SEQ ID NO: 1753191 - RNA, 20 nt, Human herpesvirus 1
agcgucccugggcccuggcc

SEQ ID NO: 1753192 - RNA, 16 nt, Human herpesvirus 1
cuaaccaggccuccac

SEQ ID NO: 1753193 - RNA, 15 nt, Human herpesvirus 1
uccccgggagccccg

SEQ ID NO: 1753194 - RNA, 13 nt, Human herpesvirus 1
uccguccccugcc

SEQ ID NO: 1753195 - RNA, 15 nt, Human herpesvirus 1
gugggggugccccaa

SEQ ID NO: 1753196 - RNA, 11 nt, Human herpesvirus 1
uuacagccccc

SEQ ID NO: 1753197 - RNA, 12 nt, Human herpesvirus 1
ccgagccaaggg

SEQ ID NO: 1753198 - RNA, 18 nt, Human herpesvirus 1
ccucgaugacgucccggc

SEQ ID NO: 1753199 - RNA, 13 nt, Human herpesvirus 1
ggcaucggaacac

SEQ ID NO: 1753200 - RNA, 16 nt, Human herpesvirus 1
ccuggcuggccgcucg

SEQ ID NO: 1753201 - RNA, 17 nt, Human herpesvirus 1
ggcgggggauggggaga

SEQ ID NO: 1753202 - RNA, 22 nt, Human herpesvirus 1
ggcaagcccuacaccggccacc

SEQ ID NO: 1753203 - RNA, 15 nt, Human herpesvirus 1
uuccgguaugggggg

SEQ ID NO: 1753204 - RNA, 14 nt, Human herpesvirus 1
gaacgcagccccgc

SEQ ID NO: 1753205 - RNA, 14 nt, Human herpesvirus 1
cggcuaccuggccc

SEQ ID NO: 1753206 - RNA, 20 nt, Human herpesvirus 1
caucgguguguccuuuuggg

SEQ ID NO: 1753207 - RNA, 13 nt, Human herpesvirus 1
cuuuccccaugcg

SEQ ID NO: 1753208 - RNA, 15 nt, Human herpesvirus 1
ugacggccaucgccg

SEQ ID NO: 1753209 - RNA, 14 nt, Human herpesvirus 1
acgcgaaggacgcc

SEQ ID NO: 1753210 - RNA, 23 nt, Human herpesvirus 1
gccccggagggagaacccgacca

SEQ ID NO: 1753211 - RNA, 17 nt, Human herpesvirus 1
ugcgugccggucgccgc

SEQ ID NO: 1753212 - RNA, 17 nt, Human herpesvirus 1
ugccaguccgcugcacc

SEQ ID NO: 1753213 - RNA, 12 nt, Human herpesvirus 1
cucgaccaccau

SEQ ID NO: 1753214 - RNA, 18 nt, Human herpesvirus 1
cccgcaaacaggagcugu

SEQ ID NO: 1753215 - RNA, 16 nt, Human herpesvirus 1
guaacggcauaugcaa

SEQ ID NO: 1753216 - RNA, 22 nt, Human herpesvirus 1
cuuauccacaugaagccacugu

SEQ ID NO: 1753217 - RNA, 15 nt, Human herpesvirus 1
cgcgagcgaggcccc

SEQ ID NO: 1753218 - RNA, 19 nt, Human herpesvirus 1
cgaggcgauuagccagcag

SEQ ID NO: 1753219 - RNA, 13 nt, Human herpesvirus 1
ccccuggcgagcc

SEQ ID NO: 1753220 - RNA, 15 nt, Human herpesvirus 1
gccccuggcgccgcc

SEQ ID NO: 1753221 - RNA, 17 nt, Human herpesvirus 1
gaccgcagucccugagu

SEQ ID NO: 1753222 - RNA, 15 nt, Human herpesvirus 1
cggccucuccggccu

SEQ ID NO: 1753223 - RNA, 15 nt, Human herpesvirus 1
ccagcuaugggcccu

SEQ ID NO: 1753224 - RNA, 16 nt, Human herpesvirus 1
cugccccgccacccag

SEQ ID NO: 1753225 - RNA, 17 nt, Human herpesvirus 1
gcaugaagcccccaaca

SEQ ID NO: 1753226 - RNA, 15 nt, Human herpesvirus 1
cggccguugucuccc

SEQ ID NO: 1753227 - RNA, 14 nt, Human herpesvirus 1
cgcccaccuccugg

SEQ ID NO: 1753228 - RNA, 10 nt, Human herpesvirus 1
cacacacccu

SEQ ID NO: 1753229 - RNA, 17 nt, Human herpesvirus 1
ccgaggcgauuagccag

SEQ ID NO: 1753230 - RNA, 20 nt, Human herpesvirus 1
ccaacccggacgcguccggg

SEQ ID NO: 1753231 - RNA, 17 nt, Human herpesvirus 1
cccucucuucccucagg

SEQ ID NO: 1753232 - RNA, 11 nt, Human herpesvirus 1
cgcccccggca

SEQ ID NO: 1753233 - RNA, 14 nt, Human herpesvirus 1
guggcaccucccca

SEQ ID NO: 1753234 - RNA, 19 nt, Human herpesvirus 1
ccacgacccgacucaccuc

SEQ ID NO: 1753235 - RNA, 21 nt, Human herpesvirus 1
ggaccaggucccccacaccac

SEQ ID NO: 1753236 - RNA, 15 nt, Human herpesvirus 1
cacggcguggagcaa

SEQ ID NO: 1753237 - RNA, 20 nt, Human herpesvirus 1
ugacccuaggaggccgccac

SEQ ID NO: 1753238 - RNA, 18 nt, Human herpesvirus 1
gccccgggccgcgucgcc

SEQ ID NO: 1753239 - RNA, 15 nt, Human herpesvirus 1
uccaggucccaccug

SEQ ID NO: 1753240 - RNA, 15 nt, Human herpesvirus 1
accgcgagcgccgcu

SEQ ID NO: 1753241 - RNA, 16 nt, Human herpesvirus 1
gacaccgcguguuccc

SEQ ID NO: 1753242 - RNA, 19 nt, Human herpesvirus 1
cuguggaacgaggcccgca

SEQ ID NO: 1753243 - RNA, 14 nt, Human herpesvirus 1
ggaccccacgacac

SEQ ID NO: 1753244 - RNA, 23 nt, Human herpesvirus 1
gacgucccggcucuccgauccca

SEQ ID NO: 1753245 - RNA, 18 nt, Human herpesvirus 1
cuggccgacguggcgcac

SEQ ID NO: 1753246 - RNA, 17 nt, Human herpesvirus 1
aacgccuccccuguugg

SEQ ID NO: 1753247 - RNA, 13 nt, Human herpesvirus 1
cagcagcucccca

SEQ ID NO: 1753248 - RNA, 20 nt, Human herpesvirus 1
cacaacggcaugccucugcg

SEQ ID NO: 1753249 - RNA, 15 nt, Human herpesvirus 1
ccuucccucccccuc

SEQ ID NO: 1753250 - RNA, 22 nt, Human herpesvirus 1
acauaaccgaccgcagucccug

SEQ ID NO: 1753251 - RNA, 22 nt, Human herpesvirus 1
gaacgccuccgcccgugcugcc

SEQ ID NO: 1753252 - RNA, 19 nt, Human herpesvirus 1
ggaucugguccgccgcgag

SEQ ID NO: 1753253 - RNA, 20 nt, Human herpesvirus 1
gcggcugguccacacccagu

SEQ ID NO: 1753254 - RNA, 17 nt, Human herpesvirus 1
cuggcgagcccagaccc

SEQ ID NO: 1753255 - RNA, 19 nt, Human herpesvirus 1
acucccgacaccaccagcu

SEQ ID NO: 1753256 - RNA, 13 nt, Human herpesvirus 1
aacaugggccuga

SEQ ID NO: 1753257 - RNA, 18 nt, Human herpesvirus 1
cagggcucuacccucugg

SEQ ID NO: 1753258 - RNA, 19 nt, Human herpesvirus 1
cagaccccuucuccccaca

SEQ ID NO: 1753259 - RNA, 21 nt, Human herpesvirus 1
agugggcguggcuucggccgu

SEQ ID NO: 1753260 - RNA, 22 nt, Human herpesvirus 1
gcuuuaucccacggccucgcca

SEQ ID NO: 1753261 - RNA, 16 nt, Human herpesvirus 1
cgaggaggugaucgac

SEQ ID NO: 1753262 - RNA, 20 nt, Human herpesvirus 1
cuguaaguacgcccucccgc

SEQ ID NO: 1753263 - RNA, 21 nt, Human herpesvirus 1
ggcucguggcgucucgccgga

SEQ ID NO: 1753264 - RNA, 12 nt, Human herpesvirus 1
gagcaccccccc

SEQ ID NO: 1753265 - RNA, 15 nt, Human herpesvirus 1
ccagcgaccucgccg

SEQ ID NO: 1753266 - RNA, 17 nt, Human herpesvirus 1
ccacaugcggaaagcaa

SEQ ID NO: 1753267 - RNA, 15 nt, Human herpesvirus 1
cagauagagcugcuc

SEQ ID NO: 1753268 - RNA, 17 nt, Human herpesvirus 1
gcccgcgggaggccgcc

SEQ ID NO: 1753269 - RNA, 16 nt, Human herpesvirus 1
cucgucuccucuucuc

SEQ ID NO: 1753270 - RNA, 14 nt, Human herpesvirus 1
gcgcgaccucacca

SEQ ID NO: 1753271 - RNA, 12 nt, Human herpesvirus 1
cccucucuuccc

SEQ ID NO: 1753272 - RNA, 14 nt, Human herpesvirus 1
caucgccucggcca

SEQ ID NO: 1753273 - RNA, 14 nt, Human herpesvirus 1
gcggugacgaacgc

SEQ ID NO: 1753274 - RNA, 17 nt, Human herpesvirus 1
gccaaguuggcccccgg

SEQ ID NO: 1753275 - RNA, 20 nt, Human herpesvirus 1
uugccgugguccuguggagc

SEQ ID NO: 1753276 - RNA, 12 nt, Human herpesvirus 1
aggcggccuggg

SEQ ID NO: 1753277 - RNA, 22 nt, Human herpesvirus 1
gacgcgccccaaggcgcugcgg

SEQ ID NO: 1753278 - RNA, 15 nt, Human herpesvirus 1
ggaccaccgcccccc

SEQ ID NO: 1753279 - RNA, 19 nt, Human herpesvirus 1
cgggaccugaaccccagcc

SEQ ID NO: 1753280 - RNA, 12 nt, Human herpesvirus 1
ccccaaggaggg

SEQ ID NO: 1753281 - RNA, 16 nt, Human herpesvirus 1
gcgggcgacgcacaca

SEQ ID NO: 1753282 - RNA, 14 nt, Human herpesvirus 1
gcccugcugcugcc

SEQ ID NO: 1753283 - RNA, 20 nt, Human herpesvirus 1
cggcgggcacgccaagcccc

SEQ ID NO: 1753284 - RNA, 19 nt, Human herpesvirus 1
cgccccccaaaccaugucc

SEQ ID NO: 1753285 - RNA, 17 nt, Human herpesvirus 1
uguaacuucgacccgca

SEQ ID NO: 1753286 - RNA, 16 nt, Human herpesvirus 1
gccauauccugagccc

SEQ ID NO: 1753287 - RNA, 20 nt, Human herpesvirus 1
ccucccggggucaaccacga

SEQ ID NO: 1753288 - RNA, 14 nt, Human herpesvirus 1
cugcuccgccuggc

SEQ ID NO: 1753289 - RNA, 18 nt, Human herpesvirus 1
gccugucgcacccacagc

SEQ ID NO: 1753290 - RNA, 15 nt, Human herpesvirus 1
gcucgcucucggugc

SEQ ID NO: 1753291 - RNA, 14 nt, Human herpesvirus 1
uaaggucauccgag

SEQ ID NO: 1753292 - RNA, 17 nt, Human herpesvirus 1
ccacgacacccacccca

SEQ ID NO: 1753293 - RNA, 20 nt, Human herpesvirus 1
ccgcugcgcauccccccguc

SEQ ID NO: 1753294 - RNA, 14 nt, Human herpesvirus 1
ccucaucccacccc

SEQ ID NO: 1753295 - RNA, 14 nt, Human herpesvirus 1
cgcggcugguccac

SEQ ID NO: 1753296 - RNA, 15 nt, Human herpesvirus 1
cauuaaccaccugcg

SEQ ID NO: 1753297 - RNA, 23 nt, Human herpesvirus 1
gcccccuuuguccccgccgacaa

SEQ ID NO: 1753298 - RNA, 16 nt, Human herpesvirus 1
guuuaggguaccacag

SEQ ID NO: 1753299 - RNA, 19 nt, Human herpesvirus 1
cgcgacgccauggaccgca

SEQ ID NO: 1753300 - RNA, 15 nt, Human herpesvirus 1
ccggcccuaacccca

SEQ ID NO: 1753301 - RNA, 16 nt, Human herpesvirus 1
cgggaggaagccacaa

SEQ ID NO: 1753302 - RNA, 21 nt, Human herpesvirus 1
cgggccgccucgggggcggga

SEQ ID NO: 1753303 - RNA, 18 nt, Human herpesvirus 1
cggucucccagggagccc

SEQ ID NO: 1753304 - RNA, 21 nt, Human herpesvirus 1
gcccgggggccugguggcacc

SEQ ID NO: 1753305 - RNA, 16 nt, Human herpesvirus 1
cgugauuccucuccgc

SEQ ID NO: 1753306 - RNA, 15 nt, Human herpesvirus 1
cguguuuguggggag

SEQ ID NO: 1753307 - RNA, 20 nt, Human herpesvirus 1
uccacgaacccagcgaccuc

SEQ ID NO: 1753308 - RNA, 20 nt, Human herpesvirus 1
ccugccccccccaccccaga

SEQ ID NO: 1753309 - RNA, 15 nt, Human herpesvirus 1
gucuccccggggccc

SEQ ID NO: 1753310 - RNA, 20 nt, Human herpesvirus 1
accuuccguccccugccccc

SEQ ID NO: 1753311 - RNA, 23 nt, Human herpesvirus 1
gcuggucgucgggcgccaaagcc

SEQ ID NO: 1753312 - RNA, 16 nt, Human herpesvirus 1
ggcggccccggcagcc

SEQ ID NO: 1753313 - RNA, 23 nt, Human herpesvirus 1
cacgcaccucgaggacacccgcg

SEQ ID NO: 1753314 - RNA, 20 nt, Human herpesvirus 1
ugcgccuggauucgcuggac

SEQ ID NO: 1753315 - RNA, 17 nt, Human herpesvirus 1
ggccucccccggacgac

SEQ ID NO: 1753316 - RNA, 15 nt, Human herpesvirus 1
cgacugcccccccca

SEQ ID NO: 1753317 - RNA, 19 nt, Human herpesvirus 1
ggccugggucuuccgcgga

SEQ ID NO: 1753318 - RNA, 23 nt, Human herpesvirus 1
cuugguucggggccgcccuggcc

SEQ ID NO: 1753319 - RNA, 21 nt, Human herpesvirus 1
gcucucgcgcguggaccuggg

SEQ ID NO: 1753320 - RNA, 18 nt, Human herpesvirus 1
ccgaagagucggagcccg

SEQ ID NO: 1753321 - RNA, 13 nt, Human herpesvirus 1
augagccagaccc

SEQ ID NO: 1753322 - RNA, 17 nt, Human herpesvirus 1
ccaggcccgccgccacu

SEQ ID NO: 1753323 - RNA, 13 nt, Human herpesvirus 1
gccucgugggcac

SEQ ID NO: 1753324 - RNA, 21 nt, Human herpesvirus 1
agcugaugucccucauuuuac

SEQ ID NO: 1753325 - RNA, 14 nt, Human herpesvirus 1
cucuccccugcugc

SEQ ID NO: 1753326 - RNA, 14 nt, Human herpesvirus 1
caguauaucaucaa

SEQ ID NO: 1753327 - RNA, 19 nt, Human herpesvirus 1
ccacaacauccgcggcuuc

SEQ ID NO: 1753328 - RNA, 18 nt, Human herpesvirus 1
ugguccacacccaguggc

SEQ ID NO: 1753329 - RNA, 19 nt, Human herpesvirus 1
cguugcagggccuggugcu

SEQ ID NO: 1753330 - RNA, 22 nt, Human herpesvirus 1
aucauugccgcguugguccucg

SEQ ID NO: 1753331 - RNA, 15 nt, Human herpesvirus 1
cugggauggcuccug

SEQ ID NO: 1753332 - RNA, 16 nt, Human herpesvirus 1
ccgggcgcuuggcaug

SEQ ID NO: 1753333 - RNA, 13 nt, Human herpesvirus 1
gaucccaggcgcc

SEQ ID NO: 1753334 - RNA, 13 nt, Human herpesvirus 1
uguguuucagaua

SEQ ID NO: 1753335 - RNA, 13 nt, Human herpesvirus 1
cuggagcucaauc

SEQ ID NO: 1753336 - RNA, 10 nt, Human herpesvirus 1
uaaggccugg

SEQ ID NO: 1753337 - RNA, 12 nt, Human herpesvirus 1
acccaaccccaa

SEQ ID NO: 1753338 - RNA, 14 nt, Human herpesvirus 1
accagcgggucuuu

SEQ ID NO: 1753339 - RNA, 19 nt, Human herpesvirus 1
ggcgccggucgucacgcac

SEQ ID NO: 1753340 - RNA, 18 nt, Human herpesvirus 1
cuuggcggccgcccaacu

SEQ ID NO: 1753341 - RNA, 15 nt, Human herpesvirus 1
aucugacgcgcccca

SEQ ID NO: 1753342 - RNA, 22 nt, Human herpesvirus 1
cagacgaaaagccccgggccgc

SEQ ID NO: 1753343 - RNA, 20 nt, Human herpesvirus 1
accgaccgcagucccugagu

SEQ ID NO: 1753344 - RNA, 22 nt, Human herpesvirus 1
cgacugccagcuaugggcccug

SEQ ID NO: 1753345 - RNA, 19 nt, Human herpesvirus 1
gccggggagggcagggccg

SEQ ID NO: 1753346 - RNA, 21 nt, Human herpesvirus 1
aggccuuguuccgcuucccgg

SEQ ID NO: 1753347 - RNA, 13 nt, Human herpesvirus 1
gcucgggcccgcg

SEQ ID NO: 1753348 - RNA, 11 nt, Human herpesvirus 1
cgcgccugggu

SEQ ID NO: 1753349 - RNA, 20 nt, Human herpesvirus 1
ccguacaaguucaaggccac

SEQ ID NO: 1753350 - RNA, 19 nt, Human herpesvirus 1
caggucccccacaccaccu

SEQ ID NO: 1753351 - RNA, 22 nt, Human herpesvirus 1
ccgggccggagcucgcggcacg

SEQ ID NO: 1753352 - RNA, 21 nt, Human herpesvirus 1
cgcgccuagccaaccuguggc

SEQ ID NO: 1753353 - RNA, 17 nt, Human herpesvirus 1
ugcgcucccgccuuccg

SEQ ID NO: 1753354 - RNA, 15 nt, Human herpesvirus 1
gcucaaucuggccca

SEQ ID NO: 1753355 - RNA, 17 nt, Human herpesvirus 1
uccuucuugucgucucu

SEQ ID NO: 1753356 - RNA, 21 nt, Human herpesvirus 1
ccgcguuugagaccgccggca

SEQ ID NO: 1753357 - RNA, 15 nt, Human herpesvirus 1
uggccgggagcacca

SEQ ID NO: 1753358 - RNA, 17 nt, Human herpesvirus 1
ugcggaaagcaagaaca

SEQ ID NO: 1753359 - RNA, 15 nt, Human herpesvirus 1
acgcgucauaugcaa

SEQ ID NO: 1753360 - RNA, 13 nt, Human herpesvirus 1
cuagggaacccag

SEQ ID NO: 1753361 - RNA, 13 nt, Human herpesvirus 1
cccgcccccgccg

SEQ ID NO: 1753362 - RNA, 18 nt, Human herpesvirus 1
caucggggguugcugucc

SEQ ID NO: 1753363 - RNA, 18 nt, Human herpesvirus 1
agcaucgggaugcugccc

SEQ ID NO: 1753364 - RNA, 13 nt, Human herpesvirus 1
uggggcgcuggcc

SEQ ID NO: 1753365 - RNA, 11 nt, Human herpesvirus 1
cgacgccucaa

SEQ ID NO: 1753366 - RNA, 23 nt, Human herpesvirus 1
uggcagccgaugccccgggagac

SEQ ID NO: 1753367 - RNA, 16 nt, Human herpesvirus 1
gccggacgacgugguc

SEQ ID NO: 1753368 - RNA, 14 nt, Human herpesvirus 1
caagaacaauaaag

SEQ ID NO: 1753369 - RNA, 21 nt, Human herpesvirus 1
ccguggccgacaacugccuga

SEQ ID NO: 1753370 - RNA, 23 nt, Human herpesvirus 1
gaccgacagcacucacagccccg

SEQ ID NO: 1753371 - RNA, 13 nt, Human herpesvirus 1
auccgacaugucc

SEQ ID NO: 1753372 - RNA, 20 nt, Human herpesvirus 1
cgcacaucaaggugggccag

SEQ ID NO: 1753373 - RNA, 21 nt, Human herpesvirus 1
ggaggggggggucgggcgcug

SEQ ID NO: 1753374 - RNA, 19 nt, Human herpesvirus 1
agcgcgcugcucagcgcca

SEQ ID NO: 1753375 - RNA, 21 nt, Human herpesvirus 1
ccuggauucgcuggaccucac

SEQ ID NO: 1753376 - RNA, 23 nt, Human herpesvirus 1
ggaucgccuguugggccuuaucc

SEQ ID NO: 1753377 - RNA, 18 nt, Human herpesvirus 1
cguugcagggccuggugc

SEQ ID NO: 1753378 - RNA, 21 nt, Human herpesvirus 1
cgacuugccccccuccccgca

SEQ ID NO: 1753379 - RNA, 15 nt, Human herpesvirus 1
gagccccggucuccc

SEQ ID NO: 1753380 - RNA, 15 nt, Human herpesvirus 1
cgagggccgggcccc

SEQ ID NO: 1753381 - RNA, 14 nt, Human herpesvirus 1
cgggcgaugagcca

SEQ ID NO: 1753382 - RNA, 15 nt, Human herpesvirus 1
acccuaccccagucc

SEQ ID NO: 1753383 - RNA, 17 nt, Human herpesvirus 1
ccagaccggcaccaccg

SEQ ID NO: 1753384 - RNA, 17 nt, Human herpesvirus 1
guacaacggcucggccu

SEQ ID NO: 1753385 - RNA, 16 nt, Human herpesvirus 1
guggacgagaugcugc

SEQ ID NO: 1753386 - RNA, 17 nt, Human herpesvirus 1
accaggucccccacacc

SEQ ID NO: 1753387 - RNA, 21 nt, Human herpesvirus 1
agaccaccggucgucccucgc

SEQ ID NO: 1753388 - RNA, 17 nt, Human herpesvirus 1
cguccaaacccaccgac

SEQ ID NO: 1753389 - RNA, 20 nt, Human herpesvirus 1
gccugccucuccccccaggc

SEQ ID NO: 1753390 - RNA, 11 nt, Human herpesvirus 1
ccgggggcgcu

SEQ ID NO: 1753391 - RNA, 11 nt, Human herpesvirus 1
ccuggggcgcg

SEQ ID NO: 1753392 - RNA, 17 nt, Human herpesvirus 1
cacacgggugcgucugg

SEQ ID NO: 1753393 - RNA, 15 nt, Human herpesvirus 1
ccgcuccccaagcau

SEQ ID NO: 1753394 - RNA, 14 nt, Human herpesvirus 1
gcaucccccgccuu

SEQ ID NO: 1753395 - RNA, 17 nt, Human herpesvirus 1
caugcggcugcagagca

SEQ ID NO: 1753396 - RNA, 12 nt, Human herpesvirus 1
acgccucccccu

SEQ ID NO: 1753397 - RNA, 17 nt, Human herpesvirus 1
cgcccaaugggccgggc

SEQ ID NO: 1753398 - RNA, 17 nt, Human herpesvirus 1
ugggucggugacgcgcc

SEQ ID NO: 1753399 - RNA, 19 nt, Human herpesvirus 1
gugcucgugugguacaccg

SEQ ID NO: 1753400 - RNA, 17 nt, Human herpesvirus 1
acgugcacagccuggcc

SEQ ID NO: 1753401 - RNA, 23 nt, Human herpesvirus 1
ucgcgauacccucgggcaucucg

SEQ ID NO: 1753402 - RNA, 13 nt, Human herpesvirus 1
ccgcagccugguc

SEQ ID NO: 1753403 - RNA, 16 nt, Human herpesvirus 1
ccgacccggcccgagg

SEQ ID NO: 1753404 - RNA, 16 nt, Human herpesvirus 1
cucuccccccaggccu

SEQ ID NO: 1753405 - RNA, 12 nt, Human herpesvirus 1
uccucguggccg

SEQ ID NO: 1753406 - RNA, 18 nt, Human herpesvirus 1
cccgacgccagcuuuccg

SEQ ID NO: 1753407 - RNA, 19 nt, Human herpesvirus 1
caagcuaugcagccccgug

SEQ ID NO: 1753408 - RNA, 13 nt, Human herpesvirus 1
aggagacaauacc

SEQ ID NO: 1753409 - RNA, 14 nt, Human herpesvirus 1
uccacgacaacccc

SEQ ID NO: 1753410 - RNA, 12 nt, Human herpesvirus 1
gggaggccacag

SEQ ID NO: 1753411 - RNA, 12 nt, Human herpesvirus 1
cgaggagcccgc

SEQ ID NO: 1753412 - RNA, 12 nt, Human herpesvirus 1
cggggcccggcc

SEQ ID NO: 1753413 - RNA, 15 nt, Human herpesvirus 1
gcggcagcccggagg

SEQ ID NO: 1753414 - RNA, 16 nt, Human herpesvirus 1
gccuccacccccucga

SEQ ID NO: 1753415 - RNA, 21 nt, Human herpesvirus 1
ccaagcuagccgaggcccggg

SEQ ID NO: 1753416 - RNA, 20 nt, Human herpesvirus 1
cggccggauucccgggccgg

SEQ ID NO: 1753417 - RNA, 18 nt, Human herpesvirus 1
cuccccuucccucccccu

SEQ ID NO: 1753418 - RNA, 17 nt, Human herpesvirus 1
cuagccgaggcccggga

SEQ ID NO: 1753419 - RNA, 18 nt, Human herpesvirus 1
ccggacccguuccagccc

SEQ ID NO: 1753420 - RNA, 20 nt, Human herpesvirus 1
aagacccgggcgaugagcca

SEQ ID NO: 1753421 - RNA, 17 nt, Human herpesvirus 1
ugcgggcgguccauuaa

SEQ ID NO: 1753422 - RNA, 17 nt, Human herpesvirus 1
cucacgcccgcaaacag

SEQ ID NO: 1753423 - RNA, 14 nt, Human herpesvirus 1
uguagcgccccggc

SEQ ID NO: 1753424 - RNA, 13 nt, Human herpesvirus 1
ucgccgagccccc

SEQ ID NO: 1753425 - RNA, 20 nt, Human herpesvirus 1
guuauucccaaacagggccu

SEQ ID NO: 1753426 - RNA, 19 nt, Human herpesvirus 1
ugcccucccugacggccau

SEQ ID NO: 1753427 - RNA, 17 nt, Human herpesvirus 1
ccacgcccccgccgccc

SEQ ID NO: 1753428 - RNA, 14 nt, Human herpesvirus 1
guuucagauagagc

SEQ ID NO: 1753429 - RNA, 21 nt, Human herpesvirus 1
gagccaguggucggcgagcug

SEQ ID NO: 1753430 - RNA, 21 nt, Human herpesvirus 1
cgacccccuuguaugucccca

SEQ ID NO: 1753431 - RNA, 18 nt, Human herpesvirus 1
cggggccguggcggccaa

SEQ ID NO: 1753432 - RNA, 21 nt, Human herpesvirus 1
cguuacuaucaccgucccccc

SEQ ID NO: 1753433 - RNA, 19 nt, Human herpesvirus 1
cagccggaaugaggagcuc

SEQ ID NO: 1753434 - RNA, 14 nt, Human herpesvirus 1
ccgacucaccucaa

SEQ ID NO: 1753435 - RNA, 12 nt, Human herpesvirus 1
auggggagagcc

SEQ ID NO: 1753436 - RNA, 14 nt, Human herpesvirus 1
agagaccccagggu

SEQ ID NO: 1753437 - RNA, 22 nt, Human herpesvirus 1
ggcgcugacggaccuuggucug

SEQ ID NO: 1753438 - RNA, 18 nt, Human herpesvirus 1
ccgcggccuggguuggcg

SEQ ID NO: 1753439 - RNA, 13 nt, Human herpesvirus 1
caucacccgggug

SEQ ID NO: 1753440 - RNA, 19 nt, Human herpesvirus 1
ccugguuguccguggcccc

SEQ ID NO: 1753441 - RNA, 15 nt, Human herpesvirus 1
ccuuucccccuguuu

SEQ ID NO: 1753442 - RNA, 19 nt, Human herpesvirus 1
caagaucuuucggugucua

SEQ ID NO: 1753443 - RNA, 20 nt, Human herpesvirus 1
gcggcaccaccggggccuga

SEQ ID NO: 1753444 - RNA, 23 nt, Human herpesvirus 1
acgcgcauccgucgggaggccac

SEQ ID NO: 1753445 - RNA, 15 nt, Human herpesvirus 1
ccaccauccccgcuc

SEQ ID NO: 1753446 - RNA, 22 nt, Human herpesvirus 1
agacgcgggcgacgcacacacc

SEQ ID NO: 1753447 - RNA, 15 nt, Human herpesvirus 1
accauccccgcuccc

SEQ ID NO: 1753448 - RNA, 17 nt, Human herpesvirus 1
cccugcugcccccggag

SEQ ID NO: 1753449 - RNA, 17 nt, Human herpesvirus 1
cacgugcacagccuggc

SEQ ID NO: 1753450 - RNA, 23 nt, Human herpesvirus 1
cagccugccucuccccccaggcc

SEQ ID NO: 1753451 - RNA, 16 nt, Human herpesvirus 1
ucccugggcccuggcc

SEQ ID NO: 1753452 - RNA, 11 nt, Human herpesvirus 1
ugcccacgggu

SEQ ID NO: 1753453 - RNA, 20 nt, Human herpesvirus 1
guacaacaucauccagcugg

SEQ ID NO: 1753454 - RNA, 12 nt, Human herpesvirus 1
cgcggaccaccg

SEQ ID NO: 1753455 - RNA, 12 nt, Human herpesvirus 1
ccucgcaccagc

SEQ ID NO: 1753456 - RNA, 15 nt, Human herpesvirus 1
ucccacacucucugg

SEQ ID NO: 1753457 - RNA, 20 nt, Human herpesvirus 1
cccgauggcccuccaggcug

SEQ ID NO: 1753458 - RNA, 18 nt, Human herpesvirus 1
aucgcucgaccucuccac

SEQ ID NO: 1753459 - RNA, 19 nt, Human herpesvirus 1
gacaauaccggaaggaacc

SEQ ID NO: 1753460 - RNA, 16 nt, Human herpesvirus 1
gcauucgggccugccu

SEQ ID NO: 1753461 - RNA, 16 nt, Human herpesvirus 1
uguuugucgccuggcu

SEQ ID NO: 1753462 - RNA, 20 nt, Human herpesvirus 1
ucccuguuugucgccuggcu

SEQ ID NO: 1753463 - RNA, 16 nt, Human herpesvirus 1
cgagucuucggggccc

SEQ ID NO: 1753464 - RNA, 11 nt, Human herpesvirus 1
ugguugcagug

SEQ ID NO: 1753465 - RNA, 12 nt, Human herpesvirus 1
uacagcccccag

SEQ ID NO: 1753466 - RNA, 18 nt, Human herpesvirus 1
gucgggaggccacagaaa

SEQ ID NO: 1753467 - RNA, 19 nt, Human herpesvirus 1
augcuggaggaucacgagu

SEQ ID NO: 1753468 - RNA, 13 nt, Human herpesvirus 1
gaugggggggcaa

SEQ ID NO: 1753469 - RNA, 16 nt, Human herpesvirus 1
gcggcucaacgagcuc

SEQ ID NO: 1753470 - RNA, 14 nt, Human herpesvirus 1
caccagccugguug

SEQ ID NO: 1753471 - RNA, 22 nt, Human herpesvirus 1
cgcccgauuuacagcccccaga

SEQ ID NO: 1753472 - RNA, 16 nt, Human herpesvirus 1
gccagcgcggcggggc

SEQ ID NO: 1753473 - RNA, 22 nt, Human herpesvirus 1
cccaugggacacaaaugcccac

SEQ ID NO: 1753474 - RNA, 16 nt, Human herpesvirus 1
gcaagaccaggccugg

SEQ ID NO: 1753475 - RNA, 17 nt, Human herpesvirus 1
ccgcccaccgcugggcg

SEQ ID NO: 1753476 - RNA, 23 nt, Human herpesvirus 1
cgaucuccacgcgaccccauggc

SEQ ID NO: 1753477 - RNA, 18 nt, Human herpesvirus 1
cgcaacuucccacccgga

SEQ ID NO: 1753478 - RNA, 12 nt, Human herpesvirus 1
accgguccccgg

SEQ ID NO: 1753479 - RNA, 21 nt, Human herpesvirus 1
cgccccgugucugugggccaa

SEQ ID NO: 1753480 - RNA, 21 nt, Human herpesvirus 1
cguacaaguucaaggccacca

SEQ ID NO: 1753481 - RNA, 13 nt, Human herpesvirus 1
ggcgggagccacc

SEQ ID NO: 1753482 - RNA, 15 nt, Human herpesvirus 1
cgcugcccgacccgg

SEQ ID NO: 1753483 - RNA, 15 nt, Human herpesvirus 1
acccgccccuccauc

SEQ ID NO: 1753484 - RNA, 14 nt, Human herpesvirus 1
cgcgaacgaccaac

SEQ ID NO: 1753485 - RNA, 15 nt, Human herpesvirus 1
ggccacccccccgga

SEQ ID NO: 1753486 - RNA, 13 nt, Human herpesvirus 1
ucuacaacaacua

SEQ ID NO: 1753487 - RNA, 15 nt, Human herpesvirus 1
gaagacaccccccac

SEQ ID NO: 1753488 - RNA, 21 nt, Human herpesvirus 1
caccacauaaccgaccgcagu

SEQ ID NO: 1753489 - RNA, 22 nt, Human herpesvirus 1
auaaaggcggugguaucuaguu

SEQ ID NO: 1753490 - RNA, 17 nt, Human herpesvirus 1
gccucucgcugcuggcg

SEQ ID NO: 1753491 - RNA, 21 nt, Human herpesvirus 1
gucccguuaccaagaccaacc

SEQ ID NO: 1753492 - RNA, 12 nt, Human herpesvirus 1
gauccggcggga

SEQ ID NO: 1753493 - RNA, 19 nt, Human herpesvirus 1
gacgucgccccuguggccc

SEQ ID NO: 1753494 - RNA, 18 nt, Human herpesvirus 1
ccgucgcuagaccacgcc

SEQ ID NO: 1753495 - RNA, 17 nt, Human herpesvirus 1
cccuggcgccgccuggu

SEQ ID NO: 1753496 - RNA, 22 nt, Human herpesvirus 1
ggccgugauuccucuccgcggu

SEQ ID NO: 1753497 - RNA, 12 nt, Human herpesvirus 1
cgacagaccucc

SEQ ID NO: 1753498 - RNA, 21 nt, Human herpesvirus 1
uacuacaacgggagucgccuc

SEQ ID NO: 1753499 - RNA, 18 nt, Human herpesvirus 1
uacuacucggaaagcgaa

SEQ ID NO: 1753500 - RNA, 19 nt, Human herpesvirus 1
ucuuagccuccccgggcca

SEQ ID NO: 1753501 - RNA, 15 nt, Human herpesvirus 1
ccgcaagcuaugcag

SEQ ID NO: 1753502 - RNA, 19 nt, Human herpesvirus 1
cgggcaaguaugccccccu

SEQ ID NO: 1753503 - RNA, 20 nt, Human herpesvirus 1
gcgguacagaucggcgccgc

SEQ ID NO: 1753504 - RNA, 14 nt, Human herpesvirus 1
caggccuccacccc

SEQ ID NO: 1753505 - RNA, 14 nt, Human herpesvirus 1
gugcacagccuggc

SEQ ID NO: 1753506 - RNA, 18 nt, Human herpesvirus 1
ccgcuuuaucccacggcc

SEQ ID NO: 1753507 - RNA, 22 nt, Human herpesvirus 1
cggcggccaguugagccgcgcc

SEQ ID NO: 1753508 - RNA, 13 nt, Human herpesvirus 1
gggcugccgugag

SEQ ID NO: 1753509 - RNA, 15 nt, Human herpesvirus 1
gcgugaccccaggga

SEQ ID NO: 1753510 - RNA, 18 nt, Human herpesvirus 1
ucgugcgcucgcucucgg

SEQ ID NO: 1753511 - RNA, 20 nt, Human herpesvirus 1
gaggacgucgagaaggacaa

SEQ ID NO: 1753512 - RNA, 18 nt, Human herpesvirus 1
ccgcgaagacccccccgg

SEQ ID NO: 1753513 - RNA, 14 nt, Human herpesvirus 1
ggcugggcuuccga

SEQ ID NO: 1753514 - RNA, 18 nt, Human herpesvirus 1
ggaucugguccgccgcga

SEQ ID NO: 1753515 - RNA, 14 nt, Human herpesvirus 1
cagcggccugcugg

SEQ ID NO: 1753516 - RNA, 20 nt, Human herpesvirus 1
gagucuggaaggggggaaag

SEQ ID NO: 1753517 - RNA, 20 nt, Human herpesvirus 1
gccacaggaauaccagaaua

SEQ ID NO: 1753518 - RNA, 16 nt, Human herpesvirus 1
caacugacgcuggccg

SEQ ID NO: 1753519 - RNA, 15 nt, Human herpesvirus 1
gacacgcgcguccuu

SEQ ID NO: 1753520 - RNA, 11 nt, Human herpesvirus 1
ucccagggagc

SEQ ID NO: 1753521 - RNA, 15 nt, Human herpesvirus 1
accaucccccggcca

SEQ ID NO: 1753522 - RNA, 16 nt, Human herpesvirus 1
ucacggcuaccuggcc

SEQ ID NO: 1753523 - RNA, 16 nt, Human herpesvirus 1
cgccgcgagcccgucu

SEQ ID NO: 1753524 - RNA, 16 nt, Human herpesvirus 1
ccagggcggggcucag

SEQ ID NO: 1753525 - RNA, 23 nt, Human herpesvirus 1
aaacucccgacaccaccagcugg

SEQ ID NO: 1753526 - RNA, 19 nt, Human herpesvirus 1
gccccggccgcccuucccg

SEQ ID NO: 1753527 - RNA, 15 nt, Human herpesvirus 1
cccucgggcaucucg

SEQ ID NO: 1753528 - RNA, 12 nt, Human herpesvirus 1
uccugucccugc

SEQ ID NO: 1753529 - RNA, 17 nt, Human herpesvirus 1
gccgugauuccucuccg

SEQ ID NO: 1753530 - RNA, 19 nt, Human herpesvirus 1
cugguccacacccaguggc

SEQ ID NO: 1753531 - RNA, 14 nt, Human herpesvirus 1
cccuagaggcuggu

SEQ ID NO: 1753532 - RNA, 15 nt, Human herpesvirus 1
gcagucuccuggcag

SEQ ID NO: 1753533 - RNA, 17 nt, Human herpesvirus 1
cgggccguuucccaccc

SEQ ID NO: 1753534 - RNA, 18 nt, Human herpesvirus 1
ucccaccaacgucuccuc

SEQ ID NO: 1753535 - RNA, 14 nt, Human herpesvirus 1
ggccuccacccccu

SEQ ID NO: 1753536 - RNA, 20 nt, Human herpesvirus 1
aacccgccccuaaccaggcc

SEQ ID NO: 1753537 - RNA, 14 nt, Human herpesvirus 1
ccgggacugggugg

SEQ ID NO: 1753538 - RNA, 20 nt, Human herpesvirus 1
acgugcccccuccucguccg

SEQ ID NO: 1753539 - RNA, 16 nt, Human herpesvirus 1
gcuguagcgccccggc

SEQ ID NO: 1753540 - RNA, 13 nt, Human herpesvirus 1
gggccagccgcag

SEQ ID NO: 1753541 - RNA, 18 nt, Human herpesvirus 1
cuccugggggcacccacg

SEQ ID NO: 1753542 - RNA, 14 nt, Human herpesvirus 1
ugggcgcucacgag

SEQ ID NO: 1753543 - RNA, 18 nt, Human herpesvirus 1
uugggcgggaggaagcca

SEQ ID NO: 1753544 - RNA, 18 nt, Human herpesvirus 1
gagcgcgcuuguccccga

SEQ ID NO: 1753545 - RNA, 19 nt, Human herpesvirus 1
aaccuucgcaacaccuccc

SEQ ID NO: 1753546 - RNA, 21 nt, Human herpesvirus 1
gggcucggcuccccgccgcgg

SEQ ID NO: 1753547 - RNA, 21 nt, Human herpesvirus 1
gcacgaguucaaccucgggug

SEQ ID NO: 1753548 - RNA, 22 nt, Human herpesvirus 1
gucgccguuucgggcggcaggc

SEQ ID NO: 1753549 - RNA, 23 nt, Human herpesvirus 1
ggcggcgugugggggugccccaa

SEQ ID NO: 1753550 - RNA, 16 nt, Human herpesvirus 1
cggcccugaugcagga

SEQ ID NO: 1753551 - RNA, 14 nt, Human herpesvirus 1
cgugaccccaggga

SEQ ID NO: 1753552 - RNA, 14 nt, Human herpesvirus 1
uccugggccaccug

SEQ ID NO: 1753553 - RNA, 18 nt, Human herpesvirus 1
gaucccacguccccgggu

SEQ ID NO: 1753554 - RNA, 14 nt, Human herpesvirus 1
caaaaccacaaccu

SEQ ID NO: 1753555 - RNA, 19 nt, Human herpesvirus 1
gcaacacaacacgguuccc

SEQ ID NO: 1753556 - RNA, 15 nt, Human herpesvirus 1
gacgcgcagccggcg

SEQ ID NO: 1753557 - RNA, 14 nt, Human herpesvirus 1
gcucccugcggcug

SEQ ID NO: 1753558 - RNA, 22 nt, Human herpesvirus 1
ccugaccaacgacggcccgacc

SEQ ID NO: 1753559 - RNA, 16 nt, Human herpesvirus 1
ggccgggcgacccaga

SEQ ID NO: 1753560 - RNA, 17 nt, Human herpesvirus 1
gacccgcaacgcgcugg

SEQ ID NO: 1753561 - RNA, 21 nt, Human herpesvirus 1
caccgucggaggccccccaga

SEQ ID NO: 1753562 - RNA, 12 nt, Human herpesvirus 1
ggcccaacagcc

SEQ ID NO: 1753563 - RNA, 18 nt, Human herpesvirus 1
cacguuuaccccgcagcc

SEQ ID NO: 1753564 - RNA, 17 nt, Human herpesvirus 1
auuacuuuaagcgcugc

SEQ ID NO: 1753565 - RNA, 21 nt, Human herpesvirus 1
accccggagggcugccagacc

SEQ ID NO: 1753566 - RNA, 14 nt, Human herpesvirus 1
accgccaucagccu

SEQ ID NO: 1753567 - RNA, 18 nt, Human herpesvirus 1
ccuuuguccccgccgaca

SEQ ID NO: 1753568 - RNA, 16 nt, Human herpesvirus 1
ccgaggcggccugggu

SEQ ID NO: 1753569 - RNA, 16 nt, Human herpesvirus 1
cgccaaagcugcuggc

SEQ ID NO: 1753570 - RNA, 23 nt, Human herpesvirus 1
cugcgggccgcgguggacagcca

SEQ ID NO: 1753571 - RNA, 21 nt, Human herpesvirus 1
cccugcgcgagcaccugcggg

SEQ ID NO: 1753572 - RNA, 22 nt, Human herpesvirus 1
cuccuggacuuugagcuugccu

SEQ ID NO: 1753573 - RNA, 20 nt, Human herpesvirus 1
gccgcccaacucucgcacca

SEQ ID NO: 1753574 - RNA, 11 nt, Human herpesvirus 1
guucaaggcca

SEQ ID NO: 1753575 - RNA, 21 nt, Human herpesvirus 1
gccccggguuccgcgaccacc

SEQ ID NO: 1753576 - RNA, 22 nt, Human herpesvirus 1
gcggagcuguacgugcgggaac

SEQ ID NO: 1753577 - RNA, 14 nt, Human herpesvirus 1
ggaccgcagccugg

SEQ ID NO: 1753578 - RNA, 18 nt, Human herpesvirus 1
ggccuuggcggccgccca

SEQ ID NO: 1753579 - RNA, 11 nt, Human herpesvirus 1
aaacaucugga

SEQ ID NO: 1753580 - RNA, 17 nt, Human herpesvirus 1
cgggcgcguccccggcc

SEQ ID NO: 1753581 - RNA, 17 nt, Human herpesvirus 1
ccgcaauuugcacccag

SEQ ID NO: 1753582 - RNA, 14 nt, Human herpesvirus 1
ccaccaaggcccgg

SEQ ID NO: 1753583 - RNA, 12 nt, Human herpesvirus 1
gaucccccgccc

SEQ ID NO: 1753584 - RNA, 20 nt, Human herpesvirus 1
gcagccggaaugaggagcuc

SEQ ID NO: 1753585 - RNA, 13 nt, Human herpesvirus 1
cggccccagcccu

SEQ ID NO: 1753586 - RNA, 22 nt, Human herpesvirus 1
cuccuacaacaagucucugggg

SEQ ID NO: 1753587 - RNA, 18 nt, Human herpesvirus 1
ggcuggucccgcuggugu

SEQ ID NO: 1753588 - RNA, 18 nt, Human herpesvirus 1
ccgcccggggccagcgcc

SEQ ID NO: 1753589 - RNA, 22 nt, Human herpesvirus 1
agaucaaggacagcggccugcu

SEQ ID NO: 1753590 - RNA, 13 nt, Human herpesvirus 1
gcgucggcggcuc

SEQ ID NO: 1753591 - RNA, 16 nt, Human herpesvirus 1
cugcgccuugggcccg

SEQ ID NO: 1753592 - RNA, 15 nt, Human herpesvirus 1
agcaggucgacggcu

SEQ ID NO: 1753593 - RNA, 22 nt, Human herpesvirus 1
caccggugcgccccccaaacca

SEQ ID NO: 1753594 - RNA, 12 nt, Human herpesvirus 1
ucucccagggag

SEQ ID NO: 1753595 - RNA, 21 nt, Human herpesvirus 1
guuccgggaugccgugccgcc

SEQ ID NO: 1753596 - RNA, 18 nt, Human herpesvirus 1
ucccacgcucuccccugc

SEQ ID NO: 1753597 - RNA, 22 nt, Human herpesvirus 1
accacauaaccgaccgcagucc

SEQ ID NO: 1753598 - RNA, 18 nt, Human herpesvirus 1
cgacugggggggauccgc

SEQ ID NO: 1753599 - RNA, 22 nt, Human herpesvirus 1
cgcgguucgcgucccgcccacc

SEQ ID NO: 1753600 - RNA, 22 nt, Human herpesvirus 1
ccgugcugccgucgcuagacca

SEQ ID NO: 1753601 - RNA, 20 nt, Human herpesvirus 1
ccgggaccugaaccccagcc

SEQ ID NO: 1753602 - RNA, 14 nt, Human herpesvirus 1
caccaccuucacca

SEQ ID NO: 1753603 - RNA, 17 nt, Human herpesvirus 1
ggagguuccggaggcgc

SEQ ID NO: 1753604 - RNA, 16 nt, Human herpesvirus 1
agagcggggccguggc

SEQ ID NO: 1753605 - RNA, 16 nt, Human herpesvirus 1
gcccggggccagcgcc

SEQ ID NO: 1753606 - RNA, 20 nt, Human herpesvirus 1
cugggggggauccgcccuau

SEQ ID NO: 1753607 - RNA, 16 nt, Human herpesvirus 1
cgagcugacccugugg

SEQ ID NO: 1753608 - RNA, 13 nt, Human herpesvirus 1
accgcagucccug

SEQ ID NO: 1753609 - RNA, 17 nt, Human herpesvirus 1
guuuaggguaccacagg

SEQ ID NO: 1753610 - RNA, 17 nt, Human herpesvirus 1
ccgguauuauuuaccua

SEQ ID NO: 1753611 - RNA, 22 nt, Human herpesvirus 1
uaaccaccugcgcucccucagc

SEQ ID NO: 1753612 - RNA, 19 nt, Human herpesvirus 1
cagcuuuuaccgcuuccuc

SEQ ID NO: 1753613 - RNA, 18 nt, Human herpesvirus 1
ccagcagacgcugcuccg

SEQ ID NO: 1753614 - RNA, 17 nt, Human herpesvirus 1
acgacccgaagcugcuc

SEQ ID NO: 1753615 - RNA, 13 nt, Human herpesvirus 1
gcaauuugcaccc

SEQ ID NO: 1753616 - RNA, 18 nt, Human herpesvirus 1
ccaucaccccgcaauuug

SEQ ID NO: 1753617 - RNA, 19 nt, Human herpesvirus 1
gugaaagacacgggcacca

SEQ ID NO: 1753618 - RNA, 19 nt, Human herpesvirus 1
cgagcgcgcuuguccccga

SEQ ID NO: 1753619 - RNA, 15 nt, Human herpesvirus 1
auggcgggacugggc

SEQ ID NO: 1753620 - RNA, 17 nt, Human herpesvirus 1
cacaugaagccacuguu

SEQ ID NO: 1753621 - RNA, 13 nt, Human herpesvirus 1
cugggccgagguc

SEQ ID NO: 1753622 - RNA, 14 nt, Human herpesvirus 1
gaccacgccccuuu

SEQ ID NO: 1753623 - RNA, 15 nt, Human herpesvirus 1
cgggcuacugguggg

SEQ ID NO: 1753624 - RNA, 18 nt, Human herpesvirus 1
ugcgauggcgacacaccu

SEQ ID NO: 1753625 - RNA, 17 nt, Human herpesvirus 1
ucccgacaccaccagcu

SEQ ID NO: 1753626 - RNA, 17 nt, Human herpesvirus 1
cguaaacgccgagcugc

SEQ ID NO: 1753627 - RNA, 20 nt, Human herpesvirus 1
gggcgccucggucaccccaa

SEQ ID NO: 1753628 - RNA, 16 nt, Human herpesvirus 1
uguacugcggucuguc

SEQ ID NO: 1753629 - RNA, 22 nt, Human herpesvirus 1
cgggcuguuccgccaggcgguc

SEQ ID NO: 1753630 - RNA, 15 nt, Human herpesvirus 1
ccgcgggaggccgcc

SEQ ID NO: 1753631 - RNA, 12 nt, Human herpesvirus 1
ccucccccuccg

SEQ ID NO: 1753632 - RNA, 20 nt, Human herpesvirus 1
ugucugugggccaagauggc

SEQ ID NO: 1753633 - RNA, 17 nt, Human herpesvirus 1
cgccaaacgccagccug

SEQ ID NO: 1753634 - RNA, 11 nt, Human herpesvirus 1
ccaccagccug

SEQ ID NO: 1753635 - RNA, 14 nt, Human herpesvirus 1
cgacaccaccagcu

SEQ ID NO: 1753636 - RNA, 21 nt, Human herpesvirus 1
caccucgcccacccacuccuc

SEQ ID NO: 1753637 - RNA, 21 nt, Human herpesvirus 1
uugucugcguauuccagggcg

SEQ ID NO: 1753638 - RNA, 15 nt, Human herpesvirus 1
ccuggagcaccgagc

SEQ ID NO: 1753639 - RNA, 13 nt, Human herpesvirus 1
cgcacccacagcu

SEQ ID NO: 1753640 - RNA, 18 nt, Human herpesvirus 1
gaacaccuucuuugcccu

SEQ ID NO: 1753641 - RNA, 21 nt, Human herpesvirus 1
cgguuuccuuugcgcucccgc

SEQ ID NO: 1753642 - RNA, 23 nt, Human herpesvirus 1
gccgcuguggccucaccugacca

SEQ ID NO: 1753643 - RNA, 19 nt, Human herpesvirus 1
cccgaagacaccccccacc

SEQ ID NO: 1753644 - RNA, 16 nt, Human herpesvirus 1
cgccgcccugagcgcc

SEQ ID NO: 1753645 - RNA, 15 nt, Human herpesvirus 1
ggaugcugccccgcu

SEQ ID NO: 1753646 - RNA, 23 nt, Human herpesvirus 1
ggcguuauucccaaacagggccu

SEQ ID NO: 1753647 - RNA, 18 nt, Human herpesvirus 1
cgagcucccagagacccc

SEQ ID NO: 1753648 - RNA, 18 nt, Human herpesvirus 1
cucccagagaccccaggg

SEQ ID NO: 1753649 - RNA, 20 nt, Human herpesvirus 1
guccgggggcucggaaacug

SEQ ID NO: 1753650 - RNA, 16 nt, Human herpesvirus 1
caagccgcucuccgga

SEQ ID NO: 1753651 - RNA, 19 nt, Human herpesvirus 1
cacgaccuguugauggccu

SEQ ID NO: 1753652 - RNA, 18 nt, Human herpesvirus 1
cacuugcggcaagacccg

SEQ ID NO: 1753653 - RNA, 13 nt, Human herpesvirus 1
cgccaucagccuu

SEQ ID NO: 1753654 - RNA, 13 nt, Human herpesvirus 1
cgcccgccccugc

SEQ ID NO: 1753655 - RNA, 13 nt, Human herpesvirus 1
cgccucagggccu

SEQ ID NO: 1753656 - RNA, 13 nt, Human herpesvirus 1
ggagcccgcccuu

SEQ ID NO: 1753657 - RNA, 19 nt, Human herpesvirus 1
ccgugauccuuaggggccg

SEQ ID NO: 1753658 - RNA, 15 nt, Human herpesvirus 1
uccucacugccuccc

SEQ ID NO: 1753659 - RNA, 11 nt, Human herpesvirus 1
gcaucccagga

SEQ ID NO: 1753660 - RNA, 20 nt, Human herpesvirus 1
gggagccccggucuccccgg

SEQ ID NO: 1753661 - RNA, 16 nt, Human herpesvirus 1
cgcauaucccacccug

SEQ ID NO: 1753662 - RNA, 16 nt, Human herpesvirus 1
gccgcgccgcugcccg

SEQ ID NO: 1753663 - RNA, 13 nt, Human herpesvirus 1
gcgcuuugcggag

SEQ ID NO: 1753664 - RNA, 16 nt, Human herpesvirus 1
uccaaaaccacaaccu

SEQ ID NO: 1753665 - RNA, 20 nt, Human herpesvirus 1
gcugcggccacacagccggc

SEQ ID NO: 1753666 - RNA, 17 nt, Human herpesvirus 1
gucuccccgauggcccu

SEQ ID NO: 1753667 - RNA, 13 nt, Human herpesvirus 1
gauggccugugcu

SEQ ID NO: 1753668 - RNA, 17 nt, Human herpesvirus 1
gcgagcaccugcgggac

SEQ ID NO: 1753669 - RNA, 18 nt, Human herpesvirus 1
cgccaacaauccccagga

SEQ ID NO: 1753670 - RNA, 21 nt, Human herpesvirus 1
uaggaugccagccagggcggc

SEQ ID NO: 1753671 - RNA, 12 nt, Human herpesvirus 1
ccugauggagcc

SEQ ID NO: 1753672 - RNA, 19 nt, Human herpesvirus 1
ucgaagcugaugucccuca

SEQ ID NO: 1753673 - RNA, 22 nt, Human herpesvirus 1
cggaacgcaccgaggggccaag

SEQ ID NO: 1753674 - RNA, 20 nt, Human herpesvirus 1
ggggcgggugggccuugccg

SEQ ID NO: 1753675 - RNA, 13 nt, Human herpesvirus 1
cacagccuggccg

SEQ ID NO: 1753676 - RNA, 18 nt, Human herpesvirus 1
cccgucgaagcugauguc

SEQ ID NO: 1753677 - RNA, 12 nt, Human herpesvirus 1
cccggggccagc

SEQ ID NO: 1753678 - RNA, 18 nt, Human herpesvirus 1
gggcucggcuccccgccg

SEQ ID NO: 1753679 - RNA, 17 nt, Human herpesvirus 1
gaugggcgaccuggggc

SEQ ID NO: 1753680 - RNA, 17 nt, Human herpesvirus 1
guggacgccggggccuu

SEQ ID NO: 1753681 - RNA, 17 nt, Human herpesvirus 1
cccucucuucucucccg

SEQ ID NO: 1753682 - RNA, 16 nt, Human herpesvirus 1
cacccgaggcggccug

SEQ ID NO: 1753683 - RNA, 19 nt, Human herpesvirus 1
accccgcaauuugcaccca

SEQ ID NO: 1753684 - RNA, 13 nt, Human herpesvirus 1
caucgcgccccuc

SEQ ID NO: 1753685 - RNA, 19 nt, Human herpesvirus 1
ccuccgcaucccaggauca

SEQ ID NO: 1753686 - RNA, 20 nt, Human herpesvirus 1
gcgccccggccccucauggg

SEQ ID NO: 1753687 - RNA, 18 nt, Human herpesvirus 1
gguuguccguggccccac

SEQ ID NO: 1753688 - RNA, 15 nt, Human herpesvirus 1
uagcguguucgugga

SEQ ID NO: 1753689 - RNA, 22 nt, Human herpesvirus 1
ucaaggacagcggccugcugga

SEQ ID NO: 1753690 - RNA, 14 nt, Human herpesvirus 1
auacacagccaccc

SEQ ID NO: 1753691 - RNA, 14 nt, Human herpesvirus 1
ggggagagcccaca

SEQ ID NO: 1753692 - RNA, 21 nt, Human herpesvirus 1
cgaccgcgcccucgccacacc

SEQ ID NO: 1753693 - RNA, 22 nt, Human herpesvirus 1
cuccaggcugucgacgcccccu

SEQ ID NO: 1753694 - RNA, 13 nt, Human herpesvirus 1
cgccggggcgguc

SEQ ID NO: 1753695 - RNA, 22 nt, Human herpesvirus 1
ugcccuuccaggucccaccuga

SEQ ID NO: 1753696 - RNA, 17 nt, Human herpesvirus 1
ucccucccccuccgcau

SEQ ID NO: 1753697 - RNA, 17 nt, Human herpesvirus 1
ggucuccccgggagccc

SEQ ID NO: 1753698 - RNA, 21 nt, Human herpesvirus 1
ggcggauuuggggcgcuccug

SEQ ID NO: 1753699 - RNA, 15 nt, Human herpesvirus 1
ggccucuccggccug

SEQ ID NO: 1753700 - RNA, 14 nt, Human herpesvirus 1
ucgggaugcugccc

SEQ ID NO: 1753701 - RNA, 17 nt, Human herpesvirus 1
gcccccgaggccagcau

SEQ ID NO: 1753702 - RNA, 13 nt, Human herpesvirus 1
aucuccggacccc

SEQ ID NO: 1753703 - RNA, 17 nt, Human herpesvirus 1
gcccgaccacacacccc

SEQ ID NO: 1753704 - RNA, 13 nt, Human herpesvirus 1
guccccuggggcg

SEQ ID NO: 1753705 - RNA, 18 nt, Human herpesvirus 1
gccaagaagaagggcacg

SEQ ID NO: 1753706 - RNA, 11 nt, Human herpesvirus 1
ggguccgggcc

SEQ ID NO: 1753707 - RNA, 16 nt, Human herpesvirus 1
gcguccccggcccgga

SEQ ID NO: 1753708 - RNA, 20 nt, Human herpesvirus 1
cagggccuccgaccccagac

SEQ ID NO: 1753709 - RNA, 17 nt, Human herpesvirus 1
cgguccggagccgcgcg

SEQ ID NO: 1753710 - RNA, 17 nt, Human herpesvirus 1
gaaauagcaacaaggcc

SEQ ID NO: 1753711 - RNA, 12 nt, Human herpesvirus 1
ccaccgcugggc

SEQ ID NO: 1753712 - RNA, 16 nt, Human herpesvirus 1
accccgggcgcgcccu

SEQ ID NO: 1753713 - RNA, 19 nt, Human herpesvirus 1
ggguggagggugucccagg

SEQ ID NO: 1753714 - RNA, 21 nt, Human herpesvirus 1
uggccaucgguccccucuggg

SEQ ID NO: 1753715 - RNA, 22 nt, Human herpesvirus 1
cugcggcucaacgagcuccugg

SEQ ID NO: 1753716 - RNA, 11 nt, Human herpesvirus 1
caccuccaccc

SEQ ID NO: 1753717 - RNA, 17 nt, Human herpesvirus 1
cggggccgcccuggccg

SEQ ID NO: 1753718 - RNA, 20 nt, Human herpesvirus 1
gcccgggccacggcgccgac

SEQ ID NO: 1753719 - RNA, 15 nt, Human herpesvirus 1
ucaauaaaaggcauu

SEQ ID NO: 1753720 - RNA, 20 nt, Human herpesvirus 1
ucaucgaccucaacaucacc

SEQ ID NO: 1753721 - RNA, 17 nt, Human herpesvirus 1
ggcggacccaagccgcc

SEQ ID NO: 1753722 - RNA, 17 nt, Human herpesvirus 1
aaagugaaagacacggg

SEQ ID NO: 1753723 - RNA, 19 nt, Human herpesvirus 1
cguucuccggggcccggcc

SEQ ID NO: 1753724 - RNA, 18 nt, Human herpesvirus 1
gccuuguuccgcuucccg

SEQ ID NO: 1753725 - RNA, 14 nt, Human herpesvirus 1
gggcguagagcugu

SEQ ID NO: 1753726 - RNA, 16 nt, Human herpesvirus 1
ggggacccgccccgga

SEQ ID NO: 1753727 - RNA, 21 nt, Human herpesvirus 1
guggaccccacgacacccacc

SEQ ID NO: 1753728 - RNA, 12 nt, Human herpesvirus 1
cccagcugggcc

SEQ ID NO: 1753729 - RNA, 22 nt, Human herpesvirus 1
guccaccaaagucucugugggu

SEQ ID NO: 1753730 - RNA, 14 nt, Human herpesvirus 1
uccugauguggcug

SEQ ID NO: 1753731 - RNA, 15 nt, Human herpesvirus 1
cugucccgcgugcaa

SEQ ID NO: 1753732 - RNA, 14 nt, Human herpesvirus 1
ccgggccgcaccgg

SEQ ID NO: 1753733 - RNA, 20 nt, Human herpesvirus 1
gcgggcucgucuuggccacc

SEQ ID NO: 1753734 - RNA, 19 nt, Human herpesvirus 1
gugguucccccccguggcu

SEQ ID NO: 1753735 - RNA, 21 nt, Human herpesvirus 1
cguccgguuggccgcgcggca

SEQ ID NO: 1753736 - RNA, 16 nt, Human herpesvirus 1
ccuccgcaucccagga

SEQ ID NO: 1753737 - RNA, 18 nt, Human herpesvirus 1
uccgaacgcagccccgcu

SEQ ID NO: 1753738 - RNA, 19 nt, Human herpesvirus 1
cgacagcccccccaagcgc

SEQ ID NO: 1753739 - RNA, 17 nt, Human herpesvirus 1
gcgcgcuuguccccgaa

SEQ ID NO: 1753740 - RNA, 14 nt, Human herpesvirus 1
cggucgggcggaga

SEQ ID NO: 1753741 - RNA, 16 nt, Human herpesvirus 1
acggguguggggaccc

SEQ ID NO: 1753742 - RNA, 16 nt, Human herpesvirus 1
ccaccuccacccccuc

SEQ ID NO: 1753743 - RNA, 15 nt, Human herpesvirus 1
ccgcggugggcugga

SEQ ID NO: 1753744 - RNA, 23 nt, Human herpesvirus 1
ggugcgauggcgacacaccugug

SEQ ID NO: 1753745 - RNA, 21 nt, Human herpesvirus 1
gaaagcaagaacaauaaaggc

SEQ ID NO: 1753746 - RNA, 16 nt, Human herpesvirus 1
gccgcgcgccgcgcgu

SEQ ID NO: 1753747 - RNA, 20 nt, Human herpesvirus 1
cugcgaccccagccuucacg

SEQ ID NO: 1753748 - RNA, 21 nt, Human herpesvirus 1
agcacccugcugcccccggag

SEQ ID NO: 1753749 - RNA, 15 nt, Human herpesvirus 1
ccacccaggcgcugg

SEQ ID NO: 1753750 - RNA, 13 nt, Human herpesvirus 1
aggcccacgccuc

SEQ ID NO: 1753751 - RNA, 22 nt, Human herpesvirus 1
ccgcggccccagcccucucccc

SEQ ID NO: 1753752 - RNA, 15 nt, Human herpesvirus 1
gcuguuguaggcggu

SEQ ID NO: 1753753 - RNA, 24 nt, Human herpesvirus 1
cggaggauuacuuuaagcgcugcu

SEQ ID NO: 1753754 - RNA, 22 nt, Human herpesvirus 1
cucccaacccccuaagacccac

SEQ ID NO: 1753755 - RNA, 19 nt, Human herpesvirus 1
auucucccgaaccaggccg

SEQ ID NO: 1753756 - RNA, 22 nt, Human herpesvirus 1
cugugguguuuuuggcaucaug

SEQ ID NO: 1753757 - RNA, 19 nt, Human herpesvirus 1
aaccccuuuggggcgcugg

SEQ ID NO: 1753758 - RNA, 14 nt, Human herpesvirus 1
cgacgcacacaccc

SEQ ID NO: 1753759 - RNA, 13 nt, Human herpesvirus 1
gccucccccugag

SEQ ID NO: 1753760 - RNA, 15 nt, Human herpesvirus 1
ggucgggcggagaaa

SEQ ID NO: 1753761 - RNA, 17 nt, Human herpesvirus 1
ccagccguccucgcacc

SEQ ID NO: 1753762 - RNA, 22 nt, Human herpesvirus 1
gauggggagagcccacaugcgg

SEQ ID NO: 1753763 - RNA, 15 nt, Human herpesvirus 1
cgccgacgaccuggu

SEQ ID NO: 1753764 - RNA, 19 nt, Human herpesvirus 1
gcccacacaacgcuccgcc

SEQ ID NO: 1753765 - RNA, 17 nt, Human herpesvirus 1
caggaucacaccgguca

SEQ ID NO: 1753766 - RNA, 15 nt, Human herpesvirus 1
ugcacccagccuuua

SEQ ID NO: 1753767 - RNA, 17 nt, Human herpesvirus 1
cuugggcccgggggccu

SEQ ID NO: 1753768 - RNA, 23 nt, Human herpesvirus 1
ucaagcaggccaucgccggggac

SEQ ID NO: 1753769 - RNA, 20 nt, Human herpesvirus 1
cggaacgcaccgaggggcca

SEQ ID NO: 1753770 - RNA, 14 nt, Human herpesvirus 1
ucuucuccccuucc

SEQ ID NO: 1753771 - RNA, 11 nt, Human herpesvirus 1
gcucagccaga

SEQ ID NO: 1753772 - RNA, 18 nt, Human herpesvirus 1
ucuuuuguguuggcccua

SEQ ID NO: 1753773 - RNA, 12 nt, Human herpesvirus 1
ggcggaccuggc

SEQ ID NO: 1753774 - RNA, 23 nt, Human herpesvirus 1
gucacagcgaccgcaacuuccca

SEQ ID NO: 1753775 - RNA, 17 nt, Human herpesvirus 1
aagcgucccugggcccu

SEQ ID NO: 1753776 - RNA, 14 nt, Human herpesvirus 1
cggcccacccuggc

SEQ ID NO: 1753777 - RNA, 21 nt, Human herpesvirus 1
cgcgaccaccccaaauacagc

SEQ ID NO: 1753778 - RNA, 21 nt, Human herpesvirus 1
cggccagaucuacugcugggc

SEQ ID NO: 1753779 - RNA, 15 nt, Human herpesvirus 1
accggcacccggccu

SEQ ID NO: 1753780 - RNA, 18 nt, Human herpesvirus 1
ccagcagcuugcggggcu

SEQ ID NO: 1753781 - RNA, 16 nt, Human herpesvirus 1
cccggaccccacgcac

SEQ ID NO: 1753782 - RNA, 22 nt, Human herpesvirus 1
ccacccucucuucccucagguc

SEQ ID NO: 1753783 - RNA, 16 nt, Human herpesvirus 1
acacgcgcguccuucu

SEQ ID NO: 1753784 - RNA, 16 nt, Human herpesvirus 1
aagcgucccugggccc

SEQ ID NO: 1753785 - RNA, 23 nt, Human herpesvirus 1
gcagacgaaaagccccgggccgc

SEQ ID NO: 1753786 - RNA, 15 nt, Human herpesvirus 1
gagguggagcugccc

SEQ ID NO: 1753787 - RNA, 18 nt, Human herpesvirus 1
gacgccccccguggaccc

SEQ ID NO: 1753788 - RNA, 23 nt, Human herpesvirus 1
ggcggagaaacggccgaagccac

SEQ ID NO: 1753789 - RNA, 15 nt, Human herpesvirus 1
uuccaggucccaccu

SEQ ID NO: 1753790 - RNA, 21 nt, Human herpesvirus 1
gcggcucaacgagcuccuggc

SEQ ID NO: 1753791 - RNA, 19 nt, Human herpesvirus 1
gcucgccagcgacccgcac

SEQ ID NO: 1753792 - RNA, 19 nt, Human herpesvirus 1
gccgguccgcugugccauc

SEQ ID NO: 1753793 - RNA, 15 nt, Human herpesvirus 1
gcgcaccuggugaug

SEQ ID NO: 1753794 - RNA, 16 nt, Human herpesvirus 1
acgccaaugcccuccc

SEQ ID NO: 1753795 - RNA, 12 nt, Human herpesvirus 1
cugcgugucaaa

SEQ ID NO: 1753796 - RNA, 19 nt, Human herpesvirus 1
ggccgcccacuucccggua

SEQ ID NO: 1753797 - RNA, 15 nt, Human herpesvirus 1
uacgcgggccccggg

SEQ ID NO: 1753798 - RNA, 21 nt, Human herpesvirus 1
cacguacacggguggccgggc

SEQ ID NO: 1753799 - RNA, 20 nt, Human herpesvirus 1
ccaaucgccgguuccucccg

SEQ ID NO: 1753800 - RNA, 23 nt, Human herpesvirus 1
cgcuguucucguuccucacugcc

SEQ ID NO: 1753801 - RNA, 17 nt, Human herpesvirus 1
gcggccgcccaacucuc

SEQ ID NO: 1753802 - RNA, 20 nt, Human herpesvirus 1
ucgacccgcaacgcgcuggg

SEQ ID NO: 1753803 - RNA, 17 nt, Human herpesvirus 1
cccacgcaccccccgcg

SEQ ID NO: 1753804 - RNA, 23 nt, Human herpesvirus 1
gcccuaaccccaccccugugcua

SEQ ID NO: 1753805 - RNA, 23 nt, Human herpesvirus 1
accaguuuugcgaggagcccgcc

SEQ ID NO: 1753806 - RNA, 13 nt, Human herpesvirus 1
gcccaacccacac

SEQ ID NO: 1753807 - RNA, 17 nt, Human herpesvirus 1
gccucugggucugugcc

SEQ ID NO: 1753808 - RNA, 18 nt, Human herpesvirus 1
cucuccgggaugggcuac

SEQ ID NO: 1753809 - RNA, 17 nt, Human herpesvirus 1
agcgacguccugggcca

SEQ ID NO: 1753810 - RNA, 21 nt, Human herpesvirus 1
gcuccgcaacggggcgccguc

SEQ ID NO: 1753811 - RNA, 23 nt, Human herpesvirus 1
ccgguuccucccgcucggcggca

SEQ ID NO: 1753812 - RNA, 19 nt, Human herpesvirus 1
gcgcguaucugguccccgc

SEQ ID NO: 1753813 - RNA, 18 nt, Human herpesvirus 1
ucgaccaccauccccgcu

SEQ ID NO: 1753814 - RNA, 13 nt, Human herpesvirus 1
caacaugacccag

SEQ ID NO: 1753815 - RNA, 18 nt, Human herpesvirus 1
ccugucgcacccacagcu

SEQ ID NO: 1753816 - RNA, 22 nt, Human herpesvirus 1
cgaggaccacgugcacagccug

SEQ ID NO: 1753817 - RNA, 16 nt, Human herpesvirus 1
gccucgggggcgggac

SEQ ID NO: 1753818 - RNA, 15 nt, Human herpesvirus 1
gaucuacugcugggc

SEQ ID NO: 1753819 - RNA, 14 nt, Human herpesvirus 1
caucauccagcugg

SEQ ID NO: 1753820 - RNA, 15 nt, Human herpesvirus 1
ccgcaauuugcaccc

SEQ ID NO: 1753821 - RNA, 21 nt, Human herpesvirus 1
ccucgcgccacacucaccggc

SEQ ID NO: 1753822 - RNA, 16 nt, Human herpesvirus 1
gcccgaagacaccccc

SEQ ID NO: 1753823 - RNA, 16 nt, Human herpesvirus 1
acuggguucuccugga

SEQ ID NO: 1753824 - RNA, 18 nt, Human herpesvirus 1
cugggggcacccacgccc

SEQ ID NO: 1753825 - RNA, 15 nt, Human herpesvirus 1
ccuguuugucgccug

SEQ ID NO: 1753826 - RNA, 13 nt, Human herpesvirus 1
acagccgcccccu

SEQ ID NO: 1753827 - RNA, 15 nt, Human herpesvirus 1
ggaugucgcccgucu

SEQ ID NO: 1753828 - RNA, 21 nt, Human herpesvirus 1
ccgcccccagcugggcccgga

SEQ ID NO: 1753829 - RNA, 13 nt, Human herpesvirus 1
acgcgcggcuggu

SEQ ID NO: 1753830 - RNA, 20 nt, Human herpesvirus 1
ccgucgcacgcguccagucg

SEQ ID NO: 1753831 - RNA, 19 nt, Human herpesvirus 1
gcuggacuacacggagguc

SEQ ID NO: 1753832 - RNA, 18 nt, Human herpesvirus 1
ccggucuccccgggagcc

SEQ ID NO: 1753833 - RNA, 13 nt, Human herpesvirus 1
cccccuggaggug

SEQ ID NO: 1753834 - RNA, 14 nt, Human herpesvirus 1
aucguccaccuccg

SEQ ID NO: 1753835 - RNA, 21 nt, Human herpesvirus 1
ggggcgugucuguuucuuggc

SEQ ID NO: 1753836 - RNA, 13 nt, Human herpesvirus 1
cggacgccacacc

SEQ ID NO: 1753837 - RNA, 14 nt, Human herpesvirus 1
cgcgccgcgggccc

SEQ ID NO: 1753838 - RNA, 19 nt, Human herpesvirus 1
ccacgcccgaccacacacc

SEQ ID NO: 1753839 - RNA, 13 nt, Human herpesvirus 1
agugaaagacacg

SEQ ID NO: 1753840 - RNA, 13 nt, Human herpesvirus 1
cgggcaccacaca

SEQ ID NO: 1753841 - RNA, 18 nt, Human herpesvirus 1
cccugaccccgcuccugu

SEQ ID NO: 1753842 - RNA, 14 nt, Human herpesvirus 1
gcccggguccccgc

SEQ ID NO: 1753843 - RNA, 13 nt, Human herpesvirus 1
gcggggcccggcc

SEQ ID NO: 1753844 - RNA, 12 nt, Human herpesvirus 1
cacaaccucccg

SEQ ID NO: 1753845 - RNA, 14 nt, Human herpesvirus 1
auuaaccaccugcg

SEQ ID NO: 1753846 - RNA, 15 nt, Human herpesvirus 1
ggcccgucgugucuu

SEQ ID NO: 1753847 - RNA, 14 nt, Human herpesvirus 1
gucccccuggaggu

SEQ ID NO: 1753848 - RNA, 15 nt, Human herpesvirus 1
gcuccugauguggcu

SEQ ID NO: 1753849 - RNA, 18 nt, Human herpesvirus 1
accugggggacugcaucg

SEQ ID NO: 1753850 - RNA, 16 nt, Human herpesvirus 1
cuuuaaaaagcagggg

SEQ ID NO: 1753851 - RNA, 22 nt, Human herpesvirus 1
cacgagaucaaggacagcggcc

SEQ ID NO: 1753852 - RNA, 12 nt, Human herpesvirus 1
guccgcggggcc

SEQ ID NO: 1753853 - RNA, 23 nt, Human herpesvirus 1
gaggugcuucuguuuggcgcccc

SEQ ID NO: 1753854 - RNA, 19 nt, Human herpesvirus 1
ccugugugucguauguuua

SEQ ID NO: 1753855 - RNA, 18 nt, Human herpesvirus 1
ugaucgcguaccagcccc

SEQ ID NO: 1753856 - RNA, 12 nt, Human herpesvirus 1
cgcggggccccc

SEQ ID NO: 1753857 - RNA, 18 nt, Human herpesvirus 1
acaacccuacaaccugac

SEQ ID NO: 1753858 - RNA, 17 nt, Human herpesvirus 1
cugggauccgaccccca

SEQ ID NO: 1753859 - RNA, 14 nt, Human herpesvirus 1
ccaggccuccaccc

SEQ ID NO: 1753860 - RNA, 19 nt, Human herpesvirus 1
ucuccucuucuccccuucc

SEQ ID NO: 1753861 - RNA, 13 nt, Human herpesvirus 1
caaacgacccacc

SEQ ID NO: 1753862 - RNA, 13 nt, Human herpesvirus 1
gagacaauaccgg

SEQ ID NO: 1753863 - RNA, 17 nt, Human herpesvirus 1
cgcggcggggcccggcc

SEQ ID NO: 1753864 - RNA, 20 nt, Human herpesvirus 1
gguggcgaccacgggcuguc

SEQ ID NO: 1753865 - RNA, 14 nt, Human herpesvirus 1
ccuuccccacggga

SEQ ID NO: 1753866 - RNA, 17 nt, Human herpesvirus 1
uccaccaaagucucugu

SEQ ID NO: 1753867 - RNA, 23 nt, Human herpesvirus 1
gccggcguuucugaccugcaccg

SEQ ID NO: 1753868 - RNA, 18 nt, Human herpesvirus 1
ccuuggucuggcccacgc

SEQ ID NO: 1753869 - RNA, 16 nt, Human herpesvirus 1
gccaacgcccugacca

SEQ ID NO: 1753870 - RNA, 20 nt, Human herpesvirus 1
gcacgcccccuacgaggacg

SEQ ID NO: 1753871 - RNA, 14 nt, Human herpesvirus 1
ggagcucccgggag

SEQ ID NO: 1753872 - RNA, 18 nt, Human herpesvirus 1
ccagaucuacugcugggc

SEQ ID NO: 1753873 - RNA, 21 nt, Human herpesvirus 1
uacauugaggcggaaaauccc

SEQ ID NO: 1753874 - RNA, 12 nt, Human herpesvirus 1
cgaagcccagcg

SEQ ID NO: 1753875 - RNA, 22 nt, Human herpesvirus 1
acagcuggccgccgucgcacgc

SEQ ID NO: 1753876 - RNA, 22 nt, Human herpesvirus 1
cauaaccgaccgcagucccuga

SEQ ID NO: 1753877 - RNA, 19 nt, Human herpesvirus 1
aguucaccguggccuggga

SEQ ID NO: 1753878 - RNA, 18 nt, Human herpesvirus 1
ccaccgcgcuccucccgc

SEQ ID NO: 1753879 - RNA, 16 nt, Human herpesvirus 1
ccgcaauuugcaccca

SEQ ID NO: 1753880 - RNA, 12 nt, Human herpesvirus 1
gcuggaccucac

SEQ ID NO: 1753881 - RNA, 16 nt, Human herpesvirus 1
uacucgaucacggagg

SEQ ID NO: 1753882 - RNA, 17 nt, Human herpesvirus 1
aauuugcacccagccuu

SEQ ID NO: 1753883 - RNA, 13 nt, Human herpesvirus 1
cugacccucuccg

SEQ ID NO: 1753884 - RNA, 22 nt, Human herpesvirus 1
cgaccucuccacaccugcacca

SEQ ID NO: 1753885 - RNA, 21 nt, Human herpesvirus 1
cccccggacgacauggccagc

SEQ ID NO: 1753886 - RNA, 17 nt, Human herpesvirus 1
gucaaacgaccucauca

SEQ ID NO: 1753887 - RNA, 18 nt, Human herpesvirus 1
ggacggcggggcagagcc

SEQ ID NO: 1753888 - RNA, 18 nt, Human herpesvirus 1
caaccccggucucccagg

SEQ ID NO: 1753889 - RNA, 15 nt, Human herpesvirus 1
cccucugggcccgcc

SEQ ID NO: 1753890 - RNA, 21 nt, Human herpesvirus 1
ccgucgcacgcguccagucgg

SEQ ID NO: 1753891 - RNA, 20 nt, Human herpesvirus 1
uggucggcgagcuggauggc

SEQ ID NO: 1753892 - RNA, 16 nt, Human herpesvirus 1
gugguccgccuagccg

SEQ ID NO: 1753893 - RNA, 20 nt, Human herpesvirus 1
ccacccccccggaggaaacc

SEQ ID NO: 1753894 - RNA, 15 nt, Human herpesvirus 1
gccacaacagcccug

SEQ ID NO: 1753895 - RNA, 14 nt, Human herpesvirus 1
agggugucccagga

SEQ ID NO: 1753896 - RNA, 16 nt, Human herpesvirus 1
ucccugucgccuccca

SEQ ID NO: 1753897 - RNA, 19 nt, Human herpesvirus 1
ucagcgacguccugggcca

SEQ ID NO: 1753898 - RNA, 15 nt, Human herpesvirus 1
ccacgcaaacaacac

SEQ ID NO: 1753899 - RNA, 21 nt, Human herpesvirus 1
cgcaauuugcacccagccuuu

SEQ ID NO: 1753900 - RNA, 18 nt, Human herpesvirus 1
cacccugcugcccccgga

SEQ ID NO: 1753901 - RNA, 12 nt, Human herpesvirus 1
guaucaaacuca

SEQ ID NO: 1753902 - RNA, 14 nt, Human herpesvirus 1
aggaaauccguggc

SEQ ID NO: 1753903 - RNA, 17 nt, Human herpesvirus 1
cagaggcgcgcgcaccu

SEQ ID NO: 1753904 - RNA, 18 nt, Human herpesvirus 1
gucgggguggcacagaac

SEQ ID NO: 1753905 - RNA, 13 nt, Human herpesvirus 1
ucuccccugcugc

SEQ ID NO: 1753906 - RNA, 21 nt, Human herpesvirus 1
caugaccgcccgccccucgcc

SEQ ID NO: 1753907 - RNA, 12 nt, Human herpesvirus 1
gcgcccccgccc

SEQ ID NO: 1753908 - RNA, 12 nt, Human herpesvirus 1
gcccccccgcgc

SEQ ID NO: 1753909 - RNA, 16 nt, Human herpesvirus 1
cugcuccgccuggccu

SEQ ID NO: 1753910 - RNA, 16 nt, Human herpesvirus 1
gggaccugaaccccag

SEQ ID NO: 1753911 - RNA, 23 nt, Human herpesvirus 1
ccggagccgggcgcgugcugcgc

SEQ ID NO: 1753912 - RNA, 15 nt, Human herpesvirus 1
cuccccuucccuccc

SEQ ID NO: 1753913 - RNA, 12 nt, Human herpesvirus 1
gccaccgugggc

SEQ ID NO: 1753914 - RNA, 18 nt, Human herpesvirus 1
agcccaacccacacgcac

SEQ ID NO: 1753915 - RNA, 15 nt, Human herpesvirus 1
gcgcgaucguccacc

SEQ ID NO: 1753916 - RNA, 14 nt, Human herpesvirus 1
accgcagucccuga

SEQ ID NO: 1753917 - RNA, 20 nt, Human herpesvirus 1
caucgacacgcgcguccuuc

SEQ ID NO: 1753918 - RNA, 18 nt, Human herpesvirus 1
cccgccccucgccacguc

SEQ ID NO: 1753919 - RNA, 19 nt, Human herpesvirus 1
cgccgaagagucggagccc

SEQ ID NO: 1753920 - RNA, 18 nt, Human herpesvirus 1
cccaccaacgucuccucc

SEQ ID NO: 1753921 - RNA, 11 nt, Human herpesvirus 1
gcgccccgaug

SEQ ID NO: 1753922 - RNA, 14 nt, Human herpesvirus 1
acccugcugcaggc

SEQ ID NO: 1753923 - RNA, 14 nt, Human herpesvirus 1
uuguguuggcccua

SEQ ID NO: 1753924 - RNA, 18 nt, Human herpesvirus 1
cugagccgcuuuccuacc

SEQ ID NO: 1753925 - RNA, 17 nt, Human herpesvirus 1
ggccgcgguggacagcc

SEQ ID NO: 1753926 - RNA, 15 nt, Human herpesvirus 1
gcugccagaccucaa

SEQ ID NO: 1753927 - RNA, 14 nt, Human herpesvirus 1
uccagggcggggcu

SEQ ID NO: 1753928 - RNA, 20 nt, Human herpesvirus 1
cagcccccagaugcccacgg

SEQ ID NO: 1753929 - RNA, 21 nt, Human herpesvirus 1
cuauggcgccugacgcgccgc

SEQ ID NO: 1753930 - RNA, 14 nt, Human herpesvirus 1
cagccugcggccgg

SEQ ID NO: 1753931 - RNA, 19 nt, Human herpesvirus 1
acauccaggcgggccuacc

SEQ ID NO: 1753932 - RNA, 17 nt, Human herpesvirus 1
cgggauccucggccagc

SEQ ID NO: 1753933 - RNA, 16 nt, Human herpesvirus 1
cacaccccccaugcca

SEQ ID NO: 1753934 - RNA, 17 nt, Human herpesvirus 1
ccgcugacccccaccgc

SEQ ID NO: 1753935 - RNA, 21 nt, Human herpesvirus 1
ccguggggacgguggcgccgc

SEQ ID NO: 1753936 - RNA, 15 nt, Human herpesvirus 1
cccgacaccaccagc

SEQ ID NO: 1753937 - RNA, 19 nt, Human herpesvirus 1
ugccugacccucuccggga

SEQ ID NO: 1753938 - RNA, 15 nt, Human herpesvirus 1
acuggaugcgccgcc

SEQ ID NO: 1753939 - RNA, 22 nt, Human herpesvirus 1
ugaugucccucauuuuacaaua

SEQ ID NO: 1753940 - RNA, 20 nt, Human herpesvirus 1
ccaucgccucggccaccgug

SEQ ID NO: 1753941 - RNA, 18 nt, Human herpesvirus 1
acaccuuggcccuggcuc

SEQ ID NO: 1753942 - RNA, 22 nt, Human herpesvirus 1
ccuggcgccaaagcugcuggcg

SEQ ID NO: 1753943 - RNA, 17 nt, Human herpesvirus 1
ccagcgcggcggggccc

SEQ ID NO: 1753944 - RNA, 19 nt, Human herpesvirus 1
uggggagagcccacaugcg

SEQ ID NO: 1753945 - RNA, 15 nt, Human herpesvirus 1
gccuguuugagcaga

SEQ ID NO: 1753946 - RNA, 23 nt, Human herpesvirus 1
ucgaccaccauccccgcucccca

SEQ ID NO: 1753947 - RNA, 13 nt, Human herpesvirus 1
cccagccucccga

SEQ ID NO: 1753948 - RNA, 23 nt, Human herpesvirus 1
guaugucaccggcugagucccuc

SEQ ID NO: 1753949 - RNA, 17 nt, Human herpesvirus 1
gcucagcgccaagguca

SEQ ID NO: 1753950 - RNA, 23 nt, Human herpesvirus 1
ggggaggggggggucgggcgcug

SEQ ID NO: 1753951 - RNA, 18 nt, Human herpesvirus 1
auccccccgucagccugc

SEQ ID NO: 1753952 - RNA, 14 nt, Human herpesvirus 1
ggcgacgugauggc

SEQ ID NO: 1753953 - RNA, 22 nt, Human herpesvirus 1
ggacaccggcgcuacuucaccu

SEQ ID NO: 1753954 - RNA, 14 nt, Human herpesvirus 1
ggagaacccgacca

SEQ ID NO: 1753955 - RNA, 18 nt, Human herpesvirus 1
ucaccggugcgcccccca

SEQ ID NO: 1753956 - RNA, 17 nt, Human herpesvirus 1
ccacccaguuuccaccc

SEQ ID NO: 1753957 - RNA, 13 nt, Human herpesvirus 1
gguaggcccagca

SEQ ID NO: 1753958 - RNA, 20 nt, Human herpesvirus 1
acgaccuguugauggccugu

SEQ ID NO: 1753959 - RNA, 15 nt, Human herpesvirus 1
gcccugaugcaggau

SEQ ID NO: 1753960 - RNA, 23 nt, Human herpesvirus 1
cuggucgucgggcgccaaagccc

SEQ ID NO: 1753961 - RNA, 15 nt, Human herpesvirus 1
gucggaggcccccca

SEQ ID NO: 1753962 - RNA, 18 nt, Human herpesvirus 1
ccccuccgcgccaggccc

SEQ ID NO: 1753963 - RNA, 18 nt, Human herpesvirus 1
ugcgucgggccucccgga

SEQ ID NO: 1753964 - RNA, 20 nt, Human herpesvirus 1
cuggacguccccgaggaccc

SEQ ID NO: 1753965 - RNA, 15 nt, Human herpesvirus 1
cucccugacggccau

SEQ ID NO: 1753966 - RNA, 20 nt, Human herpesvirus 1
cgcaccgucggaggcccccc

SEQ ID NO: 1753967 - RNA, 20 nt, Human herpesvirus 1
guugacgcuggggguccugg

SEQ ID NO: 1753968 - RNA, 12 nt, Human herpesvirus 1
caccgcugggcg

SEQ ID NO: 1753969 - RNA, 21 nt, Human herpesvirus 1
cccgucuggguuuuccccucc

SEQ ID NO: 1753970 - RNA, 23 nt, Human herpesvirus 1
gacccgcaacgcgcuggggcugc

SEQ ID NO: 1753971 - RNA, 13 nt, Human herpesvirus 1
ggggagagcccac

SEQ ID NO: 1753972 - RNA, 20 nt, Human herpesvirus 1
gaccacgcccuuccccacgg

SEQ ID NO: 1753973 - RNA, 22 nt, Human herpesvirus 1
gucccgacauuaaccaccugcg

SEQ ID NO: 1753974 - RNA, 22 nt, Human herpesvirus 1
cauagccgccgaagggacucug

SEQ ID NO: 1753975 - RNA, 20 nt, Human herpesvirus 1
cgacaacgcgggcguucccg

SEQ ID NO: 1753976 - RNA, 20 nt, Human herpesvirus 1
cagauuguccgcggggccuc

SEQ ID NO: 1753977 - RNA, 18 nt, Human herpesvirus 1
uccugggccaccugacgc

SEQ ID NO: 1753978 - RNA, 15 nt, Human herpesvirus 1
cacuccggcgccgcc

SEQ ID NO: 1753979 - RNA, 21 nt, Human herpesvirus 1
cccggguacgaccaucacccg

SEQ ID NO: 1753980 - RNA, 21 nt, Human herpesvirus 1
cgccggcggucgcgcuccucu

SEQ ID NO: 1753981 - RNA, 13 nt, Human herpesvirus 1
acgcaccccccgc

SEQ ID NO: 1753982 - RNA, 21 nt, Human herpesvirus 1
ucacccccgaguucccccggg

SEQ ID NO: 1753983 - RNA, 16 nt, Human herpesvirus 1
cgcuggccgacguggc

SEQ ID NO: 1753984 - RNA, 11 nt, Human herpesvirus 1
accccacgccc

SEQ ID NO: 1753985 - RNA, 14 nt, Human herpesvirus 1
ccugggcccuggcc

SEQ ID NO: 1753986 - RNA, 17 nt, Human herpesvirus 1
ugggccaccgacagccu

SEQ ID NO: 1753987 - RNA, 12 nt, Human herpesvirus 1
ggcgggacucug

SEQ ID NO: 1753988 - RNA, 18 nt, Human herpesvirus 1
ggugucugggaauagagc

SEQ ID NO: 1753989 - RNA, 15 nt, Human herpesvirus 1
cguugcccgggccgu

SEQ ID NO: 1753990 - RNA, 14 nt, Human herpesvirus 1
caaggugggccagc

SEQ ID NO: 1753991 - RNA, 19 nt, Human herpesvirus 1
acccagccuuuaacuacau

SEQ ID NO: 1753992 - RNA, 14 nt, Human herpesvirus 1
ucacagccccgcau

SEQ ID NO: 1753993 - RNA, 18 nt, Human herpesvirus 1
uaaauuuuacaaacagau

SEQ ID NO: 1753994 - RNA, 15 nt, Human herpesvirus 1
cccgugucugugggc

SEQ ID NO: 1753995 - RNA, 18 nt, Human herpesvirus 1
gcuggguggucucuggcc

SEQ ID NO: 1753996 - RNA, 15 nt, Human herpesvirus 1
cagggcccgccaucu

SEQ ID NO: 1753997 - RNA, 13 nt, Human herpesvirus 1
ucccaacaacucc

SEQ ID NO: 1753998 - RNA, 20 nt, Human herpesvirus 1
cucagggccuccgaccccag

SEQ ID NO: 1753999 - RNA, 16 nt, Human herpesvirus 1
uucggaugggaggcaa

SEQ ID NO: 1754000 - RNA, 16 nt, Human herpesvirus 1
cggggaccccaucagc

SEQ ID NO: 1754001 - RNA, 19 nt, Human herpesvirus 1
guccgccaaauaaagccac

SEQ ID NO: 1754002 - RNA, 14 nt, Human herpesvirus 1
guuaauguaaauaa

SEQ ID NO: 1754003 - RNA, 15 nt, Human herpesvirus 1
uggccggggagggca

SEQ ID NO: 1754004 - RNA, 18 nt, Human herpesvirus 1
guggcacuaccccauggg

SEQ ID NO: 1754005 - RNA, 18 nt, Human herpesvirus 1
cuccccgggagccccgga

SEQ ID NO: 1754006 - RNA, 17 nt, Human herpesvirus 1
gggucaccugccaguca

SEQ ID NO: 1754007 - RNA, 19 nt, Human herpesvirus 1
cgccccggaagaccccgag

SEQ ID NO: 1754008 - RNA, 18 nt, Human herpesvirus 1
caagcccccgcccgaccg

SEQ ID NO: 1754009 - RNA, 20 nt, Human herpesvirus 1
cgacugcgaccccagccuuc

SEQ ID NO: 1754010 - RNA, 17 nt, Human herpesvirus 1
ucgguccacggccaagu

SEQ ID NO: 1754011 - RNA, 20 nt, Human herpesvirus 1
auguccccaaaauaaaagac

SEQ ID NO: 1754012 - RNA, 20 nt, Human herpesvirus 1
caugggacacaaaugcccac

SEQ ID NO: 1754013 - RNA, 15 nt, Human herpesvirus 1
ggagacagcgccugc

SEQ ID NO: 1754014 - RNA, 17 nt, Human herpesvirus 1
gcucccgccuuccggac

SEQ ID NO: 1754015 - RNA, 18 nt, Human herpesvirus 1
gcgagguggagcugcccg

SEQ ID NO: 1754016 - RNA, 20 nt, Human herpesvirus 1
ggacagccauauccugagcc

SEQ ID NO: 1754017 - RNA, 12 nt, Human herpesvirus 1
ggcgccccggcc

SEQ ID NO: 1754018 - RNA, 12 nt, Human herpesvirus 1
ggacccccggag

SEQ ID NO: 1754019 - RNA, 22 nt, Human herpesvirus 1
gcccugagacaagagcgcuccc

SEQ ID NO: 1754020 - RNA, 19 nt, Human herpesvirus 1
gaggaccgcgcccccgucc

SEQ ID NO: 1754021 - RNA, 17 nt, Human herpesvirus 1
cagccccccagccuccc

SEQ ID NO: 1754022 - RNA, 22 nt, Human herpesvirus 1
caggaaauccguggccccggcc

SEQ ID NO: 1754023 - RNA, 24 nt, Human herpesvirus 1
gcguccuucuugucgucucucuuc

SEQ ID NO: 1754024 - RNA, 16 nt, Human herpesvirus 1
uccgcuggggccccca

SEQ ID NO: 1754025 - RNA, 12 nt, Human herpesvirus 1
uacauggcccug

SEQ ID NO: 1754026 - RNA, 19 nt, Human herpesvirus 1
cggccccugggccccggga

SEQ ID NO: 1754027 - RNA, 14 nt, Human herpesvirus 1
acgugcccccuccu

SEQ ID NO: 1754028 - RNA, 19 nt, Human herpesvirus 1
cggcaccuauggcgccuga

SEQ ID NO: 1754029 - RNA, 21 nt, Human herpesvirus 1
gcaccacauaaccgaccgcag

SEQ ID NO: 1754030 - RNA, 22 nt, Human herpesvirus 1
cggagguggggcgggggccccg

SEQ ID NO: 1754031 - RNA, 16 nt, Human herpesvirus 1
ggccgcaggacccagc

SEQ ID NO: 1754032 - RNA, 22 nt, Human herpesvirus 1
cggcagucuccuggcagcccug

SEQ ID NO: 1754033 - RNA, 16 nt, Human herpesvirus 1
uggguuucacugaaac

SEQ ID NO: 1754034 - RNA, 15 nt, Human herpesvirus 1
cauccgagcaccccc

SEQ ID NO: 1754035 - RNA, 23 nt, Human herpesvirus 1
cacgguggugcaguucgagcagc

SEQ ID NO: 1754036 - RNA, 15 nt, Human herpesvirus 1
ucuauaucucugggc

SEQ ID NO: 1754037 - RNA, 13 nt, Human herpesvirus 1
aagccacaaaaug

SEQ ID NO: 1754038 - RNA, 15 nt, Human herpesvirus 1
uccaccccccauguc

SEQ ID NO: 1754039 - RNA, 13 nt, Human herpesvirus 1
cccagaccccggg

SEQ ID NO: 1754040 - RNA, 12 nt, Human herpesvirus 1
ucgugagagaau

SEQ ID NO: 1754041 - RNA, 22 nt, Human herpesvirus 1
gccgagcucaaaucgcauccga

SEQ ID NO: 1754042 - RNA, 12 nt, Human herpesvirus 1
cccccgggccgc

SEQ ID NO: 1754043 - RNA, 14 nt, Human herpesvirus 1
gcacaccggucccc

SEQ ID NO: 1754044 - RNA, 19 nt, Human herpesvirus 1
cgguacauggcccuggugu

SEQ ID NO: 1754045 - RNA, 24 nt, Human herpesvirus 1
guugccaucgcguggugcgagcug

SEQ ID NO: 1754046 - RNA, 18 nt, Human herpesvirus 1
gcucaaaucgcauccgag

SEQ ID NO: 1754047 - RNA, 16 nt, Human herpesvirus 1
ggccacuggccgggag

SEQ ID NO: 1754048 - RNA, 20 nt, Human herpesvirus 1
cccaaaacacacggagcugc

SEQ ID NO: 1754049 - RNA, 17 nt, Human herpesvirus 1
caacgcgacccucaccg

SEQ ID NO: 1754050 - RNA, 15 nt, Human herpesvirus 1
accgcgcccucgcca

SEQ ID NO: 1754051 - RNA, 20 nt, Human herpesvirus 1
agggauccacgacaaccccg

SEQ ID NO: 1754052 - RNA, 18 nt, Human herpesvirus 1
cgugcgggaacaccuccg

SEQ ID NO: 1754053 - RNA, 15 nt, Human herpesvirus 1
acgucgcgccugggu

SEQ ID NO: 1754054 - RNA, 14 nt, Human herpesvirus 1
aagccuacuacucg

SEQ ID NO: 1754055 - RNA, 14 nt, Human herpesvirus 1
auccagggagaaac

SEQ ID NO: 1754056 - RNA, 18 nt, Human herpesvirus 1
ggacauccaccacccggc

SEQ ID NO: 1754057 - RNA, 15 nt, Human herpesvirus 1
gcccgaccacacacc

SEQ ID NO: 1754058 - RNA, 14 nt, Human herpesvirus 1
caacgcacuguggc

SEQ ID NO: 1754059 - RNA, 15 nt, Human herpesvirus 1
gcgcuggccgugggu

SEQ ID NO: 1754060 - RNA, 19 nt, Human herpesvirus 1
gccuguguccgcuucucuu

SEQ ID NO: 1754061 - RNA, 12 nt, Human herpesvirus 1
ggcacccacgcc

SEQ ID NO: 1754062 - RNA, 14 nt, Human herpesvirus 1
ucgaccaccaccuc

SEQ ID NO: 1754063 - RNA, 17 nt, Human herpesvirus 1
uuuugucggugggggcu

SEQ ID NO: 1754064 - RNA, 12 nt, Human herpesvirus 1
ccacacagccgg

SEQ ID NO: 1754065 - RNA, 15 nt, Human herpesvirus 1
gccgccgcgccccgc

SEQ ID NO: 1754066 - RNA, 14 nt, Human herpesvirus 1
cuucagcgccguca

SEQ ID NO: 1754067 - RNA, 15 nt, Human herpesvirus 1
cccggaggaggcucu

SEQ ID NO: 1754068 - RNA, 21 nt, Human herpesvirus 1
uggugucugccauggagcgca

SEQ ID NO: 1754069 - RNA, 17 nt, Human herpesvirus 1
cccgacaccaccagcug

SEQ ID NO: 1754070 - RNA, 16 nt, Human herpesvirus 1
gaccaggcgcgccgcg

SEQ ID NO: 1754071 - RNA, 20 nt, Human herpesvirus 1
cggccacgggcugcguguca

SEQ ID NO: 1754072 - RNA, 16 nt, Human herpesvirus 1
ugguccucgaggaggc

SEQ ID NO: 1754073 - RNA, 19 nt, Human herpesvirus 1
gccgccgaagggacucugg

SEQ ID NO: 1754074 - RNA, 19 nt, Human herpesvirus 1
cuaagcgucccugggcccu

SEQ ID NO: 1754075 - RNA, 14 nt, Human herpesvirus 1
guacgccccaccgg

SEQ ID NO: 1754076 - RNA, 13 nt, Human herpesvirus 1
cgacagccccccc

SEQ ID NO: 1754077 - RNA, 14 nt, Human herpesvirus 1
cucaugcgcgguga

SEQ ID NO: 1754078 - RNA, 14 nt, Human herpesvirus 1
acucucgcaccauc

SEQ ID NO: 1754079 - RNA, 22 nt, Human herpesvirus 1
cgguccggagccgcgcggccac

SEQ ID NO: 1754080 - RNA, 17 nt, Human herpesvirus 1
cggcagcccggaggcgc

SEQ ID NO: 1754081 - RNA, 15 nt, Human herpesvirus 1
acuacaccagccaau

SEQ ID NO: 1754082 - RNA, 22 nt, Human herpesvirus 1
cgaagccccggcccugaugcag

SEQ ID NO: 1754083 - RNA, 18 nt, Human herpesvirus 1
cccaccgcgcuccucccg

SEQ ID NO: 1754084 - RNA, 16 nt, Human herpesvirus 1
uccugauguggcugcu

SEQ ID NO: 1754085 - RNA, 20 nt, Human herpesvirus 1
ggagagacgauggcaggagc

SEQ ID NO: 1754086 - RNA, 17 nt, Human herpesvirus 1
cuggccgggagcaccac

SEQ ID NO: 1754087 - RNA, 12 nt, Human herpesvirus 1
caugccacccuc

SEQ ID NO: 1754088 - RNA, 23 nt, Human herpesvirus 1
acugcggucugucucgucuccuc

SEQ ID NO: 1754089 - RNA, 14 nt, Human herpesvirus 1
cccacuccuccccg

SEQ ID NO: 1754090 - RNA, 12 nt, Human herpesvirus 1
cgccccucgggu

SEQ ID NO: 1754091 - RNA, 14 nt, Human herpesvirus 1
gacccgcauccccc

SEQ ID NO: 1754092 - RNA, 22 nt, Human herpesvirus 1
ucccggcgggguuauaggccac

SEQ ID NO: 1754093 - RNA, 21 nt, Human herpesvirus 1
cgcguguuccccgggagcccc

SEQ ID NO: 1754094 - RNA, 19 nt, Human herpesvirus 1
gagugucgcagcaccuccu

SEQ ID NO: 1754095 - RNA, 21 nt, Human herpesvirus 1
gguggaucuuagccuccccgg

SEQ ID NO: 1754096 - RNA, 17 nt, Human herpesvirus 1
cgucaccaugcagcgcc

SEQ ID NO: 1754097 - RNA, 21 nt, Human herpesvirus 1
guuugggagagccggccccgg

SEQ ID NO: 1754098 - RNA, 11 nt, Human herpesvirus 1
cccccuggccu

SEQ ID NO: 1754099 - RNA, 14 nt, Human herpesvirus 1
gccccggaagaccc

SEQ ID NO: 1754100 - RNA, 12 nt, Human herpesvirus 1
ccggaggugggg

SEQ ID NO: 1754101 - RNA, 11 nt, Human herpesvirus 1
ccggccugggc

SEQ ID NO: 1754102 - RNA, 13 nt, Human herpesvirus 1
cccuggcgccgcc

SEQ ID NO: 1754103 - RNA, 12 nt, Human herpesvirus 1
acauccccccga

SEQ ID NO: 1754104 - RNA, 13 nt, Human herpesvirus 1
gcguccacccgga

SEQ ID NO: 1754105 - RNA, 23 nt, Human herpesvirus 1
acaugaccgcccgccccucgcca

SEQ ID NO: 1754106 - RNA, 18 nt, Human herpesvirus 1
cguguuugcccauaauaa

SEQ ID NO: 1754107 - RNA, 21 nt, Human herpesvirus 1
cgggagccccggaccccacgc

SEQ ID NO: 1754108 - RNA, 22 nt, Human herpesvirus 1
agaaccuuuaggaugccagcca

SEQ ID NO: 1754109 - RNA, 19 nt, Human herpesvirus 1
cagucuccuggcagcccug

SEQ ID NO: 1754110 - RNA, 16 nt, Human herpesvirus 1
ggccauguugggccgc

SEQ ID NO: 1754111 - RNA, 14 nt, Human herpesvirus 1
gauggggagagccc

SEQ ID NO: 1754112 - RNA, 14 nt, Human herpesvirus 1
aaagccacugaaac

SEQ ID NO: 1754113 - RNA, 14 nt, Human herpesvirus 1
cuccacccccucga

SEQ ID NO: 1754114 - RNA, 13 nt, Human herpesvirus 1
uucgccccacaca

SEQ ID NO: 1754115 - RNA, 19 nt, Human herpesvirus 1
gugggucuguugguccugg

SEQ ID NO: 1754116 - RNA, 18 nt, Human herpesvirus 1
gacaacgcgacaggccag

SEQ ID NO: 1754117 - RNA, 15 nt, Human herpesvirus 1
ccagcuacgccgccg

SEQ ID NO: 1754118 - RNA, 14 nt, Human herpesvirus 1
guuugguccccccu

SEQ ID NO: 1754119 - RNA, 15 nt, Human herpesvirus 1
cuggccgcgcccacu

SEQ ID NO: 1754120 - RNA, 18 nt, Human herpesvirus 1
acacgagcacccugcugc

SEQ ID NO: 1754121 - RNA, 15 nt, Human herpesvirus 1
cgugcguagcauacc

SEQ ID NO: 1754122 - RNA, 22 nt, Human herpesvirus 1
ccacauaaccgaccgcaguccc

SEQ ID NO: 1754123 - RNA, 19 nt, Human herpesvirus 1
cccgccgcaaagccaccca

SEQ ID NO: 1754124 - RNA, 13 nt, Human herpesvirus 1
auauccugagccc

SEQ ID NO: 1754125 - RNA, 14 nt, Human herpesvirus 1
gggggucggcaggc

SEQ ID NO: 1754126 - RNA, 16 nt, Human herpesvirus 1
cccuccgcaucccagg

SEQ ID NO: 1754127 - RNA, 15 nt, Human herpesvirus 1
cgccagccugcggcc

SEQ ID NO: 1754128 - RNA, 17 nt, Human herpesvirus 1
cccgcccaccgcugggc

SEQ ID NO: 1754129 - RNA, 17 nt, Human herpesvirus 1
ccugggggacugcaucg

SEQ ID NO: 1754130 - RNA, 21 nt, Human herpesvirus 1
cccgcgcuaugacggcaauaa

SEQ ID NO: 1754131 - RNA, 17 nt, Human herpesvirus 1
gacgcucccgucgcccg

SEQ ID NO: 1754132 - RNA, 14 nt, Human herpesvirus 1
cgggcccggccagg

SEQ ID NO: 1754133 - RNA, 14 nt, Human herpesvirus 1
gcagcuccccauga

SEQ ID NO: 1754134 - RNA, 13 nt, Human herpesvirus 1
ggccgugugacac

SEQ ID NO: 1754135 - RNA, 18 nt, Human herpesvirus 1
gugaacgcaacggcggga

SEQ ID NO: 1754136 - RNA, 19 nt, Human herpesvirus 1
ccaagccgggacuccgcgg

SEQ ID NO: 1754137 - RNA, 12 nt, Human herpesvirus 1
cccggcucuccg

SEQ ID NO: 1754138 - RNA, 20 nt, Human herpesvirus 1
ccucccugacggccaucgcc

SEQ ID NO: 1754139 - RNA, 15 nt, Human herpesvirus 1
cuguauagcccgggc

SEQ ID NO: 1754140 - RNA, 18 nt, Human herpesvirus 1
acgcgcguccuucuuguc

SEQ ID NO: 1754141 - RNA, 21 nt, Human herpesvirus 1
aucccacguccccgggucugu

SEQ ID NO: 1754142 - RNA, 13 nt, Human herpesvirus 1
gaugccagccagg

SEQ ID NO: 1754143 - RNA, 17 nt, Human herpesvirus 1
gccggggagggcagggc

SEQ ID NO: 1754144 - RNA, 24 nt, Human herpesvirus 1
cggguccaaacucccgacaccacc

SEQ ID NO: 1754145 - RNA, 21 nt, Human herpesvirus 1
ccccagagguguucacgcacc

SEQ ID NO: 1754146 - RNA, 15 nt, Human herpesvirus 1
caccaacgcacgagc

SEQ ID NO: 1754147 - RNA, 20 nt, Human herpesvirus 1
ccuuuuggguuucacugaaa

SEQ ID NO: 1754148 - RNA, 21 nt, Human herpesvirus 1
aauaacgacccgaagcugcuc

SEQ ID NO: 1754149 - RNA, 14 nt, Human herpesvirus 1
ccggggagggcagg

SEQ ID NO: 1754150 - RNA, 22 nt, Human herpesvirus 1
cagcgaccccacggccuccgcg

SEQ ID NO: 1754151 - RNA, 15 nt, Human herpesvirus 1
cugacgcgccuagcc

SEQ ID NO: 1754152 - RNA, 21 nt, Human herpesvirus 1
gaccuggggucgcucugucca

SEQ ID NO: 1754153 - RNA, 14 nt, Human herpesvirus 1
cgaacccagcgacc

SEQ ID NO: 1754154 - RNA, 15 nt, Human herpesvirus 1
guuacucggcccccg

SEQ ID NO: 1754155 - RNA, 15 nt, Human herpesvirus 1
gggagagcccacaug

SEQ ID NO: 1754156 - RNA, 17 nt, Human herpesvirus 1
gcgaggagggcggcgac

SEQ ID NO: 1754157 - RNA, 16 nt, Human herpesvirus 1
agugaaagacacgggc

SEQ ID NO: 1754158 - RNA, 15 nt, Human herpesvirus 1
cgacccaccaauaaa

SEQ ID NO: 1754159 - RNA, 23 nt, Human herpesvirus 1
cagcuuuuuuugcgaaccguccc

SEQ ID NO: 1754160 - RNA, 13 nt, Human herpesvirus 1
gccgcgggccccc

SEQ ID NO: 1754161 - RNA, 20 nt, Human herpesvirus 1
ugcccuuccaggucccaccu

SEQ ID NO: 1754162 - RNA, 17 nt, Human herpesvirus 1
ccuggccaaugggggcu

SEQ ID NO: 1754163 - RNA, 20 nt, Human herpesvirus 1
ccuucgccccacacagcccu

SEQ ID NO: 1754164 - RNA, 17 nt, Human herpesvirus 1
uccugcgccccgccgcc

SEQ ID NO: 1754165 - RNA, 23 nt, Human herpesvirus 1
gucaccgguucguauccacaaua

SEQ ID NO: 1754166 - RNA, 16 nt, Human herpesvirus 1
cugcacgaccugcgcu

SEQ ID NO: 1754167 - RNA, 19 nt, Human herpesvirus 1
gagcucaucgcgacccugu

SEQ ID NO: 1754168 - RNA, 18 nt, Human herpesvirus 1
acccgcuaaccaccaagg

SEQ ID NO: 1754169 - RNA, 18 nt, Human herpesvirus 1
ccuccccgcgcaugcucu

SEQ ID NO: 1754170 - RNA, 14 nt, Human herpesvirus 1
gcgaccaccccaaa

SEQ ID NO: 1754171 - RNA, 17 nt, Human herpesvirus 1
gguuacgcgggccccgg

SEQ ID NO: 1754172 - RNA, 13 nt, Human herpesvirus 1
ggcgcggggcccc

SEQ ID NO: 1754173 - RNA, 15 nt, Human herpesvirus 1
ucaacauaccccgcu

SEQ ID NO: 1754174 - RNA, 13 nt, Human herpesvirus 1
ccuuuggggcgcu

SEQ ID NO: 1754175 - RNA, 22 nt, Human herpesvirus 1
acgcgcggcugguccacaccca

SEQ ID NO: 1754176 - RNA, 12 nt, Human herpesvirus 1
ucccggcgccgg

SEQ ID NO: 1754177 - RNA, 21 nt, Human herpesvirus 1
ccuggagcucaaucuggccca

SEQ ID NO: 1754178 - RNA, 12 nt, Human herpesvirus 1
cgagccccccgc

SEQ ID NO: 1754179 - RNA, 13 nt, Human herpesvirus 1
ugcacgcccccgc

SEQ ID NO: 1754180 - RNA, 14 nt, Human herpesvirus 1
ccucguggccccga

SEQ ID NO: 1754181 - RNA, 12 nt, Human herpesvirus 1
gccaaccaagag

SEQ ID NO: 1754182 - RNA, 15 nt, Human herpesvirus 1
cagccacuuccccga

SEQ ID NO: 1754183 - RNA, 14 nt, Human herpesvirus 1
cagacucucgguga

SEQ ID NO: 1754184 - RNA, 18 nt, Human herpesvirus 1
aguuggcauuggauccgg

SEQ ID NO: 1754185 - RNA, 20 nt, Human herpesvirus 1
accaaacaaacaaaccaaaa

SEQ ID NO: 1754186 - RNA, 19 nt, Human herpesvirus 1
acggggccgggagcgccag

SEQ ID NO: 1754187 - RNA, 21 nt, Human herpesvirus 1
cccgcuccugugcacccucac

SEQ ID NO: 1754188 - RNA, 12 nt, Human herpesvirus 1
gaagcugauguc

SEQ ID NO: 1754189 - RNA, 22 nt, Human herpesvirus 1
gugcccauuuacguggcugggu

SEQ ID NO: 1754190 - RNA, 16 nt, Human herpesvirus 1
cggcucggccuauggc

SEQ ID NO: 1754191 - RNA, 12 nt, Human herpesvirus 1
cauuagggagaa

SEQ ID NO: 1754192 - RNA, 17 nt, Human herpesvirus 1
ggcgacgcacacacccu

SEQ ID NO: 1754193 - RNA, 15 nt, Human herpesvirus 1
ccgacucaccucaaa

SEQ ID NO: 1754194 - RNA, 18 nt, Human herpesvirus 1
accacgugcacagccugg

SEQ ID NO: 1754195 - RNA, 13 nt, Human herpesvirus 1
aggcccgggccac

SEQ ID NO: 1754196 - RNA, 17 nt, Human herpesvirus 1
uccaugcagugcauggc

SEQ ID NO: 1754197 - RNA, 16 nt, Human herpesvirus 1
cgcgguagcccggccg

SEQ ID NO: 1754198 - RNA, 23 nt, Human herpesvirus 1
caccagccugguuguccguggcc

SEQ ID NO: 1754199 - RNA, 16 nt, Human herpesvirus 1
gcaagguggugauggg

SEQ ID NO: 1754200 - RNA, 18 nt, Human herpesvirus 1
cacaacggcaugccucug

SEQ ID NO: 1754201 - RNA, 18 nt, Human herpesvirus 1
cgaccgcagucccugagu

SEQ ID NO: 1754202 - RNA, 17 nt, Human herpesvirus 1
cggcaaagaccuuccgg

SEQ ID NO: 1754203 - RNA, 18 nt, Human herpesvirus 1
ucgucgggcgccaaagcc

SEQ ID NO: 1754204 - RNA, 17 nt, Human herpesvirus 1
accgcccaccuccuggc

SEQ ID NO: 1754205 - RNA, 21 nt, Human herpesvirus 1
ccgcgccgcugcccgacccgg

SEQ ID NO: 1754206 - RNA, 18 nt, Human herpesvirus 1
cggucuccccgggagccc

SEQ ID NO: 1754207 - RNA, 15 nt, Human herpesvirus 1
ccucaaguacaaccc

SEQ ID NO: 1754208 - RNA, 14 nt, Human herpesvirus 1
cucucccgggccgc

SEQ ID NO: 1754209 - RNA, 17 nt, Human herpesvirus 1
ccucgaccaccaccucc

SEQ ID NO: 1754210 - RNA, 20 nt, Human herpesvirus 1
ucccucgcaugaagccccca

SEQ ID NO: 1754211 - RNA, 15 nt, Human herpesvirus 1
ccgguaugguaauua

SEQ ID NO: 1754212 - RNA, 23 nt, Human herpesvirus 1
gccccauacacgagcacccugcu

SEQ ID NO: 1754213 - RNA, 14 nt, Human herpesvirus 1
uuguuccgcuuccc

SEQ ID NO: 1754214 - RNA, 19 nt, Human herpesvirus 1
gcgggccucgugggcacuu

SEQ ID NO: 1754215 - RNA, 15 nt, Human herpesvirus 1
ccccgauccgcgucu

SEQ ID NO: 1754216 - RNA, 21 nt, Human herpesvirus 1
caggccguuccgaucgcccug

SEQ ID NO: 1754217 - RNA, 22 nt, Human herpesvirus 1
ucagggcucuacccucuggacg

SEQ ID NO: 1754218 - RNA, 16 nt, Human herpesvirus 1
gcucggcuccccgccg

SEQ ID NO: 1754219 - RNA, 21 nt, Human herpesvirus 1
cacaacggcaugccucugcgg

SEQ ID NO: 1754220 - RNA, 22 nt, Human herpesvirus 1
acaggggccauguugggccgcc

SEQ ID NO: 1754221 - RNA, 13 nt, Human herpesvirus 1
uauauccguguau

SEQ ID NO: 1754222 - RNA, 18 nt, Human herpesvirus 1
cugcuccccaccccggag

SEQ ID NO: 1754223 - RNA, 12 nt, Human herpesvirus 1
ggaccuccugga

SEQ ID NO: 1754224 - RNA, 22 nt, Human herpesvirus 1
cgccugcguucaucggaccccc

SEQ ID NO: 1754225 - RNA, 23 nt, Human herpesvirus 1
cgggcgacgcacacacccuagcg

SEQ ID NO: 1754226 - RNA, 15 nt, Human herpesvirus 1
ugccucuccccccag

SEQ ID NO: 1754227 - RNA, 14 nt, Human herpesvirus 1
cgccggccgcaccc

SEQ ID NO: 1754228 - RNA, 13 nt, Human herpesvirus 1
uggcugccccccc

SEQ ID NO: 1754229 - RNA, 20 nt, Human herpesvirus 1
gccauguuugcgggccuggg

SEQ ID NO: 1754230 - RNA, 13 nt, Human herpesvirus 1
aggugcgccaggu

SEQ ID NO: 1754231 - RNA, 20 nt, Human herpesvirus 1
acccccccggagccgggcgc

SEQ ID NO: 1754232 - RNA, 23 nt, Human herpesvirus 1
ccuccgcgccaggcccgccgcca

SEQ ID NO: 1754233 - RNA, 16 nt, Human herpesvirus 1
cgcugcuccgccuggc

SEQ ID NO: 1754234 - RNA, 20 nt, Human herpesvirus 1
uggcgcagcugggaccccgg

SEQ ID NO: 1754235 - RNA, 15 nt, Human herpesvirus 1
cucccgacaccacca

SEQ ID NO: 1754236 - RNA, 18 nt, Human herpesvirus 1
uugcggccacgggcugcg

SEQ ID NO: 1754237 - RNA, 14 nt, Human herpesvirus 1
cguguucagggcga

SEQ ID NO: 1754238 - RNA, 15 nt, Human herpesvirus 1
cacgagcgcgcugcu

SEQ ID NO: 1754239 - RNA, 19 nt, Human herpesvirus 1
ugcgcgaucccccgccccc

SEQ ID NO: 1754240 - RNA, 19 nt, Human herpesvirus 1
ggcccgggggccugguggc

SEQ ID NO: 1754241 - RNA, 18 nt, Human herpesvirus 1
aggguauggggcggggga

SEQ ID NO: 1754242 - RNA, 23 nt, Human herpesvirus 1
gguugcggcccgcguuuggccug

SEQ ID NO: 1754243 - RNA, 18 nt, Human herpesvirus 1
ccaccacccggccggugg

SEQ ID NO: 1754244 - RNA, 22 nt, Human herpesvirus 1
gcccugagcgcccuccugacca

SEQ ID NO: 1754245 - RNA, 20 nt, Human herpesvirus 1
ccggucaacgaggguugggg

SEQ ID NO: 1754246 - RNA, 24 nt, Human herpesvirus 1
gaagaccugcuuauucucggggag

SEQ ID NO: 1754247 - RNA, 23 nt, Human herpesvirus 1
ggacccgugacacccuaccccag

SEQ ID NO: 1754248 - RNA, 16 nt, Human herpesvirus 1
cuccuccccgcgccgu

SEQ ID NO: 1754249 - RNA, 19 nt, Human herpesvirus 1
gaccaguuuugcgaggagc

SEQ ID NO: 1754250 - RNA, 16 nt, Human herpesvirus 1
ggcguaacguuccgcc

SEQ ID NO: 1754251 - RNA, 12 nt, Human herpesvirus 1
cccaccagcuga

SEQ ID NO: 1754252 - RNA, 14 nt, Human herpesvirus 1
ccccuagccccgcc

SEQ ID NO: 1754253 - RNA, 15 nt, Human herpesvirus 1
cccagcggcacgacc

SEQ ID NO: 1754254 - RNA, 17 nt, Human herpesvirus 1
gcgggggauggggagag

SEQ ID NO: 1754255 - RNA, 15 nt, Human herpesvirus 1
ugggcggccccggcc

SEQ ID NO: 1754256 - RNA, 18 nt, Human herpesvirus 1
cgucgccuggcugaccca

SEQ ID NO: 1754257 - RNA, 23 nt, Human herpesvirus 1
cguugggguggaucuuagccucc

SEQ ID NO: 1754258 - RNA, 17 nt, Human herpesvirus 1
ccacccccgccguccga

SEQ ID NO: 1754259 - RNA, 17 nt, Human herpesvirus 1
cgcccgccaucgagcca

SEQ ID NO: 1754260 - RNA, 21 nt, Human herpesvirus 1
cgccccccguggaccccacga

SEQ ID NO: 1754261 - RNA, 17 nt, Human herpesvirus 1
uaacuacauuaaauugg

SEQ ID NO: 1754262 - RNA, 14 nt, Human herpesvirus 1
ccggggcucagcca

SEQ ID NO: 1754263 - RNA, 19 nt, Human herpesvirus 1
cugggccaccugacgcgcc

SEQ ID NO: 1754264 - RNA, 17 nt, Human herpesvirus 1
caaaauaaaagaccaaa

SEQ ID NO: 1754265 - RNA, 22 nt, Human herpesvirus 1
ggccccauacacgagcacccug

SEQ ID NO: 1754266 - RNA, 12 nt, Human herpesvirus 1
gguccacaccca

SEQ ID NO: 1754267 - RNA, 13 nt, Human herpesvirus 1
cauccagggagaa

SEQ ID NO: 1754268 - RNA, 16 nt, Human herpesvirus 1
cacccacccaccaaga

SEQ ID NO: 1754269 - RNA, 13 nt, Human herpesvirus 1
ggucuggcccacg

SEQ ID NO: 1754270 - RNA, 18 nt, Human herpesvirus 1
gcuugguuucggauggga

SEQ ID NO: 1754271 - RNA, 14 nt, Human herpesvirus 1
gaacacaaggccaa

SEQ ID NO: 1754272 - RNA, 19 nt, Human herpesvirus 1
ccccgaggauucggcccuc

SEQ ID NO: 1754273 - RNA, 17 nt, Human herpesvirus 1
gcgccgucgggcguccc

SEQ ID NO: 1754274 - RNA, 22 nt, Human herpesvirus 1
ccgucgcccgauuuacagcccc

SEQ ID NO: 1754275 - RNA, 22 nt, Human herpesvirus 1
gccagcuaugggcccugcuccg

SEQ ID NO: 1754276 - RNA, 17 nt, Human herpesvirus 1
cgaccacgcccuucccc

SEQ ID NO: 1754277 - RNA, 15 nt, Human herpesvirus 1
cgaacgggggcccug

SEQ ID NO: 1754278 - RNA, 17 nt, Human herpesvirus 1
ggcgcaauugcggccac

SEQ ID NO: 1754279 - RNA, 18 nt, Human herpesvirus 1
ccggcccauugggcggga

SEQ ID NO: 1754280 - RNA, 13 nt, Human herpesvirus 1
guccccaaaauaa

SEQ ID NO: 1754281 - RNA, 17 nt, Human herpesvirus 1
guuggcgucgggaccau

SEQ ID NO: 1754282 - RNA, 15 nt, Human herpesvirus 1
accccaugaaggccc

SEQ ID NO: 1754283 - RNA, 24 nt, Human herpesvirus 1
gcccaacucucgcaccaucccggg

SEQ ID NO: 1754284 - RNA, 20 nt, Human herpesvirus 1
ggcccgggccacggcgccga

SEQ ID NO: 1754285 - RNA, 16 nt, Human herpesvirus 1
accccaacuccagacc

SEQ ID NO: 1754286 - RNA, 19 nt, Human herpesvirus 1
ccgcuuuaucccacggccu

SEQ ID NO: 1754287 - RNA, 16 nt, Human herpesvirus 1
gcgcaccuguuccgcc

SEQ ID NO: 1754288 - RNA, 13 nt, Human herpesvirus 1
agaggcccacgcc

SEQ ID NO: 1754289 - RNA, 14 nt, Human herpesvirus 1
cuucccccccauca

SEQ ID NO: 1754290 - RNA, 21 nt, Human herpesvirus 1
ccccaacgccacgcagccaga

SEQ ID NO: 1754291 - RNA, 16 nt, Human herpesvirus 1
uucguggaaccaugac

SEQ ID NO: 1754292 - RNA, 22 nt, Human herpesvirus 1
cagcaucgggaugcugccccgc

SEQ ID NO: 1754293 - RNA, 21 nt, Human herpesvirus 1
agaccggauggaggagccccu

SEQ ID NO: 1754294 - RNA, 17 nt, Human herpesvirus 1
aaaagaccgcaucgaca

SEQ ID NO: 1754295 - RNA, 19 nt, Human herpesvirus 1
cacgcucuccccugcugcc

SEQ ID NO: 1754296 - RNA, 21 nt, Human herpesvirus 1
gacccccuuguauguccccaa

SEQ ID NO: 1754297 - RNA, 17 nt, Human herpesvirus 1
acccugcgcgagcaccu

SEQ ID NO: 1754298 - RNA, 17 nt, Human herpesvirus 1
augaccgcccgccccuc

SEQ ID NO: 1754299 - RNA, 17 nt, Human herpesvirus 1
gacggcccgaagccugc

SEQ ID NO: 1754300 - RNA, 18 nt, Human herpesvirus 1
ccccucugggcccgccug

SEQ ID NO: 1754301 - RNA, 23 nt, Human herpesvirus 1
ggacacuacgaucucgaagccau

SEQ ID NO: 1754302 - RNA, 21 nt, Human herpesvirus 1
cggacccucucuucucucccg

SEQ ID NO: 1754303 - RNA, 19 nt, Human herpesvirus 1
cagcgacguccugggccac

SEQ ID NO: 1754304 - RNA, 21 nt, Human herpesvirus 1
ugcgcgggguuacgcgggccc

SEQ ID NO: 1754305 - RNA, 20 nt, Human herpesvirus 1
gggccucccggaagagccug

SEQ ID NO: 1754306 - RNA, 17 nt, Human herpesvirus 1
cccgggccgcaccgggc

SEQ ID NO: 1754307 - RNA, 17 nt, Human herpesvirus 1
cagccuggucgaggcgg

SEQ ID NO: 1754308 - RNA, 20 nt, Human herpesvirus 1
agaaguaauaguccguguuc

SEQ ID NO: 1754309 - RNA, 16 nt, Human herpesvirus 1
gaccacgagaccgaca

SEQ ID NO: 1754310 - RNA, 23 nt, Human herpesvirus 1
ccacgccgacgccaacgccgcca

SEQ ID NO: 1754311 - RNA, 13 nt, Human herpesvirus 1
gcggggggugggu

SEQ ID NO: 1754312 - RNA, 14 nt, Human herpesvirus 1
aggaccccgugggc

SEQ ID NO: 1754313 - RNA, 23 nt, Human herpesvirus 1
ggagagcccacaugcggaaagca

SEQ ID NO: 1754314 - RNA, 20 nt, Human herpesvirus 1
aacccccuccgcgccaggcc

SEQ ID NO: 1754315 - RNA, 14 nt, Human herpesvirus 1
guggacccaaagcc

SEQ ID NO: 1754316 - RNA, 20 nt, Human herpesvirus 1
ccacacccaguggcuccggg

SEQ ID NO: 1754317 - RNA, 16 nt, Human herpesvirus 1
cguccucgcaccagcc

SEQ ID NO: 1754318 - RNA, 23 nt, Human herpesvirus 1
gucgcccgauuuacagcccccag

SEQ ID NO: 1754319 - RNA, 16 nt, Human herpesvirus 1
guccgcggaccggcgg

SEQ ID NO: 1754320 - RNA, 16 nt, Human herpesvirus 1
accgcgugcccacguc

SEQ ID NO: 1754321 - RNA, 18 nt, Human herpesvirus 1
cgccccuguggcccuggc

SEQ ID NO: 1754322 - RNA, 19 nt, Human herpesvirus 1
gcgcauacgccucccccac

SEQ ID NO: 1754323 - RNA, 17 nt, Human herpesvirus 1
ucccccaagggggaggg

SEQ ID NO: 1754324 - RNA, 22 nt, Human herpesvirus 1
ggcugucgacgcccccucccug

SEQ ID NO: 1754325 - RNA, 21 nt, Human herpesvirus 1
ggggcuguacucgacccacug

SEQ ID NO: 1754326 - RNA, 16 nt, Human herpesvirus 1
ggcggcgacgugcccc

SEQ ID NO: 1754327 - RNA, 13 nt, Human herpesvirus 1
ccucguggccccg

SEQ ID NO: 1754328 - RNA, 20 nt, Human herpesvirus 1
guacaaguucaaggccacca

SEQ ID NO: 1754329 - RNA, 15 nt, Human herpesvirus 1
gugcuuucuggugcu

SEQ ID NO: 1754330 - RNA, 14 nt, Human herpesvirus 1
cauugguguauguu

SEQ ID NO: 1754331 - RNA, 13 nt, Human herpesvirus 1
agguugggggccg

SEQ ID NO: 1754332 - RNA, 14 nt, Human herpesvirus 1
ccgcguccacccgg

SEQ ID NO: 1754333 - RNA, 21 nt, Human herpesvirus 1
cgaagacccccccggagccgg

SEQ ID NO: 1754334 - RNA, 14 nt, Human herpesvirus 1
cggucauccacgcc

SEQ ID NO: 1754335 - RNA, 12 nt, Human herpesvirus 1
ccucggccagcu

SEQ ID NO: 1754336 - RNA, 12 nt, Human herpesvirus 1
ccccuccauccc

SEQ ID NO: 1754337 - RNA, 17 nt, Human herpesvirus 1
caagaccaacccagcca

SEQ ID NO: 1754338 - RNA, 18 nt, Human herpesvirus 1
gaggagcccgcccuucgc

SEQ ID NO: 1754339 - RNA, 14 nt, Human herpesvirus 1
gcgacaacgcgacc

SEQ ID NO: 1754340 - RNA, 11 nt, Human herpesvirus 1
uacaaacagau

SEQ ID NO: 1754341 - RNA, 21 nt, Human herpesvirus 1
ggccuggugcucgugggccuc

SEQ ID NO: 1754342 - RNA, 20 nt, Human herpesvirus 1
uaggagacaccuuggcccug

SEQ ID NO: 1754343 - RNA, 21 nt, Human herpesvirus 1
uggguuggcgucgggaccauc

SEQ ID NO: 1754344 - RNA, 18 nt, Human herpesvirus 1
cucacagggcgggccgcc

SEQ ID NO: 1754345 - RNA, 15 nt, Human herpesvirus 1
ccgcgucuggccccg

SEQ ID NO: 1754346 - RNA, 14 nt, Human herpesvirus 1
agguacggggcggc

SEQ ID NO: 1754347 - RNA, 18 nt, Human herpesvirus 1
uuugcacccagccuuuaa

SEQ ID NO: 1754348 - RNA, 19 nt, Human herpesvirus 1
guccccgggucuguugggg

SEQ ID NO: 1754349 - RNA, 16 nt, Human herpesvirus 1
ggaggugcccccgcgc

SEQ ID NO: 1754350 - RNA, 21 nt, Human herpesvirus 1
caccgacaccgcacugcggcu

SEQ ID NO: 1754351 - RNA, 16 nt, Human herpesvirus 1
gggauccgacccccau

SEQ ID NO: 1754352 - RNA, 13 nt, Human herpesvirus 1
cgccagggccucg

SEQ ID NO: 1754353 - RNA, 14 nt, Human herpesvirus 1
gcccaccuccuggc

SEQ ID NO: 1754354 - RNA, 20 nt, Human herpesvirus 1
cuccuggccuacgucuccgu

SEQ ID NO: 1754355 - RNA, 14 nt, Human herpesvirus 1
gaugcccacgggca

SEQ ID NO: 1754356 - RNA, 17 nt, Human herpesvirus 1
aagcaagaacaauaaag

SEQ ID NO: 1754357 - RNA, 20 nt, Human herpesvirus 1
ugcugcccccggagcugucc

SEQ ID NO: 1754358 - RNA, 18 nt, Human herpesvirus 1
ccugauguggcugcuccg

SEQ ID NO: 1754359 - RNA, 23 nt, Human herpesvirus 1
caggacuuccccuuccucgcgga

SEQ ID NO: 1754360 - RNA, 15 nt, Human herpesvirus 1
gccgcccuagaggcu

SEQ ID NO: 1754361 - RNA, 23 nt, Human herpesvirus 1
ccggugaacgccuccgcccgugc

SEQ ID NO: 1754362 - RNA, 18 nt, Human herpesvirus 1
gccugccucuccccccag

SEQ ID NO: 1754363 - RNA, 18 nt, Human herpesvirus 1
gaccacgugcacagccug

SEQ ID NO: 1754364 - RNA, 13 nt, Human herpesvirus 1
cucggggagcuuc

SEQ ID NO: 1754365 - RNA, 19 nt, Human herpesvirus 1
ccaacacaacggcaugccu

SEQ ID NO: 1754366 - RNA, 19 nt, Human herpesvirus 1
cuucgcuuugugggggacc

SEQ ID NO: 1754367 - RNA, 12 nt, Human herpesvirus 1
uauaaggccugg

SEQ ID NO: 1754368 - RNA, 21 nt, Human herpesvirus 1
cgccgcgaguacguggccggu

SEQ ID NO: 1754369 - RNA, 18 nt, Human herpesvirus 1
ccacggguguggggaccc

SEQ ID NO: 1754370 - RNA, 15 nt, Human herpesvirus 1
gccugacgcgccgcg

SEQ ID NO: 1754371 - RNA, 19 nt, Human herpesvirus 1
gcuauccccaucacgguca

SEQ ID NO: 1754372 - RNA, 21 nt, Human herpesvirus 1
cgcgaucccccgcccccggcu

SEQ ID NO: 1754373 - RNA, 16 nt, Human herpesvirus 1
gcuguccgagaccccc

SEQ ID NO: 1754374 - RNA, 14 nt, Human herpesvirus 1
gggagccccggguu

SEQ ID NO: 1754375 - RNA, 16 nt, Human herpesvirus 1
ccuggguguguuuauu

SEQ ID NO: 1754376 - RNA, 20 nt, Human herpesvirus 1
ugggccucucguucuccggg

SEQ ID NO: 1754377 - RNA, 13 nt, Human herpesvirus 1
ccguuccagcccc

SEQ ID NO: 1754378 - RNA, 16 nt, Human herpesvirus 1
ggcgccaaagcugcug

SEQ ID NO: 1754379 - RNA, 19 nt, Human herpesvirus 1
cuccugauguggcugcucc

SEQ ID NO: 1754380 - RNA, 16 nt, Human herpesvirus 1
ggucggcgggcccgcg

SEQ ID NO: 1754381 - RNA, 21 nt, Human herpesvirus 1
ccaaguacgcuuucgacccca

SEQ ID NO: 1754382 - RNA, 15 nt, Human herpesvirus 1
gacacaaaugcccac

SEQ ID NO: 1754383 - RNA, 16 nt, Human herpesvirus 1
ggcagcccggaggcgc

SEQ ID NO: 1754384 - RNA, 22 nt, Human herpesvirus 1
cuccaaucgccgguuccucccg

SEQ ID NO: 1754385 - RNA, 22 nt, Human herpesvirus 1
cgaggggaugggcgaccugggg

SEQ ID NO: 1754386 - RNA, 21 nt, Human herpesvirus 1
caggcugucgacgcccccucc

SEQ ID NO: 1754387 - RNA, 18 nt, Human herpesvirus 1
uucugcgggucaccugcc

SEQ ID NO: 1754388 - RNA, 20 nt, Human herpesvirus 1
cccugcuccggcggggccuc

SEQ ID NO: 1754389 - RNA, 21 nt, Human herpesvirus 1
ccccgcgagguccgaagacuc

SEQ ID NO: 1754390 - RNA, 19 nt, Human herpesvirus 1
uggagcucaaucuggccca

SEQ ID NO: 1754391 - RNA, 13 nt, Human herpesvirus 1
cucugggggccug

SEQ ID NO: 1754392 - RNA, 17 nt, Human herpesvirus 1
accaccccaaauacagc

SEQ ID NO: 1754393 - RNA, 20 nt, Human herpesvirus 1
cccugguguuucuggggagc

SEQ ID NO: 1754394 - RNA, 15 nt, Human herpesvirus 1
ggccguggcggccaa

SEQ ID NO: 1754395 - RNA, 16 nt, Human herpesvirus 1
ccucucgcugcuggcg

SEQ ID NO: 1754396 - RNA, 23 nt, Human herpesvirus 1
agccuguuuguccuggggauggc

SEQ ID NO: 1754397 - RNA, 14 nt, Human herpesvirus 1
ccgcaucccaggau

SEQ ID NO: 1754398 - RNA, 16 nt, Human herpesvirus 1
ggccuuuuacgagguc

SEQ ID NO: 1754399 - RNA, 15 nt, Human herpesvirus 1
auccgucgggaggcc

SEQ ID NO: 1754400 - RNA, 12 nt, Human herpesvirus 1
gggcccccgccc

SEQ ID NO: 1754401 - RNA, 23 nt, Human herpesvirus 1
ggccccauacacgagcacccugc

SEQ ID NO: 1754402 - RNA, 22 nt, Human herpesvirus 1
uccggaaacaacccuacaaccu

SEQ ID NO: 1754403 - RNA, 21 nt, Human herpesvirus 1
ccaucaccccgcaauuugcac

SEQ ID NO: 1754404 - RNA, 21 nt, Human herpesvirus 1
cggcguccgcgccccucuggc

SEQ ID NO: 1754405 - RNA, 16 nt, Human herpesvirus 1
ccguggccccacgguc

SEQ ID NO: 1754406 - RNA, 13 nt, Human herpesvirus 1
cuccccagcggcc

SEQ ID NO: 1754407 - RNA, 13 nt, Human herpesvirus 1
cugaccagcgcac

SEQ ID NO: 1754408 - RNA, 23 nt, Human herpesvirus 1
gcaccaugaccaaguggcaggag

SEQ ID NO: 1754409 - RNA, 14 nt, Human herpesvirus 1
gcagggggaugggg

SEQ ID NO: 1754410 - RNA, 20 nt, Human herpesvirus 1
ggcggcgaggccggcgccga

SEQ ID NO: 1754411 - RNA, 12 nt, Human herpesvirus 1
agcaccacauaa

SEQ ID NO: 1754412 - RNA, 21 nt, Human herpesvirus 1
accaucccggguuaauguaaa

SEQ ID NO: 1754413 - RNA, 20 nt, Human herpesvirus 1
ggcggggccuuggcggccgc

SEQ ID NO: 1754414 - RNA, 19 nt, Human herpesvirus 1
ggaggcuguaggucuggga

SEQ ID NO: 1754415 - RNA, 18 nt, Human herpesvirus 1
aggacaaacccaaccguc

SEQ ID NO: 1754416 - RNA, 18 nt, Human herpesvirus 1
cuggcccgcgccccaccc

SEQ ID NO: 1754417 - RNA, 20 nt, Human herpesvirus 1
agccuaugccacgccagggc

SEQ ID NO: 1754418 - RNA, 18 nt, Human herpesvirus 1
ggccccgcgucuggcccc

SEQ ID NO: 1754419 - RNA, 17 nt, Human herpesvirus 1
ccucccgucaccgguuc

SEQ ID NO: 1754420 - RNA, 18 nt, Human herpesvirus 1
ggccccuggcgccgccug

SEQ ID NO: 1754421 - RNA, 18 nt, Human herpesvirus 1
cggugucugggaauagag

SEQ ID NO: 1754422 - RNA, 16 nt, Human herpesvirus 1
ccucggccaccguggg

SEQ ID NO: 1754423 - RNA, 14 nt, Human herpesvirus 1
cacccugcugcagg

SEQ ID NO: 1754424 - RNA, 22 nt, Human herpesvirus 1
accccucguggccccgacagcc

SEQ ID NO: 1754425 - RNA, 18 nt, Human herpesvirus 1
ucaccaccgucagcaccu

SEQ ID NO: 1754426 - RNA, 21 nt, Human herpesvirus 1
ugcgauucuagccucgugggg

SEQ ID NO: 1754427 - RNA, 12 nt, Human herpesvirus 1
gcgccgaccacc

SEQ ID NO: 1754428 - RNA, 11 nt, Human herpesvirus 1
auuaaagacaa

SEQ ID NO: 1754429 - RNA, 12 nt, Human herpesvirus 1
cgcgcauggcag

SEQ ID NO: 1754430 - RNA, 11 nt, Human herpesvirus 1
uucccgggccg

SEQ ID NO: 1754431 - RNA, 19 nt, Human herpesvirus 1
cccugguguuucuggggag

SEQ ID NO: 1754432 - RNA, 22 nt, Human herpesvirus 1
ccacguccccgggucuguuggg

SEQ ID NO: 1754433 - RNA, 15 nt, Human herpesvirus 1
gcugaccgacccucc

SEQ ID NO: 1754434 - RNA, 16 nt, Human herpesvirus 1
gucggcggcuguagcg

SEQ ID NO: 1754435 - RNA, 21 nt, Human herpesvirus 1
ggcuucggccguuucuccgcc

SEQ ID NO: 1754436 - RNA, 14 nt, Human herpesvirus 1
uuggucaaacucag

SEQ ID NO: 1754437 - RNA, 15 nt, Human herpesvirus 1
cgaguccgaagagga

SEQ ID NO: 1754438 - RNA, 17 nt, Human herpesvirus 1
ccucgaccaccaucccc

SEQ ID NO: 1754439 - RNA, 14 nt, Human herpesvirus 1
cacccuaccccagu

SEQ ID NO: 1754440 - RNA, 14 nt, Human herpesvirus 1
cgucucucuucccc

SEQ ID NO: 1754441 - RNA, 15 nt, Human herpesvirus 1
ggacgccggggccuu

SEQ ID NO: 1754442 - RNA, 17 nt, Human herpesvirus 1
ggcucguggcgucucgc

SEQ ID NO: 1754443 - RNA, 15 nt, Human herpesvirus 1
cguggugcgagcugc

SEQ ID NO: 1754444 - RNA, 13 nt, Human herpesvirus 1
gauggggagagcc

SEQ ID NO: 1754445 - RNA, 18 nt, Human herpesvirus 1
cggccccggcaccacggg

SEQ ID NO: 1754446 - RNA, 18 nt, Human herpesvirus 1
ggaccccagcgaccccac

SEQ ID NO: 1754447 - RNA, 18 nt, Human herpesvirus 1
gugcacagccuggccgug

SEQ ID NO: 1754448 - RNA, 18 nt, Human herpesvirus 1
cgggaccugaaccccagc

SEQ ID NO: 1754449 - RNA, 18 nt, Human herpesvirus 1
gagccgugcaccguggga

SEQ ID NO: 1754450 - RNA, 17 nt, Human herpesvirus 1
gcgcgcgucgacgucgc

SEQ ID NO: 1754451 - RNA, 15 nt, Human herpesvirus 1
ucccacgcucucccc

SEQ ID NO: 1754452 - RNA, 24 nt, Human herpesvirus 1
cccacgaucaccgcgggagcggug

SEQ ID NO: 1754453 - RNA, 19 nt, Human herpesvirus 1
ggaggcgccugccccgcca

SEQ ID NO: 1754454 - RNA, 21 nt, Human herpesvirus 1
uguggcgcgaggggggguccg

SEQ ID NO: 1754455 - RNA, 19 nt, Human herpesvirus 1
gcgccgcaaaucccaccaa

SEQ ID NO: 1754456 - RNA, 14 nt, Human herpesvirus 1
gcgcauccccccgu

SEQ ID NO: 1754457 - RNA, 17 nt, Human herpesvirus 1
cugccccgcuucauccc

SEQ ID NO: 1754458 - RNA, 17 nt, Human herpesvirus 1
gccggaacgcaccgagg

SEQ ID NO: 1754459 - RNA, 21 nt, Human herpesvirus 1
gcccccgccguugagccccuc

SEQ ID NO: 1754460 - RNA, 20 nt, Human herpesvirus 1
cuggcguucgucgcccucca

SEQ ID NO: 1754461 - RNA, 13 nt, Human herpesvirus 1
acucucgcaccau

SEQ ID NO: 1754462 - RNA, 17 nt, Human herpesvirus 1
uaaaccgguauuauuua

SEQ ID NO: 1754463 - RNA, 14 nt, Human herpesvirus 1
aguucgagcagccg

SEQ ID NO: 1754464 - RNA, 16 nt, Human herpesvirus 1
ggucucuggccgcgcc

SEQ ID NO: 1754465 - RNA, 17 nt, Human herpesvirus 1
cagcucgcggaggagcc

SEQ ID NO: 1754466 - RNA, 14 nt, Human herpesvirus 1
cucgcgccacacuc

SEQ ID NO: 1754467 - RNA, 17 nt, Human herpesvirus 1
cgucauagugggccucc

SEQ ID NO: 1754468 - RNA, 20 nt, Human herpesvirus 1
gccuccgcccgugcugccgu

SEQ ID NO: 1754469 - RNA, 11 nt, Human herpesvirus 1
uucgaggaggu

SEQ ID NO: 1754470 - RNA, 17 nt, Human herpesvirus 1
caccgcccacagagggc

SEQ ID NO: 1754471 - RNA, 22 nt, Human herpesvirus 1
cgcguguacugcggucugucuc

SEQ ID NO: 1754472 - RNA, 15 nt, Human herpesvirus 1
cauggcgggacuggg

SEQ ID NO: 1754473 - RNA, 14 nt, Human herpesvirus 1
cagcagacgcugcu

SEQ ID NO: 1754474 - RNA, 21 nt, Human herpesvirus 1
ccucucguucuccggggcccg

SEQ ID NO: 1754475 - RNA, 19 nt, Human herpesvirus 1
cgcacggaacacaaggcca

SEQ ID NO: 1754476 - RNA, 18 nt, Human herpesvirus 1
cgaggugcgccaggucgg

SEQ ID NO: 1754477 - RNA, 22 nt, Human herpesvirus 1
gcccgggcgcuugcgcaccugg

SEQ ID NO: 1754478 - RNA, 22 nt, Human herpesvirus 1
gaggacggcgccggggcucucg

SEQ ID NO: 1754479 - RNA, 18 nt, Human herpesvirus 1
gaccccggggcucagcca

SEQ ID NO: 1754480 - RNA, 22 nt, Human herpesvirus 1
ggccgaggcgauuagccagcag

SEQ ID NO: 1754481 - RNA, 19 nt, Human herpesvirus 1
cgccgucccacgcucuccc

SEQ ID NO: 1754482 - RNA, 24 nt, Human herpesvirus 1
gcccgccaucugggauggcuccug

SEQ ID NO: 1754483 - RNA, 12 nt, Human herpesvirus 1
cuacgugccccc

SEQ ID NO: 1754484 - RNA, 16 nt, Human herpesvirus 1
gccgagccccccgcug

SEQ ID NO: 1754485 - RNA, 21 nt, Human herpesvirus 1
gcccuaaccccaccccugugc

SEQ ID NO: 1754486 - RNA, 23 nt, Human herpesvirus 1
cguccuuugggcgggaggaagcc

SEQ ID NO: 1754487 - RNA, 12 nt, Human herpesvirus 1
cacgcccgacca

SEQ ID NO: 1754488 - RNA, 22 nt, Human herpesvirus 1
gcggcuuaugaacgacugggcc

SEQ ID NO: 1754489 - RNA, 16 nt, Human herpesvirus 1
guacgccgccaccgug

SEQ ID NO: 1754490 - RNA, 19 nt, Human herpesvirus 1
ccaucaccccgcaauuugc

SEQ ID NO: 1754491 - RNA, 14 nt, Human herpesvirus 1
cagagaccccaggg

SEQ ID NO: 1754492 - RNA, 21 nt, Human herpesvirus 1
ggccacuggccgggagcacca

SEQ ID NO: 1754493 - RNA, 20 nt, Human herpesvirus 1
gaccaccauccccgcucccc

SEQ ID NO: 1754494 - RNA, 20 nt, Human herpesvirus 1
uccccgaggaccccgugggc

SEQ ID NO: 1754495 - RNA, 21 nt, Human herpesvirus 1
cccaguaacaugcgcacguga

SEQ ID NO: 1754496 - RNA, 22 nt, Human herpesvirus 1
cgccaggucggcgaccgccagc

SEQ ID NO: 1754497 - RNA, 14 nt, Human herpesvirus 1
ggcggcgugugggg

SEQ ID NO: 1754498 - RNA, 21 nt, Human herpesvirus 1
ccuugggcccgggggccuggu

SEQ ID NO: 1754499 - RNA, 17 nt, Human herpesvirus 1
augaguacgaggaucug

SEQ ID NO: 1754500 - RNA, 13 nt, Human herpesvirus 1
aaccccaacucca

SEQ ID NO: 1754501 - RNA, 20 nt, Human herpesvirus 1
uggcgcccccgaccucggac

SEQ ID NO: 1754502 - RNA, 19 nt, Human herpesvirus 1
accgguucucccuguucaa

SEQ ID NO: 1754503 - RNA, 22 nt, Human herpesvirus 1
cagggagaaaccccagcauacc

SEQ ID NO: 1754504 - RNA, 18 nt, Human herpesvirus 1
cucggcccccgaggccag

SEQ ID NO: 1754505 - RNA, 13 nt, Human herpesvirus 1
ggcgcuuggcaug

SEQ ID NO: 1754506 - RNA, 13 nt, Human herpesvirus 1
gcagcaaauuaaa

SEQ ID NO: 1754507 - RNA, 23 nt, Human herpesvirus 1
ccucaccaccaaggcccgggcca

SEQ ID NO: 1754508 - RNA, 15 nt, Human herpesvirus 1
ucacgcacgccaaug

SEQ ID NO: 1754509 - RNA, 16 nt, Human herpesvirus 1
uuggacuggaggagga

SEQ ID NO: 1754510 - RNA, 21 nt, Human herpesvirus 1
cacgcaagaccaggccugguc

SEQ ID NO: 1754511 - RNA, 20 nt, Human herpesvirus 1
ggcccgcgucgggauccaca

SEQ ID NO: 1754512 - RNA, 22 nt, Human herpesvirus 1
aucuccugggggcacccacgcc

SEQ ID NO: 1754513 - RNA, 16 nt, Human herpesvirus 1
uccgcuaucuccuggg

SEQ ID NO: 1754514 - RNA, 15 nt, Human herpesvirus 1
guucagggcgacgcc

SEQ ID NO: 1754515 - RNA, 14 nt, Human herpesvirus 1
gccgcgcguccccc

SEQ ID NO: 1754516 - RNA, 19 nt, Human herpesvirus 1
cucucggugaucuuggcgu

SEQ ID NO: 1754517 - RNA, 15 nt, Human herpesvirus 1
ucuccggacccccgc

SEQ ID NO: 1754518 - RNA, 11 nt, Human herpesvirus 1
cggggcgccgu

SEQ ID NO: 1754519 - RNA, 16 nt, Human herpesvirus 1
cccgcaauuugcaccc

SEQ ID NO: 1754520 - RNA, 14 nt, Human herpesvirus 1
aaacaagagccucc

SEQ ID NO: 1754521 - RNA, 12 nt, Human herpesvirus 1
cugccucccccg

SEQ ID NO: 1754522 - RNA, 14 nt, Human herpesvirus 1
aaaccugggcggcc

SEQ ID NO: 1754523 - RNA, 23 nt, Human herpesvirus 1
cgcccgauuuacagcccccagau

SEQ ID NO: 1754524 - RNA, 14 nt, Human herpesvirus 1
cagcgccaagguca

SEQ ID NO: 1754525 - RNA, 20 nt, Human herpesvirus 1
ucccucccccuccgcauccc

SEQ ID NO: 1754526 - RNA, 17 nt, Human herpesvirus 1
uguaaguacgcccuccc

SEQ ID NO: 1754527 - RNA, 17 nt, Human herpesvirus 1
aagcacacacgggggag

SEQ ID NO: 1754528 - RNA, 13 nt, Human herpesvirus 1
aacccaaccgucc

SEQ ID NO: 1754529 - RNA, 14 nt, Human herpesvirus 1
gccgcaccgggccc

SEQ ID NO: 1754530 - RNA, 16 nt, Human herpesvirus 1
ccggcggacccccgga

SEQ ID NO: 1754531 - RNA, 19 nt, Human herpesvirus 1
ccaccaccuccacccccuc

SEQ ID NO: 1754532 - RNA, 20 nt, Human herpesvirus 1
gcccagaccccuucucccca

SEQ ID NO: 1754533 - RNA, 17 nt, Human herpesvirus 1
guacugcggucugucuc

SEQ ID NO: 1754534 - RNA, 22 nt, Human herpesvirus 1
ugggucugugccaccagccugg

SEQ ID NO: 1754535 - RNA, 18 nt, Human herpesvirus 1
gccuggucccccggggac

SEQ ID NO: 1754536 - RNA, 20 nt, Human herpesvirus 1
ggcccugccacuccggcgcc

SEQ ID NO: 1754537 - RNA, 22 nt, Human herpesvirus 1
ggcccggcccauugggcgggag

SEQ ID NO: 1754538 - RNA, 15 nt, Human herpesvirus 1
cuccgcccccaaccc

SEQ ID NO: 1754539 - RNA, 14 nt, Human herpesvirus 1
uggcgucccaucug

SEQ ID NO: 1754540 - RNA, 22 nt, Human herpesvirus 1
acugcaucgucgaggaggugga

SEQ ID NO: 1754541 - RNA, 23 nt, Human herpesvirus 1
caccuguguggcgguugguccag

SEQ ID NO: 1754542 - RNA, 19 nt, Human herpesvirus 1
uacggcuaccgggaggggu

SEQ ID NO: 1754543 - RNA, 13 nt, Human herpesvirus 1
cccagcgacccca

SEQ ID NO: 1754544 - RNA, 18 nt, Human herpesvirus 1
cggcccuaaccccacccc

SEQ ID NO: 1754545 - RNA, 22 nt, Human herpesvirus 1
gacguuaucucgguggaggcgc

SEQ ID NO: 1754546 - RNA, 18 nt, Human herpesvirus 1
ggccccggcaccacgggu

SEQ ID NO: 1754547 - RNA, 18 nt, Human herpesvirus 1
gguacaacgcgacgcaca

SEQ ID NO: 1754548 - RNA, 22 nt, Human herpesvirus 1
agcucgucgggguggcacagaa

SEQ ID NO: 1754549 - RNA, 20 nt, Human herpesvirus 1
gacccgcaacgcgcuggggc

SEQ ID NO: 1754550 - RNA, 18 nt, Human herpesvirus 1
gagcggcaccaccggggc

SEQ ID NO: 1754551 - RNA, 16 nt, Human herpesvirus 1
accucccagugucccg

SEQ ID NO: 1754552 - RNA, 14 nt, Human herpesvirus 1
ccuggucagaggcc

SEQ ID NO: 1754553 - RNA, 11 nt, Human herpesvirus 1
gcggcggggca

SEQ ID NO: 1754554 - RNA, 14 nt, Human herpesvirus 1
cauagcccuggugu

SEQ ID NO: 1754555 - RNA, 22 nt, Human herpesvirus 1
gacacccuaccccaguccccgg

SEQ ID NO: 1754556 - RNA, 17 nt, Human herpesvirus 1
ugccacuccggcgccgc

SEQ ID NO: 1754557 - RNA, 20 nt, Human herpesvirus 1
cuccgcaacggggcgccguc

SEQ ID NO: 1754558 - RNA, 18 nt, Human herpesvirus 1
gggcgaggagggcggcga

SEQ ID NO: 1754559 - RNA, 19 nt, Human herpesvirus 1
cucguccgcgccccccgac

SEQ ID NO: 1754560 - RNA, 15 nt, Human herpesvirus 1
ccggacccgggccgu

SEQ ID NO: 1754561 - RNA, 14 nt, Human herpesvirus 1
ccgacauggucaug

SEQ ID NO: 1754562 - RNA, 15 nt, Human herpesvirus 1
cccuuccccgcuguc

SEQ ID NO: 1754563 - RNA, 15 nt, Human herpesvirus 1
cauguccgugccgcu

SEQ ID NO: 1754564 - RNA, 17 nt, Human herpesvirus 1
cggcacuuucugacgcc

SEQ ID NO: 1754565 - RNA, 17 nt, Human herpesvirus 1
gacccuaugguacacac

SEQ ID NO: 1754566 - RNA, 21 nt, Human herpesvirus 1
gaacccgcgcuaugacggcaa

SEQ ID NO: 1754567 - RNA, 17 nt, Human herpesvirus 1
acucaccggcggacccc

SEQ ID NO: 1754568 - RNA, 13 nt, Human herpesvirus 1
gaacgcaggcgcu

SEQ ID NO: 1754569 - RNA, 18 nt, Human herpesvirus 1
ucugucucgucuccucuu

SEQ ID NO: 1754570 - RNA, 18 nt, Human herpesvirus 1
agccucugugucaggugg

SEQ ID NO: 1754571 - RNA, 16 nt, Human herpesvirus 1
ccccucguucugcugc

SEQ ID NO: 1754572 - RNA, 15 nt, Human herpesvirus 1
cggcgccgaccaccc

SEQ ID NO: 1754573 - RNA, 18 nt, Human herpesvirus 1
gccuaccggccccugggc

SEQ ID NO: 1754574 - RNA, 17 nt, Human herpesvirus 1
agcgccggguggcgccu

SEQ ID NO: 1754575 - RNA, 17 nt, Human herpesvirus 1
ggcuuccgacgcccccc

SEQ ID NO: 1754576 - RNA, 17 nt, Human herpesvirus 1
guugcccgcggaccacc

SEQ ID NO: 1754577 - RNA, 23 nt, Human herpesvirus 1
gcgggggauggggagagcccaca

SEQ ID NO: 1754578 - RNA, 19 nt, Human herpesvirus 1
accccggggcucagccaga

SEQ ID NO: 1754579 - RNA, 18 nt, Human herpesvirus 1
acccuguggaacgaggcc

SEQ ID NO: 1754580 - RNA, 23 nt, Human herpesvirus 1
cccuggacgugggccucacccac

SEQ ID NO: 1754581 - RNA, 18 nt, Human herpesvirus 1
ccugccccccccacccca

SEQ ID NO: 1754582 - RNA, 22 nt, Human herpesvirus 1
acucauuuguggacgccggggc

SEQ ID NO: 1754583 - RNA, 15 nt, Human herpesvirus 1
gaccggcaccaccga

SEQ ID NO: 1754584 - RNA, 16 nt, Human herpesvirus 1
cagccgggacgaggcc

SEQ ID NO: 1754585 - RNA, 20 nt, Human herpesvirus 1
auccguggccccggccccca

SEQ ID NO: 1754586 - RNA, 12 nt, Human herpesvirus 1
uggucucuggcc

SEQ ID NO: 1754587 - RNA, 15 nt, Human herpesvirus 1
caguggcuccgggcc

SEQ ID NO: 1754588 - RNA, 16 nt, Human herpesvirus 1
gcgucagucccgacac

SEQ ID NO: 1754589 - RNA, 14 nt, Human herpesvirus 1
acgacaucuugucg

SEQ ID NO: 1754590 - RNA, 18 nt, Human herpesvirus 1
ggcgccacaccacgccac

SEQ ID NO: 1754591 - RNA, 17 nt, Human herpesvirus 1
gucugcuccccaccccg

SEQ ID NO: 1754592 - RNA, 22 nt, Human herpesvirus 1
caugaccgcccgccccucgcca

SEQ ID NO: 1754593 - RNA, 13 nt, Human herpesvirus 1
cuucggggcccgg

SEQ ID NO: 1754594 - RNA, 13 nt, Human herpesvirus 1
ucccgacaccacc

SEQ ID NO: 1754595 - RNA, 17 nt, Human herpesvirus 1
cuccgcccgugcugccg

SEQ ID NO: 1754596 - RNA, 15 nt, Human herpesvirus 1
ucgccuggcugaccc

SEQ ID NO: 1754597 - RNA, 22 nt, Human herpesvirus 1
acucucccaccgccaucagccu

SEQ ID NO: 1754598 - RNA, 18 nt, Human herpesvirus 1
caucgaccacgcccuucc

SEQ ID NO: 1754599 - RNA, 19 nt, Human herpesvirus 1
cagcaucgggaugcugccc

SEQ ID NO: 1754600 - RNA, 13 nt, Human herpesvirus 1
caaacaggagcug

SEQ ID NO: 1754601 - RNA, 15 nt, Human herpesvirus 1
ccccgcugcggccac

SEQ ID NO: 1754602 - RNA, 16 nt, Human herpesvirus 1
gacguccugggccacc

SEQ ID NO: 1754603 - RNA, 22 nt, Human herpesvirus 1
ggaacgaggcccgcaagcugaa

SEQ ID NO: 1754604 - RNA, 23 nt, Human herpesvirus 1
aagcugaugucccucauuuuaca

SEQ ID NO: 1754605 - RNA, 19 nt, Human herpesvirus 1
uccagccuccccuccaggu

SEQ ID NO: 1754606 - RNA, 17 nt, Human herpesvirus 1
cacgcgccgccgacucc

SEQ ID NO: 1754607 - RNA, 22 nt, Human herpesvirus 1
agccccaaagcgcauacgccuc

SEQ ID NO: 1754608 - RNA, 13 nt, Human herpesvirus 1
ggcgaccgccggc

SEQ ID NO: 1754609 - RNA, 19 nt, Human herpesvirus 1
gagaccagucgcccgaaga

SEQ ID NO: 1754610 - RNA, 19 nt, Human herpesvirus 1
gcucggcggcagcccggag

SEQ ID NO: 1754611 - RNA, 17 nt, Human herpesvirus 1
acuaagcgucccugggc

SEQ ID NO: 1754612 - RNA, 14 nt, Human herpesvirus 1
ccugauguggcugc

SEQ ID NO: 1754613 - RNA, 18 nt, Human herpesvirus 1
cagcaaauaugccuuggu

SEQ ID NO: 1754614 - RNA, 15 nt, Human herpesvirus 1
cguccggggagggcg

SEQ ID NO: 1754615 - RNA, 20 nt, Human herpesvirus 1
ugguauagguccacggccac

SEQ ID NO: 1754616 - RNA, 12 nt, Human herpesvirus 1
gccgcgccccgc

SEQ ID NO: 1754617 - RNA, 11 nt, Human herpesvirus 1
acucugggcgu

SEQ ID NO: 1754618 - RNA, 16 nt, Human herpesvirus 1
gcccacccuggcgcca

SEQ ID NO: 1754619 - RNA, 18 nt, Human herpesvirus 1
gcccugguguuucugggg

SEQ ID NO: 1754620 - RNA, 17 nt, Human herpesvirus 1
ccgacgcccagcagcuc

SEQ ID NO: 1754621 - RNA, 13 nt, Human herpesvirus 1
ccucaucaccgac

SEQ ID NO: 1754622 - RNA, 24 nt, Human herpesvirus 1
cggggaucugguccgccgcgagcc

SEQ ID NO: 1754623 - RNA, 13 nt, Human herpesvirus 1
ccacuggccggga

SEQ ID NO: 1754624 - RNA, 19 nt, Human herpesvirus 1
cccgggcgcgcccucuucu

SEQ ID NO: 1754625 - RNA, 20 nt, Human herpesvirus 1
cucaccaccaaggcccgggc

SEQ ID NO: 1754626 - RNA, 16 nt, Human herpesvirus 1
cugaucccccgcgcgg

SEQ ID NO: 1754627 - RNA, 15 nt, Human herpesvirus 1
cccuccgcuggggcc

SEQ ID NO: 1754628 - RNA, 18 nt, Human herpesvirus 1
auuccgcggccccagccc

SEQ ID NO: 1754629 - RNA, 22 nt, Human herpesvirus 1
cuguccaccgggaagcagggcc

SEQ ID NO: 1754630 - RNA, 19 nt, Human herpesvirus 1
cuagccgaggcccgggaga

SEQ ID NO: 1754631 - RNA, 19 nt, Human herpesvirus 1
cccuggacacccucuucgu

SEQ ID NO: 1754632 - RNA, 12 nt, Human herpesvirus 1
augagccagacc

SEQ ID NO: 1754633 - RNA, 16 nt, Human herpesvirus 1
uggccccaguccccaa

SEQ ID NO: 1754634 - RNA, 14 nt, Human herpesvirus 1
gagacgggcgguuc

SEQ ID NO: 1754635 - RNA, 15 nt, Human herpesvirus 1
ccaaagcgcccgucg

SEQ ID NO: 1754636 - RNA, 22 nt, Human herpesvirus 1
ggcgcccaccccgugugccgcg

SEQ ID NO: 1754637 - RNA, 14 nt, Human herpesvirus 1
acaacccuacaacc

SEQ ID NO: 1754638 - RNA, 23 nt, Human herpesvirus 1
cuucccucccccuccgcauccca

SEQ ID NO: 1754639 - RNA, 20 nt, Human herpesvirus 1
ccugggggacugcaucggca

SEQ ID NO: 1754640 - RNA, 19 nt, Human herpesvirus 1
aacccccuaagacccaccc

SEQ ID NO: 1754641 - RNA, 18 nt, Human herpesvirus 1
aucagccucgucccgccc

SEQ ID NO: 1754642 - RNA, 18 nt, Human herpesvirus 1
cgcagggcgccaugcgug

SEQ ID NO: 1754643 - RNA, 15 nt, Human herpesvirus 1
aaaaccacaaccucc

SEQ ID NO: 1754644 - RNA, 17 nt, Human herpesvirus 1
gacccguuccagccccc

SEQ ID NO: 1754645 - RNA, 21 nt, Human herpesvirus 1
cgccgcggaucgggccuuggu

SEQ ID NO: 1754646 - RNA, 23 nt, Human herpesvirus 1
uccccgauggcccuccaggcugu

SEQ ID NO: 1754647 - RNA, 13 nt, Human herpesvirus 1
gccagcgacccgc

SEQ ID NO: 1754648 - RNA, 16 nt, Human herpesvirus 1
cgggaacaccuccgcg

SEQ ID NO: 1754649 - RNA, 15 nt, Human herpesvirus 1
gcuugagucuguccg

SEQ ID NO: 1754650 - RNA, 15 nt, Human herpesvirus 1
cuucuccccuucccu

SEQ ID NO: 1754651 - RNA, 20 nt, Human herpesvirus 1
cgcaauuugcacccagccuu

SEQ ID NO: 1754652 - RNA, 14 nt, Human herpesvirus 1
auauaaggccuggg

SEQ ID NO: 1754653 - RNA, 22 nt, Human herpesvirus 1
ucggugccaguccgcugcaccg

SEQ ID NO: 1754654 - RNA, 20 nt, Human herpesvirus 1
gucggcaagauccucgggcu

SEQ ID NO: 1754655 - RNA, 14 nt, Human herpesvirus 1
cgcguggaccuggg

SEQ ID NO: 1754656 - RNA, 13 nt, Human herpesvirus 1
acgccacaacagc

SEQ ID NO: 1754657 - RNA, 23 nt, Human herpesvirus 1
acuucccacccggagcuuucuuc

SEQ ID NO: 1754658 - RNA, 21 nt, Human herpesvirus 1
gggcuuggacgcgccucccgg

SEQ ID NO: 1754659 - RNA, 17 nt, Human herpesvirus 1
gcgaugagccaaccucg

SEQ ID NO: 1754660 - RNA, 15 nt, Human herpesvirus 1
cgcgugaccccaggg

SEQ ID NO: 1754661 - RNA, 19 nt, Human herpesvirus 1
ccgggcgcgugcugcgccu

SEQ ID NO: 1754662 - RNA, 20 nt, Human herpesvirus 1
cgacagcggauggcacgagu

SEQ ID NO: 1754663 - RNA, 14 nt, Human herpesvirus 1
agacgucgccccug

SEQ ID NO: 1754664 - RNA, 19 nt, Human herpesvirus 1
cacggagggaaccaccauc

SEQ ID NO: 1754665 - RNA, 21 nt, Human herpesvirus 1
cggucagcgacguccugggcc

SEQ ID NO: 1754666 - RNA, 13 nt, Human herpesvirus 1
guugggaugggac

SEQ ID NO: 1754667 - RNA, 18 nt, Human herpesvirus 1
cgggcuguuccgccaggc

SEQ ID NO: 1754668 - RNA, 17 nt, Human herpesvirus 1
gccuuccggaccugcuc

SEQ ID NO: 1754669 - RNA, 16 nt, Human herpesvirus 1
gucgucacgcacgcca

SEQ ID NO: 1754670 - RNA, 15 nt, Human herpesvirus 1
gccccuguggcccug

SEQ ID NO: 1754671 - RNA, 17 nt, Human herpesvirus 1
gauggaggagccccugc

SEQ ID NO: 1754672 - RNA, 17 nt, Human herpesvirus 1
ccaguugagccgcgcca

SEQ ID NO: 1754673 - RNA, 16 nt, Human herpesvirus 1
cgccguguuggagcgc

SEQ ID NO: 1754674 - RNA, 21 nt, Human herpesvirus 1
cuguacgacugggggggaucc

SEQ ID NO: 1754675 - RNA, 23 nt, Human herpesvirus 1
acgccucagggccuccgacccca

SEQ ID NO: 1754676 - RNA, 17 nt, Human herpesvirus 1
ggucucccagggagccc

SEQ ID NO: 1754677 - RNA, 19 nt, Human herpesvirus 1
cuggccccaguccccaaga

SEQ ID NO: 1754678 - RNA, 17 nt, Human herpesvirus 1
cacaugcggaaagcaag

SEQ ID NO: 1754679 - RNA, 21 nt, Human herpesvirus 1
cgcgugcccacgucgccccgc

SEQ ID NO: 1754680 - RNA, 18 nt, Human herpesvirus 1
cagacccaacccccggcc

SEQ ID NO: 1754681 - RNA, 21 nt, Human herpesvirus 1
ccacuggccgggagcaccaca

SEQ ID NO: 1754682 - RNA, 20 nt, Human herpesvirus 1
ucccgcccaccggaagccca

SEQ ID NO: 1754683 - RNA, 17 nt, Human herpesvirus 1
ucuggugcugucugaca

SEQ ID NO: 1754684 - RNA, 21 nt, Human herpesvirus 1
cacgccuaccggccccugggc

SEQ ID NO: 1754685 - RNA, 22 nt, Human herpesvirus 1
aggcccgcaagcugaaccccaa

SEQ ID NO: 1754686 - RNA, 20 nt, Human herpesvirus 1
auagcaacaaggccguggac

SEQ ID NO: 1754687 - RNA, 21 nt, Human herpesvirus 1
accacguuucggcguguguuu

SEQ ID NO: 1754688 - RNA, 19 nt, Human herpesvirus 1
ccaaagcugcuggcgcgca

SEQ ID NO: 1754689 - RNA, 18 nt, Human herpesvirus 1
gggccccggggagacagc

SEQ ID NO: 1754690 - RNA, 22 nt, Human herpesvirus 1
ggcuccaugcagugcauggcgc

SEQ ID NO: 1754691 - RNA, 17 nt, Human herpesvirus 1
ugggguccgggagggcg

SEQ ID NO: 1754692 - RNA, 19 nt, Human herpesvirus 1
gcagccuggucgaggcggc

SEQ ID NO: 1754693 - RNA, 15 nt, Human herpesvirus 1
cgcaucuuuccugug

SEQ ID NO: 1754694 - RNA, 19 nt, Human herpesvirus 1
gccacacucaaaaagcccc

SEQ ID NO: 1754695 - RNA, 13 nt, Human herpesvirus 1
ucaagcaggccau

SEQ ID NO: 1754696 - RNA, 16 nt, Human herpesvirus 1
gccgccucggcccgcg

SEQ ID NO: 1754697 - RNA, 21 nt, Human herpesvirus 1
guuggguuuucuuugugccug

SEQ ID NO: 1754698 - RNA, 20 nt, Human herpesvirus 1
cccagagguguucacgcacc

SEQ ID NO: 1754699 - RNA, 15 nt, Human herpesvirus 1
ccggucuccccggga

SEQ ID NO: 1754700 - RNA, 15 nt, Human herpesvirus 1
gugcacagccuggcc

SEQ ID NO: 1754701 - RNA, 15 nt, Human herpesvirus 1
ccaaguacgccgcca

SEQ ID NO: 1754702 - RNA, 21 nt, Human herpesvirus 1
uguucguggaaccaugaccuc

SEQ ID NO: 1754703 - RNA, 18 nt, Human herpesvirus 1
gcccgauuuacagccccc

SEQ ID NO: 1754704 - RNA, 16 nt, Human herpesvirus 1
acgugcacagccuggc

SEQ ID NO: 1754705 - RNA, 13 nt, Human herpesvirus 1
uaagacucucccc

SEQ ID NO: 1754706 - RNA, 22 nt, Human herpesvirus 1
cgcuuugugggggaccaggucc

SEQ ID NO: 1754707 - RNA, 14 nt, Human herpesvirus 1
ggaaagcaagaaca

SEQ ID NO: 1754708 - RNA, 16 nt, Human herpesvirus 1
caccaugcuggaggau

SEQ ID NO: 1754709 - RNA, 19 nt, Human herpesvirus 1
uacgcgguacgccccaccg

SEQ ID NO: 1754710 - RNA, 17 nt, Human herpesvirus 1
cccugagccgcuuuccu

SEQ ID NO: 1754711 - RNA, 19 nt, Human herpesvirus 1
ccggcggccccuggcgccg

SEQ ID NO: 1754712 - RNA, 20 nt, Human herpesvirus 1
ucuccgcggugucugggaau

SEQ ID NO: 1754713 - RNA, 15 nt, Human herpesvirus 1
ggggguugcuguccc

SEQ ID NO: 1754714 - RNA, 17 nt, Human herpesvirus 1
ucggcgaccgccagccg

SEQ ID NO: 1754715 - RNA, 20 nt, Human herpesvirus 1
gcccgaccaacgucgccgcc

SEQ ID NO: 1754716 - RNA, 22 nt, Human herpesvirus 1
ucgccggggaccgcagccuggu

SEQ ID NO: 1754717 - RNA, 19 nt, Human herpesvirus 1
gcgcgcugcucagcgccaa

SEQ ID NO: 1754718 - RNA, 23 nt, Human herpesvirus 1
acgaccuguugauggccugugcu

SEQ ID NO: 1754719 - RNA, 15 nt, Human herpesvirus 1
uccucgugcccucgc

SEQ ID NO: 1754720 - RNA, 17 nt, Human herpesvirus 1
gucuccuccaccaccca

SEQ ID NO: 1754721 - RNA, 17 nt, Human herpesvirus 1
cgugccguuguucccau

SEQ ID NO: 1754722 - RNA, 12 nt, Human herpesvirus 1
cccgaaccaggc

SEQ ID NO: 1754723 - RNA, 16 nt, Human herpesvirus 1
cagggggaugcuagcc

SEQ ID NO: 1754724 - RNA, 18 nt, Human herpesvirus 1
accacgccccuuuccccc

SEQ ID NO: 1754725 - RNA, 16 nt, Human herpesvirus 1
ccgugucugugggcca

SEQ ID NO: 1754726 - RNA, 15 nt, Human herpesvirus 1
cagccuuaccacgcc

SEQ ID NO: 1754727 - RNA, 20 nt, Human herpesvirus 1
ccgaguucccccggcacgcc

SEQ ID NO: 1754728 - RNA, 14 nt, Human herpesvirus 1
cgccucggagccga

SEQ ID NO: 1754729 - RNA, 15 nt, Human herpesvirus 1
cgucgggccucccgg

SEQ ID NO: 1754730 - RNA, 22 nt, Human herpesvirus 1
guagggugguuccuguaucugg

SEQ ID NO: 1754731 - RNA, 19 nt, Human herpesvirus 1
ggcggacccccggaggcgc

SEQ ID NO: 1754732 - RNA, 21 nt, Human herpesvirus 1
cggacccccggaggcgccugc

SEQ ID NO: 1754733 - RNA, 22 nt, Human herpesvirus 1
uguggggacccggcccuaaccc

SEQ ID NO: 1754734 - RNA, 18 nt, Human herpesvirus 1
acaagucucugggggccu

SEQ ID NO: 1754735 - RNA, 21 nt, Human herpesvirus 1
cuggccugcgaggugcgccag

SEQ ID NO: 1754736 - RNA, 16 nt, Human herpesvirus 1
ggccccggggagacag

SEQ ID NO: 1754737 - RNA, 14 nt, Human herpesvirus 1
cgccuuaccauccc

SEQ ID NO: 1754738 - RNA, 21 nt, Human herpesvirus 1
cgccagcgcggcggggcccgg

SEQ ID NO: 1754739 - RNA, 19 nt, Human herpesvirus 1
ccaggcugucgacgccccc

SEQ ID NO: 1754740 - RNA, 21 nt, Human herpesvirus 1
aucucuguaacggggacccca

SEQ ID NO: 1754741 - RNA, 21 nt, Human herpesvirus 1
gcgcagcugggaccccggcgg

SEQ ID NO: 1754742 - RNA, 13 nt, Human herpesvirus 1
ccgacccccuugu

SEQ ID NO: 1754743 - RNA, 18 nt, Human herpesvirus 1
gccaacaauccccaggac

SEQ ID NO: 1754744 - RNA, 22 nt, Human herpesvirus 1
ccgccaacgcacuguggcucuc

SEQ ID NO: 1754745 - RNA, 16 nt, Human herpesvirus 1
ucacgagcugacccug

SEQ ID NO: 1754746 - RNA, 19 nt, Human herpesvirus 1
acccgcaacgcgcuggggc

SEQ ID NO: 1754747 - RNA, 13 nt, Human herpesvirus 1
gcugcucagcgcc

SEQ ID NO: 1754748 - RNA, 13 nt, Human herpesvirus 1
ggaccgggguccc

SEQ ID NO: 1754749 - RNA, 16 nt, Human herpesvirus 1
ggauccucggccagcu

SEQ ID NO: 1754750 - RNA, 15 nt, Human herpesvirus 1
ccccgaccagcgccg

SEQ ID NO: 1754751 - RNA, 19 nt, Human herpesvirus 1
cgggcgaugagccaaccuc

SEQ ID NO: 1754752 - RNA, 13 nt, Human herpesvirus 1
aacgguccucacc

SEQ ID NO: 1754753 - RNA, 19 nt, Human herpesvirus 1
caucugggauggcuccugg

SEQ ID NO: 1754754 - RNA, 19 nt, Human herpesvirus 1
cgagccaagggcuccugua

SEQ ID NO: 1754755 - RNA, 16 nt, Human herpesvirus 1
cgcccagcagcucccc

SEQ ID NO: 1754756 - RNA, 13 nt, Human herpesvirus 1
cccaguccccggg

SEQ ID NO: 1754757 - RNA, 19 nt, Human herpesvirus 1
ccaccauggccccccgcgu

SEQ ID NO: 1754758 - RNA, 20 nt, Human herpesvirus 1
cucgcgggccucgugggcac

SEQ ID NO: 1754759 - RNA, 19 nt, Human herpesvirus 1
ugggggccugucccauccg

SEQ ID NO: 1754760 - RNA, 17 nt, Human herpesvirus 1
aggggaaaagugaaaga

SEQ ID NO: 1754761 - RNA, 15 nt, Human herpesvirus 1
gugacgcacccccug

SEQ ID NO: 1754762 - RNA, 11 nt, Human herpesvirus 1
ccacaccaccu

SEQ ID NO: 1754763 - RNA, 23 nt, Human herpesvirus 1
cgcauauauacgcuuggagccag

SEQ ID NO: 1754764 - RNA, 13 nt, Human herpesvirus 1
auaacgcacugaa

SEQ ID NO: 1754765 - RNA, 22 nt, Human herpesvirus 1
ucgcuugguuucggaugggagg

SEQ ID NO: 1754766 - RNA, 22 nt, Human herpesvirus 1
gcgccaacgcguccguggagcg

SEQ ID NO: 1754767 - RNA, 18 nt, Human herpesvirus 1
ucugucgguccacggcca

SEQ ID NO: 1754768 - RNA, 22 nt, Human herpesvirus 1
gccaguccgcugcaccgaugua

SEQ ID NO: 1754769 - RNA, 11 nt, Human herpesvirus 1
ggcccggggcc

SEQ ID NO: 1754770 - RNA, 23 nt, Human herpesvirus 1
gcaaugcggagggcacccaacaa

SEQ ID NO: 1754771 - RNA, 23 nt, Human herpesvirus 1
gaccacaccgacgaaucccccaa

SEQ ID NO: 1754772 - RNA, 18 nt, Human herpesvirus 1
cucccccaccgcccacag

SEQ ID NO: 1754773 - RNA, 21 nt, Human herpesvirus 1
ccaugggacacaaaugcccac

SEQ ID NO: 1754774 - RNA, 13 nt, Human herpesvirus 1
cgacaucuugucg

SEQ ID NO: 1754775 - RNA, 16 nt, Human herpesvirus 1
gccccuaaccaggccu

SEQ ID NO: 1754776 - RNA, 13 nt, Human herpesvirus 1
uuuguuguaaaua

SEQ ID NO: 1754777 - RNA, 20 nt, Human herpesvirus 1
cuccgcuggggcccccaggg

SEQ ID NO: 1754778 - RNA, 15 nt, Human herpesvirus 1
aucgccgcggcuccc

SEQ ID NO: 1754779 - RNA, 22 nt, Human herpesvirus 1
gcaccgucggaggccccccaga

SEQ ID NO: 1754780 - RNA, 19 nt, Human herpesvirus 1
gagggugguucccccccgu

SEQ ID NO: 1754781 - RNA, 18 nt, Human herpesvirus 1
ugggggcguagagcugug

SEQ ID NO: 1754782 - RNA, 19 nt, Human herpesvirus 1
uccaccaaagucucugugg

SEQ ID NO: 1754783 - RNA, 19 nt, Human herpesvirus 1
uaucccuaaggcccggcua

SEQ ID NO: 1754784 - RNA, 14 nt, Human herpesvirus 1
ccgaccacacaccc

SEQ ID NO: 1754785 - RNA, 12 nt, Human herpesvirus 1
auagagcugcuc

SEQ ID NO: 1754786 - RNA, 22 nt, Human herpesvirus 1
aucagccuuaccacgcccgacc

SEQ ID NO: 1754787 - RNA, 15 nt, Human herpesvirus 1
cggcggggcccggcc

SEQ ID NO: 1754788 - RNA, 14 nt, Human herpesvirus 1
aggagaucgccauc

SEQ ID NO: 1754789 - RNA, 22 nt, Human herpesvirus 1
ccuggguuggcgucgggaccau

SEQ ID NO: 1754790 - RNA, 13 nt, Human herpesvirus 1
gguggcacagaac

SEQ ID NO: 1754791 - RNA, 19 nt, Human herpesvirus 1
accgcgugaccccagggau

SEQ ID NO: 1754792 - RNA, 17 nt, Human herpesvirus 1
accaccauccccgcucc

SEQ ID NO: 1754793 - RNA, 18 nt, Human herpesvirus 1
ggcguaccgaaggcgcuu

SEQ ID NO: 1754794 - RNA, 18 nt, Human herpesvirus 1
ggcggccaacgacuuccu

SEQ ID NO: 1754795 - RNA, 18 nt, Human herpesvirus 1
cggcagucuccuggcagc

SEQ ID NO: 1754796 - RNA, 18 nt, Human herpesvirus 1
cuggccuuuuacgagguc

SEQ ID NO: 1754797 - RNA, 21 nt, Human herpesvirus 1
cuguccgagacccccaacgcc

SEQ ID NO: 1754798 - RNA, 15 nt, Human herpesvirus 1
caccacgccacaaca

SEQ ID NO: 1754799 - RNA, 22 nt, Human herpesvirus 1
cucacgcgcauccgcaagcuau

SEQ ID NO: 1754800 - RNA, 19 nt, Human herpesvirus 1
uccggcacggacccaaaau

SEQ ID NO: 1754801 - RNA, 17 nt, Human herpesvirus 1
ccugguuguccguggcc

SEQ ID NO: 1754802 - RNA, 15 nt, Human herpesvirus 1
gcuuuauacacagau

SEQ ID NO: 1754803 - RNA, 21 nt, Human herpesvirus 1
uuauuaacucacaggggcgcu

SEQ ID NO: 1754804 - RNA, 17 nt, Human herpesvirus 1
agggccucgcugaccag

SEQ ID NO: 1754805 - RNA, 16 nt, Human herpesvirus 1
acgcgagcgaggcccc

SEQ ID NO: 1754806 - RNA, 18 nt, Human herpesvirus 1
auugacccaaaacacacg

SEQ ID NO: 1754807 - RNA, 19 nt, Human herpesvirus 1
ccguugcccgggccuccuc

SEQ ID NO: 1754808 - RNA, 14 nt, Human herpesvirus 1
ccccaacgccacgc

SEQ ID NO: 1754809 - RNA, 20 nt, Human herpesvirus 1
cuuaaccgcccaccuccugg

SEQ ID NO: 1754810 - RNA, 21 nt, Human herpesvirus 1
cguccaucauagcccuggugu

SEQ ID NO: 1754811 - RNA, 16 nt, Human herpesvirus 1
cucgcugcuggcggac

SEQ ID NO: 1754812 - RNA, 23 nt, Human herpesvirus 1
gggccuggugcucgugggccucu

SEQ ID NO: 1754813 - RNA, 16 nt, Human herpesvirus 1
ccucggcgggcacgcc

SEQ ID NO: 1754814 - RNA, 18 nt, Human herpesvirus 1
ugguccccccucuauccc

SEQ ID NO: 1754815 - RNA, 13 nt, Human herpesvirus 1
gcggccccuggcg

SEQ ID NO: 1754816 - RNA, 21 nt, Human herpesvirus 1
uggccgacaacugccugaccc

SEQ ID NO: 1754817 - RNA, 22 nt, Human herpesvirus 1
guucuggacgggagucccgagg

SEQ ID NO: 1754818 - RNA, 22 nt, Human herpesvirus 1
gcaucgacacgcgcguccuucu

SEQ ID NO: 1754819 - RNA, 19 nt, Human herpesvirus 1
gggcugccgccagguuggg

SEQ ID NO: 1754820 - RNA, 12 nt, Human herpesvirus 1
gucgcacccaca

SEQ ID NO: 1754821 - RNA, 19 nt, Human herpesvirus 1
cgcugcugcggccagucca

SEQ ID NO: 1754822 - RNA, 23 nt, Human herpesvirus 1
agcgcgcugcucagcgccaaggu

SEQ ID NO: 1754823 - RNA, 13 nt, Human herpesvirus 1
ggagcgccaggac

SEQ ID NO: 1754824 - RNA, 16 nt, Human herpesvirus 1
cgggccucgugggcac

SEQ ID NO: 1754825 - RNA, 23 nt, Human herpesvirus 1
gggcgucaccaugcagcgccgga

SEQ ID NO: 1754826 - RNA, 16 nt, Human herpesvirus 1
cgccgccaccguggcc

SEQ ID NO: 1754827 - RNA, 15 nt, Human herpesvirus 1
gggagaaaccccagc

SEQ ID NO: 1754828 - RNA, 22 nt, Human herpesvirus 1
caugaagcccccaacaugaccc

SEQ ID NO: 1754829 - RNA, 16 nt, Human herpesvirus 1
cgggcccaaggcccca

SEQ ID NO: 1754830 - RNA, 23 nt, Human herpesvirus 1
gagccgggcgcgugcugcgccuu

SEQ ID NO: 1754831 - RNA, 13 nt, Human herpesvirus 1
uccgcgccaggcc

SEQ ID NO: 1754832 - RNA, 22 nt, Human herpesvirus 1
cacuacccaccgcgagaugucc

SEQ ID NO: 1754833 - RNA, 22 nt, Human herpesvirus 1
gagcccacaugcggaaagcaag

SEQ ID NO: 1754834 - RNA, 16 nt, Human herpesvirus 1
gagcuccgcaccaagc

SEQ ID NO: 1754835 - RNA, 22 nt, Human herpesvirus 1
gacagcggggacucgggcgagu

SEQ ID NO: 1754836 - RNA, 15 nt, Human herpesvirus 1
caagccgcucuccgg

SEQ ID NO: 1754837 - RNA, 16 nt, Human herpesvirus 1
cuguugguauaggucc

SEQ ID NO: 1754838 - RNA, 18 nt, Human herpesvirus 1
gcgcuucauagucgccga

SEQ ID NO: 1754839 - RNA, 19 nt, Human herpesvirus 1
acggacccaaaauaauaaa

SEQ ID NO: 1754840 - RNA, 18 nt, Human herpesvirus 1
caccccaacgccuccccu

SEQ ID NO: 1754841 - RNA, 18 nt, Human herpesvirus 1
caaguucaaggccaccau

SEQ ID NO: 1754842 - RNA, 13 nt, Human herpesvirus 1
acuccgucuuggu

SEQ ID NO: 1754843 - RNA, 20 nt, Human herpesvirus 1
ccgacagcacucacagcccc

SEQ ID NO: 1754844 - RNA, 15 nt, Human herpesvirus 1
cccgcgcggcugcca

SEQ ID NO: 1754845 - RNA, 15 nt, Human herpesvirus 1
gccccccagccuccc

SEQ ID NO: 1754846 - RNA, 16 nt, Human herpesvirus 1
agcucccagagacccc

SEQ ID NO: 1754847 - RNA, 17 nt, Human herpesvirus 1
caauccgugucggggag

SEQ ID NO: 1754848 - RNA, 23 nt, Human herpesvirus 1
gccgguauggggcaugaucagac

SEQ ID NO: 1754849 - RNA, 16 nt, Human herpesvirus 1
ccaaguucaccguggc

SEQ ID NO: 1754850 - RNA, 21 nt, Human herpesvirus 1
ugaccgcccgccccucgccac

SEQ ID NO: 1754851 - RNA, 17 nt, Human herpesvirus 1
guccccggcccggagga

SEQ ID NO: 1754852 - RNA, 17 nt, Human herpesvirus 1
acugccugacccucucc

SEQ ID NO: 1754853 - RNA, 23 nt, Human herpesvirus 1
cggccaacgccgcgacccgcacg

SEQ ID NO: 1754854 - RNA, 21 nt, Human herpesvirus 1
uggccggggagggcagggccg

SEQ ID NO: 1754855 - RNA, 23 nt, Human herpesvirus 1
accucgggugcauauccugggau

SEQ ID NO: 1754856 - RNA, 14 nt, Human herpesvirus 1
cacgugcgugccgg

SEQ ID NO: 1754857 - RNA, 16 nt, Human herpesvirus 1
caggccuccacccccu

SEQ ID NO: 1754858 - RNA, 21 nt, Human herpesvirus 1
cagguggcccuuccuaaccca

SEQ ID NO: 1754859 - RNA, 22 nt, Human herpesvirus 1
cccgaccgcguguacgggcugu

SEQ ID NO: 1754860 - RNA, 20 nt, Human herpesvirus 1
ccuaucacggcaaggagcgc

SEQ ID NO: 1754861 - RNA, 16 nt, Human herpesvirus 1
gacgacauggccagcg

SEQ ID NO: 1754862 - RNA, 15 nt, Human herpesvirus 1
ccgcaccgggccccc

SEQ ID NO: 1754863 - RNA, 15 nt, Human herpesvirus 1
cagcugagccgcgcc

SEQ ID NO: 1754864 - RNA, 17 nt, Human herpesvirus 1
ucuagccucguggggcu

SEQ ID NO: 1754865 - RNA, 15 nt, Human herpesvirus 1
cucccugcggcuggc

SEQ ID NO: 1754866 - RNA, 12 nt, Human herpesvirus 1
cgcggggccucc

SEQ ID NO: 1754867 - RNA, 19 nt, Human herpesvirus 1
agggcugccagaccucaac

SEQ ID NO: 1754868 - RNA, 20 nt, Human herpesvirus 1
cgggagccccggucuccccg

SEQ ID NO: 1754869 - RNA, 17 nt, Human herpesvirus 1
gccagccugcggccgga

SEQ ID NO: 1754870 - RNA, 19 nt, Human herpesvirus 1
acaacgccagccugcggcc

SEQ ID NO: 1754871 - RNA, 16 nt, Human herpesvirus 1
cggggccgcccuggcc

SEQ ID NO: 1754872 - RNA, 15 nt, Human herpesvirus 1
accaacgccgaugua

SEQ ID NO: 1754873 - RNA, 19 nt, Human herpesvirus 1
gcgaccccagccuucacgu

SEQ ID NO: 1754874 - RNA, 16 nt, Human herpesvirus 1
cgcuggggcugccgug

SEQ ID NO: 1754875 - RNA, 12 nt, Human herpesvirus 1
gccccccagccu

SEQ ID NO: 1754876 - RNA, 22 nt, Human herpesvirus 1
gccaggucggcgaccgccagcc

SEQ ID NO: 1754877 - RNA, 21 nt, Human herpesvirus 1
ugccgcccguugcagggccug

SEQ ID NO: 1754878 - RNA, 14 nt, Human herpesvirus 1
ucuggacuggacca

SEQ ID NO: 1754879 - RNA, 20 nt, Human herpesvirus 1
gcaguacuggaaguaccugc

SEQ ID NO: 1754880 - RNA, 14 nt, Human herpesvirus 1
ggccucgugggcac

SEQ ID NO: 1754881 - RNA, 20 nt, Human herpesvirus 1
cgcgcgucucuggggagccu

SEQ ID NO: 1754882 - RNA, 15 nt, Human herpesvirus 1
gugacucaggacauc

SEQ ID NO: 1754883 - RNA, 13 nt, Human herpesvirus 1
caagccgccccag

SEQ ID NO: 1754884 - RNA, 20 nt, Human herpesvirus 1
ccucugugucagguggcccu

SEQ ID NO: 1754885 - RNA, 14 nt, Human herpesvirus 1
ggaaagguggacag

SEQ ID NO: 1754886 - RNA, 16 nt, Human herpesvirus 1
cgcuaaucccccggcu

SEQ ID NO: 1754887 - RNA, 17 nt, Human herpesvirus 1
acgcuggggguccuggu

SEQ ID NO: 1754888 - RNA, 13 nt, Human herpesvirus 1
ccgcaaccagcug

SEQ ID NO: 1754889 - RNA, 12 nt, Human herpesvirus 1
cgcuccucugcg

SEQ ID NO: 1754890 - RNA, 21 nt, Human herpesvirus 1
ccagggcgaggugcgguuggg

SEQ ID NO: 1754891 - RNA, 20 nt, Human herpesvirus 1
gcccacaugcggaaagcaag

SEQ ID NO: 1754892 - RNA, 20 nt, Human herpesvirus 1
ucgggccucccggaagagcc

SEQ ID NO: 1754893 - RNA, 17 nt, Human herpesvirus 1
cagcugaccgacccucc

SEQ ID NO: 1754894 - RNA, 14 nt, Human herpesvirus 1
ccgggccgcccacu

SEQ ID NO: 1754895 - RNA, 16 nt, Human herpesvirus 1
ggccucucacacagca

SEQ ID NO: 1754896 - RNA, 22 nt, Human herpesvirus 1
caacgcgaccgucgccgcgggc

SEQ ID NO: 1754897 - RNA, 20 nt, Human herpesvirus 1
ccugugugucuucucuucgu

SEQ ID NO: 1754898 - RNA, 16 nt, Human herpesvirus 1
ucuuuuguguuggccc

SEQ ID NO: 1754899 - RNA, 15 nt, Human herpesvirus 1
acgugggccucaccc

SEQ ID NO: 1754900 - RNA, 18 nt, Human herpesvirus 1
gcggaaagcaagaacaau

SEQ ID NO: 1754901 - RNA, 18 nt, Human herpesvirus 1
ucccccuccgcaucccag

SEQ ID NO: 1754902 - RNA, 16 nt, Human herpesvirus 1
ccgguucguauccaca

SEQ ID NO: 1754903 - RNA, 23 nt, Human herpesvirus 1
cgggauaccgguaugccgcggcc

SEQ ID NO: 1754904 - RNA, 13 nt, Human herpesvirus 1
uacgcgggccccg

SEQ ID NO: 1754905 - RNA, 21 nt, Human herpesvirus 1
ugcgccuggauucgcuggacc

SEQ ID NO: 1754906 - RNA, 22 nt, Human herpesvirus 1
ggccgugggucuguugguccug

SEQ ID NO: 1754907 - RNA, 20 nt, Human herpesvirus 1
acccaaccaaaccaggcgug

SEQ ID NO: 1754908 - RNA, 16 nt, Human herpesvirus 1
cugccgucgcuagacc

SEQ ID NO: 1754909 - RNA, 19 nt, Human herpesvirus 1
gacggcauucgggccugcc

SEQ ID NO: 1754910 - RNA, 15 nt, Human herpesvirus 1
ugcgggcucggcucc

SEQ ID NO: 1754911 - RNA, 22 nt, Human herpesvirus 1
uccgcgccccccgacccuccca

SEQ ID NO: 1754912 - RNA, 17 nt, Human herpesvirus 1
gaaggcccuguacccgc

SEQ ID NO: 1754913 - RNA, 17 nt, Human herpesvirus 1
ggcgaccgccggcgagg

SEQ ID NO: 1754914 - RNA, 14 nt, Human herpesvirus 1
gacggcggggcaga

SEQ ID NO: 1754915 - RNA, 15 nt, Human herpesvirus 1
gcauggcgcagcugg

SEQ ID NO: 1754916 - RNA, 22 nt, Human herpesvirus 1
ucccauccgaacgcagccccgc

SEQ ID NO: 1754917 - RNA, 11 nt, Human herpesvirus 1
gccggccuggc

SEQ ID NO: 1754918 - RNA, 13 nt, Human herpesvirus 1
ugcuacagccgcc

SEQ ID NO: 1754919 - RNA, 13 nt, Human herpesvirus 1
agggugucccagg

SEQ ID NO: 1754920 - RNA, 20 nt, Human herpesvirus 1
cgucggucugcaccaugacc

SEQ ID NO: 1754921 - RNA, 20 nt, Human herpesvirus 1
cgggggauggggagagccca

SEQ ID NO: 1754922 - RNA, 20 nt, Human herpesvirus 1
uggccccaguccccaagacc

SEQ ID NO: 1754923 - RNA, 19 nt, Human herpesvirus 1
ucagccuuaccacgcccga

SEQ ID NO: 1754924 - RNA, 17 nt, Human herpesvirus 1
cuacccguguuugccca

SEQ ID NO: 1754925 - RNA, 16 nt, Human herpesvirus 1
ccucucuucucucccg

SEQ ID NO: 1754926 - RNA, 21 nt, Human herpesvirus 1
cuguaccggugggcguccugg

SEQ ID NO: 1754927 - RNA, 17 nt, Human herpesvirus 1
uccggcgggagccaccc

SEQ ID NO: 1754928 - RNA, 22 nt, Human herpesvirus 1
uacugcgcgaucguccaccucc

SEQ ID NO: 1754929 - RNA, 17 nt, Human herpesvirus 1
ccgcccuggacacccuc

SEQ ID NO: 1754930 - RNA, 15 nt, Human herpesvirus 1
cucgccccacgaccc

SEQ ID NO: 1754931 - RNA, 13 nt, Human herpesvirus 1
ccaccgaccucaa

SEQ ID NO: 1754932 - RNA, 23 nt, Human herpesvirus 1
gccugacgcgccgcgggcccccg

SEQ ID NO: 1754933 - RNA, 16 nt, Human herpesvirus 1
ccugaguugggaauaa

SEQ ID NO: 1754934 - RNA, 15 nt, Human herpesvirus 1
acacucgacccccgc

SEQ ID NO: 1754935 - RNA, 17 nt, Human herpesvirus 1
cccgaucccaacaacuc

SEQ ID NO: 1754936 - RNA, 22 nt, Human herpesvirus 1
gacccccuuguauguccccaaa

SEQ ID NO: 1754937 - RNA, 22 nt, Human herpesvirus 1
gcggcgaacgggggcccugcca

SEQ ID NO: 1754938 - RNA, 14 nt, Human herpesvirus 1
gccugccgccucac

SEQ ID NO: 1754939 - RNA, 18 nt, Human herpesvirus 1
ggcccggcuagacccacg

SEQ ID NO: 1754940 - RNA, 17 nt, Human herpesvirus 1
ggccaagcuagccgagg

SEQ ID NO: 1754941 - RNA, 13 nt, Human herpesvirus 1
gaccucaccacca

SEQ ID NO: 1754942 - RNA, 16 nt, Human herpesvirus 1
ccgaccacacaccccc

SEQ ID NO: 1754943 - RNA, 23 nt, Human herpesvirus 1
cgcacgcauacgggcggccaccc

SEQ ID NO: 1754944 - RNA, 13 nt, Human herpesvirus 1
cggcucaacgagc

SEQ ID NO: 1754945 - RNA, 13 nt, Human herpesvirus 1
ggacgggguuccc

SEQ ID NO: 1754946 - RNA, 18 nt, Human herpesvirus 1
cucguccccuggggcggc

SEQ ID NO: 1754947 - RNA, 21 nt, Human herpesvirus 1
gagcagagccgcaagccccca

SEQ ID NO: 1754948 - RNA, 13 nt, Human herpesvirus 1
accucgcccaccc

SEQ ID NO: 1754949 - RNA, 22 nt, Human herpesvirus 1
cacgacaaccccggucucccag

SEQ ID NO: 1754950 - RNA, 19 nt, Human herpesvirus 1
gacccgcaacgcgcugggg

SEQ ID NO: 1754951 - RNA, 21 nt, Human herpesvirus 1
cagacauuccgcuaucuccug

SEQ ID NO: 1754952 - RNA, 14 nt, Human herpesvirus 1
gcuuccggccuggg

SEQ ID NO: 1754953 - RNA, 15 nt, Human herpesvirus 1
ucgggugugcaccuu

SEQ ID NO: 1754954 - RNA, 19 nt, Human herpesvirus 1
cucgcggagcuguacgugc

SEQ ID NO: 1754955 - RNA, 23 nt, Human herpesvirus 1
gacaaccccggucucccagggag

SEQ ID NO: 1754956 - RNA, 13 nt, Human herpesvirus 1
cgccccuguggcc

SEQ ID NO: 1754957 - RNA, 17 nt, Human herpesvirus 1
acaugcggaaagcaaga

SEQ ID NO: 1754958 - RNA, 20 nt, Human herpesvirus 1
gccgcaguacuaccuggcca

SEQ ID NO: 1754959 - RNA, 11 nt, Human herpesvirus 1
acuccccggac

SEQ ID NO: 1754960 - RNA, 23 nt, Human herpesvirus 1
gcgcuucuacccguguuugccca

SEQ ID NO: 1754961 - RNA, 18 nt, Human herpesvirus 1
gagggcguaacguuccgc

SEQ ID NO: 1754962 - RNA, 23 nt, Human herpesvirus 1
guuucguuccuucccccuccccc

SEQ ID NO: 1754963 - RNA, 23 nt, Human herpesvirus 1
gccagaucuacugcugggccaug

SEQ ID NO: 1754964 - RNA, 13 nt, Human herpesvirus 1
acacgggcuaccc

SEQ ID NO: 1754965 - RNA, 22 nt, Human herpesvirus 1
gucugugccggagguggggcgg

SEQ ID NO: 1754966 - RNA, 14 nt, Human herpesvirus 1
ucgucucucuuccc

SEQ ID NO: 1754967 - RNA, 23 nt, Human herpesvirus 1
cgcuacugcgcgaucguccaccu

SEQ ID NO: 1754968 - RNA, 18 nt, Human herpesvirus 1
uuaaccgcaccccccucg

SEQ ID NO: 1754969 - RNA, 21 nt, Human herpesvirus 1
cggugaacgaagcggccaugg

SEQ ID NO: 1754970 - RNA, 18 nt, Human herpesvirus 1
ccagggagaaaccccagc

SEQ ID NO: 1754971 - RNA, 23 nt, Human herpesvirus 1
cuccccgggagccccggacccca

SEQ ID NO: 1754972 - RNA, 19 nt, Human herpesvirus 1
ccaaccgcgacccuccggg

SEQ ID NO: 1754973 - RNA, 15 nt, Human herpesvirus 1
accccacgacaccca

SEQ ID NO: 1754974 - RNA, 20 nt, Human herpesvirus 1
cagccagaacucgccccgga

SEQ ID NO: 1754975 - RNA, 19 nt, Human herpesvirus 1
ccgagacccccaacgccac

SEQ ID NO: 1754976 - RNA, 13 nt, Human herpesvirus 1
ccguguccuggag

SEQ ID NO: 1754977 - RNA, 13 nt, Human herpesvirus 1
agcgcacugcccg

SEQ ID NO: 1754978 - RNA, 20 nt, Human herpesvirus 1
caacgcgggcguucccgagc

SEQ ID NO: 1754979 - RNA, 15 nt, Human herpesvirus 1
uggugcgagcugcag

SEQ ID NO: 1754980 - RNA, 12 nt, Human herpesvirus 1
gcgccccccaaa

SEQ ID NO: 1754981 - RNA, 18 nt, Human herpesvirus 1
cauccccgcuccccaagc

SEQ ID NO: 1754982 - RNA, 16 nt, Human herpesvirus 1
cgguccuggaccagcu

SEQ ID NO: 1754983 - RNA, 16 nt, Human herpesvirus 1
cgcgacaacgagcccc

SEQ ID NO: 1754984 - RNA, 20 nt, Human herpesvirus 1
acucagggcucuacccucug

SEQ ID NO: 1754985 - RNA, 11 nt, Human herpesvirus 1
auuuggggcgc

SEQ ID NO: 1754986 - RNA, 18 nt, Human herpesvirus 1
cgccuggcgucuccucug

SEQ ID NO: 1754987 - RNA, 18 nt, Human herpesvirus 1
acccguuccagcccccca

SEQ ID NO: 1754988 - RNA, 13 nt, Human herpesvirus 1
acgcgcuggggcu

SEQ ID NO: 1754989 - RNA, 18 nt, Human herpesvirus 1
cccaggccuaccagcagg

SEQ ID NO: 1754990 - RNA, 17 nt, Human herpesvirus 1
cccgggccacggcgccg

SEQ ID NO: 1754991 - RNA, 15 nt, Human herpesvirus 1
agcgaagcagccgcc

SEQ ID NO: 1754992 - RNA, 17 nt, Human herpesvirus 1
gcugcgcauccccccgu

SEQ ID NO: 1754993 - RNA, 21 nt, Human herpesvirus 1
cugagacaagagcgcuccccc

SEQ ID NO: 1754994 - RNA, 16 nt, Human herpesvirus 1
acccccucgaccacca

SEQ ID NO: 1754995 - RNA, 15 nt, Human herpesvirus 1
caacgagcugcggcu

SEQ ID NO: 1754996 - RNA, 10 nt, Human herpesvirus 1
ucccaggacu

SEQ ID NO: 1754997 - RNA, 17 nt, Human herpesvirus 1
gugcgucgggccucccg

SEQ ID NO: 1754998 - RNA, 13 nt, Human herpesvirus 1
gcucacgaccccc

SEQ ID NO: 1754999 - RNA, 20 nt, Human herpesvirus 1
ggcauccagggagaaacccc

SEQ ID NO: 1755000 - RNA, 16 nt, Human herpesvirus 1
cagggaccuccuggac

SEQ ID NO: 1755001 - RNA, 22 nt, Human herpesvirus 1
cuugaggggggagaugggaccc

SEQ ID NO: 1755002 - RNA, 17 nt, Human herpesvirus 1
cagccgcgccgcugccc

SEQ ID NO: 1755003 - RNA, 14 nt, Human herpesvirus 1
cggcgugucggugc

SEQ ID NO: 1755004 - RNA, 15 nt, Human herpesvirus 1
gccaccgugggccgg

SEQ ID NO: 1755005 - RNA, 18 nt, Human herpesvirus 1
ccgggcgcguccccggcc

SEQ ID NO: 1755006 - RNA, 17 nt, Human herpesvirus 1
cguugcagggccuggug

SEQ ID NO: 1755007 - RNA, 17 nt, Human herpesvirus 1
ccgccccuaucgcucga

SEQ ID NO: 1755008 - RNA, 16 nt, Human herpesvirus 1
cuggacgugggccuca

SEQ ID NO: 1755009 - RNA, 20 nt, Human herpesvirus 1
gggcaucucgcgccccgaug

SEQ ID NO: 1755010 - RNA, 18 nt, Human herpesvirus 1
ggugccaauaaaccccca

SEQ ID NO: 1755011 - RNA, 14 nt, Human herpesvirus 1
cccgccgccacugu

SEQ ID NO: 1755012 - RNA, 17 nt, Human herpesvirus 1
gaccggcaagcggagcg

SEQ ID NO: 1755013 - RNA, 17 nt, Human herpesvirus 1
uguccgcggggccuccg

SEQ ID NO: 1755014 - RNA, 13 nt, Human herpesvirus 1
accucuccacacc

SEQ ID NO: 1755015 - RNA, 18 nt, Human herpesvirus 1
agacacgggcaccacaca

SEQ ID NO: 1755016 - RNA, 18 nt, Human herpesvirus 1
acccuaccccaguccccg

SEQ ID NO: 1755017 - RNA, 15 nt, Human herpesvirus 1
gcacccacgcccgcg

SEQ ID NO: 1755018 - RNA, 14 nt, Human herpesvirus 1
ggcccgaagccugc

SEQ ID NO: 1755019 - RNA, 23 nt, Human herpesvirus 1
cacgagcgcgcugcucagcgcca

SEQ ID NO: 1755020 - RNA, 13 nt, Human herpesvirus 1
uccucccgccacc

SEQ ID NO: 1755021 - RNA, 15 nt, Human herpesvirus 1
cacggcuaccuggcc

SEQ ID NO: 1755022 - RNA, 14 nt, Human herpesvirus 1
gaccggcggguccc

SEQ ID NO: 1755023 - RNA, 22 nt, Human herpesvirus 1
ccgcguguuccccgggagcccc

SEQ ID NO: 1755024 - RNA, 21 nt, Human herpesvirus 1
ccaccgccaucagccuuacca

SEQ ID NO: 1755025 - RNA, 15 nt, Human herpesvirus 1
aggcacggcagcaug

SEQ ID NO: 1755026 - RNA, 19 nt, Human herpesvirus 1
ugucuccccgauggcccuc

SEQ ID NO: 1755027 - RNA, 14 nt, Human herpesvirus 1
cgggagccccgguc

SEQ ID NO: 1755028 - RNA, 18 nt, Human herpesvirus 1
gccacgucgaccgcgccc

SEQ ID NO: 1755029 - RNA, 12 nt, Human herpesvirus 1
acccgacacuga

SEQ ID NO: 1755030 - RNA, 15 nt, Human herpesvirus 1
cagagaccccagggu

SEQ ID NO: 1755031 - RNA, 12 nt, Human herpesvirus 1
ccgccccacccc

SEQ ID NO: 1755032 - RNA, 20 nt, Human herpesvirus 1
gucgucauagugggccucca

SEQ ID NO: 1755033 - RNA, 22 nt, Human herpesvirus 1
gccguccucgcaccagcccuug

SEQ ID NO: 1755034 - RNA, 15 nt, Human herpesvirus 1
cgcucaaccaccgcu

SEQ ID NO: 1755035 - RNA, 17 nt, Human herpesvirus 1
ugugccaucgcgccccc

SEQ ID NO: 1755036 - RNA, 16 nt, Human herpesvirus 1
guccccgcgaagaccc

SEQ ID NO: 1755037 - RNA, 14 nt, Human herpesvirus 1
cccaugaaggcccu

SEQ ID NO: 1755038 - RNA, 18 nt, Human herpesvirus 1
gggauugguuagacccau

SEQ ID NO: 1755039 - RNA, 12 nt, Human herpesvirus 1
cgugcccuucca

SEQ ID NO: 1755040 - RNA, 19 nt, Human herpesvirus 1
ccagccuguuuguccuggg

SEQ ID NO: 1755041 - RNA, 22 nt, Human herpesvirus 1
gugggcgacugcgaccccagcc

SEQ ID NO: 1755042 - RNA, 17 nt, Human herpesvirus 1
ccaguggcuccgggcca

SEQ ID NO: 1755043 - RNA, 18 nt, Human herpesvirus 1
aaauuuuacaaacagauu

SEQ ID NO: 1755044 - RNA, 14 nt, Human herpesvirus 1
gccagggcgcuacg

SEQ ID NO: 1755045 - RNA, 14 nt, Human herpesvirus 1
guccguggagcgca

SEQ ID NO: 1755046 - RNA, 19 nt, Human herpesvirus 1
acgaguaucugcgggccgc

SEQ ID NO: 1755047 - RNA, 14 nt, Human herpesvirus 1
ucuucucucccggg

SEQ ID NO: 1755048 - RNA, 19 nt, Human herpesvirus 1
caacuccagaccaccgguc

SEQ ID NO: 1755049 - RNA, 21 nt, Human herpesvirus 1
ugucccgacauuaaccaccug

SEQ ID NO: 1755050 - RNA, 16 nt, Human herpesvirus 1
gucuucggccccgcgu

SEQ ID NO: 1755051 - RNA, 17 nt, Human herpesvirus 1
gccccgugucugugggc

SEQ ID NO: 1755052 - RNA, 15 nt, Human herpesvirus 1
acacccgccccucca

SEQ ID NO: 1755053 - RNA, 23 nt, Human herpesvirus 1
cagcagacgcugcuccgccuggc

SEQ ID NO: 1755054 - RNA, 17 nt, Human herpesvirus 1
gcuuguccccgaacaaa

SEQ ID NO: 1755055 - RNA, 14 nt, Human herpesvirus 1
cuauaaagccgcca

SEQ ID NO: 1755056 - RNA, 16 nt, Human herpesvirus 1
uccgaacgcagccccg

SEQ ID NO: 1755057 - RNA, 23 nt, Human herpesvirus 1
cuucggccccgcgucuggccccg

SEQ ID NO: 1755058 - RNA, 22 nt, Human herpesvirus 1
guucccccggcacgccuggggu

SEQ ID NO: 1755059 - RNA, 23 nt, Human herpesvirus 1
uggcuucggccguuucuccgccc

SEQ ID NO: 1755060 - RNA, 17 nt, Human herpesvirus 1
ccacgagaucaaggaca

SEQ ID NO: 1755061 - RNA, 22 nt, Human herpesvirus 1
cgcgucgacgucgcgccugggu

SEQ ID NO: 1755062 - RNA, 21 nt, Human herpesvirus 1
ucuccgaucccaacuccucag

SEQ ID NO: 1755063 - RNA, 13 nt, Human herpesvirus 1
accagguccccca

SEQ ID NO: 1755064 - RNA, 16 nt, Human herpesvirus 1
gccuagccgcagcaaa

SEQ ID NO: 1755065 - RNA, 13 nt, Human herpesvirus 1
cggcggggccuca

SEQ ID NO: 1755066 - RNA, 23 nt, Human herpesvirus 1
cucucgcaccaucccggguuaau

SEQ ID NO: 1755067 - RNA, 18 nt, Human herpesvirus 1
guacugcggucugucucg

SEQ ID NO: 1755068 - RNA, 17 nt, Human herpesvirus 1
accggacccgcaucccc

SEQ ID NO: 1755069 - RNA, 21 nt, Human herpesvirus 1
caaacacaaaacacacggguu

SEQ ID NO: 1755070 - RNA, 17 nt, Human herpesvirus 1
cguggauacggucaccc

SEQ ID NO: 1755071 - RNA, 20 nt, Human herpesvirus 1
cccugagcgcccuccugacc

SEQ ID NO: 1755072 - RNA, 14 nt, Human herpesvirus 1
ccgaagccccggcc

SEQ ID NO: 1755073 - RNA, 22 nt, Human herpesvirus 1
gcggguaugguggaccgcggac

SEQ ID NO: 1755074 - RNA, 20 nt, Human herpesvirus 1
gauagagucgacgaccuggg

SEQ ID NO: 1755075 - RNA, 17 nt, Human herpesvirus 1
ucgcguggugcgagcug

SEQ ID NO: 1755076 - RNA, 16 nt, Human herpesvirus 1
uggaggucguuuucau

SEQ ID NO: 1755077 - RNA, 17 nt, Human herpesvirus 1
guccgcgcauccgaccc

SEQ ID NO: 1755078 - RNA, 12 nt, Human herpesvirus 1
gcuugcggggcu

SEQ ID NO: 1755079 - RNA, 16 nt, Human herpesvirus 1
cucgagaugggccagg

SEQ ID NO: 1755080 - RNA, 19 nt, Human herpesvirus 1
ccaguccccgggcccagcc

SEQ ID NO: 1755081 - RNA, 22 nt, Human herpesvirus 1
ccucccggggggucggcaggcg

SEQ ID NO: 1755082 - RNA, 20 nt, Human herpesvirus 1
gcgggacccgacaggcgacc

SEQ ID NO: 1755083 - RNA, 14 nt, Human herpesvirus 1
caccaucucccccg

SEQ ID NO: 1755084 - RNA, 22 nt, Human herpesvirus 1
cgcgaccucaccaccaaggccc

SEQ ID NO: 1755085 - RNA, 16 nt, Human herpesvirus 1
gcagcgccggccuccc

SEQ ID NO: 1755086 - RNA, 13 nt, Human herpesvirus 1
gcuccgccgcgga

SEQ ID NO: 1755087 - RNA, 23 nt, Human herpesvirus 1
caauccgugucggggaggggaaa

SEQ ID NO: 1755088 - RNA, 22 nt, Human herpesvirus 1
gguaccgcgugaccccagggau

SEQ ID NO: 1755089 - RNA, 12 nt, Human herpesvirus 1
aucgucggugcc

SEQ ID NO: 1755090 - RNA, 15 nt, Human herpesvirus 1
guccccgaacaaacg

SEQ ID NO: 1755091 - RNA, 21 nt, Human herpesvirus 1
ugcccucccugacggccaucg

SEQ ID NO: 1755092 - RNA, 21 nt, Human herpesvirus 1
ccuggaggacggcgccggggc

SEQ ID NO: 1755093 - RNA, 14 nt, Human herpesvirus 1
ugccugacccucuc

SEQ ID NO: 1755094 - RNA, 16 nt, Human herpesvirus 1
ccggcggacccaagcc

SEQ ID NO: 1755095 - RNA, 22 nt, Human herpesvirus 1
ccucccgcucggcggcagcccg

SEQ ID NO: 1755096 - RNA, 20 nt, Human herpesvirus 1
cgccacccgaaccaccacug

SEQ ID NO: 1755097 - RNA, 13 nt, Human herpesvirus 1
gggcaggugcaga

SEQ ID NO: 1755098 - RNA, 13 nt, Human herpesvirus 1
acccgacucaccu

SEQ ID NO: 1755099 - RNA, 16 nt, Human herpesvirus 1
gauggaggagccccug

SEQ ID NO: 1755100 - RNA, 15 nt, Human herpesvirus 1
agcuuuccgagggcg

SEQ ID NO: 1755101 - RNA, 19 nt, Human herpesvirus 1
cacccugcugcccccggag

SEQ ID NO: 1755102 - RNA, 12 nt, Human herpesvirus 1
cagacgcacccg

SEQ ID NO: 1755103 - RNA, 16 nt, Human herpesvirus 1
gcccccgaggccagca

SEQ ID NO: 1755104 - RNA, 11 nt, Human herpesvirus 1
acggcaaggag

SEQ ID NO: 1755105 - RNA, 16 nt, Human herpesvirus 1
ccgccuggucccccgg

SEQ ID NO: 1755106 - RNA, 14 nt, Human herpesvirus 1
cccuggcgagccca

SEQ ID NO: 1755107 - RNA, 12 nt, Human herpesvirus 1
aacaugacccag

SEQ ID NO: 1755108 - RNA, 21 nt, Human herpesvirus 1
gacccucucuucucucccggg

SEQ ID NO: 1755109 - RNA, 17 nt, Human herpesvirus 1
gggucuguuggggacac

SEQ ID NO: 1755110 - RNA, 17 nt, Human herpesvirus 1
cgucucucuuccccccc

SEQ ID NO: 1755111 - RNA, 15 nt, Human herpesvirus 1
cacgagcacccugcu

SEQ ID NO: 1755112 - RNA, 19 nt, Human herpesvirus 1
acggcauucgggccugccu

SEQ ID NO: 1755113 - RNA, 20 nt, Human herpesvirus 1
aaccaccuuccguccccugc

SEQ ID NO: 1755114 - RNA, 15 nt, Human herpesvirus 1
cccacgacccgacuc

SEQ ID NO: 1755115 - RNA, 15 nt, Human herpesvirus 1
ugacgccucagggcc

SEQ ID NO: 1755116 - RNA, 21 nt, Human herpesvirus 1
ucuggcguucgucgcccucca

SEQ ID NO: 1755117 - RNA, 13 nt, Human herpesvirus 1
cccugucgccucc

SEQ ID NO: 1755118 - RNA, 16 nt, Human herpesvirus 1
uagcucgcggagggcg

SEQ ID NO: 1755119 - RNA, 17 nt, Human herpesvirus 1
caccccgaagccccggc

SEQ ID NO: 1755120 - RNA, 16 nt, Human herpesvirus 1
cauacacagccaccca

SEQ ID NO: 1755121 - RNA, 17 nt, Human herpesvirus 1
uccagagggcaacgcgg

SEQ ID NO: 1755122 - RNA, 13 nt, Human herpesvirus 1
ccagggagccccg

SEQ ID NO: 1755123 - RNA, 18 nt, Human herpesvirus 1
ugggauccgacccccaug

SEQ ID NO: 1755124 - RNA, 13 nt, Human herpesvirus 1
uccgcgccccucu

SEQ ID NO: 1755125 - RNA, 15 nt, Human herpesvirus 1
ccagaugcccacggg

SEQ ID NO: 1755126 - RNA, 15 nt, Human herpesvirus 1
gaccacgugcacagc

SEQ ID NO: 1755127 - RNA, 23 nt, Human herpesvirus 1
guccccccucuaucccgcccacc

SEQ ID NO: 1755128 - RNA, 19 nt, Human herpesvirus 1
acgccuggggucgcggccg

SEQ ID NO: 1755129 - RNA, 16 nt, Human herpesvirus 1
gccagcuaugggcccu

SEQ ID NO: 1755130 - RNA, 12 nt, Human herpesvirus 1
gcggccauggcc

SEQ ID NO: 1755131 - RNA, 13 nt, Human herpesvirus 1
gcggcccccgcga

SEQ ID NO: 1755132 - RNA, 12 nt, Human herpesvirus 1
ucaaucuggccc

SEQ ID NO: 1755133 - RNA, 15 nt, Human herpesvirus 1
ugcagggccuggugc

SEQ ID NO: 1755134 - RNA, 21 nt, Human herpesvirus 1
cuucuugucgucucucuuccc

SEQ ID NO: 1755135 - RNA, 19 nt, Human herpesvirus 1
uccagggggaugcuagccu

SEQ ID NO: 1755136 - RNA, 12 nt, Human herpesvirus 1
auggcaggagcc

SEQ ID NO: 1755137 - RNA, 16 nt, Human herpesvirus 1
cccgcccggguccccg

SEQ ID NO: 1755138 - RNA, 12 nt, Human herpesvirus 1
uguggggacccg

SEQ ID NO: 1755139 - RNA, 16 nt, Human herpesvirus 1
cgccgcggccuggguu

SEQ ID NO: 1755140 - RNA, 21 nt, Human herpesvirus 1
uccacacccaguggcuccggg

SEQ ID NO: 1755141 - RNA, 20 nt, Human herpesvirus 1
gcggggcggggaaugugugu

SEQ ID NO: 1755142 - RNA, 13 nt, Human herpesvirus 1
acugcgaccccag

SEQ ID NO: 1755143 - RNA, 19 nt, Human herpesvirus 1
gccuccgcccgugcugccg

SEQ ID NO: 1755144 - RNA, 22 nt, Human herpesvirus 1
gagccacccgacaacagccccc

SEQ ID NO: 1755145 - RNA, 18 nt, Human herpesvirus 1
cugcaccgguucucccug

SEQ ID NO: 1755146 - RNA, 15 nt, Human herpesvirus 1
ucccuggccgugguc

SEQ ID NO: 1755147 - RNA, 15 nt, Human herpesvirus 1
uuuggguccgggccc

SEQ ID NO: 1755148 - RNA, 12 nt, Human herpesvirus 1
cgccgcgggccc

SEQ ID NO: 1755149 - RNA, 19 nt, Human herpesvirus 1
ccccaugcgggcucggcuc

SEQ ID NO: 1755150 - RNA, 21 nt, Human herpesvirus 1
ccaguggcuccgggccaacca

SEQ ID NO: 1755151 - RNA, 17 nt, Human herpesvirus 1
aguggaggaagaccugc

SEQ ID NO: 1755152 - RNA, 12 nt, Human herpesvirus 1
gcuuggagccag

SEQ ID NO: 1755153 - RNA, 16 nt, Human herpesvirus 1
gcuucggccguuucuc

SEQ ID NO: 1755154 - RNA, 15 nt, Human herpesvirus 1
acguccugggccacc

SEQ ID NO: 1755155 - RNA, 12 nt, Human herpesvirus 1
ccccgcccgggu

SEQ ID NO: 1755156 - RNA, 11 nt, Human herpesvirus 1
guccuggggau

SEQ ID NO: 1755157 - RNA, 21 nt, Human herpesvirus 1
cucggccuauggcuccugcga

SEQ ID NO: 1755158 - RNA, 20 nt, Human herpesvirus 1
accacaaucgcgaccacccc

SEQ ID NO: 1755159 - RNA, 16 nt, Human herpesvirus 1
gcuccuuagcgcggcc

SEQ ID NO: 1755160 - RNA, 13 nt, Human herpesvirus 1
guguucgagggcc

SEQ ID NO: 1755161 - RNA, 20 nt, Human herpesvirus 1
gccuacacucgacccccgcg

SEQ ID NO: 1755162 - RNA, 12 nt, Human herpesvirus 1
ucugggcgggcc

SEQ ID NO: 1755163 - RNA, 13 nt, Human herpesvirus 1
uuggggcccaccc

SEQ ID NO: 1755164 - RNA, 16 nt, Human herpesvirus 1
cccgcgcaugcucugg

SEQ ID NO: 1755165 - RNA, 18 nt, Human herpesvirus 1
ucgagaugagccagaccc

SEQ ID NO: 1755166 - RNA, 22 nt, Human herpesvirus 1
ggccuuguuccgcuucccggua

SEQ ID NO: 1755167 - RNA, 18 nt, Human herpesvirus 1
guggcuccgggccaacca

SEQ ID NO: 1755168 - RNA, 15 nt, Human herpesvirus 1
cccaugaaggcccug

SEQ ID NO: 1755169 - RNA, 14 nt, Human herpesvirus 1
ucuccacaccugca

SEQ ID NO: 1755170 - RNA, 18 nt, Human herpesvirus 1
agagucgacgaccugggg

SEQ ID NO: 1755171 - RNA, 20 nt, Human herpesvirus 1
ggaggagccccugcccgaca

SEQ ID NO: 1755172 - RNA, 22 nt, Human herpesvirus 1
ccucccgauaaaaagcgccccg

SEQ ID NO: 1755173 - RNA, 15 nt, Human herpesvirus 1
ccauggaccgcaucu

SEQ ID NO: 1755174 - RNA, 22 nt, Human herpesvirus 1
cgucuucggccccgcgucuggc

SEQ ID NO: 1755175 - RNA, 20 nt, Human herpesvirus 1
uccgcccccaaccccuuccc

SEQ ID NO: 1755176 - RNA, 17 nt, Human herpesvirus 1
cauggccaugacggguc

SEQ ID NO: 1755177 - RNA, 18 nt, Human herpesvirus 1
cgcuucccgguaugguaa

SEQ ID NO: 1755178 - RNA, 13 nt, Human herpesvirus 1
uuccgcugagccu

SEQ ID NO: 1755179 - RNA, 17 nt, Human herpesvirus 1
caugcgcaagcgccgca

SEQ ID NO: 1755180 - RNA, 21 nt, Human herpesvirus 1
gcacuuuccccaugcgacagc

SEQ ID NO: 1755181 - RNA, 16 nt, Human herpesvirus 1
cucgaucggccacggg

SEQ ID NO: 1755182 - RNA, 16 nt, Human herpesvirus 1
ggaggagccccugccc

SEQ ID NO: 1755183 - RNA, 16 nt, Human herpesvirus 1
auguccccaaaauaaa

SEQ ID NO: 1755184 - RNA, 15 nt, Human herpesvirus 1
cacccgaaccaccac

SEQ ID NO: 1755185 - RNA, 22 nt, Human herpesvirus 1
ccccacgcccccgccgcccggg

SEQ ID NO: 1755186 - RNA, 12 nt, Human herpesvirus 1
gugauuccucuc

SEQ ID NO: 1755187 - RNA, 23 nt, Human herpesvirus 1
caugcgcgggcucgucuuggcca

SEQ ID NO: 1755188 - RNA, 15 nt, Human herpesvirus 1
uccgcaucccaggau

SEQ ID NO: 1755189 - RNA, 20 nt, Human herpesvirus 1
gucgccccgugucugugggc

SEQ ID NO: 1755190 - RNA, 14 nt, Human herpesvirus 1
cgcagccuggucga

SEQ ID NO: 1755191 - RNA, 21 nt, Human herpesvirus 1
acaccgcguguuccccgggag

SEQ ID NO: 1755192 - RNA, 18 nt, Human herpesvirus 1
gcucgcggaggagccagu

SEQ ID NO: 1755193 - RNA, 13 nt, Human herpesvirus 1
aagcugauguccc

SEQ ID NO: 1755194 - RNA, 21 nt, Human herpesvirus 1
ugggcggccccggccgcccuu

SEQ ID NO: 1755195 - RNA, 18 nt, Human herpesvirus 1
cgcgagcucccugcggcu

SEQ ID NO: 1755196 - RNA, 21 nt, Human herpesvirus 1
cgccgcgacccgcacgagccg

SEQ ID NO: 1755197 - RNA, 21 nt, Human herpesvirus 1
ccggguacggcgucugggcca

SEQ ID NO: 1755198 - RNA, 17 nt, Human herpesvirus 1
cgcuuuauaggccggga

SEQ ID NO: 1755199 - RNA, 18 nt, Human herpesvirus 1
cguacaaguucaaggcca

SEQ ID NO: 1755200 - RNA, 14 nt, Human herpesvirus 1
cgcaacggggcgcc

SEQ ID NO: 1755201 - RNA, 18 nt, Human herpesvirus 1
accaccauggccccccgc

SEQ ID NO: 1755202 - RNA, 20 nt, Human herpesvirus 1
gcgaccucggcgccucugga

SEQ ID NO: 1755203 - RNA, 20 nt, Human herpesvirus 1
uggguguguuuauugggcgc

SEQ ID NO: 1755204 - RNA, 18 nt, Human herpesvirus 1
cggacccaaaauaauaaa

SEQ ID NO: 1755205 - RNA, 12 nt, Human herpesvirus 1
ccacccuggagc

SEQ ID NO: 1755206 - RNA, 21 nt, Human herpesvirus 1
acaccggucaacgaggguugg

SEQ ID NO: 1755207 - RNA, 12 nt, Human herpesvirus 1
cgcuagaccacg

SEQ ID NO: 1755208 - RNA, 19 nt, Human herpesvirus 1
gccccggaccccacgcacc

SEQ ID NO: 1755209 - RNA, 16 nt, Human herpesvirus 1
uuucguuccuuccccc

SEQ ID NO: 1755210 - RNA, 20 nt, Human herpesvirus 1
agcucccagagaccccaggg

SEQ ID NO: 1755211 - RNA, 16 nt, Human herpesvirus 1
ugucgcagcaccuccu

SEQ ID NO: 1755212 - RNA, 19 nt, Human herpesvirus 1
cugcgcgagcaccugcggg

SEQ ID NO: 1755213 - RNA, 21 nt, Human herpesvirus 1
uagccagcagacgcugcuccg

SEQ ID NO: 1755214 - RNA, 16 nt, Human herpesvirus 1
ccccuucccucccccu

SEQ ID NO: 1755215 - RNA, 18 nt, Human herpesvirus 1
ccgcaacgcgcuggggcu

SEQ ID NO: 1755216 - RNA, 19 nt, Human herpesvirus 1
gccgccaccguggccggcc

SEQ ID NO: 1755217 - RNA, 17 nt, Human herpesvirus 1
caagccccuagccccgc

SEQ ID NO: 1755218 - RNA, 14 nt, Human herpesvirus 1
cagaccgaagaggu

SEQ ID NO: 1755219 - RNA, 22 nt, Human herpesvirus 1
cacccuccgcuggggcccccag

SEQ ID NO: 1755220 - RNA, 15 nt, Human herpesvirus 1
gucccgcccaccgga

SEQ ID NO: 1755221 - RNA, 14 nt, Human herpesvirus 1
caacgccuccccug

SEQ ID NO: 1755222 - RNA, 19 nt, Human herpesvirus 1
ccgcgcuaugacggcaaua

SEQ ID NO: 1755223 - RNA, 14 nt, Human herpesvirus 1
cucgcugcccuucu

SEQ ID NO: 1755224 - RNA, 13 nt, Human herpesvirus 1
ccacaaccucccg

SEQ ID NO: 1755225 - RNA, 19 nt, Human herpesvirus 1
ugguaucaaacucauuugu

SEQ ID NO: 1755226 - RNA, 17 nt, Human herpesvirus 1
gugguccuguggagccu

SEQ ID NO: 1755227 - RNA, 15 nt, Human herpesvirus 1
cucgucgccuggcug

SEQ ID NO: 1755228 - RNA, 14 nt, Human herpesvirus 1
cgcgacccuccggg

SEQ ID NO: 1755229 - RNA, 23 nt, Human herpesvirus 1
gccccguacaaguucaaggccac

SEQ ID NO: 1755230 - RNA, 20 nt, Human herpesvirus 1
ccccaguccccgggcccagc

SEQ ID NO: 1755231 - RNA, 16 nt, Human herpesvirus 1
ucgugucuuucggugg

SEQ ID NO: 1755232 - RNA, 14 nt, Human herpesvirus 1
cgagcucccagaga

SEQ ID NO: 1755233 - RNA, 19 nt, Human herpesvirus 1
cgcaccaagccgcucuccg

SEQ ID NO: 1755234 - RNA, 18 nt, Human herpesvirus 1
caccuccccagcggccag

SEQ ID NO: 1755235 - RNA, 20 nt, Human herpesvirus 1
gcgaccgccggcgaggugga

SEQ ID NO: 1755236 - RNA, 17 nt, Human herpesvirus 1
gaggcgcgcgcaccucc

SEQ ID NO: 1755237 - RNA, 13 nt, Human herpesvirus 1
ccugcccccugga

SEQ ID NO: 1755238 - RNA, 13 nt, Human herpesvirus 1
cccggucucccag

SEQ ID NO: 1755239 - RNA, 14 nt, Human herpesvirus 1
ggauggggagagcc

SEQ ID NO: 1755240 - RNA, 13 nt, Human herpesvirus 1
aucuccugggggc

SEQ ID NO: 1755241 - RNA, 11 nt, Human herpesvirus 1
acaaacacaaa

SEQ ID NO: 1755242 - RNA, 22 nt, Human herpesvirus 1
uuuguacccuuaauaaauuuua

SEQ ID NO: 1755243 - RNA, 19 nt, Human herpesvirus 1
gucccauccgaacgcagcc

SEQ ID NO: 1755244 - RNA, 24 nt, Human herpesvirus 1
auccgggaagacgaccagccgucc

SEQ ID NO: 1755245 - RNA, 17 nt, Human herpesvirus 1
ggugguccguguggagg

SEQ ID NO: 1755246 - RNA, 21 nt, Human herpesvirus 1
guccuuugggcgggaggaagc

SEQ ID NO: 1755247 - RNA, 17 nt, Human herpesvirus 1
cugccucuccccccagg

SEQ ID NO: 1755248 - RNA, 14 nt, Human herpesvirus 1
cugggccaccugac

SEQ ID NO: 1755249 - RNA, 12 nt, Human herpesvirus 1
gcgggggauggg

SEQ ID NO: 1755250 - RNA, 19 nt, Human herpesvirus 1
ccagggagaaaccccagca

SEQ ID NO: 1755251 - RNA, 13 nt, Human herpesvirus 1
auguccccaaaau

SEQ ID NO: 1755252 - RNA, 23 nt, Human herpesvirus 1
cgccauguuugcgggccugggcg

SEQ ID NO: 1755253 - RNA, 17 nt, Human herpesvirus 1
gucggggcgucccugga

SEQ ID NO: 1755254 - RNA, 19 nt, Human herpesvirus 1
ccacggcgccgaccacccg

SEQ ID NO: 1755255 - RNA, 15 nt, Human herpesvirus 1
gcugcagagcaaccc

SEQ ID NO: 1755256 - RNA, 15 nt, Human herpesvirus 1
ggugacgguggacag

SEQ ID NO: 1755257 - RNA, 16 nt, Human herpesvirus 1
ucccggguuaauguaa

SEQ ID NO: 1755258 - RNA, 21 nt, Human herpesvirus 1
gucgacgcagacgcacccgcu

SEQ ID NO: 1755259 - RNA, 17 nt, Human herpesvirus 1
gcccaccgcugggcgcu

SEQ ID NO: 1755260 - RNA, 20 nt, Human herpesvirus 1
gucuccccgggagccccgga

SEQ ID NO: 1755261 - RNA, 16 nt, Human herpesvirus 1
gaccccgcccaugggu

SEQ ID NO: 1755262 - RNA, 18 nt, Human herpesvirus 1
ugcucgggcaggugcaga

SEQ ID NO: 1755263 - RNA, 14 nt, Human herpesvirus 1
ugcgguuggggagg

SEQ ID NO: 1755264 - RNA, 15 nt, Human herpesvirus 1
agcgcggccgugggc

SEQ ID NO: 1755265 - RNA, 14 nt, Human herpesvirus 1
gcaccaucccgggu

SEQ ID NO: 1755266 - RNA, 16 nt, Human herpesvirus 1
agacagccgaucucca

SEQ ID NO: 1755267 - RNA, 13 nt, Human herpesvirus 1
ccaggccuccacc

SEQ ID NO: 1755268 - RNA, 17 nt, Human herpesvirus 1
ucaccccgcaauuugca

SEQ ID NO: 1755269 - RNA, 17 nt, Human herpesvirus 1
uacagcauggcgccaca

SEQ ID NO: 1755270 - RNA, 22 nt, Human herpesvirus 1
gggcccacgaucaccgcgggag

SEQ ID NO: 1755271 - RNA, 14 nt, Human herpesvirus 1
gccgcgccccgccg

SEQ ID NO: 1755272 - RNA, 15 nt, Human herpesvirus 1
cucagggccuccgac

SEQ ID NO: 1755273 - RNA, 12 nt, Human herpesvirus 1
gacccuccggga

SEQ ID NO: 1755274 - RNA, 20 nt, Human herpesvirus 1
accgcuuuauaggccgggac

SEQ ID NO: 1755275 - RNA, 11 nt, Human herpesvirus 1
ggaacccgcgc

SEQ ID NO: 1755276 - RNA, 17 nt, Human herpesvirus 1
cagcccccccaagcgcc

SEQ ID NO: 1755277 - RNA, 20 nt, Human herpesvirus 1
cacgcucgcggagcuguacg

SEQ ID NO: 1755278 - RNA, 22 nt, Human herpesvirus 1
ccagcggcacgaccggcuccau

SEQ ID NO: 1755279 - RNA, 22 nt, Human herpesvirus 1
acaacucccccgcgcgccccga

SEQ ID NO: 1755280 - RNA, 21 nt, Human herpesvirus 1
gcuccggggaucugguccgcc

SEQ ID NO: 1755281 - RNA, 12 nt, Human herpesvirus 1
cccagcaccgac

SEQ ID NO: 1755282 - RNA, 18 nt, Human herpesvirus 1
ucuggguuuuccccuccc

SEQ ID NO: 1755283 - RNA, 19 nt, Human herpesvirus 1
cccggcccugcugcugccg

SEQ ID NO: 1755284 - RNA, 14 nt, Human herpesvirus 1
cgggcggccacccc

SEQ ID NO: 1755285 - RNA, 15 nt, Human herpesvirus 1
accgacauggagcug

SEQ ID NO: 1755286 - RNA, 13 nt, Human herpesvirus 1
gguugcggcccgc

SEQ ID NO: 1755287 - RNA, 12 nt, Human herpesvirus 1
agaggugcugcc

SEQ ID NO: 1755288 - RNA, 15 nt, Human herpesvirus 1
gccaucgagccaacg

SEQ ID NO: 1755289 - RNA, 17 nt, Human herpesvirus 1
gccugccaaccugaucc

SEQ ID NO: 1755290 - RNA, 14 nt, Human herpesvirus 1
ccuuuccgcccgcc

SEQ ID NO: 1755291 - RNA, 23 nt, Human herpesvirus 1
cgugaacgcucuacugcagaugc

SEQ ID NO: 1755292 - RNA, 19 nt, Human herpesvirus 1
ggccauggacagcgaccug

SEQ ID NO: 1755293 - RNA, 17 nt, Human herpesvirus 1
cccuccgcaucccagga

SEQ ID NO: 1755294 - RNA, 16 nt, Human herpesvirus 1
ccacgggggggugggg

SEQ ID NO: 1755295 - RNA, 16 nt, Human herpesvirus 1
cuauaagacucucccc

SEQ ID NO: 1755296 - RNA, 11 nt, Human herpesvirus 1
cacgcgccgcc

SEQ ID NO: 1755297 - RNA, 13 nt, Human herpesvirus 1
gguagcgggggac

SEQ ID NO: 1755298 - RNA, 23 nt, Human herpesvirus 1
gagggcaacgcgggacuaugccg

SEQ ID NO: 1755299 - RNA, 14 nt, Human herpesvirus 1
gcgacccuccggga

SEQ ID NO: 1755300 - RNA, 16 nt, Human herpesvirus 1
cggcacuuucugacgc

SEQ ID NO: 1755301 - RNA, 21 nt, Human herpesvirus 1
aauacagcauggcgccacacc

SEQ ID NO: 1755302 - RNA, 13 nt, Human herpesvirus 1
gccgcgggccacg

SEQ ID NO: 1755303 - RNA, 23 nt, Human herpesvirus 1
ccgucguaacggaguccuguccc

SEQ ID NO: 1755304 - RNA, 12 nt, Human herpesvirus 1
agccccccagcc

SEQ ID NO: 1755305 - RNA, 20 nt, Human herpesvirus 1
gcggccccugauggagccug

SEQ ID NO: 1755306 - RNA, 19 nt, Human herpesvirus 1
cgccgagucuucggggccc

SEQ ID NO: 1755307 - RNA, 14 nt, Human herpesvirus 1
gacgccagcuuucc

SEQ ID NO: 1755308 - RNA, 22 nt, Human herpesvirus 1
gccacccgacaacagcccccgg

SEQ ID NO: 1755309 - RNA, 14 nt, Human herpesvirus 1
uacaaguucaaggc

SEQ ID NO: 1755310 - RNA, 20 nt, Human herpesvirus 1
gacgcucuggacgucuggga

SEQ ID NO: 1755311 - RNA, 13 nt, Human herpesvirus 1
cccuacaaccuga

SEQ ID NO: 1755312 - RNA, 16 nt, Human herpesvirus 1
gggaccagguccccca

SEQ ID NO: 1755313 - RNA, 19 nt, Human herpesvirus 1
ggcguagagcuguggcacu

SEQ ID NO: 1755314 - RNA, 23 nt, Human herpesvirus 1
gcaaaacgccucccccugagccg

SEQ ID NO: 1755315 - RNA, 21 nt, Human herpesvirus 1
ccagaguaccgcgagcuccca

SEQ ID NO: 1755316 - RNA, 23 nt, Human herpesvirus 1
uggcgcccccccaacgggggacc

SEQ ID NO: 1755317 - RNA, 16 nt, Human herpesvirus 1
gcgcgaauugacccua

SEQ ID NO: 1755318 - RNA, 15 nt, Human herpesvirus 1
auccuggagcaccga

SEQ ID NO: 1755319 - RNA, 17 nt, Human herpesvirus 1
gccaaauuuauguguua

SEQ ID NO: 1755320 - RNA, 14 nt, Human herpesvirus 1
uaucccacccugga

SEQ ID NO: 1755321 - RNA, 16 nt, Human herpesvirus 1
cgucugggccaccgac

SEQ ID NO: 1755322 - RNA, 15 nt, Human herpesvirus 1
cggggcccggcccau

SEQ ID NO: 1755323 - RNA, 11 nt, Human herpesvirus 1
ccacgccaggg

SEQ ID NO: 1755324 - RNA, 23 nt, Human herpesvirus 1
uuguauguccccaaaauaaaaga

SEQ ID NO: 1755325 - RNA, 14 nt, Human herpesvirus 1
aguguacccuggcg

SEQ ID NO: 1755326 - RNA, 17 nt, Human herpesvirus 1
cgcagccccgcuggaac

SEQ ID NO: 1755327 - RNA, 16 nt, Human herpesvirus 1
cgcggaccaccgggcc

SEQ ID NO: 1755328 - RNA, 15 nt, Human herpesvirus 1
ccuguggcccuggcg

SEQ ID NO: 1755329 - RNA, 11 nt, Human herpesvirus 1
accaccagcug

SEQ ID NO: 1755330 - RNA, 22 nt, Human herpesvirus 1
gaccggcaccaccgacucuccc

SEQ ID NO: 1755331 - RNA, 13 nt, Human herpesvirus 1
cacggggacggcg

SEQ ID NO: 1755332 - RNA, 18 nt, Human herpesvirus 1
gcguuugcacaacacaaa

SEQ ID NO: 1755333 - RNA, 23 nt, Human herpesvirus 1
ucccccaccgcccacagagggcc

SEQ ID NO: 1755334 - RNA, 12 nt, Human herpesvirus 1
acacaaggccaa

SEQ ID NO: 1755335 - RNA, 20 nt, Human herpesvirus 1
accugcgcggguugcugcgc

SEQ ID NO: 1755336 - RNA, 19 nt, Human herpesvirus 1
ucacagggcgggccgccuc

SEQ ID NO: 1755337 - RNA, 22 nt, Human herpesvirus 1
uaacaaccacccgcacccccag

SEQ ID NO: 1755338 - RNA, 15 nt, Human herpesvirus 1
gugguucgggugugc

SEQ ID NO: 1755339 - RNA, 13 nt, Human herpesvirus 1
gggacuggccaau

SEQ ID NO: 1755340 - RNA, 19 nt, Human herpesvirus 1
ccuucuugucgucucucuu

SEQ ID NO: 1755341 - RNA, 16 nt, Human herpesvirus 1
cacuguggcucuccuc

SEQ ID NO: 1755342 - RNA, 23 nt, Human herpesvirus 1
gggaggggggggucgggcgcugg

SEQ ID NO: 1755343 - RNA, 15 nt, Human herpesvirus 1
accuuggucuggccc

SEQ ID NO: 1755344 - RNA, 19 nt, Human herpesvirus 1
uccagccccccagccuccc

SEQ ID NO: 1755345 - RNA, 19 nt, Human herpesvirus 1
ucgugggccucugggucug

SEQ ID NO: 1755346 - RNA, 19 nt, Human herpesvirus 1
gccaacgccgcgacccgca

SEQ ID NO: 1755347 - RNA, 18 nt, Human herpesvirus 1
ugagcgcccuccugacca

SEQ ID NO: 1755348 - RNA, 15 nt, Human herpesvirus 1
cccucgaccaccauc

SEQ ID NO: 1755349 - RNA, 14 nt, Human herpesvirus 1
gauccucggccagc

SEQ ID NO: 1755350 - RNA, 18 nt, Human herpesvirus 1
cgcgugcugcgccuuggg

SEQ ID NO: 1755351 - RNA, 20 nt, Human herpesvirus 1
cccccgucgaagcugauguc

SEQ ID NO: 1755352 - RNA, 14 nt, Human herpesvirus 1
ucucuucccucagg

SEQ ID NO: 1755353 - RNA, 22 nt, Human herpesvirus 1
gguuccggaggcgccgcgcgga

SEQ ID NO: 1755354 - RNA, 14 nt, Human herpesvirus 1
ccuucccgcuuccg

SEQ ID NO: 1755355 - RNA, 16 nt, Human herpesvirus 1
ggcgcuugcgcaccug

SEQ ID NO: 1755356 - RNA, 21 nt, Human herpesvirus 1
ggccgcccaacucucgcacca

SEQ ID NO: 1755357 - RNA, 13 nt, Human herpesvirus 1
caacgaccccgcc

SEQ ID NO: 1755358 - RNA, 16 nt, Human herpesvirus 1
cgaggagggguuuggg

SEQ ID NO: 1755359 - RNA, 21 nt, Human herpesvirus 1
ccuguguccgcuucucuuugg

SEQ ID NO: 1755360 - RNA, 17 nt, Human herpesvirus 1
gccuggucagaggccca

SEQ ID NO: 1755361 - RNA, 14 nt, Human herpesvirus 1
ucgggccucccgga

SEQ ID NO: 1755362 - RNA, 21 nt, Human herpesvirus 1
gcggccacgcaaaaccaggcc

SEQ ID NO: 1755363 - RNA, 15 nt, Human herpesvirus 1
ggggcgcuggccgug

SEQ ID NO: 1755364 - RNA, 16 nt, Human herpesvirus 1
gcuccgccuggccugc

SEQ ID NO: 1755365 - RNA, 20 nt, Human herpesvirus 1
ccuggccccaguccccaaga

SEQ ID NO: 1755366 - RNA, 20 nt, Human herpesvirus 1
guggagcugcccggcggcca

SEQ ID NO: 1755367 - RNA, 18 nt, Human herpesvirus 1
cgucagccugccucuccc

SEQ ID NO: 1755368 - RNA, 21 nt, Human herpesvirus 1
gaggacaccccucguggcccc

SEQ ID NO: 1755369 - RNA, 14 nt, Human herpesvirus 1
gccucaccugacca

SEQ ID NO: 1755370 - RNA, 16 nt, Human herpesvirus 1
cggccccugauggagc

SEQ ID NO: 1755371 - RNA, 13 nt, Human herpesvirus 1
acccuaugguaca

SEQ ID NO: 1755372 - RNA, 13 nt, Human herpesvirus 1
gaggagcccgccc

SEQ ID NO: 1755373 - RNA, 23 nt, Human herpesvirus 1
cucaccggguacggcgucugggc

SEQ ID NO: 1755374 - RNA, 20 nt, Human herpesvirus 1
cuuaauaaauuuuacaaaca

SEQ ID NO: 1755375 - RNA, 23 nt, Human herpesvirus 1
ggcggcgacgugcccccuccucg

SEQ ID NO: 1755376 - RNA, 17 nt, Human herpesvirus 1
cccggaaccugcucacg

SEQ ID NO: 1755377 - RNA, 21 nt, Human herpesvirus 1
gacgccuuaccaucccccggc

SEQ ID NO: 1755378 - RNA, 21 nt, Human herpesvirus 1
cccggcaaccccgaaggcgga

SEQ ID NO: 1755379 - RNA, 21 nt, Human herpesvirus 1
ccagacccaacccccggcccc

SEQ ID NO: 1755380 - RNA, 13 nt, Human herpesvirus 1
agauuuuucugua

SEQ ID NO: 1755381 - RNA, 22 nt, Human herpesvirus 1
gcggcucaacgagcuccuggcc

SEQ ID NO: 1755382 - RNA, 20 nt, Human herpesvirus 1
ccuuccuaacccagaccccg

SEQ ID NO: 1755383 - RNA, 22 nt, Human herpesvirus 1
uggcccuuccuaacccagaccc

SEQ ID NO: 1755384 - RNA, 18 nt, Human herpesvirus 1
aggcaguuaacugucugg

SEQ ID NO: 1755385 - RNA, 14 nt, Human herpesvirus 1
cgucaccaugcagc

SEQ ID NO: 1755386 - RNA, 14 nt, Human herpesvirus 1
caaggacagcggcc

SEQ ID NO: 1755387 - RNA, 17 nt, Human herpesvirus 1
uacacagccacccaccc

SEQ ID NO: 1755388 - RNA, 16 nt, Human herpesvirus 1
ccggaucgcgcucguc

SEQ ID NO: 1755389 - RNA, 18 nt, Human herpesvirus 1
aggcugucgacgcccccu

SEQ ID NO: 1755390 - RNA, 13 nt, Human herpesvirus 1
uccccuuccucgc

SEQ ID NO: 1755391 - RNA, 17 nt, Human herpesvirus 1
ccggggggucggcaggc

SEQ ID NO: 1755392 - RNA, 22 nt, Human herpesvirus 1
aauaaagagccguaacccaacc

SEQ ID NO: 1755393 - RNA, 17 nt, Human herpesvirus 1
auacggugcgggcggcc

SEQ ID NO: 1755394 - RNA, 18 nt, Human herpesvirus 1
acggccgaagccacgccc

SEQ ID NO: 1755395 - RNA, 21 nt, Human herpesvirus 1
gcccugccacuccggcgccgc

SEQ ID NO: 1755396 - RNA, 18 nt, Human herpesvirus 1
cugccucuccccccaggc

SEQ ID NO: 1755397 - RNA, 22 nt, Human herpesvirus 1
aaccgcaccccccucguccccc

SEQ ID NO: 1755398 - RNA, 21 nt, Human herpesvirus 1
ccacgccccuuucccccuguu

SEQ ID NO: 1755399 - RNA, 17 nt, Human herpesvirus 1
gcgccuugcggcagcgc

SEQ ID NO: 1755400 - RNA, 15 nt, Human herpesvirus 1
guccuguggagccug

SEQ ID NO: 1755401 - RNA, 16 nt, Human herpesvirus 1
ugccaucgcgcccccu

SEQ ID NO: 1755402 - RNA, 23 nt, Human herpesvirus 1
ggaagcagggcccgccaucuggg

SEQ ID NO: 1755403 - RNA, 21 nt, Human herpesvirus 1
gacccguuccagccccccagc

SEQ ID NO: 1755404 - RNA, 14 nt, Human herpesvirus 1
uccucccgcucggc

SEQ ID NO: 1755405 - RNA, 15 nt, Human herpesvirus 1
gcgagcucccugcgg

SEQ ID NO: 1755406 - RNA, 18 nt, Human herpesvirus 1
gcguccaucauagcccug

SEQ ID NO: 1755407 - RNA, 21 nt, Human herpesvirus 1
cccgggacaccccccaugcgg

SEQ ID NO: 1755408 - RNA, 20 nt, Human herpesvirus 1
caggcugucgacgcccccuc

SEQ ID NO: 1755409 - RNA, 22 nt, Human herpesvirus 1
cgcaggugugguucggccaccg

SEQ ID NO: 1755410 - RNA, 21 nt, Human herpesvirus 1
ccagccuguuuguccugggga

SEQ ID NO: 1755411 - RNA, 14 nt, Human herpesvirus 1
cgggauccacaccg

SEQ ID NO: 1755412 - RNA, 18 nt, Human herpesvirus 1
ccucuucuccccuucccu

SEQ ID NO: 1755413 - RNA, 16 nt, Human herpesvirus 1
cggccaacgaggacca

SEQ ID NO: 1755414 - RNA, 14 nt, Human herpesvirus 1
cagcgccggguggc

SEQ ID NO: 1755415 - RNA, 12 nt, Human herpesvirus 1
agcgcugcugcg

SEQ ID NO: 1755416 - RNA, 13 nt, Human herpesvirus 1
caugcaccccaga

SEQ ID NO: 1755417 - RNA, 18 nt, Human herpesvirus 1
ccucgcccgccaucgagc

SEQ ID NO: 1755418 - RNA, 19 nt, Human herpesvirus 1
guaucggggguucccacca

SEQ ID NO: 1755419 - RNA, 17 nt, Human herpesvirus 1
ucucccagggagccccg

SEQ ID NO: 1755420 - RNA, 16 nt, Human herpesvirus 1
cucauuuuacaauaaa

SEQ ID NO: 1755421 - RNA, 17 nt, Human herpesvirus 1
ccugcgccccgccgccc

SEQ ID NO: 1755422 - RNA, 21 nt, Human herpesvirus 1
gcgccugccccgccacccagu

SEQ ID NO: 1755423 - RNA, 11 nt, Human herpesvirus 1
gccuggaggac

SEQ ID NO: 1755424 - RNA, 14 nt, Human herpesvirus 1
ucgcacccacagcu

SEQ ID NO: 1755425 - RNA, 16 nt, Human herpesvirus 1
cgucgccgcgggccac

SEQ ID NO: 1755426 - RNA, 22 nt, Human herpesvirus 1
ucucccaccgccaucagccuua

SEQ ID NO: 1755427 - RNA, 22 nt, Human herpesvirus 1
cuggucgucgggcgccaaagcc

SEQ ID NO: 1755428 - RNA, 20 nt, Human herpesvirus 1
ggcggcgacuuugacgaggc

SEQ ID NO: 1755429 - RNA, 17 nt, Human herpesvirus 1
uccgagcacccccccca

SEQ ID NO: 1755430 - RNA, 14 nt, Human herpesvirus 1
cgggcacgccaagc

SEQ ID NO: 1755431 - RNA, 23 nt, Human herpesvirus 1
augccaaguauuggacuggagga

SEQ ID NO: 1755432 - RNA, 13 nt, Human herpesvirus 1
ccgcccacuuccc

SEQ ID NO: 1755433 - RNA, 16 nt, Human herpesvirus 1
aggaugccagccaggg

SEQ ID NO: 1755434 - RNA, 21 nt, Human herpesvirus 1
agucggcaagauccucgggcu

SEQ ID NO: 1755435 - RNA, 15 nt, Human herpesvirus 1
gcaccaucccggguu

SEQ ID NO: 1755436 - RNA, 15 nt, Human herpesvirus 1
cacucacagccccgc

SEQ ID NO: 1755437 - RNA, 20 nt, Human herpesvirus 1
guuggggggugggggaaccu

SEQ ID NO: 1755438 - RNA, 18 nt, Human herpesvirus 1
cucgggaacggacggggu

SEQ ID NO: 1755439 - RNA, 13 nt, Human herpesvirus 1
ccacaaaaugcaa

SEQ ID NO: 1755440 - RNA, 15 nt, Human herpesvirus 1
ucgccuaccuucgca

SEQ ID NO: 1755441 - RNA, 22 nt, Human herpesvirus 1
guccccgaacaaacgacccacc

SEQ ID NO: 1755442 - RNA, 14 nt, Human herpesvirus 1
acgucgagaaggac

SEQ ID NO: 1755443 - RNA, 21 nt, Human herpesvirus 1
uacacgagcacccugcugccc

SEQ ID NO: 1755444 - RNA, 11 nt, Human herpesvirus 1
ugccugugugu

SEQ ID NO: 1755445 - RNA, 20 nt, Human herpesvirus 1
gccucgaugacgucccggcu

SEQ ID NO: 1755446 - RNA, 16 nt, Human herpesvirus 1
accccaccccugugcu

SEQ ID NO: 1755447 - RNA, 21 nt, Human herpesvirus 1
cucgcgaguacuuccacgccc

SEQ ID NO: 1755448 - RNA, 16 nt, Human herpesvirus 1
cccacuacaccagcca

SEQ ID NO: 1755449 - RNA, 22 nt, Human herpesvirus 1
ugcggccggcgggacucugggc

SEQ ID NO: 1755450 - RNA, 16 nt, Human herpesvirus 1
ccgguaugccgcggcc

SEQ ID NO: 1755451 - RNA, 16 nt, Human herpesvirus 1
ggagacauggcccccg

SEQ ID NO: 1755452 - RNA, 16 nt, Human herpesvirus 1
gugucagguggcccuu

SEQ ID NO: 1755453 - RNA, 20 nt, Human herpesvirus 1
cgggcgaaaaaaggcggugc

SEQ ID NO: 1755454 - RNA, 22 nt, Human herpesvirus 1
ggccacgcaaaaccaggccgac

SEQ ID NO: 1755455 - RNA, 18 nt, Human herpesvirus 1
cuggccgcucgguggcuc

SEQ ID NO: 1755456 - RNA, 12 nt, Human herpesvirus 1
ucugcgggccgc

SEQ ID NO: 1755457 - RNA, 14 nt, Human herpesvirus 1
ccgaagcccagcgu

SEQ ID NO: 1755458 - RNA, 12 nt, Human herpesvirus 1
gccaugcuggcg

SEQ ID NO: 1755459 - RNA, 14 nt, Human herpesvirus 1
uccgaaagccacca

SEQ ID NO: 1755460 - RNA, 19 nt, Human herpesvirus 1
uccccgcgccguuggcccc

SEQ ID NO: 1755461 - RNA, 22 nt, Human herpesvirus 1
acugccucccccgcccuggaca

SEQ ID NO: 1755462 - RNA, 17 nt, Human herpesvirus 1
aacugucuggagacccu

SEQ ID NO: 1755463 - RNA, 16 nt, Human herpesvirus 1
cucuuggaggaccccg

SEQ ID NO: 1755464 - RNA, 22 nt, Human herpesvirus 1
ucccggcccguaacgucgcggg

SEQ ID NO: 1755465 - RNA, 19 nt, Human herpesvirus 1
cuaacagucuuccgcugac

SEQ ID NO: 1755466 - RNA, 21 nt, Human herpesvirus 1
gcagccuucucccggugccuu

SEQ ID NO: 1755467 - RNA, 15 nt, Human herpesvirus 1
ccaggaucacaccgg

SEQ ID NO: 1755468 - RNA, 16 nt, Human herpesvirus 1
caagauggccgacccc

SEQ ID NO: 1755469 - RNA, 20 nt, Human herpesvirus 1
uccccaagcaucgaccacgc

SEQ ID NO: 1755470 - RNA, 16 nt, Human herpesvirus 1
gcgggacaucaaggcg

SEQ ID NO: 1755471 - RNA, 21 nt, Human herpesvirus 1
caucgaguauguacugcggcu

SEQ ID NO: 1755472 - RNA, 20 nt, Human herpesvirus 1
ggcggccaaguacgccgcca

SEQ ID NO: 1755473 - RNA, 21 nt, Human herpesvirus 1
ccgcaacgcgcuggggcugcc

SEQ ID NO: 1755474 - RNA, 13 nt, Human herpesvirus 1
gcgucugggccac

SEQ ID NO: 1755475 - RNA, 15 nt, Human herpesvirus 1
uggggagccucgauc

SEQ ID NO: 1755476 - RNA, 21 nt, Human herpesvirus 1
uggcacaaaaagaccccgauc

SEQ ID NO: 1755477 - RNA, 18 nt, Human herpesvirus 1
cgcccgauuuacagcccc

SEQ ID NO: 1755478 - RNA, 21 nt, Human herpesvirus 1
auauaguuugguccccccucu

SEQ ID NO: 1755479 - RNA, 15 nt, Human herpesvirus 1
ggggugggggugggc

SEQ ID NO: 1755480 - RNA, 20 nt, Human herpesvirus 1
agcguccgggcgcuuggcau

SEQ ID NO: 1755481 - RNA, 16 nt, Human herpesvirus 1
gcauccgagcaccccc

SEQ ID NO: 1755482 - RNA, 14 nt, Human herpesvirus 1
agacacgggcacca

SEQ ID NO: 1755483 - RNA, 13 nt, Human herpesvirus 1
gcggugguaucua

SEQ ID NO: 1755484 - RNA, 15 nt, Human herpesvirus 1
cugcuccgccuggcc

SEQ ID NO: 1755485 - RNA, 11 nt, Human herpesvirus 1
gaccaggcgcg

SEQ ID NO: 1755486 - RNA, 23 nt, Human herpesvirus 1
cucccaacccccuaagacccacc

SEQ ID NO: 1755487 - RNA, 16 nt, Human herpesvirus 1
ggcggcaggcgccagc

SEQ ID NO: 1755488 - RNA, 17 nt, Human herpesvirus 1
ccucucacacagcaucc

SEQ ID NO: 1755489 - RNA, 18 nt, Human herpesvirus 1
aggggaaaagugaaagac

SEQ ID NO: 1755490 - RNA, 21 nt, Human herpesvirus 1
ugaggacgucgagaaggacaa

SEQ ID NO: 1755491 - RNA, 16 nt, Human herpesvirus 1
gacgacacgcucgccg

SEQ ID NO: 1755492 - RNA, 17 nt, Human herpesvirus 1
guccacgguaggcccag

SEQ ID NO: 1755493 - RNA, 18 nt, Human herpesvirus 1
gacggacgugcgccugga

SEQ ID NO: 1755494 - RNA, 15 nt, Human herpesvirus 1
gaacaacaugggccu

SEQ ID NO: 1755495 - RNA, 17 nt, Human herpesvirus 1
guaggcuggucagcacg

SEQ ID NO: 1755496 - RNA, 12 nt, Human herpesvirus 1
cgucgggaggcc

SEQ ID NO: 1755497 - RNA, 13 nt, Human herpesvirus 1
ugggccagccgca

SEQ ID NO: 1755498 - RNA, 15 nt, Human herpesvirus 1
ccucgaccaccaccu

SEQ ID NO: 1755499 - RNA, 10 nt, Human herpesvirus 1
gaccuggggu

SEQ ID NO: 1755500 - RNA, 16 nt, Human herpesvirus 1
caggaucacaccgguc

SEQ ID NO: 1755501 - RNA, 17 nt, Human herpesvirus 1
gcguggaccugggggac

SEQ ID NO: 1755502 - RNA, 18 nt, Human herpesvirus 1
gagccccggaccccacgc

SEQ ID NO: 1755503 - RNA, 20 nt, Human herpesvirus 1
uccacgccgacgccaacgcc

SEQ ID NO: 1755504 - RNA, 20 nt, Human herpesvirus 1
cggcggcgaggccggcgccg

SEQ ID NO: 1755505 - RNA, 23 nt, Human herpesvirus 1
cccggagggcugccagaccucaa

SEQ ID NO: 1755506 - RNA, 16 nt, Human herpesvirus 1
ccguguucgagggcca

SEQ ID NO: 1755507 - RNA, 20 nt, Human herpesvirus 1
aaacucauuaaugggcggcc

SEQ ID NO: 1755508 - RNA, 17 nt, Human herpesvirus 1
ccucacccacgccggca

SEQ ID NO: 1755509 - RNA, 18 nt, Human herpesvirus 1
gugugggguccucaugga

SEQ ID NO: 1755510 - RNA, 21 nt, Human herpesvirus 1
gaaccuagggaacccagagua

SEQ ID NO: 1755511 - RNA, 19 nt, Human herpesvirus 1
aggauucggcccucuugga

SEQ ID NO: 1755512 - RNA, 17 nt, Human herpesvirus 1
cgagcugacccugugga

SEQ ID NO: 1755513 - RNA, 13 nt, Human herpesvirus 1
uggcgccccggcc

SEQ ID NO: 1755514 - RNA, 14 nt, Human herpesvirus 1
ccccgcucccucga

SEQ ID NO: 1755515 - RNA, 14 nt, Human herpesvirus 1
ccgcguacgaggac

SEQ ID NO: 1755516 - RNA, 13 nt, Human herpesvirus 1
guucggggccgcc

SEQ ID NO: 1755517 - RNA, 14 nt, Human herpesvirus 1
acgccgcugacccc

SEQ ID NO: 1755518 - RNA, 14 nt, Human herpesvirus 1
uccggaggcgccgc

SEQ ID NO: 1755519 - RNA, 23 nt, Human herpesvirus 1
ggcggacccccggaggcgccugc

SEQ ID NO: 1755520 - RNA, 22 nt, Human herpesvirus 1
cggcugguccacacccaguggc

SEQ ID NO: 1755521 - RNA, 16 nt, Human herpesvirus 1
cauggauaacaaccac

SEQ ID NO: 1755522 - RNA, 18 nt, Human herpesvirus 1
gccccuaaccaggccucc

SEQ ID NO: 1755523 - RNA, 12 nt, Human herpesvirus 1
aaccccaccccu

SEQ ID NO: 1755524 - RNA, 18 nt, Human herpesvirus 1
ccgcaacuucccacccgg

SEQ ID NO: 1755525 - RNA, 17 nt, Human herpesvirus 1
acgagcccccgccccuc

SEQ ID NO: 1755526 - RNA, 17 nt, Human herpesvirus 1
cggugcgucugggcccg

SEQ ID NO: 1755527 - RNA, 19 nt, Human herpesvirus 1
ccgcccggggccagcgcca

SEQ ID NO: 1755528 - RNA, 18 nt, Human herpesvirus 1
aggucuccgucaccgcga

SEQ ID NO: 1755529 - RNA, 23 nt, Human herpesvirus 1
gcgcaucuucggcgggugucugc

SEQ ID NO: 1755530 - RNA, 23 nt, Human herpesvirus 1
auggucggggcgucccuggauau

SEQ ID NO: 1755531 - RNA, 16 nt, Human herpesvirus 1
gccccgggacaccccc

SEQ ID NO: 1755532 - RNA, 16 nt, Human herpesvirus 1
cucuggacuggaccac

SEQ ID NO: 1755533 - RNA, 13 nt, Human herpesvirus 1
ccgacccuccggg

SEQ ID NO: 1755534 - RNA, 19 nt, Human herpesvirus 1
cccuguuggucggggagug

SEQ ID NO: 1755535 - RNA, 23 nt, Human herpesvirus 1
gggucagaacuacacggagggca

SEQ ID NO: 1755536 - RNA, 15 nt, Human herpesvirus 1
cgacaacgagccccc

SEQ ID NO: 1755537 - RNA, 15 nt, Human herpesvirus 1
cacgcaagaccaggc

SEQ ID NO: 1755538 - RNA, 19 nt, Human herpesvirus 1
gggccguuucccaccccca

SEQ ID NO: 1755539 - RNA, 17 nt, Human herpesvirus 1
cacgucgaccgcgcccu

SEQ ID NO: 1755540 - RNA, 19 nt, Human herpesvirus 1
ggucuccccgggagccccg

SEQ ID NO: 1755541 - RNA, 17 nt, Human herpesvirus 1
uugucgucucucuuccc

SEQ ID NO: 1755542 - RNA, 15 nt, Human herpesvirus 1
cggggggugggaccu

SEQ ID NO: 1755543 - RNA, 15 nt, Human herpesvirus 1
acgaugaccgccccc

SEQ ID NO: 1755544 - RNA, 14 nt, Human herpesvirus 1
cucucggugccccu

SEQ ID NO: 1755545 - RNA, 17 nt, Human herpesvirus 1
cgcugcgucggcauggu

SEQ ID NO: 1755546 - RNA, 19 nt, Human herpesvirus 1
ccacccuccgcuggggccc

SEQ ID NO: 1755547 - RNA, 16 nt, Human herpesvirus 1
gcccccgcuuccggau

SEQ ID NO: 1755548 - RNA, 22 nt, Human herpesvirus 1
caggacgccgcgacgccuuacc

SEQ ID NO: 1755549 - RNA, 20 nt, Human herpesvirus 1
aguccccgggcccagccuuc

SEQ ID NO: 1755550 - RNA, 21 nt, Human herpesvirus 1
agacacgggcaccacacacca

SEQ ID NO: 1755551 - RNA, 22 nt, Human herpesvirus 1
ccuucaucgaccucaacaucac

SEQ ID NO: 1755552 - RNA, 15 nt, Human herpesvirus 1
uggcuccuggccagg

SEQ ID NO: 1755553 - RNA, 23 nt, Human herpesvirus 1
ccaucgaguucgccaggcugcag

SEQ ID NO: 1755554 - RNA, 17 nt, Human herpesvirus 1
cgccccacacagcccuc

SEQ ID NO: 1755555 - RNA, 18 nt, Human herpesvirus 1
caccgccccccuguuccc

SEQ ID NO: 1755556 - RNA, 15 nt, Human herpesvirus 1
gcccggaggcgcccg

SEQ ID NO: 1755557 - RNA, 18 nt, Human herpesvirus 1
cggccaccucgcccaccc

SEQ ID NO: 1755558 - RNA, 17 nt, Human herpesvirus 1
ugagcgcccuccugacc

SEQ ID NO: 1755559 - RNA, 20 nt, Human herpesvirus 1
ggacgccauacacagccacc

SEQ ID NO: 1755560 - RNA, 17 nt, Human herpesvirus 1
cuccccgauggcccucc

SEQ ID NO: 1755561 - RNA, 16 nt, Human herpesvirus 1
cagacgagcgcgcuug

SEQ ID NO: 1755562 - RNA, 22 nt, Human herpesvirus 1
ucccgcagauuccauucggggu

SEQ ID NO: 1755563 - RNA, 21 nt, Human herpesvirus 1
ggaggggcuccuuagcgcggc

SEQ ID NO: 1755564 - RNA, 17 nt, Human herpesvirus 1
caggccgacugccagcu

SEQ ID NO: 1755565 - RNA, 13 nt, Human herpesvirus 1
cuguggcucuccu

SEQ ID NO: 1755566 - RNA, 16 nt, Human herpesvirus 1
cugaccccgcuccugu

SEQ ID NO: 1755567 - RNA, 14 nt, Human herpesvirus 1
cgccuugcggcagc

SEQ ID NO: 1755568 - RNA, 16 nt, Human herpesvirus 1
ccauaucgcuucccga

SEQ ID NO: 1755569 - RNA, 22 nt, Human herpesvirus 1
ccgccgcaaagccacccacgcc

SEQ ID NO: 1755570 - RNA, 13 nt, Human herpesvirus 1
ccauccgccggca

SEQ ID NO: 1755571 - RNA, 18 nt, Human herpesvirus 1
gcgacguccugggccacc

SEQ ID NO: 1755572 - RNA, 16 nt, Human herpesvirus 1
ugaccgacccuccggg

SEQ ID NO: 1755573 - RNA, 15 nt, Human herpesvirus 1
cucccucgaccacca

SEQ ID NO: 1755574 - RNA, 21 nt, Human herpesvirus 1
cagccaauccgugucggggag

SEQ ID NO: 1755575 - RNA, 19 nt, Human herpesvirus 1
gcgggguuauaggccacgc

SEQ ID NO: 1755576 - RNA, 22 nt, Human herpesvirus 1
ccugccccgccacccaguuucc

SEQ ID NO: 1755577 - RNA, 12 nt, Human herpesvirus 1
ccgcagucccug

SEQ ID NO: 1755578 - RNA, 16 nt, Human herpesvirus 1
gacagcaaccagaagc

SEQ ID NO: 1755579 - RNA, 18 nt, Human herpesvirus 1
ggccguuucuccgcccga

SEQ ID NO: 1755580 - RNA, 19 nt, Human herpesvirus 1
gugcgucgggccucccgga

SEQ ID NO: 1755581 - RNA, 12 nt, Human herpesvirus 1
cgcuuggagcca

SEQ ID NO: 1755582 - RNA, 13 nt, Human herpesvirus 1
ggagcaccacaua

SEQ ID NO: 1755583 - RNA, 23 nt, Human herpesvirus 1
cuggcguucgucgcccuccacca

SEQ ID NO: 1755584 - RNA, 16 nt, Human herpesvirus 1
cgggcaucucgcgccc

SEQ ID NO: 1755585 - RNA, 17 nt, Human herpesvirus 1
uccgggaccugaacccc

SEQ ID NO: 1755586 - RNA, 20 nt, Human herpesvirus 1
gcagugcauggcgcucaggg

SEQ ID NO: 1755587 - RNA, 16 nt, Human herpesvirus 1
cccugggcccuggccg

SEQ ID NO: 1755588 - RNA, 18 nt, Human herpesvirus 1
ccagacgacaucagcugu

SEQ ID NO: 1755589 - RNA, 14 nt, Human herpesvirus 1
ucagcgccaagguc

SEQ ID NO: 1755590 - RNA, 16 nt, Human herpesvirus 1
cgagcuaugggccucu

SEQ ID NO: 1755591 - RNA, 16 nt, Human herpesvirus 1
ucucccgaaccaggcc

SEQ ID NO: 1755592 - RNA, 23 nt, Human herpesvirus 1
cauacacgagcacccugcugccc

SEQ ID NO: 1755593 - RNA, 23 nt, Human herpesvirus 1
ccaggcggcguuaaccgcacccc

SEQ ID NO: 1755594 - RNA, 15 nt, Human herpesvirus 1
cguguuugcccauaa

SEQ ID NO: 1755595 - RNA, 22 nt, Human herpesvirus 1
cgaccaccauccccgcucccuc

SEQ ID NO: 1755596 - RNA, 18 nt, Human herpesvirus 1
cuccuggaacgaggccgc

SEQ ID NO: 1755597 - RNA, 21 nt, Human herpesvirus 1
gagccccucgcccguccucgc

SEQ ID NO: 1755598 - RNA, 14 nt, Human herpesvirus 1
cuggguucuccugg

SEQ ID NO: 1755599 - RNA, 22 nt, Human herpesvirus 1
acgggacacuuguccggagaac

SEQ ID NO: 1755600 - RNA, 14 nt, Human herpesvirus 1
cccggggcucagcc

SEQ ID NO: 1755601 - RNA, 16 nt, Human herpesvirus 1
ggcccggccaaccagc

SEQ ID NO: 1755602 - RNA, 18 nt, Human herpesvirus 1
ggggccuuggcggccgcc

SEQ ID NO: 1755603 - RNA, 13 nt, Human herpesvirus 1
ccccgggccaaua

SEQ ID NO: 1755604 - RNA, 22 nt, Human herpesvirus 1
aacagcucgcggaggagccagu

SEQ ID NO: 1755605 - RNA, 22 nt, Human herpesvirus 1
gcuccuacaacaagucucuggg

SEQ ID NO: 1755606 - RNA, 19 nt, Human herpesvirus 1
gcuaucuccugggggcacc

SEQ ID NO: 1755607 - RNA, 15 nt, Human herpesvirus 1
cgcgaccccauggcc

SEQ ID NO: 1755608 - RNA, 21 nt, Human herpesvirus 1
ucgaucguccaucaccacgcc

SEQ ID NO: 1755609 - RNA, 14 nt, Human herpesvirus 1
ccugggccccggga

SEQ ID NO: 1755610 - RNA, 12 nt, Human herpesvirus 1
ucgcgcuccucu

SEQ ID NO: 1755611 - RNA, 19 nt, Human herpesvirus 1
cgccggggaccgcagccug

SEQ ID NO: 1755612 - RNA, 11 nt, Human herpesvirus 1
gcccucucccc

SEQ ID NO: 1755613 - RNA, 19 nt, Human herpesvirus 1
aggagcucaagaaccccac

SEQ ID NO: 1755614 - RNA, 13 nt, Human herpesvirus 1
gccaccauccuca

SEQ ID NO: 1755615 - RNA, 19 nt, Human herpesvirus 1
uccggggggcuuccggccu

SEQ ID NO: 1755616 - RNA, 20 nt, Human herpesvirus 1
agcaaacgccccgcccacac

SEQ ID NO: 1755617 - RNA, 23 nt, Human herpesvirus 1
caucaaggcggagaacaccgaug

SEQ ID NO: 1755618 - RNA, 18 nt, Human herpesvirus 1
ggccaaccagcguccgcc

SEQ ID NO: 1755619 - RNA, 12 nt, Human herpesvirus 1
auaugccugugu

SEQ ID NO: 1755620 - RNA, 19 nt, Human herpesvirus 1
aguaugccccccuggcgag

SEQ ID NO: 1755621 - RNA, 23 nt, Human herpesvirus 1
acauggcccuggugucugccaug

SEQ ID NO: 1755622 - RNA, 23 nt, Human herpesvirus 1
ccacaugcggaaagcaagaacaa

SEQ ID NO: 1755623 - RNA, 21 nt, Human herpesvirus 1
gcccggguauaaauuccggaa

SEQ ID NO: 1755624 - RNA, 17 nt, Human herpesvirus 1
aagauggccgaccccaa

SEQ ID NO: 1755625 - RNA, 14 nt, Human herpesvirus 1
cuccggcgccgccc

SEQ ID NO: 1755626 - RNA, 19 nt, Human herpesvirus 1
accccggucucccagggag

SEQ ID NO: 1755627 - RNA, 20 nt, Human herpesvirus 1
gcuccugauguggcugcucc

SEQ ID NO: 1755628 - RNA, 17 nt, Human herpesvirus 1
ccauggagcgcacggaa

SEQ ID NO: 1755629 - RNA, 12 nt, Human herpesvirus 1
gggcggccccgg

SEQ ID NO: 1755630 - RNA, 13 nt, Human herpesvirus 1
augcggaaagcaa

SEQ ID NO: 1755631 - RNA, 16 nt, Human herpesvirus 1
cguucgcgcgccaucu

SEQ ID NO: 1755632 - RNA, 16 nt, Human herpesvirus 1
ugggcauccagggaga

SEQ ID NO: 1755633 - RNA, 21 nt, Human herpesvirus 1
cgggaggccgcaucgaacgca

SEQ ID NO: 1755634 - RNA, 23 nt, Human herpesvirus 1
uaucuccugggggcacccacgcc

SEQ ID NO: 1755635 - RNA, 19 nt, Human herpesvirus 1
cgggccgcccacuucccgg

SEQ ID NO: 1755636 - RNA, 22 nt, Human herpesvirus 1
acuggugccggucgugagagaa

SEQ ID NO: 1755637 - RNA, 13 nt, Human herpesvirus 1
cccguggacccca

SEQ ID NO: 1755638 - RNA, 18 nt, Human herpesvirus 1
uggcgcggugccugacgc

SEQ ID NO: 1755639 - RNA, 19 nt, Human herpesvirus 1
ccauggacagcgaccuggg

SEQ ID NO: 1755640 - RNA, 16 nt, Human herpesvirus 1
acucucccccaccgcc

SEQ ID NO: 1755641 - RNA, 14 nt, Human herpesvirus 1
ggaccagguccccc

SEQ ID NO: 1755642 - RNA, 18 nt, Human herpesvirus 1
ccgacgaacgcggacccc

SEQ ID NO: 1755643 - RNA, 15 nt, Human herpesvirus 1
ccagcuuuccgcuga

SEQ ID NO: 1755644 - RNA, 22 nt, Human herpesvirus 1
gcccagcgcagaggcggccaga

SEQ ID NO: 1755645 - RNA, 21 nt, Human herpesvirus 1
ggagcaaaacgccucccccug

SEQ ID NO: 1755646 - RNA, 14 nt, Human herpesvirus 1
cagcgggcgcggcg

SEQ ID NO: 1755647 - RNA, 16 nt, Human herpesvirus 1
cgacagaccuccccgc

SEQ ID NO: 1755648 - RNA, 12 nt, Human herpesvirus 1
cgcugugccauc

SEQ ID NO: 1755649 - RNA, 19 nt, Human herpesvirus 1
cagcguauccacccccgcc

SEQ ID NO: 1755650 - RNA, 15 nt, Human herpesvirus 1
auuccaaagugcccc

SEQ ID NO: 1755651 - RNA, 16 nt, Human herpesvirus 1
gccgccccagcaccga

SEQ ID NO: 1755652 - RNA, 21 nt, Human herpesvirus 1
cuggaucccaacgaccccgcc

SEQ ID NO: 1755653 - RNA, 16 nt, Human herpesvirus 1
gucccugggcccuggc

SEQ ID NO: 1755654 - RNA, 23 nt, Human herpesvirus 1
agcauacgcucgggcccgcgucg

SEQ ID NO: 1755655 - RNA, 21 nt, Human herpesvirus 1
gccccccguguuuguggggag

SEQ ID NO: 1755656 - RNA, 20 nt, Human herpesvirus 1
accaacacaacggcaugccu

SEQ ID NO: 1755657 - RNA, 20 nt, Human herpesvirus 1
ccccggaggcgccugccccg

SEQ ID NO: 1755658 - RNA, 14 nt, Human herpesvirus 1
guuugcgggccugg

SEQ ID NO: 1755659 - RNA, 20 nt, Human herpesvirus 1
cgaggcccgcaagcugaacc

SEQ ID NO: 1755660 - RNA, 23 nt, Human herpesvirus 1
ugccacgcgagcgacccgcgacu

SEQ ID NO: 1755661 - RNA, 13 nt, Human herpesvirus 1
gguuaauguaaau

SEQ ID NO: 1755662 - RNA, 14 nt, Human herpesvirus 1
cgacggcccgacca

SEQ ID NO: 1755663 - RNA, 13 nt, Human herpesvirus 1
guucaaccccagg

SEQ ID NO: 1755664 - RNA, 16 nt, Human herpesvirus 1
agcccccaaaccccac

SEQ ID NO: 1755665 - RNA, 18 nt, Human herpesvirus 1
agagucggagcccgcugg

SEQ ID NO: 1755666 - RNA, 18 nt, Human herpesvirus 1
accccgcaauuugcaccc

SEQ ID NO: 1755667 - RNA, 14 nt, Human herpesvirus 1
ggcccugcuccggc

SEQ ID NO: 1755668 - RNA, 23 nt, Human herpesvirus 1
gcugccccgcuucauccccgaga

SEQ ID NO: 1755669 - RNA, 16 nt, Human herpesvirus 1
ggcccgcaagcugaac

SEQ ID NO: 1755670 - RNA, 20 nt, Human herpesvirus 1
gcccgauuuacagcccccag

SEQ ID NO: 1755671 - RNA, 21 nt, Human herpesvirus 1
cccgagaaccuagggaaccca

SEQ ID NO: 1755672 - RNA, 18 nt, Human herpesvirus 1
auccccaacgcgcugccc

SEQ ID NO: 1755673 - RNA, 13 nt, Human herpesvirus 1
caccgcucccccc

SEQ ID NO: 1755674 - RNA, 12 nt, Human herpesvirus 1
ucgccgcuccgu

SEQ ID NO: 1755675 - RNA, 16 nt, Human herpesvirus 1
ccggcccuaaccccac

SEQ ID NO: 1755676 - RNA, 21 nt, Human herpesvirus 1
cgcggcccuuaaugggcaacc

SEQ ID NO: 1755677 - RNA, 15 nt, Human herpesvirus 1
gcccaccccccacgg

SEQ ID NO: 1755678 - RNA, 21 nt, Human herpesvirus 1
ggcgucuccucugggggcgac

SEQ ID NO: 1755679 - RNA, 17 nt, Human herpesvirus 1
uccauaccgaccacacc

SEQ ID NO: 1755680 - RNA, 23 nt, Human herpesvirus 1
uccccgcgaagacccccccggag

SEQ ID NO: 1755681 - RNA, 21 nt, Human herpesvirus 1
aguugggccgggcgacccaga

SEQ ID NO: 1755682 - RNA, 13 nt, Human herpesvirus 1
aagugaaagacac

SEQ ID NO: 1755683 - RNA, 21 nt, Human herpesvirus 1
caacgucuccuccaccaccca

SEQ ID NO: 1755684 - RNA, 14 nt, Human herpesvirus 1
accccaacgccucc

SEQ ID NO: 1755685 - RNA, 13 nt, Human herpesvirus 1
gcgaggugcgcca

SEQ ID NO: 1755686 - RNA, 20 nt, Human herpesvirus 1
ggccaaccagcguccgccga

SEQ ID NO: 1755687 - RNA, 12 nt, Human herpesvirus 1
cccacacgcacu

SEQ ID NO: 1755688 - RNA, 20 nt, Human herpesvirus 1
gcgaccgucgccgcgggcca

SEQ ID NO: 1755689 - RNA, 12 nt, Human herpesvirus 1
uacggcggcucc

SEQ ID NO: 1755690 - RNA, 23 nt, Human herpesvirus 1
gaccugcaccgaucgcagcgucc

SEQ ID NO: 1755691 - RNA, 23 nt, Human herpesvirus 1
cccagccuucacgugcugcugcg

SEQ ID NO: 1755692 - RNA, 17 nt, Human herpesvirus 1
ucccacggccucgccag

SEQ ID NO: 1755693 - RNA, 19 nt, Human herpesvirus 1
aaucaccggugcgcccccc

SEQ ID NO: 1755694 - RNA, 17 nt, Human herpesvirus 1
ccgagcuaugggccucu

SEQ ID NO: 1755695 - RNA, 14 nt, Human herpesvirus 1
ugcuccgccuggcc

SEQ ID NO: 1755696 - RNA, 17 nt, Human herpesvirus 1
accucggacgccacacc

SEQ ID NO: 1755697 - RNA, 21 nt, Human herpesvirus 1
accugcucacgacccccaagu

SEQ ID NO: 1755698 - RNA, 16 nt, Human herpesvirus 1
ccuggucagaggccca

SEQ ID NO: 1755699 - RNA, 19 nt, Human herpesvirus 1
gacccgacaggcgaccgcc

SEQ ID NO: 1755700 - RNA, 14 nt, Human herpesvirus 1
cgggagcgccagga

SEQ ID NO: 1755701 - RNA, 17 nt, Human herpesvirus 1
cgccuaccggccccugg

SEQ ID NO: 1755702 - RNA, 20 nt, Human herpesvirus 1
ucaaccccagggaccuccug

SEQ ID NO: 1755703 - RNA, 22 nt, Human herpesvirus 1
gcuucauccccgagaaccagcg

SEQ ID NO: 1755704 - RNA, 14 nt, Human herpesvirus 1
uggguggucucugg

SEQ ID NO: 1755705 - RNA, 16 nt, Human herpesvirus 1
uacugcggucugucuc

SEQ ID NO: 1755706 - RNA, 15 nt, Human herpesvirus 1
cgcccccagcugggc

SEQ ID NO: 1755707 - RNA, 13 nt, Human herpesvirus 1
gcguggaccuggg

SEQ ID NO: 1755708 - RNA, 17 nt, Human herpesvirus 1
gugcucgugggccucug

SEQ ID NO: 1755709 - RNA, 19 nt, Human herpesvirus 1
ggucucccagggagccccg

SEQ ID NO: 1755710 - RNA, 21 nt, Human herpesvirus 1
ccgccgcggaucgggccuugg

SEQ ID NO: 1755711 - RNA, 22 nt, Human herpesvirus 1
cccaggcggcguuaaccgcacc

SEQ ID NO: 1755712 - RNA, 15 nt, Human herpesvirus 1
cgguugguccagacg

SEQ ID NO: 1755713 - RNA, 20 nt, Human herpesvirus 1
ccgucccguagucccauccc

SEQ ID NO: 1755714 - RNA, 14 nt, Human herpesvirus 1
ccgacaccaccagc

SEQ ID NO: 1755715 - RNA, 23 nt, Human herpesvirus 1
gacggcccgaccaacgucgccgc

SEQ ID NO: 1755716 - RNA, 16 nt, Human herpesvirus 1
acaugcggaaagcaag

SEQ ID NO: 1755717 - RNA, 20 nt, Human herpesvirus 1
gaacccgcgcuaugacggca

SEQ ID NO: 1755718 - RNA, 20 nt, Human herpesvirus 1
gccgggccgcccacuucccg

SEQ ID NO: 1755719 - RNA, 17 nt, Human herpesvirus 1
cccggaccccacgcacc

SEQ ID NO: 1755720 - RNA, 17 nt, Human herpesvirus 1
ggagagccggccccggc

SEQ ID NO: 1755721 - RNA, 20 nt, Human herpesvirus 1
uggccgacaacugccugacc

SEQ ID NO: 1755722 - RNA, 14 nt, Human herpesvirus 1
ccccaccccugugc

SEQ ID NO: 1755723 - RNA, 14 nt, Human herpesvirus 1
gaaucccccaaggg

SEQ ID NO: 1755724 - RNA, 20 nt, Human herpesvirus 1
gcccacuacaccagccaauc

SEQ ID NO: 1755725 - RNA, 20 nt, Human herpesvirus 1
cacgggcaccacacaccagc

SEQ ID NO: 1755726 - RNA, 12 nt, Human herpesvirus 1
gaccgcagccug

SEQ ID NO: 1755727 - RNA, 17 nt, Human herpesvirus 1
ucuccucuucuccccuu

SEQ ID NO: 1755728 - RNA, 23 nt, Human herpesvirus 1
gcccgggcaaguaugccccccug

SEQ ID NO: 1755729 - RNA, 23 nt, Human herpesvirus 1
ucgccgcccugagcgcccuccug

SEQ ID NO: 1755730 - RNA, 24 nt, Human herpesvirus 1
aaucauaaccacgcccagcgcaga

SEQ ID NO: 1755731 - RNA, 18 nt, Human herpesvirus 1
ggccgccgacgaccuggu

SEQ ID NO: 1755732 - RNA, 14 nt, Human herpesvirus 1
ggcguccuggaugc

SEQ ID NO: 1755733 - RNA, 12 nt, Human herpesvirus 1
ucuccgccucuc

SEQ ID NO: 1755734 - RNA, 14 nt, Human herpesvirus 1
ggacagccaggagc

SEQ ID NO: 1755735 - RNA, 13 nt, Human herpesvirus 1
ccgacgaggugcg

SEQ ID NO: 1755736 - RNA, 22 nt, Human herpesvirus 1
cgccuuuuuggguccgggcccg

SEQ ID NO: 1755737 - RNA, 14 nt, Human herpesvirus 1
gugucaauggacgc

SEQ ID NO: 1755738 - RNA, 14 nt, Human herpesvirus 1
cgcggcccggggcc

SEQ ID NO: 1755739 - RNA, 15 nt, Human herpesvirus 1
aaccccccccaaaaa

SEQ ID NO: 1755740 - RNA, 18 nt, Human herpesvirus 1
gugagcgcgcggaugcuc

SEQ ID NO: 1755741 - RNA, 17 nt, Human herpesvirus 1
ucggccgucccggggca

SEQ ID NO: 1755742 - RNA, 23 nt, Human herpesvirus 1
gcuuccggccugggggccguccu

SEQ ID NO: 1755743 - RNA, 22 nt, Human herpesvirus 1
cgaggacaccccucguggcccc

SEQ ID NO: 1755744 - RNA, 21 nt, Human herpesvirus 1
ccaacgucuccuccaccaccc

SEQ ID NO: 1755745 - RNA, 16 nt, Human herpesvirus 1
ggccgccgacgaccug

SEQ ID NO: 1755746 - RNA, 17 nt, Human herpesvirus 1
aaaguuguuagcccugc

SEQ ID NO: 1755747 - RNA, 22 nt, Human herpesvirus 1
accaucccggguuaauguaaau

SEQ ID NO: 1755748 - RNA, 12 nt, Human herpesvirus 1
ucauccacgccg

SEQ ID NO: 1755749 - RNA, 23 nt, Human herpesvirus 1
gcauucgggccugccugcggcuc

SEQ ID NO: 1755750 - RNA, 16 nt, Human herpesvirus 1
cuguggcagaccggca

SEQ ID NO: 1755751 - RNA, 17 nt, Human herpesvirus 1
agaccaggccuggucag

SEQ ID NO: 1755752 - RNA, 16 nt, Human herpesvirus 1
ccaaugcccucccuga

SEQ ID NO: 1755753 - RNA, 15 nt, Human herpesvirus 1
ucgucucucuucccc

SEQ ID NO: 1755754 - RNA, 18 nt, Human herpesvirus 1
cccuauuuucccccccgg

SEQ ID NO: 1755755 - RNA, 21 nt, Human herpesvirus 1
gcucgucagggccggcggcgc

SEQ ID NO: 1755756 - RNA, 22 nt, Human herpesvirus 1
cacguugggguuguugcuggcg

SEQ ID NO: 1755757 - RNA, 20 nt, Human herpesvirus 1
cucgucuccucuucuccccu

SEQ ID NO: 1755758 - RNA, 17 nt, Human herpesvirus 1
aagccuacuacucggaa

SEQ ID NO: 1755759 - RNA, 21 nt, Human herpesvirus 1
aaggcgcugcgguugcccccg

SEQ ID NO: 1755760 - RNA, 22 nt, Human herpesvirus 1
gccccgaugcggcggcgcugca

SEQ ID NO: 1755761 - RNA, 17 nt, Human herpesvirus 1
ccccuaagacccacccc

SEQ ID NO: 1755762 - RNA, 23 nt, Human herpesvirus 1
cggcgguaaucauaaccacgccc

SEQ ID NO: 1755763 - RNA, 14 nt, Human herpesvirus 1
cucuucgcuuuccu

SEQ ID NO: 1755764 - RNA, 21 nt, Human herpesvirus 1
ggucagcgacguccugggcca

SEQ ID NO: 1755765 - RNA, 17 nt, Human herpesvirus 1
cccaacuccagaccacc

SEQ ID NO: 1755766 - RNA, 18 nt, Human herpesvirus 1
cccaggaucacaccgguc

SEQ ID NO: 1755767 - RNA, 22 nt, Human herpesvirus 1
gccucccaacccccuaagaccc

SEQ ID NO: 1755768 - RNA, 22 nt, Human herpesvirus 1
uggccggggagggcagggccgc

SEQ ID NO: 1755769 - RNA, 13 nt, Human herpesvirus 1
caaucggcggccg

SEQ ID NO: 1755770 - RNA, 13 nt, Human herpesvirus 1
caacagggguuca

SEQ ID NO: 1755771 - RNA, 20 nt, Human herpesvirus 1
aaaacagcgacgacgucugu

SEQ ID NO: 1755772 - RNA, 24 nt, Human herpesvirus 1
uaugguacacacgggugcgucugg

SEQ ID NO: 1755773 - RNA, 15 nt, Human herpesvirus 1
gaccaccauccccgc

SEQ ID NO: 1755774 - RNA, 20 nt, Human herpesvirus 1
cccgcauaucccacccugga

SEQ ID NO: 1755775 - RNA, 14 nt, Human herpesvirus 1
ggcagcccggaggc

SEQ ID NO: 1755776 - RNA, 16 nt, Human herpesvirus 1
gcgacguccugggcca

SEQ ID NO: 1755777 - RNA, 14 nt, Human herpesvirus 1
cuccagccuccccu

SEQ ID NO: 1755778 - RNA, 15 nt, Human herpesvirus 1
cgcccggcggaccca

SEQ ID NO: 1755779 - RNA, 15 nt, Human herpesvirus 1
gucgcgccugggugc

SEQ ID NO: 1755780 - RNA, 23 nt, Human herpesvirus 1
gcgacccguaaaugguugcagug

SEQ ID NO: 1755781 - RNA, 23 nt, Human herpesvirus 1
cccucucuucucucccgggccgc

SEQ ID NO: 1755782 - RNA, 16 nt, Human herpesvirus 1
ggcgguaacaggcgcg

SEQ ID NO: 1755783 - RNA, 18 nt, Human herpesvirus 1
gaccgcaacuucccaccc

SEQ ID NO: 1755784 - RNA, 19 nt, Human herpesvirus 1
gacacuggguucuccugga

SEQ ID NO: 1755785 - RNA, 22 nt, Human herpesvirus 1
ggcugccaaacagcuggccgcc

SEQ ID NO: 1755786 - RNA, 12 nt, Human herpesvirus 1
gcaagcugaacc

SEQ ID NO: 1755787 - RNA, 16 nt, Human herpesvirus 1
ccggggcuggcacacc

SEQ ID NO: 1755788 - RNA, 14 nt, Human herpesvirus 1
ccgcagcaccucua

SEQ ID NO: 1755789 - RNA, 20 nt, Human herpesvirus 1
ccucacagggcgggccgccu

SEQ ID NO: 1755790 - RNA, 20 nt, Human herpesvirus 1
ccaucugggauggcuccugg

SEQ ID NO: 1755791 - RNA, 18 nt, Human herpesvirus 1
accggcgcuacuucaccu

SEQ ID NO: 1755792 - RNA, 15 nt, Human herpesvirus 1
cggggcggggacggg

SEQ ID NO: 1755793 - RNA, 14 nt, Human herpesvirus 1
gccccagaaacccc

SEQ ID NO: 1755794 - RNA, 15 nt, Human herpesvirus 1
aauuugcacccagcc

SEQ ID NO: 1755795 - RNA, 20 nt, Human herpesvirus 1
cauacuccggccgcgguaca

SEQ ID NO: 1755796 - RNA, 14 nt, Human herpesvirus 1
cuaaucccccggcu

SEQ ID NO: 1755797 - RNA, 12 nt, Human herpesvirus 1
gcacgcgccgcc

SEQ ID NO: 1755798 - RNA, 23 nt, Human herpesvirus 1
uuggccgucccguuaccaagacc

SEQ ID NO: 1755799 - RNA, 23 nt, Human herpesvirus 1
ggccaauaucgcuagagacagcc

SEQ ID NO: 1755800 - RNA, 16 nt, Human herpesvirus 1
ccaacaauccccagga

SEQ ID NO: 1755801 - RNA, 14 nt, Human herpesvirus 1
cggccagccgcgcg

SEQ ID NO: 1755802 - RNA, 16 nt, Human herpesvirus 1
ccuucgcaacaccucc

SEQ ID NO: 1755803 - RNA, 19 nt, Human herpesvirus 1
gcccccuuuguccccgccg

SEQ ID NO: 1755804 - RNA, 23 nt, Human herpesvirus 1
ccuguugguauagguccacggcc

SEQ ID NO: 1755805 - RNA, 18 nt, Human herpesvirus 1
uccguccccugccccccc

SEQ ID NO: 1755806 - RNA, 21 nt, Human herpesvirus 1
guccacggccacuggccggga

SEQ ID NO: 1755807 - RNA, 22 nt, Human herpesvirus 1
gcguacaacggcucggccuaug

SEQ ID NO: 1755808 - RNA, 20 nt, Human herpesvirus 1
auccacgguggagguucugu

SEQ ID NO: 1755809 - RNA, 13 nt, Human herpesvirus 1
ugggccgggccgc

SEQ ID NO: 1755810 - RNA, 16 nt, Human herpesvirus 1
ccugacgcgccuagcc

SEQ ID NO: 1755811 - RNA, 19 nt, Human herpesvirus 1
cgcgccaagguggacuggu

SEQ ID NO: 1755812 - RNA, 22 nt, Human herpesvirus 1
ggucgucccucgcaugaagccc

SEQ ID NO: 1755813 - RNA, 12 nt, Human herpesvirus 1
ggccgucgggca

SEQ ID NO: 1755814 - RNA, 20 nt, Human herpesvirus 1
caaccgcgacccuccgggau

SEQ ID NO: 1755815 - RNA, 15 nt, Human herpesvirus 1
cgggggauggggaga

SEQ ID NO: 1755816 - RNA, 18 nt, Human herpesvirus 1
cccgcagucccgggggcu

SEQ ID NO: 1755817 - RNA, 20 nt, Human herpesvirus 1
gcauacgccucccccacauc

SEQ ID NO: 1755818 - RNA, 16 nt, Human herpesvirus 1
uggcuccuggccagga

SEQ ID NO: 1755819 - RNA, 23 nt, Human herpesvirus 1
gcagcguccgguuggccgcgcgg

SEQ ID NO: 1755820 - RNA, 17 nt, Human herpesvirus 1
gcggggacucgggcgag

SEQ ID NO: 1755821 - RNA, 20 nt, Human herpesvirus 1
gcgcccgucggucugcacca

SEQ ID NO: 1755822 - RNA, 12 nt, Human herpesvirus 1
ugggggacgagg

SEQ ID NO: 1755823 - RNA, 19 nt, Human herpesvirus 1
ccuccaccacccaacccca

SEQ ID NO: 1755824 - RNA, 17 nt, Human herpesvirus 1
ccagucccggcccggcg

SEQ ID NO: 1755825 - RNA, 16 nt, Human herpesvirus 1
gcccgaccacacaccc

SEQ ID NO: 1755826 - RNA, 21 nt, Human herpesvirus 1
aguuuguguuggcgacuggcg

SEQ ID NO: 1755827 - RNA, 15 nt, Human herpesvirus 1
ggucagaggcccacg

SEQ ID NO: 1755828 - RNA, 15 nt, Human herpesvirus 1
gcacgagccggggcu

SEQ ID NO: 1755829 - RNA, 23 nt, Human herpesvirus 1
gggucuguuggggacacuggguu

SEQ ID NO: 1755830 - RNA, 21 nt, Human herpesvirus 1
gcgccuagccaaccuguggca

SEQ ID NO: 1755831 - RNA, 23 nt, Human herpesvirus 1
cgcauccgucgggaggccacaga

SEQ ID NO: 1755832 - RNA, 22 nt, Human herpesvirus 1
uccggucgccccgacccccuug

SEQ ID NO: 1755833 - RNA, 21 nt, Human herpesvirus 1
agacgagcgcgcuuguccccg

SEQ ID NO: 1755834 - RNA, 13 nt, Human herpesvirus 1
gccagcuaugggc

SEQ ID NO: 1755835 - RNA, 14 nt, Human herpesvirus 1
gcaugcaccccaga

SEQ ID NO: 1755836 - RNA, 13 nt, Human herpesvirus 1
cccucgucccccu

SEQ ID NO: 1755837 - RNA, 17 nt, Human herpesvirus 1
gguccgcggggccuccc

SEQ ID NO: 1755838 - RNA, 12 nt, Human herpesvirus 1
ucugugggccaa

SEQ ID NO: 1755839 - RNA, 14 nt, Human herpesvirus 1
ggcccggaggaggc

SEQ ID NO: 1755840 - RNA, 20 nt, Human herpesvirus 1
gugcccacgucgccccgccg

SEQ ID NO: 1755841 - RNA, 24 nt, Human herpesvirus 1
cccggacgacauggccagcggccc

SEQ ID NO: 1755842 - RNA, 17 nt, Human herpesvirus 1
cguggaccugggggacu

SEQ ID NO: 1755843 - RNA, 22 nt, Human herpesvirus 1
accgcguguuccccgggagccc

SEQ ID NO: 1755844 - RNA, 21 nt, Human herpesvirus 1
gccgucgcuccacuacgaguc

SEQ ID NO: 1755845 - RNA, 15 nt, Human herpesvirus 1
gccccccccacccca

SEQ ID NO: 1755846 - RNA, 19 nt, Human herpesvirus 1
uggaucuuagccuccccgg

SEQ ID NO: 1755847 - RNA, 19 nt, Human herpesvirus 1
ccgaggcgauuagccagca

SEQ ID NO: 1755848 - RNA, 19 nt, Human herpesvirus 1
uccggccucgaugacgucc

SEQ ID NO: 1755849 - RNA, 18 nt, Human herpesvirus 1
cccccaucuuguccccaa

SEQ ID NO: 1755850 - RNA, 16 nt, Human herpesvirus 1
uguggggacccggccc

SEQ ID NO: 1755851 - RNA, 13 nt, Human herpesvirus 1
aaccgguauuauu

SEQ ID NO: 1755852 - RNA, 21 nt, Human herpesvirus 1
ucuggguuuuccccucccguc

SEQ ID NO: 1755853 - RNA, 15 nt, Human herpesvirus 1
cgcguccacccggag

SEQ ID NO: 1755854 - RNA, 16 nt, Human herpesvirus 1
gcauacgcucgggccc

SEQ ID NO: 1755855 - RNA, 20 nt, Human herpesvirus 1
uuguacccuuaauaaauuuu

SEQ ID NO: 1755856 - RNA, 18 nt, Human herpesvirus 1
ggggaaaagugaaagaca

SEQ ID NO: 1755857 - RNA, 12 nt, Human herpesvirus 1
agauagagcugc

SEQ ID NO: 1755858 - RNA, 19 nt, Human herpesvirus 1
cccgcaucccccgucuggg

SEQ ID NO: 1755859 - RNA, 17 nt, Human herpesvirus 1
gcaauuugcacccagcc

SEQ ID NO: 1755860 - RNA, 18 nt, Human herpesvirus 1
gcucaaccaccgcucccc

SEQ ID NO: 1755861 - RNA, 22 nt, Human herpesvirus 1
uuggccggggagggcagggccg

SEQ ID NO: 1755862 - RNA, 21 nt, Human herpesvirus 1
cacccucucuucccucagguc

SEQ ID NO: 1755863 - RNA, 20 nt, Human herpesvirus 1
ggcggucagcgacguccugg

SEQ ID NO: 1755864 - RNA, 16 nt, Human herpesvirus 1
cacaccgguccccgga

SEQ ID NO: 1755865 - RNA, 14 nt, Human herpesvirus 1
ugacccucuccggg

SEQ ID NO: 1755866 - RNA, 19 nt, Human herpesvirus 1
ucugcuacgccgcugaccc

SEQ ID NO: 1755867 - RNA, 14 nt, Human herpesvirus 1
gaacgggggcccug

SEQ ID NO: 1755868 - RNA, 21 nt, Human herpesvirus 1
cgcggcugccaaacagcuggc

SEQ ID NO: 1755869 - RNA, 14 nt, Human herpesvirus 1
ugcccccggagcug

SEQ ID NO: 1755870 - RNA, 14 nt, Human herpesvirus 1
ugcgauucuagccu

SEQ ID NO: 1755871 - RNA, 14 nt, Human herpesvirus 1
ccgcccaacucucg

SEQ ID NO: 1755872 - RNA, 14 nt, Human herpesvirus 1
ugggcggccccggc

SEQ ID NO: 1755873 - RNA, 16 nt, Human herpesvirus 1
cgccacgcgcggcugg

SEQ ID NO: 1755874 - RNA, 17 nt, Human herpesvirus 1
gccccgcgucuggcccc

SEQ ID NO: 1755875 - RNA, 12 nt, Human herpesvirus 1
aggagcgccggc

SEQ ID NO: 1755876 - RNA, 18 nt, Human herpesvirus 1
cccgagaccagucgcccg

SEQ ID NO: 1755877 - RNA, 16 nt, Human herpesvirus 1
aacgcagccccgcugg

SEQ ID NO: 1755878 - RNA, 16 nt, Human herpesvirus 1
gcaccucgaggacacc

SEQ ID NO: 1755879 - RNA, 23 nt, Human herpesvirus 1
gaaacuguccugucuuggggccc

SEQ ID NO: 1755880 - RNA, 12 nt, Human herpesvirus 1
accugcaccacc

SEQ ID NO: 1755881 - RNA, 17 nt, Human herpesvirus 1
aaucuggcccaacagcc

SEQ ID NO: 1755882 - RNA, 12 nt, Human herpesvirus 1
gccaaauuuaug

SEQ ID NO: 1755883 - RNA, 16 nt, Human herpesvirus 1
cggccacuggccggga

SEQ ID NO: 1755884 - RNA, 15 nt, Human herpesvirus 1
ggcggugcuccgccg

SEQ ID NO: 1755885 - RNA, 17 nt, Human herpesvirus 1
acgcgccggccgcaccc

SEQ ID NO: 1755886 - RNA, 15 nt, Human herpesvirus 1
gcgcuggggcugccg

SEQ ID NO: 1755887 - RNA, 17 nt, Human herpesvirus 1
ugggcacuuuccccaug

SEQ ID NO: 1755888 - RNA, 16 nt, Human herpesvirus 1
ccccggagggcugcca

SEQ ID NO: 1755889 - RNA, 15 nt, Human herpesvirus 1
gacguccugggccac

SEQ ID NO: 1755890 - RNA, 21 nt, Human herpesvirus 1
gaucaugguacggggccggga

SEQ ID NO: 1755891 - RNA, 20 nt, Human herpesvirus 1
cccucgaccaccaccuccac

SEQ ID NO: 1755892 - RNA, 15 nt, Human herpesvirus 1
accuuggcccuggcu

SEQ ID NO: 1755893 - RNA, 15 nt, Human herpesvirus 1
gggggcauuucagug

SEQ ID NO: 1755894 - RNA, 14 nt, Human herpesvirus 1
uccgaacccaggcc

SEQ ID NO: 1755895 - RNA, 12 nt, Human herpesvirus 1
ggaaagcaagaa

SEQ ID NO: 1755896 - RNA, 16 nt, Human herpesvirus 1
cgccguuggcccccgc

SEQ ID NO: 1755897 - RNA, 15 nt, Human herpesvirus 1
ggagcucccgggagc

SEQ ID NO: 1755898 - RNA, 19 nt, Human herpesvirus 1
ggccggggagggcagggcc

SEQ ID NO: 1755899 - RNA, 15 nt, Human herpesvirus 1
guccccuucgaggag

SEQ ID NO: 1755900 - RNA, 21 nt, Human herpesvirus 1
gccgccagcgcggcggggccc

SEQ ID NO: 1755901 - RNA, 14 nt, Human herpesvirus 1
cccgagaccagucg

SEQ ID NO: 1755902 - RNA, 17 nt, Human herpesvirus 1
cgcgcggacgacggcgg

SEQ ID NO: 1755903 - RNA, 13 nt, Human herpesvirus 1
aagcaagaacaau

SEQ ID NO: 1755904 - RNA, 18 nt, Human herpesvirus 1
ugaagaucgccggguggc

SEQ ID NO: 1755905 - RNA, 17 nt, Human herpesvirus 1
cugucgcacccacagcu

SEQ ID NO: 1755906 - RNA, 16 nt, Human herpesvirus 1
gcccauaucugcuacg

SEQ ID NO: 1755907 - RNA, 18 nt, Human herpesvirus 1
gcgccaucuggaccgggg

SEQ ID NO: 1755908 - RNA, 20 nt, Human herpesvirus 1
accacgccccuuucccccug

SEQ ID NO: 1755909 - RNA, 20 nt, Human herpesvirus 1
acgcugcuccgccuggccug

SEQ ID NO: 1755910 - RNA, 14 nt, Human herpesvirus 1
guucguuccgggca

SEQ ID NO: 1755911 - RNA, 16 nt, Human herpesvirus 1
cggcgcgacaacgagc

SEQ ID NO: 1755912 - RNA, 18 nt, Human herpesvirus 1
cguggugcgucgggccuc

SEQ ID NO: 1755913 - RNA, 20 nt, Human herpesvirus 1
gcgugcccacgucgccccgc

SEQ ID NO: 1755914 - RNA, 15 nt, Human herpesvirus 1
cccaacccacacgca

SEQ ID NO: 1755915 - RNA, 22 nt, Human herpesvirus 1
cuuccguccccugcccccccca

SEQ ID NO: 1755916 - RNA, 16 nt, Human herpesvirus 1
cagggccucgcugacc

SEQ ID NO: 1755917 - RNA, 22 nt, Human herpesvirus 1
ggcguugggguggaucuuagcc

SEQ ID NO: 1755918 - RNA, 12 nt, Human herpesvirus 1
gcauccagggag

SEQ ID NO: 1755919 - RNA, 15 nt, Human herpesvirus 1
uaaagccacugaaac

SEQ ID NO: 1755920 - RNA, 17 nt, Human herpesvirus 1
guggccgggcguugggg

SEQ ID NO: 1755921 - RNA, 20 nt, Human herpesvirus 1
gaccggcgggucccgaccga

SEQ ID NO: 1755922 - RNA, 15 nt, Human herpesvirus 1
ccucucacacagcau

SEQ ID NO: 1755923 - RNA, 15 nt, Human herpesvirus 1
gucauagugggccuc

SEQ ID NO: 1755924 - RNA, 17 nt, Human herpesvirus 1
gcacaacgccagccugc

SEQ ID NO: 1755925 - RNA, 12 nt, Human herpesvirus 1
cccaacggggga

SEQ ID NO: 1755926 - RNA, 17 nt, Human herpesvirus 1
gaacaacaugggccuga

SEQ ID NO: 1755927 - RNA, 17 nt, Human herpesvirus 1
gcccguccucgcccgcc

SEQ ID NO: 1755928 - RNA, 14 nt, Human herpesvirus 1
ccgguucucccugu

SEQ ID NO: 1755929 - RNA, 16 nt, Human herpesvirus 1
uggcgucggcggcucc

SEQ ID NO: 1755930 - RNA, 17 nt, Human herpesvirus 1
cgcaugaucuccggacc

SEQ ID NO: 1755931 - RNA, 18 nt, Human herpesvirus 1
cggcccgcguuuggccug

SEQ ID NO: 1755932 - RNA, 18 nt, Human herpesvirus 1
ccacuguuuuccgcccca

SEQ ID NO: 1755933 - RNA, 15 nt, Human herpesvirus 1
ccaccgccccccugu

SEQ ID NO: 1755934 - RNA, 21 nt, Human herpesvirus 1
gcuccggggggcuuccggccu

SEQ ID NO: 1755935 - RNA, 16 nt, Human herpesvirus 1
gccacuggccgggagc

SEQ ID NO: 1755936 - RNA, 20 nt, Human herpesvirus 1
cagcugggaccccggcggcc

SEQ ID NO: 1755937 - RNA, 21 nt, Human herpesvirus 1
acgugcgcaacaaccuggaga

SEQ ID NO: 1755938 - RNA, 18 nt, Human herpesvirus 1
gcgagcucccagagaccc

SEQ ID NO: 1755939 - RNA, 15 nt, Human herpesvirus 1
ccgcucgguggcucc

SEQ ID NO: 1755940 - RNA, 14 nt, Human herpesvirus 1
ggcccuaaccccac

SEQ ID NO: 1755941 - RNA, 14 nt, Human herpesvirus 1
ccuggcugacccac

SEQ ID NO: 1755942 - RNA, 19 nt, Human herpesvirus 1
ucugggccaccgacagccu

SEQ ID NO: 1755943 - RNA, 21 nt, Human herpesvirus 1
ccugacgcgccgcgggccccc

SEQ ID NO: 1755944 - RNA, 18 nt, Human herpesvirus 1
uccggcgcguguaccaca

SEQ ID NO: 1755945 - RNA, 14 nt, Human herpesvirus 1
ucaccguggccugg

SEQ ID NO: 1755946 - RNA, 16 nt, Human herpesvirus 1
gcggcggucagcgacg

SEQ ID NO: 1755947 - RNA, 14 nt, Human herpesvirus 1
ggccccugggcccc

SEQ ID NO: 1755948 - RNA, 16 nt, Human herpesvirus 1
gaccagcgccgggugg

SEQ ID NO: 1755949 - RNA, 17 nt, Human herpesvirus 1
ggggucuccgaaagcca

SEQ ID NO: 1755950 - RNA, 19 nt, Human herpesvirus 1
cgugcuuguuuguguuccg

SEQ ID NO: 1755951 - RNA, 22 nt, Human herpesvirus 1
cccugcugcaggccccccgccg

SEQ ID NO: 1755952 - RNA, 19 nt, Human herpesvirus 1
ggcgucugggccaccgaca

SEQ ID NO: 1755953 - RNA, 23 nt, Human herpesvirus 1
ccgccuggaggacggcgccgggg

SEQ ID NO: 1755954 - RNA, 22 nt, Human herpesvirus 1
cguggaccccacgacacccacc

SEQ ID NO: 1755955 - RNA, 23 nt, Human herpesvirus 1
cccauccgaacgcagccccgcug

SEQ ID NO: 1755956 - RNA, 21 nt, Human herpesvirus 1
ccucuccgcggugucugggaa

SEQ ID NO: 1755957 - RNA, 12 nt, Human herpesvirus 1
ggaggggcuccu

SEQ ID NO: 1755958 - RNA, 15 nt, Human herpesvirus 1
uucccccccaucacc

SEQ ID NO: 1755959 - RNA, 15 nt, Human herpesvirus 1
cauaaccgaccgcag

SEQ ID NO: 1755960 - RNA, 22 nt, Human herpesvirus 1
cuccacccccucgaccaccacc

SEQ ID NO: 1755961 - RNA, 16 nt, Human herpesvirus 1
ccgcggaucugcuccg

SEQ ID NO: 1755962 - RNA, 18 nt, Human herpesvirus 1
guccggagccgcgcggcc

SEQ ID NO: 1755963 - RNA, 12 nt, Human herpesvirus 1
uggcccuccagg

SEQ ID NO: 1755964 - RNA, 17 nt, Human herpesvirus 1
ucgccgcggcucccggc

SEQ ID NO: 1755965 - RNA, 19 nt, Human herpesvirus 1
ccaggcccgccgccacugu

SEQ ID NO: 1755966 - RNA, 18 nt, Human herpesvirus 1
cccgcguccacccggagg

SEQ ID NO: 1755967 - RNA, 19 nt, Human herpesvirus 1
ccccggauggggcccgggu

SEQ ID NO: 1755968 - RNA, 15 nt, Human herpesvirus 1
uauacacagauguca

SEQ ID NO: 1755969 - RNA, 17 nt, Human herpesvirus 1
ccgacaucaccaccguc

SEQ ID NO: 1755970 - RNA, 22 nt, Human herpesvirus 1
agaccguggccgacaacugccu

SEQ ID NO: 1755971 - RNA, 20 nt, Human herpesvirus 1
ggugacguuuaucggcaggc

SEQ ID NO: 1755972 - RNA, 17 nt, Human herpesvirus 1
agggcgacgccgugggc

SEQ ID NO: 1755973 - RNA, 14 nt, Human herpesvirus 1
cccccgucagccug

SEQ ID NO: 1755974 - RNA, 14 nt, Human herpesvirus 1
ccgggcgaugagcc

SEQ ID NO: 1755975 - RNA, 17 nt, Human herpesvirus 1
cucguggcgucucgccg

SEQ ID NO: 1755976 - RNA, 18 nt, Human herpesvirus 1
gacagcggauggcacgag

SEQ ID NO: 1755977 - RNA, 21 nt, Human herpesvirus 1
cuucggccccgcgucuggccc

SEQ ID NO: 1755978 - RNA, 10 nt, Human herpesvirus 1
aaggccuggg

SEQ ID NO: 1755979 - RNA, 21 nt, Human herpesvirus 1
acggccuccgcguacgaggac

SEQ ID NO: 1755980 - RNA, 20 nt, Human herpesvirus 1
ggagcucaagaaccccacca

SEQ ID NO: 1755981 - RNA, 16 nt, Human herpesvirus 1
gcggcagucuccuggc

SEQ ID NO: 1755982 - RNA, 22 nt, Human herpesvirus 1
cggaaagcaagaacaauaaagg

SEQ ID NO: 1755983 - RNA, 22 nt, Human herpesvirus 1
cucccaaccgcgacccuccggg

SEQ ID NO: 1755984 - RNA, 16 nt, Human herpesvirus 1
ugccggucggcgggcc

SEQ ID NO: 1755985 - RNA, 20 nt, Human herpesvirus 1
gcgcggccacgucguccggg

SEQ ID NO: 1755986 - RNA, 19 nt, Human herpesvirus 1
gccuccaugggguccgcag

SEQ ID NO: 1755987 - RNA, 16 nt, Human herpesvirus 1
acgccuaccggccccu

SEQ ID NO: 1755988 - RNA, 20 nt, Human herpesvirus 1
aucgguccccucugggcccg

SEQ ID NO: 1755989 - RNA, 18 nt, Human herpesvirus 1
uccuaacccagaccccgg

SEQ ID NO: 1755990 - RNA, 20 nt, Human herpesvirus 1
cgaucccaacaacucccccg

SEQ ID NO: 1755991 - RNA, 18 nt, Human herpesvirus 1
acccgcgacccccgggcu

SEQ ID NO: 1755992 - RNA, 17 nt, Human herpesvirus 1
gauccucgggcuacugg

SEQ ID NO: 1755993 - RNA, 19 nt, Human herpesvirus 1
cggccuauggcuccugcga

SEQ ID NO: 1755994 - RNA, 17 nt, Human herpesvirus 1
gggccccggggagacag

SEQ ID NO: 1755995 - RNA, 16 nt, Human herpesvirus 1
augcacgaccuguuga

SEQ ID NO: 1755996 - RNA, 22 nt, Human herpesvirus 1
gccacaccacgccacaacagcc

SEQ ID NO: 1755997 - RNA, 17 nt, Human herpesvirus 1
cgaugcgaucgagccgu

SEQ ID NO: 1755998 - RNA, 22 nt, Human herpesvirus 1
uacaccgaaugcuccuacaaca

SEQ ID NO: 1755999 - RNA, 20 nt, Human herpesvirus 1
ggauccgacccccauggagc

SEQ ID NO: 1756000 - RNA, 14 nt, Human herpesvirus 1
gugccaccagccug

SEQ ID NO: 1756001 - RNA, 14 nt, Human herpesvirus 1
cccgugucuguggg

SEQ ID NO: 1756002 - RNA, 13 nt, Human herpesvirus 1
ucgcccuccacca

SEQ ID NO: 1756003 - RNA, 23 nt, Human herpesvirus 1
gcgaccgcaacuucccacccgga

SEQ ID NO: 1756004 - RNA, 21 nt, Human herpesvirus 1
ggccccaguccccaagacccc

SEQ ID NO: 1756005 - RNA, 20 nt, Human herpesvirus 1
acgccguggcgccccggccc

SEQ ID NO: 1756006 - RNA, 20 nt, Human herpesvirus 1
ggacgcguccggggagggcg

SEQ ID NO: 1756007 - RNA, 15 nt, Human herpesvirus 1
ugggguuucuguguu

SEQ ID NO: 1756008 - RNA, 18 nt, Human herpesvirus 1
uuccucuccgcggugucu

SEQ ID NO: 1756009 - RNA, 16 nt, Human herpesvirus 1
ccaucccgaggcccca

SEQ ID NO: 1756010 - RNA, 20 nt, Human herpesvirus 1
cuugguucggggccgcccug

SEQ ID NO: 1756011 - RNA, 18 nt, Human herpesvirus 1
cgaccucggcgccucugg

SEQ ID NO: 1756012 - RNA, 16 nt, Human herpesvirus 1
guugugguuauaugca

SEQ ID NO: 1756013 - RNA, 22 nt, Human herpesvirus 1
gcugagccgcgccgacaucacc

SEQ ID NO: 1756014 - RNA, 12 nt, Human herpesvirus 1
ucacccacgccg

SEQ ID NO: 1756015 - RNA, 17 nt, Human herpesvirus 1
gcggggaggggggcaag

SEQ ID NO: 1756016 - RNA, 15 nt, Human herpesvirus 1
cccgcgcuaugacgg

SEQ ID NO: 1756017 - RNA, 21 nt, Human herpesvirus 1
aggagacaauaccggaaggaa

SEQ ID NO: 1756018 - RNA, 12 nt, Human herpesvirus 1
cuccggcgccgc

SEQ ID NO: 1756019 - RNA, 15 nt, Human herpesvirus 1
ugugccaccagccug

SEQ ID NO: 1756020 - RNA, 23 nt, Human herpesvirus 1
gcaccaccgacucucccaccgcc

SEQ ID NO: 1756021 - RNA, 14 nt, Human herpesvirus 1
ggaccagagcgcga

SEQ ID NO: 1756022 - RNA, 14 nt, Human herpesvirus 1
cggggagggcaggg

SEQ ID NO: 1756023 - RNA, 22 nt, Human herpesvirus 1
ggggucaaccacgaacccccau

SEQ ID NO: 1756024 - RNA, 21 nt, Human herpesvirus 1
aacaagucucugggggccugu

SEQ ID NO: 1756025 - RNA, 18 nt, Human herpesvirus 1
gugcguagcauaccuggg

SEQ ID NO: 1756026 - RNA, 16 nt, Human herpesvirus 1
ucgcuagaccacgccc

SEQ ID NO: 1756027 - RNA, 19 nt, Human herpesvirus 1
uccacggccaaguacgugc

SEQ ID NO: 1756028 - RNA, 18 nt, Human herpesvirus 1
ugaaagacacgggcacca

SEQ ID NO: 1756029 - RNA, 19 nt, Human herpesvirus 1
uccgcgacccaccgggccc

SEQ ID NO: 1756030 - RNA, 17 nt, Human herpesvirus 1
ggggaccagguccccca

SEQ ID NO: 1756031 - RNA, 21 nt, Human herpesvirus 1
cgccauguuugcgggccuggg

SEQ ID NO: 1756032 - RNA, 14 nt, Human herpesvirus 1
guggucucuggccg

SEQ ID NO: 1756033 - RNA, 12 nt, Human herpesvirus 1
cccaacgggggc

SEQ ID NO: 1756034 - RNA, 18 nt, Human herpesvirus 1
ccgccggcaugcacccca

SEQ ID NO: 1756035 - RNA, 20 nt, Human herpesvirus 1
cguuccagccccccagccuc

SEQ ID NO: 1756036 - RNA, 15 nt, Human herpesvirus 1
gcaggccccccgccg

SEQ ID NO: 1756037 - RNA, 19 nt, Human herpesvirus 1
ucccgauaaaaagcgcccc

SEQ ID NO: 1756038 - RNA, 20 nt, Human herpesvirus 1
cagaucuacugcugggccau

SEQ ID NO: 1756039 - RNA, 18 nt, Human herpesvirus 1
acgaugaccgcccccagc

SEQ ID NO: 1756040 - RNA, 18 nt, Human herpesvirus 1
caaggugggccagccgca

SEQ ID NO: 1756041 - RNA, 12 nt, Human herpesvirus 1
acgaggccaagc

SEQ ID NO: 1756042 - RNA, 17 nt, Human herpesvirus 1
ccggggucccagcggca

SEQ ID NO: 1756043 - RNA, 18 nt, Human herpesvirus 1
gcgacggcgucucccggg

SEQ ID NO: 1756044 - RNA, 15 nt, Human herpesvirus 1
guguggguggaggag

SEQ ID NO: 1756045 - RNA, 19 nt, Human herpesvirus 1
ucgacgcccccucccuguu

SEQ ID NO: 1756046 - RNA, 19 nt, Human herpesvirus 1
ucugguccgccgcgagccc

SEQ ID NO: 1756047 - RNA, 22 nt, Human herpesvirus 1
cccaucgcgggcgccauggcgg

SEQ ID NO: 1756048 - RNA, 15 nt, Human herpesvirus 1
cggaccugcucucgc

SEQ ID NO: 1756049 - RNA, 16 nt, Human herpesvirus 1
cacaccacgccacaac

SEQ ID NO: 1756050 - RNA, 20 nt, Human herpesvirus 1
gccgguuccucccgcucggc

SEQ ID NO: 1756051 - RNA, 14 nt, Human herpesvirus 1
ccacggccacuggc

SEQ ID NO: 1756052 - RNA, 20 nt, Human herpesvirus 1
ggacacuggguucuccugga

SEQ ID NO: 1756053 - RNA, 13 nt, Human herpesvirus 1
gcgacgggcagug

SEQ ID NO: 1756054 - RNA, 15 nt, Human herpesvirus 1
ucuggguuuuccccu

SEQ ID NO: 1756055 - RNA, 13 nt, Human herpesvirus 1
cgcgcccucgcca

SEQ ID NO: 1756056 - RNA, 13 nt, Human herpesvirus 1
ccaccuccacccc

SEQ ID NO: 1756057 - RNA, 14 nt, Human herpesvirus 1
uacggaccgccucg

SEQ ID NO: 1756058 - RNA, 22 nt, Human herpesvirus 1
gcccucuuggaggaccccgugg

SEQ ID NO: 1756059 - RNA, 19 nt, Human herpesvirus 1
ccccauacacgagcacccu

SEQ ID NO: 1756060 - RNA, 15 nt, Human herpesvirus 1
ccguuucgggcggca

SEQ ID NO: 1756061 - RNA, 19 nt, Human herpesvirus 1
aaagacacgggcaccacac

SEQ ID NO: 1756062 - RNA, 19 nt, Human herpesvirus 1
accgccaacaauccccagg

SEQ ID NO: 1756063 - RNA, 16 nt, Human herpesvirus 1
cugucuuggggcccac

SEQ ID NO: 1756064 - RNA, 15 nt, Human herpesvirus 1
cuggguucuccugga

SEQ ID NO: 1756065 - RNA, 18 nt, Human herpesvirus 1
cgcgauuccgagggccgg

SEQ ID NO: 1756066 - RNA, 18 nt, Human herpesvirus 1
acagccgcccccugguca

SEQ ID NO: 1756067 - RNA, 16 nt, Human herpesvirus 1
aggcuguaggucuggg

SEQ ID NO: 1756068 - RNA, 15 nt, Human herpesvirus 1
gacgccccggccgcc

SEQ ID NO: 1756069 - RNA, 13 nt, Human herpesvirus 1
ugguuauaugcac

SEQ ID NO: 1756070 - RNA, 22 nt, Human herpesvirus 1
agagucggagcccgcuggggcg

SEQ ID NO: 1756071 - RNA, 20 nt, Human herpesvirus 1
agccccggucuccccgggag

SEQ ID NO: 1756072 - RNA, 13 nt, Human herpesvirus 1
caugcggcugcag

SEQ ID NO: 1756073 - RNA, 12 nt, Human herpesvirus 1
cucucuucucuc

SEQ ID NO: 1756074 - RNA, 19 nt, Human herpesvirus 1
caaggcguccauucucccg

SEQ ID NO: 1756075 - RNA, 21 nt, Human herpesvirus 1
cccauccgaacgcagccccgc

SEQ ID NO: 1756076 - RNA, 16 nt, Human herpesvirus 1
guacucccaccagcug

SEQ ID NO: 1756077 - RNA, 24 nt, Human herpesvirus 1
cagccuggucgaggcggccgaggc

SEQ ID NO: 1756078 - RNA, 19 nt, Human herpesvirus 1
ccccuuaaugggugcgggg

SEQ ID NO: 1756079 - RNA, 23 nt, Human herpesvirus 1
gccgccaccauccucaagcaggc

SEQ ID NO: 1756080 - RNA, 14 nt, Human herpesvirus 1
aucccgaggcccca

SEQ ID NO: 1756081 - RNA, 15 nt, Human herpesvirus 1
gcggggggugggacc

SEQ ID NO: 1756082 - RNA, 12 nt, Human herpesvirus 1
cggccaccgcua

SEQ ID NO: 1756083 - RNA, 23 nt, Human herpesvirus 1
cccgucucgcugcccuucugucu

SEQ ID NO: 1756084 - RNA, 14 nt, Human herpesvirus 1
acccgacucaccuc

SEQ ID NO: 1756085 - RNA, 14 nt, Human herpesvirus 1
gacgccgugggcaa

SEQ ID NO: 1756086 - RNA, 16 nt, Human herpesvirus 1
cggaaacccguccggg

SEQ ID NO: 1756087 - RNA, 23 nt, Human herpesvirus 1
ccugagacaagagcgcucccccg

SEQ ID NO: 1756088 - RNA, 22 nt, Human herpesvirus 1
ucggccguuucuccgcccgacc

SEQ ID NO: 1756089 - RNA, 14 nt, Human herpesvirus 1
ccuggaccagcuga

SEQ ID NO: 1756090 - RNA, 22 nt, Human herpesvirus 1
accaagagacgucgccccugug

SEQ ID NO: 1756091 - RNA, 22 nt, Human herpesvirus 1
cgccccgugucugugggccaag

SEQ ID NO: 1756092 - RNA, 15 nt, Human herpesvirus 1
uccgggaugggcuac

SEQ ID NO: 1756093 - RNA, 16 nt, Human herpesvirus 1
gacccaaagcccucag

SEQ ID NO: 1756094 - RNA, 14 nt, Human herpesvirus 1
gugcuugagucugu

SEQ ID NO: 1756095 - RNA, 16 nt, Human herpesvirus 1
ccgggacuccgcggac

SEQ ID NO: 1756096 - RNA, 20 nt, Human herpesvirus 1
gcccauuuacguggcugggu

SEQ ID NO: 1756097 - RNA, 22 nt, Human herpesvirus 1
gaaugcagcgccggccuccccg

SEQ ID NO: 1756098 - RNA, 19 nt, Human herpesvirus 1
accaucccggguuaaugua

SEQ ID NO: 1756099 - RNA, 15 nt, Human herpesvirus 1
cugcgccuugggccc

SEQ ID NO: 1756100 - RNA, 20 nt, Human herpesvirus 1
acgggcggccacccccccgg

SEQ ID NO: 1756101 - RNA, 15 nt, Human herpesvirus 1
cgggaggauguguuu

SEQ ID NO: 1756102 - RNA, 12 nt, Human herpesvirus 1
cgagcagagccg

SEQ ID NO: 1756103 - RNA, 19 nt, Human herpesvirus 1
cguggccgacaacugccug

SEQ ID NO: 1756104 - RNA, 14 nt, Human herpesvirus 1
ggcccccgcccccg

SEQ ID NO: 1756105 - RNA, 12 nt, Human herpesvirus 1
gaggggggagau

SEQ ID NO: 1756106 - RNA, 17 nt, Human herpesvirus 1
gcggcucaacgagcucc

SEQ ID NO: 1756107 - RNA, 14 nt, Human herpesvirus 1
ucauccacaccuua

SEQ ID NO: 1756108 - RNA, 15 nt, Human herpesvirus 1
caacgaggguugggg

SEQ ID NO: 1756109 - RNA, 20 nt, Human herpesvirus 1
uuguggggaggggggggucg

SEQ ID NO: 1756110 - RNA, 14 nt, Human herpesvirus 1
augcggaaagcaag

SEQ ID NO: 1756111 - RNA, 19 nt, Human herpesvirus 1
gaucacggagggaaccacc

SEQ ID NO: 1756112 - RNA, 15 nt, Human herpesvirus 1
cgaccgacagcacuc

SEQ ID NO: 1756113 - RNA, 18 nt, Human herpesvirus 1
gcaauuugcacccagccu

SEQ ID NO: 1756114 - RNA, 16 nt, Human herpesvirus 1
caggucccccacacca

SEQ ID NO: 1756115 - RNA, 17 nt, Human herpesvirus 1
gggauggggagagccca

SEQ ID NO: 1756116 - RNA, 13 nt, Human herpesvirus 1
gccgggagcacca

SEQ ID NO: 1756117 - RNA, 11 nt, Human herpesvirus 1
ccuccccccgc

SEQ ID NO: 1756118 - RNA, 21 nt, Human herpesvirus 1
cgcgggcgacgccccggccgc

SEQ ID NO: 1756119 - RNA, 20 nt, Human herpesvirus 1
caaucccccccgaccggguu

SEQ ID NO: 1756120 - RNA, 14 nt, Human herpesvirus 1
gucgccccuguggc

SEQ ID NO: 1756121 - RNA, 14 nt, Human herpesvirus 1
uccgacgccccccg

SEQ ID NO: 1756122 - RNA, 20 nt, Human herpesvirus 1
ccccggauaugcgcgggguu

SEQ ID NO: 1756123 - RNA, 15 nt, Human herpesvirus 1
aucgggaugcugccc

SEQ ID NO: 1756124 - RNA, 15 nt, Human herpesvirus 1
cgcucccucagcauc

SEQ ID NO: 1756125 - RNA, 21 nt, Human herpesvirus 1
guccagggggaugcuagccug

SEQ ID NO: 1756126 - RNA, 23 nt, Human herpesvirus 1
agggccacucacgcauccccagu

SEQ ID NO: 1756127 - RNA, 22 nt, Human herpesvirus 1
gcacuugcggcaagacccgggc

SEQ ID NO: 1756128 - RNA, 18 nt, Human herpesvirus 1
ccgcuuuauaggccggga

SEQ ID NO: 1756129 - RNA, 15 nt, Human herpesvirus 1
ggcggcgaggccggc

SEQ ID NO: 1756130 - RNA, 11 nt, Human herpesvirus 1
auccccgcucc

SEQ ID NO: 1756131 - RNA, 14 nt, Human herpesvirus 1
uccccucugggccc

SEQ ID NO: 1756132 - RNA, 17 nt, Human herpesvirus 1
guacuggaugcgccgcc

SEQ ID NO: 1756133 - RNA, 17 nt, Human herpesvirus 1
gaugcgaucgagccgug

SEQ ID NO: 1756134 - RNA, 13 nt, Human herpesvirus 1
ccguccgaccgcc

SEQ ID NO: 1756135 - RNA, 17 nt, Human herpesvirus 1
ccuuaaccgcuggcugg

SEQ ID NO: 1756136 - RNA, 15 nt, Human herpesvirus 1
ccgaucgcagcgucc

SEQ ID NO: 1756137 - RNA, 20 nt, Human herpesvirus 1
gauccaaaaccacaaccucc

SEQ ID NO: 1756138 - RNA, 13 nt, Human herpesvirus 1
cgaagccccggcc

SEQ ID NO: 1756139 - RNA, 15 nt, Human herpesvirus 1
ggugggcguccugga

SEQ ID NO: 1756140 - RNA, 23 nt, Human herpesvirus 1
ugccaaagcgcccgucggucugc

SEQ ID NO: 1756141 - RNA, 17 nt, Human herpesvirus 1
gaccgcccgccccucgc

SEQ ID NO: 1756142 - RNA, 17 nt, Human herpesvirus 1
cgucucuggggagccuc

SEQ ID NO: 1756143 - RNA, 13 nt, Human herpesvirus 1
guuuucucuuccc

SEQ ID NO: 1756144 - RNA, 12 nt, Human herpesvirus 1
ccagggagcccc

SEQ ID NO: 1756145 - RNA, 20 nt, Human herpesvirus 1
ucagggcucuacccucugga

SEQ ID NO: 1756146 - RNA, 17 nt, Human herpesvirus 1
cgccgguuccucccgcu

SEQ ID NO: 1756147 - RNA, 15 nt, Human herpesvirus 1
gccgcggcucccggc

SEQ ID NO: 1756148 - RNA, 12 nt, Human herpesvirus 1
cuggccccggcg

SEQ ID NO: 1756149 - RNA, 16 nt, Human herpesvirus 1
gcgcugcucagcgcca

SEQ ID NO: 1756150 - RNA, 20 nt, Human herpesvirus 1
gcggcguccgcgccccucug

SEQ ID NO: 1756151 - RNA, 15 nt, Human herpesvirus 1
ggcccuccaggcugu

SEQ ID NO: 1756152 - RNA, 10 nt, Human herpesvirus 1
ccccaaggag

SEQ ID NO: 1756153 - RNA, 13 nt, Human herpesvirus 1
caaauaaagccac

SEQ ID NO: 1756154 - RNA, 15 nt, Human herpesvirus 1
cgcccgaccacacac

SEQ ID NO: 1756155 - RNA, 19 nt, Human herpesvirus 1
gcaggcgcugucuccccgg

SEQ ID NO: 1756156 - RNA, 22 nt, Human herpesvirus 1
ucaucgggggaguugugaucau

SEQ ID NO: 1756157 - RNA, 15 nt, Human herpesvirus 1
ggauuuggguugggg

SEQ ID NO: 1756158 - RNA, 17 nt, Human herpesvirus 1
ccauggcgggacugggc

SEQ ID NO: 1756159 - RNA, 22 nt, Human herpesvirus 1
ggucgcccgucucugcuacgcc

SEQ ID NO: 1756160 - RNA, 15 nt, Human herpesvirus 1
aacgcgcuggggcug

SEQ ID NO: 1756161 - RNA, 12 nt, Human herpesvirus 1
ugggcauccagg

SEQ ID NO: 1756162 - RNA, 21 nt, Human herpesvirus 1
ccgcggcuucaucgcgccccu

SEQ ID NO: 1756163 - RNA, 18 nt, Human herpesvirus 1
uacaccggccacccaggu

SEQ ID NO: 1756164 - RNA, 13 nt, Human herpesvirus 1
cccgccccggagg

SEQ ID NO: 1756165 - RNA, 13 nt, Human herpesvirus 1
uccccuucccucc

SEQ ID NO: 1756166 - RNA, 15 nt, Human herpesvirus 1
gcgcccacuacacca

SEQ ID NO: 1756167 - RNA, 19 nt, Human herpesvirus 1
cugcucagcgccaagguca

SEQ ID NO: 1756168 - RNA, 21 nt, Human herpesvirus 1
ggcggucagcgagacgaccuc

SEQ ID NO: 1756169 - RNA, 16 nt, Human herpesvirus 1
cacuguuuuccgcccc

SEQ ID NO: 1756170 - RNA, 19 nt, Human herpesvirus 1
cacaugcggaaagcaagaa

SEQ ID NO: 1756171 - RNA, 16 nt, Human herpesvirus 1
guggucucuggccgcg

SEQ ID NO: 1756172 - RNA, 17 nt, Human herpesvirus 1
cggcaagauccucgggc

SEQ ID NO: 1756173 - RNA, 18 nt, Human herpesvirus 1
ugcaccgguucucccugu

SEQ ID NO: 1756174 - RNA, 14 nt, Human herpesvirus 1
gccucccccugagc

SEQ ID NO: 1756175 - RNA, 18 nt, Human herpesvirus 1
accagcugagccgcgccg

SEQ ID NO: 1756176 - RNA, 18 nt, Human herpesvirus 1
cggcgccucuggacugga

SEQ ID NO: 1756177 - RNA, 13 nt, Human herpesvirus 1
aggagcccgcccu

SEQ ID NO: 1756178 - RNA, 20 nt, Human herpesvirus 1
accaggucccccacaccacc

SEQ ID NO: 1756179 - RNA, 11 nt, Human herpesvirus 1
gucucuggccg

SEQ ID NO: 1756180 - RNA, 17 nt, Human herpesvirus 1
ggcaccgcaccagcgcg

SEQ ID NO: 1756181 - RNA, 19 nt, Human herpesvirus 1
ucccacacucucugggcgg

SEQ ID NO: 1756182 - RNA, 13 nt, Human herpesvirus 1
ccaggucccaccu

SEQ ID NO: 1756183 - RNA, 17 nt, Human herpesvirus 1
accgacucucccaccgc

SEQ ID NO: 1756184 - RNA, 24 nt, Human herpesvirus 1
uugguauagguccacggccacugg

SEQ ID NO: 1756185 - RNA, 13 nt, Human herpesvirus 1
uacacagccaccc

SEQ ID NO: 1756186 - RNA, 15 nt, Human herpesvirus 1
cggcugguccacacc

SEQ ID NO: 1756187 - RNA, 15 nt, Human herpesvirus 1
aucauaaccacgccc

SEQ ID NO: 1756188 - RNA, 15 nt, Human herpesvirus 1
cuucggggcccggcc

SEQ ID NO: 1756189 - RNA, 14 nt, Human herpesvirus 1
cguguuugugggga

SEQ ID NO: 1756190 - RNA, 12 nt, Human herpesvirus 1
aaggccugggau

SEQ ID NO: 1756191 - RNA, 19 nt, Human herpesvirus 1
aagacccccccggagccgg

SEQ ID NO: 1756192 - RNA, 19 nt, Human herpesvirus 1
gacaugaccgcccgccccu

SEQ ID NO: 1756193 - RNA, 22 nt, Human herpesvirus 1
accccaguccccgggcccagcc

SEQ ID NO: 1756194 - RNA, 16 nt, Human herpesvirus 1
accacgugcacagccu

SEQ ID NO: 1756195 - RNA, 21 nt, Human herpesvirus 1
gggcgggggauggggagagcc

SEQ ID NO: 1756196 - RNA, 22 nt, Human herpesvirus 1
gcuccgacgacgcgcagccggc

SEQ ID NO: 1756197 - RNA, 20 nt, Human herpesvirus 1
aacuucaucacccccgaguu

SEQ ID NO: 1756198 - RNA, 16 nt, Human herpesvirus 1
gaggcgccugccccgc

SEQ ID NO: 1756199 - RNA, 17 nt, Human herpesvirus 1
acggcgaaugcagcgcc

SEQ ID NO: 1756200 - RNA, 14 nt, Human herpesvirus 1
agacccaacccccg

SEQ ID NO: 1756201 - RNA, 21 nt, Human herpesvirus 1
caaccccagggaccuccugga

SEQ ID NO: 1756202 - RNA, 14 nt, Human herpesvirus 1
cacccccgcccggg

SEQ ID NO: 1756203 - RNA, 19 nt, Human herpesvirus 1
gcgcuggguggucucuggc

SEQ ID NO: 1756204 - RNA, 19 nt, Human herpesvirus 1
ggcgacgccgugggcaaug

SEQ ID NO: 1756205 - RNA, 12 nt, Human herpesvirus 1
cccacgccgccu

SEQ ID NO: 1756206 - RNA, 14 nt, Human herpesvirus 1
uagggaacccagag

SEQ ID NO: 1756207 - RNA, 15 nt, Human herpesvirus 1
cgccaugcuggcgga

SEQ ID NO: 1756208 - RNA, 16 nt, Human herpesvirus 1
gaacgcggaccccccc

SEQ ID NO: 1756209 - RNA, 20 nt, Human herpesvirus 1
agaacaauaaaggcgguggu

SEQ ID NO: 1756210 - RNA, 15 nt, Human herpesvirus 1
cuggggcccccaggg

SEQ ID NO: 1756211 - RNA, 16 nt, Human herpesvirus 1
ccccggaggggcuccu

SEQ ID NO: 1756212 - RNA, 13 nt, Human herpesvirus 1
gcaggauggagag

SEQ ID NO: 1756213 - RNA, 15 nt, Human herpesvirus 1
cggcaugccucugcg

SEQ ID NO: 1756214 - RNA, 20 nt, Human herpesvirus 1
ccguccgcaucgauccggag

SEQ ID NO: 1756215 - RNA, 13 nt, Human herpesvirus 1
acccugcugcagg

SEQ ID NO: 1756216 - RNA, 14 nt, Human herpesvirus 1
gagcgcccuccuga

SEQ ID NO: 1756217 - RNA, 15 nt, Human herpesvirus 1
gagcaccacauaacc

SEQ ID NO: 1756218 - RNA, 11 nt, Human herpesvirus 1
ccaggaucaca

SEQ ID NO: 1756219 - RNA, 17 nt, Human herpesvirus 1
ggaaccugcucacgacc

SEQ ID NO: 1756220 - RNA, 19 nt, Human herpesvirus 1
gacccccuuguaugucccc

SEQ ID NO: 1756221 - RNA, 21 nt, Human herpesvirus 1
cggccacgcaaaaccaggccg

SEQ ID NO: 1756222 - RNA, 23 nt, Human herpesvirus 1
gcggguugcugcgcggcguccgc

SEQ ID NO: 1756223 - RNA, 14 nt, Human herpesvirus 1
ccgucgaagcugau

SEQ ID NO: 1756224 - RNA, 18 nt, Human herpesvirus 1
gcccaccggaagcccaac

SEQ ID NO: 1756225 - RNA, 16 nt, Human herpesvirus 1
cgucgcugugaugaag

SEQ ID NO: 1756226 - RNA, 14 nt, Human herpesvirus 1
guccugacggccaa

SEQ ID NO: 1756227 - RNA, 14 nt, Human herpesvirus 1
aucgguccccucug

SEQ ID NO: 1756228 - RNA, 22 nt, Human herpesvirus 1
ccaucgccucggccaccguggg

SEQ ID NO: 1756229 - RNA, 20 nt, Human herpesvirus 1
ccgugggcgacugcgacccc

SEQ ID NO: 1756230 - RNA, 17 nt, Human herpesvirus 1
cuggccccaguccccaa

SEQ ID NO: 1756231 - RNA, 17 nt, Human herpesvirus 1
ggcccgcgggaggccgc

SEQ ID NO: 1756232 - RNA, 16 nt, Human herpesvirus 1
cagaacucgccccgga

SEQ ID NO: 1756233 - RNA, 15 nt, Human herpesvirus 1
uggagggugucccag

SEQ ID NO: 1756234 - RNA, 20 nt, Human herpesvirus 1
ugcgguucguucuggacggg

SEQ ID NO: 1756235 - RNA, 15 nt, Human herpesvirus 1
gaccggauggaggag

SEQ ID NO: 1756236 - RNA, 15 nt, Human herpesvirus 1
aagaccaaaaucaaa

SEQ ID NO: 1756237 - RNA, 14 nt, Human herpesvirus 1
gcgagcccagaccc

SEQ ID NO: 1756238 - RNA, 22 nt, Human herpesvirus 1
ggaacacgccuaccggccccug

SEQ ID NO: 1756239 - RNA, 19 nt, Human herpesvirus 1
gacccgcaucccccgucug

SEQ ID NO: 1756240 - RNA, 16 nt, Human herpesvirus 1
gcugcuccgccuggcc

SEQ ID NO: 1756241 - RNA, 18 nt, Human herpesvirus 1
cccgcgugcaacgcggga

SEQ ID NO: 1756242 - RNA, 22 nt, Human herpesvirus 1
agggggggggggcauuucagug

SEQ ID NO: 1756243 - RNA, 19 nt, Human herpesvirus 1
gccccggaagaccccgagg

SEQ ID NO: 1756244 - RNA, 15 nt, Human herpesvirus 1
gugcucgacagccac

SEQ ID NO: 1756245 - RNA, 13 nt, Human herpesvirus 1
cucccccaccgcc

SEQ ID NO: 1756246 - RNA, 22 nt, Human herpesvirus 1
caucggacccccccucgcgcca

SEQ ID NO: 1756247 - RNA, 16 nt, Human herpesvirus 1
acucccgacaccacca

SEQ ID NO: 1756248 - RNA, 19 nt, Human herpesvirus 1
gccuggcugacccacgcgg

SEQ ID NO: 1756249 - RNA, 21 nt, Human herpesvirus 1
gaagcucgaacgcggguggga

SEQ ID NO: 1756250 - RNA, 13 nt, Human herpesvirus 1
gacgguggugccc

SEQ ID NO: 1756251 - RNA, 21 nt, Human herpesvirus 1
cuauuuucccccccgggccgc

SEQ ID NO: 1756252 - RNA, 20 nt, Human herpesvirus 1
ccacgcccuuccccacggga

SEQ ID NO: 1756253 - RNA, 19 nt, Human herpesvirus 1
gcuccgacgacgcgcagcc

SEQ ID NO: 1756254 - RNA, 23 nt, Human herpesvirus 1
ccagggcacccaaggggccgugc

SEQ ID NO: 1756255 - RNA, 22 nt, Human herpesvirus 1
ucugucucgucuccucuucucc

SEQ ID NO: 1756256 - RNA, 15 nt, Human herpesvirus 1
ccagauaauccagau

SEQ ID NO: 1756257 - RNA, 16 nt, Human herpesvirus 1
ccaccgacagccugaa

SEQ ID NO: 1756258 - RNA, 22 nt, Human herpesvirus 1
aacgcaacggcgggagcugggu

SEQ ID NO: 1756259 - RNA, 13 nt, Human herpesvirus 1
agccccggacccc

SEQ ID NO: 1756260 - RNA, 17 nt, Human herpesvirus 1
gaccuguugauggccug

SEQ ID NO: 1756261 - RNA, 16 nt, Human herpesvirus 1
uggaggacggcgccgg

SEQ ID NO: 1756262 - RNA, 12 nt, Human herpesvirus 1
gucgucucucuu

SEQ ID NO: 1756263 - RNA, 11 nt, Human herpesvirus 1
gcuacgacauc

SEQ ID NO: 1756264 - RNA, 19 nt, Human herpesvirus 1
agucucugggggccugucc

SEQ ID NO: 1756265 - RNA, 21 nt, Human herpesvirus 1
acccgugacacccuaccccag

SEQ ID NO: 1756266 - RNA, 22 nt, Human herpesvirus 1
uccggcagggggaugggggggc

SEQ ID NO: 1756267 - RNA, 12 nt, Human herpesvirus 1
gcgaccuggggu

SEQ ID NO: 1756268 - RNA, 11 nt, Human herpesvirus 1
ccccccccuuc

SEQ ID NO: 1756269 - RNA, 15 nt, Human herpesvirus 1
cgugcacagccuggc

SEQ ID NO: 1756270 - RNA, 19 nt, Human herpesvirus 1
gcccaguaacaugcgcacg

SEQ ID NO: 1756271 - RNA, 16 nt, Human herpesvirus 1
gugaccgcgugcccac

SEQ ID NO: 1756272 - RNA, 22 nt, Human herpesvirus 1
cucugggucugugccaccagcc

SEQ ID NO: 1756273 - RNA, 13 nt, Human herpesvirus 1
gggcucggcuccc

SEQ ID NO: 1756274 - RNA, 15 nt, Human herpesvirus 1
gaccggggucccagc

SEQ ID NO: 1756275 - RNA, 19 nt, Human herpesvirus 1
acgaguccauccugcggcu

SEQ ID NO: 1756276 - RNA, 14 nt, Human herpesvirus 1
ccugcgcuucgccg

SEQ ID NO: 1756277 - RNA, 17 nt, Human herpesvirus 1
cggcccccgaggccagc

SEQ ID NO: 1756278 - RNA, 19 nt, Human herpesvirus 1
uccggcgcgcgucucuggg

SEQ ID NO: 1756279 - RNA, 22 nt, Human herpesvirus 1
acccuggcgccaaagcugcugg

SEQ ID NO: 1756280 - RNA, 22 nt, Human herpesvirus 1
ugcgauucuuuuaucccacgcg

SEQ ID NO: 1756281 - RNA, 22 nt, Human herpesvirus 1
cacggguggccgggcguugggg

SEQ ID NO: 1756282 - RNA, 18 nt, Human herpesvirus 1
cgcuggucgucgggcgcc

SEQ ID NO: 1756283 - RNA, 16 nt, Human herpesvirus 1
gucgcgcuccucugcg

SEQ ID NO: 1756284 - RNA, 17 nt, Human herpesvirus 1
gcgucgacgucgcgccu

SEQ ID NO: 1756285 - RNA, 21 nt, Human herpesvirus 1
ugcuccgccgcggaucgggcc

SEQ ID NO: 1756286 - RNA, 17 nt, Human herpesvirus 1
cggcgcgagcucccugc

SEQ ID NO: 1756287 - RNA, 23 nt, Human herpesvirus 1
agcggccauggcccgccucggag

SEQ ID NO: 1756288 - RNA, 18 nt, Human herpesvirus 1
aucaccaaccacccgggg

SEQ ID NO: 1756289 - RNA, 18 nt, Human herpesvirus 1
gcaccuccccagcggcca

SEQ ID NO: 1756290 - RNA, 15 nt, Human herpesvirus 1
cgaccaucacccgag

SEQ ID NO: 1756291 - RNA, 15 nt, Human herpesvirus 1
agggagaaaccccag

SEQ ID NO: 1756292 - RNA, 19 nt, Human herpesvirus 1
cccgcaacgcgcuggggcu

SEQ ID NO: 1756293 - RNA, 17 nt, Human herpesvirus 1
accccaaauacagcaug

SEQ ID NO: 1756294 - RNA, 16 nt, Human herpesvirus 1
accagcuacgccgccg

SEQ ID NO: 1756295 - RNA, 17 nt, Human herpesvirus 1
cgccagcgcggcggggc

SEQ ID NO: 1756296 - RNA, 18 nt, Human herpesvirus 1
cgcggcguccgcgccccu

SEQ ID NO: 1756297 - RNA, 14 nt, Human herpesvirus 1
ccgccucggagccg

SEQ ID NO: 1756298 - RNA, 14 nt, Human herpesvirus 1
guacucgacccacu

SEQ ID NO: 1756299 - RNA, 17 nt, Human herpesvirus 1
gcuccugcgacccgaaa

SEQ ID NO: 1756300 - RNA, 14 nt, Human herpesvirus 1
ggcgcggugccuga

SEQ ID NO: 1756301 - RNA, 21 nt, Human herpesvirus 1
gaccguuuggggcgugucugu

SEQ ID NO: 1756302 - RNA, 20 nt, Human herpesvirus 1
ggaccacgugcacagccugg

SEQ ID NO: 1756303 - RNA, 11 nt, Human herpesvirus 1
ggugcuccgcc

SEQ ID NO: 1756304 - RNA, 19 nt, Human herpesvirus 1
cuuuuuuuauugggaggcg

SEQ ID NO: 1756305 - RNA, 21 nt, Human herpesvirus 1
cggacaacauccccccgacca

SEQ ID NO: 1756306 - RNA, 15 nt, Human herpesvirus 1
cagcccucccgaccg

SEQ ID NO: 1756307 - RNA, 16 nt, Human herpesvirus 1
ccaacgccuccccugu

SEQ ID NO: 1756308 - RNA, 21 nt, Human herpesvirus 1
gcauucgggccugccugcggc

SEQ ID NO: 1756309 - RNA, 17 nt, Human herpesvirus 1
cacugcacucccugccg

SEQ ID NO: 1756310 - RNA, 17 nt, Human herpesvirus 1
agccccgcauaucccac

SEQ ID NO: 1756311 - RNA, 19 nt, Human herpesvirus 1
gccgacucccggcuugccg

SEQ ID NO: 1756312 - RNA, 16 nt, Human herpesvirus 1
cgcucccucgaccacc

SEQ ID NO: 1756313 - RNA, 21 nt, Human herpesvirus 1
cuucauccccgagaaccagcg

SEQ ID NO: 1756314 - RNA, 19 nt, Human herpesvirus 1
gacgcccccucccuguuug

SEQ ID NO: 1756315 - RNA, 14 nt, Human herpesvirus 1
cuccuggcagcccu

SEQ ID NO: 1756316 - RNA, 18 nt, Human herpesvirus 1
ccgguuggccgcgcggca

SEQ ID NO: 1756317 - RNA, 15 nt, Human herpesvirus 1
gcucccucgaccacc

SEQ ID NO: 1756318 - RNA, 14 nt, Human herpesvirus 1
cauggccaugacgg

SEQ ID NO: 1756319 - RNA, 19 nt, Human herpesvirus 1
gaaccuagggaacccagag

SEQ ID NO: 1756320 - RNA, 16 nt, Human herpesvirus 1
ucaccaaccacccggg

SEQ ID NO: 1756321 - RNA, 22 nt, Human herpesvirus 1
guggagcaaaacgccucccccu

SEQ ID NO: 1756322 - RNA, 13 nt, Human herpesvirus 1
caccccccaugcc

SEQ ID NO: 1756323 - RNA, 16 nt, Human herpesvirus 1
uggggacgguggcgcc

SEQ ID NO: 1756324 - RNA, 12 nt, Human herpesvirus 1
cgacgucugucg

SEQ ID NO: 1756325 - RNA, 13 nt, Human herpesvirus 1
cucguuugccgcc

SEQ ID NO: 1756326 - RNA, 22 nt, Human herpesvirus 1
cugcgggccgcgguggacagcc

SEQ ID NO: 1756327 - RNA, 18 nt, Human herpesvirus 1
cugaaccccagccccaga

SEQ ID NO: 1756328 - RNA, 19 nt, Human herpesvirus 1
agucuucggggcccggccc

SEQ ID NO: 1756329 - RNA, 22 nt, Human herpesvirus 1
gcgccggguggcgccugugugu

SEQ ID NO: 1756330 - RNA, 22 nt, Human herpesvirus 1
ugugcuuucuggugcugucuga

SEQ ID NO: 1756331 - RNA, 22 nt, Human herpesvirus 1
ggccacggguguggggacccgc

SEQ ID NO: 1756332 - RNA, 15 nt, Human herpesvirus 1
gucccccuggaggug

SEQ ID NO: 1756333 - RNA, 21 nt, Human herpesvirus 1
gaccacgcccuuccccacggg

SEQ ID NO: 1756334 - RNA, 14 nt, Human herpesvirus 1
ggggauggggagag

SEQ ID NO: 1756335 - RNA, 20 nt, Human herpesvirus 1
uccgcaccaagccgcucucc

SEQ ID NO: 1756336 - RNA, 16 nt, Human herpesvirus 1
ccugaugcacgccccc

SEQ ID NO: 1756337 - RNA, 18 nt, Human herpesvirus 1
acgccauacacagccacc

SEQ ID NO: 1756338 - RNA, 20 nt, Human herpesvirus 1
gggccauguugggccgccac

SEQ ID NO: 1756339 - RNA, 16 nt, Human herpesvirus 1
cuggaaguaccugcag

SEQ ID NO: 1756340 - RNA, 15 nt, Human herpesvirus 1
guuacgcgggccccg

SEQ ID NO: 1756341 - RNA, 15 nt, Human herpesvirus 1
uggaucggcgccaug

SEQ ID NO: 1756342 - RNA, 15 nt, Human herpesvirus 1
cggccgcccuucccg

SEQ ID NO: 1756343 - RNA, 18 nt, Human herpesvirus 1
gggcuggcacaccaccga

SEQ ID NO: 1756344 - RNA, 22 nt, Human herpesvirus 1
cggcucuccgaucccaacuccu

SEQ ID NO: 1756345 - RNA, 18 nt, Human herpesvirus 1
cacauaaauuuggcuggu

SEQ ID NO: 1756346 - RNA, 19 nt, Human herpesvirus 1
gccucaacauaccccgcug

SEQ ID NO: 1756347 - RNA, 17 nt, Human herpesvirus 1
ggaggaaacccccgacc

SEQ ID NO: 1756348 - RNA, 16 nt, Human herpesvirus 1
ucgggcgccaaagccc

SEQ ID NO: 1756349 - RNA, 13 nt, Human herpesvirus 1
cuaagugcccagg

SEQ ID NO: 1756350 - RNA, 13 nt, Human herpesvirus 1
agcgaaggcugcc

SEQ ID NO: 1756351 - RNA, 22 nt, Human herpesvirus 1
gauggccauagccgccgaaggg

SEQ ID NO: 1756352 - RNA, 16 nt, Human herpesvirus 1
ccauccugcggcucgu

SEQ ID NO: 1756353 - RNA, 13 nt, Human herpesvirus 1
ucgagaugagcca

SEQ ID NO: 1756354 - RNA, 18 nt, Human herpesvirus 1
aguuuguggacccaaagc

SEQ ID NO: 1756355 - RNA, 22 nt, Human herpesvirus 1
cgucugggcccgacagaccucc

SEQ ID NO: 1756356 - RNA, 13 nt, Human herpesvirus 1
ccagggcggggcu

SEQ ID NO: 1756357 - RNA, 15 nt, Human herpesvirus 1
gcucggcggcagccc

SEQ ID NO: 1756358 - RNA, 23 nt, Human herpesvirus 1
gcaauuucaccgccccagcaccg

SEQ ID NO: 1756359 - RNA, 23 nt, Human herpesvirus 1
auauuuuucaauaaaaggcauua

SEQ ID NO: 1756360 - RNA, 22 nt, Human herpesvirus 1
ccgacggcccgaagccugcugu

SEQ ID NO: 1756361 - RNA, 16 nt, Human herpesvirus 1
gucuucggggcccggc

SEQ ID NO: 1756362 - RNA, 20 nt, Human herpesvirus 1
caggggccauguugggccgc

SEQ ID NO: 1756363 - RNA, 17 nt, Human herpesvirus 1
ugaguacgaggaucugu

SEQ ID NO: 1756364 - RNA, 15 nt, Human herpesvirus 1
ccucgaccaccaucc

SEQ ID NO: 1756365 - RNA, 12 nt, Human herpesvirus 1
ggggggcuuccg

SEQ ID NO: 1756366 - RNA, 23 nt, Human herpesvirus 1
gaaacucggccgucccggggcag

SEQ ID NO: 1756367 - RNA, 13 nt, Human herpesvirus 1
aggaggccgccac

SEQ ID NO: 1756368 - RNA, 12 nt, Human herpesvirus 1
cucgcaccagcc

SEQ ID NO: 1756369 - RNA, 20 nt, Human herpesvirus 1
uaaauuccggaaggggacac

SEQ ID NO: 1756370 - RNA, 21 nt, Human herpesvirus 1
gccccgcauaucccacccugg

SEQ ID NO: 1756371 - RNA, 21 nt, Human herpesvirus 1
auggguugugguuauaugcac

SEQ ID NO: 1756372 - RNA, 16 nt, Human herpesvirus 1
acgcgcgcgaccucac

SEQ ID NO: 1756373 - RNA, 18 nt, Human herpesvirus 1
gcucuccccugcugccau

SEQ ID NO: 1756374 - RNA, 18 nt, Human herpesvirus 1
cagccuguuuguccuggg

SEQ ID NO: 1756375 - RNA, 14 nt, Human herpesvirus 1
acuggccgggagca

SEQ ID NO: 1756376 - RNA, 18 nt, Human herpesvirus 1
ccuggcgagcccagaccc

SEQ ID NO: 1756377 - RNA, 20 nt, Human herpesvirus 1
gucccgcaauuucaccgccc

SEQ ID NO: 1756378 - RNA, 17 nt, Human herpesvirus 1
guccuggccggccuggc

SEQ ID NO: 1756379 - RNA, 18 nt, Human herpesvirus 1
gacccggcccuaacccca

SEQ ID NO: 1756380 - RNA, 23 nt, Human herpesvirus 1
gccgaggucccgugcaacccuua

SEQ ID NO: 1756381 - RNA, 14 nt, Human herpesvirus 1
auaaaagaccaaaa

SEQ ID NO: 1756382 - RNA, 14 nt, Human herpesvirus 1
cccggucgccgagc

SEQ ID NO: 1756383 - RNA, 22 nt, Human herpesvirus 1
cggcauggugaucgccugucuc

SEQ ID NO: 1756384 - RNA, 18 nt, Human herpesvirus 1
ggcauggggggggggcgg

SEQ ID NO: 1756385 - RNA, 13 nt, Human herpesvirus 1
ucacggcaaggag

SEQ ID NO: 1756386 - RNA, 17 nt, Human herpesvirus 1
gccccccgcugcggcca

SEQ ID NO: 1756387 - RNA, 13 nt, Human herpesvirus 1
ccaacuccagacc

SEQ ID NO: 1756388 - RNA, 13 nt, Human herpesvirus 1
ccuggaccagcug

SEQ ID NO: 1756389 - RNA, 13 nt, Human herpesvirus 1
gcagucccugagu

SEQ ID NO: 1756390 - RNA, 16 nt, Human herpesvirus 1
cccgaggccccacguc

SEQ ID NO: 1756391 - RNA, 13 nt, Human herpesvirus 1
gcgaaggcugccg

SEQ ID NO: 1756392 - RNA, 18 nt, Human herpesvirus 1
ggccgcgguggacagcca

SEQ ID NO: 1756393 - RNA, 19 nt, Human herpesvirus 1
gguccccucugggcccgcc

SEQ ID NO: 1756394 - RNA, 21 nt, Human herpesvirus 1
cugagccgcgccgacaucacc

SEQ ID NO: 1756395 - RNA, 16 nt, Human herpesvirus 1
gaucgcgcucgucacc

SEQ ID NO: 1756396 - RNA, 23 nt, Human herpesvirus 1
ccucugggucugugccaccagcc

SEQ ID NO: 1756397 - RNA, 16 nt, Human herpesvirus 1
cuggucagaggcccac

SEQ ID NO: 1756398 - RNA, 15 nt, Human herpesvirus 1
cacaacgccagccug

SEQ ID NO: 1756399 - RNA, 15 nt, Human herpesvirus 1
ucgggcgccaaagcc

SEQ ID NO: 1756400 - RNA, 20 nt, Human herpesvirus 1
ggcacgcccccuacgaggac

SEQ ID NO: 1756401 - RNA, 19 nt, Human herpesvirus 1
cccccuuguauguccccaa

SEQ ID NO: 1756402 - RNA, 13 nt, Human herpesvirus 1
ggaacgaggcccg

SEQ ID NO: 1756403 - RNA, 18 nt, Human herpesvirus 1
gcucccagagaccccagg

SEQ ID NO: 1756404 - RNA, 21 nt, Human herpesvirus 1
gccggcguuucugaccugcac

SEQ ID NO: 1756405 - RNA, 19 nt, Human herpesvirus 1
gcgccgcaaccagcugcac

SEQ ID NO: 1756406 - RNA, 21 nt, Human herpesvirus 1
ucuacccucuggacgcccggg

SEQ ID NO: 1756407 - RNA, 12 nt, Human herpesvirus 1
aggcgcuucccc

SEQ ID NO: 1756408 - RNA, 13 nt, Human herpesvirus 1
cgccugccccgcc

SEQ ID NO: 1756409 - RNA, 20 nt, Human herpesvirus 1
cccccggugccaauaaaccc

SEQ ID NO: 1756410 - RNA, 20 nt, Human herpesvirus 1
ggcccacgaucaccgcggga

SEQ ID NO: 1756411 - RNA, 17 nt, Human herpesvirus 1
ccccuuccccgcuguca

SEQ ID NO: 1756412 - RNA, 22 nt, Human herpesvirus 1
acgccgccaccguggccggccu

SEQ ID NO: 1756413 - RNA, 15 nt, Human herpesvirus 1
cgacccgaagcugcu

SEQ ID NO: 1756414 - RNA, 15 nt, Human herpesvirus 1
gcgguccugacggcc

SEQ ID NO: 1756415 - RNA, 21 nt, Human herpesvirus 1
acagggcgggccgccucgggg

SEQ ID NO: 1756416 - RNA, 15 nt, Human herpesvirus 1
uggacgcccgggcgc

SEQ ID NO: 1756417 - RNA, 15 nt, Human herpesvirus 1
uggagagcgaaggcu

SEQ ID NO: 1756418 - RNA, 12 nt, Human herpesvirus 1
uggccagcggcc

SEQ ID NO: 1756419 - RNA, 15 nt, Human herpesvirus 1
uggccagcggcccgg

SEQ ID NO: 1756420 - RNA, 21 nt, Human herpesvirus 1
uggccaggggcauccgggacc

SEQ ID NO: 1756421 - RNA, 20 nt, Human herpesvirus 1
uggcccccggacccgggccg

SEQ ID NO: 1756422 - RNA, 15 nt, Human herpesvirus 1
uggcauucgacgaca

SEQ ID NO: 1756423 - RNA, 15 nt, Human herpesvirus 1
uggcacaccgguccc

SEQ ID NO: 1756424 - RNA, 21 nt, Human herpesvirus 1
uggcccuggcggacggcggcc

SEQ ID NO: 1756425 - RNA, 17 nt, Human herpesvirus 1
cgggauccucggccagc

SEQ ID NO: 1756426 - RNA, 22 nt, Human herpesvirus 1
cgggcaaguaugccccccuggc

SEQ ID NO: 1756427 - RNA, 19 nt, Human herpesvirus 1
cgggccccggggagacagc

SEQ ID NO: 1756428 - RNA, 22 nt, Human herpesvirus 1
cgggccccggggagacagcgcc

SEQ ID NO: 1756429 - RNA, 18 nt, Human herpesvirus 1
cgggcaucggaacacgcc

SEQ ID NO: 1756430 - RNA, 18 nt, Human herpesvirus 1
cgggccacgccacccugc

SEQ ID NO: 1756431 - RNA, 21 nt, Human herpesvirus 1
cgggccacgccacccugcgcg

SEQ ID NO: 1756432 - RNA, 17 nt, Human herpesvirus 1
cgggccgccucgggggc

SEQ ID NO: 1756433 - RNA, 21 nt, Human herpesvirus 1
cgggccgugauuccucuccgc

SEQ ID NO: 1756434 - RNA, 19 nt, Human herpesvirus 1
cggcuguagcgccccggcg

SEQ ID NO: 1756435 - RNA, 15 nt, Human herpesvirus 1
cggcggccccuggcg

SEQ ID NO: 1756436 - RNA, 16 nt, Human herpesvirus 1
cggcggacccccggag

SEQ ID NO: 1756437 - RNA, 19 nt, Human herpesvirus 1
cggcguccgcgccccucug

SEQ ID NO: 1756438 - RNA, 16 nt, Human herpesvirus 1
cggcgugggcgcguuu

SEQ ID NO: 1756439 - RNA, 16 nt, Human herpesvirus 1
cggcgagguggacguc

SEQ ID NO: 1756440 - RNA, 21 nt, Human herpesvirus 1
cggcgccggggcucucggggc

SEQ ID NO: 1756441 - RNA, 23 nt, Human herpesvirus 1
cggcgcgacaacgagcccccgcc

SEQ ID NO: 1756442 - RNA, 20 nt, Human herpesvirus 1
cggcgcgcuucuacccgugu

SEQ ID NO: 1756443 - RNA, 10 nt, Human herpesvirus 1
cggcgcggcc

SEQ ID NO: 1756444 - RNA, 20 nt, Human herpesvirus 1
cggcgccgcccgccccuggc

SEQ ID NO: 1756445 - RNA, 15 nt, Human herpesvirus 1
cggcgcuggcggcca

SEQ ID NO: 1756446 - RNA, 17 nt, Human herpesvirus 1
cggccgcgacccaggcg

SEQ ID NO: 1756447 - RNA, 18 nt, Human herpesvirus 1
cggccggauucccgggcc

SEQ ID NO: 1756448 - RNA, 17 nt, Human herpesvirus 1
cggccguugucuccccg

SEQ ID NO: 1756449 - RNA, 13 nt, Human herpesvirus 1
cggccuccgcgua

SEQ ID NO: 1756450 - RNA, 20 nt, Human herpesvirus 1
cggccacgcaaaaccaggcc

SEQ ID NO: 1756451 - RNA, 17 nt, Human herpesvirus 1
cggccgccacccaggcg

SEQ ID NO: 1756452 - RNA, 13 nt, Human herpesvirus 1
cggccgccgcgga

SEQ ID NO: 1756453 - RNA, 20 nt, Human herpesvirus 1
cggccugggucuuccgcgga

SEQ ID NO: 1756454 - RNA, 14 nt, Human herpesvirus 1
cggcgaccgccagc

SEQ ID NO: 1756455 - RNA, 16 nt, Human herpesvirus 1
cggcgaccgccagccg

SEQ ID NO: 1756456 - RNA, 20 nt, Human herpesvirus 1
cggcgacuuugacgaggcca

SEQ ID NO: 1756457 - RNA, 17 nt, Human herpesvirus 1
cggcgcccaccccgugu

SEQ ID NO: 1756458 - RNA, 16 nt, Human herpesvirus 1
cggccaaccagcgucc

SEQ ID NO: 1756459 - RNA, 16 nt, Human herpesvirus 1
cggccaacgccgcgac

SEQ ID NO: 1756460 - RNA, 18 nt, Human herpesvirus 1
cggccacacagccggcca

SEQ ID NO: 1756461 - RNA, 14 nt, Human herpesvirus 1
cggcccacccuggc

SEQ ID NO: 1756462 - RNA, 15 nt, Human herpesvirus 1
cggcccacccuggcg

SEQ ID NO: 1756463 - RNA, 23 nt, Human herpesvirus 1
cggccccgcgucuggccccggcg

SEQ ID NO: 1756464 - RNA, 18 nt, Human herpesvirus 1
cggccccugggccccggg

SEQ ID NO: 1756465 - RNA, 14 nt, Human herpesvirus 1
gcccgccccucgcc

SEQ ID NO: 1756466 - RNA, 17 nt, Human herpesvirus 1
gcccgaagacacccccc

SEQ ID NO: 1756467 - RNA, 18 nt, Human herpesvirus 1
gcccgaagacacccccca

SEQ ID NO: 1756468 - RNA, 19 nt, Human herpesvirus 1
gcccgaccacacacccccc

SEQ ID NO: 1756469 - RNA, 20 nt, Human herpesvirus 1
gcccgaccacacacccccca

SEQ ID NO: 1756470 - RNA, 22 nt, Human herpesvirus 1
gccccgaacccugcgguccgga

SEQ ID NO: 1756471 - RNA, 20 nt, Human herpesvirus 1
gccccgauggcccuggacgc

SEQ ID NO: 1756472 - RNA, 23 nt, Human herpesvirus 1
gccccgauggcccuggacgcggc

SEQ ID NO: 1756473 - RNA, 18 nt, Human herpesvirus 1
gccccggaccccacgcac

SEQ ID NO: 1756474 - RNA, 16 nt, Human herpesvirus 1
gccccggccgccuggu

SEQ ID NO: 1756475 - RNA, 18 nt, Human herpesvirus 1
gccccgggacacccccca

SEQ ID NO: 1756476 - RNA, 11 nt, Human herpesvirus 1
gccccgggccg

SEQ ID NO: 1756477 - RNA, 19 nt, Human herpesvirus 1
gccacguaucugacggccg

SEQ ID NO: 1756478 - RNA, 22 nt, Human herpesvirus 1
gccagcgcggcggggcccggcc

SEQ ID NO: 1756479 - RNA, 23 nt, Human herpesvirus 1
gcccccccccccuugcgggcggu

SEQ ID NO: 1756480 - RNA, 19 nt, Human herpesvirus 1
gcccccggacccgggccgu

SEQ ID NO: 1756481 - RNA, 19 nt, Human herpesvirus 1
gcccccgccccucccccga

SEQ ID NO: 1756482 - RNA, 14 nt, Human herpesvirus 1
gcaggugugguucg

SEQ ID NO: 1756483 - RNA, 14 nt, Human herpesvirus 1
gccaacgcccugac

SEQ ID NO: 1756484 - RNA, 19 nt, Human herpesvirus 1
gccaauccgugucggggag

SEQ ID NO: 1756485 - RNA, 23 nt, Human herpesvirus 1
gccaaugcccucccugacggcca

SEQ ID NO: 1756486 - RNA, 23 nt, Human herpesvirus 1
gccacgagaucaaggacagcggc

SEQ ID NO: 1756487 - RNA, 18 nt, Human herpesvirus 1
gccacgcaaaaccaggcc

SEQ ID NO: 1756488 - RNA, 20 nt, Human herpesvirus 1
gccacuggccgggagcacca

SEQ ID NO: 1756489 - RNA, 14 nt, Human herpesvirus 1
gccacuuccccgac

SEQ ID NO: 1756490 - RNA, 16 nt, Human herpesvirus 1
gccagaacucgccccg

SEQ ID NO: 1756491 - RNA, 18 nt, Human herpesvirus 1
gccagacccaacccccgg

SEQ ID NO: 1756492 - RNA, 13 nt, Human herpesvirus 1
gacucucccccac

SEQ ID NO: 1756493 - RNA, 14 nt, Human herpesvirus 1
gacacgggcaccac

SEQ ID NO: 1756494 - RNA, 21 nt, Human herpesvirus 1
gacucguuauugcacccccga

SEQ ID NO: 1756495 - RNA, 12 nt, Human herpesvirus 1
gacgcccgggcg

SEQ ID NO: 1756496 - RNA, 14 nt, Human herpesvirus 1
gacgcgcagccggc

SEQ ID NO: 1756497 - RNA, 20 nt, Human herpesvirus 1
gacgcuggccgacguggcgc

SEQ ID NO: 1756498 - RNA, 15 nt, Human herpesvirus 1
cguaucugacggccg

SEQ ID NO: 1756499 - RNA, 15 nt, Human herpesvirus 1
gaagggcacgagcgc

SEQ ID NO: 1756500 - RNA, 15 nt, Human herpesvirus 1
cgggccugccugcgg

SEQ ID NO: 1756501 - RNA, 13 nt, Human herpesvirus 1
cgguggacagcca

SEQ ID NO: 1756502 - RNA, 15 nt, Human herpesvirus 1
cguacgcaugggccg

SEQ ID NO: 1756503 - RNA, 17 nt, Human herpesvirus 1
cgguuacucggcccccg

SEQ ID NO: 1756504 - RNA, 18 nt, Human herpesvirus 1
cguagagcuguggcacua

SEQ ID NO: 1756505 - RNA, 22 nt, Human herpesvirus 1
cguauacagaacauuguuuugg

SEQ ID NO: 1756506 - RNA, 19 nt, Human herpesvirus 1
gcccgauuuacagccccca

SEQ ID NO: 1756507 - RNA, 14 nt, Human herpesvirus 1
guucucccuguuca

SEQ ID NO: 1756508 - RNA, 13 nt, Human herpesvirus 1
guucgggcggacg

SEQ ID NO: 1756509 - RNA, 22 nt, Human herpesvirus 1
guuccgcuuccaucgccccugg

SEQ ID NO: 1756510 - RNA, 14 nt, Human herpesvirus 1
guuguggcucgggg

SEQ ID NO: 1756511 - RNA, 17 nt, Human herpesvirus 1
guuuacgcgggcacgca

SEQ ID NO: 1756512 - RNA, 14 nt, Human herpesvirus 1
guucugcugcaccg

SEQ ID NO: 1756513 - RNA, 13 nt, Human herpesvirus 1
uacacccaaguuc

SEQ ID NO: 1756514 - RNA, 23 nt, Human herpesvirus 1
uaaccgcaccccccucguccccc

SEQ ID NO: 1756515 - RNA, 17 nt, Human herpesvirus 1
ucaccgguuuccgcgac

SEQ ID NO: 1756516 - RNA, 17 nt, Human herpesvirus 1
ucacgcaagaccaggcc

SEQ ID NO: 1756517 - RNA, 17 nt, Human herpesvirus 1
ucacccacgccggcacc

SEQ ID NO: 1756518 - RNA, 21 nt, Human herpesvirus 1
ucaccccaaucccccccgacc

SEQ ID NO: 1756519 - RNA, 19 nt, Human herpesvirus 1
ucaccccgaagccccggcc

SEQ ID NO: 1756520 - RNA, 10 nt, Human herpesvirus 1
ucaccccgca

SEQ ID NO: 1756521 - RNA, 20 nt, Human herpesvirus 1
ucaccaccaaggcccgggcc

SEQ ID NO: 1756522 - RNA, 19 nt, Human herpesvirus 1
ucaccaugcagcgccggac

SEQ ID NO: 1756523 - RNA, 19 nt, Human herpesvirus 1
ucacacagcaucccccgcc

SEQ ID NO: 1756524 - RNA, 14 nt, Human herpesvirus 1
ucaaccacccggcc

SEQ ID NO: 1756525 - RNA, 17 nt, Human herpesvirus 1
ugacccagaccggcacc

SEQ ID NO: 1756526 - RNA, 20 nt, Human herpesvirus 1
ugacccuaggaggccgccac

SEQ ID NO: 1756527 - RNA, 12 nt, Human herpesvirus 1
ugaccugcaccg

SEQ ID NO: 1756528 - RNA, 14 nt, Human herpesvirus 1
ugacgaggccaagc

SEQ ID NO: 1756529 - RNA, 22 nt, Human herpesvirus 1
ugacgcacccccugaccccgcu

SEQ ID NO: 1756530 - RNA, 15 nt, Human herpesvirus 1
ugacggccgacgacg

SEQ ID NO: 1756531 - RNA, 16 nt, Human herpesvirus 1
ugacggccgacgacga

SEQ ID NO: 1756532 - RNA, 23 nt, Human herpesvirus 1
ugagccagacccaacccccggcc

SEQ ID NO: 1756533 - RNA, 13 nt, Human herpesvirus 1
ugcaucggcaagg

SEQ ID NO: 1756534 - RNA, 18 nt, Human herpesvirus 1
ugaccaacgacggcccga

SEQ ID NO: 1756535 - RNA, 19 nt, Human herpesvirus 1
ugaccaacgacggcccgac

SEQ ID NO: 1756536 - RNA, 19 nt, Human herpesvirus 1
ugaccagcgcacugcccga

SEQ ID NO: 1756537 - RNA, 17 nt, Human herpesvirus 1
uggaccuugggccgucg

SEQ ID NO: 1756538 - RNA, 15 nt, Human herpesvirus 1
uggaccccagcgacc

SEQ ID NO: 1756539 - RNA, 20 nt, Human herpesvirus 1
ugcucacgacccccaaguuc

SEQ ID NO: 1756540 - RNA, 17 nt, Human herpesvirus 1
ugcucagcgccaagguc

SEQ ID NO: 1756541 - RNA, 12 nt, Human herpesvirus 1
ugcccagcggcc

SEQ ID NO: 1756542 - RNA, 21 nt, Human herpesvirus 1
ugccccaccguugcccgggcc

SEQ ID NO: 1756543 - RNA, 23 nt, Human herpesvirus 1
ugcccccgcgccucccggcccgu

SEQ ID NO: 1756544 - RNA, 20 nt, Human herpesvirus 1
ugcccgacagggccgugccc

SEQ ID NO: 1756545 - RNA, 20 nt, Human herpesvirus 1
ugcccgcggaccaccgggcc

SEQ ID NO: 1756546 - RNA, 16 nt, Human herpesvirus 1
guccgcgggagguucc

SEQ ID NO: 1756547 - RNA, 16 nt, Human herpesvirus 1
gugcgauggcgacaca

SEQ ID NO: 1756548 - RNA, 14 nt, Human herpesvirus 1
gcggaugacggccc

SEQ ID NO: 1756549 - RNA, 22 nt, Human herpesvirus 1
gcggccuggguuggcgucggga

SEQ ID NO: 1756550 - RNA, 15 nt, Human herpesvirus 1
gcggagcucccggga

SEQ ID NO: 1756551 - RNA, 14 nt, Human herpesvirus 1
gcggagggcggcca

SEQ ID NO: 1756552 - RNA, 16 nt, Human herpesvirus 1
gcggagaacaccgaug

SEQ ID NO: 1756553 - RNA, 22 nt, Human herpesvirus 1
gcggacggcgcggggcccccgc

SEQ ID NO: 1756554 - RNA, 16 nt, Human herpesvirus 1
gcggacaacgugaucg

SEQ ID NO: 1756555 - RNA, 12 nt, Human herpesvirus 1
gcggacccccgg

SEQ ID NO: 1756556 - RNA, 23 nt, Human herpesvirus 1
gcgucgcgacagaacugcguuug

SEQ ID NO: 1756557 - RNA, 21 nt, Human herpesvirus 1
gcggcgugguaucggccgugu

SEQ ID NO: 1756558 - RNA, 13 nt, Human herpesvirus 1
gcggcucguggcg

SEQ ID NO: 1756559 - RNA, 14 nt, Human herpesvirus 1
gcggcucguggcgu

SEQ ID NO: 1756560 - RNA, 21 nt, Human herpesvirus 1
gcggcgguacguacgggaccg

SEQ ID NO: 1756561 - RNA, 16 nt, Human herpesvirus 1
gcggcgcuggcggcca

SEQ ID NO: 1756562 - RNA, 20 nt, Human herpesvirus 1
gcggcgaacgggggcccugc

SEQ ID NO: 1756563 - RNA, 14 nt, Human herpesvirus 1
gcggcgaggccggc

SEQ ID NO: 1756564 - RNA, 16 nt, Human herpesvirus 1
gcgugacgcacccccu

SEQ ID NO: 1756565 - RNA, 18 nt, Human herpesvirus 1
gcgugacgcacccccuga

SEQ ID NO: 1756566 - RNA, 21 nt, Human herpesvirus 1
gcguccgguuggccgcgcggc

SEQ ID NO: 1756567 - RNA, 18 nt, Human herpesvirus 1
gcgucggugauccccaac

SEQ ID NO: 1756568 - RNA, 14 nt, Human herpesvirus 1
gcugaggacgucga

SEQ ID NO: 1756569 - RNA, 14 nt, Human herpesvirus 1
gcugccagaccuca

SEQ ID NO: 1756570 - RNA, 21 nt, Human herpesvirus 1
gcugcccgacccggcccgagg

SEQ ID NO: 1756571 - RNA, 20 nt, Human herpesvirus 1
gcuuccgacgccccccgugg

SEQ ID NO: 1756572 - RNA, 20 nt, Human herpesvirus 1
gcuucggccguuucuccgcc

SEQ ID NO: 1756573 - RNA, 20 nt, Human herpesvirus 1
ggagggcguaacguuccgcc

SEQ ID NO: 1756574 - RNA, 13 nt, Human herpesvirus 1
ggagguccagcgc

SEQ ID NO: 1756575 - RNA, 20 nt, Human herpesvirus 1
ggagguccagcgccgcaacc

SEQ ID NO: 1756576 - RNA, 20 nt, Human herpesvirus 1
ggauggagagcgaaggcugc

SEQ ID NO: 1756577 - RNA, 14 nt, Human herpesvirus 1
ggauucccgggccg

SEQ ID NO: 1756578 - RNA, 13 nt, Human herpesvirus 1
gucagcgacgucc

SEQ ID NO: 1756579 - RNA, 20 nt, Human herpesvirus 1
guccaucaccacgcccagua

SEQ ID NO: 1756580 - RNA, 19 nt, Human herpesvirus 1
gucccaucugugcggggag

SEQ ID NO: 1756581 - RNA, 13 nt, Human herpesvirus 1
gucccgcccgugu

SEQ ID NO: 1756582 - RNA, 17 nt, Human herpesvirus 1
gugccugacgccugcca

SEQ ID NO: 1756583 - RNA, 11 nt, Human herpesvirus 1
ggugggggaac

SEQ ID NO: 1756584 - RNA, 12 nt, Human herpesvirus 1
gguguccgcggu

SEQ ID NO: 1756585 - RNA, 17 nt, Human herpesvirus 1
ggugauguugcccgcgg

SEQ ID NO: 1756586 - RNA, 14 nt, Human herpesvirus 1
gguggagcugcccg

SEQ ID NO: 1756587 - RNA, 16 nt, Human herpesvirus 1
gguggcgucgcaucga

SEQ ID NO: 1756588 - RNA, 15 nt, Human herpesvirus 1
ggucggcgaccgcca

SEQ ID NO: 1756589 - RNA, 17 nt, Human herpesvirus 1
ggucgaucccgaacgac

SEQ ID NO: 1756590 - RNA, 22 nt, Human herpesvirus 1
ggcacccaaggggccgugcggg

SEQ ID NO: 1756591 - RNA, 19 nt, Human herpesvirus 1
ggugccaaagcgcccgucg

SEQ ID NO: 1756592 - RNA, 20 nt, Human herpesvirus 1
ggugccaguccgcugcaccg

SEQ ID NO: 1756593 - RNA, 17 nt, Human herpesvirus 1
ggucuguauagcccggg

SEQ ID NO: 1756594 - RNA, 16 nt, Human herpesvirus 1
ggucggugacgcgcca

SEQ ID NO: 1756595 - RNA, 11 nt, Human herpesvirus 1
aaccggccgcc

SEQ ID NO: 1756596 - RNA, 17 nt, Human herpesvirus 1
aaccacccgcaccccca

SEQ ID NO: 1756597 - RNA, 11 nt, Human herpesvirus 1
aaccaggccgu

SEQ ID NO: 1756598 - RNA, 12 nt, Human herpesvirus 1
aacgacggcccg

SEQ ID NO: 1756599 - RNA, 21 nt, Human herpesvirus 1
aacgccgcuaccgacgcuccc

SEQ ID NO: 1756600 - RNA, 17 nt, Human herpesvirus 1
aacgagccgacggcccg

SEQ ID NO: 1756601 - RNA, 12 nt, Human herpesvirus 1
aacgaggcccgc

SEQ ID NO: 1756602 - RNA, 19 nt, Human herpesvirus 1
aacgauauguugggccgcg

SEQ ID NO: 1756603 - RNA, 21 nt, Human herpesvirus 1
acaacgaccaggcgcgccgcg

SEQ ID NO: 1756604 - RNA, 23 nt, Human herpesvirus 1
acaacgaguaucugcgggccgcg

SEQ ID NO: 1756605 - RNA, 21 nt, Human herpesvirus 1
acaacgccagccugcggccgg

SEQ ID NO: 1756606 - RNA, 15 nt, Human herpesvirus 1
acacagccggccacg

SEQ ID NO: 1756607 - RNA, 16 nt, Human herpesvirus 1
acaccgguccccggag

SEQ ID NO: 1756608 - RNA, 18 nt, Human herpesvirus 1
acaccugcaccacccccg

SEQ ID NO: 1756609 - RNA, 15 nt, Human herpesvirus 1
accaggccuccaccc

SEQ ID NO: 1756610 - RNA, 20 nt, Human herpesvirus 1
accauggccccccgcgucca

SEQ ID NO: 1756611 - RNA, 15 nt, Human herpesvirus 1
acccaacccccggcc

SEQ ID NO: 1756612 - RNA, 15 nt, Human herpesvirus 1
acccaagccgggacu

SEQ ID NO: 1756613 - RNA, 22 nt, Human herpesvirus 1
accccgugggcgacugcgaccc

SEQ ID NO: 1756614 - RNA, 18 nt, Human herpesvirus 1
accccgcaauuugcaccc

SEQ ID NO: 1756615 - RNA, 20 nt, Human herpesvirus 1
acccgacaacagcccccggg

SEQ ID NO: 1756616 - RNA, 19 nt, Human herpesvirus 1
accccgcuccugugcaccc

SEQ ID NO: 1756617 - RNA, 13 nt, Human herpesvirus 1
acccgccccggag

SEQ ID NO: 1756618 - RNA, 18 nt, Human herpesvirus 1
acccgccccuaaccaggc

SEQ ID NO: 1756619 - RNA, 16 nt, Human herpesvirus 1
acccacccaccaagac

SEQ ID NO: 1756620 - RNA, 18 nt, Human herpesvirus 1
acccagaccggcaccacc

SEQ ID NO: 1756621 - RNA, 14 nt, Human herpesvirus 1
accccagggaccuc

SEQ ID NO: 1756622 - RNA, 20 nt, Human herpesvirus 1
acccccaucuaaugccacgc

SEQ ID NO: 1756623 - RNA, 19 nt, Human herpesvirus 1
acccccgaguucccccggg

SEQ ID NO: 1756624 - RNA, 18 nt, Human herpesvirus 1
acccccgggcuacacggc

SEQ ID NO: 1756625 - RNA, 17 nt, Human herpesvirus 1
accccgaagccccggcc

SEQ ID NO: 1756626 - RNA, 14 nt, Human herpesvirus 1
acccugcugccccc

SEQ ID NO: 1756627 - RNA, 16 nt, Human herpesvirus 1
acccgcgacccccggg

SEQ ID NO: 1756628 - RNA, 20 nt, Human herpesvirus 1
acccgggccguuucccaccc

SEQ ID NO: 1756629 - RNA, 23 nt, Human herpesvirus 1
accgaagaggugcugccgccgcg

SEQ ID NO: 1756630 - RNA, 14 nt, Human herpesvirus 1
agcaccgacaccgc

SEQ ID NO: 1756631 - RNA, 19 nt, Human herpesvirus 1
agcacgccaccgacaccgc

SEQ ID NO: 1756632 - RNA, 17 nt, Human herpesvirus 1
agcgcccgucggucugc

SEQ ID NO: 1756633 - RNA, 14 nt, Human herpesvirus 1
accugcucacgacc

SEQ ID NO: 1756634 - RNA, 13 nt, Human herpesvirus 1
accuucaucgacc

SEQ ID NO: 1756635 - RNA, 14 nt, Human herpesvirus 1
accuugccccggcc

SEQ ID NO: 1756636 - RNA, 21 nt, Human herpesvirus 1
acgacccucgagauccccggg

SEQ ID NO: 1756637 - RNA, 19 nt, Human herpesvirus 1
acgacggcggcgaggccgg

SEQ ID NO: 1756638 - RNA, 16 nt, Human herpesvirus 1
aguucgagcagccgcg

SEQ ID NO: 1756639 - RNA, 14 nt, Human herpesvirus 1
aguuuccacccccc

SEQ ID NO: 1756640 - RNA, 15 nt, Human herpesvirus 1
agugaaagacacggg

SEQ ID NO: 1756641 - RNA, 15 nt, Human herpesvirus 1
aggacagcggccugc

SEQ ID NO: 1756642 - RNA, 15 nt, Human herpesvirus 1
agcguauccaccccc

SEQ ID NO: 1756643 - RNA, 18 nt, Human herpesvirus 1
ccaauaaagaucgcggua

SEQ ID NO: 1756644 - RNA, 14 nt, Human herpesvirus 1
ccacaaccucccgg

SEQ ID NO: 1756645 - RNA, 20 nt, Human herpesvirus 1
caucggcaaggacgcccgcg

SEQ ID NO: 1756646 - RNA, 19 nt, Human herpesvirus 1
ccacacagcccucccgacc

SEQ ID NO: 1756647 - RNA, 23 nt, Human herpesvirus 1
ccacaccaccuacuacgaugggg

SEQ ID NO: 1756648 - RNA, 23 nt, Human herpesvirus 1
ccacagcuuuggguucguuccgg

SEQ ID NO: 1756649 - RNA, 14 nt, Human herpesvirus 1
ccaccauggccccc

SEQ ID NO: 1756650 - RNA, 18 nt, Human herpesvirus 1
ccaccauuaucgggccgc

SEQ ID NO: 1756651 - RNA, 21 nt, Human herpesvirus 1
ccacccggagcuuucuuccgg

SEQ ID NO: 1756652 - RNA, 19 nt, Human herpesvirus 1
ccacccggccauccgcgcc

SEQ ID NO: 1756653 - RNA, 22 nt, Human herpesvirus 1
ccaccgggaagcagggcccgcc

SEQ ID NO: 1756654 - RNA, 21 nt, Human herpesvirus 1
ccaccuucaccaccaaccuga

SEQ ID NO: 1756655 - RNA, 23 nt, Human herpesvirus 1
ccaccuuccguccccugcccccc

SEQ ID NO: 1756656 - RNA, 20 nt, Human herpesvirus 1
ccaccgauagcguccgggcg

SEQ ID NO: 1756657 - RNA, 19 nt, Human herpesvirus 1
ccaccguugcccgggccgu

SEQ ID NO: 1756658 - RNA, 21 nt, Human herpesvirus 1
ccaccuacuacgaugggggcg

SEQ ID NO: 1756659 - RNA, 13 nt, Human herpesvirus 1
ccaccuccacccc

SEQ ID NO: 1756660 - RNA, 15 nt, Human herpesvirus 1
ccacgccgacgccaa

SEQ ID NO: 1756661 - RNA, 22 nt, Human herpesvirus 1
ccacgcagccagaacucgcccc

SEQ ID NO: 1756662 - RNA, 17 nt, Human herpesvirus 1
auuggcucggacgagac

SEQ ID NO: 1756663 - RNA, 12 nt, Human herpesvirus 1
auugggcgggag

SEQ ID NO: 1756664 - RNA, 21 nt, Human herpesvirus 1
cauccgggaagacgaccagcc

SEQ ID NO: 1756665 - RNA, 15 nt, Human herpesvirus 1
cauccgaacgcagcc

SEQ ID NO: 1756666 - RNA, 15 nt, Human herpesvirus 1
caucgacacgcgcgu

SEQ ID NO: 1756667 - RNA, 12 nt, Human herpesvirus 1
caucacccccga

SEQ ID NO: 1756668 - RNA, 17 nt, Human herpesvirus 1
caucagcucgcggcccg

SEQ ID NO: 1756669 - RNA, 13 nt, Human herpesvirus 1
caucccacccccc

SEQ ID NO: 1756670 - RNA, 19 nt, Human herpesvirus 1
cauccccgagaaccagcgc

SEQ ID NO: 1756671 - RNA, 21 nt, Human herpesvirus 1
ucggcgagcuggauggcgcgu

SEQ ID NO: 1756672 - RNA, 13 nt, Human herpesvirus 1
ucggcuccccgcc

SEQ ID NO: 1756673 - RNA, 19 nt, Human herpesvirus 1
ucgggaccaucaucggggg

SEQ ID NO: 1756674 - RNA, 17 nt, Human herpesvirus 1
ucgggaugcugccccgc

SEQ ID NO: 1756675 - RNA, 14 nt, Human herpesvirus 1
ucggcaggcaccgc

SEQ ID NO: 1756676 - RNA, 17 nt, Human herpesvirus 1
ucggccgccacccaggc

SEQ ID NO: 1756677 - RNA, 15 nt, Human herpesvirus 1
ucggccgccgacgac

SEQ ID NO: 1756678 - RNA, 20 nt, Human herpesvirus 1
ucggccguuucuccgcccga

SEQ ID NO: 1756679 - RNA, 23 nt, Human herpesvirus 1
ucgcucucggugcgucugggccc

SEQ ID NO: 1756680 - RNA, 12 nt, Human herpesvirus 1
ucggaggccccc

SEQ ID NO: 1756681 - RNA, 11 nt, Human herpesvirus 1
gggucgggcgc

SEQ ID NO: 1756682 - RNA, 20 nt, Human herpesvirus 1
gggucagcuccucgcgcggc

SEQ ID NO: 1756683 - RNA, 23 nt, Human herpesvirus 1
gggucccuccuuagcacgaucga

SEQ ID NO: 1756684 - RNA, 16 nt, Human herpesvirus 1
gguaccgcgugacccc

SEQ ID NO: 1756685 - RNA, 23 nt, Human herpesvirus 1
gguacgaagaccagggcccguug

SEQ ID NO: 1756686 - RNA, 14 nt, Human herpesvirus 1
gggccguugcccgg

SEQ ID NO: 1756687 - RNA, 20 nt, Human herpesvirus 1
gguacaacgcgacgcacauc

SEQ ID NO: 1756688 - RNA, 14 nt, Human herpesvirus 1
gguacgugaacgcu

SEQ ID NO: 1756689 - RNA, 19 nt, Human herpesvirus 1
gguauggcugcccccccgc

SEQ ID NO: 1756690 - RNA, 17 nt, Human herpesvirus 1
ggucaaaugccgggcca

SEQ ID NO: 1756691 - RNA, 15 nt, Human herpesvirus 1
ggucccaccugacgc

SEQ ID NO: 1756692 - RNA, 20 nt, Human herpesvirus 1
gguccucgugcccucgcggg

SEQ ID NO: 1756693 - RNA, 17 nt, Human herpesvirus 1
gguccuggccggccugg

SEQ ID NO: 1756694 - RNA, 16 nt, Human herpesvirus 1
ucgcgguagcccggcc

SEQ ID NO: 1756695 - RNA, 21 nt, Human herpesvirus 1
ucgcuagaccacgccccuuuc

SEQ ID NO: 1756696 - RNA, 18 nt, Human herpesvirus 1
gggccucugggucugugc

SEQ ID NO: 1756697 - RNA, 17 nt, Human herpesvirus 1
gggccuggugcucgugg

SEQ ID NO: 1756698 - RNA, 23 nt, Human herpesvirus 1
gggccuucuuucgaaccgugguc

SEQ ID NO: 1756699 - RNA, 16 nt, Human herpesvirus 1
gggccuugccgugguc

SEQ ID NO: 1756700 - RNA, 16 nt, Human herpesvirus 1
gggccuuggcggccgc

SEQ ID NO: 1756701 - RNA, 22 nt, Human herpesvirus 1
gggccggcgggugagcgcgcgg

SEQ ID NO: 1756702 - RNA, 19 nt, Human herpesvirus 1
gggccggggacggcgaaca

SEQ ID NO: 1756703 - RNA, 16 nt, Human herpesvirus 1
ggggucaggucugcgg

SEQ ID NO: 1756704 - RNA, 16 nt, Human herpesvirus 1
gggcaucgcggugguc

SEQ ID NO: 1756705 - RNA, 20 nt, Human herpesvirus 1
gggccaaccaagagacgucg

SEQ ID NO: 1756706 - RNA, 20 nt, Human herpesvirus 1
gggcccacgaucaccgcggg

SEQ ID NO: 1756707 - RNA, 14 nt, Human herpesvirus 1
gggcccgcgucggg

SEQ ID NO: 1756708 - RNA, 18 nt, Human herpesvirus 1
gggcccugcuccggcggg

SEQ ID NO: 1756709 - RNA, 16 nt, Human herpesvirus 1
gggccgccacgcgcgg

SEQ ID NO: 1756710 - RNA, 12 nt, Human herpesvirus 1
gggccgcgcgga

SEQ ID NO: 1756711 - RNA, 14 nt, Human herpesvirus 1
gggccgcgguggac

SEQ ID NO: 1756712 - RNA, 20 nt, Human herpesvirus 1
gggcacccaaggggccgugc

SEQ ID NO: 1756713 - RNA, 19 nt, Human herpesvirus 1
gggagcggugacgaacgcg

SEQ ID NO: 1756714 - RNA, 20 nt, Human herpesvirus 1
gggaggccgcaucgaacgca

SEQ ID NO: 1756715 - RNA, 20 nt, Human herpesvirus 1
ggcuguagcgccccggcgac

SEQ ID NO: 1756716 - RNA, 21 nt, Human herpesvirus 1
ggcuuuuguugcugcgcggcg

SEQ ID NO: 1756717 - RNA, 22 nt, Human herpesvirus 1
ggcgcauaaagggccggugguc

SEQ ID NO: 1756718 - RNA, 21 nt, Human herpesvirus 1
ggccuggacguccccgaggac

SEQ ID NO: 1756719 - RNA, 13 nt, Human herpesvirus 1
ggccuggcggcgg

SEQ ID NO: 1756720 - RNA, 19 nt, Human herpesvirus 1
ggccuccgcguacgaggac

SEQ ID NO: 1756721 - RNA, 14 nt, Human herpesvirus 1
ggccgcucgguggc

SEQ ID NO: 1756722 - RNA, 16 nt, Human herpesvirus 1
ggccggcgggugagcg

SEQ ID NO: 1756723 - RNA, 17 nt, Human herpesvirus 1
ggccacacagccggcca

SEQ ID NO: 1756724 - RNA, 20 nt, Human herpesvirus 1
ggccaacgacuuccucguac

SEQ ID NO: 1756725 - RNA, 18 nt, Human herpesvirus 1
ggccgcgguggacagcca

SEQ ID NO: 1756726 - RNA, 18 nt, Human herpesvirus 1
ggccuaauuguccgcgca

SEQ ID NO: 1756727 - RNA, 19 nt, Human herpesvirus 1
ggccuccacccccucgacc

SEQ ID NO: 1756728 - RNA, 21 nt, Human herpesvirus 1
ggccucucguucuccggggcc

SEQ ID NO: 1756729 - RNA, 20 nt, Human herpesvirus 1
ggccggcggcgcuccucgcc

SEQ ID NO: 1756730 - RNA, 17 nt, Human herpesvirus 1
ggccgugauuccucucc

SEQ ID NO: 1756731 - RNA, 20 nt, Human herpesvirus 1
ggccgugcacacgacggccu

SEQ ID NO: 1756732 - RNA, 14 nt, Human herpesvirus 1
ggccguggacggca

SEQ ID NO: 1756733 - RNA, 14 nt, Human herpesvirus 1
ggccguggcggcca

SEQ ID NO: 1756734 - RNA, 15 nt, Human herpesvirus 1
gcgcagaggcggcca

SEQ ID NO: 1756735 - RNA, 13 nt, Human herpesvirus 1
gcgcgccgcgagu

SEQ ID NO: 1756736 - RNA, 19 nt, Human herpesvirus 1
gcgcagcugggaccccggc

SEQ ID NO: 1756737 - RNA, 22 nt, Human herpesvirus 1
gcgcgccaucuggaccgggguc

SEQ ID NO: 1756738 - RNA, 20 nt, Human herpesvirus 1
ggcacgcccccuacgaggac

SEQ ID NO: 1756739 - RNA, 18 nt, Human herpesvirus 1
gcgcgcggaugcucggcg

SEQ ID NO: 1756740 - RNA, 17 nt, Human herpesvirus 1
ggcagcgcuccgacgac

SEQ ID NO: 1756741 - RNA, 21 nt, Human herpesvirus 1
gcgcaccuccuccgacgccca

SEQ ID NO: 1756742 - RNA, 22 nt, Human herpesvirus 1
ccggcagggggaugggggggca

SEQ ID NO: 1756743 - RNA, 20 nt, Human herpesvirus 1
ccggccccugggccccggga

SEQ ID NO: 1756744 - RNA, 21 nt, Human herpesvirus 1
ccggccccugggccccgggac

SEQ ID NO: 1756745 - RNA, 14 nt, Human herpesvirus 1
ccggccuggcggcg

SEQ ID NO: 1756746 - RNA, 17 nt, Human herpesvirus 1
ccggccuggcggcggcc

SEQ ID NO: 1756747 - RNA, 17 nt, Human herpesvirus 1
ccggccugggggccguc

SEQ ID NO: 1756748 - RNA, 23 nt, Human herpesvirus 1
cgcgcgaugcgaucgagccgugc

SEQ ID NO: 1756749 - RNA, 19 nt, Human herpesvirus 1
cgcggcaaagaccuuccgg

SEQ ID NO: 1756750 - RNA, 15 nt, Human herpesvirus 1
cgcggaucugcuccg

SEQ ID NO: 1756751 - RNA, 17 nt, Human herpesvirus 1
cgcggcccggggccugc

SEQ ID NO: 1756752 - RNA, 16 nt, Human herpesvirus 1
cgcggcgacaacgcgg

SEQ ID NO: 1756753 - RNA, 20 nt, Human herpesvirus 1
cgcgcgauagagucgacgac

SEQ ID NO: 1756754 - RNA, 17 nt, Human herpesvirus 1
cgcggagggcggccagc

SEQ ID NO: 1756755 - RNA, 20 nt, Human herpesvirus 1
cucgcgcguggaccuggggg

SEQ ID NO: 1756756 - RNA, 19 nt, Human herpesvirus 1
cguggacgggcucgccagc

SEQ ID NO: 1756757 - RNA, 20 nt, Human herpesvirus 1
cguggauaucgaguccgaag

SEQ ID NO: 1756758 - RNA, 17 nt, Human herpesvirus 1
cguggaccugggggacu

SEQ ID NO: 1756759 - RNA, 16 nt, Human herpesvirus 1
cguggagcaaaacgcc

SEQ ID NO: 1756760 - RNA, 20 nt, Human herpesvirus 1
cguggagcaaaacgccuccc

SEQ ID NO: 1756761 - RNA, 19 nt, Human herpesvirus 1
cguggcgucucgccggacg

SEQ ID NO: 1756762 - RNA, 16 nt, Human herpesvirus 1
cguggugcgucgggcc

SEQ ID NO: 1756763 - RNA, 17 nt, Human herpesvirus 1
cgugggccucacccacg

SEQ ID NO: 1756764 - RNA, 20 nt, Human herpesvirus 1
cgugugccugccguccgaac

SEQ ID NO: 1756765 - RNA, 13 nt, Human herpesvirus 1
cucgaucggccac

SEQ ID NO: 1756766 - RNA, 14 nt, Human herpesvirus 1
cucgaucggccacg

SEQ ID NO: 1756767 - RNA, 22 nt, Human herpesvirus 1
cucgaugcgcaucagcucgcgg

SEQ ID NO: 1756768 - RNA, 20 nt, Human herpesvirus 1
gcaccgucggaggcccccca

SEQ ID NO: 1756769 - RNA, 18 nt, Human herpesvirus 1
gcaccgugggacaccggc

SEQ ID NO: 1756770 - RNA, 20 nt, Human herpesvirus 1
gcaccuccuacgccggggcg

SEQ ID NO: 1756771 - RNA, 19 nt, Human herpesvirus 1
gaggucguuuucaugcccg

SEQ ID NO: 1756772 - RNA, 22 nt, Human herpesvirus 1
gagguggacgucggagacgagc

SEQ ID NO: 1756773 - RNA, 21 nt, Human herpesvirus 1
gaguacccgcucucgcgcgug

SEQ ID NO: 1756774 - RNA, 16 nt, Human herpesvirus 1
gcacccaaggggccgu

SEQ ID NO: 1756775 - RNA, 20 nt, Human herpesvirus 1
gcaccgcaccagcgcggagg

SEQ ID NO: 1756776 - RNA, 17 nt, Human herpesvirus 1
gcacauccucacccuca

SEQ ID NO: 1756777 - RNA, 13 nt, Human herpesvirus 1
gcaccacccccgc

SEQ ID NO: 1756778 - RNA, 17 nt, Human herpesvirus 1
gcacagaugggacgcca

SEQ ID NO: 1756779 - RNA, 14 nt, Human herpesvirus 1
gaguacgaggaucu

SEQ ID NO: 1756780 - RNA, 22 nt, Human herpesvirus 1
gaguugccccaccguugcccgg

SEQ ID NO: 1756781 - RNA, 15 nt, Human herpesvirus 1
ccggagcgugacgca

SEQ ID NO: 1756782 - RNA, 16 nt, Human herpesvirus 1
ccggagcucgcggcac

SEQ ID NO: 1756783 - RNA, 19 nt, Human herpesvirus 1
ccggagcucgcggcacgcg

SEQ ID NO: 1756784 - RNA, 17 nt, Human herpesvirus 1
ccggaggaaacccccga

SEQ ID NO: 1756785 - RNA, 21 nt, Human herpesvirus 1
ccggaggcgccgcgcggacgg

SEQ ID NO: 1756786 - RNA, 19 nt, Human herpesvirus 1
ccggaggcgccugccccgc

SEQ ID NO: 1756787 - RNA, 17 nt, Human herpesvirus 1
ccggcaccaacaacgac

SEQ ID NO: 1756788 - RNA, 15 nt, Human herpesvirus 1
ccggcacgccugggg

SEQ ID NO: 1756789 - RNA, 12 nt, Human herpesvirus 1
ccggacccccgc

SEQ ID NO: 1756790 - RNA, 19 nt, Human herpesvirus 1
ccggaaccugcucacgacc

SEQ ID NO: 1756791 - RNA, 24 nt, Human herpesvirus 1
ccggacgacgugguccgcggggcc

SEQ ID NO: 1756792 - RNA, 14 nt, Human herpesvirus 1
ccggacgcgcggcg

SEQ ID NO: 1756793 - RNA, 18 nt, Human herpesvirus 1
ccggacgcgcggcgcgag

SEQ ID NO: 1756794 - RNA, 15 nt, Human herpesvirus 1
ccggagccgggcgcg

SEQ ID NO: 1756795 - RNA, 16 nt, Human herpesvirus 1
ucgccccacgacccga

SEQ ID NO: 1756796 - RNA, 17 nt, Human herpesvirus 1
ucgccacacccgcgacc

SEQ ID NO: 1756797 - RNA, 14 nt, Human herpesvirus 1
ucgccacgucgacc

SEQ ID NO: 1756798 - RNA, 19 nt, Human herpesvirus 1
ucgccccuguggcccuggc

SEQ ID NO: 1756799 - RNA, 15 nt, Human herpesvirus 1
ucgccgacaucgaca

SEQ ID NO: 1756800 - RNA, 22 nt, Human herpesvirus 1
uccuacgccggggcggucguca

SEQ ID NO: 1756801 - RNA, 13 nt, Human herpesvirus 1
uccggggcccggc

SEQ ID NO: 1756802 - RNA, 17 nt, Human herpesvirus 1
uccgucuucggccccgc

SEQ ID NO: 1756803 - RNA, 15 nt, Human herpesvirus 1
uccguggccccggcc

SEQ ID NO: 1756804 - RNA, 19 nt, Human herpesvirus 1
uccugaugcacgcccccgc

SEQ ID NO: 1756805 - RNA, 14 nt, Human herpesvirus 1
ucgagcagccgcgc

SEQ ID NO: 1756806 - RNA, 20 nt, Human herpesvirus 1
ucgauccaggacgccgcgac

SEQ ID NO: 1756807 - RNA, 20 nt, Human herpesvirus 1
ucgcacgcguccagucggca

SEQ ID NO: 1756808 - RNA, 16 nt, Human herpesvirus 1
ucgaguucgccaggcu

SEQ ID NO: 1756809 - RNA, 15 nt, Human herpesvirus 1
uccgcggccccagcc

SEQ ID NO: 1756810 - RNA, 21 nt, Human herpesvirus 1
uccgccuggccugcgaggugc

SEQ ID NO: 1756811 - RNA, 16 nt, Human herpesvirus 1
ggcggcggucagcgac

SEQ ID NO: 1756812 - RNA, 21 nt, Human herpesvirus 1
uccgcggggccucccccggac

SEQ ID NO: 1756813 - RNA, 18 nt, Human herpesvirus 1
uccggagacauggccccc

SEQ ID NO: 1756814 - RNA, 19 nt, Human herpesvirus 1
uccggagaucuauaaggcc

SEQ ID NO: 1756815 - RNA, 21 nt, Human herpesvirus 1
uccggaggcgccgcgcggacg

SEQ ID NO: 1756816 - RNA, 19 nt, Human herpesvirus 1
uccggcaauucccgcggcc

SEQ ID NO: 1756817 - RNA, 13 nt, Human herpesvirus 1
uccggccuggggg

SEQ ID NO: 1756818 - RNA, 19 nt, Human herpesvirus 1
uccggccugggggccgucc

SEQ ID NO: 1756819 - RNA, 19 nt, Human herpesvirus 1
ggcgcucagggcggcgguc

SEQ ID NO: 1756820 - RNA, 16 nt, Human herpesvirus 1
ggcggaaaccguaacg

SEQ ID NO: 1756821 - RNA, 21 nt, Human herpesvirus 1
ggcgcuacgaccggugcguug

SEQ ID NO: 1756822 - RNA, 19 nt, Human herpesvirus 1
ggcgcuacuucaccuucgg

SEQ ID NO: 1756823 - RNA, 17 nt, Human herpesvirus 1
ggcggcgcuggcggcca

SEQ ID NO: 1756824 - RNA, 16 nt, Human herpesvirus 1
uccgagggccgggccc

SEQ ID NO: 1756825 - RNA, 17 nt, Human herpesvirus 1
uccgaguucccccggca

SEQ ID NO: 1756826 - RNA, 21 nt, Human herpesvirus 1
uccgcaagccccuagccccgc

SEQ ID NO: 1756827 - RNA, 14 nt, Human herpesvirus 1
ggcgcgcccucuuc

SEQ ID NO: 1756828 - RNA, 14 nt, Human herpesvirus 1
ggcgcggcucgugg

SEQ ID NO: 1756829 - RNA, 19 nt, Human herpesvirus 1
ggcgcgcgaaaucguggcg

SEQ ID NO: 1756830 - RNA, 19 nt, Human herpesvirus 1
ggcgccacaccacgccaca

SEQ ID NO: 1756831 - RNA, 18 nt, Human herpesvirus 1
ggcgccgcccgccccugg

SEQ ID NO: 1756832 - RNA, 22 nt, Human herpesvirus 1
gcgcgugcuguugggcgggacg

SEQ ID NO: 1756833 - RNA, 20 nt, Human herpesvirus 1
ggcgccagcguaaccuccgg

SEQ ID NO: 1756834 - RNA, 17 nt, Human herpesvirus 1
gcgcgucguucgggcgg

SEQ ID NO: 1756835 - RNA, 21 nt, Human herpesvirus 1
gcgccgucuuucuccccaacg

SEQ ID NO: 1756836 - RNA, 17 nt, Human herpesvirus 1
gcgcgaaaucguggcgc

SEQ ID NO: 1756837 - RNA, 14 nt, Human herpesvirus 1
gcgccggugguucg

SEQ ID NO: 1756838 - RNA, 20 nt, Human herpesvirus 1
gcgccgcugcccgacccggc

SEQ ID NO: 1756839 - RNA, 13 nt, Human herpesvirus 1
gcgccgacggaca

SEQ ID NO: 1756840 - RNA, 17 nt, Human herpesvirus 1
gcgcgaccucaccacca

SEQ ID NO: 1756841 - RNA, 22 nt, Human herpesvirus 1
gcgcgauccgacauguccgugc

SEQ ID NO: 1756842 - RNA, 14 nt, Human herpesvirus 1
gcgcgaugcgaucg

SEQ ID NO: 1756843 - RNA, 13 nt, Human herpesvirus 1
gcgcggcguccgc

SEQ ID NO: 1756844 - RNA, 14 nt, Human herpesvirus 1
gcgcggccgugggc

SEQ ID NO: 1756845 - RNA, 19 nt, Human herpesvirus 1
gcgcgggguuacgcgggcc

SEQ ID NO: 1756846 - RNA, 15 nt, Human herpesvirus 1
gaucauuacccccgu

SEQ ID NO: 1756847 - RNA, 14 nt, Human herpesvirus 1
gaucccccgcgcgg

SEQ ID NO: 1756848 - RNA, 15 nt, Human herpesvirus 1
gaucccucgcgaggg

SEQ ID NO: 1756849 - RNA, 21 nt, Human herpesvirus 1
gauccgacauguccgugccgc

SEQ ID NO: 1756850 - RNA, 15 nt, Human herpesvirus 1
gauccgcggcgacaa

SEQ ID NO: 1756851 - RNA, 22 nt, Human herpesvirus 1
gaucgccugucuccucguggcc

SEQ ID NO: 1756852 - RNA, 17 nt, Human herpesvirus 1
gagcgcccuccugacca

SEQ ID NO: 1756853 - RNA, 16 nt, Human herpesvirus 1
gagccgugcaccgugg

SEQ ID NO: 1756854 - RNA, 17 nt, Human herpesvirus 1
gagcggggccguggcgg

SEQ ID NO: 1756855 - RNA, 17 nt, Human herpesvirus 1
gaugcuguggacgacgg

SEQ ID NO: 1756856 - RNA, 17 nt, Human herpesvirus 1
gaugggcaucgugggcg

SEQ ID NO: 1756857 - RNA, 19 nt, Human herpesvirus 1
gaugccgugccgcccguug

SEQ ID NO: 1756858 - RNA, 17 nt, Human herpesvirus 1
cucaccggcggaccccc

SEQ ID NO: 1756859 - RNA, 21 nt, Human herpesvirus 1
cucaagcacacacgggggagc

SEQ ID NO: 1756860 - RNA, 21 nt, Human herpesvirus 1
cucaaguacaaccccucgcgg

SEQ ID NO: 1756861 - RNA, 17 nt, Human herpesvirus 1
cgcgcguggaccugggg

SEQ ID NO: 1756862 - RNA, 12 nt, Human herpesvirus 1
cgcgcuccuccc

SEQ ID NO: 1756863 - RNA, 18 nt, Human herpesvirus 1
cgcgcucaaccaccgcuc

SEQ ID NO: 1756864 - RNA, 18 nt, Human herpesvirus 1
gagccaacgcccugacca

SEQ ID NO: 1756865 - RNA, 23 nt, Human herpesvirus 1
gagccccccgcugcggccacaca

SEQ ID NO: 1756866 - RNA, 22 nt, Human herpesvirus 1
cuccccaagcaucgaccacgcc

SEQ ID NO: 1756867 - RNA, 12 nt, Human herpesvirus 1
cuccccagcggc

SEQ ID NO: 1756868 - RNA, 15 nt, Human herpesvirus 1
cuccccgccgcggcc

SEQ ID NO: 1756869 - RNA, 23 nt, Human herpesvirus 1
cucccaccagcugagccgcgccg

SEQ ID NO: 1756870 - RNA, 14 nt, Human herpesvirus 1
gagcgcaguccacg

SEQ ID NO: 1756871 - RNA, 14 nt, Human herpesvirus 1
gagccgcgcggcca

SEQ ID NO: 1756872 - RNA, 16 nt, Human herpesvirus 1
cucacuaucgagggcg

SEQ ID NO: 1756873 - RNA, 19 nt, Human herpesvirus 1
cucagcaacacgcucgcgg

SEQ ID NO: 1756874 - RNA, 22 nt, Human herpesvirus 1
cucagggccuccgaccccagac

SEQ ID NO: 1756875 - RNA, 14 nt, Human herpesvirus 1
cuccaggugcgccu

SEQ ID NO: 1756876 - RNA, 21 nt, Human herpesvirus 1
cucccaaccgcgacccuccgg

SEQ ID NO: 1756877 - RNA, 16 nt, Human herpesvirus 1
ccgcggccuggguugg

SEQ ID NO: 1756878 - RNA, 18 nt, Human herpesvirus 1
ccggcgcggugggcggca

SEQ ID NO: 1756879 - RNA, 16 nt, Human herpesvirus 1
ccgcgcuaugacggca

SEQ ID NO: 1756880 - RNA, 16 nt, Human herpesvirus 1
ccgcgccgucgggcgu

SEQ ID NO: 1756881 - RNA, 21 nt, Human herpesvirus 1
ccgcgggccacgccacccugc

SEQ ID NO: 1756882 - RNA, 15 nt, Human herpesvirus 1
ccggcggacccccgg

SEQ ID NO: 1756883 - RNA, 23 nt, Human herpesvirus 1
ccggcggacccccggaggcgccu

SEQ ID NO: 1756884 - RNA, 19 nt, Human herpesvirus 1
ccggcggcgacgugccccc

SEQ ID NO: 1756885 - RNA, 15 nt, Human herpesvirus 1
ccggcggcgcuggcg

SEQ ID NO: 1756886 - RNA, 23 nt, Human herpesvirus 1
ccggcgggguuauaggccacgca

SEQ ID NO: 1756887 - RNA, 13 nt, Human herpesvirus 1
ccggcggucgcgc

SEQ ID NO: 1756888 - RNA, 15 nt, Human herpesvirus 1
ccggcuacaggggcc

SEQ ID NO: 1756889 - RNA, 15 nt, Human herpesvirus 1
ccggcuagacccacg

SEQ ID NO: 1756890 - RNA, 18 nt, Human herpesvirus 1
ccgggacgaccacgagac

SEQ ID NO: 1756891 - RNA, 22 nt, Human herpesvirus 1
ccgggacuuuuggaugucgccc

SEQ ID NO: 1756892 - RNA, 15 nt, Human herpesvirus 1
ccgggagccccggac

SEQ ID NO: 1756893 - RNA, 23 nt, Human herpesvirus 1
ccgggaggggucgcacaccgaac

SEQ ID NO: 1756894 - RNA, 16 nt, Human herpesvirus 1
ccgggaagcagggccc

SEQ ID NO: 1756895 - RNA, 14 nt, Human herpesvirus 1
ccgcggaucgggcc

SEQ ID NO: 1756896 - RNA, 16 nt, Human herpesvirus 1
ccgggccacggcgccg

SEQ ID NO: 1756897 - RNA, 19 nt, Human herpesvirus 1
ccgggccggagcucgcggc

SEQ ID NO: 1756898 - RNA, 19 nt, Human herpesvirus 1
ccgggcgcaauugcggcca

SEQ ID NO: 1756899 - RNA, 21 nt, Human herpesvirus 1
ccggggagacagcgccugcgu

SEQ ID NO: 1756900 - RNA, 15 nt, Human herpesvirus 1
ccggggaucuggucc

SEQ ID NO: 1756901 - RNA, 16 nt, Human herpesvirus 1
ccggggaucugguccg

SEQ ID NO: 1756902 - RNA, 23 nt, Human herpesvirus 1
ccggggcaggcgguugucggggg

SEQ ID NO: 1756903 - RNA, 20 nt, Human herpesvirus 1
cgcgaaaucguggcgcggcu

SEQ ID NO: 1756904 - RNA, 21 nt, Human herpesvirus 1
cgccuggcgucuccucugggg

SEQ ID NO: 1756905 - RNA, 19 nt, Human herpesvirus 1
cgccuggcugacccacgcg

SEQ ID NO: 1756906 - RNA, 22 nt, Human herpesvirus 1
cgccuggcuggccgcucggugg

SEQ ID NO: 1756907 - RNA, 18 nt, Human herpesvirus 1
cgccugguugcggcccgc

SEQ ID NO: 1756908 - RNA, 17 nt, Human herpesvirus 1
ccggggcucucggggcc

SEQ ID NO: 1756909 - RNA, 22 nt, Human herpesvirus 1
ccggggcuggcacaccaccgac

SEQ ID NO: 1756910 - RNA, 13 nt, Human herpesvirus 1
ccgggggccuggu

SEQ ID NO: 1756911 - RNA, 15 nt, Human herpesvirus 1
ccggggggcggaacg

SEQ ID NO: 1756912 - RNA, 23 nt, Human herpesvirus 1
cgccugccaaccugauccgcggc

SEQ ID NO: 1756913 - RNA, 22 nt, Human herpesvirus 1
cgccugcguucaucggaccccc

SEQ ID NO: 1756914 - RNA, 14 nt, Human herpesvirus 1
cgcgacccaggcgg

SEQ ID NO: 1756915 - RNA, 20 nt, Human herpesvirus 1
cgcgaccccauggccgcucc

SEQ ID NO: 1756916 - RNA, 17 nt, Human herpesvirus 1
cgcgacccgcacgagcc

SEQ ID NO: 1756917 - RNA, 21 nt, Human herpesvirus 1
cgcgacccucaccggguacgg

SEQ ID NO: 1756918 - RNA, 17 nt, Human herpesvirus 1
cgcgaccaccccgagaa

SEQ ID NO: 1756919 - RNA, 23 nt, Human herpesvirus 1
cgcgacgggcagugaggguggca

SEQ ID NO: 1756920 - RNA, 13 nt, Human herpesvirus 1
ccgcgacccgcac

SEQ ID NO: 1756921 - RNA, 13 nt, Human herpesvirus 1
ccgcgacccggac

SEQ ID NO: 1756922 - RNA, 20 nt, Human herpesvirus 1
ccgcgacccggacgccgauc

SEQ ID NO: 1756923 - RNA, 12 nt, Human herpesvirus 1
ccgcgcgggggc

SEQ ID NO: 1756924 - RNA, 18 nt, Human herpesvirus 1
ccgcgcuccucccgccac

SEQ ID NO: 1756925 - RNA, 15 nt, Human herpesvirus 1
ccgcgaccaccccga

SEQ ID NO: 1756926 - RNA, 22 nt, Human herpesvirus 1
ccgcgacccaccgggcccggcc

SEQ ID NO: 1756927 - RNA, 18 nt, Human herpesvirus 1
ccgcgcauauccgggggc

SEQ ID NO: 1756928 - RNA, 14 nt, Human herpesvirus 1
ccgcgcauccgacc

SEQ ID NO: 1756929 - RNA, 19 nt, Human herpesvirus 1
ccgcgcaugaucuccggac

SEQ ID NO: 1756930 - RNA, 13 nt, Human herpesvirus 1
ccgcgccccccga

SEQ ID NO: 1756931 - RNA, 22 nt, Human herpesvirus 1
ccgcgccgacaucaccaccguc

SEQ ID NO: 1756932 - RNA, 19 nt, Human herpesvirus 1
ccgcgcggacggcgcgggg

SEQ ID NO: 1756933 - RNA, 21 nt, Human herpesvirus 1
ccgcgcggacggcgcggggcc

SEQ ID NO: 1756934 - RNA, 12 nt, Human herpesvirus 1
ccgccggcggcg

SEQ ID NO: 1756935 - RNA, 14 nt, Human herpesvirus 1
ccgccguccgaacc

SEQ ID NO: 1756936 - RNA, 15 nt, Human herpesvirus 1
ccgccucggcccgcg

SEQ ID NO: 1756937 - RNA, 14 nt, Human herpesvirus 1
ccgccuuccggacc

SEQ ID NO: 1756938 - RNA, 21 nt, Human herpesvirus 1
ccgcccucacagggcgggccg

SEQ ID NO: 1756939 - RNA, 14 nt, Human herpesvirus 1
ccgcccuggccgcg

SEQ ID NO: 1756940 - RNA, 19 nt, Human herpesvirus 1
ccgccgagucuucggggcc

SEQ ID NO: 1756941 - RNA, 15 nt, Human herpesvirus 1
ccgccgcccggggcc

SEQ ID NO: 1756942 - RNA, 20 nt, Human herpesvirus 1
ccgcccaaugggccgggccg

SEQ ID NO: 1756943 - RNA, 18 nt, Human herpesvirus 1
ccgccccccccccgucac

SEQ ID NO: 1756944 - RNA, 12 nt, Human herpesvirus 1
ccgcccccggca

SEQ ID NO: 1756945 - RNA, 13 nt, Human herpesvirus 1
ccgcccccggcau

SEQ ID NO: 1756946 - RNA, 12 nt, Human herpesvirus 1
ccgcccgccccu

SEQ ID NO: 1756947 - RNA, 23 nt, Human herpesvirus 1
ccgccauguuugcgggccugggc

SEQ ID NO: 1756948 - RNA, 21 nt, Human herpesvirus 1
ccgcccaacucucgcaccauc

SEQ ID NO: 1756949 - RNA, 11 nt, Human herpesvirus 1
uugcccucuuu

SEQ ID NO: 1756950 - RNA, 15 nt, Human herpesvirus 1
uugucgucucucuuc

SEQ ID NO: 1756951 - RNA, 19 nt, Human herpesvirus 1
uugucgucucucuuccccc

SEQ ID NO: 1756952 - RNA, 20 nt, Human herpesvirus 1
uucugaucgcguaccagccc

SEQ ID NO: 1756953 - RNA, 19 nt, Human herpesvirus 1
uucccccccgaccggcacc

SEQ ID NO: 1756954 - RNA, 16 nt, Human herpesvirus 1
uuccgagggccgggcc

SEQ ID NO: 1756955 - RNA, 22 nt, Human herpesvirus 1
uuaccgcccaaugggccgggcc

SEQ ID NO: 1756956 - RNA, 16 nt, Human herpesvirus 1
uuagccuccccgggcc

SEQ ID NO: 1756957 - RNA, 13 nt, Human herpesvirus 1
uguugggcgggac

SEQ ID NO: 1756958 - RNA, 13 nt, Human herpesvirus 1
ugugggguccuca

SEQ ID NO: 1756959 - RNA, 21 nt, Human herpesvirus 1
ugucucgucuccucuucuccc

SEQ ID NO: 1756960 - RNA, 23 nt, Human herpesvirus 1
uguccccgccgacaagccgcgau

SEQ ID NO: 1756961 - RNA, 22 nt, Human herpesvirus 1
uguccaccgggaagcagggccc

SEQ ID NO: 1756962 - RNA, 13 nt, Human herpesvirus 1
uggguccgggccc

SEQ ID NO: 1756963 - RNA, 22 nt, Human herpesvirus 1
uggucggcgucggugaucccca

SEQ ID NO: 1756964 - RNA, 18 nt, Human herpesvirus 1
uggucucuggccgcgccc

SEQ ID NO: 1756965 - RNA, 13 nt, Human herpesvirus 1
uggggggggggcg

SEQ ID NO: 1756966 - RNA, 15 nt, Human herpesvirus 1
uggggggguccggca

SEQ ID NO: 1756967 - RNA, 15 nt, Human herpesvirus 1
ugggcggccccggcc

SEQ ID NO: 1756968 - RNA, 20 nt, Human herpesvirus 1
ugcgggaguuucuccgcggu

SEQ ID NO: 1756969 - RNA, 16 nt, Human herpesvirus 1
ugcggggaggggggca

SEQ ID NO: 1756970 - RNA, 13 nt, Human herpesvirus 1
ugcggcccgcguu

SEQ ID NO: 1756971 - RNA, 15 nt, Human herpesvirus 1
ugcggccggcgggac

SEQ ID NO: 1756972 - RNA, 23 nt, Human herpesvirus 1
ugcgcgaucccccgcccccggcu

SEQ ID NO: 1756973 - RNA, 21 nt, Human herpesvirus 1
uggccgcucccaaccgcgacc

SEQ ID NO: 1756974 - RNA, 20 nt, Human herpesvirus 1
uggccggggagggcagggcc

SEQ ID NO: 1756975 - RNA, 20 nt, Human herpesvirus 1
uggcgcagcugggaccccgg

SEQ ID NO: 1756976 - RNA, 19 nt, Human herpesvirus 1
uggcgccgccugguccccc

SEQ ID NO: 1756977 - RNA, 13 nt, Human herpesvirus 1
uggcgccccggcc

SEQ ID NO: 1756978 - RNA, 14 nt, Human herpesvirus 1
uggcgccccggccc

SEQ ID NO: 1756979 - RNA, 20 nt, Human herpesvirus 1
uggcgcguaucugguccccg

SEQ ID NO: 1756980 - RNA, 12 nt, Human herpesvirus 1
uggcuccgggcc

SEQ ID NO: 1756981 - RNA, 13 nt, Human herpesvirus 1
uggcuggccgcuc

SEQ ID NO: 1756982 - RNA, 15 nt, Human herpesvirus 1
ugggacaccggcgcu

SEQ ID NO: 1756983 - RNA, 18 nt, Human herpesvirus 1
ugggagagccggccccgg

SEQ ID NO: 1756984 - RNA, 22 nt, Human herpesvirus 1
guggagcugcccggcggccagu

SEQ ID NO: 1756985 - RNA, 19 nt, Human herpesvirus 1
guggcgcacgaauccuucg

SEQ ID NO: 1756986 - RNA, 22 nt, Human herpesvirus 1
guggcgucucgccggacgacgu

SEQ ID NO: 1756987 - RNA, 13 nt, Human herpesvirus 1
guuauaggccacg

SEQ ID NO: 1756988 - RNA, 18 nt, Human herpesvirus 1
uaccgaaggcgcuucccc

SEQ ID NO: 1756989 - RNA, 15 nt, Human herpesvirus 1
gugguauuccugccg

SEQ ID NO: 1756990 - RNA, 19 nt, Human herpesvirus 1
guguaugucuggugugugg

SEQ ID NO: 1756991 - RNA, 14 nt, Human herpesvirus 1
uacgcgggccccgg

SEQ ID NO: 1756992 - RNA, 16 nt, Human herpesvirus 1
uacgcggggcuguacu

SEQ ID NO: 1756993 - RNA, 12 nt, Human herpesvirus 1
uagaccacgccc

SEQ ID NO: 1756994 - RNA, 15 nt, Human herpesvirus 1
uaccaucccccggcc

SEQ ID NO: 1756995 - RNA, 18 nt, Human herpesvirus 1
uaccccaguccccgggcc

SEQ ID NO: 1756996 - RNA, 18 nt, Human herpesvirus 1
uaccggaaggaacccgcg

SEQ ID NO: 1756997 - RNA, 23 nt, Human herpesvirus 1
uacgccgccaccguggccggccu

SEQ ID NO: 1756998 - RNA, 18 nt, Human herpesvirus 1
uacgcuaaucccccggcu

SEQ ID NO: 1756999 - RNA, 14 nt, Human herpesvirus 1
uagccuccccgggc

SEQ ID NO: 1757000 - RNA, 15 nt, Human herpesvirus 1
uagccuccccgggcc

SEQ ID NO: 1757001 - RNA, 12 nt, Human herpesvirus 1
uagcgccccggc

SEQ ID NO: 1757002 - RNA, 16 nt, Human herpesvirus 1
uagcgccccggcgacc

SEQ ID NO: 1757003 - RNA, 21 nt, Human herpesvirus 1
ucucaucgccgcgcguccccc

SEQ ID NO: 1757004 - RNA, 12 nt, Human herpesvirus 1
ucuccgcccgac

SEQ ID NO: 1757005 - RNA, 16 nt, Human herpesvirus 1
ucuccgucaccgcgac

SEQ ID NO: 1757006 - RNA, 14 nt, Human herpesvirus 1
ucugaucgacgacg

SEQ ID NO: 1757007 - RNA, 18 nt, Human herpesvirus 1
ugaucagacgagccgcgc

SEQ ID NO: 1757008 - RNA, 14 nt, Human herpesvirus 1
ugauccgcggcgac

SEQ ID NO: 1757009 - RNA, 20 nt, Human herpesvirus 1
ugauggcacaccgguccccg

SEQ ID NO: 1757010 - RNA, 18 nt, Human herpesvirus 1
ugauggccugugcuuucu

SEQ ID NO: 1757011 - RNA, 18 nt, Human herpesvirus 1
ugcacagccuggccgugc

SEQ ID NO: 1757012 - RNA, 16 nt, Human herpesvirus 1
ugcacgcccccgcguu

SEQ ID NO: 1757013 - RNA, 19 nt, Human herpesvirus 1
ugauaaugaucaagcggcg

SEQ ID NO: 1757014 - RNA, 16 nt, Human herpesvirus 1
ugaaaaucgguccccc

SEQ ID NO: 1757015 - RNA, 15 nt, Human herpesvirus 1
ugaaaccggccaacg

SEQ ID NO: 1757016 - RNA, 18 nt, Human herpesvirus 1
ucuggccaucgguccccu

SEQ ID NO: 1757017 - RNA, 13 nt, Human herpesvirus 1
ucuggccccggcg

SEQ ID NO: 1757018 - RNA, 24 nt, Human herpesvirus 1
ucugaccugcaccgaucgcagcgu

SEQ ID NO: 1757019 - RNA, 16 nt, Human herpesvirus 1
ugccuccaccgggccc

SEQ ID NO: 1757020 - RNA, 21 nt, Human herpesvirus 1
ugcacccccgacgaggugcgc

SEQ ID NO: 1757021 - RNA, 14 nt, Human herpesvirus 1
gccgcugaccccca

SEQ ID NO: 1757022 - RNA, 21 nt, Human herpesvirus 1
gccgcuggcaacucgccccac

SEQ ID NO: 1757023 - RNA, 15 nt, Human herpesvirus 1
gccggcaacugacgc

SEQ ID NO: 1757024 - RNA, 19 nt, Human herpesvirus 1
gccuacacucgacccccgc

SEQ ID NO: 1757025 - RNA, 17 nt, Human herpesvirus 1
gccuacuacucggaaag

SEQ ID NO: 1757026 - RNA, 18 nt, Human herpesvirus 1
gccggauucccgggccgg

SEQ ID NO: 1757027 - RNA, 22 nt, Human herpesvirus 1
gccgagccccccgcugcggcca

SEQ ID NO: 1757028 - RNA, 22 nt, Human herpesvirus 1
gccgagucuucggggcccggcc

SEQ ID NO: 1757029 - RNA, 13 nt, Human herpesvirus 1
gccgacggcccga

SEQ ID NO: 1757030 - RNA, 15 nt, Human herpesvirus 1
gccgaucccucgcga

SEQ ID NO: 1757031 - RNA, 12 nt, Human herpesvirus 1
gccgccacgcgc

SEQ ID NO: 1757032 - RNA, 17 nt, Human herpesvirus 1
gccgacaucgacacggu

SEQ ID NO: 1757033 - RNA, 18 nt, Human herpesvirus 1
gucuucgcgaacccccgu

SEQ ID NO: 1757034 - RNA, 21 nt, Human herpesvirus 1
gugcccccggauaugcgcggg

SEQ ID NO: 1757035 - RNA, 19 nt, Human herpesvirus 1
gucugcuccccaccccgga

SEQ ID NO: 1757036 - RNA, 14 nt, Human herpesvirus 1
gucuguccucggga

SEQ ID NO: 1757037 - RNA, 21 nt, Human herpesvirus 1
gucuccgaaagccaccaauag

SEQ ID NO: 1757038 - RNA, 20 nt, Human herpesvirus 1
gucucuggccgcgcccacua

SEQ ID NO: 1757039 - RNA, 14 nt, Human herpesvirus 1
gucgucgaucgacg

SEQ ID NO: 1757040 - RNA, 18 nt, Human herpesvirus 1
gucgucucucuucccccc

SEQ ID NO: 1757041 - RNA, 14 nt, Human herpesvirus 1
gucgggaggccaca

SEQ ID NO: 1757042 - RNA, 19 nt, Human herpesvirus 1
gucggcaagauccucgggc

SEQ ID NO: 1757043 - RNA, 20 nt, Human herpesvirus 1
guaggcccagcauguccgcc

SEQ ID NO: 1757044 - RNA, 23 nt, Human herpesvirus 1
guacuggaaguaccugcagacgg

SEQ ID NO: 1757045 - RNA, 22 nt, Human herpesvirus 1
guacguggucguccgcggaccg

SEQ ID NO: 1757046 - RNA, 23 nt, Human herpesvirus 1
ggacccaagccgccccagcaccg

SEQ ID NO: 1757047 - RNA, 15 nt, Human herpesvirus 1
ggaccgccucggucc

SEQ ID NO: 1757048 - RNA, 19 nt, Human herpesvirus 1
ggaccgccugccgcgcgga

SEQ ID NO: 1757049 - RNA, 20 nt, Human herpesvirus 1
ggaacgggaggccacagcgc

SEQ ID NO: 1757050 - RNA, 17 nt, Human herpesvirus 1
gcugcgguugcccccga

SEQ ID NO: 1757051 - RNA, 18 nt, Human herpesvirus 1
gcugcugcggccagucca

SEQ ID NO: 1757052 - RNA, 16 nt, Human herpesvirus 1
gcuggccgacguggcg

SEQ ID NO: 1757053 - RNA, 12 nt, Human herpesvirus 1
ggaaacccccga

SEQ ID NO: 1757054 - RNA, 15 nt, Human herpesvirus 1
ggaacacacccccgu

SEQ ID NO: 1757055 - RNA, 13 nt, Human herpesvirus 1
ggaacaccuccgc

SEQ ID NO: 1757056 - RNA, 18 nt, Human herpesvirus 1
gcucgcggagggcggcca

SEQ ID NO: 1757057 - RNA, 21 nt, Human herpesvirus 1
gcuccggggaucugguccgcc

SEQ ID NO: 1757058 - RNA, 21 nt, Human herpesvirus 1
gcguuucugucggaccaccgc

SEQ ID NO: 1757059 - RNA, 21 nt, Human herpesvirus 1
gcuccgaguucccccggcacg

SEQ ID NO: 1757060 - RNA, 17 nt, Human herpesvirus 1
gcgggcccccggccgcc

SEQ ID NO: 1757061 - RNA, 16 nt, Human herpesvirus 1
gcgggccgccucgggg

SEQ ID NO: 1757062 - RNA, 15 nt, Human herpesvirus 1
gccuggaucccaacg

SEQ ID NO: 1757063 - RNA, 15 nt, Human herpesvirus 1
gcgggagacgggcgg

SEQ ID NO: 1757064 - RNA, 13 nt, Human herpesvirus 1
gccuccacccccu

SEQ ID NO: 1757065 - RNA, 14 nt, Human herpesvirus 1
gccuccaccgggcc

SEQ ID NO: 1757066 - RNA, 16 nt, Human herpesvirus 1
gccucccaacccccua

SEQ ID NO: 1757067 - RNA, 12 nt, Human herpesvirus 1
gccucccgauca

SEQ ID NO: 1757068 - RNA, 15 nt, Human herpesvirus 1
gccuccgaccccaga

SEQ ID NO: 1757069 - RNA, 18 nt, Human herpesvirus 1
gccucggcccgcgaacgg

SEQ ID NO: 1757070 - RNA, 23 nt, Human herpesvirus 1
gccucggcccgcgaacggcacgc

SEQ ID NO: 1757071 - RNA, 18 nt, Human herpesvirus 1
gccucguggggcuggacg

SEQ ID NO: 1757072 - RNA, 23 nt, Human herpesvirus 1
gccucucacacagcaucccccgc

SEQ ID NO: 1757073 - RNA, 12 nt, Human herpesvirus 1
gccucucccccc

SEQ ID NO: 1757074 - RNA, 21 nt, Human herpesvirus 1
gccugacccucuccgggaugg

SEQ ID NO: 1757075 - RNA, 14 nt, Human herpesvirus 1
gccugacgccugcc

SEQ ID NO: 1757076 - RNA, 18 nt, Human herpesvirus 1
gcguuaaccgcacccccc

SEQ ID NO: 1757077 - RNA, 18 nt, Human herpesvirus 1
gcguucaucggacccccc

SEQ ID NO: 1757078 - RNA, 13 nt, Human herpesvirus 1
gcgggcgccaugg

SEQ ID NO: 1757079 - RNA, 12 nt, Human herpesvirus 1
gcggggccgugg

SEQ ID NO: 1757080 - RNA, 20 nt, Human herpesvirus 1
gcggggccuuggcggccgcc

SEQ ID NO: 1757081 - RNA, 17 nt, Human herpesvirus 1
gcgggguuauaggccac

SEQ ID NO: 1757082 - RNA, 20 nt, Human herpesvirus 1
cgggcgaaaaaaggcggugc

SEQ ID NO: 1757083 - RNA, 19 nt, Human herpesvirus 1
cggacggcgcggggccccc

SEQ ID NO: 1757084 - RNA, 18 nt, Human herpesvirus 1
cggggcagagccgcccgu

SEQ ID NO: 1757085 - RNA, 13 nt, Human herpesvirus 1
cggggccagcgcc

SEQ ID NO: 1757086 - RNA, 22 nt, Human herpesvirus 1
cggggcggggccuuggcggccg

SEQ ID NO: 1757087 - RNA, 22 nt, Human herpesvirus 1
cggggcggggguguccgggggc

SEQ ID NO: 1757088 - RNA, 20 nt, Human herpesvirus 1
cggggccugcuacagccgcc

SEQ ID NO: 1757089 - RNA, 14 nt, Human herpesvirus 1
cgggggcccugcca

SEQ ID NO: 1757090 - RNA, 12 nt, Human herpesvirus 1
cggguccgcggg

SEQ ID NO: 1757091 - RNA, 18 nt, Human herpesvirus 1
cgggugcuucccacgcga

SEQ ID NO: 1757092 - RNA, 15 nt, Human herpesvirus 1
cggguucccccggca

SEQ ID NO: 1757093 - RNA, 19 nt, Human herpesvirus 1
cggggaccuugccccggcc

SEQ ID NO: 1757094 - RNA, 11 nt, Human herpesvirus 1
cgggcgcggcg

SEQ ID NO: 1757095 - RNA, 12 nt, Human herpesvirus 1
cgggcguccgcc

SEQ ID NO: 1757096 - RNA, 19 nt, Human herpesvirus 1
cgggcuacccucacuaucg

SEQ ID NO: 1757097 - RNA, 22 nt, Human herpesvirus 1
cgggcuacccucacuaucgagg

SEQ ID NO: 1757098 - RNA, 21 nt, Human herpesvirus 1
cgggcuacuggugggugagcg

SEQ ID NO: 1757099 - RNA, 13 nt, Human herpesvirus 1
cgggcgaugagcc

SEQ ID NO: 1757100 - RNA, 18 nt, Human herpesvirus 1
cgggcgcaauugcggcca

SEQ ID NO: 1757101 - RNA, 12 nt, Human herpesvirus 1
cgggcgcguccc

SEQ ID NO: 1757102 - RNA, 17 nt, Human herpesvirus 1
cgggcgcguccccggcc

SEQ ID NO: 1757103 - RNA, 12 nt, Human herpesvirus 1
cgggcgcugggu

SEQ ID NO: 1757104 - RNA, 13 nt, Human herpesvirus 1
cgggcggcccugc

SEQ ID NO: 1757105 - RNA, 23 nt, Human herpesvirus 1
cgucgccuggcugacccacgcgg

SEQ ID NO: 1757106 - RNA, 20 nt, Human herpesvirus 1
cgucgcccuccaccaacgcc

SEQ ID NO: 1757107 - RNA, 19 nt, Human herpesvirus 1
cgucgccgcgggccacgcc

SEQ ID NO: 1757108 - RNA, 17 nt, Human herpesvirus 1
cguccgguuggccgcgc

SEQ ID NO: 1757109 - RNA, 19 nt, Human herpesvirus 1
cgucgacucuaucgcgcgc

SEQ ID NO: 1757110 - RNA, 15 nt, Human herpesvirus 1
cgucgcacgcgucca

SEQ ID NO: 1757111 - RNA, 22 nt, Human herpesvirus 1
cugaucauuacccccguccgca

SEQ ID NO: 1757112 - RNA, 16 nt, Human herpesvirus 1
cugacgccucagggcc

SEQ ID NO: 1757113 - RNA, 17 nt, Human herpesvirus 1
cugacgccucagggccu

SEQ ID NO: 1757114 - RNA, 20 nt, Human herpesvirus 1
cugagcgcccuccugaccaa

SEQ ID NO: 1757115 - RNA, 22 nt, Human herpesvirus 1
cgucagcgaggauaaccugggg

SEQ ID NO: 1757116 - RNA, 17 nt, Human herpesvirus 1
cggugcuccgccgcgga

SEQ ID NO: 1757117 - RNA, 19 nt, Human herpesvirus 1
cgucacgcaagaccaggcc

SEQ ID NO: 1757118 - RNA, 16 nt, Human herpesvirus 1
cguccaucaccacgcc

SEQ ID NO: 1757119 - RNA, 23 nt, Human herpesvirus 1
cguccauucucccgaaccaggcc

SEQ ID NO: 1757120 - RNA, 16 nt, Human herpesvirus 1
cgucccggcucuccga

SEQ ID NO: 1757121 - RNA, 22 nt, Human herpesvirus 1
cgucccguagucccaucccccg

SEQ ID NO: 1757122 - RNA, 21 nt, Human herpesvirus 1
cguccgccgagucuucggggc

SEQ ID NO: 1757123 - RNA, 13 nt, Human herpesvirus 1
cguccgcgccccu

SEQ ID NO: 1757124 - RNA, 14 nt, Human herpesvirus 1
cggugaccgcgugc

SEQ ID NO: 1757125 - RNA, 19 nt, Human herpesvirus 1
cggugacgcgccaaacgcc

SEQ ID NO: 1757126 - RNA, 17 nt, Human herpesvirus 1
cggugauguucgggcgg

SEQ ID NO: 1757127 - RNA, 16 nt, Human herpesvirus 1
cggugcgucugggccc

SEQ ID NO: 1757128 - RNA, 18 nt, Human herpesvirus 1
cggugaacgaagcggcca

SEQ ID NO: 1757129 - RNA, 21 nt, Human herpesvirus 1
cggucauccacgccgacgcca

SEQ ID NO: 1757130 - RNA, 13 nt, Human herpesvirus 1
cgguccacggcca

SEQ ID NO: 1757131 - RNA, 16 nt, Human herpesvirus 1
cgguccccucugggcc

SEQ ID NO: 1757132 - RNA, 20 nt, Human herpesvirus 1
cgguccggagccgcgcggcc

SEQ ID NO: 1757133 - RNA, 21 nt, Human herpesvirus 1
cgguccggagccgcgcggcca

SEQ ID NO: 1757134 - RNA, 15 nt, Human herpesvirus 1
cgguccugacggcca

SEQ ID NO: 1757135 - RNA, 13 nt, Human herpesvirus 1
cugcaucggcaag

SEQ ID NO: 1757136 - RNA, 16 nt, Human herpesvirus 1
cugcacgaccugcgcu

SEQ ID NO: 1757137 - RNA, 16 nt, Human herpesvirus 1
cugcagaaucacgagc

SEQ ID NO: 1757138 - RNA, 18 nt, Human herpesvirus 1
cuggacguccccgaggac

SEQ ID NO: 1757139 - RNA, 22 nt, Human herpesvirus 1
cuggaccggggucccagcggca

SEQ ID NO: 1757140 - RNA, 17 nt, Human herpesvirus 1
cuggccaaucggcggcc

SEQ ID NO: 1757141 - RNA, 18 nt, Human herpesvirus 1
cuggccaaucggcggccg

SEQ ID NO: 1757142 - RNA, 11 nt, Human herpesvirus 1
cuggccggccu

SEQ ID NO: 1757143 - RNA, 21 nt, Human herpesvirus 1
cuggccggccuggcggcggcc

SEQ ID NO: 1757144 - RNA, 23 nt, Human herpesvirus 1
cuuuaagcgcugcugcggccagu

SEQ ID NO: 1757145 - RNA, 13 nt, Human herpesvirus 1
cuuggcggccgcc

SEQ ID NO: 1757146 - RNA, 20 nt, Human herpesvirus 1
cuugggguugacgcuggggg

SEQ ID NO: 1757147 - RNA, 16 nt, Human herpesvirus 1
cuggcgcaaccacgcc

SEQ ID NO: 1757148 - RNA, 23 nt, Human herpesvirus 1
cuggcgcccccccaacgggggac

SEQ ID NO: 1757149 - RNA, 15 nt, Human herpesvirus 1
cuggcguacaacggc

SEQ ID NO: 1757150 - RNA, 16 nt, Human herpesvirus 1
cuucggccccgcgucu

SEQ ID NO: 1757151 - RNA, 13 nt, Human herpesvirus 1
cuucuccgcgugg

SEQ ID NO: 1757152 - RNA, 21 nt, Human herpesvirus 1
cuugaagaucgccggguggca

SEQ ID NO: 1757153 - RNA, 15 nt, Human herpesvirus 1
gaccaacgacggccc

SEQ ID NO: 1757154 - RNA, 15 nt, Human herpesvirus 1
gaccacacacccccc

SEQ ID NO: 1757155 - RNA, 14 nt, Human herpesvirus 1
gacagggccgugcc

SEQ ID NO: 1757156 - RNA, 14 nt, Human herpesvirus 1
gacauccaccaccc

SEQ ID NO: 1757157 - RNA, 16 nt, Human herpesvirus 1
gacaugaccgcccgcc

SEQ ID NO: 1757158 - RNA, 13 nt, Human herpesvirus 1
gacccaaaauaau

SEQ ID NO: 1757159 - RNA, 15 nt, Human herpesvirus 1
gaccagcgcacugcc

SEQ ID NO: 1757160 - RNA, 22 nt, Human herpesvirus 1
gaccagcugaccgacccuccgg

SEQ ID NO: 1757161 - RNA, 15 nt, Human herpesvirus 1
gaccaggucccccac

SEQ ID NO: 1757162 - RNA, 14 nt, Human herpesvirus 1
gacccaacccccgg

SEQ ID NO: 1757163 - RNA, 13 nt, Human herpesvirus 1
gacccaccaauaa

SEQ ID NO: 1757164 - RNA, 14 nt, Human herpesvirus 1
gacccaccgggccc

SEQ ID NO: 1757165 - RNA, 20 nt, Human herpesvirus 1
gaccccagcgaccccacggc

SEQ ID NO: 1757166 - RNA, 11 nt, Human herpesvirus 1
gacccgacuca

SEQ ID NO: 1757167 - RNA, 23 nt, Human herpesvirus 1
gacccuaggaggccgccacgcgc

SEQ ID NO: 1757168 - RNA, 12 nt, Human herpesvirus 1
gacccucuccgg

SEQ ID NO: 1757169 - RNA, 14 nt, Human herpesvirus 1
gaccgacaccccca

SEQ ID NO: 1757170 - RNA, 12 nt, Human herpesvirus 1
gaagagccugcc

SEQ ID NO: 1757171 - RNA, 18 nt, Human herpesvirus 1
gaagaggaggagggggcc

SEQ ID NO: 1757172 - RNA, 19 nt, Human herpesvirus 1
gccccaccccccgacgcca

SEQ ID NO: 1757173 - RNA, 19 nt, Human herpesvirus 1
gcccacgaucaccgcggga

SEQ ID NO: 1757174 - RNA, 15 nt, Human herpesvirus 1
gcccacgccucgggc

SEQ ID NO: 1757175 - RNA, 20 nt, Human herpesvirus 1
gcccagcgcagaggcggcca

SEQ ID NO: 1757176 - RNA, 14 nt, Human herpesvirus 1
gcccacuucccccc

SEQ ID NO: 1757177 - RNA, 15 nt, Human herpesvirus 1
gcccagacgcccucc

SEQ ID NO: 1757178 - RNA, 15 nt, Human herpesvirus 1
gcccacgucgccccg

SEQ ID NO: 1757179 - RNA, 18 nt, Human herpesvirus 1
gcccaaugggccgggccg

SEQ ID NO: 1757180 - RNA, 19 nt, Human herpesvirus 1
gcccaaugggccgggccgc

SEQ ID NO: 1757181 - RNA, 11 nt, Human herpesvirus 1
gcccacccccc

SEQ ID NO: 1757182 - RNA, 14 nt, Human herpesvirus 1
gccaucaaccccgc

SEQ ID NO: 1757183 - RNA, 13 nt, Human herpesvirus 1
gccauccucacgc

SEQ ID NO: 1757184 - RNA, 16 nt, Human herpesvirus 1
gccaguccgcugcacc

SEQ ID NO: 1757185 - RNA, 17 nt, Human herpesvirus 1
gccaugcuggcggacgg

SEQ ID NO: 1757186 - RNA, 14 nt, Human herpesvirus 1
gccaugcgugccgu

SEQ ID NO: 1757187 - RNA, 18 nt, Human herpesvirus 1
gccaggucggcgaccgcc

SEQ ID NO: 1757188 - RNA, 19 nt, Human herpesvirus 1
gccaggucggcgaccgcca

SEQ ID NO: 1757189 - RNA, 22 nt, Human herpesvirus 1
gacucaagcacacacgggggag

SEQ ID NO: 1757190 - RNA, 16 nt, Human herpesvirus 1
gccaggaccgccugcc

SEQ ID NO: 1757191 - RNA, 16 nt, Human herpesvirus 1
gacguuuuccucgucc

SEQ ID NO: 1757192 - RNA, 16 nt, Human herpesvirus 1
gacggguacgugaacg

SEQ ID NO: 1757193 - RNA, 18 nt, Human herpesvirus 1
gacggugagcgaggacgg

SEQ ID NO: 1757194 - RNA, 22 nt, Human herpesvirus 1
gacguccugggccaccugacgc

SEQ ID NO: 1757195 - RNA, 21 nt, Human herpesvirus 1
gacgucugggaacacaggcgc

SEQ ID NO: 1757196 - RNA, 16 nt, Human herpesvirus 1
cggaccaccgcccccc

SEQ ID NO: 1757197 - RNA, 23 nt, Human herpesvirus 1
cggaccaccgccccccuguuccc

SEQ ID NO: 1757198 - RNA, 20 nt, Human herpesvirus 1
cggacccguuccagcccccc

SEQ ID NO: 1757199 - RNA, 17 nt, Human herpesvirus 1
cgcugugccaucgcgcc

SEQ ID NO: 1757200 - RNA, 18 nt, Human herpesvirus 1
cgcuguugccggaacgca

SEQ ID NO: 1757201 - RNA, 16 nt, Human herpesvirus 1
cgcuuccaucgccccu

SEQ ID NO: 1757202 - RNA, 17 nt, Human herpesvirus 1
cggaaacguucgcgcgc

SEQ ID NO: 1757203 - RNA, 15 nt, Human herpesvirus 1
cggaacgggaggcca

SEQ ID NO: 1757204 - RNA, 17 nt, Human herpesvirus 1
cgcgucgacgucgcgcc

SEQ ID NO: 1757205 - RNA, 18 nt, Human herpesvirus 1
cgcgugcccacgucgccc

SEQ ID NO: 1757206 - RNA, 19 nt, Human herpesvirus 1
cgcgugcccacgucgcccc

SEQ ID NO: 1757207 - RNA, 23 nt, Human herpesvirus 1
cgcggggggggcgggcucguccc

SEQ ID NO: 1757208 - RNA, 23 nt, Human herpesvirus 1
cgcgggucuguauagcccgggca

SEQ ID NO: 1757209 - RNA, 13 nt, Human herpesvirus 1
cgcgguucgcguc

SEQ ID NO: 1757210 - RNA, 16 nt, Human herpesvirus 1
cgcagaggcggccaga

SEQ ID NO: 1757211 - RNA, 22 nt, Human herpesvirus 1
cgcagcaccuccuacgccgggg

SEQ ID NO: 1757212 - RNA, 17 nt, Human herpesvirus 1
cgccgaccgacuccccg

SEQ ID NO: 1757213 - RNA, 16 nt, Human herpesvirus 1
cgccgacggacagcca

SEQ ID NO: 1757214 - RNA, 21 nt, Human herpesvirus 1
cgcacgcucccaucgcgggcg

SEQ ID NO: 1757215 - RNA, 22 nt, Human herpesvirus 1
cgcacuugcggcaagacccggg

SEQ ID NO: 1757216 - RNA, 22 nt, Human herpesvirus 1
cgcagacgaaaagccccgggcc

SEQ ID NO: 1757217 - RNA, 13 nt, Human herpesvirus 1
cgccgacucccgg

SEQ ID NO: 1757218 - RNA, 13 nt, Human herpesvirus 1
cgccgagcccccc

SEQ ID NO: 1757219 - RNA, 21 nt, Human herpesvirus 1
cgccgaucccgacuccccgga

SEQ ID NO: 1757220 - RNA, 21 nt, Human herpesvirus 1
cgccgcaaagccacccacgcc

SEQ ID NO: 1757221 - RNA, 22 nt, Human herpesvirus 1
cgccgcaaagccacccacgccg

SEQ ID NO: 1757222 - RNA, 19 nt, Human herpesvirus 1
cgccgccaccguggccggc

SEQ ID NO: 1757223 - RNA, 16 nt, Human herpesvirus 1
cgccgcgacccgcacg

SEQ ID NO: 1757224 - RNA, 16 nt, Human herpesvirus 1
cgccgcgagauggccg

SEQ ID NO: 1757225 - RNA, 19 nt, Human herpesvirus 1
cgccgcgagauggccgccc

SEQ ID NO: 1757226 - RNA, 17 nt, Human herpesvirus 1
cgcgggcguucccgagc

SEQ ID NO: 1757227 - RNA, 19 nt, Human herpesvirus 1
cgcggggacacgauuccgg

SEQ ID NO: 1757228 - RNA, 15 nt, Human herpesvirus 1
cgcggggccuccccc

SEQ ID NO: 1757229 - RNA, 19 nt, Human herpesvirus 1
cgcggggccucccccggac

SEQ ID NO: 1757230 - RNA, 13 nt, Human herpesvirus 1
cgcgggcgacgcc

SEQ ID NO: 1757231 - RNA, 19 nt, Human herpesvirus 1
cgcgguagcccggccgugu

SEQ ID NO: 1757232 - RNA, 23 nt, Human herpesvirus 1
cgccgcggcucccggcccgggcc

SEQ ID NO: 1757233 - RNA, 15 nt, Human herpesvirus 1
cgccgcgccccgccg

SEQ ID NO: 1757234 - RNA, 19 nt, Human herpesvirus 1
cgccgcugacccccaccgc

SEQ ID NO: 1757235 - RNA, 11 nt, Human herpesvirus 1
cgcggcgcgcu

SEQ ID NO: 1757236 - RNA, 16 nt, Human herpesvirus 1
cgcgggaggccgcccc

SEQ ID NO: 1757237 - RNA, 18 nt, Human herpesvirus 1
cgcgggcccccggccgcc

SEQ ID NO: 1757238 - RNA, 21 nt, Human herpesvirus 1
cgaccggacccgcaucccccg

SEQ ID NO: 1757239 - RNA, 17 nt, Human herpesvirus 1
cgaccgccggcggcgac

SEQ ID NO: 1757240 - RNA, 18 nt, Human herpesvirus 1
cgaacaucuugagggggg

SEQ ID NO: 1757241 - RNA, 15 nt, Human herpesvirus 1
cgaacgcggaccccc

SEQ ID NO: 1757242 - RNA, 13 nt, Human herpesvirus 1
ccuugccccggcc

SEQ ID NO: 1757243 - RNA, 18 nt, Human herpesvirus 1
ccugucggccgccgacga

SEQ ID NO: 1757244 - RNA, 22 nt, Human herpesvirus 1
ccuuacgcuaaucccccggcuc

SEQ ID NO: 1757245 - RNA, 17 nt, Human herpesvirus 1
ccugaucgccggcgcgg

SEQ ID NO: 1757246 - RNA, 18 nt, Human herpesvirus 1
ccugaccaacgacggccc

SEQ ID NO: 1757247 - RNA, 16 nt, Human herpesvirus 1
ccugagcccggcggcg

SEQ ID NO: 1757248 - RNA, 18 nt, Human herpesvirus 1
ccugaucauuacccccgu

SEQ ID NO: 1757249 - RNA, 19 nt, Human herpesvirus 1
ccucggacgccacaccauc

SEQ ID NO: 1757250 - RNA, 13 nt, Human herpesvirus 1
ccucgcgcggcga

SEQ ID NO: 1757251 - RNA, 16 nt, Human herpesvirus 1
ccucgccacgucgacc

SEQ ID NO: 1757252 - RNA, 18 nt, Human herpesvirus 1
ccucgccccauacucccg

SEQ ID NO: 1757253 - RNA, 14 nt, Human herpesvirus 1
ccucgaccaccauc

SEQ ID NO: 1757254 - RNA, 13 nt, Human herpesvirus 1
ccucgaugacguc

SEQ ID NO: 1757255 - RNA, 13 nt, Human herpesvirus 1
ccucgcaccagcc

SEQ ID NO: 1757256 - RNA, 15 nt, Human herpesvirus 1
ccgaccacccggaac

SEQ ID NO: 1757257 - RNA, 11 nt, Human herpesvirus 1
ccuccaugggg

SEQ ID NO: 1757258 - RNA, 14 nt, Human herpesvirus 1
ccgaagccccggcc

SEQ ID NO: 1757259 - RNA, 13 nt, Human herpesvirus 1
ccucccgccaccc

SEQ ID NO: 1757260 - RNA, 15 nt, Human herpesvirus 1
ccucccugacggcca

SEQ ID NO: 1757261 - RNA, 17 nt, Human herpesvirus 1
ccuccgcuggggccccc

SEQ ID NO: 1757262 - RNA, 14 nt, Human herpesvirus 1
cgaggagguggacg

SEQ ID NO: 1757263 - RNA, 14 nt, Human herpesvirus 1
cgcacgagccgggg

SEQ ID NO: 1757264 - RNA, 23 nt, Human herpesvirus 1
cgcacgcauacgggcggccaccc

SEQ ID NO: 1757265 - RNA, 16 nt, Human herpesvirus 1
cgaccggguucccccg

SEQ ID NO: 1757266 - RNA, 14 nt, Human herpesvirus 1
cgaccuggggcgcg

SEQ ID NO: 1757267 - RNA, 17 nt, Human herpesvirus 1
cgacgucgcgccugggu

SEQ ID NO: 1757268 - RNA, 16 nt, Human herpesvirus 1
cccagaugcccacggg

SEQ ID NO: 1757269 - RNA, 18 nt, Human herpesvirus 1
cccagauuguccgcgggg

SEQ ID NO: 1757270 - RNA, 12 nt, Human herpesvirus 1
ccccggccccca

SEQ ID NO: 1757271 - RNA, 15 nt, Human herpesvirus 1
cccagaccccgggcg

SEQ ID NO: 1757272 - RNA, 13 nt, Human herpesvirus 1
cccacgucgcccc

SEQ ID NO: 1757273 - RNA, 13 nt, Human herpesvirus 1
ccccuggcgcgcg

SEQ ID NO: 1757274 - RNA, 20 nt, Human herpesvirus 1
cccgaaacuucaucaccccc

SEQ ID NO: 1757275 - RNA, 19 nt, Human herpesvirus 1
cccgaaccaggccguuccg

SEQ ID NO: 1757276 - RNA, 23 nt, Human herpesvirus 1
ccccggguuccgcgaccaccccg

SEQ ID NO: 1757277 - RNA, 14 nt, Human herpesvirus 1
ccccggucuccccg

SEQ ID NO: 1757278 - RNA, 17 nt, Human herpesvirus 1
ccccggucuccccggga

SEQ ID NO: 1757279 - RNA, 12 nt, Human herpesvirus 1
ccccgucacccg

SEQ ID NO: 1757280 - RNA, 19 nt, Human herpesvirus 1
cccgaagccugcuguuucg

SEQ ID NO: 1757281 - RNA, 15 nt, Human herpesvirus 1
cccgaugcggcggcg

SEQ ID NO: 1757282 - RNA, 21 nt, Human herpesvirus 1
cccgcacagaugggacgccau

SEQ ID NO: 1757283 - RNA, 12 nt, Human herpesvirus 1
cccgcccaccgg

SEQ ID NO: 1757284 - RNA, 13 nt, Human herpesvirus 1
cccgcccccggca

SEQ ID NO: 1757285 - RNA, 13 nt, Human herpesvirus 1
cccgcccccggcu

SEQ ID NO: 1757286 - RNA, 18 nt, Human herpesvirus 1
cccgcccgaccgcgugua

SEQ ID NO: 1757287 - RNA, 13 nt, Human herpesvirus 1
cccugugucgcgc

SEQ ID NO: 1757288 - RNA, 16 nt, Human herpesvirus 1
cccuguuugucgacga

SEQ ID NO: 1757289 - RNA, 19 nt, Human herpesvirus 1
cccuguuugucgccuggcu

SEQ ID NO: 1757290 - RNA, 16 nt, Human herpesvirus 1
ccgaacagcucgcgga

SEQ ID NO: 1757291 - RNA, 20 nt, Human herpesvirus 1
ccgaacgcagccccgcugga

SEQ ID NO: 1757292 - RNA, 15 nt, Human herpesvirus 1
ccgacagggccgugc

SEQ ID NO: 1757293 - RNA, 15 nt, Human herpesvirus 1
cccucaaccccggcg

SEQ ID NO: 1757294 - RNA, 23 nt, Human herpesvirus 1
cccucuuggaggaccccgugggg

SEQ ID NO: 1757295 - RNA, 18 nt, Human herpesvirus 1
cccugcugcaggcccccc

SEQ ID NO: 1757296 - RNA, 12 nt, Human herpesvirus 1
cccuggccgugg

SEQ ID NO: 1757297 - RNA, 16 nt, Human herpesvirus 1
cccgcauaucccaccc

SEQ ID NO: 1757298 - RNA, 18 nt, Human herpesvirus 1
cccgccgcaaagccaccc

SEQ ID NO: 1757299 - RNA, 20 nt, Human herpesvirus 1
cccguccgaagaucgcgugu

SEQ ID NO: 1757300 - RNA, 16 nt, Human herpesvirus 1
cccguccgcaucgauc

SEQ ID NO: 1757301 - RNA, 20 nt, Human herpesvirus 1
cccguggggacgguggcgcc

SEQ ID NO: 1757302 - RNA, 15 nt, Human herpesvirus 1
cccgugugccgcgcc

SEQ ID NO: 1757303 - RNA, 15 nt, Human herpesvirus 1
cccuccccccgcccc

SEQ ID NO: 1757304 - RNA, 22 nt, Human herpesvirus 1
cccucccgcugcgcaucccccc

SEQ ID NO: 1757305 - RNA, 13 nt, Human herpesvirus 1
cccucccgucacc

SEQ ID NO: 1757306 - RNA, 22 nt, Human herpesvirus 1
cccuccggggguccggcgcgug

SEQ ID NO: 1757307 - RNA, 17 nt, Human herpesvirus 1
cccacgaucaccgcggg

SEQ ID NO: 1757308 - RNA, 22 nt, Human herpesvirus 1
cccaauaaacguauaucgcuac

SEQ ID NO: 1757309 - RNA, 19 nt, Human herpesvirus 1
cccacacaacgcuccgccc

SEQ ID NO: 1757310 - RNA, 17 nt, Human herpesvirus 1
cccacccacuccucccc

SEQ ID NO: 1757311 - RNA, 15 nt, Human herpesvirus 1
cccaccccccacggg

SEQ ID NO: 1757312 - RNA, 18 nt, Human herpesvirus 1
cccaccccccgacgccag

SEQ ID NO: 1757313 - RNA, 17 nt, Human herpesvirus 1
cccaccgggcccggcca

SEQ ID NO: 1757314 - RNA, 18 nt, Human herpesvirus 1
cccaccguugcccgggcc

SEQ ID NO: 1757315 - RNA, 22 nt, Human herpesvirus 1
cccaacaaagacggugacgccg

SEQ ID NO: 1757316 - RNA, 15 nt, Human herpesvirus 1
cccaacgccacgcag

SEQ ID NO: 1757317 - RNA, 13 nt, Human herpesvirus 1
cccaagccgcccc

SEQ ID NO: 1757318 - RNA, 21 nt, Human herpesvirus 1
ccaucgguccccucugggccc

SEQ ID NO: 1757319 - RNA, 19 nt, Human herpesvirus 1
ccaucuacguugcggggcg

SEQ ID NO: 1757320 - RNA, 18 nt, Human herpesvirus 1
aagcuagccgaggcccgg

SEQ ID NO: 1757321 - RNA, 19 nt, Human herpesvirus 1
aagucgguagcgggggacg

SEQ ID NO: 1757322 - RNA, 14 nt, Human herpesvirus 1
acacgggcaccaca

SEQ ID NO: 1757323 - RNA, 14 nt, Human herpesvirus 1
acacgacggccucg

SEQ ID NO: 1757324 - RNA, 21 nt, Human herpesvirus 1
acacgagcacccugcugcccc

SEQ ID NO: 1757325 - RNA, 14 nt, Human herpesvirus 1
aaucggcggccgcc

SEQ ID NO: 1757326 - RNA, 22 nt, Human herpesvirus 1
aaucagcguucacccggcggcg

SEQ ID NO: 1757327 - RNA, 17 nt, Human herpesvirus 1
accgcaacuucccaccc

SEQ ID NO: 1757328 - RNA, 22 nt, Human herpesvirus 1
accgcagacgaaaagccccggg

SEQ ID NO: 1757329 - RNA, 12 nt, Human herpesvirus 1
accgcaucgaca

SEQ ID NO: 1757330 - RNA, 16 nt, Human herpesvirus 1
accgccggcgaggugg

SEQ ID NO: 1757331 - RNA, 17 nt, Human herpesvirus 1
accgcguguuccccggg

SEQ ID NO: 1757332 - RNA, 17 nt, Human herpesvirus 1
accgcgguucgcguccc

SEQ ID NO: 1757333 - RNA, 15 nt, Human herpesvirus 1
accggaaggaacccg

SEQ ID NO: 1757334 - RNA, 23 nt, Human herpesvirus 1
accggacccgcaucccccgucug

SEQ ID NO: 1757335 - RNA, 23 nt, Human herpesvirus 1
accggccccugggccccgggaca

SEQ ID NO: 1757336 - RNA, 16 nt, Human herpesvirus 1
accgggcccccgcccc

SEQ ID NO: 1757337 - RNA, 18 nt, Human herpesvirus 1
accgugacuaagcguccc

SEQ ID NO: 1757338 - RNA, 22 nt, Human herpesvirus 1
accgucgccgcgggccacgcca

SEQ ID NO: 1757339 - RNA, 17 nt, Human herpesvirus 1
acauggccagcggcccg

SEQ ID NO: 1757340 - RNA, 20 nt, Human herpesvirus 1
acaggcgaccgccggcggcg

SEQ ID NO: 1757341 - RNA, 15 nt, Human herpesvirus 1
accaccaaggcccgg

SEQ ID NO: 1757342 - RNA, 17 nt, Human herpesvirus 1
accaccacugcacuccc

SEQ ID NO: 1757343 - RNA, 16 nt, Human herpesvirus 1
accacgcccgaccaca

SEQ ID NO: 1757344 - RNA, 21 nt, Human herpesvirus 1
accacguacggcucgcggguc

SEQ ID NO: 1757345 - RNA, 21 nt, Human herpesvirus 1
accagaauaaugaccaccaca

SEQ ID NO: 1757346 - RNA, 19 nt, Human herpesvirus 1
cacaccagcuacgccgccg

SEQ ID NO: 1757347 - RNA, 14 nt, Human herpesvirus 1
cagcugagccgcgc

SEQ ID NO: 1757348 - RNA, 15 nt, Human herpesvirus 1
caggacaccgcgugu

SEQ ID NO: 1757349 - RNA, 20 nt, Human herpesvirus 1
caggaaauccguggccccgg

SEQ ID NO: 1757350 - RNA, 18 nt, Human herpesvirus 1
auacagcauggcgccaca

SEQ ID NO: 1757351 - RNA, 19 nt, Human herpesvirus 1
auagccauccccgcgucca

SEQ ID NO: 1757352 - RNA, 20 nt, Human herpesvirus 1
auaguuugguccccccucua

SEQ ID NO: 1757353 - RNA, 19 nt, Human herpesvirus 1
agggcgaggagggcggcga

SEQ ID NO: 1757354 - RNA, 14 nt, Human herpesvirus 1
agggcgcccccgcg

SEQ ID NO: 1757355 - RNA, 16 nt, Human herpesvirus 1
aggcccgggccacggc

SEQ ID NO: 1757356 - RNA, 17 nt, Human herpesvirus 1
aggcccgggccacggcg

SEQ ID NO: 1757357 - RNA, 18 nt, Human herpesvirus 1
aggccggcgccgacacgc

SEQ ID NO: 1757358 - RNA, 15 nt, Human herpesvirus 1
aggccuccacccccu

SEQ ID NO: 1757359 - RNA, 15 nt, Human herpesvirus 1
aggcgaccgccggcg

SEQ ID NO: 1757360 - RNA, 20 nt, Human herpesvirus 1
aggcgcauaaagggccggug

SEQ ID NO: 1757361 - RNA, 18 nt, Human herpesvirus 1
aggcgcugucuccccggg

SEQ ID NO: 1757362 - RNA, 15 nt, Human herpesvirus 1
aggcgcuuccccgcg

SEQ ID NO: 1757363 - RNA, 13 nt, Human herpesvirus 1
aggccccccgccg

SEQ ID NO: 1757364 - RNA, 17 nt, Human herpesvirus 1
acgcaaaaccaggccga

SEQ ID NO: 1757365 - RNA, 17 nt, Human herpesvirus 1
acgcaagaccaggccug

SEQ ID NO: 1757366 - RNA, 13 nt, Human herpesvirus 1
acgaggacgacga

SEQ ID NO: 1757367 - RNA, 20 nt, Human herpesvirus 1
caagaggucgucgggggacg

SEQ ID NO: 1757368 - RNA, 12 nt, Human herpesvirus 1
caacgggggacc

SEQ ID NO: 1757369 - RNA, 20 nt, Human herpesvirus 1
caaguggcaggagguggacg

SEQ ID NO: 1757370 - RNA, 20 nt, Human herpesvirus 1
caagaagaagggcacgagcg

SEQ ID NO: 1757371 - RNA, 19 nt, Human herpesvirus 1
caacgccaucgccucggcc

SEQ ID NO: 1757372 - RNA, 12 nt, Human herpesvirus 1
caacgcgacgca

SEQ ID NO: 1757373 - RNA, 18 nt, Human herpesvirus 1
caaccacccgcaccccca

SEQ ID NO: 1757374 - RNA, 23 nt, Human herpesvirus 1
caaccccuuuggggcgcuggccg

SEQ ID NO: 1757375 - RNA, 16 nt, Human herpesvirus 1
auccguggccccggcc

SEQ ID NO: 1757376 - RNA, 18 nt, Human herpesvirus 1
auccccgcucccucgacc

SEQ ID NO: 1757377 - RNA, 12 nt, Human herpesvirus 1
aucaccacgccc

SEQ ID NO: 1757378 - RNA, 22 nt, Human herpesvirus 1
aucaccccgcaauuugcaccca

SEQ ID NO: 1757379 - RNA, 12 nt, Human herpesvirus 1
ucguggccccga

SEQ ID NO: 1757380 - RNA, 15 nt, Human herpesvirus 1
ucgugcaugucguca

SEQ ID NO: 1757381 - RNA, 15 nt, Human herpesvirus 1
uuuucgagugucgca

SEQ ID NO: 1757382 - RNA, 22 nt, Human herpesvirus 1
uuucggugucuaacgguccuca

SEQ ID NO: 1757383 - RNA, 15 nt, Human herpesvirus 1
uuuuguuugucguca

SEQ ID NO: 1757384 - RNA, 15 nt, Human herpesvirus 1
ucgacgaccugggga

SEQ ID NO: 1757385 - RNA, 23 nt, Human herpesvirus 1
ucgacggcuucuacgcgcgcgac

SEQ ID NO: 1757386 - RNA, 19 nt, Human herpesvirus 1
ucgacucuaucgcgcgcau

SEQ ID NO: 1757387 - RNA, 16 nt, Human herpesvirus 1
ucggggccgcccuggc

SEQ ID NO: 1757388 - RNA, 17 nt, Human herpesvirus 1
ucggggccgcccuggcc

SEQ ID NO: 1757389 - RNA, 20 nt, Human herpesvirus 1
ucggugcgucugggcccgac

SEQ ID NO: 1757390 - RNA, 18 nt, Human herpesvirus 1
ucguacgcaugggccgcc

SEQ ID NO: 1757391 - RNA, 14 nt, Human herpesvirus 1
ucguccccuggggc

SEQ ID NO: 1757392 - RNA, 15 nt, Human herpesvirus 1
ucguccggcgcgcgu

SEQ ID NO: 1757393 - RNA, 17 nt, Human herpesvirus 1
uccgaacgcagccccgc

SEQ ID NO: 1757394 - RNA, 23 nt, Human herpesvirus 1
ucccggggggucggcaggcgacg

SEQ ID NO: 1757395 - RNA, 15 nt, Human herpesvirus 1
ucccuaaggcccggc

SEQ ID NO: 1757396 - RNA, 23 nt, Human herpesvirus 1
ucccgccaacacccccuuccccc

SEQ ID NO: 1757397 - RNA, 14 nt, Human herpesvirus 1
ucccgaaccaggcc

SEQ ID NO: 1757398 - RNA, 19 nt, Human herpesvirus 1
ucccgaccuccggucccga

SEQ ID NO: 1757399 - RNA, 15 nt, Human herpesvirus 1
uccuucuugucgucu

SEQ ID NO: 1757400 - RNA, 23 nt, Human herpesvirus 1
uccccgcuccccaagcaucgacc

SEQ ID NO: 1757401 - RNA, 12 nt, Human herpesvirus 1
uccccggcccgg

SEQ ID NO: 1757402 - RNA, 17 nt, Human herpesvirus 1
ucccccgcgcgccccga

SEQ ID NO: 1757403 - RNA, 20 nt, Human herpesvirus 1
ucccccggcacgccuggggu

SEQ ID NO: 1757404 - RNA, 15 nt, Human herpesvirus 1
ucccaacgaccccgc

SEQ ID NO: 1757405 - RNA, 16 nt, Human herpesvirus 1
ucccagcggcacgacc

SEQ ID NO: 1757406 - RNA, 16 nt, Human herpesvirus 1
caccacacaccagcgg

SEQ ID NO: 1757407 - RNA, 20 nt, Human herpesvirus 1
caccaacaaccuucugcggg

SEQ ID NO: 1757408 - RNA, 20 nt, Human herpesvirus 1
cacccccucgaccaccaccu

SEQ ID NO: 1757409 - RNA, 23 nt, Human herpesvirus 1
caccccgcaauuugcacccagcc

SEQ ID NO: 1757410 - RNA, 14 nt, Human herpesvirus 1
caccccccacgggc

SEQ ID NO: 1757411 - RNA, 18 nt, Human herpesvirus 1
caccccccgacgccagcu

SEQ ID NO: 1757412 - RNA, 14 nt, Human herpesvirus 1
cacccacgccgccu

SEQ ID NO: 1757413 - RNA, 22 nt, Human herpesvirus 1
cacccacgccgccucggcccgc

SEQ ID NO: 1757414 - RNA, 23 nt, Human herpesvirus 1
cacagggcgggccgccucggggg

SEQ ID NO: 1757415 - RNA, 17 nt, Human herpesvirus 1
caccagcagcuugcggg

SEQ ID NO: 1757416 - RNA, 16 nt, Human herpesvirus 1
cacagccuggccgugc

SEQ ID NO: 1757417 - RNA, 18 nt, Human herpesvirus 1
acuucgcgcccgggcgcg

SEQ ID NO: 1757418 - RNA, 18 nt, Human herpesvirus 1
acugggcgaccgccggcg

SEQ ID NO: 1757419 - RNA, 12 nt, Human herpesvirus 1
acuccggccgcg

SEQ ID NO: 1757420 - RNA, 17 nt, Human herpesvirus 1
acuacgcuucggccgcc

SEQ ID NO: 1757421 - RNA, 21 nt, Human herpesvirus 1
acucauuaaugggcggccccg

SEQ ID NO: 1757422 - RNA, 17 nt, Human herpesvirus 1
acguucgagcgccaccu

SEQ ID NO: 1757423 - RNA, 17 nt, Human herpesvirus 1
acguucgcgcgccaucu

SEQ ID NO: 1757424 - RNA, 16 nt, Human herpesvirus 1
cacggguggccgggcg

SEQ ID NO: 1757425 - RNA, 23 nt, Human herpesvirus 1
cacggcgaaugcagcgccggccu

SEQ ID NO: 1757426 - RNA, 15 nt, Human herpesvirus 1
cacgguucccgagag

SEQ ID NO: 1757427 - RNA, 21 nt, Human herpesvirus 1
cacgugaucagcacgccaccg

SEQ ID NO: 1757428 - RNA, 19 nt, Human herpesvirus 1
cacccgaggcggccugggu

SEQ ID NO: 1757429 - RNA, 19 nt, Human herpesvirus 1
cacgcgcguccuucuuguc

SEQ ID NO: 1757430 - RNA, 20 nt, Human herpesvirus 1
cacggcaaggagcgccggcg

SEQ ID NO: 1757431 - RNA, 20 nt, Human herpesvirus 1
cacgccuggggucgcggccg

SEQ ID NO: 1757432 - RNA, 22 nt, Human herpesvirus 1
cacgccuggggucgcggccgcg

SEQ ID NO: 1757433 - RNA, 17 nt, Human herpesvirus 1
cacgcgcgacgggcagu

SEQ ID NO: 1757434 - RNA, 19 nt, Human herpesvirus 1
cagcacggcgucgcuguga

SEQ ID NO: 1757435 - RNA, 12 nt, Human herpesvirus 1
cuagcucgcgga

SEQ ID NO: 1757436 - RNA, 21 nt, Human herpesvirus 1
cuagcucgcggagggcggcca

SEQ ID NO: 1757437 - RNA, 19 nt, Human herpesvirus 1
cuagccgaucccucgcgag

SEQ ID NO: 1757438 - RNA, 17 nt, Human herpesvirus 1
gagcugcccggcggcca

SEQ ID NO: 1757439 - RNA, 23 nt, Human herpesvirus 1
gaggagggggccggggacggcga

SEQ ID NO: 1757440 - RNA, 22 nt, Human herpesvirus 1
gagcuucgcuuugugggggacc

SEQ ID NO: 1757441 - RNA, 13 nt, Human herpesvirus 1
gaggaaacccccg

SEQ ID NO: 1757442 - RNA, 23 nt, Human herpesvirus 1
cuaucuccugggggcacccacgc

SEQ ID NO: 1757443 - RNA, 18 nt, Human herpesvirus 1
cuaccuaggcaucggggg

SEQ ID NO: 1757444 - RNA, 14 nt, Human herpesvirus 1
cuacgcgccggccg

SEQ ID NO: 1757445 - RNA, 15 nt, Human herpesvirus 1
cgugcgugccggucg

SEQ ID NO: 1757446 - RNA, 21 nt, Human herpesvirus 1
cgugcgccuggauucgcugga

SEQ ID NO: 1757447 - RNA, 14 nt, Human herpesvirus 1
cgucguucgggcgg

SEQ ID NO: 1757448 - RNA, 15 nt, Human herpesvirus 1
cgucuccuccaccac

SEQ ID NO: 1757449 - RNA, 23 nt, Human herpesvirus 1
cgugacuaagcgucccugggccc

SEQ ID NO: 1757450 - RNA, 12 nt, Human herpesvirus 1
cgcgcccgggcg

SEQ ID NO: 1757451 - RNA, 23 nt, Human herpesvirus 1
cgcgcccgggcgcguccccggcc

SEQ ID NO: 1757452 - RNA, 13 nt, Human herpesvirus 1
cgcgccgcgagua

SEQ ID NO: 1757453 - RNA, 21 nt, Human herpesvirus 1
cgcgccgcugcccgacccggc

SEQ ID NO: 1757454 - RNA, 22 nt, Human herpesvirus 1
cgcgccgcugcccgacccggcc

SEQ ID NO: 1757455 - RNA, 19 nt, Human herpesvirus 1
cgcgccccaaggcgcugcg

SEQ ID NO: 1757456 - RNA, 13 nt, Human herpesvirus 1
cgcgcccccgucc

SEQ ID NO: 1757457 - RNA, 15 nt, Human herpesvirus 1
cgcgccccgccggcg

SEQ ID NO: 1757458 - RNA, 16 nt, Human herpesvirus 1
cgcgccgcgggccccc

SEQ ID NO: 1757459 - RNA, 20 nt, Human herpesvirus 1
cgcgccgcgggcccccggcc

SEQ ID NO: 1757460 - RNA, 16 nt, Human herpesvirus 1
cgcgccguuggccccc

SEQ ID NO: 1757461 - RNA, 19 nt, Human herpesvirus 1
cgcgccguuggcccccgcc

SEQ ID NO: 1757462 - RNA, 14 nt, Human herpesvirus 1
cgcgccucccggcc

SEQ ID NO: 1757463 - RNA, 17 nt, Human herpesvirus 1
cgucgcuagaccacgcc

SEQ ID NO: 1757464 - RNA, 20 nt, Human herpesvirus 1
cgcgcaccuguuccgccugu

SEQ ID NO: 1757465 - RNA, 19 nt, Human herpesvirus 1
ccgugauccuuaggggccg

SEQ ID NO: 1757466 - RNA, 18 nt, Human herpesvirus 1
ccgugcacacgacggccu

SEQ ID NO: 1757467 - RNA, 22 nt, Human herpesvirus 1
cgcgcauccgucgggaggccac

SEQ ID NO: 1757468 - RNA, 18 nt, Human herpesvirus 1
cgcgccaaacgccagccu

SEQ ID NO: 1757469 - RNA, 17 nt, Human herpesvirus 1
cgcgccacacucaccgg

SEQ ID NO: 1757470 - RNA, 15 nt, Human herpesvirus 1
cgcgccauccucacg

SEQ ID NO: 1757471 - RNA, 18 nt, Human herpesvirus 1
ccgguuggccgcgcggca

SEQ ID NO: 1757472 - RNA, 20 nt, Human herpesvirus 1
ccguaaacgccgagcugcga

SEQ ID NO: 1757473 - RNA, 20 nt, Human herpesvirus 1
ccguccccugccccccccac

SEQ ID NO: 1757474 - RNA, 22 nt, Human herpesvirus 1
ccgucgauccaggacgccgcga

SEQ ID NO: 1757475 - RNA, 15 nt, Human herpesvirus 1
ccgucgccgcgggcc

SEQ ID NO: 1757476 - RNA, 18 nt, Human herpesvirus 1
ccgucgcuagaccacgcc

SEQ ID NO: 1757477 - RNA, 21 nt, Human herpesvirus 1
ccgucgcuagaccacgccccu

SEQ ID NO: 1757478 - RNA, 15 nt, Human herpesvirus 1
ccgucucugcuacgc

SEQ ID NO: 1757479 - RNA, 23 nt, Human herpesvirus 1
ccgugacuaagcgucccugggcc

SEQ ID NO: 1757480 - RNA, 19 nt, Human herpesvirus 1
ccggguccccgcggaagcg

SEQ ID NO: 1757481 - RNA, 17 nt, Human herpesvirus 1
ccgguauggggggggcu

SEQ ID NO: 1757482 - RNA, 18 nt, Human herpesvirus 1
ccggucaacgaggguugg

SEQ ID NO: 1757483 - RNA, 23 nt, Human herpesvirus 1
ccggucucccagggagccccggu

SEQ ID NO: 1757484 - RNA, 23 nt, Human herpesvirus 1
ccggugaacgccuccgcccgugc

SEQ ID NO: 1757485 - RNA, 19 nt, Human herpesvirus 1
ccggguacggcgucugggc

SEQ ID NO: 1757486 - RNA, 21 nt, Human herpesvirus 1
ccggguacggcgucugggcca

SEQ ID NO: 1757487 - RNA, 18 nt, Human herpesvirus 1
ccggguagcguacggacc

SEQ ID NO: 1757488 - RNA, 20 nt, Human herpesvirus 1
gcacaaaaagaccccgaucc

SEQ ID NO: 1757489 - RNA, 21 nt, Human herpesvirus 1
gcacacccccauccggugguc

SEQ ID NO: 1757490 - RNA, 16 nt, Human herpesvirus 1
aacgggggggugucgc

SEQ ID NO: 1757491 - RNA, 15 nt, Human herpesvirus 1
aacgugcgcgauccc

SEQ ID NO: 1757492 - RNA, 18 nt, Human herpesvirus 1
aagaggaggagggggccg

SEQ ID NO: 1757493 - RNA, 16 nt, Human herpesvirus 1
aacuucaucacccccg

SEQ ID NO: 1757494 - RNA, 21 nt, Human herpesvirus 1
aacuucgacccgcaacgcgcu

SEQ ID NO: 1757495 - RNA, 12 nt, Human herpesvirus 1
cauggccaugac

SEQ ID NO: 1757496 - RNA, 20 nt, Human herpesvirus 1
caugggccugaucgccggcg

SEQ ID NO: 1757497 - RNA, 14 nt, Human herpesvirus 1
cauggugccgaccg

SEQ ID NO: 1757498 - RNA, 19 nt, Human herpesvirus 1
cauggcgccacaccacgcc

SEQ ID NO: 1757499 - RNA, 18 nt, Human herpesvirus 1
caguucgagcagccgcgc

SEQ ID NO: 1757500 - RNA, 21 nt, Human herpesvirus 1
caguggcugaagcacaacgcc

SEQ ID NO: 1757501 - RNA, 15 nt, Human herpesvirus 1
caggguaccgcguga

SEQ ID NO: 1757502 - RNA, 19 nt, Human herpesvirus 1
caggucccccacaccaccu

SEQ ID NO: 1757503 - RNA, 22 nt, Human herpesvirus 1
caguaccgccagggcgcuacga

SEQ ID NO: 1757504 - RNA, 19 nt, Human herpesvirus 1
cagcguauccacccccgcc

SEQ ID NO: 1757505 - RNA, 20 nt, Human herpesvirus 1
cagcgcggcggggcccggcc

SEQ ID NO: 1757506 - RNA, 19 nt, Human herpesvirus 1
cagcgccaaggucaccgac

SEQ ID NO: 1757507 - RNA, 15 nt, Human herpesvirus 1
cagcgccugcguuca

SEQ ID NO: 1757508 - RNA, 16 nt, Human herpesvirus 1
cagcgccgcaaccagc

SEQ ID NO: 1757509 - RNA, 21 nt, Human herpesvirus 1
agcgugcgauacuucgcgccc

SEQ ID NO: 1757510 - RNA, 16 nt, Human herpesvirus 1
agccugcggccggaug

SEQ ID NO: 1757511 - RNA, 14 nt, Human herpesvirus 1
agccggccccggca

SEQ ID NO: 1757512 - RNA, 23 nt, Human herpesvirus 1
agcccucccgaccgacaccccca

SEQ ID NO: 1757513 - RNA, 16 nt, Human herpesvirus 1
agccgacggcccgaag

SEQ ID NO: 1757514 - RNA, 23 nt, Human herpesvirus 1
agccgcgauuccgagggccgggc

SEQ ID NO: 1757515 - RNA, 18 nt, Human herpesvirus 1
agccgcgccgacaucacc

SEQ ID NO: 1757516 - RNA, 22 nt, Human herpesvirus 1
aucgcgggcgccauggcgggac

SEQ ID NO: 1757517 - RNA, 18 nt, Human herpesvirus 1
aucgcgguagcccggccg

SEQ ID NO: 1757518 - RNA, 16 nt, Human herpesvirus 1
aucgggaugcugcccc

SEQ ID NO: 1757519 - RNA, 14 nt, Human herpesvirus 1
aucgguccccucug

SEQ ID NO: 1757520 - RNA, 16 nt, Human herpesvirus 1
aucgucgccugccccc

SEQ ID NO: 1757521 - RNA, 19 nt, Human herpesvirus 1
aucgugagucacagcgacc

SEQ ID NO: 1757522 - RNA, 19 nt, Human herpesvirus 1
agguacggggcggcccgug

SEQ ID NO: 1757523 - RNA, 17 nt, Human herpesvirus 1
agcgugacgcacccccu

SEQ ID NO: 1757524 - RNA, 18 nt, Human herpesvirus 1
agcguguucguggaacca

SEQ ID NO: 1757525 - RNA, 16 nt, Human herpesvirus 1
cggcaagacccgggcg

SEQ ID NO: 1757526 - RNA, 22 nt, Human herpesvirus 1
cggcacgccuggggucgcggcc

SEQ ID NO: 1757527 - RNA, 18 nt, Human herpesvirus 1
cggcagcgcuccgacgac

SEQ ID NO: 1757528 - RNA, 18 nt, Human herpesvirus 1
ccugggauccgaccccca

SEQ ID NO: 1757529 - RNA, 20 nt, Human herpesvirus 1
ccugggccaccugacgcgcc

SEQ ID NO: 1757530 - RNA, 17 nt, Human herpesvirus 1
ccuggcggacggcggcc

SEQ ID NO: 1757531 - RNA, 15 nt, Human herpesvirus 1
ccuggcugacccacg

SEQ ID NO: 1757532 - RNA, 16 nt, Human herpesvirus 1
ccugcgaggugcgcca

SEQ ID NO: 1757533 - RNA, 18 nt, Human herpesvirus 1
ccugccacuccggcgccg

SEQ ID NO: 1757534 - RNA, 13 nt, Human herpesvirus 1
ccugcgcgacgcc

SEQ ID NO: 1757535 - RNA, 20 nt, Human herpesvirus 1
ccugccccccccaccccaga

SEQ ID NO: 1757536 - RNA, 13 nt, Human herpesvirus 1
ccugccccgccac

SEQ ID NO: 1757537 - RNA, 18 nt, Human herpesvirus 1
ccugcuccggcggggccu

SEQ ID NO: 1757538 - RNA, 20 nt, Human herpesvirus 1
ccagccuguuuguccugggg

SEQ ID NO: 1757539 - RNA, 17 nt, Human herpesvirus 1
ccagcgaccucgccgaa

SEQ ID NO: 1757540 - RNA, 18 nt, Human herpesvirus 1
ccagacgcgggcgacgca

SEQ ID NO: 1757541 - RNA, 15 nt, Human herpesvirus 1
ccagaggcgcgcgca

SEQ ID NO: 1757542 - RNA, 19 nt, Human herpesvirus 1
ccagaucuacugcugggcc

SEQ ID NO: 1757543 - RNA, 19 nt, Human herpesvirus 1
ccacuccuccccgcgccgu

SEQ ID NO: 1757544 - RNA, 17 nt, Human herpesvirus 1
ccacguguagccuggau

SEQ ID NO: 1757545 - RNA, 17 nt, Human herpesvirus 1
ccacuguuuuccgcccc

SEQ ID NO: 1757546 - RNA, 16 nt, Human herpesvirus 1
ccagaccccgggcgcg

SEQ ID NO: 1757547 - RNA, 15 nt, Human herpesvirus 1
ccacgggggggagca

SEQ ID NO: 1757548 - RNA, 16 nt, Human herpesvirus 1
cgacgugguccgcggg

SEQ ID NO: 1757549 - RNA, 23 nt, Human herpesvirus 1
cgacgugguccgcggggccuccc

SEQ ID NO: 1757550 - RNA, 15 nt, Human herpesvirus 1
cgaccaacuaccccg

SEQ ID NO: 1757551 - RNA, 19 nt, Human herpesvirus 1
cgaccaacuaccccgauca

SEQ ID NO: 1757552 - RNA, 14 nt, Human herpesvirus 1
cgaccaggcgcgcc

SEQ ID NO: 1757553 - RNA, 19 nt, Human herpesvirus 1
cgaccaggcgcgccgcgag

SEQ ID NO: 1757554 - RNA, 13 nt, Human herpesvirus 1
cgaccaucacccg

SEQ ID NO: 1757555 - RNA, 15 nt, Human herpesvirus 1
cgacccgcaacgcgc

SEQ ID NO: 1757556 - RNA, 16 nt, Human herpesvirus 1
cgacccugaucccccg

SEQ ID NO: 1757557 - RNA, 19 nt, Human herpesvirus 1
cgacccugaucccccgcgc

SEQ ID NO: 1757558 - RNA, 20 nt, Human herpesvirus 1
cgacccuguuggucggggag

SEQ ID NO: 1757559 - RNA, 20 nt, Human herpesvirus 1
cgaagcggccauggcccgcc

SEQ ID NO: 1757560 - RNA, 14 nt, Human herpesvirus 1
cgaagcuucggggg

SEQ ID NO: 1757561 - RNA, 12 nt, Human herpesvirus 1
cgacaacagccc

SEQ ID NO: 1757562 - RNA, 17 nt, Human herpesvirus 1
cgacacgcucgccgagc

SEQ ID NO: 1757563 - RNA, 20 nt, Human herpesvirus 1
cgacacggucauccacgccg

SEQ ID NO: 1757564 - RNA, 19 nt, Human herpesvirus 1
cgacacugaaaugcccccc

SEQ ID NO: 1757565 - RNA, 20 nt, Human herpesvirus 1
cgagaucaaggacagcggcc

SEQ ID NO: 1757566 - RNA, 23 nt, Human herpesvirus 1
cgagggcgcuuggucgggaggcc

SEQ ID NO: 1757567 - RNA, 19 nt, Human herpesvirus 1
cgaggggcagcugggggag

SEQ ID NO: 1757568 - RNA, 23 nt, Human herpesvirus 1
cgagguggagcugcccggcggcc

SEQ ID NO: 1757569 - RNA, 21 nt, Human herpesvirus 1
cgacugggggggauccgcccu

SEQ ID NO: 1757570 - RNA, 21 nt, Human herpesvirus 1
cgccagggcgcccccgcgcgg

SEQ ID NO: 1757571 - RNA, 22 nt, Human herpesvirus 1
cgccagggcgcccccgcgcggg

SEQ ID NO: 1757572 - RNA, 18 nt, Human herpesvirus 1
cgccagccugcggccgga

SEQ ID NO: 1757573 - RNA, 18 nt, Human herpesvirus 1
cgccagugcguuccggac

SEQ ID NO: 1757574 - RNA, 14 nt, Human herpesvirus 1
cgccaucaaccccg

SEQ ID NO: 1757575 - RNA, 20 nt, Human herpesvirus 1
cgcccagcucauucaccccg

SEQ ID NO: 1757576 - RNA, 21 nt, Human herpesvirus 1
cgccccaucccgaggccccac

SEQ ID NO: 1757577 - RNA, 23 nt, Human herpesvirus 1
cgccccccaaaccauguccggca

SEQ ID NO: 1757578 - RNA, 18 nt, Human herpesvirus 1
cgccccccccccgucacc

SEQ ID NO: 1757579 - RNA, 20 nt, Human herpesvirus 1
cgcccaaugggccgggccgc

SEQ ID NO: 1757580 - RNA, 21 nt, Human herpesvirus 1
cgcccagacgcccuccgagga

SEQ ID NO: 1757581 - RNA, 13 nt, Human herpesvirus 1
cgccggggaccgc

SEQ ID NO: 1757582 - RNA, 12 nt, Human herpesvirus 1
cgccguccgaac

SEQ ID NO: 1757583 - RNA, 15 nt, Human herpesvirus 1
cgccguccgaaccca

SEQ ID NO: 1757584 - RNA, 21 nt, Human herpesvirus 1
cgccggguagcguacggaccg

SEQ ID NO: 1757585 - RNA, 14 nt, Human herpesvirus 1
cgccguggcgcccc

SEQ ID NO: 1757586 - RNA, 21 nt, Human herpesvirus 1
cgaucccaacaacucccccgc

SEQ ID NO: 1757587 - RNA, 21 nt, Human herpesvirus 1
cgaucugugagugucgcggcg

SEQ ID NO: 1757588 - RNA, 19 nt, Human herpesvirus 1
cgccaccagcaucgcgcgc

SEQ ID NO: 1757589 - RNA, 14 nt, Human herpesvirus 1
cgccacccaggcgc

SEQ ID NO: 1757590 - RNA, 15 nt, Human herpesvirus 1
cggagcgggggggcg

SEQ ID NO: 1757591 - RNA, 23 nt, Human herpesvirus 1
cggaggggcuccuuagcgcggcc

SEQ ID NO: 1757592 - RNA, 15 nt, Human herpesvirus 1
cggagguccagcgcc

SEQ ID NO: 1757593 - RNA, 17 nt, Human herpesvirus 1
cggaggucuccgucacc

SEQ ID NO: 1757594 - RNA, 23 nt, Human herpesvirus 1
cggagguggggcgggggccccgc

SEQ ID NO: 1757595 - RNA, 23 nt, Human herpesvirus 1
cggaucugcuccgcaacggggcg

SEQ ID NO: 1757596 - RNA, 14 nt, Human herpesvirus 1
cggagcccgcuggg

SEQ ID NO: 1757597 - RNA, 16 nt, Human herpesvirus 1
cggagccgcgcggcca

SEQ ID NO: 1757598 - RNA, 17 nt, Human herpesvirus 1
cgccucaacauaccccg

SEQ ID NO: 1757599 - RNA, 20 nt, Human herpesvirus 1
cgccucccggggggucggca

SEQ ID NO: 1757600 - RNA, 12 nt, Human herpesvirus 1
cgccuccgcccg

SEQ ID NO: 1757601 - RNA, 12 nt, Human herpesvirus 1
cgccucgggcga

SEQ ID NO: 1757602 - RNA, 16 nt, Human herpesvirus 1
cgccucggucacccca

SEQ ID NO: 1757603 - RNA, 19 nt, Human herpesvirus 1
cgcucgguguacccguacg

SEQ ID NO: 1757604 - RNA, 14 nt, Human herpesvirus 1
cgcucugacggccc

SEQ ID NO: 1757605 - RNA, 23 nt, Human herpesvirus 1
cgcucuugggguugacgcugggg

SEQ ID NO: 1757606 - RNA, 21 nt, Human herpesvirus 1
gcaugaucuccggacccccgc

SEQ ID NO: 1757607 - RNA, 14 nt, Human herpesvirus 1
gcaugcaccccaga

SEQ ID NO: 1757608 - RNA, 16 nt, Human herpesvirus 1
gcaugcgcgggcucgu

SEQ ID NO: 1757609 - RNA, 21 nt, Human herpesvirus 1
gcagcgccggacgcgcggcgc

SEQ ID NO: 1757610 - RNA, 16 nt, Human herpesvirus 1
gcagcgccggccuccc

SEQ ID NO: 1757611 - RNA, 23 nt, Human herpesvirus 1
gcagcguccgguuggccgcgcgg

SEQ ID NO: 1757612 - RNA, 16 nt, Human herpesvirus 1
gcauacgccuccccca

SEQ ID NO: 1757613 - RNA, 21 nt, Human herpesvirus 1
gcauacgggcggccacccccc

SEQ ID NO: 1757614 - RNA, 17 nt, Human herpesvirus 1
gcaucaaaagcccgaua

SEQ ID NO: 1757615 - RNA, 23 nt, Human herpesvirus 1
gcaucaaggcuugguucggggcc

SEQ ID NO: 1757616 - RNA, 11 nt, Human herpesvirus 1
gcaucgcgcgg

SEQ ID NO: 1757617 - RNA, 17 nt, Human herpesvirus 1
gcauccgagcacccccc

SEQ ID NO: 1757618 - RNA, 20 nt, Human herpesvirus 1
gcaucgaacgcacaccccca

SEQ ID NO: 1757619 - RNA, 23 nt, Human herpesvirus 1
gcauccgggaccugaaccccagc

SEQ ID NO: 1757620 - RNA, 15 nt, Human herpesvirus 1
gcauccacccuccgc

SEQ ID NO: 1757621 - RNA, 22 nt, Human herpesvirus 1
gcauccagggagaaaccccagc

SEQ ID NO: 1757622 - RNA, 21 nt, Human herpesvirus 1
cucggccaccgugggccggcg

SEQ ID NO: 1757623 - RNA, 21 nt, Human herpesvirus 1
cucggcgacgugauggccguc

SEQ ID NO: 1757624 - RNA, 15 nt, Human herpesvirus 1
cucguccggcgcgcg

SEQ ID NO: 1757625 - RNA, 15 nt, Human herpesvirus 1
cucgucgggguggca

SEQ ID NO: 1757626 - RNA, 16 nt, Human herpesvirus 1
cucgugcccucgcggg

SEQ ID NO: 1757627 - RNA, 16 nt, Human herpesvirus 1
cucguggcgucucgcc

SEQ ID NO: 1757628 - RNA, 20 nt, Human herpesvirus 1
cugccugacccucuccggga

SEQ ID NO: 1757629 - RNA, 17 nt, Human herpesvirus 1
cugccaaacagcuggcc

SEQ ID NO: 1757630 - RNA, 17 nt, Human herpesvirus 1
cugcccgucgcgcgugu

SEQ ID NO: 1757631 - RNA, 14 nt, Human herpesvirus 1
cugccccgccaccc

SEQ ID NO: 1757632 - RNA, 21 nt, Human herpesvirus 1
cugcggccacacagccggcca

SEQ ID NO: 1757633 - RNA, 12 nt, Human herpesvirus 1
cugcggccggcg

SEQ ID NO: 1757634 - RNA, 15 nt, Human herpesvirus 1
cugcgcggcgcccgc

SEQ ID NO: 1757635 - RNA, 17 nt, Human herpesvirus 1
cugggaccccggcggcc

SEQ ID NO: 1757636 - RNA, 20 nt, Human herpesvirus 1
cugggccauggacagcgacc

SEQ ID NO: 1757637 - RNA, 23 nt, Human herpesvirus 1
cugggggcacccacgcccgcgac

SEQ ID NO: 1757638 - RNA, 15 nt, Human herpesvirus 1
cuggggucgcggccg

SEQ ID NO: 1757639 - RNA, 17 nt, Human herpesvirus 1
cugggucugugccacca

SEQ ID NO: 1757640 - RNA, 20 nt, Human herpesvirus 1
cugggugccaaagcgcccgu

SEQ ID NO: 1757641 - RNA, 17 nt, Human herpesvirus 1
cuggguggucucuggcc

SEQ ID NO: 1757642 - RNA, 22 nt, Human herpesvirus 1
cuggguggucucuggccgcgcc

SEQ ID NO: 1757643 - RNA, 20 nt, Human herpesvirus 1
cuggguuggcgucgggacca

SEQ ID NO: 1757644 - RNA, 16 nt, Human herpesvirus 1
cuggucgaggcggccg

SEQ ID NO: 1757645 - RNA, 18 nt, Human herpesvirus 1
cuguagcgccccggcgac

SEQ ID NO: 1757646 - RNA, 22 nt, Human herpesvirus 1
cuguccaccgggaagcagggcc

SEQ ID NO: 1757647 - RNA, 20 nt, Human herpesvirus 1
cuguugguccuggccggccu

SEQ ID NO: 1757648 - RNA, 19 nt, Human herpesvirus 1
cuguggccucaccugacca

SEQ ID NO: 1757649 - RNA, 14 nt, Human herpesvirus 1
cuguggacccgagc

SEQ ID NO: 1757650 - RNA, 16 nt, Human herpesvirus 1
cuucgcgcccgggcgc

SEQ ID NO: 1757651 - RNA, 19 nt, Human herpesvirus 1
cuucgcgaacccccgucac

SEQ ID NO: 1757652 - RNA, 22 nt, Human herpesvirus 1
gaccgcuucaagcaggucgacg

SEQ ID NO: 1757653 - RNA, 23 nt, Human herpesvirus 1
gaccggauggaggagccccugcc

SEQ ID NO: 1757654 - RNA, 17 nt, Human herpesvirus 1
gaccggcaagcggagcg

SEQ ID NO: 1757655 - RNA, 18 nt, Human herpesvirus 1
gaccggcaagcggagcgg

SEQ ID NO: 1757656 - RNA, 18 nt, Human herpesvirus 1
cuuccucguacgcauggg

SEQ ID NO: 1757657 - RNA, 14 nt, Human herpesvirus 1
cuuccggccugggg

SEQ ID NO: 1757658 - RNA, 14 nt, Human herpesvirus 1
cuucaucacccccg

SEQ ID NO: 1757659 - RNA, 22 nt, Human herpesvirus 1
cuucgcuuuccugucggccgcc

SEQ ID NO: 1757660 - RNA, 21 nt, Human herpesvirus 1
gaccugcuuauucucggggag

SEQ ID NO: 1757661 - RNA, 15 nt, Human herpesvirus 1
gaccgcgcccucgcc

SEQ ID NO: 1757662 - RNA, 13 nt, Human herpesvirus 1
gacgacgcccgcc

SEQ ID NO: 1757663 - RNA, 17 nt, Human herpesvirus 1
gcacgaccugcgcuucg

SEQ ID NO: 1757664 - RNA, 16 nt, Human herpesvirus 1
gcacgcauacgggcgg

SEQ ID NO: 1757665 - RNA, 21 nt, Human herpesvirus 1
gcacgcgcgauagagucgacg

SEQ ID NO: 1757666 - RNA, 20 nt, Human herpesvirus 1
gcacgaguucaaccucgggu

SEQ ID NO: 1757667 - RNA, 21 nt, Human herpesvirus 1
gcacggaacacaaggccaaga

SEQ ID NO: 1757668 - RNA, 14 nt, Human herpesvirus 1
gcacucccugccgc

SEQ ID NO: 1757669 - RNA, 19 nt, Human herpesvirus 1
gcagaccggcaagcggagc

SEQ ID NO: 1757670 - RNA, 14 nt, Human herpesvirus 1
gcagagcaacccca

SEQ ID NO: 1757671 - RNA, 17 nt, Human herpesvirus 1
gcagacgcugcuccgcc

SEQ ID NO: 1757672 - RNA, 21 nt, Human herpesvirus 1
gcagcccggaggcgcccgcgg

SEQ ID NO: 1757673 - RNA, 21 nt, Human herpesvirus 1
gucgcgcgcgcuuugcggagg

SEQ ID NO: 1757674 - RNA, 20 nt, Human herpesvirus 1
gucgcaacgccgcaggggag

SEQ ID NO: 1757675 - RNA, 19 nt, Human herpesvirus 1
gucgacgaccuggggacgg

SEQ ID NO: 1757676 - RNA, 11 nt, Human herpesvirus 1
gucgacgagau

SEQ ID NO: 1757677 - RNA, 18 nt, Human herpesvirus 1
guccucaucaccgacgac

SEQ ID NO: 1757678 - RNA, 18 nt, Human herpesvirus 1
guccuggagcuccgggga

SEQ ID NO: 1757679 - RNA, 16 nt, Human herpesvirus 1
guccuggggauggcca

SEQ ID NO: 1757680 - RNA, 17 nt, Human herpesvirus 1
guacggcacccgcgcga

SEQ ID NO: 1757681 - RNA, 19 nt, Human herpesvirus 1
guccgcugugccaucgcgc

SEQ ID NO: 1757682 - RNA, 19 nt, Human herpesvirus 1
guacgccccaccggcacca

SEQ ID NO: 1757683 - RNA, 19 nt, Human herpesvirus 1
guacgcccucccgcugcgc

SEQ ID NO: 1757684 - RNA, 19 nt, Human herpesvirus 1
guacgccgccaccguggcc

SEQ ID NO: 1757685 - RNA, 14 nt, Human herpesvirus 1
ggagccuguugugg

SEQ ID NO: 1757686 - RNA, 15 nt, Human herpesvirus 1
gguucccccccgugg

SEQ ID NO: 1757687 - RNA, 15 nt, Human herpesvirus 1
gguuccgcgaccacc

SEQ ID NO: 1757688 - RNA, 22 nt, Human herpesvirus 1
gguuccggaggcgccgcgcgga

SEQ ID NO: 1757689 - RNA, 14 nt, Human herpesvirus 1
guaaggacacgcgc

SEQ ID NO: 1757690 - RNA, 23 nt, Human herpesvirus 1
guaacguuccgccuggaggacgg

SEQ ID NO: 1757691 - RNA, 19 nt, Human herpesvirus 1
guaccugcagacgguggug

SEQ ID NO: 1757692 - RNA, 13 nt, Human herpesvirus 1
gcuaugacggcaa

SEQ ID NO: 1757693 - RNA, 14 nt, Human herpesvirus 1
gcucacgaccccca

SEQ ID NO: 1757694 - RNA, 17 nt, Human herpesvirus 1
ggacgccauacacagcc

SEQ ID NO: 1757695 - RNA, 14 nt, Human herpesvirus 1
ggacugggcaagcc

SEQ ID NO: 1757696 - RNA, 19 nt, Human herpesvirus 1
ggacugggugccaaagcgc

SEQ ID NO: 1757697 - RNA, 17 nt, Human herpesvirus 1
gcuagccgaggcccggg

SEQ ID NO: 1757698 - RNA, 14 nt, Human herpesvirus 1
gcuacuauccccgc

SEQ ID NO: 1757699 - RNA, 14 nt, Human herpesvirus 1
gcggccgcccaacu

SEQ ID NO: 1757700 - RNA, 16 nt, Human herpesvirus 1
gcguauccacccccgc

SEQ ID NO: 1757701 - RNA, 20 nt, Human herpesvirus 1
gcuacgccgcugacccccac

SEQ ID NO: 1757702 - RNA, 14 nt, Human herpesvirus 1
gcggugccugacgc

SEQ ID NO: 1757703 - RNA, 21 nt, Human herpesvirus 1
gcguaccaaacaaacaaacca

SEQ ID NO: 1757704 - RNA, 18 nt, Human herpesvirus 1
gcguagcaaacgccccgc

SEQ ID NO: 1757705 - RNA, 13 nt, Human herpesvirus 1
gcccgcgaacggc

SEQ ID NO: 1757706 - RNA, 20 nt, Human herpesvirus 1
gcccugaccaacgacggccc

SEQ ID NO: 1757707 - RNA, 16 nt, Human herpesvirus 1
gcccugagcgcccucc

SEQ ID NO: 1757708 - RNA, 20 nt, Human herpesvirus 1
gcccucacagggcgggccgc

SEQ ID NO: 1757709 - RNA, 17 nt, Human herpesvirus 1
gcccucccugacggcca

SEQ ID NO: 1757710 - RNA, 15 nt, Human herpesvirus 1
gcccuggccgaggac

SEQ ID NO: 1757711 - RNA, 14 nt, Human herpesvirus 1
gccgccgcggacgc

SEQ ID NO: 1757712 - RNA, 13 nt, Human herpesvirus 1
gcccggguccccg

SEQ ID NO: 1757713 - RNA, 22 nt, Human herpesvirus 1
gcccggccaaccagcguccgcc

SEQ ID NO: 1757714 - RNA, 22 nt, Human herpesvirus 1
gcccgugauccuuaggggccgu

SEQ ID NO: 1757715 - RNA, 21 nt, Human herpesvirus 1
gcccgggcaaguaugcccccc

SEQ ID NO: 1757716 - RNA, 16 nt, Human herpesvirus 1
gcccguuaacccccca

SEQ ID NO: 1757717 - RNA, 18 nt, Human herpesvirus 1
gcccgcgggaggccgccc

SEQ ID NO: 1757718 - RNA, 15 nt, Human herpesvirus 1
gcccgcguaaccccg

SEQ ID NO: 1757719 - RNA, 19 nt, Human herpesvirus 1
gcccgcguuuggccugcgg

SEQ ID NO: 1757720 - RNA, 18 nt, Human herpesvirus 1
gcccggaacgggaggcca

SEQ ID NO: 1757721 - RNA, 22 nt, Human herpesvirus 1
gccggcguuucugaccugcacc

SEQ ID NO: 1757722 - RNA, 14 nt, Human herpesvirus 1
gccgcggccugggu

SEQ ID NO: 1757723 - RNA, 20 nt, Human herpesvirus 1
gccgcggguauagaucgacg

SEQ ID NO: 1757724 - RNA, 19 nt, Human herpesvirus 1
gccgggacuccgcggacgg

SEQ ID NO: 1757725 - RNA, 20 nt, Human herpesvirus 1
gccggggaccgcagccuggu

SEQ ID NO: 1757726 - RNA, 18 nt, Human herpesvirus 1
gccggguggcgccugugu

SEQ ID NO: 1757727 - RNA, 15 nt, Human herpesvirus 1
gccgcgacccgcacg

SEQ ID NO: 1757728 - RNA, 13 nt, Human herpesvirus 1
gccgcgcggacga

SEQ ID NO: 1757729 - RNA, 17 nt, Human herpesvirus 1
gccgcgcggacgacggc

SEQ ID NO: 1757730 - RNA, 15 nt, Human herpesvirus 1
gccgcggaucgggcc

SEQ ID NO: 1757731 - RNA, 19 nt, Human herpesvirus 1
gcggccaguugagccgcgc

SEQ ID NO: 1757732 - RNA, 16 nt, Human herpesvirus 1
gcgguccugacggcca

SEQ ID NO: 1757733 - RNA, 13 nt, Human herpesvirus 1
gcggccgugggcg

SEQ ID NO: 1757734 - RNA, 19 nt, Human herpesvirus 1
gcggugaacgaagcggcca

SEQ ID NO: 1757735 - RNA, 17 nt, Human herpesvirus 1
gcggccacacagccggc

SEQ ID NO: 1757736 - RNA, 17 nt, Human herpesvirus 1
gcgacugcgaccccagc

SEQ ID NO: 1757737 - RNA, 20 nt, Human herpesvirus 1
gcgcuaagugcccaggacgg

SEQ ID NO: 1757738 - RNA, 14 nt, Human herpesvirus 1
gcgcuaugacggca

SEQ ID NO: 1757739 - RNA, 15 nt, Human herpesvirus 1
gcgcucaaccaccgc

SEQ ID NO: 1757740 - RNA, 22 nt, Human herpesvirus 1
gcgcucaaccaccgcucccccc

SEQ ID NO: 1757741 - RNA, 18 nt, Human herpesvirus 1
gccgucuuucuccccaac

SEQ ID NO: 1757742 - RNA, 24 nt, Human herpesvirus 1
gccggugguccgccuagccgcagc

SEQ ID NO: 1757743 - RNA, 19 nt, Human herpesvirus 1
gccgucgggcgucccacac

SEQ ID NO: 1757744 - RNA, 17 nt, Human herpesvirus 1
gccuggcauucgacgac

SEQ ID NO: 1757745 - RNA, 13 nt, Human herpesvirus 1
gccuggccugcga

SEQ ID NO: 1757746 - RNA, 20 nt, Human herpesvirus 1
gccuguuguggcucggggcg

SEQ ID NO: 1757747 - RNA, 12 nt, Human herpesvirus 1
gccuuucccccc

SEQ ID NO: 1757748 - RNA, 12 nt, Human herpesvirus 1
gcgaacccccgu

SEQ ID NO: 1757749 - RNA, 18 nt, Human herpesvirus 1
gcgacaacgagcccccgc

SEQ ID NO: 1757750 - RNA, 15 nt, Human herpesvirus 1
gcgaccacgggcugu

SEQ ID NO: 1757751 - RNA, 18 nt, Human herpesvirus 1
gcgacccugaucccccgc

SEQ ID NO: 1757752 - RNA, 19 nt, Human herpesvirus 1
gcgaccuggggcgcgcggu

SEQ ID NO: 1757753 - RNA, 12 nt, Human herpesvirus 1
ucagggcggcgg

SEQ ID NO: 1757754 - RNA, 11 nt, Human herpesvirus 1
gggggcggcgu

SEQ ID NO: 1757755 - RNA, 14 nt, Human herpesvirus 1
ucauaaccacgccc

SEQ ID NO: 1757756 - RNA, 20 nt, Human herpesvirus 1
ucaugcgcaagcgccgcaac

SEQ ID NO: 1757757 - RNA, 14 nt, Human herpesvirus 1
ucaucaacgcgacc

SEQ ID NO: 1757758 - RNA, 15 nt, Human herpesvirus 1
ucaucaccgacgacg

SEQ ID NO: 1757759 - RNA, 14 nt, Human herpesvirus 1
ucaucagccgggac

SEQ ID NO: 1757760 - RNA, 12 nt, Human herpesvirus 1
ucauccacgccg

SEQ ID NO: 1757761 - RNA, 15 nt, Human herpesvirus 1
ucgccugcggcgacc

SEQ ID NO: 1757762 - RNA, 13 nt, Human herpesvirus 1
uccacggccaagu

SEQ ID NO: 1757763 - RNA, 17 nt, Human herpesvirus 1
uccaggcugucgacgcc

SEQ ID NO: 1757764 - RNA, 18 nt, Human herpesvirus 1
ucgcgauuuccgacgaac

SEQ ID NO: 1757765 - RNA, 13 nt, Human herpesvirus 1
ucgcggccgcgac

SEQ ID NO: 1757766 - RNA, 19 nt, Human herpesvirus 1
ucgcggccgcgacccaggc

SEQ ID NO: 1757767 - RNA, 15 nt, Human herpesvirus 1
ucgcggcuucgcggu

SEQ ID NO: 1757768 - RNA, 23 nt, Human herpesvirus 1
ucgcggcuucgcgguggcggucc

SEQ ID NO: 1757769 - RNA, 21 nt, Human herpesvirus 1
gcgccacgguggugcaguucg

SEQ ID NO: 1757770 - RNA, 21 nt, Human herpesvirus 1
gcgccaggucggcgaccgcca

SEQ ID NO: 1757771 - RNA, 15 nt, Human herpesvirus 1
gcgccaucuggaccg

SEQ ID NO: 1757772 - RNA, 19 nt, Human herpesvirus 1
gcgccaugcuggcggacgg

SEQ ID NO: 1757773 - RNA, 17 nt, Human herpesvirus 1
gcgccauggcgggacug

SEQ ID NO: 1757774 - RNA, 14 nt, Human herpesvirus 1
gcgcccccgcgcgg

SEQ ID NO: 1757775 - RNA, 19 nt, Human herpesvirus 1
gcgcgcuuguccccgaaca

SEQ ID NO: 1757776 - RNA, 20 nt, Human herpesvirus 1
ggcccagcauguccgccggg

SEQ ID NO: 1757777 - RNA, 16 nt, Human herpesvirus 1
gcgcggaugacggccc

SEQ ID NO: 1757778 - RNA, 21 nt, Human herpesvirus 1
gcgcggacaacauccccccga

SEQ ID NO: 1757779 - RNA, 12 nt, Human herpesvirus 1
gcgcggccgugg

SEQ ID NO: 1757780 - RNA, 23 nt, Human herpesvirus 1
ggccaucgguccccucugggccc

SEQ ID NO: 1757781 - RNA, 19 nt, Human herpesvirus 1
ggcccggaacgggaggcca

SEQ ID NO: 1757782 - RNA, 23 nt, Human herpesvirus 1
ggcccgggggggcaucgcgcggg

SEQ ID NO: 1757783 - RNA, 16 nt, Human herpesvirus 1
ggcccugccacuccgg

SEQ ID NO: 1757784 - RNA, 17 nt, Human herpesvirus 1
ggcccgggccacggcgc

SEQ ID NO: 1757785 - RNA, 13 nt, Human herpesvirus 1
ggccgacgacgac

SEQ ID NO: 1757786 - RNA, 21 nt, Human herpesvirus 1
ggccgccacgcgcggcugguc

SEQ ID NO: 1757787 - RNA, 22 nt, Human herpesvirus 1
ggccgccagcgcggcggggccc

SEQ ID NO: 1757788 - RNA, 18 nt, Human herpesvirus 1
ggggcauccgggaccuga

SEQ ID NO: 1757789 - RNA, 12 nt, Human herpesvirus 1
ggggccguggcg

SEQ ID NO: 1757790 - RNA, 20 nt, Human herpesvirus 1
ggggccuccgaagacguccg

SEQ ID NO: 1757791 - RNA, 18 nt, Human herpesvirus 1
ggggcgcuuaccgccaca

SEQ ID NO: 1757792 - RNA, 10 nt, Human herpesvirus 1
ggggcgggac

SEQ ID NO: 1757793 - RNA, 19 nt, Human herpesvirus 1
gggggaugcuagccugugu

SEQ ID NO: 1757794 - RNA, 14 nt, Human herpesvirus 1
gggggcccggaacg

SEQ ID NO: 1757795 - RNA, 16 nt, Human herpesvirus 1
gggcgccacgguggug

SEQ ID NO: 1757796 - RNA, 14 nt, Human herpesvirus 1
gggcgccggugguu

SEQ ID NO: 1757797 - RNA, 16 nt, Human herpesvirus 1
gggcgcggcgcgacaa

SEQ ID NO: 1757798 - RNA, 12 nt, Human herpesvirus 1
gggcggcggcgu

SEQ ID NO: 1757799 - RNA, 15 nt, Human herpesvirus 1
gggcgcuggccgugg

SEQ ID NO: 1757800 - RNA, 15 nt, Human herpesvirus 1
gggcgcugggugguc

SEQ ID NO: 1757801 - RNA, 20 nt, Human herpesvirus 1
gggcgcuuggcaugcgcggg

SEQ ID NO: 1757802 - RNA, 23 nt, Human herpesvirus 1
gggcucuacccucuggacgcccg

SEQ ID NO: 1757803 - RNA, 17 nt, Human herpesvirus 1
ggcuccagucccggccc

SEQ ID NO: 1757804 - RNA, 20 nt, Human herpesvirus 1
ggcuccccgccgcggccugg

SEQ ID NO: 1757805 - RNA, 18 nt, Human herpesvirus 1
ggcucccggcccgggccc

SEQ ID NO: 1757806 - RNA, 14 nt, Human herpesvirus 1
ggcucgccagcgac

SEQ ID NO: 1757807 - RNA, 13 nt, Human herpesvirus 1
ggcugccgugagg

SEQ ID NO: 1757808 - RNA, 10 nt, Human herpesvirus 1
ggcgggccgu

SEQ ID NO: 1757809 - RNA, 17 nt, Human herpesvirus 1
ggcgguccugacggcca

SEQ ID NO: 1757810 - RNA, 17 nt, Human herpesvirus 1
ggccgcgcggcaacaca

SEQ ID NO: 1757811 - RNA, 20 nt, Human herpesvirus 1
ggccgcgacccaggcggcga

SEQ ID NO: 1757812 - RNA, 10 nt, Human herpesvirus 1
ggcgguggua

SEQ ID NO: 1757813 - RNA, 14 nt, Human herpesvirus 1
gcgcaacaaccugg

SEQ ID NO: 1757814 - RNA, 15 nt, Human herpesvirus 1
gcgcaauugcggcca

SEQ ID NO: 1757815 - RNA, 20 nt, Human herpesvirus 1
gcgcauccgucgggaggcca

SEQ ID NO: 1757816 - RNA, 17 nt, Human herpesvirus 1
gcgcaagcgccgcaaca

SEQ ID NO: 1757817 - RNA, 19 nt, Human herpesvirus 1
gcgcauacgccucccccac

SEQ ID NO: 1757818 - RNA, 15 nt, Human herpesvirus 1
gcgcaucagcucgcg

SEQ ID NO: 1757819 - RNA, 21 nt, Human herpesvirus 1
cuccggggguccggcgcgugu

SEQ ID NO: 1757820 - RNA, 18 nt, Human herpesvirus 1
cuccgaguucccccggca

SEQ ID NO: 1757821 - RNA, 13 nt, Human herpesvirus 1
cuccggccgcggu

SEQ ID NO: 1757822 - RNA, 15 nt, Human herpesvirus 1
cuccggcgccgcccg

SEQ ID NO: 1757823 - RNA, 13 nt, Human herpesvirus 1
cucgagaugagcc

SEQ ID NO: 1757824 - RNA, 20 nt, Human herpesvirus 1
acgcccacuuuauucgcguc

SEQ ID NO: 1757825 - RNA, 15 nt, Human herpesvirus 1
acgccgccucggccc

SEQ ID NO: 1757826 - RNA, 23 nt, Human herpesvirus 1
acgccggguagcguacggaccgc

SEQ ID NO: 1757827 - RNA, 19 nt, Human herpesvirus 1
acgccguggcgccccggcc

SEQ ID NO: 1757828 - RNA, 19 nt, Human herpesvirus 1
acgcagccagaacucgccc

SEQ ID NO: 1757829 - RNA, 14 nt, Human herpesvirus 1
acgcacgccgcccc

SEQ ID NO: 1757830 - RNA, 20 nt, Human herpesvirus 1
acgccuggggucgcggccgc

SEQ ID NO: 1757831 - RNA, 21 nt, Human herpesvirus 1
acgccuuaccaucccccggcc

SEQ ID NO: 1757832 - RNA, 17 nt, Human herpesvirus 1
acgcgaccgucgccgcg

SEQ ID NO: 1757833 - RNA, 21 nt, Human herpesvirus 1
acgcgccgcgggcccccggcc

SEQ ID NO: 1757834 - RNA, 11 nt, Human herpesvirus 1
acgcgcguccu

SEQ ID NO: 1757835 - RNA, 21 nt, Human herpesvirus 1
acgcggggcuguacucgaccc

SEQ ID NO: 1757836 - RNA, 19 nt, Human herpesvirus 1
acgcgguauggcugccccc

SEQ ID NO: 1757837 - RNA, 14 nt, Human herpesvirus 1
acgggcggccaccc

SEQ ID NO: 1757838 - RNA, 22 nt, Human herpesvirus 1
acgggcggccacccccccggag

SEQ ID NO: 1757839 - RNA, 20 nt, Human herpesvirus 1
acgucaauugcccgaggcgc

SEQ ID NO: 1757840 - RNA, 22 nt, Human herpesvirus 1
acggggauggucggggcguccc

SEQ ID NO: 1757841 - RNA, 23 nt, Human herpesvirus 1
acgggggcccugccacuccggcg

SEQ ID NO: 1757842 - RNA, 20 nt, Human herpesvirus 1
acgggguaugugauaugcua

SEQ ID NO: 1757843 - RNA, 21 nt, Human herpesvirus 1
acggguguggggacccgcccc

SEQ ID NO: 1757844 - RNA, 14 nt, Human herpesvirus 1
acgcgggccccggg

SEQ ID NO: 1757845 - RNA, 17 nt, Human herpesvirus 1
acgcuaaucccccggcu

SEQ ID NO: 1757846 - RNA, 18 nt, Human herpesvirus 1
acggcagcaugggaccca

SEQ ID NO: 1757847 - RNA, 17 nt, Human herpesvirus 1
acggcauucgggccugc

SEQ ID NO: 1757848 - RNA, 22 nt, Human herpesvirus 1
cacccgggugcuucccacgcga

SEQ ID NO: 1757849 - RNA, 17 nt, Human herpesvirus 1
caccgaacccggcccgg

SEQ ID NO: 1757850 - RNA, 16 nt, Human herpesvirus 1
caccgcaccagcgcgg

SEQ ID NO: 1757851 - RNA, 19 nt, Human herpesvirus 1
agacucucccccaccgccc

SEQ ID NO: 1757852 - RNA, 17 nt, Human herpesvirus 1
agaccgcaucgacacgc

SEQ ID NO: 1757853 - RNA, 20 nt, Human herpesvirus 1
agaccggcaccaccgacucu

SEQ ID NO: 1757854 - RNA, 11 nt, Human herpesvirus 1
agacacccccc

SEQ ID NO: 1757855 - RNA, 22 nt, Human herpesvirus 1
agacgaaaagccccgggccgcg

SEQ ID NO: 1757856 - RNA, 23 nt, Human herpesvirus 1
acgucgccccuguggcccuggcg

SEQ ID NO: 1757857 - RNA, 16 nt, Human herpesvirus 1
acguccugggccaccu

SEQ ID NO: 1757858 - RNA, 15 nt, Human herpesvirus 1
acgucgaccgcgccc

SEQ ID NO: 1757859 - RNA, 19 nt, Human herpesvirus 1
caccgcguguuccccggga

SEQ ID NO: 1757860 - RNA, 16 nt, Human herpesvirus 1
caccggugcgcccccc

SEQ ID NO: 1757861 - RNA, 17 nt, Human herpesvirus 1
caccuacuacgaugggg

SEQ ID NO: 1757862 - RNA, 21 nt, Human herpesvirus 1
caccucgaggacacccgcgca

SEQ ID NO: 1757863 - RNA, 15 nt, Human herpesvirus 1
caccguggccuggga

SEQ ID NO: 1757864 - RNA, 16 nt, Human herpesvirus 1
cacgacacccacccca

SEQ ID NO: 1757865 - RNA, 14 nt, Human herpesvirus 1
cacgcaucgacgug

SEQ ID NO: 1757866 - RNA, 17 nt, Human herpesvirus 1
cacgccaagcccccgcc

SEQ ID NO: 1757867 - RNA, 17 nt, Human herpesvirus 1
cacgcccccgccgcccg

SEQ ID NO: 1757868 - RNA, 15 nt, Human herpesvirus 1
cacgccgccucggcc

SEQ ID NO: 1757869 - RNA, 22 nt, Human herpesvirus 1
cacuacgcuucggccgccaccc

SEQ ID NO: 1757870 - RNA, 16 nt, Human herpesvirus 1
cacugcccgucgcgcg

SEQ ID NO: 1757871 - RNA, 18 nt, Human herpesvirus 1
cagcgacguccugggcca

SEQ ID NO: 1757872 - RNA, 23 nt, Human herpesvirus 1
cagccugccucuccccccaggcc

SEQ ID NO: 1757873 - RNA, 14 nt, Human herpesvirus 1
cagcgaccuggggu

SEQ ID NO: 1757874 - RNA, 15 nt, Human herpesvirus 1
cagcagguccgcggu

SEQ ID NO: 1757875 - RNA, 13 nt, Human herpesvirus 1
cagccccccagcc

SEQ ID NO: 1757876 - RNA, 15 nt, Human herpesvirus 1
cagacgcgggcgacg

SEQ ID NO: 1757877 - RNA, 20 nt, Human herpesvirus 1
cacuggccgggagcaccaca

SEQ ID NO: 1757878 - RNA, 11 nt, Human herpesvirus 1
cacugucgucg

SEQ ID NO: 1757879 - RNA, 23 nt, Human herpesvirus 1
ccuaccggacccguuccagcccc

SEQ ID NO: 1757880 - RNA, 23 nt, Human herpesvirus 1
ccuccaggcugucgacgcccccu

SEQ ID NO: 1757881 - RNA, 17 nt, Human herpesvirus 1
ccucacguucgcacgca

SEQ ID NO: 1757882 - RNA, 16 nt, Human herpesvirus 1
ccucagagacaacgcg

SEQ ID NO: 1757883 - RNA, 18 nt, Human herpesvirus 1
ccucacccacgccggcac

SEQ ID NO: 1757884 - RNA, 16 nt, Human herpesvirus 1
cgcgagcaccugcggg

SEQ ID NO: 1757885 - RNA, 17 nt, Human herpesvirus 1
cgcgagauggccgcccc

SEQ ID NO: 1757886 - RNA, 22 nt, Human herpesvirus 1
cgcgagauggccgccccggugu

SEQ ID NO: 1757887 - RNA, 18 nt, Human herpesvirus 1
cgcgagcagagccgcaag

SEQ ID NO: 1757888 - RNA, 17 nt, Human herpesvirus 1
cgcgagcucccagagac

SEQ ID NO: 1757889 - RNA, 20 nt, Human herpesvirus 1
ccuaaccaggccuccacccc

SEQ ID NO: 1757890 - RNA, 17 nt, Human herpesvirus 1
ccguguuggagcgcgcc

SEQ ID NO: 1757891 - RNA, 15 nt, Human herpesvirus 1
ccguuaaccccccac

SEQ ID NO: 1757892 - RNA, 15 nt, Human herpesvirus 1
ccguuucuccgcccg

SEQ ID NO: 1757893 - RNA, 18 nt, Human herpesvirus 1
ccguggccgacaacugcc

SEQ ID NO: 1757894 - RNA, 16 nt, Human herpesvirus 1
ccguggcgccccggcc

SEQ ID NO: 1757895 - RNA, 15 nt, Human herpesvirus 1
ccgcguuuggccugc

SEQ ID NO: 1757896 - RNA, 21 nt, Human herpesvirus 1
ccgcguuuggccugcggcgca

SEQ ID NO: 1757897 - RNA, 16 nt, Human herpesvirus 1
ccgcgguggacagcca

SEQ ID NO: 1757898 - RNA, 21 nt, Human herpesvirus 1
ccgcgugggugaugucggguc

SEQ ID NO: 1757899 - RNA, 20 nt, Human herpesvirus 1
ccgcguguuccccgggagcc

SEQ ID NO: 1757900 - RNA, 15 nt, Human herpesvirus 1
ccgcucugacggccc

SEQ ID NO: 1757901 - RNA, 18 nt, Human herpesvirus 1
ccgcugcccgacccggcc

SEQ ID NO: 1757902 - RNA, 17 nt, Human herpesvirus 1
ccgcugcgcaucccccc

SEQ ID NO: 1757903 - RNA, 19 nt, Human herpesvirus 1
cguugagccccucgcccgu

SEQ ID NO: 1757904 - RNA, 16 nt, Human herpesvirus 1
cguuucccacccccac

SEQ ID NO: 1757905 - RNA, 22 nt, Human herpesvirus 1
cguuccucacugccucccccgc

SEQ ID NO: 1757906 - RNA, 22 nt, Human herpesvirus 1
cguuccuucccccuccccccgc

SEQ ID NO: 1757907 - RNA, 22 nt, Human herpesvirus 1
cguuuggguguggggacccggc

SEQ ID NO: 1757908 - RNA, 22 nt, Human herpesvirus 1
cuacaacaacuaccucggcggg

SEQ ID NO: 1757909 - RNA, 21 nt, Human herpesvirus 1
cucccgcugcgcauccccccg

SEQ ID NO: 1757910 - RNA, 19 nt, Human herpesvirus 1
cucccggaagagccugccg

SEQ ID NO: 1757911 - RNA, 16 nt, Human herpesvirus 1
cucccggcccguaacg

SEQ ID NO: 1757912 - RNA, 13 nt, Human herpesvirus 1
cuaccccauggga

SEQ ID NO: 1757913 - RNA, 13 nt, Human herpesvirus 1
cgcgcgucccccg

SEQ ID NO: 1757914 - RNA, 17 nt, Human herpesvirus 1
cgcgcguccuucuuguc

SEQ ID NO: 1757915 - RNA, 14 nt, Human herpesvirus 1
cgcgcgucgacguc

SEQ ID NO: 1757916 - RNA, 15 nt, Human herpesvirus 1
cgcgcggucggcaag

SEQ ID NO: 1757917 - RNA, 12 nt, Human herpesvirus 1
cgcgauccggcc

SEQ ID NO: 1757918 - RNA, 17 nt, Human herpesvirus 1
cgcgcggaugacggccc

SEQ ID NO: 1757919 - RNA, 20 nt, Human herpesvirus 1
ccgcaaaucccaccaaacug

SEQ ID NO: 1757920 - RNA, 20 nt, Human herpesvirus 1
ccgcaaccagcugcacgacc

SEQ ID NO: 1757921 - RNA, 16 nt, Human herpesvirus 1
ccgcaacgcgcugggg

SEQ ID NO: 1757922 - RNA, 15 nt, Human herpesvirus 1
ccgcauacuccggcc

SEQ ID NO: 1757923 - RNA, 22 nt, Human herpesvirus 1
ccgcauccacccuccgcugggg

SEQ ID NO: 1757924 - RNA, 14 nt, Human herpesvirus 1
ccgccagcgcggcg

SEQ ID NO: 1757925 - RNA, 16 nt, Human herpesvirus 1
ccgccaucgccuaccu

SEQ ID NO: 1757926 - RNA, 16 nt, Human herpesvirus 1
ccgcgggcccccggcc

SEQ ID NO: 1757927 - RNA, 19 nt, Human herpesvirus 1
ccgcguccaaacccaccga

SEQ ID NO: 1757928 - RNA, 15 nt, Human herpesvirus 1
ccgcgucgccggcac

SEQ ID NO: 1757929 - RNA, 14 nt, Human herpesvirus 1
ccgcgguccagacc

SEQ ID NO: 1757930 - RNA, 16 nt, Human herpesvirus 1
ccgaucccaggcgccg

SEQ ID NO: 1757931 - RNA, 23 nt, Human herpesvirus 1
ccgaucccaggcgccgacggaca

SEQ ID NO: 1757932 - RNA, 19 nt, Human herpesvirus 1
ccgaugcggcggcgcugca

SEQ ID NO: 1757933 - RNA, 21 nt, Human herpesvirus 1
ccgauucucuuccgacgccau

SEQ ID NO: 1757934 - RNA, 15 nt, Human herpesvirus 1
aaacgccucccccug

SEQ ID NO: 1757935 - RNA, 22 nt, Human herpesvirus 1
aaacgccucccccugagccgcu

SEQ ID NO: 1757936 - RNA, 20 nt, Human herpesvirus 1
aaacggccgaagccacgccc

SEQ ID NO: 1757937 - RNA, 20 nt, Human herpesvirus 1
aaacgucagacgagcgcgcu

SEQ ID NO: 1757938 - RNA, 13 nt, Human herpesvirus 1
aaaccccacgccc

SEQ ID NO: 1757939 - RNA, 15 nt, Human herpesvirus 1
aaacccccaaacacc

SEQ ID NO: 1757940 - RNA, 23 nt, Human herpesvirus 1
cgcuggguggucucuggccgcgc

SEQ ID NO: 1757941 - RNA, 18 nt, Human herpesvirus 1
cgccccgccguggcauuc

SEQ ID NO: 1757942 - RNA, 19 nt, Human herpesvirus 1
cgccccucgccacgucgac

SEQ ID NO: 1757943 - RNA, 15 nt, Human herpesvirus 1
cgcccgaccgcgugu

SEQ ID NO: 1757944 - RNA, 14 nt, Human herpesvirus 1
cgcccgccccugcg

SEQ ID NO: 1757945 - RNA, 15 nt, Human herpesvirus 1
cgcccgccccuggcg

SEQ ID NO: 1757946 - RNA, 14 nt, Human herpesvirus 1
cgcccgcgacgcca

SEQ ID NO: 1757947 - RNA, 21 nt, Human herpesvirus 1
cgcccgcgacgccauggaccg

SEQ ID NO: 1757948 - RNA, 16 nt, Human herpesvirus 1
cgcccggggccagcgc

SEQ ID NO: 1757949 - RNA, 17 nt, Human herpesvirus 1
cgcccggggccagcgcc

SEQ ID NO: 1757950 - RNA, 16 nt, Human herpesvirus 1
cgcccggguccccgcg

SEQ ID NO: 1757951 - RNA, 17 nt, Human herpesvirus 1
cgcccggguccccgcgg

SEQ ID NO: 1757952 - RNA, 16 nt, Human herpesvirus 1
cgcccguccucgcccg

SEQ ID NO: 1757953 - RNA, 22 nt, Human herpesvirus 1
cgcccgucuuuaaccucccccg

SEQ ID NO: 1757954 - RNA, 22 nt, Human herpesvirus 1
cgcccuaacagucuuccgcuga

SEQ ID NO: 1757955 - RNA, 21 nt, Human herpesvirus 1
cgcccucacagggcgggccgc

SEQ ID NO: 1757956 - RNA, 21 nt, Human herpesvirus 1
cgcccucgguucgccuucacg

SEQ ID NO: 1757957 - RNA, 15 nt, Human herpesvirus 1
cgcccuggccgcgga

SEQ ID NO: 1757958 - RNA, 16 nt, Human herpesvirus 1
cgcccuuccccacggg

SEQ ID NO: 1757959 - RNA, 13 nt, Human herpesvirus 1
cgccgacacgcgg

SEQ ID NO: 1757960 - RNA, 21 nt, Human herpesvirus 1
cgccgacaucaccaccgucag

SEQ ID NO: 1757961 - RNA, 14 nt, Human herpesvirus 1
cgccgaccacccgg

SEQ ID NO: 1757962 - RNA, 22 nt, Human herpesvirus 1
cgcguguaauacuugcgcggcu

SEQ ID NO: 1757963 - RNA, 22 nt, Human herpesvirus 1
cgcuacugcgugggccgcgcgg

SEQ ID NO: 1757964 - RNA, 22 nt, Human herpesvirus 1
cgcuagccgaucccucgcgagg

SEQ ID NO: 1757965 - RNA, 13 nt, Human herpesvirus 1
cgcuaucggggcc

SEQ ID NO: 1757966 - RNA, 16 nt, Human herpesvirus 1
cgcuccgacgacgcgc

SEQ ID NO: 1757967 - RNA, 20 nt, Human herpesvirus 1
cgcugcuccgccuggccugc

SEQ ID NO: 1757968 - RNA, 14 nt, Human herpesvirus 1
cgcugcugcggcca

SEQ ID NO: 1757969 - RNA, 15 nt, Human herpesvirus 1
cccggaggcguuccg

SEQ ID NO: 1757970 - RNA, 14 nt, Human herpesvirus 1
cccggcaccacggg

SEQ ID NO: 1757971 - RNA, 15 nt, Human herpesvirus 1
cccgcggaccaccgg

SEQ ID NO: 1757972 - RNA, 13 nt, Human herpesvirus 1
cccgcguccaccc

SEQ ID NO: 1757973 - RNA, 15 nt, Human herpesvirus 1
cccgcguccacccgg

SEQ ID NO: 1757974 - RNA, 22 nt, Human herpesvirus 1
cccgcggaaacguucgcgcgcc

SEQ ID NO: 1757975 - RNA, 23 nt, Human herpesvirus 1
cccgcgucuggccccggcgagcg

SEQ ID NO: 1757976 - RNA, 15 nt, Human herpesvirus 1
cccgcucccucgacc

SEQ ID NO: 1757977 - RNA, 14 nt, Human herpesvirus 1
cccgcucucgcgcg

SEQ ID NO: 1757978 - RNA, 16 nt, Human herpesvirus 1
cccgcucugacggccc

SEQ ID NO: 1757979 - RNA, 16 nt, Human herpesvirus 1
ccgacgaaucccccaa

SEQ ID NO: 1757980 - RNA, 16 nt, Human herpesvirus 1
ccgaccucggacgcca

SEQ ID NO: 1757981 - RNA, 17 nt, Human herpesvirus 1
ccgaccucggacgccac

SEQ ID NO: 1757982 - RNA, 20 nt, Human herpesvirus 1
cccggcggccccuggcgccg

SEQ ID NO: 1757983 - RNA, 18 nt, Human herpesvirus 1
cccggcuagacccacggg

SEQ ID NO: 1757984 - RNA, 15 nt, Human herpesvirus 1
ccgacguggcgcacg

SEQ ID NO: 1757985 - RNA, 14 nt, Human herpesvirus 1
ccgacuccccggac

SEQ ID NO: 1757986 - RNA, 17 nt, Human herpesvirus 1
ccgagacccccaacgcc

SEQ ID NO: 1757987 - RNA, 22 nt, Human herpesvirus 1
ccgagaguuugaucguggacgg

SEQ ID NO: 1757988 - RNA, 18 nt, Human herpesvirus 1
ccgagccccccgcugcgg

SEQ ID NO: 1757989 - RNA, 21 nt, Human herpesvirus 1
ccgagccccccgcugcggcca

SEQ ID NO: 1757990 - RNA, 15 nt, Human herpesvirus 1
ccgagcuaugggccu

SEQ ID NO: 1757991 - RNA, 20 nt, Human herpesvirus 1
ccgagcuuguuuucgugggg

SEQ ID NO: 1757992 - RNA, 17 nt, Human herpesvirus 1
ccgaguucccccggcac

SEQ ID NO: 1757993 - RNA, 15 nt, Human herpesvirus 1
ccgagggccgggccc

SEQ ID NO: 1757994 - RNA, 20 nt, Human herpesvirus 1
cgagccaacgcccugaccaa

SEQ ID NO: 1757995 - RNA, 14 nt, Human herpesvirus 1
cgagccgacggccc

SEQ ID NO: 1757996 - RNA, 14 nt, Human herpesvirus 1
cgagcgccagcgcu

SEQ ID NO: 1757997 - RNA, 17 nt, Human herpesvirus 1
cgcaacuucccacccgg

SEQ ID NO: 1757998 - RNA, 21 nt, Human herpesvirus 1
cgauucuuuuaucccacgcgu

SEQ ID NO: 1757999 - RNA, 17 nt, Human herpesvirus 1
cgcaacgcgcuggggcu

SEQ ID NO: 1758000 - RNA, 15 nt, Human herpesvirus 1
cgcaauugcggccac

SEQ ID NO: 1758001 - RNA, 19 nt, Human herpesvirus 1
cgcaccaagccgcucuccg

SEQ ID NO: 1758002 - RNA, 15 nt, Human herpesvirus 1
cgcaccgaggggcca

SEQ ID NO: 1758003 - RNA, 14 nt, Human herpesvirus 1
cgcaccgggccccc

SEQ ID NO: 1758004 - RNA, 19 nt, Human herpesvirus 1
cgcaccgggcccccgcccc

SEQ ID NO: 1758005 - RNA, 19 nt, Human herpesvirus 1
cgcaccgucggaggccccc

SEQ ID NO: 1758006 - RNA, 21 nt, Human herpesvirus 1
cgcaccuccuccgacgcccag

SEQ ID NO: 1758007 - RNA, 22 nt, Human herpesvirus 1
cgcaccucgaggacacccgcgc

SEQ ID NO: 1758008 - RNA, 21 nt, Human herpesvirus 1
cgcagccuauguucgcgggcg

SEQ ID NO: 1758009 - RNA, 16 nt, Human herpesvirus 1
cgcagccuucucccgg

SEQ ID NO: 1758010 - RNA, 22 nt, Human herpesvirus 1
cgcagcguccgguuggccgcgc

SEQ ID NO: 1758011 - RNA, 19 nt, Human herpesvirus 1
cgcaggcgcugucuccccg

SEQ ID NO: 1758012 - RNA, 20 nt, Human herpesvirus 1
cgcaguccacgggggggagc

SEQ ID NO: 1758013 - RNA, 16 nt, Human herpesvirus 1
cgcagucccgggggcu

SEQ ID NO: 1758014 - RNA, 20 nt, Human herpesvirus 1
cgcaugaucuccggaccccc

SEQ ID NO: 1758015 - RNA, 14 nt, Human herpesvirus 1
cgccacaccacgcc

SEQ ID NO: 1758016 - RNA, 19 nt, Human herpesvirus 1
cgccacaccaucucccccg

SEQ ID NO: 1758017 - RNA, 20 nt, Human herpesvirus 1
cgcccccggcuacaggggcc

SEQ ID NO: 1758018 - RNA, 20 nt, Human herpesvirus 1
cgccccgaagagggggaccc

SEQ ID NO: 1758019 - RNA, 15 nt, Human herpesvirus 1
augccgugccgcccg

SEQ ID NO: 1758020 - RNA, 19 nt, Human herpesvirus 1
auggaguccacgguaggcc

SEQ ID NO: 1758021 - RNA, 16 nt, Human herpesvirus 1
auggccauagccgccg

SEQ ID NO: 1758022 - RNA, 21 nt, Human herpesvirus 1
auggcccaguguacccuggcg

SEQ ID NO: 1758023 - RNA, 22 nt, Human herpesvirus 1
caagccccuagccccgcccccu

SEQ ID NO: 1758024 - RNA, 19 nt, Human herpesvirus 1
caaggcuugguucggggcc

SEQ ID NO: 1758025 - RNA, 19 nt, Human herpesvirus 1
caaggacgcccgcgacgcc

SEQ ID NO: 1758026 - RNA, 15 nt, Human herpesvirus 1
caaggagcgccggcg

SEQ ID NO: 1758027 - RNA, 16 nt, Human herpesvirus 1
caaggugggccagccg

SEQ ID NO: 1758028 - RNA, 17 nt, Human herpesvirus 1
caaguacgccgccaccg

SEQ ID NO: 1758029 - RNA, 13 nt, Human herpesvirus 1
caggccccccgcc

SEQ ID NO: 1758030 - RNA, 11 nt, Human herpesvirus 1
caacaaacccc

SEQ ID NO: 1758031 - RNA, 13 nt, Human herpesvirus 1
caaacaaccagcc

SEQ ID NO: 1758032 - RNA, 17 nt, Human herpesvirus 1
augggcggccccggccg

SEQ ID NO: 1758033 - RNA, 20 nt, Human herpesvirus 1
augggcaucgugggcggcgu

SEQ ID NO: 1758034 - RNA, 19 nt, Human herpesvirus 1
augggccagggcgaggugc

SEQ ID NO: 1758035 - RNA, 11 nt, Human herpesvirus 1
ccaagccggga

SEQ ID NO: 1758036 - RNA, 19 nt, Human herpesvirus 1
ccaaagcugcuggcgcgca

SEQ ID NO: 1758037 - RNA, 22 nt, Human herpesvirus 1
ccaaagugccccgaccccgaga

SEQ ID NO: 1758038 - RNA, 15 nt, Human herpesvirus 1
ccaacucucgcacca

SEQ ID NO: 1758039 - RNA, 13 nt, Human herpesvirus 1
ccaacgacggccc

SEQ ID NO: 1758040 - RNA, 22 nt, Human herpesvirus 1
caggcgcugucuccccggggcc

SEQ ID NO: 1758041 - RNA, 16 nt, Human herpesvirus 1
caggcccgccgccacu

SEQ ID NO: 1758042 - RNA, 18 nt, Human herpesvirus 1
caggccuggucagaggcc

SEQ ID NO: 1758043 - RNA, 16 nt, Human herpesvirus 1
caggcgaccgccggcg

SEQ ID NO: 1758044 - RNA, 18 nt, Human herpesvirus 1
caggcgccuccggggguc

SEQ ID NO: 1758045 - RNA, 22 nt, Human herpesvirus 1
cagggcgggccgccucgggggc

SEQ ID NO: 1758046 - RNA, 18 nt, Human herpesvirus 1
ccagguugggggccguga

SEQ ID NO: 1758047 - RNA, 18 nt, Human herpesvirus 1
ccaggucggcgaccgcca

SEQ ID NO: 1758048 - RNA, 22 nt, Human herpesvirus 1
ccagggcgcccccgcgcggggg

SEQ ID NO: 1758049 - RNA, 14 nt, Human herpesvirus 1
cccaggcgcugggc

SEQ ID NO: 1758050 - RNA, 20 nt, Human herpesvirus 1
ccaucgccccuggcgcgcga

SEQ ID NO: 1758051 - RNA, 15 nt, Human herpesvirus 1
cccagccucccgauc

SEQ ID NO: 1758052 - RNA, 15 nt, Human herpesvirus 1
cccaggaucacaccg

SEQ ID NO: 1758053 - RNA, 14 nt, Human herpesvirus 1
ccaucccccgaucc

SEQ ID NO: 1758054 - RNA, 20 nt, Human herpesvirus 1
ccauccugcggcucguggcg

SEQ ID NO: 1758055 - RNA, 16 nt, Human herpesvirus 1
ccaguugagccgcgcc

SEQ ID NO: 1758056 - RNA, 18 nt, Human herpesvirus 1
ccagcgcagaggcggcca

SEQ ID NO: 1758057 - RNA, 16 nt, Human herpesvirus 1
ccagcgcggcggggcc

SEQ ID NO: 1758058 - RNA, 21 nt, Human herpesvirus 1
ccagcuaugggcccugcuccg

SEQ ID NO: 1758059 - RNA, 21 nt, Human herpesvirus 1
ccagcguaaccuccgggggcg

SEQ ID NO: 1758060 - RNA, 16 nt, Human herpesvirus 1
ccagcguccgccgagu

SEQ ID NO: 1758061 - RNA, 12 nt, Human herpesvirus 1
ccagcugggccc

SEQ ID NO: 1758062 - RNA, 17 nt, Human herpesvirus 1
ccaggcgccgacggaca

SEQ ID NO: 1758063 - RNA, 15 nt, Human herpesvirus 1
ccaggcgcgccgcga

SEQ ID NO: 1758064 - RNA, 19 nt, Human herpesvirus 1
ccaggcggcgaacgggggc

SEQ ID NO: 1758065 - RNA, 16 nt, Human herpesvirus 1
cccaucgcgggcgcca

SEQ ID NO: 1758066 - RNA, 18 nt, Human herpesvirus 1
cccaucuaaugccacgcg

SEQ ID NO: 1758067 - RNA, 21 nt, Human herpesvirus 1
ccccaguggguuuugcggacc

SEQ ID NO: 1758068 - RNA, 20 nt, Human herpesvirus 1
ccccauaucgcuucccgacc

SEQ ID NO: 1758069 - RNA, 13 nt, Human herpesvirus 1
ccccaucaccccg

SEQ ID NO: 1758070 - RNA, 21 nt, Human herpesvirus 1
ccccaucgccgcggcucccgg

SEQ ID NO: 1758071 - RNA, 15 nt, Human herpesvirus 1
ccccauggaccccag

SEQ ID NO: 1758072 - RNA, 17 nt, Human herpesvirus 1
cccccaaaccccacgcc

SEQ ID NO: 1758073 - RNA, 19 nt, Human herpesvirus 1
cccccaaaucccggcgccg

SEQ ID NO: 1758074 - RNA, 19 nt, Human herpesvirus 1
cccccauaagguccguccg

SEQ ID NO: 1758075 - RNA, 21 nt, Human herpesvirus 1
cccccaucuaaugccacgcga

SEQ ID NO: 1758076 - RNA, 13 nt, Human herpesvirus 1
cccccccaagcgc

SEQ ID NO: 1758077 - RNA, 13 nt, Human herpesvirus 1
cccccccacccgc

SEQ ID NO: 1758078 - RNA, 13 nt, Human herpesvirus 1
cccccccucgcgc

SEQ ID NO: 1758079 - RNA, 13 nt, Human herpesvirus 1
cccccgcccgggu

SEQ ID NO: 1758080 - RNA, 16 nt, Human herpesvirus 1
cccccgccucuggggu

SEQ ID NO: 1758081 - RNA, 13 nt, Human herpesvirus 1
cccccgucugggu

SEQ ID NO: 1758082 - RNA, 13 nt, Human herpesvirus 1
cccccuccgcgcc

SEQ ID NO: 1758083 - RNA, 22 nt, Human herpesvirus 1
cccccucuaucccgcccaccgc

SEQ ID NO: 1758084 - RNA, 20 nt, Human herpesvirus 1
cccccuguuugucgacgaga

SEQ ID NO: 1758085 - RNA, 16 nt, Human herpesvirus 1
ccccgaacccugcggu

SEQ ID NO: 1758086 - RNA, 18 nt, Human herpesvirus 1
ccccacgaugaccgcccc

SEQ ID NO: 1758087 - RNA, 23 nt, Human herpesvirus 1
cccaucccgaggccccacgucgg

SEQ ID NO: 1758088 - RNA, 14 nt, Human herpesvirus 1
ccccagccuucacg

SEQ ID NO: 1758089 - RNA, 18 nt, Human herpesvirus 1
cccccggcacgccugggg

SEQ ID NO: 1758090 - RNA, 22 nt, Human herpesvirus 1
cccccggccgccgcggacgccg

SEQ ID NO: 1758091 - RNA, 20 nt, Human herpesvirus 1
cccccggguuuucccacgcc

SEQ ID NO: 1758092 - RNA, 16 nt, Human herpesvirus 1
ccccgcuucauccccg

SEQ ID NO: 1758093 - RNA, 15 nt, Human herpesvirus 1
ccccggacccgggcc

SEQ ID NO: 1758094 - RNA, 16 nt, Human herpesvirus 1
ccccggacgacauggc

SEQ ID NO: 1758095 - RNA, 15 nt, Human herpesvirus 1
ccccgauggcccucc

SEQ ID NO: 1758096 - RNA, 15 nt, Human herpesvirus 1
ccccgacagcccccc

SEQ ID NO: 1758097 - RNA, 14 nt, Human herpesvirus 1
ccccgacaugaccg

SEQ ID NO: 1758098 - RNA, 15 nt, Human herpesvirus 1
ccccgacugcccccc

SEQ ID NO: 1758099 - RNA, 14 nt, Human herpesvirus 1
ccccgagaaccagc

SEQ ID NO: 1758100 - RNA, 18 nt, Human herpesvirus 1
cccgcgacccggacgccg

SEQ ID NO: 1758101 - RNA, 13 nt, Human herpesvirus 1
cccgcgacgccau

SEQ ID NO: 1758102 - RNA, 20 nt, Human herpesvirus 1
ccccggaggcguuccgggca

SEQ ID NO: 1758103 - RNA, 14 nt, Human herpesvirus 1
ccccggccaccccg

SEQ ID NO: 1758104 - RNA, 17 nt, Human herpesvirus 1
cccgcgcgggggcgccg

SEQ ID NO: 1758105 - RNA, 16 nt, Human herpesvirus 1
cccgcgcucgcgagua

SEQ ID NO: 1758106 - RNA, 17 nt, Human
cucucuggggcuguguu

SEQ ID NO: 1758107 - RNA, 14 nt, Human
cucuaugcuuucca

SEQ ID NO: 1758108 - RNA, 16 nt, Human
cucuaugcuuuccaaa

SEQ ID NO: 1758109 - RNA, 19 nt, Human
cuccuuucaccccagggcc

SEQ ID NO: 1758110 - RNA, 13 nt, Human
cucugcagggccg

SEQ ID NO: 1758111 - RNA, 19 nt, Human
cucugcagggccgccaggg

SEQ ID NO: 1758112 - RNA, 21 nt, Human
cucugcuccucuccccagcaa

SEQ ID NO: 1758113 - RNA, 13 nt, Human
cucugcucgccuu

SEQ ID NO: 1758114 - RNA, 15 nt, Human
cucugcucgccuuag

SEQ ID NO: 1758115 - RNA, 21 nt, Human
cucugcugacagacacaggcc

SEQ ID NO: 1758116 - RNA, 22 nt, Human
cucugcugacagacacaggccc

SEQ ID NO: 1758117 - RNA, 16 nt, Human
cucugcucgccuuagc

SEQ ID NO: 1758118 - RNA, 17 nt, Human
cucugcucgccuuagca

SEQ ID NO: 1758119 - RNA, 23 nt, Human
cucugcugacagacacaggcccg

SEQ ID NO: 1758120 - RNA, 13 nt, Human
cucuguccuggga

SEQ ID NO: 1758121 - RNA, 14 nt, Human
cuccggacuggugc

SEQ ID NO: 1758122 - RNA, 15 nt, Human
cuccggacuggugcc

SEQ ID NO: 1758123 - RNA, 16 nt, Human
cuccggacuggugccc

SEQ ID NO: 1758124 - RNA, 14 nt, Human
cuccggcucccagc

SEQ ID NO: 1758125 - RNA, 15 nt, Human
cuccggcucccagcc

SEQ ID NO: 1758126 - RNA, 16 nt, Human
cuccggcucccagccu

SEQ ID NO: 1758127 - RNA, 17 nt, Human
cuccggcucccagccuc

SEQ ID NO: 1758128 - RNA, 19 nt, Human
cuccucugaaacagcugcc

SEQ ID NO: 1758129 - RNA, 20 nt, Human
cuccucugaaacagcugccu

SEQ ID NO: 1758130 - RNA, 21 nt, Human
cuccucugaaacagcugccuu

SEQ ID NO: 1758131 - RNA, 22 nt, Human
cuccucugaaacagcugccuua

SEQ ID NO: 1758132 - RNA, 23 nt, Human
cuccucugaaacagcugccuuag

SEQ ID NO: 1758133 - RNA, 13 nt, Human
cuccucugacuca

SEQ ID NO: 1758134 - RNA, 18 nt, Human
cuccucugacucagggcu

SEQ ID NO: 1758135 - RNA, 19 nt, Human
cuccucugacucagggcuc

SEQ ID NO: 1758136 - RNA, 20 nt, Human
cuccucugacucagggcucc

SEQ ID NO: 1758137 - RNA, 22 nt, Human
cuccucugacucagggcuccug

SEQ ID NO: 1758138 - RNA, 18 nt, Human
cuccuguccucccucacc

SEQ ID NO: 1758139 - RNA, 15 nt, Human
cuccuuucaccacau

SEQ ID NO: 1758140 - RNA, 21 nt, Human
cuccugggcccucucugcucu

SEQ ID NO: 1758141 - RNA, 22 nt, Human
cuccugggcccucucugcucug

SEQ ID NO: 1758142 - RNA, 23 nt, Human
cuccuggguuuuguauucucuga

SEQ ID NO: 1758143 - RNA, 22 nt, Human
cuccuggguuuuguauucucug

SEQ ID NO: 1758144 - RNA, 12 nt, Human
cuccuguccucc

SEQ ID NO: 1758145 - RNA, 23 nt, Human
cuccucuucuuuuuuuucauuau

SEQ ID NO: 1758146 - RNA, 12 nt, Human
cuccuggcccag

SEQ ID NO: 1758147 - RNA, 19 nt, Human
cuccuggccucaagugauu

SEQ ID NO: 1758148 - RNA, 14 nt, Human
cuccuggcccaggu

SEQ ID NO: 1758149 - RNA, 18 nt, Human
cuccugggcuaagugauc

SEQ ID NO: 1758150 - RNA, 15 nt, Human
cuccugggcccucuc

SEQ ID NO: 1758151 - RNA, 17 nt, Human
cuccugggcccucucug

SEQ ID NO: 1758152 - RNA, 19 nt, Human
cuccugggcccucucugcu

SEQ ID NO: 1758153 - RNA, 20 nt, Human
cuccugggcccucucugcuc

SEQ ID NO: 1758154 - RNA, 17 nt, Human
cucccagagcuggugga

SEQ ID NO: 1758155 - RNA, 22 nt, Human
cucccagagcugguggacccag

SEQ ID NO: 1758156 - RNA, 15 nt, Human
cuccaggcuccuuua

SEQ ID NO: 1758157 - RNA, 23 nt, Human
cuccaggcuccuuuagcgcccag

SEQ ID NO: 1758158 - RNA, 20 nt, Human
cuccaggcuguaucccauga

SEQ ID NO: 1758159 - RNA, 22 nt, Human
cuccaggcuguaucccaugagc

SEQ ID NO: 1758160 - RNA, 21 nt, Human
cucccaggacucugaccccag

SEQ ID NO: 1758161 - RNA, 18 nt, Human
cuccccccuccucugaaa

SEQ ID NO: 1758162 - RNA, 23 nt, Human
cuccccccuccucugaaacagcu

SEQ ID NO: 1758163 - RNA, 15 nt, Human
cucaaucaagaaaau

SEQ ID NO: 1758164 - RNA, 22 nt, Human
cuauguuuuuguucaaagccag

SEQ ID NO: 1758165 - RNA, 21 nt, Human
cucaagugauucuccugccuc

SEQ ID NO: 1758166 - RNA, 20 nt, Human
cuauguuuuuguucaaagcc

SEQ ID NO: 1758167 - RNA, 15 nt, Human
cuauccguguugcag

SEQ ID NO: 1758168 - RNA, 17 nt, Human
cuauccguguugcaggu

SEQ ID NO: 1758169 - RNA, 14 nt, Human
cuaucauggugaaa

SEQ ID NO: 1758170 - RNA, 22 nt, Human
cuaucauggugaaaagcuccau

SEQ ID NO: 1758171 - RNA, 18 nt, Human
cuauguugcccaggcagg

SEQ ID NO: 1758172 - RNA, 19 nt, Human
cuauguugcccaggcaggu

SEQ ID NO: 1758173 - RNA, 21 nt, Human
cuauguugcccaggcaggucu

SEQ ID NO: 1758174 - RNA, 22 nt, Human
cuauguugcccaggcaggucuu

SEQ ID NO: 1758175 - RNA, 14 nt, Human
cuauguugcccagg

SEQ ID NO: 1758176 - RNA, 23 nt, Human
cucaggugucccugcacuugcag

SEQ ID NO: 1758177 - RNA, 17 nt, Human
cucaugaggaggggccc

SEQ ID NO: 1758178 - RNA, 23 nt, Human
cucaugaggaggggccccccugc

SEQ ID NO: 1758179 - RNA, 14 nt, Human
cucaugaggggaga

SEQ ID NO: 1758180 - RNA, 15 nt, Human
cucaugaggggagag

SEQ ID NO: 1758181 - RNA, 19 nt, Human
cucaugaggggagaggaga

SEQ ID NO: 1758182 - RNA, 15 nt, Human
cucaguccauagcag

SEQ ID NO: 1758183 - RNA, 17 nt, Human
cucaguccauagcagag

SEQ ID NO: 1758184 - RNA, 19 nt, Human
cucaggccggcagccccag

SEQ ID NO: 1758185 - RNA, 20 nt, Human
cucaggccggcagccccagc

SEQ ID NO: 1758186 - RNA, 21 nt, Human
cucaggccggcagccccagcc

SEQ ID NO: 1758187 - RNA, 22 nt, Human
cucaggccggcagccccagccu

SEQ ID NO: 1758188 - RNA, 23 nt, Human
cucaggccggcagccccagccug

SEQ ID NO: 1758189 - RNA, 24 nt, Human
cucaggccggcagccccagccugc

SEQ ID NO: 1758190 - RNA, 21 nt, Human
cucaggcgggacagugcugca

SEQ ID NO: 1758191 - RNA, 14 nt, Human
cucaccuuuguuuu

SEQ ID NO: 1758192 - RNA, 22 nt, Human
cucaccuuuguuuuuuguugga

SEQ ID NO: 1758193 - RNA, 13 nt, Human
cucagaagacacu

SEQ ID NO: 1758194 - RNA, 14 nt, Human
cucagaacccuugg

SEQ ID NO: 1758195 - RNA, 21 nt, Human
cucagaacccuuggcuugccc

SEQ ID NO: 1758196 - RNA, 15 nt, Human
cucagaagacacuga

SEQ ID NO: 1758197 - RNA, 17 nt, Human
cucagaagacacugaug

SEQ ID NO: 1758198 - RNA, 20 nt, Human
cucagaagacacugaugggc

SEQ ID NO: 1758199 - RNA, 22 nt, Human
cucagaagacacugaugggcaa

SEQ ID NO: 1758200 - RNA, 19 nt, Human
cucagccucccgaauagcu

SEQ ID NO: 1758201 - RNA, 21 nt, Human
cucagccucccgaauagcugg

SEQ ID NO: 1758202 - RNA, 22 nt, Human
cucagccucccgaauagcuggg

SEQ ID NO: 1758203 - RNA, 23 nt, Human
cucagaagacacugaugggcaac

SEQ ID NO: 1758204 - RNA, 14 nt, Human
cucagaacuugcug

SEQ ID NO: 1758205 - RNA, 17 nt, Human
cucagaacuugcugcug

SEQ ID NO: 1758206 - RNA, 18 nt, Human
cucagaacuugcugcugu

SEQ ID NO: 1758207 - RNA, 19 nt, Human
cucagaacuugcugcuguc

SEQ ID NO: 1758208 - RNA, 20 nt, Human
cucagaacuugcugcugucu

SEQ ID NO: 1758209 - RNA, 23 nt, Human
cucagaacuugcugcugucuugu

SEQ ID NO: 1758210 - RNA, 15 nt, Human
cucagaagccucugg

SEQ ID NO: 1758211 - RNA, 17 nt, Human
cucagaagccucugggu

SEQ ID NO: 1758212 - RNA, 12 nt, Human
cgguggcugggc

SEQ ID NO: 1758213 - RNA, 13 nt, Human
cgguggcugggca

SEQ ID NO: 1758214 - RNA, 14 nt, Human
cgguggcugggcag

SEQ ID NO: 1758215 - RNA, 21 nt, Human
cgguggcugggcagagcugca

SEQ ID NO: 1758216 - RNA, 12 nt, Human
cgggcugugccc

SEQ ID NO: 1758217 - RNA, 17 nt, Human
cguacaggcuggcgcag

SEQ ID NO: 1758218 - RNA, 13 nt, Human
cgggcuccagcca

SEQ ID NO: 1758219 - RNA, 14 nt, Human
cgggcuccagccau

SEQ ID NO: 1758220 - RNA, 18 nt, Human
cgggcuccagccaucuca

SEQ ID NO: 1758221 - RNA, 13 nt, Human
cgggccagggcug

SEQ ID NO: 1758222 - RNA, 17 nt, Human
cgggccagggcugcccc

SEQ ID NO: 1758223 - RNA, 18 nt, Human
cgggccagggcugccccu

SEQ ID NO: 1758224 - RNA, 21 nt, Human
cgggcccuucccacaggacau

SEQ ID NO: 1758225 - RNA, 20 nt, Human
cggagacggagucccaccuu

SEQ ID NO: 1758226 - RNA, 17 nt, Human
cggagacggagucccac

SEQ ID NO: 1758227 - RNA, 21 nt, Human
cggagucccaccuuggcugca

SEQ ID NO: 1758228 - RNA, 22 nt, Human
cggagucccaccuuggcugcag

SEQ ID NO: 1758229 - RNA, 12 nt, Human
cggagggcugcg

SEQ ID NO: 1758230 - RNA, 11 nt, Human
cggaggggagu

SEQ ID NO: 1758231 - RNA, 14 nt, Human
cggaggggaguaga

SEQ ID NO: 1758232 - RNA, 23 nt, Human
cggagucccaccuuggcugcagg

SEQ ID NO: 1758233 - RNA, 15 nt, Human
cggcguacaggcugg

SEQ ID NO: 1758234 - RNA, 16 nt, Human
cggcguacaggcuggc

SEQ ID NO: 1758235 - RNA, 12 nt, Human
cgccacaggacc

SEQ ID NO: 1758236 - RNA, 13 nt, Human
cgccacaggaccc

SEQ ID NO: 1758237 - RNA, 13 nt, Human
ccuuucgaggccu

SEQ ID NO: 1758238 - RNA, 14 nt, Human
ccuuucgaggccug

SEQ ID NO: 1758239 - RNA, 15 nt, Human
ccuuuccuccucuga

SEQ ID NO: 1758240 - RNA, 11 nt, Human
ccuuuccuguc

SEQ ID NO: 1758241 - RNA, 14 nt, Human
ccuuuccuguccca

SEQ ID NO: 1758242 - RNA, 15 nt, Human
ccuuuccugucccac

SEQ ID NO: 1758243 - RNA, 17 nt, Human
cgcuggagugcagugag

SEQ ID NO: 1758244 - RNA, 18 nt, Human
cgcuggagugcagugagc

SEQ ID NO: 1758245 - RNA, 15 nt, Human
cgcugccugcccaca

SEQ ID NO: 1758246 - RNA, 14 nt, Human
cgcugagccaccug

SEQ ID NO: 1758247 - RNA, 15 nt, Human
cgcugagccaccugc

SEQ ID NO: 1758248 - RNA, 16 nt, Human
cgcugagccaccugcc

SEQ ID NO: 1758249 - RNA, 21 nt, Human
cgcugagccaccugcccuuuu

SEQ ID NO: 1758250 - RNA, 20 nt, Human
cgccugcaaacgcugccugc

SEQ ID NO: 1758251 - RNA, 21 nt, Human
cgccugcaaacgcugccugcc

SEQ ID NO: 1758252 - RNA, 22 nt, Human
cgccugcaaacgcugccugccc

SEQ ID NO: 1758253 - RNA, 22 nt, Human
cgccugcaaacgcugccugccg

SEQ ID NO: 1758254 - RNA, 17 nt, Human
cgccugcauguaaacac

SEQ ID NO: 1758255 - RNA, 22 nt, Human
cgccugcauguaaacacgccug

SEQ ID NO: 1758256 - RNA, 22 nt, Human
cgugagccacugcaccgggcca

SEQ ID NO: 1758257 - RNA, 15 nt, Human
cgugagcucuuguga

SEQ ID NO: 1758258 - RNA, 14 nt, Human
cgugagccacugca

SEQ ID NO: 1758259 - RNA, 15 nt, Human
cgugagccacugcac

SEQ ID NO: 1758260 - RNA, 20 nt, Human
cgugagccacugcaccgggc

SEQ ID NO: 1758261 - RNA, 14 nt, Human
cgugacaacacuug

SEQ ID NO: 1758262 - RNA, 15 nt, Human
cgugacaacacuugu

SEQ ID NO: 1758263 - RNA, 20 nt, Human
cguuagucgugagcucuugu

SEQ ID NO: 1758264 - RNA, 14 nt, Human
cguuagaggaaaaa

SEQ ID NO: 1758265 - RNA, 17 nt, Human
cguuagaggaaaaauau

SEQ ID NO: 1758266 - RNA, 12 nt, Human
cuaauuuuuaag

SEQ ID NO: 1758267 - RNA, 14 nt, Human
cuaagaaccccucu

SEQ ID NO: 1758268 - RNA, 20 nt, Human
ccuuuauuguguuugucauu

SEQ ID NO: 1758269 - RNA, 15 nt, Human
ccuuuauuguguuug

SEQ ID NO: 1758270 - RNA, 12 nt, Human
ccuuuauugugu

SEQ ID NO: 1758271 - RNA, 21 nt, Human
ccuuuauuguguuugucauua

SEQ ID NO: 1758272 - RNA, 18 nt, Human
ccuugccuuucgaggccu

SEQ ID NO: 1758273 - RNA, 19 nt, Human
ccuugccuuucgaggccug

SEQ ID NO: 1758274 - RNA, 20 nt, Human
ccuugccuuucgaggccuga

SEQ ID NO: 1758275 - RNA, 21 nt, Human
ccuuccuauuccaagcuucca

SEQ ID NO: 1758276 - RNA, 12 nt, Human
ccuuccuccugg

SEQ ID NO: 1758277 - RNA, 13 nt, Human
ccuuccuccuggg

SEQ ID NO: 1758278 - RNA, 14 nt, Human
ccuucucugaagga

SEQ ID NO: 1758279 - RNA, 16 nt, Human
ccuucucugaaggaca

SEQ ID NO: 1758280 - RNA, 22 nt, Human
ccuucuguccuacucuguguca

SEQ ID NO: 1758281 - RNA, 20 nt, Human
ccuucuguccuacucugugu

SEQ ID NO: 1758282 - RNA, 21 nt, Human
ccuucuguccuacucuguguc

SEQ ID NO: 1758283 - RNA, 13 nt, Human
ccuguucagcucc

SEQ ID NO: 1758284 - RNA, 23 nt, Human
ccuguuagacguccuccguccau

SEQ ID NO: 1758285 - RNA, 12 nt, Human
ccugcugcuucu

SEQ ID NO: 1758286 - RNA, 14 nt, Human
ccugcugcuucucc

SEQ ID NO: 1758287 - RNA, 15 nt, Human
ccugcugcuucucca

SEQ ID NO: 1758288 - RNA, 16 nt, Human
ccugcugcuucuccaa

SEQ ID NO: 1758289 - RNA, 12 nt, Human
ccugcuggaagc

SEQ ID NO: 1758290 - RNA, 13 nt, Human
ccugcuggaagcc

SEQ ID NO: 1758291 - RNA, 14 nt, Human
ccugcuggaagccc

SEQ ID NO: 1758292 - RNA, 16 nt, Human
ccugcuggaagcccag

SEQ ID NO: 1758293 - RNA, 17 nt, Human
ccugcuggaagcccagc

SEQ ID NO: 1758294 - RNA, 12 nt, Human
ccugcuggaggc

SEQ ID NO: 1758295 - RNA, 13 nt, Human
ccugcuggaggcc

SEQ ID NO: 1758296 - RNA, 14 nt, Human
ccugcuggaggccu

SEQ ID NO: 1758297 - RNA, 15 nt, Human
ccugcuggaggccuc

SEQ ID NO: 1758298 - RNA, 16 nt, Human
ccugcuggaggccuca

SEQ ID NO: 1758299 - RNA, 17 nt, Human
ccugcuggaggccucag

SEQ ID NO: 1758300 - RNA, 18 nt, Human
ccugcuggaggccucagg

SEQ ID NO: 1758301 - RNA, 21 nt, Human
ccugcuggaggccucaggugc

SEQ ID NO: 1758302 - RNA, 22 nt, Human
ccugcuggaggccucaggugcu

SEQ ID NO: 1758303 - RNA, 19 nt, Human
ccuuagcagggaaacagcu

SEQ ID NO: 1758304 - RNA, 20 nt, Human
ccuuagcagggaaacagcua

SEQ ID NO: 1758305 - RNA, 20 nt, Human
ccuuagcacuaccacuccug

SEQ ID NO: 1758306 - RNA, 22 nt, Human
ccuguugcuaagccccagcaag

SEQ ID NO: 1758307 - RNA, 14 nt, Human
ccuguugcuaagcc

SEQ ID NO: 1758308 - RNA, 13 nt, Human
ccuguugcuaagc

SEQ ID NO: 1758309 - RNA, 12 nt, Human
ccuguugcuaag

SEQ ID NO: 1758310 - RNA, 14 nt, Human
ccuguuccuggagg

SEQ ID NO: 1758311 - RNA, 21 nt, Human
ccuguugaauuuuguucucug

SEQ ID NO: 1758312 - RNA, 22 nt, Human
ccuguugaauuuuguucucugg

SEQ ID NO: 1758313 - RNA, 23 nt, Human
ccuguugaauuuuguucucuggg

SEQ ID NO: 1758314 - RNA, 23 nt, Human
ccuguucagcuccagcucaccag

SEQ ID NO: 1758315 - RNA, 20 nt, Human
ccuguucagcuccagcucac

SEQ ID NO: 1758316 - RNA, 21 nt, Human
ccuguucagcuccagcucacc

SEQ ID NO: 1758317 - RNA, 14 nt, Human
ccuguucagcucca

SEQ ID NO: 1758318 - RNA, 15 nt, Human
ccuguucagcuccag

SEQ ID NO: 1758319 - RNA, 16 nt, Human
ccuguucagcuccagc

SEQ ID NO: 1758320 - RNA, 19 nt, Human
ccuguucagcuccagcuca

SEQ ID NO: 1758321 - RNA, 16 nt, Human
ccuuauuagagugucu

SEQ ID NO: 1758322 - RNA, 21 nt, Human
ccuuauuagagugucuuucca

SEQ ID NO: 1758323 - RNA, 19 nt, Human
ccuuaugcuucuuucaaau

SEQ ID NO: 1758324 - RNA, 15 nt, Human
ccuuaucugugcuca

SEQ ID NO: 1758325 - RNA, 17 nt, Human
ccuuaucugugcucagg

SEQ ID NO: 1758326 - RNA, 23 nt, Human
ccuuaucuccacaaccucuuccc

SEQ ID NO: 1758327 - RNA, 12 nt, Human
ccuuagcuucag

SEQ ID NO: 1758328 - RNA, 14 nt, Human
ccuuagcuucagga

SEQ ID NO: 1758329 - RNA, 16 nt, Human
ccuuagcuucaggaac

SEQ ID NO: 1758330 - RNA, 17 nt, Human
ccuuagcuucaggaacc

SEQ ID NO: 1758331 - RNA, 19 nt, Human
ccuuagcuucaggaaccuc

SEQ ID NO: 1758332 - RNA, 13 nt, Human
ccugcugcaugcc

SEQ ID NO: 1758333 - RNA, 16 nt, Human
ccugcugcaugcccuc

SEQ ID NO: 1758334 - RNA, 20 nt, Human
ccugcugcaugcccucucag

SEQ ID NO: 1758335 - RNA, 21 nt, Human
ccugcugcaugcccucucagg

SEQ ID NO: 1758336 - RNA, 23 nt, Human
ccugcugcaugcccucucaggcc

SEQ ID NO: 1758337 - RNA, 14 nt, Human
ccucuuugcugcag

SEQ ID NO: 1758338 - RNA, 20 nt, Human
ccucuucugucccuguuaga

SEQ ID NO: 1758339 - RNA, 13 nt, Human
ccucuucugggag

SEQ ID NO: 1758340 - RNA, 17 nt, Human
ccucuucugggagggca

SEQ ID NO: 1758341 - RNA, 18 nt, Human
ccucuucugggagggcag

SEQ ID NO: 1758342 - RNA, 21 nt, Human
ccucuucugggagggcagcag

SEQ ID NO: 1758343 - RNA, 21 nt, Human
ccucugccugaagucacacag

SEQ ID NO: 1758344 - RNA, 13 nt, Human
ccugacucauucu

SEQ ID NO: 1758345 - RNA, 12 nt, Human
ccuccccagccu

SEQ ID NO: 1758346 - RNA, 13 nt, Human
ccuccccagccug

SEQ ID NO: 1758347 - RNA, 14 nt, Human
ccuccccagccugc

SEQ ID NO: 1758348 - RNA, 15 nt, Human
ccuccccagccugcg

SEQ ID NO: 1758349 - RNA, 16 nt, Human
ccuccccagccugcgc

SEQ ID NO: 1758350 - RNA, 21 nt, Human
ccuccccagccugcgccugcu

SEQ ID NO: 1758351 - RNA, 22 nt, Human
ccuccccagccugcgccugcug

SEQ ID NO: 1758352 - RNA, 23 nt, Human
ccucccagagcugguggacccag

SEQ ID NO: 1758353 - RNA, 19 nt, Human
ccucaggaggcaggaccuu

SEQ ID NO: 1758354 - RNA, 20 nt, Human
ccuagccgguuccugucccu

SEQ ID NO: 1758355 - RNA, 21 nt, Human
ccuagccgguuccugucccug

SEQ ID NO: 1758356 - RNA, 22 nt, Human
ccuagccgguuccugucccugc

SEQ ID NO: 1758357 - RNA, 23 nt, Human
ccuagccgguuccugucccugcg

SEQ ID NO: 1758358 - RNA, 18 nt, Human
ccuccuuuccuccucuga

SEQ ID NO: 1758359 - RNA, 21 nt, Human
ccuccuuuccuccucugacuu

SEQ ID NO: 1758360 - RNA, 16 nt, Human
ccucgaacuggcugca

SEQ ID NO: 1758361 - RNA, 15 nt, Human
ccucgaacuggcugc

SEQ ID NO: 1758362 - RNA, 14 nt, Human
ccuccgccuccagg

SEQ ID NO: 1758363 - RNA, 16 nt, Human
ccuccgccuccaggaa

SEQ ID NO: 1758364 - RNA, 18 nt, Human
ccuccgggaccuggugcu

SEQ ID NO: 1758365 - RNA, 15 nt, Human
ccuccguccauauca

SEQ ID NO: 1758366 - RNA, 19 nt, Human
ccucucuauauuucggguc

SEQ ID NO: 1758367 - RNA, 20 nt, Human
ccucugccucugacacacag

SEQ ID NO: 1758368 - RNA, 21 nt, Human
ccucugccucugacacacagc

SEQ ID NO: 1758369 - RNA, 23 nt, Human
ccucugccucugacacacagcuc

SEQ ID NO: 1758370 - RNA, 11 nt, Human
ccucugccuga

SEQ ID NO: 1758371 - RNA, 20 nt, Human
ccucugccugaagucacaca

SEQ ID NO: 1758372 - RNA, 13 nt, Human
ccucuccuuccug

SEQ ID NO: 1758373 - RNA, 15 nt, Human
ccucuccuuccugug

SEQ ID NO: 1758374 - RNA, 14 nt, Human
ccucuccuuuguuc

SEQ ID NO: 1758375 - RNA, 22 nt, Human
ccucgccggacccucuaaccuc

SEQ ID NO: 1758376 - RNA, 13 nt, Human
ccucgcugccagc

SEQ ID NO: 1758377 - RNA, 14 nt, Human
ccucgcugccagcu

SEQ ID NO: 1758378 - RNA, 19 nt, Human
ccucgcugccagcucugua

SEQ ID NO: 1758379 - RNA, 20 nt, Human
ccucgcugccagcucuguau

SEQ ID NO: 1758380 - RNA, 19 nt, Human
ccucggcuuuucucagcug

SEQ ID NO: 1758381 - RNA, 20 nt, Human
ccucggcuuuucucagcugg

SEQ ID NO: 1758382 - RNA, 18 nt, Human
cccuccggacuggugccc

SEQ ID NO: 1758383 - RNA, 19 nt, Human
cccuccggacuggugcccu

SEQ ID NO: 1758384 - RNA, 13 nt, Human
cccuccgccucca

SEQ ID NO: 1758385 - RNA, 16 nt, Human
cccuccgccuccagga

SEQ ID NO: 1758386 - RNA, 14 nt, Human
cccucgcugccagc

SEQ ID NO: 1758387 - RNA, 14 nt, Human
cccugcccggcugc

SEQ ID NO: 1758388 - RNA, 17 nt, Human
cccugcccggcugcgga

SEQ ID NO: 1758389 - RNA, 13 nt, Human
cccugagcugagg

SEQ ID NO: 1758390 - RNA, 14 nt, Human
cccugagcugaggc

SEQ ID NO: 1758391 - RNA, 16 nt, Human
cccugagcugaggcag

SEQ ID NO: 1758392 - RNA, 17 nt, Human
cccugagcugaggcagc

SEQ ID NO: 1758393 - RNA, 19 nt, Human
cccugagcugaggcagcag

SEQ ID NO: 1758394 - RNA, 21 nt, Human
cccugagcugaggcagcagug

SEQ ID NO: 1758395 - RNA, 14 nt, Human
cccugacuuuucug

SEQ ID NO: 1758396 - RNA, 15 nt, Human
cccugacucauucug

SEQ ID NO: 1758397 - RNA, 19 nt, Human
cccugacucauucugaagg

SEQ ID NO: 1758398 - RNA, 21 nt, Human
cccugacucauucugaaggag

SEQ ID NO: 1758399 - RNA, 13 nt, Human
cccugacugggag

SEQ ID NO: 1758400 - RNA, 16 nt, Human
ccgaauagcugggacu

SEQ ID NO: 1758401 - RNA, 17 nt, Human
ccgaauagcugggacua

SEQ ID NO: 1758402 - RNA, 18 nt, Human
ccgaccagacaccuugac

SEQ ID NO: 1758403 - RNA, 13 nt, Human
ccgaccagacacc

SEQ ID NO: 1758404 - RNA, 17 nt, Human
ccgaccagacaccuuga

SEQ ID NO: 1758405 - RNA, 19 nt, Human
ccgaaagggacuuggaagc

SEQ ID NO: 1758406 - RNA, 22 nt, Human
cccugugcagccgcugagcgag

SEQ ID NO: 1758407 - RNA, 22 nt, Human
ccgcccagagacccaagcugcc

SEQ ID NO: 1758408 - RNA, 21 nt, Human
cccuguccggaaugccaccca

SEQ ID NO: 1758409 - RNA, 22 nt, Human
cccuguccggaaugccacccac

SEQ ID NO: 1758410 - RNA, 15 nt, Human
ccggccccugcuggu

SEQ ID NO: 1758411 - RNA, 18 nt, Human
ccggcccgcgccacagga

SEQ ID NO: 1758412 - RNA, 17 nt, Human
ccggcccgcgccacagg

SEQ ID NO: 1758413 - RNA, 15 nt, Human
ccggcuccaggcucc

SEQ ID NO: 1758414 - RNA, 13 nt, Human
ccggcuccaggcu

SEQ ID NO: 1758415 - RNA, 14 nt, Human
ccggcuccaggcuc

SEQ ID NO: 1758416 - RNA, 17 nt, Human
ccuagccgguuccuguc

SEQ ID NO: 1758417 - RNA, 13 nt, Human
ccuaaucucugua

SEQ ID NO: 1758418 - RNA, 21 nt, Human
ccagcgagcccugguggcagu

SEQ ID NO: 1758419 - RNA, 16 nt, Human
ccagcgaggaggcucc

SEQ ID NO: 1758420 - RNA, 13 nt, Human
ccagcguccuccu

SEQ ID NO: 1758421 - RNA, 19 nt, Human
ccagcguccuccucuguga

SEQ ID NO: 1758422 - RNA, 17 nt, Human
ccagcguccuccucugu

SEQ ID NO: 1758423 - RNA, 11 nt, Human
ccaguccugcu

SEQ ID NO: 1758424 - RNA, 12 nt, Human
ccaguccugcua

SEQ ID NO: 1758425 - RNA, 15 nt, Human
ccaguccugcuaccu

SEQ ID NO: 1758426 - RNA, 21 nt, Human
ccaguccugcuaccucccuug

SEQ ID NO: 1758427 - RNA, 13 nt, Human
ccagagagggugg

SEQ ID NO: 1758428 - RNA, 13 nt, Human
ccagaugcaccag

SEQ ID NO: 1758429 - RNA, 14 nt, Human
ccagaugcaccagc

SEQ ID NO: 1758430 - RNA, 16 nt, Human
ccagauaacugaggag

SEQ ID NO: 1758431 - RNA, 17 nt, Human
ccagacccggcugcgug

SEQ ID NO: 1758432 - RNA, 15 nt, Human
ccagacggcuccacu

SEQ ID NO: 1758433 - RNA, 20 nt, Human
ccagacggcuccacuaggac

SEQ ID NO: 1758434 - RNA, 19 nt, Human
ccacugcacuauagccuag

SEQ ID NO: 1758435 - RNA, 20 nt, Human
ccacugcacuauagccuagg

SEQ ID NO: 1758436 - RNA, 13 nt, Human
ccacugcaccggg

SEQ ID NO: 1758437 - RNA, 14 nt, Human
ccacugcaccgggc

SEQ ID NO: 1758438 - RNA, 17 nt, Human
ccacugcaccgggccac

SEQ ID NO: 1758439 - RNA, 19 nt, Human
ccacugcaccgggccacag

SEQ ID NO: 1758440 - RNA, 13 nt, Human
ccacugagggcag

SEQ ID NO: 1758441 - RNA, 18 nt, Human
cccaggcuggcgugcagu

SEQ ID NO: 1758442 - RNA, 21 nt, Human
cccaggcuggcgugcaguggu

SEQ ID NO: 1758443 - RNA, 23 nt, Human
cccagggcaaggguuaaggccug

SEQ ID NO: 1758444 - RNA, 18 nt, Human
cccagggcaagcuccgca

SEQ ID NO: 1758445 - RNA, 20 nt, Human
cccagggcaagcuccgcagg

SEQ ID NO: 1758446 - RNA, 15 nt, Human
cccagggcaagcucc

SEQ ID NO: 1758447 - RNA, 19 nt, Human
cccaggcuggcgugcagug

SEQ ID NO: 1758448 - RNA, 20 nt, Human
cccaggcuggcgugcagugg

SEQ ID NO: 1758449 - RNA, 17 nt, Human
cccagggcaucuugcug

SEQ ID NO: 1758450 - RNA, 19 nt, Human
cccagggcaucuugcuggc

SEQ ID NO: 1758451 - RNA, 21 nt, Human
cccagggcaucuugcuggcua

SEQ ID NO: 1758452 - RNA, 19 nt, Human
cccagcccacuucugccau

SEQ ID NO: 1758453 - RNA, 11 nt, Human
cccagcccaga

SEQ ID NO: 1758454 - RNA, 12 nt, Human
cccagcccagau

SEQ ID NO: 1758455 - RNA, 20 nt, Human
cccagcccagauuccccugu

SEQ ID NO: 1758456 - RNA, 21 nt, Human
cccagcccagauuccccugug

SEQ ID NO: 1758457 - RNA, 13 nt, Human
cccagcauucuca

SEQ ID NO: 1758458 - RNA, 15 nt, Human
cccagcauucucagg

SEQ ID NO: 1758459 - RNA, 16 nt, Human
cccagcauucucaggc

SEQ ID NO: 1758460 - RNA, 17 nt, Human
cccagcauucucaggca

SEQ ID NO: 1758461 - RNA, 19 nt, Human
cccagcauucucaggcacc

SEQ ID NO: 1758462 - RNA, 21 nt, Human
ccccauucugccugcccaggc

SEQ ID NO: 1758463 - RNA, 12 nt, Human
cccauugcuguu

SEQ ID NO: 1758464 - RNA, 14 nt, Human
ccccaaaacccggg

SEQ ID NO: 1758465 - RNA, 18 nt, Human
ccccagcauucucaggca

SEQ ID NO: 1758466 - RNA, 19 nt, Human
ccccagcauucucaggcac

SEQ ID NO: 1758467 - RNA, 20 nt, Human
ccccagcauucucaggcacc

SEQ ID NO: 1758468 - RNA, 21 nt, Human
ccccagcauucucaggcacca

SEQ ID NO: 1758469 - RNA, 22 nt, Human
ccccagcauucucaggcaccag

SEQ ID NO: 1758470 - RNA, 20 nt, Human
ccaugucugcagugugcccc

SEQ ID NO: 1758471 - RNA, 17 nt, Human
ccaugggcagagcccaa

SEQ ID NO: 1758472 - RNA, 13 nt, Human
ccaugagccucag

SEQ ID NO: 1758473 - RNA, 14 nt, Human
ccaugggcagagcc

SEQ ID NO: 1758474 - RNA, 16 nt, Human
ccaugggcagagccca

SEQ ID NO: 1758475 - RNA, 14 nt, Human
cccaagcagagaag

SEQ ID NO: 1758476 - RNA, 17 nt, Human
cccaagcucugcuccuc

SEQ ID NO: 1758477 - RNA, 19 nt, Human
ccauugugaaccaaugcaa

SEQ ID NO: 1758478 - RNA, 19 nt, Human
ccauuguccaauccuaugu

SEQ ID NO: 1758479 - RNA, 23 nt, Human
cacaucuugcucugcugacagac

SEQ ID NO: 1758480 - RNA, 17 nt, Human
cacauuuauucugcuca

SEQ ID NO: 1758481 - RNA, 18 nt, Human
cacauuuauucugcucac

SEQ ID NO: 1758482 - RNA, 17 nt, Human
caccagccccagugccc

SEQ ID NO: 1758483 - RNA, 19 nt, Human
caccagcccuuagcaggga

SEQ ID NO: 1758484 - RNA, 18 nt, Human
caccagccccagugccca

SEQ ID NO: 1758485 - RNA, 21 nt, Human
caccagccccagugcccacag

SEQ ID NO: 1758486 - RNA, 22 nt, Human
caccagccccagugcccacagg

SEQ ID NO: 1758487 - RNA, 12 nt, Human
cacccagcccac

SEQ ID NO: 1758488 - RNA, 13 nt, Human
cacaucuugcucu

SEQ ID NO: 1758489 - RNA, 14 nt, Human
cacaucuugcucug

SEQ ID NO: 1758490 - RNA, 15 nt, Human
cacaucuugcucugc

SEQ ID NO: 1758491 - RNA, 20 nt, Human
cacaucuugcucugcugaca

SEQ ID NO: 1758492 - RNA, 21 nt, Human
cacaucuugcucugcugacag

SEQ ID NO: 1758493 - RNA, 22 nt, Human
cacaucuugcucugcugacaga

SEQ ID NO: 1758494 - RNA, 19 nt, Human
cacucccaagguuggagcc

SEQ ID NO: 1758495 - RNA, 20 nt, Human
cacucccaagguuggagccc

SEQ ID NO: 1758496 - RNA, 21 nt, Human
cacgcuggagugcagugagcc

SEQ ID NO: 1758497 - RNA, 16 nt, Human
cacgcuggagugcagu

SEQ ID NO: 1758498 - RNA, 17 nt, Human
cacgcuggagugcagug

SEQ ID NO: 1758499 - RNA, 18 nt, Human
cacgcuggagugcaguga

SEQ ID NO: 1758500 - RNA, 20 nt, Human
cacgcuggagugcagugagc

SEQ ID NO: 1758501 - RNA, 15 nt, Human
cacgcuggagugcag

SEQ ID NO: 1758502 - RNA, 15 nt, Human
cacggagccacuccu

SEQ ID NO: 1758503 - RNA, 16 nt, Human
cacggagccacuccuc

SEQ ID NO: 1758504 - RNA, 17 nt, Human
cacggagccacuccucu

SEQ ID NO: 1758505 - RNA, 18 nt, Human
cacggagccacuccucug

SEQ ID NO: 1758506 - RNA, 19 nt, Human
cacggagccacuccucuga

SEQ ID NO: 1758507 - RNA, 21 nt, Human
cacggagccacuccucugacu

SEQ ID NO: 1758508 - RNA, 23 nt, Human
cacggagccacuccucugacuca

SEQ ID NO: 1758509 - RNA, 12 nt, Human
cacccuccuuuc

SEQ ID NO: 1758510 - RNA, 12 nt, Human
cacccugcucuc

SEQ ID NO: 1758511 - RNA, 16 nt, Human
caaggcccagaugugg

SEQ ID NO: 1758512 - RNA, 20 nt, Human
caaggauugcuacuguccua

SEQ ID NO: 1758513 - RNA, 15 nt, Human
caagcucugcuccuc

SEQ ID NO: 1758514 - RNA, 14 nt, Human
caagcuccgcagga

SEQ ID NO: 1758515 - RNA, 15 nt, Human
caagcuccgcaggac

SEQ ID NO: 1758516 - RNA, 16 nt, Human
caagcuccgcaggacu

SEQ ID NO: 1758517 - RNA, 17 nt, Human
caagcuccgcaggacuu

SEQ ID NO: 1758518 - RNA, 16 nt, Human
caagcucugcuccucu

SEQ ID NO: 1758519 - RNA, 12 nt, Human
caaugcuggcug

SEQ ID NO: 1758520 - RNA, 16 nt, Human
caauggcagccuuggc

SEQ ID NO: 1758521 - RNA, 13 nt, Human
caauggcagccuu

SEQ ID NO: 1758522 - RNA, 14 nt, Human
caauggcagccuug

SEQ ID NO: 1758523 - RNA, 15 nt, Human
caauggcagccuugg

SEQ ID NO: 1758524 - RNA, 15 nt, Human
caaucagcuccuucc

SEQ ID NO: 1758525 - RNA, 16 nt, Human
caaucagcuccuuccu

SEQ ID NO: 1758526 - RNA, 18 nt, Human
caaucagcuccuuccugg

SEQ ID NO: 1758527 - RNA, 13 nt, Human
caaugccaucauc

SEQ ID NO: 1758528 - RNA, 14 nt, Human
caaugccaucaucu

SEQ ID NO: 1758529 - RNA, 21 nt, Human
caacuauuuauugacucuggg

SEQ ID NO: 1758530 - RNA, 22 nt, Human
caacuauuuauugacucugggu

SEQ ID NO: 1758531 - RNA, 14 nt, Human
caacccccagccug

SEQ ID NO: 1758532 - RNA, 17 nt, Human
caaccccuucgcuccug

SEQ ID NO: 1758533 - RNA, 21 nt, Human
caacuagugggguuuccuggc

SEQ ID NO: 1758534 - RNA, 14 nt, Human
caaccccuucgcuc

SEQ ID NO: 1758535 - RNA, 16 nt, Human
caaccccuucgcuccu

SEQ ID NO: 1758536 - RNA, 14 nt, Human
caagcaccuccugc

SEQ ID NO: 1758537 - RNA, 13 nt, Human
caagcaccuccug

SEQ ID NO: 1758538 - RNA, 14 nt, Human
caagcaaacccaga

SEQ ID NO: 1758539 - RNA, 17 nt, Human
caagcaaacccagacgg

SEQ ID NO: 1758540 - RNA, 13 nt, Human
caagcaagacuga

SEQ ID NO: 1758541 - RNA, 14 nt, Human
caagcaagacugag

SEQ ID NO: 1758542 - RNA, 21 nt, Human
caagauauuuuaaaaucuguc

SEQ ID NO: 1758543 - RNA, 23 nt, Human
caagauauuuuaaaaucugucac

SEQ ID NO: 1758544 - RNA, 23 nt, Human
auuugcacagaagcacaugcacc

SEQ ID NO: 1758545 - RNA, 22 nt, Human
auuuaauuagugcuaaguguga

SEQ ID NO: 1758546 - RNA, 21 nt, Human
auuuaauuagugcuaagugug

SEQ ID NO: 1758547 - RNA, 20 nt, Human
auuuaauuagugcuaagugu

SEQ ID NO: 1758548 - RNA, 23 nt, Human
auuuaauuagugcuaagugugaa

SEQ ID NO: 1758549 - RNA, 21 nt, Human
caaacaugacccuaaaucuug

SEQ ID NO: 1758550 - RNA, 14 nt, Human
caaaccagcuucau

SEQ ID NO: 1758551 - RNA, 14 nt, Human
auuuuuuuucaugu

SEQ ID NO: 1758552 - RNA, 15 nt, Human
auuuuuuuucauguu

SEQ ID NO: 1758553 - RNA, 16 nt, Human
auuuuuuuucauguuu

SEQ ID NO: 1758554 - RNA, 20 nt, Human
auuuuuuuucauguuuuaac

SEQ ID NO: 1758555 - RNA, 19 nt, Human
caaaagguucacuaaagca

SEQ ID NO: 1758556 - RNA, 18 nt, Human
caaacauccuaucaacaa

SEQ ID NO: 1758557 - RNA, 19 nt, Human
auuuucuauaauuuaaaua

SEQ ID NO: 1758558 - RNA, 18 nt, Human
auuuucuauaauuuaaau

SEQ ID NO: 1758559 - RNA, 17 nt, Human
auuuucuauaauuuaaa

SEQ ID NO: 1758560 - RNA, 15 nt, Human
auuuguguugaagga

SEQ ID NO: 1758561 - RNA, 19 nt, Human
auuuguguugaaggaacuu

SEQ ID NO: 1758562 - RNA, 16 nt, Human
auuuguuauuuugcaa

SEQ ID NO: 1758563 - RNA, 17 nt, Human
auuuguuauuuugcaac

SEQ ID NO: 1758564 - RNA, 20 nt, Human
auucggaacuguccuuuccu

SEQ ID NO: 1758565 - RNA, 21 nt, Human
auucggaacuguccuuuccuu

SEQ ID NO: 1758566 - RNA, 16 nt, Human
auucgagacagaaccu

SEQ ID NO: 1758567 - RNA, 17 nt, Human
auucgagacagaaccuu

SEQ ID NO: 1758568 - RNA, 21 nt, Human
auucggugugcaccaggguug

SEQ ID NO: 1758569 - RNA, 16 nt, Human
auuacaggugugaacc

SEQ ID NO: 1758570 - RNA, 16 nt, Human
auuagagugucuuucc

SEQ ID NO: 1758571 - RNA, 17 nt, Human
auuagagugucuuucca

SEQ ID NO: 1758572 - RNA, 23 nt, Human
auuagagugucuuuccacggagc

SEQ ID NO: 1758573 - RNA, 16 nt, Human
auuagauguucucuau

SEQ ID NO: 1758574 - RNA, 14 nt, Human
auuagauguucucu

SEQ ID NO: 1758575 - RNA, 13 nt, Human
auuagauguucuc

SEQ ID NO: 1758576 - RNA, 17 nt, Human
auucaauaaaguauuua

SEQ ID NO: 1758577 - RNA, 14 nt, Human
auucaauaaaguau

SEQ ID NO: 1758578 - RNA, 13 nt, Human
auucaauaaagua

SEQ ID NO: 1758579 - RNA, 12 nt, Human
auucaauaaagu

SEQ ID NO: 1758580 - RNA, 12 nt, Human
auucauuauuug

SEQ ID NO: 1758581 - RNA, 15 nt, Human
auucauuauuuguca

SEQ ID NO: 1758582 - RNA, 16 nt, Human
auucauuauuugucaa

SEQ ID NO: 1758583 - RNA, 22 nt, Human
caggcacugagauaccagcgag

SEQ ID NO: 1758584 - RNA, 17 nt, Human
caggaccuccaagccac

SEQ ID NO: 1758585 - RNA, 19 nt, Human
caggaccuccaagccacug

SEQ ID NO: 1758586 - RNA, 20 nt, Human
caggaccuccaagccacuga

SEQ ID NO: 1758587 - RNA, 23 nt, Human
caggaccuccaagccacugagca

SEQ ID NO: 1758588 - RNA, 15 nt, Human
caggacccagaggaa

SEQ ID NO: 1758589 - RNA, 16 nt, Human
caggacccagaggaag

SEQ ID NO: 1758590 - RNA, 13 nt, Human
caggacccagagg

SEQ ID NO: 1758591 - RNA, 14 nt, Human
caggacccagagga

SEQ ID NO: 1758592 - RNA, 21 nt, Human
caggaccagucaaccugggca

SEQ ID NO: 1758593 - RNA, 12 nt, Human
caggacauuucu

SEQ ID NO: 1758594 - RNA, 14 nt, Human
caggacauuucucu

SEQ ID NO: 1758595 - RNA, 18 nt, Human
caggacauuucucuaaga

SEQ ID NO: 1758596 - RNA, 10 nt, Human
caggaccagc

SEQ ID NO: 1758597 - RNA, 20 nt, Human
caggaccagccagcagcagc

SEQ ID NO: 1758598 - RNA, 15 nt, Human
caggcaaugcuggcu

SEQ ID NO: 1758599 - RNA, 16 nt, Human
caggcaaugcuggcug

SEQ ID NO: 1758600 - RNA, 17 nt, Human
caggcaaugcuggcugu

SEQ ID NO: 1758601 - RNA, 18 nt, Human
caggaggccaggccggcg

SEQ ID NO: 1758602 - RNA, 21 nt, Human
cagggagaccuggacacaggc

SEQ ID NO: 1758603 - RNA, 20 nt, Human
cagggagaccuggacacagg

SEQ ID NO: 1758604 - RNA, 14 nt, Human
cagggcuacccuga

SEQ ID NO: 1758605 - RNA, 16 nt, Human
cagggcuacccugagc

SEQ ID NO: 1758606 - RNA, 18 nt, Human
cagggcuacccugagcug

SEQ ID NO: 1758607 - RNA, 19 nt, Human
cagggcuacccugagcuga

SEQ ID NO: 1758608 - RNA, 22 nt, Human
cagggcuacccugagcugaggc

SEQ ID NO: 1758609 - RNA, 23 nt, Human
cagggcuacccugagcugaggca

SEQ ID NO: 1758610 - RNA, 24 nt, Human
cagggcuacccugagcugaggcag

SEQ ID NO: 1758611 - RNA, 12 nt, Human
cagggcuccugg

SEQ ID NO: 1758612 - RNA, 13 nt, Human
cagggcuccuggg

SEQ ID NO: 1758613 - RNA, 12 nt, Human
cagcuaaagcaa

SEQ ID NO: 1758614 - RNA, 19 nt, Human
cagcuaaagcaauaugcau

SEQ ID NO: 1758615 - RNA, 22 nt, Human
cagcuaaaccaaggacugagca

SEQ ID NO: 1758616 - RNA, 17 nt, Human
cagcgcggcccucccga

SEQ ID NO: 1758617 - RNA, 12 nt, Human
cagcugaggcug

SEQ ID NO: 1758618 - RNA, 21 nt, Human
cagcugaggcugggggagagc

SEQ ID NO: 1758619 - RNA, 23 nt, Human
cagcugaggcugggggagagccg

SEQ ID NO: 1758620 - RNA, 14 nt, Human
cagcugucaagggc

SEQ ID NO: 1758621 - RNA, 19 nt, Human
cagacagaggaugagcucu

SEQ ID NO: 1758622 - RNA, 16 nt, Human
cagacagacacacaca

SEQ ID NO: 1758623 - RNA, 12 nt, Human
cagacagaggau

SEQ ID NO: 1758624 - RNA, 14 nt, Human
cagacagaggauga

SEQ ID NO: 1758625 - RNA, 14 nt, Human
cagacagacacaca

SEQ ID NO: 1758626 - RNA, 15 nt, Human
cagacagacacacac

SEQ ID NO: 1758627 - RNA, 11 nt, Human
cagacaggcaa

SEQ ID NO: 1758628 - RNA, 13 nt, Human
cagacaggcaagc

SEQ ID NO: 1758629 - RNA, 18 nt, Human
cagacaggcaagcaccuc

SEQ ID NO: 1758630 - RNA, 20 nt, Human
cagacaggcaagcaccuccu

SEQ ID NO: 1758631 - RNA, 21 nt, Human
cagacaggcaagcaccuccug

SEQ ID NO: 1758632 - RNA, 23 nt, Human
cagacucuacagaggccaugggc

SEQ ID NO: 1758633 - RNA, 18 nt, Human
cagacucuacagaggcca

SEQ ID NO: 1758634 - RNA, 19 nt, Human
cagacucuacagaggccau

SEQ ID NO: 1758635 - RNA, 20 nt, Human
cagacucuacagaggccaug

SEQ ID NO: 1758636 - RNA, 21 nt, Human
cagacucuacagaggccaugg

SEQ ID NO: 1758637 - RNA, 17 nt, Human
cagacucuacagaggcc

SEQ ID NO: 1758638 - RNA, 22 nt, Human
cagacaggcaagcaccuccugc

SEQ ID NO: 1758639 - RNA, 23 nt, Human
cagacaggcaagcaccuccugcc

SEQ ID NO: 1758640 - RNA, 13 nt, Human
cagacuggaagca

SEQ ID NO: 1758641 - RNA, 17 nt, Human
cagacugaucaggaccu

SEQ ID NO: 1758642 - RNA, 16 nt, Human
cagacugaucaggacc

SEQ ID NO: 1758643 - RNA, 14 nt, Human
cagacuggaagcac

SEQ ID NO: 1758644 - RNA, 16 nt, Human
cagacuggaagcacag

SEQ ID NO: 1758645 - RNA, 17 nt, Human
cagacuggaagcacagc

SEQ ID NO: 1758646 - RNA, 18 nt, Human
cagacuggaagcacagcu

SEQ ID NO: 1758647 - RNA, 20 nt, Human
cagacuggaagcacagcuuc

SEQ ID NO: 1758648 - RNA, 21 nt, Human
cagacuggaagcacagcuuca

SEQ ID NO: 1758649 - RNA, 19 nt, Human
cagauugcaacaggcuggg

SEQ ID NO: 1758650 - RNA, 20 nt, Human
cagauugcaacaggcugggc

SEQ ID NO: 1758651 - RNA, 17 nt, Human
cagauuguggaauguug

SEQ ID NO: 1758652 - RNA, 18 nt, Human
cagauuguggaauguugg

SEQ ID NO: 1758653 - RNA, 20 nt, Human
cagauuguggaauguuggau

SEQ ID NO: 1758654 - RNA, 21 nt, Human
cagauuguggaauguuggaua

SEQ ID NO: 1758655 - RNA, 18 nt, Human
cagauugcaacaggcugg

SEQ ID NO: 1758656 - RNA, 13 nt, Human
cagcaccugucuc

SEQ ID NO: 1758657 - RNA, 19 nt, Human
cagcacuaugcuuuccuuc

SEQ ID NO: 1758658 - RNA, 20 nt, Human
cagcacuaugcuuuccuucu

SEQ ID NO: 1758659 - RNA, 12 nt, Human
cagagagggugg

SEQ ID NO: 1758660 - RNA, 17 nt, Human
cagagaggguggugacc

SEQ ID NO: 1758661 - RNA, 20 nt, Human
cagagaggguggugaccucu

SEQ ID NO: 1758662 - RNA, 22 nt, Human
cagagaggguggugaccucugc

SEQ ID NO: 1758663 - RNA, 23 nt, Human
cagagaggguggugaccucugcc

SEQ ID NO: 1758664 - RNA, 13 nt, Human
cagagcuuuucag

SEQ ID NO: 1758665 - RNA, 14 nt, Human
cagagcuuuucaga

SEQ ID NO: 1758666 - RNA, 15 nt, Human
cagagcuuuucagau

SEQ ID NO: 1758667 - RNA, 20 nt, Human
cagagcuucuuccaggugcc

SEQ ID NO: 1758668 - RNA, 23 nt, Human
cagagcuucuuccaggugcccag

SEQ ID NO: 1758669 - RNA, 18 nt, Human
cagaucccaggccccugg

SEQ ID NO: 1758670 - RNA, 20 nt, Human
cagaucccaggccccuggag

SEQ ID NO: 1758671 - RNA, 21 nt, Human
cagaucccaggccccuggagg

SEQ ID NO: 1758672 - RNA, 22 nt, Human
cagaucccaggccccuggaggc

SEQ ID NO: 1758673 - RNA, 24 nt, Human
caguuugaaugcagucuguccagg

SEQ ID NO: 1758674 - RNA, 13 nt, Human
caguuugaaauuc

SEQ ID NO: 1758675 - RNA, 16 nt, Human
caguuugaaauucuga

SEQ ID NO: 1758676 - RNA, 17 nt, Human
caguuugaaauucugaa

SEQ ID NO: 1758677 - RNA, 18 nt, Human
caguuugaaauucugaau

SEQ ID NO: 1758678 - RNA, 19 nt, Human
caguuugaaauucugaauu

SEQ ID NO: 1758679 - RNA, 20 nt, Human
caguuugaaauucugaauuu

SEQ ID NO: 1758680 - RNA, 21 nt, Human
caguuugaaauucugaauuug

SEQ ID NO: 1758681 - RNA, 22 nt, Human
caguuugaaauucugaauuugc

SEQ ID NO: 1758682 - RNA, 17 nt, Human
cauauguagccuucaca

SEQ ID NO: 1758683 - RNA, 24 nt, Human
cauauguagccuucacacagauag

SEQ ID NO: 1758684 - RNA, 23 nt, Human
cauagcagagaaugaaagggccc

SEQ ID NO: 1758685 - RNA, 16 nt, Human
cauagguuuaauaauu

SEQ ID NO: 1758686 - RNA, 15 nt, Human
caucuaaccucaucu

SEQ ID NO: 1758687 - RNA, 18 nt, Human
caucuaaccucaucuucu

SEQ ID NO: 1758688 - RNA, 19 nt, Human
caucuaaccucaucuucuu

SEQ ID NO: 1758689 - RNA, 17 nt, Human
caucugguuaggauggc

SEQ ID NO: 1758690 - RNA, 18 nt, Human
caucagcuaaacaccacg

SEQ ID NO: 1758691 - RNA, 20 nt, Human
caucagcuaaacaccacguc

SEQ ID NO: 1758692 - RNA, 22 nt, Human
caguuauuauauuuacaaaugg

SEQ ID NO: 1758693 - RNA, 21 nt, Human
caguucaaaauucuaaaugua

SEQ ID NO: 1758694 - RNA, 21 nt, Human
cagucugauucccaagcucug

SEQ ID NO: 1758695 - RNA, 22 nt, Human
cagucugauucccaagcucugc

SEQ ID NO: 1758696 - RNA, 20 nt, Human
cagugguaugaucacggcuc

SEQ ID NO: 1758697 - RNA, 16 nt, Human
cagugggagcugccug

SEQ ID NO: 1758698 - RNA, 17 nt, Human
cagugggagcugccugu

SEQ ID NO: 1758699 - RNA, 18 nt, Human
cagugggagcugccuguu

SEQ ID NO: 1758700 - RNA, 21 nt, Human
cagugcccacaggaucagucu

SEQ ID NO: 1758701 - RNA, 22 nt, Human
cagugcccacaggaucagucug

SEQ ID NO: 1758702 - RNA, 23 nt, Human
cagucugauucccaagcucugcu

SEQ ID NO: 1758703 - RNA, 21 nt, Human
cagugguaugaucacggcuca

SEQ ID NO: 1758704 - RNA, 20 nt, Human
cagugguccacaucccggga

SEQ ID NO: 1758705 - RNA, 13 nt, Human
caguggucucaca

SEQ ID NO: 1758706 - RNA, 19 nt, Human
caguggugcgaucuggguu

SEQ ID NO: 1758707 - RNA, 20 nt, Human
caguggugcgaucuggguuc

SEQ ID NO: 1758708 - RNA, 21 nt, Human
caguuauuauauuuacaaaug

SEQ ID NO: 1758709 - RNA, 17 nt, Human
caguuauuauauuuaca

SEQ ID NO: 1758710 - RNA, 15 nt, Human
cauggcccucauuaa

SEQ ID NO: 1758711 - RNA, 22 nt, Human
cauggcccucauuaaugacacu

SEQ ID NO: 1758712 - RNA, 19 nt, Human
cauguuaaguccucccuga

SEQ ID NO: 1758713 - RNA, 18 nt, Human
cauguuggccaggcuggu

SEQ ID NO: 1758714 - RNA, 17 nt, Human
cauguuggccaggcugg

SEQ ID NO: 1758715 - RNA, 19 nt, Human
cauguuggccaggcugguc

SEQ ID NO: 1758716 - RNA, 16 nt, Human
cauucucgcuucccug

SEQ ID NO: 1758717 - RNA, 17 nt, Human
cauucucgcuucccuga

SEQ ID NO: 1758718 - RNA, 14 nt, Human
cauucucugucuca

SEQ ID NO: 1758719 - RNA, 19 nt, Human
cauucucugucucauccau

SEQ ID NO: 1758720 - RNA, 23 nt, Human
cauucucugucucauccaucauc

SEQ ID NO: 1758721 - RNA, 16 nt, Human
cauucugaaggagccc

SEQ ID NO: 1758722 - RNA, 14 nt, Human
ccaaagugcuggga

SEQ ID NO: 1758723 - RNA, 14 nt, Human
ccaauuauguuaaa

SEQ ID NO: 1758724 - RNA, 17 nt, Human
ccaauuauguuaaacua

SEQ ID NO: 1758725 - RNA, 15 nt, Human
ccaauuauguuaaac

SEQ ID NO: 1758726 - RNA, 22 nt, Human
ccaauucuaucuuuuguuuccu

SEQ ID NO: 1758727 - RNA, 12 nt, Human
ccaaggaggauu

SEQ ID NO: 1758728 - RNA, 22 nt, Human
ccaaggacugagcacccucugg

SEQ ID NO: 1758729 - RNA, 16 nt, Human
ccaaaucauaguggcu

SEQ ID NO: 1758730 - RNA, 17 nt, Human
ccaagcucugcuccucu

SEQ ID NO: 1758731 - RNA, 16 nt, Human
ccaagcucugcuccuc

SEQ ID NO: 1758732 - RNA, 14 nt, Human
ccaagcucugcucc

SEQ ID NO: 1758733 - RNA, 15 nt, Human
ccaagcucugcuccu

SEQ ID NO: 1758734 - RNA, 23 nt, Human
ccaacuauuuauugacucugggu

SEQ ID NO: 1758735 - RNA, 11 nt, Human
ccaacuauuua

SEQ ID NO: 1758736 - RNA, 16 nt, Human
ccaacuauuuauugac

SEQ ID NO: 1758737 - RNA, 14 nt, Human
ccaacucagaaggg

SEQ ID NO: 1758738 - RNA, 16 nt, Human
cauuggacccuuccau

SEQ ID NO: 1758739 - RNA, 17 nt, Human
cauuggacccuuccaug

SEQ ID NO: 1758740 - RNA, 17 nt, Human
cauuuaguuugauuauu

SEQ ID NO: 1758741 - RNA, 20 nt, Human
ccaaaaaagcuguauuuuga

SEQ ID NO: 1758742 - RNA, 22 nt, Human
ccaaaaaagcuguauuuugaaa

SEQ ID NO: 1758743 - RNA, 23 nt, Human
ccaaaaaagcuguauuuugaaaa

SEQ ID NO: 1758744 - RNA, 18 nt, Human
ccaaaaguggccucuuug

SEQ ID NO: 1758745 - RNA, 21 nt, Human
ccaaaaguggccucuuugucu

SEQ ID NO: 1758746 - RNA, 15 nt, Human
ccaaaaguggccucu

SEQ ID NO: 1758747 - RNA, 19 nt, Human
cauuuggcagagcuucuuc

SEQ ID NO: 1758748 - RNA, 19 nt, Human
ggcuccugagggagcucca

SEQ ID NO: 1758749 - RNA, 17 nt, Human
ggcugcagggaguccga

SEQ ID NO: 1758750 - RNA, 14 nt, Human
ggcuggcgugcagu

SEQ ID NO: 1758751 - RNA, 16 nt, Human
ggcuggcgugcagugg

SEQ ID NO: 1758752 - RNA, 20 nt, Human
ggcuggcgugcaguggugcg

SEQ ID NO: 1758753 - RNA, 16 nt, Human
ggcugcaugauguuug

SEQ ID NO: 1758754 - RNA, 22 nt, Human
ggcugcaugauguuugcccaaa

SEQ ID NO: 1758755 - RNA, 20 nt, Human
ggcugccccuaaucucugua

SEQ ID NO: 1758756 - RNA, 22 nt, Human
ggcugccccuaaucucuguagg

SEQ ID NO: 1758757 - RNA, 23 nt, Human
ggcugccccuaaucucuguagga

SEQ ID NO: 1758758 - RNA, 13 nt, Human
aaaaaaaaaguuc

SEQ ID NO: 1758759 - RNA, 13 nt, Human
aaaaaguauuauu

SEQ ID NO: 1758760 - RNA, 14 nt, Human
aaaaaguauuauuu

SEQ ID NO: 1758761 - RNA, 15 nt, Human
aaaaaguauuauuuu

SEQ ID NO: 1758762 - RNA, 19 nt, Human
aaaaaguauuauuuuccaa

SEQ ID NO: 1758763 - RNA, 13 nt, Human
aaaaaaacacaaa

SEQ ID NO: 1758764 - RNA, 11 nt, Human
aaaaaaaagaa

SEQ ID NO: 1758765 - RNA, 12 nt, Human
aaaaaaaagaau

SEQ ID NO: 1758766 - RNA, 19 nt, Human
ggcuguaucccaugagccu

SEQ ID NO: 1758767 - RNA, 16 nt, Human
ggcuggugucaccuga

SEQ ID NO: 1758768 - RNA, 18 nt, Human
aaaaagugcuucauucuu

SEQ ID NO: 1758769 - RNA, 15 nt, Human
ggcuucaguggcagc

SEQ ID NO: 1758770 - RNA, 20 nt, Human
ggcuguaucccaugagccuc

SEQ ID NO: 1758771 - RNA, 22 nt, Human
ggcuguaucccaugagccucag

SEQ ID NO: 1758772 - RNA, 23 nt, Human
ggcuguaucccaugagccucagc

SEQ ID NO: 1758773 - RNA, 16 nt, Human
ggcuucaguggcagcu

SEQ ID NO: 1758774 - RNA, 17 nt, Human
gggaaaauuauuugcau

SEQ ID NO: 1758775 - RNA, 18 nt, Human
gggaaaauuauuugcaua

SEQ ID NO: 1758776 - RNA, 19 nt, Human
gggaaacagguugggaugg

SEQ ID NO: 1758777 - RNA, 21 nt, Human
gggaaacaucacaccugcccu

SEQ ID NO: 1758778 - RNA, 12 nt, Human
aaaauauaagua

SEQ ID NO: 1758779 - RNA, 16 nt, Human
aaaauauaaguaaagu

SEQ ID NO: 1758780 - RNA, 18 nt, Human
aaaauauaaguaaaguga

SEQ ID NO: 1758781 - RNA, 14 nt, Human
aaaauaacacacau

SEQ ID NO: 1758782 - RNA, 22 nt, Human
aaaauagauaagaguagaaacu

SEQ ID NO: 1758783 - RNA, 14 nt, Human
gggcagcagggcua

SEQ ID NO: 1758784 - RNA, 12 nt, Human
gggcagagccca

SEQ ID NO: 1758785 - RNA, 14 nt, Human
gggcagagcccaag

SEQ ID NO: 1758786 - RNA, 13 nt, Human
gggagggcugcga

SEQ ID NO: 1758787 - RNA, 14 nt, Human
gggagggcugcgac

SEQ ID NO: 1758788 - RNA, 17 nt, Human
gggaggggaagcuucug

SEQ ID NO: 1758789 - RNA, 11 nt, Human
gggagggcagc

SEQ ID NO: 1758790 - RNA, 13 nt, Human
gggagggcagcag

SEQ ID NO: 1758791 - RNA, 14 nt, Human
gggagacugggcug

SEQ ID NO: 1758792 - RNA, 16 nt, Human
gggagacugggcugag

SEQ ID NO: 1758793 - RNA, 19 nt, Human
gggagacugggcugaggga

SEQ ID NO: 1758794 - RNA, 20 nt, Human
gggagacugggcugagggag

SEQ ID NO: 1758795 - RNA, 16 nt, Human
aaaagcgcuuuuccuu

SEQ ID NO: 1758796 - RNA, 18 nt, Human
aaaagcuguauuuugaaa

SEQ ID NO: 1758797 - RNA, 22 nt, Human
aaaagcuccauuuuuagugaaa

SEQ ID NO: 1758798 - RNA, 14 nt, Human
gggaacagacugga

SEQ ID NO: 1758799 - RNA, 22 nt, Human
gggaacagacuggaagcacagc

SEQ ID NO: 1758800 - RNA, 13 nt, Human
gggaacagccacu

SEQ ID NO: 1758801 - RNA, 20 nt, Human
aaaaaugcaaauccuaugug

SEQ ID NO: 1758802 - RNA, 18 nt, Human
aaaaaugcaaauccuaug

SEQ ID NO: 1758803 - RNA, 12 nt, Human
aaaaauuaaaau

SEQ ID NO: 1758804 - RNA, 21 nt, Human
aaaaaugcacaaacaaugcaa

SEQ ID NO: 1758805 - RNA, 22 nt, Human
aaaaaugcaaauccuaugugau

SEQ ID NO: 1758806 - RNA, 23 nt, Human
aaaaaugcaaauccuaugugauu

SEQ ID NO: 1758807 - RNA, 18 nt, Human
aaaaaugcccuuaaauca

SEQ ID NO: 1758808 - RNA, 20 nt, Human
ggguaucaggugcugccauc

SEQ ID NO: 1758809 - RNA, 15 nt, Human
ggggucuguaaaauc

SEQ ID NO: 1758810 - RNA, 19 nt, Human
gggucagacgccugaggaa

SEQ ID NO: 1758811 - RNA, 18 nt, Human
gggucagaaacaggaccg

SEQ ID NO: 1758812 - RNA, 16 nt, Human
gggucagaaacaggac

SEQ ID NO: 1758813 - RNA, 20 nt, Human
gggucagaacccugccaugg

SEQ ID NO: 1758814 - RNA, 23 nt, Human
ggggucugggaggaauggacaga

SEQ ID NO: 1758815 - RNA, 22 nt, Human
ggggucgacuucgggcuggcca

SEQ ID NO: 1758816 - RNA, 17 nt, Human
ggggccuuaucgggcuc

SEQ ID NO: 1758817 - RNA, 16 nt, Human
ggggccugggacuucc

SEQ ID NO: 1758818 - RNA, 23 nt, Human
ggggccugggacuuccaugccuu

SEQ ID NO: 1758819 - RNA, 22 nt, Human
gggucucacuauguugcccagg

SEQ ID NO: 1758820 - RNA, 19 nt, Human
gggucgggggcaggugcug

SEQ ID NO: 1758821 - RNA, 12 nt, Human
gggucucacucu

SEQ ID NO: 1758822 - RNA, 23 nt, Human
gggucucacuauguugcccaggc

SEQ ID NO: 1758823 - RNA, 22 nt, Human
aaacuccgagugaacuggucuu

SEQ ID NO: 1758824 - RNA, 17 nt, Human
aaacuaggaaauuuuuu

SEQ ID NO: 1758825 - RNA, 14 nt, Human
aaacuccuuccugg

SEQ ID NO: 1758826 - RNA, 20 nt, Human
aaacuccuuccuggccugag

SEQ ID NO: 1758827 - RNA, 14 nt, Human
aaacuagcauaucu

SEQ ID NO: 1758828 - RNA, 19 nt, Human
aaacuacugccuuuagaaa

SEQ ID NO: 1758829 - RNA, 21 nt, Human
aaacuacugccuuuagaaaau

SEQ ID NO: 1758830 - RNA, 22 nt, Human
aaacuagcauaucugccuuuau

SEQ ID NO: 1758831 - RNA, 21 nt, Human
aaacuagcauaucugccuuua

SEQ ID NO: 1758832 - RNA, 20 nt, Human
aaacuagcauaucugccuuu

SEQ ID NO: 1758833 - RNA, 19 nt, Human
aaacuagcauaucugccuu

SEQ ID NO: 1758834 - RNA, 14 nt, Human
aaacgcuccuuugu

SEQ ID NO: 1758835 - RNA, 16 nt, Human
aaacgcuccuuugugu

SEQ ID NO: 1758836 - RNA, 12 nt, Human
aaacgcugccug

SEQ ID NO: 1758837 - RNA, 14 nt, Human
aaacgcugccugcc

SEQ ID NO: 1758838 - RNA, 16 nt, Human
aaacgcugccugccca

SEQ ID NO: 1758839 - RNA, 17 nt, Human
ggggaaacagguuggga

SEQ ID NO: 1758840 - RNA, 17 nt, Human
ggggaaaggcaaggucc

SEQ ID NO: 1758841 - RNA, 22 nt, Human
ggggaaaggcaagguccggccc

SEQ ID NO: 1758842 - RNA, 15 nt, Human
aaacaauaaaugugc

SEQ ID NO: 1758843 - RNA, 17 nt, Human
aaacaaaauggcuucag

SEQ ID NO: 1758844 - RNA, 18 nt, Human
aaacaaaauggcuucagu

SEQ ID NO: 1758845 - RNA, 17 nt, Human
aaacaacucuuugagaa

SEQ ID NO: 1758846 - RNA, 17 nt, Human
aaaauguauaugcacuu

SEQ ID NO: 1758847 - RNA, 13 nt, Human
aaaauggauacau

SEQ ID NO: 1758848 - RNA, 14 nt, Human
aaaauggauacaua

SEQ ID NO: 1758849 - RNA, 16 nt, Human
aaaauguagaauauuc

SEQ ID NO: 1758850 - RNA, 14 nt, Human
aaaauguauaugca

SEQ ID NO: 1758851 - RNA, 16 nt, Human
gguauaaaagaugggg

SEQ ID NO: 1758852 - RNA, 12 nt, Human
gguaugucugcc

SEQ ID NO: 1758853 - RNA, 13 nt, Human
gguaugucugcca

SEQ ID NO: 1758854 - RNA, 14 nt, Human
gguaugucugccau

SEQ ID NO: 1758855 - RNA, 13 nt, Human
gguauaaaagaug

SEQ ID NO: 1758856 - RNA, 12 nt, Human
gguauaaaagau

SEQ ID NO: 1758857 - RNA, 19 nt, Human
gguccacccaggagccccg

SEQ ID NO: 1758858 - RNA, 17 nt, Human
gguauuguauuuauuca

SEQ ID NO: 1758859 - RNA, 12 nt, Human
gguauuguauuu

SEQ ID NO: 1758860 - RNA, 20 nt, Human
gguccacccaggagccccga

SEQ ID NO: 1758861 - RNA, 22 nt, Human
gguccacccaggagccccgagg

SEQ ID NO: 1758862 - RNA, 17 nt, Human
gguccaugggcagagcc

SEQ ID NO: 1758863 - RNA, 20 nt, Human
gguccagaaggagacaggca

SEQ ID NO: 1758864 - RNA, 18 nt, Human
gguccaugggcagagccc

SEQ ID NO: 1758865 - RNA, 21 nt, Human
gguccagaaggagacaggcag

SEQ ID NO: 1758866 - RNA, 23 nt, Human
aaagauggggucuguaaaaucuu

SEQ ID NO: 1758867 - RNA, 19 nt, Human
aaagaugggugaaggcugg

SEQ ID NO: 1758868 - RNA, 23 nt, Human
aaagaugguguggguguccugcc

SEQ ID NO: 1758869 - RNA, 23 nt, Human
aaagaugucucugcaaaccaaca

SEQ ID NO: 1758870 - RNA, 18 nt, Human
aaagagagaacaggacua

SEQ ID NO: 1758871 - RNA, 18 nt, Human
aaagaauuccaaagcaaa

SEQ ID NO: 1758872 - RNA, 13 nt, Human
aaagaauguuacu

SEQ ID NO: 1758873 - RNA, 18 nt, Human
aaagaauguuacugccuu

SEQ ID NO: 1758874 - RNA, 19 nt, Human
aaagaauguuacugccuua

SEQ ID NO: 1758875 - RNA, 13 nt, Human
ggugauggggagg

SEQ ID NO: 1758876 - RNA, 21 nt, Human
ggucuugaacuccuggccuca

SEQ ID NO: 1758877 - RNA, 22 nt, Human
ggucuugaacuccuggccucaa

SEQ ID NO: 1758878 - RNA, 14 nt, Human
ggucuguaaaaucu

SEQ ID NO: 1758879 - RNA, 12 nt, Human
ggucuguaaaau

SEQ ID NO: 1758880 - RNA, 21 nt, Human
ggucugggaggaauggacaga

SEQ ID NO: 1758881 - RNA, 18 nt, Human
aaagcuaggccuggccag

SEQ ID NO: 1758882 - RNA, 18 nt, Human
ggugccaugucugcagug

SEQ ID NO: 1758883 - RNA, 17 nt, Human
aaaggaaucauuucuau

SEQ ID NO: 1758884 - RNA, 13 nt, Human
aaaggaauuuaaa

SEQ ID NO: 1758885 - RNA, 12 nt, Human
ggaugagaaagg

SEQ ID NO: 1758886 - RNA, 22 nt, Human
ggaugagaaagguugaagcacc

SEQ ID NO: 1758887 - RNA, 21 nt, Human
ggaugagaauuugagugcucu

SEQ ID NO: 1758888 - RNA, 23 nt, Human
ggaugagaauuugagugcucuga

SEQ ID NO: 1758889 - RNA, 13 nt, Human
ggauguucuggga

SEQ ID NO: 1758890 - RNA, 23 nt, Human
ggauguuauuauccuugggggcu

SEQ ID NO: 1758891 - RNA, 21 nt, Human
ggauuuugauccaagcugguc

SEQ ID NO: 1758892 - RNA, 22 nt, Human
ggauuugcacagaagcacaugc

SEQ ID NO: 1758893 - RNA, 19 nt, Human
ggcaaaggguccagaagga

SEQ ID NO: 1758894 - RNA, 13 nt, Human
ggcaaacccauca

SEQ ID NO: 1758895 - RNA, 14 nt, Human
ggcaggcagguguu

SEQ ID NO: 1758896 - RNA, 17 nt, Human
ggcagaaauacagucuu

SEQ ID NO: 1758897 - RNA, 17 nt, Human
ggcagaaggcaaaccca

SEQ ID NO: 1758898 - RNA, 21 nt, Human
ggcaggaccuucgggcugugc

SEQ ID NO: 1758899 - RNA, 23 nt, Human
ggcaggaccuucgggcugugccc

SEQ ID NO: 1758900 - RNA, 18 nt, Human
ggcaggacgugggcuggg

SEQ ID NO: 1758901 - RNA, 20 nt, Human
ggcccagggcaagcuccgca

SEQ ID NO: 1758902 - RNA, 17 nt, Human
ggcccagggcaagcucc

SEQ ID NO: 1758903 - RNA, 19 nt, Human
ggcccagggcaagcuccgc

SEQ ID NO: 1758904 - RNA, 22 nt, Human
ggcccagggcaagcuccgcagg

SEQ ID NO: 1758905 - RNA, 14 nt, Human
ggcccgcgccacag

SEQ ID NO: 1758906 - RNA, 20 nt, Human
ggcccucauuaaugacacuu

SEQ ID NO: 1758907 - RNA, 17 nt, Human
ggcccgcgccacaggac

SEQ ID NO: 1758908 - RNA, 18 nt, Human
ggcccgcgccacaggacc

SEQ ID NO: 1758909 - RNA, 18 nt, Human
ggccccaggaaaggccca

SEQ ID NO: 1758910 - RNA, 22 nt, Human
ggccccaggcauugccaagggc

SEQ ID NO: 1758911 - RNA, 15 nt, Human
ggccaaagccaaagc

SEQ ID NO: 1758912 - RNA, 23 nt, Human
ggccagagggagugacagaggca

SEQ ID NO: 1758913 - RNA, 19 nt, Human
ggccagaugcaccagcccu

SEQ ID NO: 1758914 - RNA, 20 nt, Human
ggccagaugcaccagcccuu

SEQ ID NO: 1758915 - RNA, 16 nt, Human
ggagccccauuccugg

SEQ ID NO: 1758916 - RNA, 17 nt, Human
ggagccccauuccuggg

SEQ ID NO: 1758917 - RNA, 22 nt, Human
ggagcugccuguucagcuccag

SEQ ID NO: 1758918 - RNA, 20 nt, Human
ggagcuucuuguuuccuugu

SEQ ID NO: 1758919 - RNA, 16 nt, Human
ggaggccagugagcca

SEQ ID NO: 1758920 - RNA, 17 nt, Human
ggaggccagugagccac

SEQ ID NO: 1758921 - RNA, 14 nt, Human
ggaggcccaaccuc

SEQ ID NO: 1758922 - RNA, 14 nt, Human
ggaggccaggccgg

SEQ ID NO: 1758923 - RNA, 23 nt, Human
ggaggccaggccggcgagcccug

SEQ ID NO: 1758924 - RNA, 15 nt, Human
ggaggaaagggagga

SEQ ID NO: 1758925 - RNA, 20 nt, Human
ggagcacugggcucccgggc

SEQ ID NO: 1758926 - RNA, 12 nt, Human
ggagcagagggg

SEQ ID NO: 1758927 - RNA, 18 nt, Human
ggagagcaucggccuagg

SEQ ID NO: 1758928 - RNA, 22 nt, Human
ggagagccaccaagagggacgc

SEQ ID NO: 1758929 - RNA, 20 nt, Human
ggagagcaucggccuagggc

SEQ ID NO: 1758930 - RNA, 15 nt, Human
ggacuuccaugccuu

SEQ ID NO: 1758931 - RNA, 19 nt, Human
ggacuuccccggagggcug

SEQ ID NO: 1758932 - RNA, 20 nt, Human
ggacuuccccggagggcugc

SEQ ID NO: 1758933 - RNA, 20 nt, Human
ggacuacaggugugagucac

SEQ ID NO: 1758934 - RNA, 22 nt, Human
ggacucaaugcacugacauugu

SEQ ID NO: 1758935 - RNA, 17 nt, Human
ggacucagaagccucug

SEQ ID NO: 1758936 - RNA, 18 nt, Human
ggacucagaagccucugg

SEQ ID NO: 1758937 - RNA, 23 nt, Human
ggagacugggcugagggagccug

SEQ ID NO: 1758938 - RNA, 13 nt, Human
ggagacugggcug

SEQ ID NO: 1758939 - RNA, 17 nt, Human
ggagacugggcugaggg

SEQ ID NO: 1758940 - RNA, 20 nt, Human
ggagacugggcugagggagc

SEQ ID NO: 1758941 - RNA, 18 nt, Human
ggagaaaaucaucaagaa

SEQ ID NO: 1758942 - RNA, 15 nt, Human
ggacuuggaagcucc

SEQ ID NO: 1758943 - RNA, 17 nt, Human
ggacuuggaagcuccgc

SEQ ID NO: 1758944 - RNA, 13 nt, Human
gcuuggucuguuu

SEQ ID NO: 1758945 - RNA, 15 nt, Human
gcuuggucuguuuga

SEQ ID NO: 1758946 - RNA, 20 nt, Human
ggaccggguggaagggaugg

SEQ ID NO: 1758947 - RNA, 23 nt, Human
gcuuaaaggcaguauuuuguguc

SEQ ID NO: 1758948 - RNA, 21 nt, Human
gcuguuggcugggggccucag

SEQ ID NO: 1758949 - RNA, 22 nt, Human
gcuguuggcugggggccucagu

SEQ ID NO: 1758950 - RNA, 15 nt, Human
gcugugcugggagaa

SEQ ID NO: 1758951 - RNA, 18 nt, Human
gcugugcuugaaggcccu

SEQ ID NO: 1758952 - RNA, 19 nt, Human
gcugugcuugaaggcccug

SEQ ID NO: 1758953 - RNA, 20 nt, Human
gcugugcuugaaggcccugc

SEQ ID NO: 1758954 - RNA, 23 nt, Human
gcugugcuugaaggcccugcuga

SEQ ID NO: 1758955 - RNA, 21 nt, Human
gcugugcucuggacaggcaug

SEQ ID NO: 1758956 - RNA, 13 nt, Human
gcugugaacccug

SEQ ID NO: 1758957 - RNA, 19 nt, Human
gcugugaacccuggggccu

SEQ ID NO: 1758958 - RNA, 20 nt, Human
gcugugaacccuggggccug

SEQ ID NO: 1758959 - RNA, 21 nt, Human
gcugugaacccuggggccuga

SEQ ID NO: 1758960 - RNA, 22 nt, Human
gcugugaacccuggggccugac

SEQ ID NO: 1758961 - RNA, 23 nt, Human
gcugugaacccuggggccugacu

SEQ ID NO: 1758962 - RNA, 20 nt, Human
gcuguaucccaugagccuca

SEQ ID NO: 1758963 - RNA, 23 nt, Human
gcuguaucccaugagccucagca

SEQ ID NO: 1758964 - RNA, 17 nt, Human
gcuguauuaagccacuu

SEQ ID NO: 1758965 - RNA, 14 nt, Human
gcuggguuggaggg

SEQ ID NO: 1758966 - RNA, 21 nt, Human
gcuggguuggaggguguccca

SEQ ID NO: 1758967 - RNA, 23 nt, Human
gcuucuuucuuugggaauauuug

SEQ ID NO: 1758968 - RNA, 18 nt, Human
gcuucuuucuuugggaau

SEQ ID NO: 1758969 - RNA, 12 nt, Human
gcuucuuucuuu

SEQ ID NO: 1758970 - RNA, 18 nt, Human
gcuucgggcccuucccac

SEQ ID NO: 1758971 - RNA, 20 nt, Human
gcuucgggcccuucccacag

SEQ ID NO: 1758972 - RNA, 16 nt, Human
gcuucuuguuuccuug

SEQ ID NO: 1758973 - RNA, 23 nt, Human
gcuuccuuguagcgacuaaacua

SEQ ID NO: 1758974 - RNA, 15 nt, Human
gcuucccuccauccc

SEQ ID NO: 1758975 - RNA, 17 nt, Human
gcuucccuccauccccc

SEQ ID NO: 1758976 - RNA, 14 nt, Human
gcuucccugacuca

SEQ ID NO: 1758977 - RNA, 18 nt, Human
gcuucccugacucauucu

SEQ ID NO: 1758978 - RNA, 11 nt, Human
gcuucccugaa

SEQ ID NO: 1758979 - RNA, 17 nt, Human
gcuucccugaaagacug

SEQ ID NO: 1758980 - RNA, 12 nt, Human
gcuggagugcag

SEQ ID NO: 1758981 - RNA, 21 nt, Human
gcuggacucucagucucugag

SEQ ID NO: 1758982 - RNA, 22 nt, Human
gcuggacucucagucucugagc

SEQ ID NO: 1758983 - RNA, 19 nt, Human
gcuggacggguuagacagc

SEQ ID NO: 1758984 - RNA, 14 nt, Human
gcuggagugcagug

SEQ ID NO: 1758985 - RNA, 15 nt, Human
gcuggagugcaguga

SEQ ID NO: 1758986 - RNA, 16 nt, Human
gcugggauuacaggug

SEQ ID NO: 1758987 - RNA, 18 nt, Human
gcugggauuacaggugug

SEQ ID NO: 1758988 - RNA, 19 nt, Human
gcugggauuacagguguga

SEQ ID NO: 1758989 - RNA, 14 nt, Human
gcugcucugagcca

SEQ ID NO: 1758990 - RNA, 17 nt, Human
gcugccugcccacacag

SEQ ID NO: 1758991 - RNA, 13 nt, Human
gcugccugcccgu

SEQ ID NO: 1758992 - RNA, 22 nt, Human
gcugccugcccguaaacacgcc

SEQ ID NO: 1758993 - RNA, 22 nt, Human
gcugccugccgguaaacacgcc

SEQ ID NO: 1758994 - RNA, 14 nt, Human
gcugccugcccaca

SEQ ID NO: 1758995 - RNA, 15 nt, Human
gcugccugcccacac

SEQ ID NO: 1758996 - RNA, 18 nt, Human
gcugccugcccacacagg

SEQ ID NO: 1758997 - RNA, 18 nt, Human
gcugccccaucagugcuc

SEQ ID NO: 1758998 - RNA, 21 nt, Human
gcugccccaucuccccucagc

SEQ ID NO: 1758999 - RNA, 22 nt, Human
gcugccccaucuccccucagcu

SEQ ID NO: 1759000 - RNA, 23 nt, Human
gcugccccaucuccccucagcuc

SEQ ID NO: 1759001 - RNA, 12 nt, Human
gcugagggccug

SEQ ID NO: 1759002 - RNA, 13 nt, Human
gcugagggccugc

SEQ ID NO: 1759003 - RNA, 14 nt, Human
gcugagggccugcu

SEQ ID NO: 1759004 - RNA, 15 nt, Human
gcugagggccugcug

SEQ ID NO: 1759005 - RNA, 16 nt, Human
gcugagggccugcugg

SEQ ID NO: 1759006 - RNA, 17 nt, Human
gcugagggccugcugga

SEQ ID NO: 1759007 - RNA, 18 nt, Human
gcugagggccugcuggag

SEQ ID NO: 1759008 - RNA, 22 nt, Human
gcugagggccugcuggaggccu

SEQ ID NO: 1759009 - RNA, 23 nt, Human
gcugagggccugcuggaggccuc

SEQ ID NO: 1759010 - RNA, 15 nt, Human
gcugaggcuggggga

SEQ ID NO: 1759011 - RNA, 22 nt, Human
gcugaggcugggggagagccgu

SEQ ID NO: 1759012 - RNA, 23 nt, Human
gcugaggcugggggagagccgug

SEQ ID NO: 1759013 - RNA, 14 nt, Human
gcugagggagccug

SEQ ID NO: 1759014 - RNA, 21 nt, Human
gcugccauccagguucagcuu

SEQ ID NO: 1759015 - RNA, 17 nt, Human
gcugccagcucuguauc

SEQ ID NO: 1759016 - RNA, 18 nt, Human
gcugccagcucuguauca

SEQ ID NO: 1759017 - RNA, 23 nt, Human
gcugccauccagguucagcuugu

SEQ ID NO: 1759018 - RNA, 16 nt, Human
gcucggcucagcucgg

SEQ ID NO: 1759019 - RNA, 13 nt, Human
gcucggcucagcu

SEQ ID NO: 1759020 - RNA, 13 nt, Human
gcucgcuguugcu

SEQ ID NO: 1759021 - RNA, 16 nt, Human
gcucgcuguugcugaa

SEQ ID NO: 1759022 - RNA, 14 nt, Human
gcucgcuguugcug

SEQ ID NO: 1759023 - RNA, 21 nt, Human
gcucgcuguugcugaauaggc

SEQ ID NO: 1759024 - RNA, 17 nt, Human
gcugacagacacaggcc

SEQ ID NO: 1759025 - RNA, 23 nt, Human
gcugagcgaggagaugcuccuug

SEQ ID NO: 1759026 - RNA, 16 nt, Human
gcugacagacacaggc

SEQ ID NO: 1759027 - RNA, 14 nt, Human
gcugacagacacag

SEQ ID NO: 1759028 - RNA, 15 nt, Human
gcugacagacacagg

SEQ ID NO: 1759029 - RNA, 19 nt, Human
gcugaauaggcgaucacaa

SEQ ID NO: 1759030 - RNA, 16 nt, Human
gcucuguccugggagu

SEQ ID NO: 1759031 - RNA, 15 nt, Human
gcucuguccugggag

SEQ ID NO: 1759032 - RNA, 15 nt, Human
gcucuguuugugggg

SEQ ID NO: 1759033 - RNA, 18 nt, Human
gcucuguuugugggguga

SEQ ID NO: 1759034 - RNA, 21 nt, Human
gcucuguuuguggggugacgg

SEQ ID NO: 1759035 - RNA, 14 nt, Human
gcucuuacucuuuc

SEQ ID NO: 1759036 - RNA, 14 nt, Human
gcuaggccuggcca

SEQ ID NO: 1759037 - RNA, 15 nt, Human
gcuaggccuggccag

SEQ ID NO: 1759038 - RNA, 14 nt, Human
gccuguucagcucc

SEQ ID NO: 1759039 - RNA, 20 nt, Human
gccuguucagcuccagcuca

SEQ ID NO: 1759040 - RNA, 19 nt, Human
gccuguucagcuccagcuc

SEQ ID NO: 1759041 - RNA, 17 nt, Human
gcucaggacucagaagc

SEQ ID NO: 1759042 - RNA, 18 nt, Human
gcucaggacucagaagcc

SEQ ID NO: 1759043 - RNA, 19 nt, Human
gcucaggacucagaagccu

SEQ ID NO: 1759044 - RNA, 12 nt, Human
gccaggccagag

SEQ ID NO: 1759045 - RNA, 19 nt, Human
gccaggccggcgagcccug

SEQ ID NO: 1759046 - RNA, 20 nt, Human
gccaggccggcgagcccugu

SEQ ID NO: 1759047 - RNA, 23 nt, Human
gccaggccggcgagcccugugga

SEQ ID NO: 1759048 - RNA, 13 nt, Human
gccaggccagagg

SEQ ID NO: 1759049 - RNA, 19 nt, Human
gccauauucuguuggccag

SEQ ID NO: 1759050 - RNA, 20 nt, Human
gccauauucuguuggccagu

SEQ ID NO: 1759051 - RNA, 22 nt, Human
gccauauugcacaugucuuaau

SEQ ID NO: 1759052 - RNA, 21 nt, Human
gccauauugcacaugucuuaa

SEQ ID NO: 1759053 - RNA, 21 nt, Human
gccauguaaauccccacuggg

SEQ ID NO: 1759054 - RNA, 22 nt, Human
gccauguaaauccccacuggga

SEQ ID NO: 1759055 - RNA, 15 nt, Human
gccauguuggccagg

SEQ ID NO: 1759056 - RNA, 16 nt, Human
gccauguuggccaggc

SEQ ID NO: 1759057 - RNA, 17 nt, Human
gccauguuggccaggcu

SEQ ID NO: 1759058 - RNA, 18 nt, Human
gccauguuggccaggcug

SEQ ID NO: 1759059 - RNA, 14 nt, Human
gccauguuggccag

SEQ ID NO: 1759060 - RNA, 22 nt, Human
gccaugucugcagugugccccc

SEQ ID NO: 1759061 - RNA, 23 nt, Human
gccaugucugcagugugcccccc

SEQ ID NO: 1759062 - RNA, 18 nt, Human
gcccaccuuggcucaagu

SEQ ID NO: 1759063 - RNA, 15 nt, Human
gcccacgcuggagug

SEQ ID NO: 1759064 - RNA, 16 nt, Human
gcccacgcuggagugc

SEQ ID NO: 1759065 - RNA, 17 nt, Human
gcccacgcuggagugca

SEQ ID NO: 1759066 - RNA, 19 nt, Human
gccauguuggccaggcugg

SEQ ID NO: 1759067 - RNA, 20 nt, Human
gccauguuggccaggcuggu

SEQ ID NO: 1759068 - RNA, 22 nt, Human
gccauguuggccaggcuggucu

SEQ ID NO: 1759069 - RNA, 24 nt, Human
gccauguuggccaggcuggucuca

SEQ ID NO: 1759070 - RNA, 15 nt, Human
gccacaugggaggcu

SEQ ID NO: 1759071 - RNA, 22 nt, Human
gccaccaagagggacgccuggg

SEQ ID NO: 1759072 - RNA, 14 nt, Human
gccaccaagaggga

SEQ ID NO: 1759073 - RNA, 19 nt, Human
gccaccaagagggacgccu

SEQ ID NO: 1759074 - RNA, 18 nt, Human
gccaccaacuuacaaaaa

SEQ ID NO: 1759075 - RNA, 21 nt, Human
gccacugcacuauagccuagg

SEQ ID NO: 1759076 - RNA, 13 nt, Human
gccacccugggga

SEQ ID NO: 1759077 - RNA, 19 nt, Human
gccacccuggggagaaagu

SEQ ID NO: 1759078 - RNA, 23 nt, Human
gccacugcaccgggccacagaga

SEQ ID NO: 1759079 - RNA, 18 nt, Human
gccaccccuaaacuccag

SEQ ID NO: 1759080 - RNA, 20 nt, Human
gccaccccuaaacuccaggg

SEQ ID NO: 1759081 - RNA, 18 nt, Human
gccacuuaaaauguucac

SEQ ID NO: 1759082 - RNA, 13 nt, Human
gccacuuggagug

SEQ ID NO: 1759083 - RNA, 17 nt, Human
gccugggacuuccaugc

SEQ ID NO: 1759084 - RNA, 21 nt, Human
gccugggacuuccaugccuua

SEQ ID NO: 1759085 - RNA, 21 nt, Human
gccugcgccaccgcccagaga

SEQ ID NO: 1759086 - RNA, 13 nt, Human
gccuccugugugu

SEQ ID NO: 1759087 - RNA, 19 nt, Human
gccuccuggcccaggugag

SEQ ID NO: 1759088 - RNA, 15 nt, Human
gccuccuggcccagg

SEQ ID NO: 1759089 - RNA, 14 nt, Human
gccucuucugggag

SEQ ID NO: 1759090 - RNA, 15 nt, Human
gccucuucugggagg

SEQ ID NO: 1759091 - RNA, 18 nt, Human
gccucuucugggagggca

SEQ ID NO: 1759092 - RNA, 16 nt, Human
gccucuucugucccug

SEQ ID NO: 1759093 - RNA, 18 nt, Human
gccugcccaggccccugc

SEQ ID NO: 1759094 - RNA, 19 nt, Human
gccugcccaggccccugcc

SEQ ID NO: 1759095 - RNA, 20 nt, Human
gccugcccaggccccugcca

SEQ ID NO: 1759096 - RNA, 21 nt, Human
gccugccgguaaacacgccug

SEQ ID NO: 1759097 - RNA, 14 nt, Human
gccugccgggcuga

SEQ ID NO: 1759098 - RNA, 17 nt, Human
gccugccgggcugaggg

SEQ ID NO: 1759099 - RNA, 20 nt, Human
gccugccgggcugagggccu

SEQ ID NO: 1759100 - RNA, 16 nt, Human
gccugccgguaaacac

SEQ ID NO: 1759101 - RNA, 18 nt, Human
gcccuaaacccuguuccu

SEQ ID NO: 1759102 - RNA, 15 nt, Human
gccccugcccggcug

SEQ ID NO: 1759103 - RNA, 13 nt, Human
gccccugcccggc

SEQ ID NO: 1759104 - RNA, 14 nt, Human
gccccugcccggcu

SEQ ID NO: 1759105 - RNA, 22 nt, Human
gcccauguuaaguccucccuga

SEQ ID NO: 1759106 - RNA, 23 nt, Human
gcccauguuaaguccucccugac

SEQ ID NO: 1759107 - RNA, 15 nt, Human
gccauguugccccuu

SEQ ID NO: 1759108 - RNA, 17 nt, Human
gcccacucugcucgccu

SEQ ID NO: 1759109 - RNA, 19 nt, Human
gcccugcugagucaucugu

SEQ ID NO: 1759110 - RNA, 13 nt, Human
gcccuguguacuu

SEQ ID NO: 1759111 - RNA, 20 nt, Human
gcccuguugaauuuuguucu

SEQ ID NO: 1759112 - RNA, 17 nt, Human
gccgccaguacuuguca

SEQ ID NO: 1759113 - RNA, 20 nt, Human
gccgccaguacuugucauau

SEQ ID NO: 1759114 - RNA, 15 nt, Human
gccgcugagcgagga

SEQ ID NO: 1759115 - RNA, 17 nt, Human
gccgcugagcgaggaga

SEQ ID NO: 1759116 - RNA, 18 nt, Human
gccggcagccccagccug

SEQ ID NO: 1759117 - RNA, 19 nt, Human
gccggcagccccagccugc

SEQ ID NO: 1759118 - RNA, 20 nt, Human
gccggcagccccagccugcu

SEQ ID NO: 1759119 - RNA, 21 nt, Human
gccggcagccccagccugcua

SEQ ID NO: 1759120 - RNA, 20 nt, Human
gcacaccgggcacucagaag

SEQ ID NO: 1759121 - RNA, 14 nt, Human
gcacaccgggcacu

SEQ ID NO: 1759122 - RNA, 17 nt, Human
gcacacccacucagcuc

SEQ ID NO: 1759123 - RNA, 18 nt, Human
gcacacccacucagcucc

SEQ ID NO: 1759124 - RNA, 23 nt, Human
gcaccgggccacagagaaaguac

SEQ ID NO: 1759125 - RNA, 14 nt, Human
gcaccgggccacag

SEQ ID NO: 1759126 - RNA, 13 nt, Human
gcacucagaagac

SEQ ID NO: 1759127 - RNA, 16 nt, Human
gcacucagaagacacu

SEQ ID NO: 1759128 - RNA, 17 nt, Human
gcacucagaagacacug

SEQ ID NO: 1759129 - RNA, 18 nt, Human
gauucuccugccucagcc

SEQ ID NO: 1759130 - RNA, 15 nt, Human
gauucuccugccuca

SEQ ID NO: 1759131 - RNA, 17 nt, Human
gauucuccugccucagc

SEQ ID NO: 1759132 - RNA, 12 nt, Human
gauucuucugcu

SEQ ID NO: 1759133 - RNA, 16 nt, Human
gauucuucaaaagcau

SEQ ID NO: 1759134 - RNA, 13 nt, Human
gauuauugaaaua

SEQ ID NO: 1759135 - RNA, 13 nt, Human
gauuauucagugu

SEQ ID NO: 1759136 - RNA, 14 nt, Human
gauuauucaguguc

SEQ ID NO: 1759137 - RNA, 15 nt, Human
gauuauucaguguca

SEQ ID NO: 1759138 - RNA, 14 nt, Human
gaugaucuuugcag

SEQ ID NO: 1759139 - RNA, 16 nt, Human
gaguuuaaauuguaau

SEQ ID NO: 1759140 - RNA, 13 nt, Human
gaguuuaaaaauc

SEQ ID NO: 1759141 - RNA, 14 nt, Human
gaguuuaaaaauca

SEQ ID NO: 1759142 - RNA, 13 nt, Human
gaguuuaaagcaa

SEQ ID NO: 1759143 - RNA, 23 nt, Human
gaggugaccccagguuucuaugu

SEQ ID NO: 1759144 - RNA, 23 nt, Human
gaggugaacaagcaaacccagac

SEQ ID NO: 1759145 - RNA, 17 nt, Human
gagucaccaagcccagu

SEQ ID NO: 1759146 - RNA, 16 nt, Human
gagucaccaagcccag

SEQ ID NO: 1759147 - RNA, 14 nt, Human
gagucagcucucug

SEQ ID NO: 1759148 - RNA, 15 nt, Human
gagucagcucucugc

SEQ ID NO: 1759149 - RNA, 17 nt, Human
gagucagcucucugccc

SEQ ID NO: 1759150 - RNA, 18 nt, Human
gagucagcucucugcccu

SEQ ID NO: 1759151 - RNA, 12 nt, Human
gagucccaccuu

SEQ ID NO: 1759152 - RNA, 13 nt, Human
gagucccaccuug

SEQ ID NO: 1759153 - RNA, 18 nt, Human
gagugacagaggcagccc

SEQ ID NO: 1759154 - RNA, 20 nt, Human
gaguggaggugggcugggcc

SEQ ID NO: 1759155 - RNA, 20 nt, Human
gagugacagaggcagcccca

SEQ ID NO: 1759156 - RNA, 15 nt, Human
gagucacuacaacug

SEQ ID NO: 1759157 - RNA, 19 nt, Human
gagugacaguggauugcau

SEQ ID NO: 1759158 - RNA, 13 nt, Human
gagugacucucca

SEQ ID NO: 1759159 - RNA, 14 nt, Human
gaggcagggucuca

SEQ ID NO: 1759160 - RNA, 15 nt, Human
gaggcagggucucac

SEQ ID NO: 1759161 - RNA, 18 nt, Human
gaggcagggucucacucu

SEQ ID NO: 1759162 - RNA, 23 nt, Human
gagggcugcgacgcuugcucugu

SEQ ID NO: 1759163 - RNA, 17 nt, Human
gaggggccccccugccc

SEQ ID NO: 1759164 - RNA, 12 nt, Human
gaacccuuggcu

SEQ ID NO: 1759165 - RNA, 16 nt, Human
gaacccuuggcuugcc

SEQ ID NO: 1759166 - RNA, 14 nt, Human
gaacccugccaugg

SEQ ID NO: 1759167 - RNA, 16 nt, Human
gaacccugccauggaa

SEQ ID NO: 1759168 - RNA, 22 nt, Human
gaacccugccauggaacuguuu

SEQ ID NO: 1759169 - RNA, 16 nt, Human
gaacccuggggccuga

SEQ ID NO: 1759170 - RNA, 17 nt, Human
gaacccuggggccugac

SEQ ID NO: 1759171 - RNA, 20 nt, Human
gaacccuggggccugacugc

SEQ ID NO: 1759172 - RNA, 21 nt, Human
gaacccuggggccugacugcu

SEQ ID NO: 1759173 - RNA, 17 nt, Human
gaacccuuggcuugccc

SEQ ID NO: 1759174 - RNA, 18 nt, Human
gaacccuuggcuugccca

SEQ ID NO: 1759175 - RNA, 20 nt, Human
gaacccuuggcuugcccacg

SEQ ID NO: 1759176 - RNA, 21 nt, Human
gaacccuuggcuugcccacgu

SEQ ID NO: 1759177 - RNA, 11 nt, Human
gaacuggcugc

SEQ ID NO: 1759178 - RNA, 12 nt, Human
gaacuggcugca

SEQ ID NO: 1759179 - RNA, 22 nt, Human
gaacugcuagucaagugcgucc

SEQ ID NO: 1759180 - RNA, 20 nt, Human
gaacuggacccuguugcuaa

SEQ ID NO: 1759181 - RNA, 18 nt, Human
gaacuggacccuguugcu

SEQ ID NO: 1759182 - RNA, 23 nt, Human
gaacuggacccuguugcuaagcc

SEQ ID NO: 1759183 - RNA, 22 nt, Human
gaacuggacccuguugcuaagc

SEQ ID NO: 1759184 - RNA, 19 nt, Human
gaacugcguuaugaagagc

SEQ ID NO: 1759185 - RNA, 19 nt, Human
gaagcuccgcuuucuaccc

SEQ ID NO: 1759186 - RNA, 20 nt, Human
gaagcucuuacucuuuccua

SEQ ID NO: 1759187 - RNA, 18 nt, Human
gaagcugacgaacuucca

SEQ ID NO: 1759188 - RNA, 19 nt, Human
gaagcugacgaacuuccau

SEQ ID NO: 1759189 - RNA, 22 nt, Human
gaagcuccgcuuucuacccagc

SEQ ID NO: 1759190 - RNA, 19 nt, Human
gaagcucucgggcuaggaa

SEQ ID NO: 1759191 - RNA, 13 nt, Human
gaagggcugcaug

SEQ ID NO: 1759192 - RNA, 14 nt, Human
gaagggcugcauga

SEQ ID NO: 1759193 - RNA, 18 nt, Human
gaagggcugcaugauguu

SEQ ID NO: 1759194 - RNA, 22 nt, Human
gaagggcugcaugauguuugcc

SEQ ID NO: 1759195 - RNA, 16 nt, Human
gaaggcuucucucugu

SEQ ID NO: 1759196 - RNA, 16 nt, Human
gaaggcccugcugagu

SEQ ID NO: 1759197 - RNA, 18 nt, Human
gaaggcccugcugaguca

SEQ ID NO: 1759198 - RNA, 14 nt, Human
gaaggcuggcauga

SEQ ID NO: 1759199 - RNA, 18 nt, Human
gaaggcuggcaugaucca

SEQ ID NO: 1759200 - RNA, 13 nt, Human
gaauauuugaauc

SEQ ID NO: 1759201 - RNA, 12 nt, Human
gaauauuugaau

SEQ ID NO: 1759202 - RNA, 11 nt, Human
gaauauuugaa

SEQ ID NO: 1759203 - RNA, 10 nt, Human
gaauauuuga

SEQ ID NO: 1759204 - RNA, 13 nt, Human
gaauauuguccau

SEQ ID NO: 1759205 - RNA, 12 nt, Human
gaauauaaugga

SEQ ID NO: 1759206 - RNA, 14 nt, Human
gaaguuauuuucca

SEQ ID NO: 1759207 - RNA, 15 nt, Human
gaaguuauuuuccag

SEQ ID NO: 1759208 - RNA, 22 nt, Human
gaaguuacacagaaaugcugcu

SEQ ID NO: 1759209 - RNA, 23 nt, Human
gaaguuacacagaaaugcugcug

SEQ ID NO: 1759210 - RNA, 19 nt, Human
gacauuguuggccaaagcc

SEQ ID NO: 1759211 - RNA, 13 nt, Human
gacauuucucuaa

SEQ ID NO: 1759212 - RNA, 16 nt, Human
gacauuucucuaagag

SEQ ID NO: 1759213 - RNA, 21 nt, Human
gacagugcugcagcucccugg

SEQ ID NO: 1759214 - RNA, 22 nt, Human
gacagugcugcagcucccuggc

SEQ ID NO: 1759215 - RNA, 14 nt, Human
gacauugcggacag

SEQ ID NO: 1759216 - RNA, 15 nt, Human
gacauugcggacagc

SEQ ID NO: 1759217 - RNA, 20 nt, Human
gacauucucgcuucccugaa

SEQ ID NO: 1759218 - RNA, 21 nt, Human
gacauuccuucucccaucucu

SEQ ID NO: 1759219 - RNA, 14 nt, Human
gacacagcucuucu

SEQ ID NO: 1759220 - RNA, 16 nt, Human
gacacagcucuucucc

SEQ ID NO: 1759221 - RNA, 13 nt, Human
gacacagcucuuc

SEQ ID NO: 1759222 - RNA, 17 nt, Human
gacacagcucuucucca

SEQ ID NO: 1759223 - RNA, 22 nt, Human
gacacagcucuucuccaggcug

SEQ ID NO: 1759224 - RNA, 23 nt, Human
gacacagcucuucuccaggcugu

SEQ ID NO: 1759225 - RNA, 12 nt, Human
gacacaggcccg

SEQ ID NO: 1759226 - RNA, 17 nt, Human
gacucagaaagccaaca

SEQ ID NO: 1759227 - RNA, 13 nt, Human
gacucagaagccu

SEQ ID NO: 1759228 - RNA, 15 nt, Human
gacucagaagccucu

SEQ ID NO: 1759229 - RNA, 16 nt, Human
gacucagaagccucug

SEQ ID NO: 1759230 - RNA, 17 nt, Human
gacucagaagccucugg

SEQ ID NO: 1759231 - RNA, 19 nt, Human
gacucugucucaaaaaaac

SEQ ID NO: 1759232 - RNA, 21 nt, Human
gacuguugggguggguauaaa

SEQ ID NO: 1759233 - RNA, 19 nt, Human
gacgccugggggugccagg

SEQ ID NO: 1759234 - RNA, 21 nt, Human
gacgccugggggugccaggac

SEQ ID NO: 1759235 - RNA, 12 nt, Human
gacgccuggggg

SEQ ID NO: 1759236 - RNA, 24 nt, Human
gaccaugcgacacugggaggccag

SEQ ID NO: 1759237 - RNA, 19 nt, Human
cuuccauggcccucauuaa

SEQ ID NO: 1759238 - RNA, 13 nt, Human
cuuccaugccuua

SEQ ID NO: 1759239 - RNA, 16 nt, Human
cuuccauggcccucau

SEQ ID NO: 1759240 - RNA, 18 nt, Human
cuucaguggcagcugcuu

SEQ ID NO: 1759241 - RNA, 16 nt, Human
cuucaucuaauaugau

SEQ ID NO: 1759242 - RNA, 10 nt, Human
cuucauggau

SEQ ID NO: 1759243 - RNA, 13 nt, Human
cuucauggaucag

SEQ ID NO: 1759244 - RNA, 18 nt, Human
cuuauugcccacgcugga

SEQ ID NO: 1759245 - RNA, 21 nt, Human
cuucaccugauucaacuaaaa

SEQ ID NO: 1759246 - RNA, 18 nt, Human
cuucaccugauucaacua

SEQ ID NO: 1759247 - RNA, 20 nt, Human
cuucaccugauucaacuaaa

SEQ ID NO: 1759248 - RNA, 12 nt, Human
cuuauugcccac

SEQ ID NO: 1759249 - RNA, 13 nt, Human
cuuauugcccacg

SEQ ID NO: 1759250 - RNA, 18 nt, Human
cuuagcagggaaacagcu

SEQ ID NO: 1759251 - RNA, 21 nt, Human
cuuagcagggaaacagcuaau

SEQ ID NO: 1759252 - RNA, 18 nt, Human
cuguugggguggguauaa

SEQ ID NO: 1759253 - RNA, 17 nt, Human
cuguugggguggguaua

SEQ ID NO: 1759254 - RNA, 20 nt, Human
cuguugggguggguauaaaa

SEQ ID NO: 1759255 - RNA, 24 nt, Human
cuuaaaauguucacuuuugacaaa

SEQ ID NO: 1759256 - RNA, 19 nt, Human
cuuaaacaaaaauuaaaau

SEQ ID NO: 1759257 - RNA, 13 nt, Human
cuuaaacaaaaau

SEQ ID NO: 1759258 - RNA, 14 nt, Human
cuuagauguucuaa

SEQ ID NO: 1759259 - RNA, 18 nt, Human
cuuagauguucuaagucu

SEQ ID NO: 1759260 - RNA, 21 nt, Human
cuuagcacuaccacuccugcc

SEQ ID NO: 1759261 - RNA, 13 nt, Human
cuguucagcucca

SEQ ID NO: 1759262 - RNA, 14 nt, Human
cuguucagcuccag

SEQ ID NO: 1759263 - RNA, 20 nt, Human
cugugucuugcaauggcagc

SEQ ID NO: 1759264 - RNA, 16 nt, Human
cugugucuugcaaugg

SEQ ID NO: 1759265 - RNA, 19 nt, Human
cugugucuugcaauggcag

SEQ ID NO: 1759266 - RNA, 15 nt, Human
cugugaccaaugucu

SEQ ID NO: 1759267 - RNA, 16 nt, Human
cugugaccaaugucuu

SEQ ID NO: 1759268 - RNA, 17 nt, Human
cugugaccaaugucuug

SEQ ID NO: 1759269 - RNA, 12 nt, Human
cugugcucagga

SEQ ID NO: 1759270 - RNA, 15 nt, Human
cugugcucaggacuc

SEQ ID NO: 1759271 - RNA, 16 nt, Human
cugugcucaggacuca

SEQ ID NO: 1759272 - RNA, 17 nt, Human
cugugcucaggacucag

SEQ ID NO: 1759273 - RNA, 21 nt, Human
cugugucagguggggcagcuu

SEQ ID NO: 1759274 - RNA, 16 nt, Human
cuguguacuucccggg

SEQ ID NO: 1759275 - RNA, 19 nt, Human
cugugucagguggggcagc

SEQ ID NO: 1759276 - RNA, 14 nt, Human
cugugucuugcaau

SEQ ID NO: 1759277 - RNA, 16 nt, Human
cuugugaggaaaguca

SEQ ID NO: 1759278 - RNA, 13 nt, Human
cuugugaggaaag

SEQ ID NO: 1759279 - RNA, 23 nt, Human
cuugugaggaaagucauuggcuu

SEQ ID NO: 1759280 - RNA, 19 nt, Human
cuugugaggaaagucauug

SEQ ID NO: 1759281 - RNA, 17 nt, Human
cuugugaggaaagucau

SEQ ID NO: 1759282 - RNA, 16 nt, Human
cuuguggacacagcuc

SEQ ID NO: 1759283 - RNA, 14 nt, Human
cuuguggacacagc

SEQ ID NO: 1759284 - RNA, 15 nt, Human
cuuguggacacagcu

SEQ ID NO: 1759285 - RNA, 13 nt, Human
cuuguggacacag

SEQ ID NO: 1759286 - RNA, 13 nt, Human
cuuuacaaauauu

SEQ ID NO: 1759287 - RNA, 15 nt, Human
cuuuucaaaacauuu

SEQ ID NO: 1759288 - RNA, 13 nt, Human
cuuucgaggccug

SEQ ID NO: 1759289 - RNA, 14 nt, Human
cuuucgaggccuga

SEQ ID NO: 1759290 - RNA, 20 nt, Human
cuuucgaggccugaagccag

SEQ ID NO: 1759291 - RNA, 21 nt, Human
cuuuccuuuucgccuuuccuc

SEQ ID NO: 1759292 - RNA, 17 nt, Human
cuuuccuuuuuuaaaaa

SEQ ID NO: 1759293 - RNA, 18 nt, Human
cuuuccuuuuuuaaaaau

SEQ ID NO: 1759294 - RNA, 21 nt, Human
cuuugagugcaguccugauca

SEQ ID NO: 1759295 - RNA, 20 nt, Human
cuuugauuaaagacuccagu

SEQ ID NO: 1759296 - RNA, 15 nt, Human
cuucugagcacagau

SEQ ID NO: 1759297 - RNA, 19 nt, Human
cuugaauacucugcccucu

SEQ ID NO: 1759298 - RNA, 13 nt, Human
cuugcucugcuga

SEQ ID NO: 1759299 - RNA, 14 nt, Human
cuuggcauuccgca

SEQ ID NO: 1759300 - RNA, 22 nt, Human
cuuggcauuccgcaucccuacc

SEQ ID NO: 1759301 - RNA, 12 nt, Human
cuugcucugcug

SEQ ID NO: 1759302 - RNA, 20 nt, Human
cuugccucuuuuaccugcug

SEQ ID NO: 1759303 - RNA, 21 nt, Human
cuugccucuuuuaccugcugc

SEQ ID NO: 1759304 - RNA, 22 nt, Human
cuugccucuuuuaccugcugcu

SEQ ID NO: 1759305 - RNA, 20 nt, Human
cuugacacauaguuuuucag

SEQ ID NO: 1759306 - RNA, 23 nt, Human
cuugacacauaguuuuucagucu

SEQ ID NO: 1759307 - RNA, 12 nt, Human
cuugacagggca

SEQ ID NO: 1759308 - RNA, 20 nt, Human
cuggugccccccaccccugg

SEQ ID NO: 1759309 - RNA, 21 nt, Human
cuggugccccccaccccugga

SEQ ID NO: 1759310 - RNA, 17 nt, Human
cugggcccacaaaggca

SEQ ID NO: 1759311 - RNA, 13 nt, Human
cuggggagaaagu

SEQ ID NO: 1759312 - RNA, 14 nt, Human
cuggggagaaagua

SEQ ID NO: 1759313 - RNA, 12 nt, Human
cuggggccugac

SEQ ID NO: 1759314 - RNA, 15 nt, Human
cuggggccugacugc

SEQ ID NO: 1759315 - RNA, 16 nt, Human
cuggggccugacugcu

SEQ ID NO: 1759316 - RNA, 18 nt, Human
cuggggccugacugcuca

SEQ ID NO: 1759317 - RNA, 19 nt, Human
cuggggccugacugcucag

SEQ ID NO: 1759318 - RNA, 20 nt, Human
cuggggccugacugcucaga

SEQ ID NO: 1759319 - RNA, 12 nt, Human
cugggagaaaau

SEQ ID NO: 1759320 - RNA, 15 nt, Human
cugggagaaaaucau

SEQ ID NO: 1759321 - RNA, 16 nt, Human
cugggagaaaaucauc

SEQ ID NO: 1759322 - RNA, 17 nt, Human
cugggagaaaaucauca

SEQ ID NO: 1759323 - RNA, 18 nt, Human
cugggagaaaaucaucaa

SEQ ID NO: 1759324 - RNA, 19 nt, Human
cugggagaaaaucaucaag

SEQ ID NO: 1759325 - RNA, 21 nt, Human
cugggagaaaaucaucaagaa

SEQ ID NO: 1759326 - RNA, 13 nt, Human
cugggacuacagg

SEQ ID NO: 1759327 - RNA, 15 nt, Human
cugggacuacaggca

SEQ ID NO: 1759328 - RNA, 16 nt, Human
cugggacuacaggcac

SEQ ID NO: 1759329 - RNA, 20 nt, Human
cuggaugauggucuucagcc

SEQ ID NO: 1759330 - RNA, 15 nt, Human
cuggaucuguuccuu

SEQ ID NO: 1759331 - RNA, 15 nt, Human
cugcugugaacccug

SEQ ID NO: 1759332 - RNA, 17 nt, Human
cugcugugaacccuggg

SEQ ID NO: 1759333 - RNA, 22 nt, Human
cugcugugaacccuggggccug

SEQ ID NO: 1759334 - RNA, 23 nt, Human
cugcugugaacccuggggccuga

SEQ ID NO: 1759335 - RNA, 12 nt, Human
cugcugucuugu

SEQ ID NO: 1759336 - RNA, 16 nt, Human
cugcucacauaucugu

SEQ ID NO: 1759337 - RNA, 19 nt, Human
cugcucacauaucugucau

SEQ ID NO: 1759338 - RNA, 13 nt, Human
cugcugacagugu

SEQ ID NO: 1759339 - RNA, 15 nt, Human
cugcugacaguguug

SEQ ID NO: 1759340 - RNA, 12 nt, Human
cugcugacagug

SEQ ID NO: 1759341 - RNA, 20 nt, Human
cugccccuaaucucuguagg

SEQ ID NO: 1759342 - RNA, 13 nt, Human
cugcccuguguac

SEQ ID NO: 1759343 - RNA, 22 nt, Human
cugcccuguguacuucccgggc

SEQ ID NO: 1759344 - RNA, 16 nt, Human
cugccauauucuguug

SEQ ID NO: 1759345 - RNA, 16 nt, Human
cugccauccagguuca

SEQ ID NO: 1759346 - RNA, 18 nt, Human
cugccauccagguucagc

SEQ ID NO: 1759347 - RNA, 19 nt, Human
cugccauccagguucagcu

SEQ ID NO: 1759348 - RNA, 22 nt, Human
cugccccaucuccccucagcuc

SEQ ID NO: 1759349 - RNA, 19 nt, Human
cugccccccccccccaucu

SEQ ID NO: 1759350 - RNA, 11 nt, Human
cugccagggca

SEQ ID NO: 1759351 - RNA, 12 nt, Human
cugccagggcag

SEQ ID NO: 1759352 - RNA, 13 nt, Human
cugccagggcagg

SEQ ID NO: 1759353 - RNA, 15 nt, Human
cugccagggcagggc

SEQ ID NO: 1759354 - RNA, 16 nt, Human
cugccagggcagggcc

SEQ ID NO: 1759355 - RNA, 14 nt, Human
cugcauuguaaaua

SEQ ID NO: 1759356 - RNA, 22 nt, Human
cugcaggaccugccuguagccc

SEQ ID NO: 1759357 - RNA, 14 nt, Human
cugcaggaccugcc

SEQ ID NO: 1759358 - RNA, 15 nt, Human
cugcaggaccugccu

SEQ ID NO: 1759359 - RNA, 16 nt, Human
cugcaggaccugccug

SEQ ID NO: 1759360 - RNA, 17 nt, Human
cugcaggaccugccugu

SEQ ID NO: 1759361 - RNA, 18 nt, Human
cugcaggaccugccugua

SEQ ID NO: 1759362 - RNA, 21 nt, Human
cugcaggaccugccuguagcc

SEQ ID NO: 1759363 - RNA, 24 nt, Human
cugcagccucaaccuccugggcua

SEQ ID NO: 1759364 - RNA, 23 nt, Human
cugcagccucaaccuccugggcu

SEQ ID NO: 1759365 - RNA, 15 nt, Human
cugcagcucccuggc

SEQ ID NO: 1759366 - RNA, 16 nt, Human
cugcagcucccuggcu

SEQ ID NO: 1759367 - RNA, 17 nt, Human
cugcagcucccuggcuu

SEQ ID NO: 1759368 - RNA, 18 nt, Human
cugcagcucccuggcuuc

SEQ ID NO: 1759369 - RNA, 19 nt, Human
cugcagcucccuggcuucu

SEQ ID NO: 1759370 - RNA, 23 nt, Human
cugcagcucccuggcuucugugg

SEQ ID NO: 1759371 - RNA, 16 nt, Human
cugcacuauagccuag

SEQ ID NO: 1759372 - RNA, 17 nt, Human
cugcacuauagccuagg

SEQ ID NO: 1759373 - RNA, 18 nt, Human
cugcacuauagccuaggu

SEQ ID NO: 1759374 - RNA, 20 nt, Human
cugcacuauagccuagguga

SEQ ID NO: 1759375 - RNA, 22 nt, Human
cugcacuauagccuaggugaca

SEQ ID NO: 1759376 - RNA, 23 nt, Human
cugcacuauagccuaggugacag

SEQ ID NO: 1759377 - RNA, 20 nt, Human
cugcaaccuccgccucuugg

SEQ ID NO: 1759378 - RNA, 12 nt, Human
cugcaacaaaau

SEQ ID NO: 1759379 - RNA, 15 nt, Human
cugcaacaaaaugua

SEQ ID NO: 1759380 - RNA, 21 nt, Human
cugcaacaaaauguagaauau

SEQ ID NO: 1759381 - RNA, 20 nt, Human
cugcaaaguguuuuguacca

SEQ ID NO: 1759382 - RNA, 23 nt, Human
cugcaaaguguuuuguaccagug

SEQ ID NO: 1759383 - RNA, 22 nt, Human
cugcaaccuccgccucuugggu

SEQ ID NO: 1759384 - RNA, 23 nt, Human
cugcaccgggccacagagaaagu

SEQ ID NO: 1759385 - RNA, 18 nt, Human
cugaugggcaacccccag

SEQ ID NO: 1759386 - RNA, 21 nt, Human
cugaugggcaacccccagccu

SEQ ID NO: 1759387 - RNA, 24 nt, Human
cugaugggcaacccccagccugcu

SEQ ID NO: 1759388 - RNA, 22 nt, Human
cugaugggcaacccccagccug

SEQ ID NO: 1759389 - RNA, 23 nt, Human
cugaugggcaacccccagccugc

SEQ ID NO: 1759390 - RNA, 21 nt, Human
cugcaaaggguaucaggugcu

SEQ ID NO: 1759391 - RNA, 22 nt, Human
cugcaaaggguaucaggugcug

SEQ ID NO: 1759392 - RNA, 14 nt, Human
aaauucacuuucau

SEQ ID NO: 1759393 - RNA, 15 nt, Human
aaauucacuuucauu

SEQ ID NO: 1759394 - RNA, 21 nt, Human
guauuuaauuagugcuaagug

SEQ ID NO: 1759395 - RNA, 20 nt, Human
guauuuaauuagugcuaagu

SEQ ID NO: 1759396 - RNA, 19 nt, Human
guauuuaauuagugcuaag

SEQ ID NO: 1759397 - RNA, 18 nt, Human
guauuuaauuagugcuaa

SEQ ID NO: 1759398 - RNA, 12 nt, Human
guauuuaauuag

SEQ ID NO: 1759399 - RNA, 17 nt, Human
guauuuuugcugcuucu

SEQ ID NO: 1759400 - RNA, 16 nt, Human
gucacacacuuuggcu

SEQ ID NO: 1759401 - RNA, 20 nt, Human
gucacacaguauuacuucug

SEQ ID NO: 1759402 - RNA, 14 nt, Human
gucaaccugggcaa

SEQ ID NO: 1759403 - RNA, 19 nt, Human
gucaaccugggcaaagccu

SEQ ID NO: 1759404 - RNA, 15 nt, Human
gucaacccuucugga

SEQ ID NO: 1759405 - RNA, 17 nt, Human
gucaacccuucuggaaa

SEQ ID NO: 1759406 - RNA, 19 nt, Human
gucaacccuucuggaaacu

SEQ ID NO: 1759407 - RNA, 18 nt, Human
aaauuucagcagcugcag

SEQ ID NO: 1759408 - RNA, 17 nt, Human
aaauuucagcagcugca

SEQ ID NO: 1759409 - RNA, 14 nt, Human
guaucaggacccag

SEQ ID NO: 1759410 - RNA, 18 nt, Human
guaucaggacccagagga

SEQ ID NO: 1759411 - RNA, 21 nt, Human
guaucaggacccagaggaagg

SEQ ID NO: 1759412 - RNA, 22 nt, Human
guaucaggacccagaggaaggg

SEQ ID NO: 1759413 - RNA, 13 nt, Human
guaugguggcugg

SEQ ID NO: 1759414 - RNA, 11 nt, Human
guaugucugcc

SEQ ID NO: 1759415 - RNA, 13 nt, Human
guaugucugccau

SEQ ID NO: 1759416 - RNA, 19 nt, Human
guaugucugccauguugcc

SEQ ID NO: 1759417 - RNA, 17 nt, Human
guauucuguucuggagg

SEQ ID NO: 1759418 - RNA, 17 nt, Human
guauugagauauuacac

SEQ ID NO: 1759419 - RNA, 11 nt, Human
guauucucuga

SEQ ID NO: 1759420 - RNA, 12 nt, Human
guauucucugag

SEQ ID NO: 1759421 - RNA, 13 nt, Human
guauucucugagc

SEQ ID NO: 1759422 - RNA, 19 nt, Human
guauucucugagcugugca

SEQ ID NO: 1759423 - RNA, 23 nt, Human
guauaaaagauggggucuguaaa

SEQ ID NO: 1759424 - RNA, 13 nt, Human
guauaaaagaugg

SEQ ID NO: 1759425 - RNA, 23 nt, Human
guauaaaaucagccaauuauguu

SEQ ID NO: 1759426 - RNA, 17 nt, Human
guauaaaaucagccaau

SEQ ID NO: 1759427 - RNA, 15 nt, Human
guauaaaaucagcca

SEQ ID NO: 1759428 - RNA, 12 nt, Human
guauauucacuu

SEQ ID NO: 1759429 - RNA, 15 nt, Human
guauauucauauauu

SEQ ID NO: 1759430 - RNA, 12 nt, Human
guauaaaagaug

SEQ ID NO: 1759431 - RNA, 16 nt, Human
aaauguagaauauuca

SEQ ID NO: 1759432 - RNA, 18 nt, Human
aaauguagaauauucaga

SEQ ID NO: 1759433 - RNA, 20 nt, Human
aaauguagaauauucagaca

SEQ ID NO: 1759434 - RNA, 15 nt, Human
aaaugaaaaugucuu

SEQ ID NO: 1759435 - RNA, 16 nt, Human
aaaugaaaaugucuug

SEQ ID NO: 1759436 - RNA, 17 nt, Human
aaaugaaaaugucuugu

SEQ ID NO: 1759437 - RNA, 17 nt, Human
aaaugaaaaucgugaca

SEQ ID NO: 1759438 - RNA, 23 nt, Human
aaauccuaugugauuuuaacucu

SEQ ID NO: 1759439 - RNA, 15 nt, Human
aaauccgaaccuccu

SEQ ID NO: 1759440 - RNA, 19 nt, Human
aaauccgaaccuccucugu

SEQ ID NO: 1759441 - RNA, 20 nt, Human
aaauccgaaccuccucugug

SEQ ID NO: 1759442 - RNA, 21 nt, Human
aaauccgaaccuccucuguga

SEQ ID NO: 1759443 - RNA, 14 nt, Human
aaauccuaugugau

SEQ ID NO: 1759444 - RNA, 16 nt, Human
aaauccuaugugauuu

SEQ ID NO: 1759445 - RNA, 21 nt, Human
aaauccuaugugauuuuaacu

SEQ ID NO: 1759446 - RNA, 13 nt, Human
aaaggagagcauc

SEQ ID NO: 1759447 - RNA, 15 nt, Human
aaaggagagcaucgg

SEQ ID NO: 1759448 - RNA, 14 nt, Human
guagcugaaaugca

SEQ ID NO: 1759449 - RNA, 12 nt, Human
guagcugggacu

SEQ ID NO: 1759450 - RNA, 18 nt, Human
guagcugggacuacaggc

SEQ ID NO: 1759451 - RNA, 19 nt, Human
guagcugggacuacaggca

SEQ ID NO: 1759452 - RNA, 21 nt, Human
guagcugggacuacaggcacc

SEQ ID NO: 1759453 - RNA, 22 nt, Human
guaggaaccgugguaugucugc

SEQ ID NO: 1759454 - RNA, 18 nt, Human
guaggacccaagcagaga

SEQ ID NO: 1759455 - RNA, 15 nt, Human
guaggaaguaggaag

SEQ ID NO: 1759456 - RNA, 18 nt, Human
guaggagcccagcucuga

SEQ ID NO: 1759457 - RNA, 17 nt, Human
aaaugaggucagagccu

SEQ ID NO: 1759458 - RNA, 19 nt, Human
aaaugaggucagagccugc

SEQ ID NO: 1759459 - RNA, 14 nt, Human
aaaugaaggucuuu

SEQ ID NO: 1759460 - RNA, 14 nt, Human
aaaugcacaaacaa

SEQ ID NO: 1759461 - RNA, 21 nt, Human
aaaugcaaauccuaugugauu

SEQ ID NO: 1759462 - RNA, 14 nt, Human
aaaugcaaauccua

SEQ ID NO: 1759463 - RNA, 13 nt, Human
aaaugcaaauccu

SEQ ID NO: 1759464 - RNA, 12 nt, Human
aaaugcauugua

SEQ ID NO: 1759465 - RNA, 13 nt, Human
aaaugcauuguau

SEQ ID NO: 1759466 - RNA, 20 nt, Human
aaaugcauuguaucgauguu

SEQ ID NO: 1759467 - RNA, 14 nt, Human
aaaugcauuucuaa

SEQ ID NO: 1759468 - RNA, 19 nt, Human
gucucauagguugagcaau

SEQ ID NO: 1759469 - RNA, 15 nt, Human
guccuuccugaaacu

SEQ ID NO: 1759470 - RNA, 15 nt, Human
gucucauccaucauc

SEQ ID NO: 1759471 - RNA, 16 nt, Human
gucucauccaucauca

SEQ ID NO: 1759472 - RNA, 20 nt, Human
aaccacaucuugcucugcug

SEQ ID NO: 1759473 - RNA, 22 nt, Human
aaccacaucuugcucugcugac

SEQ ID NO: 1759474 - RNA, 18 nt, Human
aaccacaucuugcucugc

SEQ ID NO: 1759475 - RNA, 13 nt, Human
aaccaauccugga

SEQ ID NO: 1759476 - RNA, 17 nt, Human
aaccuccgccucuuggg

SEQ ID NO: 1759477 - RNA, 23 nt, Human
aaccuccccagccugcgccugcu

SEQ ID NO: 1759478 - RNA, 17 nt, Human
aaccuccccagccugcg

SEQ ID NO: 1759479 - RNA, 12 nt, Human
aaccuccucugu

SEQ ID NO: 1759480 - RNA, 13 nt, Human
aaccuccucugug

SEQ ID NO: 1759481 - RNA, 14 nt, Human
aaccuccugggcua

SEQ ID NO: 1759482 - RNA, 14 nt, Human
aaccuccucuguga

SEQ ID NO: 1759483 - RNA, 15 nt, Human
aaccuccucugugaa

SEQ ID NO: 1759484 - RNA, 16 nt, Human
aaccuccccagccugc

SEQ ID NO: 1759485 - RNA, 13 nt, Human
aacccccagccug

SEQ ID NO: 1759486 - RNA, 14 nt, Human
aacccccagccugc

SEQ ID NO: 1759487 - RNA, 15 nt, Human
aacccccagccugcu

SEQ ID NO: 1759488 - RNA, 15 nt, Human
aaccuauuuugaagu

SEQ ID NO: 1759489 - RNA, 17 nt, Human
aacccagucacugugag

SEQ ID NO: 1759490 - RNA, 20 nt, Human
aacccaucaacaaaaauugu

SEQ ID NO: 1759491 - RNA, 15 nt, Human
aacccaugagauuca

SEQ ID NO: 1759492 - RNA, 17 nt, Human
aaccauguagaaaauuu

SEQ ID NO: 1759493 - RNA, 19 nt, Human
gugaaccaccacacccagc

SEQ ID NO: 1759494 - RNA, 10 nt, Human
aacuccaggg

SEQ ID NO: 1759495 - RNA, 19 nt, Human
aacuagcauaucugccuuu

SEQ ID NO: 1759496 - RNA, 18 nt, Human
aacuagcauaucugccuu

SEQ ID NO: 1759497 - RNA, 17 nt, Human
aacuagcauaucugccu

SEQ ID NO: 1759498 - RNA, 14 nt, Human
aacuagcauaucug

SEQ ID NO: 1759499 - RNA, 19 nt, Human
aaccugccugacauuugga

SEQ ID NO: 1759500 - RNA, 20 nt, Human
gucugggaggaauggacaga

SEQ ID NO: 1759501 - RNA, 18 nt, Human
aaccucuguucaguguaa

SEQ ID NO: 1759502 - RNA, 18 nt, Human
aaccucuucagaggcccu

SEQ ID NO: 1759503 - RNA, 15 nt, Human
aaccucuguucagug

SEQ ID NO: 1759504 - RNA, 16 nt, Human
aaccucuguucagugu

SEQ ID NO: 1759505 - RNA, 12 nt, Human
aaccucuguuca

SEQ ID NO: 1759506 - RNA, 13 nt, Human
aaccucuguucag

SEQ ID NO: 1759507 - RNA, 19 nt, Human
gucuuauauauuguagaua

SEQ ID NO: 1759508 - RNA, 18 nt, Human
gucuuccugaaaugcagu

SEQ ID NO: 1759509 - RNA, 21 nt, Human
gucauuugagcagggcucagc

SEQ ID NO: 1759510 - RNA, 22 nt, Human
gucauuugagcagggcucagcg

SEQ ID NO: 1759511 - RNA, 17 nt, Human
gucauuugagucucuua

SEQ ID NO: 1759512 - RNA, 20 nt, Human
guccacaaaauaaccaaucc

SEQ ID NO: 1759513 - RNA, 16 nt, Human
guccauuguccaaucc

SEQ ID NO: 1759514 - RNA, 21 nt, Human
guccauuguccaauccuaugu

SEQ ID NO: 1759515 - RNA, 12 nt, Human
guccaauccuau

SEQ ID NO: 1759516 - RNA, 17 nt, Human
guccaauccuauguuuu

SEQ ID NO: 1759517 - RNA, 20 nt, Human
aacacugugcacaucugugu

SEQ ID NO: 1759518 - RNA, 22 nt, Human
aacacugugcacaucugugucu

SEQ ID NO: 1759519 - RNA, 16 nt, Human
gucacaggcaggucca

SEQ ID NO: 1759520 - RNA, 13 nt, Human
gucacaggcaggu

SEQ ID NO: 1759521 - RNA, 15 nt, Human
gucacaggcaggucc

SEQ ID NO: 1759522 - RNA, 14 nt, Human
aacaaggaagucaa

SEQ ID NO: 1759523 - RNA, 21 nt, Human
aacaagccuccuuuuaaagua

SEQ ID NO: 1759524 - RNA, 15 nt, Human
aacaauaaaugugca

SEQ ID NO: 1759525 - RNA, 19 nt, Human
aacaagguuauaugaauau

SEQ ID NO: 1759526 - RNA, 20 nt, Human
aacaagguuauaugaauaua

SEQ ID NO: 1759527 - RNA, 22 nt, Human
aacaauccuagugcuuuccuuu

SEQ ID NO: 1759528 - RNA, 17 nt, Human
aacaauccuagugcuuu

SEQ ID NO: 1759529 - RNA, 16 nt, Human
guccggaaugccaccc

SEQ ID NO: 1759530 - RNA, 19 nt, Human
aacagacuggaagcacagc

SEQ ID NO: 1759531 - RNA, 22 nt, Human
aacaggcugggcuucaguggca

SEQ ID NO: 1759532 - RNA, 13 nt, Human
aacaggcugggcu

SEQ ID NO: 1759533 - RNA, 23 nt, Human
aacaggcugggcuucaguggcag

SEQ ID NO: 1759534 - RNA, 14 nt, Human
aacaguaaaugugc

SEQ ID NO: 1759535 - RNA, 12 nt, Human
aacaguggggaa

SEQ ID NO: 1759536 - RNA, 16 nt, Human
aacaguggggaagagu

SEQ ID NO: 1759537 - RNA, 15 nt, Human
guccugaucagagcc

SEQ ID NO: 1759538 - RNA, 15 nt, Human
guccuuauguuaagc

SEQ ID NO: 1759539 - RNA, 22 nt, Human
guccuuauguuaagcccuggca

SEQ ID NO: 1759540 - RNA, 12 nt, Human
guccugccuguc

SEQ ID NO: 1759541 - RNA, 14 nt, Human
guccugccugucug

SEQ ID NO: 1759542 - RNA, 15 nt, Human
guccugccugucugc

SEQ ID NO: 1759543 - RNA, 16 nt, Human
guccugccugucugcc

SEQ ID NO: 1759544 - RNA, 18 nt, Human
guccugccugucugcccc

SEQ ID NO: 1759545 - RNA, 21 nt, Human
guccugccugucugccccagc

SEQ ID NO: 1759546 - RNA, 18 nt, Human
aagcuuccauagcugcug

SEQ ID NO: 1759547 - RNA, 20 nt, Human
aagcuuccauagcugcugcc

SEQ ID NO: 1759548 - RNA, 22 nt, Human
aagcugacgaacuuccauggcc

SEQ ID NO: 1759549 - RNA, 19 nt, Human
aagcugacgaacuuccaug

SEQ ID NO: 1759550 - RNA, 20 nt, Human
aagcugacgaacuuccaugg

SEQ ID NO: 1759551 - RNA, 17 nt, Human
aagcugacgaacuucca

SEQ ID NO: 1759552 - RNA, 19 nt, Human
guucccuauuuuucucucc

SEQ ID NO: 1759553 - RNA, 22 nt, Human
guucccuauuuuucucuccugu

SEQ ID NO: 1759554 - RNA, 16 nt, Human
guucccgcggggcugu

SEQ ID NO: 1759555 - RNA, 14 nt, Human
guucccggcuggac

SEQ ID NO: 1759556 - RNA, 22 nt, Human
guuccccuuccacugagggcag

SEQ ID NO: 1759557 - RNA, 15 nt, Human
guuccccuuccacug

SEQ ID NO: 1759558 - RNA, 22 nt, Human
aagcuuucauguaaacugugca

SEQ ID NO: 1759559 - RNA, 23 nt, Human
aagcuuucauguaaacugugcac

SEQ ID NO: 1759560 - RNA, 22 nt, Human
guugaugaucuuugcagacagg

SEQ ID NO: 1759561 - RNA, 22 nt, Human
guucucuaucauuuaauaauau

SEQ ID NO: 1759562 - RNA, 18 nt, Human
guucucuaucauuuaaua

SEQ ID NO: 1759563 - RNA, 17 nt, Human
guucucuaucauuuaau

SEQ ID NO: 1759564 - RNA, 14 nt, Human
guucuguagaaaug

SEQ ID NO: 1759565 - RNA, 22 nt, Human
guucuguagaaaugguuguauu

SEQ ID NO: 1759566 - RNA, 17 nt, Human
aagcuaggccuggccag

SEQ ID NO: 1759567 - RNA, 18 nt, Human
aagcuaggccuggccaga

SEQ ID NO: 1759568 - RNA, 22 nt, Human
aagcuaggccuggccagaugca

SEQ ID NO: 1759569 - RNA, 17 nt, Human
guucaggguuggccccu

SEQ ID NO: 1759570 - RNA, 18 nt, Human
guucaggguuggccccug

SEQ ID NO: 1759571 - RNA, 19 nt, Human
guucaggguuggccccugc

SEQ ID NO: 1759572 - RNA, 18 nt, Human
guucagcuccagcucacc

SEQ ID NO: 1759573 - RNA, 16 nt, Human
guucagcuccagcuca

SEQ ID NO: 1759574 - RNA, 17 nt, Human
guucagcuccagcucac

SEQ ID NO: 1759575 - RNA, 12 nt, Human
guguuugucauu

SEQ ID NO: 1759576 - RNA, 15 nt, Human
guguuugucauuagc

SEQ ID NO: 1759577 - RNA, 13 nt, Human
guguuugucauua

SEQ ID NO: 1759578 - RNA, 14 nt, Human
guuaagcccuggca

SEQ ID NO: 1759579 - RNA, 18 nt, Human
guuaaugauagcuacugu

SEQ ID NO: 1759580 - RNA, 17 nt, Human
guuaaguccucccugac

SEQ ID NO: 1759581 - RNA, 23 nt, Human
guuaaguccucccugacuuuucu

SEQ ID NO: 1759582 - RNA, 14 nt, Human
guuaaggaauauaa

SEQ ID NO: 1759583 - RNA, 11 nt, Human
guuaaggccug

SEQ ID NO: 1759584 - RNA, 12 nt, Human
guuaaggccuga

SEQ ID NO: 1759585 - RNA, 16 nt, Human
guuaaggccugaauca

SEQ ID NO: 1759586 - RNA, 15 nt, Human
guuaaggugggcccg

SEQ ID NO: 1759587 - RNA, 21 nt, Human
guuacacacuuuuuaagaaau

SEQ ID NO: 1759588 - RNA, 20 nt, Human
guuacacagaaaugcugcug

SEQ ID NO: 1759589 - RNA, 21 nt, Human
guuacacagaaaugcugcugg

SEQ ID NO: 1759590 - RNA, 22 nt, Human
guuacacagaaaugcugcuggc

SEQ ID NO: 1759591 - RNA, 18 nt, Human
guuagucgugagcucuug

SEQ ID NO: 1759592 - RNA, 22 nt, Human
guuagucgugagcucuugugag

SEQ ID NO: 1759593 - RNA, 20 nt, Human
guuagucgugagcucuugug

SEQ ID NO: 1759594 - RNA, 23 nt, Human
guugaugaucuuugcagacaggc

SEQ ID NO: 1759595 - RNA, 21 nt, Human
aaggccaauuccuauacgcag

SEQ ID NO: 1759596 - RNA, 17 nt, Human
guugcccaggcaggucu

SEQ ID NO: 1759597 - RNA, 18 nt, Human
guugcccaggcaggucuu

SEQ ID NO: 1759598 - RNA, 19 nt, Human
guugcccaggcaggucuug

SEQ ID NO: 1759599 - RNA, 21 nt, Human
guugcccaggcuggcgugcag

SEQ ID NO: 1759600 - RNA, 23 nt, Human
guuuaagaaaaaauaacacacau

SEQ ID NO: 1759601 - RNA, 22 nt, Human
guuuauuaaaauucugaauuuu

SEQ ID NO: 1759602 - RNA, 15 nt, Human
guuguauuagauguu

SEQ ID NO: 1759603 - RNA, 14 nt, Human
guuguauuagaugu

SEQ ID NO: 1759604 - RNA, 23 nt, Human
guuguauacuuccuuaugcuucu

SEQ ID NO: 1759605 - RNA, 13 nt, Human
guuggguggaugc

SEQ ID NO: 1759606 - RNA, 11 nt, Human
guugccccaga

SEQ ID NO: 1759607 - RNA, 19 nt, Human
guugccccuuucucuuuuc

SEQ ID NO: 1759608 - RNA, 18 nt, Human
guugcuggaucaggaagc

SEQ ID NO: 1759609 - RNA, 18 nt, Human
guuuggggaugagaaagg

SEQ ID NO: 1759610 - RNA, 13 nt, Human
guuugccucugcc

SEQ ID NO: 1759611 - RNA, 16 nt, Human
guuugccucugccucu

SEQ ID NO: 1759612 - RNA, 15 nt, Human
guuugccggauacaa

SEQ ID NO: 1759613 - RNA, 23 nt, Human
guuugcccaaaauuuauuuuaua

SEQ ID NO: 1759614 - RNA, 18 nt, Human
aagggcuuuguuuugcac

SEQ ID NO: 1759615 - RNA, 22 nt, Human
aaggggaauguuugccucugcc

SEQ ID NO: 1759616 - RNA, 23 nt, Human
aaggggaauguuugccucugccu

SEQ ID NO: 1759617 - RNA, 17 nt, Human
aaggggucaaaauuugc

SEQ ID NO: 1759618 - RNA, 17 nt, Human
aaggcuucucucugugg

SEQ ID NO: 1759619 - RNA, 18 nt, Human
aaggcuucucucuguggg

SEQ ID NO: 1759620 - RNA, 17 nt, Human
aaggguaucaggugcug

SEQ ID NO: 1759621 - RNA, 16 nt, Human
aaggguaucaggugcu

SEQ ID NO: 1759622 - RNA, 16 nt, Human
aagaggaaguucagau

SEQ ID NO: 1759623 - RNA, 17 nt, Human
aagaggaaguucagauc

SEQ ID NO: 1759624 - RNA, 15 nt, Human
aagaccucagggcac

SEQ ID NO: 1759625 - RNA, 14 nt, Human
gugggguuuccugg

SEQ ID NO: 1759626 - RNA, 16 nt, Human
gugggguuuccuggca

SEQ ID NO: 1759627 - RNA, 18 nt, Human
guggggugacgggacuca

SEQ ID NO: 1759628 - RNA, 13 nt, Human
aagcaagacugag

SEQ ID NO: 1759629 - RNA, 12 nt, Human
aagcaaagggga

SEQ ID NO: 1759630 - RNA, 18 nt, Human
aagcaaaggggacagcug

SEQ ID NO: 1759631 - RNA, 21 nt, Human
aagcaaaggggacagcugugu

SEQ ID NO: 1759632 - RNA, 19 nt, Human
aagauauuuuaaaaucugu

SEQ ID NO: 1759633 - RNA, 13 nt, Human
aagaguagaaacu

SEQ ID NO: 1759634 - RNA, 19 nt, Human
aagauauaagugcuguaua

SEQ ID NO: 1759635 - RNA, 21 nt, Human
aagauauaagugcuguauaaa

SEQ ID NO: 1759636 - RNA, 20 nt, Human
aagauauaagugcuguauaa

SEQ ID NO: 1759637 - RNA, 17 nt, Human
gugucuugcaauggcag

SEQ ID NO: 1759638 - RNA, 18 nt, Human
gugucuugcaauggcagc

SEQ ID NO: 1759639 - RNA, 20 nt, Human
gugucuucuccaccacgcug

SEQ ID NO: 1759640 - RNA, 15 nt, Human
aagcaauccuaggua

SEQ ID NO: 1759641 - RNA, 13 nt, Human
aagcaauaugcau

SEQ ID NO: 1759642 - RNA, 19 nt, Human
aagcaauaugcauuuaaau

SEQ ID NO: 1759643 - RNA, 18 nt, Human
gugucuuuuuucacuaca

SEQ ID NO: 1759644 - RNA, 19 nt, Human
guguguccacgacugucuc

SEQ ID NO: 1759645 - RNA, 20 nt, Human
guguguccacgacugucucc

SEQ ID NO: 1759646 - RNA, 16 nt, Human
gugugucccccucugu

SEQ ID NO: 1759647 - RNA, 17 nt, Human
gugugucccccucuguc

SEQ ID NO: 1759648 - RNA, 18 nt, Human
gugugucccccucugucc

SEQ ID NO: 1759649 - RNA, 22 nt, Human
gugcucacguuaccuugacaca

SEQ ID NO: 1759650 - RNA, 23 nt, Human
gugcucacguuaccuugacacau

SEQ ID NO: 1759651 - RNA, 18 nt, Human
gugcucaggacucagaag

SEQ ID NO: 1759652 - RNA, 22 nt, Human
gugcucaggacucagaagccuc

SEQ ID NO: 1759653 - RNA, 21 nt, Human
gugcugggauuacaagcguga

SEQ ID NO: 1759654 - RNA, 22 nt, Human
gugcugggauuacaagcgugag

SEQ ID NO: 1759655 - RNA, 17 nt, Human
gugcugggagaaauacu

SEQ ID NO: 1759656 - RNA, 20 nt, Human
gugcugggauuacaggugug

SEQ ID NO: 1759657 - RNA, 23 nt, Human
guggacacagcucuucuccaggc

SEQ ID NO: 1759658 - RNA, 18 nt, Human
guggacacagcucuucuc

SEQ ID NO: 1759659 - RNA, 22 nt, Human
guggacacagcucuucuccagg

SEQ ID NO: 1759660 - RNA, 21 nt, Human
guggaugccugguggcagcug

SEQ ID NO: 1759661 - RNA, 18 nt, Human
guggauggccguggaugc

SEQ ID NO: 1759662 - RNA, 16 nt, Human
guggaauguuggauaa

SEQ ID NO: 1759663 - RNA, 17 nt, Human
guggaauguuggauaag

SEQ ID NO: 1759664 - RNA, 20 nt, Human
guggaauguuggauaaggaa

SEQ ID NO: 1759665 - RNA, 14 nt, Human
guggacuaaaagau

SEQ ID NO: 1759666 - RNA, 12 nt, Human
aagaaagaaugu

SEQ ID NO: 1759667 - RNA, 20 nt, Human
aagaaagaauguuacugccu

SEQ ID NO: 1759668 - RNA, 22 nt, Human
aagaaagaauguuacugccuua

SEQ ID NO: 1759669 - RNA, 12 nt, Human
aagaauacuuga

SEQ ID NO: 1759670 - RNA, 13 nt, Human
aagaauacuugaa

SEQ ID NO: 1759671 - RNA, 14 nt, Human
aagaauacuugaac

SEQ ID NO: 1759672 - RNA, 15 nt, Human
aagaauacuugaacu

SEQ ID NO: 1759673 - RNA, 16 nt, Human
aagaauacuugaacuu

SEQ ID NO: 1759674 - RNA, 17 nt, Human
aagaauacuugaacuug

SEQ ID NO: 1759675 - RNA, 16 nt, Human
aacuugggcacaugcu

SEQ ID NO: 1759676 - RNA, 15 nt, Human
aacuugucucuucau

SEQ ID NO: 1759677 - RNA, 21 nt, Human
gugaaccaccacacccagccc

SEQ ID NO: 1759678 - RNA, 14 nt, Human
gugaaccaaugcaa

SEQ ID NO: 1759679 - RNA, 15 nt, Human
gugaaccaaugcaag

SEQ ID NO: 1759680 - RNA, 19 nt, Human
gugccuauuuguguggaca

SEQ ID NO: 1759681 - RNA, 12 nt, Human
uaauuuauagua

SEQ ID NO: 1759682 - RNA, 22 nt, Human
uaauuuauaguaaugaguuuaa

SEQ ID NO: 1759683 - RNA, 14 nt, Human
aaugcaguauggua

SEQ ID NO: 1759684 - RNA, 15 nt, Human
aaugcaguaugguac

SEQ ID NO: 1759685 - RNA, 16 nt, Human
aaugcaguaugguaca

SEQ ID NO: 1759686 - RNA, 17 nt, Human
aaugcaguaugguacau

SEQ ID NO: 1759687 - RNA, 19 nt, Human
aaugcaguaugguacauuu

SEQ ID NO: 1759688 - RNA, 23 nt, Human
aaugcaguaugguacauuuuuca

SEQ ID NO: 1759689 - RNA, 19 nt, Human
aaugcagucuguccaggcu

SEQ ID NO: 1759690 - RNA, 20 nt, Human
aaugcagucuguccaggcuc

SEQ ID NO: 1759691 - RNA, 21 nt, Human
aaugcauuuuguuugguauug

SEQ ID NO: 1759692 - RNA, 20 nt, Human
aaugcauuuuguuugguauu

SEQ ID NO: 1759693 - RNA, 18 nt, Human
aaugcauuuuguuuggua

SEQ ID NO: 1759694 - RNA, 12 nt, Human
aaugcauuuugu

SEQ ID NO: 1759695 - RNA, 12 nt, Human
aaugcauuguau

SEQ ID NO: 1759696 - RNA, 18 nt, Human
aaugcauuguaucgaugu

SEQ ID NO: 1759697 - RNA, 21 nt, Human
aaugcauuguaucgauguuau

SEQ ID NO: 1759698 - RNA, 23 nt, Human
aaugcauuuuguuugguauugua

SEQ ID NO: 1759699 - RNA, 22 nt, Human
aaugcauuguaucgauguuaug

SEQ ID NO: 1759700 - RNA, 16 nt, Human
aaugugaugaauacug

SEQ ID NO: 1759701 - RNA, 12 nt, Human
aaugugaugaau

SEQ ID NO: 1759702 - RNA, 20 nt, Human
aaugugaugaauacuguauu

SEQ ID NO: 1759703 - RNA, 18 nt, Human
uacagaggccaugggccu

SEQ ID NO: 1759704 - RNA, 16 nt, Human
uacagagcuucccuga

SEQ ID NO: 1759705 - RNA, 15 nt, Human
uacagagcuucccug

SEQ ID NO: 1759706 - RNA, 12 nt, Human
uacaggcuggcg

SEQ ID NO: 1759707 - RNA, 21 nt, Human
uacaggcuggcgcagaacgaa

SEQ ID NO: 1759708 - RNA, 20 nt, Human
uacaguaggagcccagcucu

SEQ ID NO: 1759709 - RNA, 22 nt, Human
uacaguaggagcccagcucuga

SEQ ID NO: 1759710 - RNA, 13 nt, Human
uacaguaggagcc

SEQ ID NO: 1759711 - RNA, 14 nt, Human
uacaguaggagccc

SEQ ID NO: 1759712 - RNA, 15 nt, Human
uacaguaggagccca

SEQ ID NO: 1759713 - RNA, 18 nt, Human
uacaguaggagcccagcu

SEQ ID NO: 1759714 - RNA, 17 nt, Human
aauggagcaucaagcca

SEQ ID NO: 1759715 - RNA, 19 nt, Human
aauggacuuuuguacauag

SEQ ID NO: 1759716 - RNA, 21 nt, Human
aaugacauacgcuuuuaauga

SEQ ID NO: 1759717 - RNA, 13 nt, Human
aaugaaaagagaa

SEQ ID NO: 1759718 - RNA, 17 nt, Human
aaugacacuugucccca

SEQ ID NO: 1759719 - RNA, 13 nt, Human
uaaugaguuuaaa

SEQ ID NO: 1759720 - RNA, 13 nt, Human
aaucuugucucaa

SEQ ID NO: 1759721 - RNA, 17 nt, Human
aaucuugucucaaugcu

SEQ ID NO: 1759722 - RNA, 15 nt, Human
aaucuugucucaaug

SEQ ID NO: 1759723 - RNA, 21 nt, Human
aaucuugucucaaugcucaua

SEQ ID NO: 1759724 - RNA, 20 nt, Human
aaucuugucucaaugcucau

SEQ ID NO: 1759725 - RNA, 18 nt, Human
aaucuugucucaaugcuc

SEQ ID NO: 1759726 - RNA, 22 nt, Human
aaucuuucuuucuuagaaauuu

SEQ ID NO: 1759727 - RNA, 21 nt, Human
aaucuuucuuucuuagaaauu

SEQ ID NO: 1759728 - RNA, 20 nt, Human
aaucuuucuuucuuagaaau

SEQ ID NO: 1759729 - RNA, 19 nt, Human
aaucuuucuuucuuagaaa

SEQ ID NO: 1759730 - RNA, 18 nt, Human
aaucuuucuuucuuagaa

SEQ ID NO: 1759731 - RNA, 17 nt, Human
aaucuuucuuucuuaga

SEQ ID NO: 1759732 - RNA, 16 nt, Human
aaucuuucuuucuuag

SEQ ID NO: 1759733 - RNA, 14 nt, Human
aaucuuucuuucuu

SEQ ID NO: 1759734 - RNA, 17 nt, Human
uaauaguaauuuguaaa

SEQ ID NO: 1759735 - RNA, 18 nt, Human
uaauaguaauuuguaaag

SEQ ID NO: 1759736 - RNA, 21 nt, Human
uaauaguaauuuguaaaguug

SEQ ID NO: 1759737 - RNA, 15 nt, Human
uaaugacacuugucc

SEQ ID NO: 1759738 - RNA, 17 nt, Human
uaaguuauuuuuguaca

SEQ ID NO: 1759739 - RNA, 18 nt, Human
uaaguuauuuuuguacau

SEQ ID NO: 1759740 - RNA, 19 nt, Human
uaaguuauuuuuguacaug

SEQ ID NO: 1759741 - RNA, 15 nt, Human
uaaguuauuuuaccu

SEQ ID NO: 1759742 - RNA, 18 nt, Human
uaaguuauuuuaccuguu

SEQ ID NO: 1759743 - RNA, 15 nt, Human
aaucagaucuuuauu

SEQ ID NO: 1759744 - RNA, 13 nt, Human
aaucaugagccug

SEQ ID NO: 1759745 - RNA, 16 nt, Human
aaucaugagccugcug

SEQ ID NO: 1759746 - RNA, 17 nt, Human
aaucaugagccugcugg

SEQ ID NO: 1759747 - RNA, 18 nt, Human
aaucaugagccugcugga

SEQ ID NO: 1759748 - RNA, 15 nt, Human
aaucaucaagucuuu

SEQ ID NO: 1759749 - RNA, 12 nt, Human
aaucaucaagaa

SEQ ID NO: 1759750 - RNA, 14 nt, Human
aaucaucaagaagg

SEQ ID NO: 1759751 - RNA, 18 nt, Human
aaucaucaagaagggcug

SEQ ID NO: 1759752 - RNA, 22 nt, Human
aaucugucacguagaacuugga

SEQ ID NO: 1759753 - RNA, 14 nt, Human
aaucuagaggaaaa

SEQ ID NO: 1759754 - RNA, 19 nt, Human
aaucuagaggaaaagaaag

SEQ ID NO: 1759755 - RNA, 21 nt, Human
aaucuagaggaaaagaaagaa

SEQ ID NO: 1759756 - RNA, 16 nt, Human
aaucuuauaauuuaaa

SEQ ID NO: 1759757 - RNA, 14 nt, Human
aaucuuauaauuua

SEQ ID NO: 1759758 - RNA, 14 nt, Human
aauccuaugugauu

SEQ ID NO: 1759759 - RNA, 20 nt, Human
aauccuaugugauuuuaacu

SEQ ID NO: 1759760 - RNA, 21 nt, Human
aauccuaugugauuuuaacuc

SEQ ID NO: 1759761 - RNA, 14 nt, Human
aauccuaccuugcu

SEQ ID NO: 1759762 - RNA, 17 nt, Human
aauccuaccuugcuuuu

SEQ ID NO: 1759763 - RNA, 20 nt, Human
aauccuaccuugcuuuugcu

SEQ ID NO: 1759764 - RNA, 21 nt, Human
aauccuaccuugcuuuugcuu

SEQ ID NO: 1759765 - RNA, 20 nt, Human
aaucauuucuauuucuccuc

SEQ ID NO: 1759766 - RNA, 12 nt, Human
aaucauuucuau

SEQ ID NO: 1759767 - RNA, 19 nt, Human
aaucauuucuauuucuccu

SEQ ID NO: 1759768 - RNA, 14 nt, Human
uaaccucgcccucu

SEQ ID NO: 1759769 - RNA, 15 nt, Human
uaaccucgcccucuc

SEQ ID NO: 1759770 - RNA, 16 nt, Human
uaaccucgcccucucc

SEQ ID NO: 1759771 - RNA, 17 nt, Human
uaaccucgcccucuccu

SEQ ID NO: 1759772 - RNA, 17 nt, Human
uaaccucuucagaggcc

SEQ ID NO: 1759773 - RNA, 11 nt, Human
uaaccuggagg

SEQ ID NO: 1759774 - RNA, 15 nt, Human
aauaucaauauaaug

SEQ ID NO: 1759775 - RNA, 17 nt, Human
aauaucccggggguggg

SEQ ID NO: 1759776 - RNA, 13 nt, Human
aauaucauuuauu

SEQ ID NO: 1759777 - RNA, 23 nt, Human
aauaucauuuauuuuuuacauua

SEQ ID NO: 1759778 - RNA, 17 nt, Human
aauauaugugugccuau

SEQ ID NO: 1759779 - RNA, 13 nt, Human
aauagcugggacu

SEQ ID NO: 1759780 - RNA, 14 nt, Human
aauagcugggacua

SEQ ID NO: 1759781 - RNA, 20 nt, Human
aauagauaagaguagaaacu

SEQ ID NO: 1759782 - RNA, 18 nt, Human
aauaggcguaacuaauuu

SEQ ID NO: 1759783 - RNA, 22 nt, Human
aauaggcgaucacaacgugcau

SEQ ID NO: 1759784 - RNA, 14 nt, Human
aauagguucuucuu

SEQ ID NO: 1759785 - RNA, 16 nt, Human
aauagguucuucuugu

SEQ ID NO: 1759786 - RNA, 15 nt, Human
aauaguaauuuguaa

SEQ ID NO: 1759787 - RNA, 16 nt, Human
aauaguaauuuguaaa

SEQ ID NO: 1759788 - RNA, 21 nt, Human
aauaguaauuuguaaaguugg

SEQ ID NO: 1759789 - RNA, 13 nt, Human
aauauuguucucu

SEQ ID NO: 1759790 - RNA, 11 nt, Human
aauauuugaau

SEQ ID NO: 1759791 - RNA, 12 nt, Human
aauauuucuauu

SEQ ID NO: 1759792 - RNA, 13 nt, Human
aauauuucuauug

SEQ ID NO: 1759793 - RNA, 14 nt, Human
aauauuucuauuga

SEQ ID NO: 1759794 - RNA, 18 nt, Human
aauauuucuauugaauuc

SEQ ID NO: 1759795 - RNA, 15 nt, Human
aauauuuuacauaca

SEQ ID NO: 1759796 - RNA, 13 nt, Human
aauauuugaaucu

SEQ ID NO: 1759797 - RNA, 12 nt, Human
aauauuugaauc

SEQ ID NO: 1759798 - RNA, 14 nt, Human
aauauuugaaucuu

SEQ ID NO: 1759799 - RNA, 22 nt, Human
aauaagaaacaacucuuugaga

SEQ ID NO: 1759800 - RNA, 13 nt, Human
aauaauuuauagu

SEQ ID NO: 1759801 - RNA, 15 nt, Human
aauaauuuauaguaa

SEQ ID NO: 1759802 - RNA, 16 nt, Human
aauaauuuauaguaau

SEQ ID NO: 1759803 - RNA, 21 nt, Human
uaaauaagaaacaacucuuug

SEQ ID NO: 1759804 - RNA, 22 nt, Human
uaaauaagaaacaacucuuuga

SEQ ID NO: 1759805 - RNA, 13 nt, Human
uaaauacagucuu

SEQ ID NO: 1759806 - RNA, 17 nt, Human
uaaauacagucuuccau

SEQ ID NO: 1759807 - RNA, 20 nt, Human
uaaauacagucuuccauuug

SEQ ID NO: 1759808 - RNA, 22 nt, Human
uaaauacagucuuccauuugca

SEQ ID NO: 1759809 - RNA, 23 nt, Human
uaaauacagucuuccauuugcaa

SEQ ID NO: 1759810 - RNA, 15 nt, Human
aauacaaauugguug

SEQ ID NO: 1759811 - RNA, 18 nt, Human
uaaauagaguauaugcac

SEQ ID NO: 1759812 - RNA, 17 nt, Human
guuuucuuuaugucuuu

SEQ ID NO: 1759813 - RNA, 15 nt, Human
guuuucuuuccuccu

SEQ ID NO: 1759814 - RNA, 16 nt, Human
guuuucuuuccuccuu

SEQ ID NO: 1759815 - RNA, 18 nt, Human
guuuucuuuccuccuuuc

SEQ ID NO: 1759816 - RNA, 20 nt, Human
guuuucuuuccuccuuuccu

SEQ ID NO: 1759817 - RNA, 22 nt, Human
uaaaguauuuaauuagugcuaa

SEQ ID NO: 1759818 - RNA, 21 nt, Human
uaaaguauuuaauuagugcua

SEQ ID NO: 1759819 - RNA, 19 nt, Human
uaaaguauuuaauuagugc

SEQ ID NO: 1759820 - RNA, 17 nt, Human
uaaaguauuuaauuagu

SEQ ID NO: 1759821 - RNA, 16 nt, Human
uaaaguauuuaauuag

SEQ ID NO: 1759822 - RNA, 14 nt, Human
uaaaguauuuaauu

SEQ ID NO: 1759823 - RNA, 12 nt, Human
uaaaguauuuaa

SEQ ID NO: 1759824 - RNA, 23 nt, Human
aauaaaguauuuaauuagugcua

SEQ ID NO: 1759825 - RNA, 22 nt, Human
aauaaaguauuuaauuagugcu

SEQ ID NO: 1759826 - RNA, 21 nt, Human
aauaaaguauuuaauuagugc

SEQ ID NO: 1759827 - RNA, 20 nt, Human
aauaaaguauuuaauuagug

SEQ ID NO: 1759828 - RNA, 19 nt, Human
aauaaaguauuuaauuagu

SEQ ID NO: 1759829 - RNA, 16 nt, Human
aauaaaguauuuaauu

SEQ ID NO: 1759830 - RNA, 15 nt, Human
aauaaaguauuuaau

SEQ ID NO: 1759831 - RNA, 14 nt, Human
aauaaaguauuuaa

SEQ ID NO: 1759832 - RNA, 13 nt, Human
aauaaaguauuua

SEQ ID NO: 1759833 - RNA, 21 nt, Human
aauaacaaugaaaguugauaa

SEQ ID NO: 1759834 - RNA, 18 nt, Human
aauaaauuguauauucac

SEQ ID NO: 1759835 - RNA, 17 nt, Human
aauaaauuguauauuca

SEQ ID NO: 1759836 - RNA, 16 nt, Human
aauaaauuguauauuc

SEQ ID NO: 1759837 - RNA, 15 nt, Human
aauaaauuguauauu

SEQ ID NO: 1759838 - RNA, 13 nt, Human
aauaaauuguaua

SEQ ID NO: 1759839 - RNA, 12 nt, Human
aauaaauuguau

SEQ ID NO: 1759840 - RNA, 19 nt, Human
aauaaauugcuaauguugc

SEQ ID NO: 1759841 - RNA, 20 nt, Human
aauaaauugcuaauguugcu

SEQ ID NO: 1759842 - RNA, 15 nt, Human
aauaacgauaaaaga

SEQ ID NO: 1759843 - RNA, 19 nt, Human
aauaacucuguggcauuau

SEQ ID NO: 1759844 - RNA, 20 nt, Human
aauaacacacauauaaacau

SEQ ID NO: 1759845 - RNA, 12 nt, Human
aauaacacacau

SEQ ID NO: 1759846 - RNA, 17 nt, Human
acaagcgugagccacug

SEQ ID NO: 1759847 - RNA, 16 nt, Human
acaagcaaacccagac

SEQ ID NO: 1759848 - RNA, 15 nt, Human
acaagcaaacccaga

SEQ ID NO: 1759849 - RNA, 16 nt, Human
uagcucaggugucccu

SEQ ID NO: 1759850 - RNA, 16 nt, Human
uagcuacuaauuuuaa

SEQ ID NO: 1759851 - RNA, 15 nt, Human
acaaugaaugucuuu

SEQ ID NO: 1759852 - RNA, 18 nt, Human
acaagcgugagccacugc

SEQ ID NO: 1759853 - RNA, 14 nt, Human
acaauaugugccaa

SEQ ID NO: 1759854 - RNA, 20 nt, Human
acaauaugugccaaucaaua

SEQ ID NO: 1759855 - RNA, 22 nt, Human
acaauaugugccaaucaauagc

SEQ ID NO: 1759856 - RNA, 12 nt, Human
acaauaaaauau

SEQ ID NO: 1759857 - RNA, 15 nt, Human
acaauaaaauauuau

SEQ ID NO: 1759858 - RNA, 20 nt, Human
acaauaaaauuuuuuuucau

SEQ ID NO: 1759859 - RNA, 21 nt, Human
acaauaaaauuuuuuuucaug

SEQ ID NO: 1759860 - RNA, 19 nt, Human
acaauagccgauaucagaa

SEQ ID NO: 1759861 - RNA, 22 nt, Human
acaauagccgauaucagaauuu

SEQ ID NO: 1759862 - RNA, 18 nt, Human
aauuuguuauuuugcaac

SEQ ID NO: 1759863 - RNA, 14 nt, Human
aauuugcugccaaa

SEQ ID NO: 1759864 - RNA, 20 nt, Human
aauuugcugccaaaugcgua

SEQ ID NO: 1759865 - RNA, 20 nt, Human
aauuuuuuuagaaagcauuu

SEQ ID NO: 1759866 - RNA, 18 nt, Human
aauuuuuuuagaaagcau

SEQ ID NO: 1759867 - RNA, 14 nt, Human
aauuuuuuuucaug

SEQ ID NO: 1759868 - RNA, 15 nt, Human
aauuuuuuuagaaag

SEQ ID NO: 1759869 - RNA, 20 nt, Human
aauuuuuaaauguaaaacau

SEQ ID NO: 1759870 - RNA, 13 nt, Human
aauuuuuaagcaa

SEQ ID NO: 1759871 - RNA, 19 nt, Human
aauuuguguugaaggaacu

SEQ ID NO: 1759872 - RNA, 11 nt, Human
aauuuuugcaa

SEQ ID NO: 1759873 - RNA, 12 nt, Human
aauuuuugcaau

SEQ ID NO: 1759874 - RNA, 14 nt, Human
aauuuuugcaauaa

SEQ ID NO: 1759875 - RNA, 15 nt, Human
aauuuuugcaauaau

SEQ ID NO: 1759876 - RNA, 17 nt, Human
aauuuuugcaauaaugc

SEQ ID NO: 1759877 - RNA, 18 nt, Human
aauuuuugcaauaaugca

SEQ ID NO: 1759878 - RNA, 19 nt, Human
aauuuuugcaauaaugcag

SEQ ID NO: 1759879 - RNA, 21 nt, Human
aauuuuugcaauaaugcagua

SEQ ID NO: 1759880 - RNA, 22 nt, Human
uagauaggucagugcaaauacu

SEQ ID NO: 1759881 - RNA, 21 nt, Human
acaaauauugguguugucagu

SEQ ID NO: 1759882 - RNA, 12 nt, Human
acaaauaugcaa

SEQ ID NO: 1759883 - RNA, 11 nt, Human
acaaauaugca

SEQ ID NO: 1759884 - RNA, 19 nt, Human
acaaauaugcaaaagguuc

SEQ ID NO: 1759885 - RNA, 15 nt, Human
aauuuuuuuucaugu

SEQ ID NO: 1759886 - RNA, 23 nt, Human
aauuuuuuuucauguuuuaacaa

SEQ ID NO: 1759887 - RNA, 15 nt, Human
acaaaguuguaugug

SEQ ID NO: 1759888 - RNA, 15 nt, Human
uacgucugacaggca

SEQ ID NO: 1759889 - RNA, 17 nt, Human
uacgcuuuuaaugaaaa

SEQ ID NO: 1759890 - RNA, 21 nt, Human
uacuagggaucccucaucugu

SEQ ID NO: 1759891 - RNA, 16 nt, Human
uacgucugacaggcaa

SEQ ID NO: 1759892 - RNA, 14 nt, Human
uacuuugaagucau

SEQ ID NO: 1759893 - RNA, 18 nt, Human
uacuuugaagucauacca

SEQ ID NO: 1759894 - RNA, 20 nt, Human
uacuucuccacccugcucuc

SEQ ID NO: 1759895 - RNA, 14 nt, Human
uacuucucuauaaa

SEQ ID NO: 1759896 - RNA, 18 nt, Human
uacuucucuauaaaaaau

SEQ ID NO: 1759897 - RNA, 22 nt, Human
uacuucucuauaaaaaauaugu

SEQ ID NO: 1759898 - RNA, 15 nt, Human
uacuucugcuacaua

SEQ ID NO: 1759899 - RNA, 17 nt, Human
uacuuaguagauuaaaa

SEQ ID NO: 1759900 - RNA, 19 nt, Human
uacuucccgggccagggcu

SEQ ID NO: 1759901 - RNA, 20 nt, Human
uacuucccgggccagggcug

SEQ ID NO: 1759902 - RNA, 21 nt, Human
uacuucccgggccagggcugc

SEQ ID NO: 1759903 - RNA, 22 nt, Human
uacuuccuuaugcuucuuucaa

SEQ ID NO: 1759904 - RNA, 13 nt, Human
uacuucuccaccc

SEQ ID NO: 1759905 - RNA, 18 nt, Human
uacuucuccacccugcuc

SEQ ID NO: 1759906 - RNA, 10 nt, Human
aauuugcaaa

SEQ ID NO: 1759907 - RNA, 11 nt, Human
aauuugcaaag

SEQ ID NO: 1759908 - RNA, 12 nt, Human
aauuugcaaagu

SEQ ID NO: 1759909 - RNA, 13 nt, Human
aauuugcaaagua

SEQ ID NO: 1759910 - RNA, 14 nt, Human
aauuugcaaaguac

SEQ ID NO: 1759911 - RNA, 15 nt, Human
aauuugcaaaguacu

SEQ ID NO: 1759912 - RNA, 16 nt, Human
aauuugcaaaguacug

SEQ ID NO: 1759913 - RNA, 17 nt, Human
aauuugcaaaguacugu

SEQ ID NO: 1759914 - RNA, 18 nt, Human
aauuugcaaaguacugua

SEQ ID NO: 1759915 - RNA, 19 nt, Human
aauuugcaaaguacuguaa

SEQ ID NO: 1759916 - RNA, 19 nt, Human
aauuuacuggacaaagaau

SEQ ID NO: 1759917 - RNA, 15 nt, Human
aauuuagaaaaagaa

SEQ ID NO: 1759918 - RNA, 16 nt, Human
aauuuagaaaaagaac

SEQ ID NO: 1759919 - RNA, 17 nt, Human
aauuuagaaaaagaaca

SEQ ID NO: 1759920 - RNA, 21 nt, Human
aauuuagaaaaagaacaugca

SEQ ID NO: 1759921 - RNA, 15 nt, Human
aauuuauacaauauc

SEQ ID NO: 1759922 - RNA, 15 nt, Human
aauuuauaguaauga

SEQ ID NO: 1759923 - RNA, 18 nt, Human
aauuuauaguaaugaguu

SEQ ID NO: 1759924 - RNA, 20 nt, Human
aauuuauaguaaugaguuua

SEQ ID NO: 1759925 - RNA, 17 nt, Human
aauuuauacaauaucau

SEQ ID NO: 1759926 - RNA, 12 nt, Human
aauuuauuaaau

SEQ ID NO: 1759927 - RNA, 14 nt, Human
uauaaggaagauuu

SEQ ID NO: 1759928 - RNA, 23 nt, Human
uauaaguaaagugauuaaagugc

SEQ ID NO: 1759929 - RNA, 16 nt, Human
uauaaggcagccuuga

SEQ ID NO: 1759930 - RNA, 15 nt, Human
acacucacuucucuu

SEQ ID NO: 1759931 - RNA, 19 nt, Human
acacuuugccauauuuuca

SEQ ID NO: 1759932 - RNA, 19 nt, Human
acacuuguccccaaauccg

SEQ ID NO: 1759933 - RNA, 14 nt, Human
acacuuaaauuaug

SEQ ID NO: 1759934 - RNA, 17 nt, Human
acagacuggaagcacag

SEQ ID NO: 1759935 - RNA, 19 nt, Human
acagacuggaagcacagcu

SEQ ID NO: 1759936 - RNA, 21 nt, Human
acagacuggaagcacagcuuc

SEQ ID NO: 1759937 - RNA, 22 nt, Human
acagacuggaagcacagcuuca

SEQ ID NO: 1759938 - RNA, 18 nt, Human
acagacacaggcccggcu

SEQ ID NO: 1759939 - RNA, 22 nt, Human
acagacacaggcccggcuccag

SEQ ID NO: 1759940 - RNA, 17 nt, Human
acagacacaggcccggc

SEQ ID NO: 1759941 - RNA, 12 nt, Human
uauauuuacaaa

SEQ ID NO: 1759942 - RNA, 14 nt, Human
uauauucauauauu

SEQ ID NO: 1759943 - RNA, 14 nt, Human
acagagcuucccug

SEQ ID NO: 1759944 - RNA, 15 nt, Human
acagagcuucccuga

SEQ ID NO: 1759945 - RNA, 16 nt, Human
acagagcuucccugac

SEQ ID NO: 1759946 - RNA, 19 nt, Human
acagccgauucaccugagc

SEQ ID NO: 1759947 - RNA, 12 nt, Human
acagaugcucca

SEQ ID NO: 1759948 - RNA, 14 nt, Human
acagaugcuccagg

SEQ ID NO: 1759949 - RNA, 19 nt, Human
acagauguucccccaucuc

SEQ ID NO: 1759950 - RNA, 13 nt, Human
acagauuaauauu

SEQ ID NO: 1759951 - RNA, 12 nt, Human
uagucgugagcu

SEQ ID NO: 1759952 - RNA, 21 nt, Human
uagucgugagcucuugugagg

SEQ ID NO: 1759953 - RNA, 13 nt, Human
uaguagagacagg

SEQ ID NO: 1759954 - RNA, 13 nt, Human
uagucuuaccuaa

SEQ ID NO: 1759955 - RNA, 11 nt, Human
acacagugagu

SEQ ID NO: 1759956 - RNA, 13 nt, Human
acacagugagucg

SEQ ID NO: 1759957 - RNA, 16 nt, Human
uaguaagcaucuacuu

SEQ ID NO: 1759958 - RNA, 11 nt, Human
acacacagcuc

SEQ ID NO: 1759959 - RNA, 12 nt, Human
acacacagcucu

SEQ ID NO: 1759960 - RNA, 21 nt, Human
acacacauauaaacaucacac

SEQ ID NO: 1759961 - RNA, 14 nt, Human
acacacacauacac

SEQ ID NO: 1759962 - RNA, 17 nt, Human
acaauggggauguugug

SEQ ID NO: 1759963 - RNA, 22 nt, Human
acaaugcaguucugagcaccgu

SEQ ID NO: 1759964 - RNA, 14 nt, Human
acaccugcccuaaa

SEQ ID NO: 1759965 - RNA, 16 nt, Human
acacuaaccacgcugg

SEQ ID NO: 1759966 - RNA, 17 nt, Human
acacuaaccacgcugga

SEQ ID NO: 1759967 - RNA, 19 nt, Human
acacuaaccacgcuggacc

SEQ ID NO: 1759968 - RNA, 14 nt, Human
acaccuugacaggg

SEQ ID NO: 1759969 - RNA, 15 nt, Human
acaccuugacagggc

SEQ ID NO: 1759970 - RNA, 16 nt, Human
acaccuugacagggca

SEQ ID NO: 1759971 - RNA, 17 nt, Human
acacccacucagcuccg

SEQ ID NO: 1759972 - RNA, 21 nt, Human
uauaaaaucagccaauuaugu

SEQ ID NO: 1759973 - RNA, 15 nt, Human
uauaaaauuaagcaa

SEQ ID NO: 1759974 - RNA, 15 nt, Human
acacccacucagcuc

SEQ ID NO: 1759975 - RNA, 12 nt, Human
acacccagccca

SEQ ID NO: 1759976 - RNA, 13 nt, Human
acacccagcccac

SEQ ID NO: 1759977 - RNA, 20 nt, Human
uauaaaaucagccaauuaug

SEQ ID NO: 1759978 - RNA, 19 nt, Human
uauaaaaucagccaauuau

SEQ ID NO: 1759979 - RNA, 17 nt, Human
uauaaaaucagccaauu

SEQ ID NO: 1759980 - RNA, 16 nt, Human
uauaaaaucagccaau

SEQ ID NO: 1759981 - RNA, 14 nt, Human
uauaaaaucagcca

SEQ ID NO: 1759982 - RNA, 20 nt, Human
uaguuuucuuuccuccuuuc

SEQ ID NO: 1759983 - RNA, 18 nt, Human
uaguucagguaacaggca

SEQ ID NO: 1759984 - RNA, 12 nt, Human
ucaccccagggc

SEQ ID NO: 1759985 - RNA, 13 nt, Human
ucaccccagggcc

SEQ ID NO: 1759986 - RNA, 15 nt, Human
ucaccccagggccug

SEQ ID NO: 1759987 - RNA, 16 nt, Human
ucaccccagggccuga

SEQ ID NO: 1759988 - RNA, 19 nt, Human
ucaccccagggccugagcc

SEQ ID NO: 1759989 - RNA, 20 nt, Human
ucaccccagggccugagccu

SEQ ID NO: 1759990 - RNA, 21 nt, Human
ucaccccagggccugagccug

SEQ ID NO: 1759991 - RNA, 20 nt, Human
ucacaaauccuaaaagaagc

SEQ ID NO: 1759992 - RNA, 16 nt, Human
ucacaccugcccuaaa

SEQ ID NO: 1759993 - RNA, 17 nt, Human
ucacaccugcccuaaac

SEQ ID NO: 1759994 - RNA, 12 nt, Human
ucacauaucugu

SEQ ID NO: 1759995 - RNA, 15 nt, Human
ucacauaucugucau

SEQ ID NO: 1759996 - RNA, 16 nt, Human
ucacaguucaaaauuc

SEQ ID NO: 1759997 - RNA, 19 nt, Human
ucacaguucaaaauucuaa

SEQ ID NO: 1759998 - RNA, 23 nt, Human
ucacaguucaaaauucuaaaugu

SEQ ID NO: 1759999 - RNA, 15 nt, Human
ucaauucuugccaaa

SEQ ID NO: 1760000 - RNA, 18 nt, Human
accagaacaguaugaauu

SEQ ID NO: 1760001 - RNA, 12 nt, Human
accagagcccac

SEQ ID NO: 1760002 - RNA, 14 nt, Human
accagagcccaccu

SEQ ID NO: 1760003 - RNA, 16 nt, Human
accagagcccaccuug

SEQ ID NO: 1760004 - RNA, 14 nt, Human
accagacaccuuga

SEQ ID NO: 1760005 - RNA, 12 nt, Human
ucaccugauuca

SEQ ID NO: 1760006 - RNA, 18 nt, Human
ucaccugauucaacuaaa

SEQ ID NO: 1760007 - RNA, 19 nt, Human
ucaccugauucaacuaaaa

SEQ ID NO: 1760008 - RNA, 21 nt, Human
ucaccugauucaacuaaaaaa

SEQ ID NO: 1760009 - RNA, 16 nt, Human
ucaccugaagacucau

SEQ ID NO: 1760010 - RNA, 17 nt, Human
accagagcccaccuugg

SEQ ID NO: 1760011 - RNA, 18 nt, Human
ucacuauguugcccaggc

SEQ ID NO: 1760012 - RNA, 19 nt, Human
ucacuauguugcccaggca

SEQ ID NO: 1760013 - RNA, 20 nt, Human
ucacuauguugcccaggcag

SEQ ID NO: 1760014 - RNA, 19 nt, Human
ucacucccaccugcaucug

SEQ ID NO: 1760015 - RNA, 23 nt, Human
ucacucccaccugcaucuggggc

SEQ ID NO: 1760016 - RNA, 14 nt, Human
ucaccucuuccgac

SEQ ID NO: 1760017 - RNA, 21 nt, Human
ucaccuucguuuacuaugccu

SEQ ID NO: 1760018 - RNA, 16 nt, Human
ucaccuucaguaaccc

SEQ ID NO: 1760019 - RNA, 20 nt, Human
ucaccugugcuucgggcccu

SEQ ID NO: 1760020 - RNA, 21 nt, Human
ucaccugugcuucgggcccuu

SEQ ID NO: 1760021 - RNA, 16 nt, Human
accccuucgcuccugu

SEQ ID NO: 1760022 - RNA, 14 nt, Human
accccuucgcuccu

SEQ ID NO: 1760023 - RNA, 15 nt, Human
accccuucgcuccug

SEQ ID NO: 1760024 - RNA, 20 nt, Human
ucagcuucuauccuugacuu

SEQ ID NO: 1760025 - RNA, 20 nt, Human
ucagcuuguaaauagcucag

SEQ ID NO: 1760026 - RNA, 19 nt, Human
ucagcuauuuacugccaaa

SEQ ID NO: 1760027 - RNA, 20 nt, Human
ucagcuauuuacugccaaag

SEQ ID NO: 1760028 - RNA, 14 nt, Human
ucagcggggacagc

SEQ ID NO: 1760029 - RNA, 15 nt, Human
ucaggaaaggaauca

SEQ ID NO: 1760030 - RNA, 19 nt, Human
acccagcgagcccuggugg

SEQ ID NO: 1760031 - RNA, 23 nt, Human
acccagcgagcccugguggcagu

SEQ ID NO: 1760032 - RNA, 17 nt, Human
ucagcauuugaucuguu

SEQ ID NO: 1760033 - RNA, 18 nt, Human
ucagagcuaaacuccuuc

SEQ ID NO: 1760034 - RNA, 22 nt, Human
ucagagcuaaacuccuuccugg

SEQ ID NO: 1760035 - RNA, 17 nt, Human
ucagagccuuuccucaa

SEQ ID NO: 1760036 - RNA, 20 nt, Human
ucagagccuuuccucaaaac

SEQ ID NO: 1760037 - RNA, 24 nt, Human
acccagcgagcccugguggcagug

SEQ ID NO: 1760038 - RNA, 13 nt, Human
acccagggaacag

SEQ ID NO: 1760039 - RNA, 22 nt, Human
acccagggaacagccacucccc

SEQ ID NO: 1760040 - RNA, 12 nt, Human
acccagggccug

SEQ ID NO: 1760041 - RNA, 13 nt, Human
acccagggccugc

SEQ ID NO: 1760042 - RNA, 14 nt, Human
acccagggccugca

SEQ ID NO: 1760043 - RNA, 10 nt, Human
accccagggc

SEQ ID NO: 1760044 - RNA, 12 nt, Human
ucagagccugca

SEQ ID NO: 1760045 - RNA, 13 nt, Human
ucagagccugcag

SEQ ID NO: 1760046 - RNA, 14 nt, Human
ucagagccugcagu

SEQ ID NO: 1760047 - RNA, 15 nt, Human
ucagagccugcaguu

SEQ ID NO: 1760048 - RNA, 18 nt, Human
ucagagccugcaguuauu

SEQ ID NO: 1760049 - RNA, 14 nt, Human
ucagaagacacuga

SEQ ID NO: 1760050 - RNA, 16 nt, Human
ucagaagccucugggu

SEQ ID NO: 1760051 - RNA, 22 nt, Human
acccagaggaaggggccagagg

SEQ ID NO: 1760052 - RNA, 15 nt, Human
acccagcccucaucc

SEQ ID NO: 1760053 - RNA, 16 nt, Human
acccagcccucauccc

SEQ ID NO: 1760054 - RNA, 21 nt, Human
ucagaagggagcuagccagag

SEQ ID NO: 1760055 - RNA, 23 nt, Human
ucagaagggagcuagccagagga

SEQ ID NO: 1760056 - RNA, 21 nt, Human
ucacucuuauugcccacgcug

SEQ ID NO: 1760057 - RNA, 23 nt, Human
ucacucuuauugcccacgcugga

SEQ ID NO: 1760058 - RNA, 17 nt, Human
accauguagaaaauuug

SEQ ID NO: 1760059 - RNA, 18 nt, Human
accauugaauucuugguu

SEQ ID NO: 1760060 - RNA, 17 nt, Human
acccagacggcuccacu

SEQ ID NO: 1760061 - RNA, 21 nt, Human
acccagacggcuccacuagga

SEQ ID NO: 1760062 - RNA, 22 nt, Human
acccagacggcuccacuaggac

SEQ ID NO: 1760063 - RNA, 13 nt, Human
acccacugcucug

SEQ ID NO: 1760064 - RNA, 14 nt, Human
acccacugcucugg

SEQ ID NO: 1760065 - RNA, 15 nt, Human
acccacugcucuggu

SEQ ID NO: 1760066 - RNA, 11 nt, Human
acccacugcuu

SEQ ID NO: 1760067 - RNA, 10 nt, Human
acccacugcu

SEQ ID NO: 1760068 - RNA, 11 nt, Human
acccacugcuc

SEQ ID NO: 1760069 - RNA, 13 nt, Human
acccacucagcuc

SEQ ID NO: 1760070 - RNA, 15 nt, Human
acccacucgguccca

SEQ ID NO: 1760071 - RNA, 23 nt, Human
accauuucuugagguaaaagcau

SEQ ID NO: 1760072 - RNA, 24 nt, Human
ucaaaacuggagucccaaauguca

SEQ ID NO: 1760073 - RNA, 15 nt, Human
uauuuuucucuccug

SEQ ID NO: 1760074 - RNA, 16 nt, Human
ucaaaagauaauauuu

SEQ ID NO: 1760075 - RNA, 12 nt, Human
ucaaaaucuuuc

SEQ ID NO: 1760076 - RNA, 14 nt, Human
ucaaagcugaaaug

SEQ ID NO: 1760077 - RNA, 17 nt, Human
ucaaaauucuaaaugua

SEQ ID NO: 1760078 - RNA, 13 nt, Human
ucaaaauuugcug

SEQ ID NO: 1760079 - RNA, 23 nt, Human
ucaaaauuugcugccaaaugcgu

SEQ ID NO: 1760080 - RNA, 12 nt, Human
ucaaagccagcg

SEQ ID NO: 1760081 - RNA, 22 nt, Human
ucaaagccagcguccuccucug

SEQ ID NO: 1760082 - RNA, 23 nt, Human
ucaaagccagcguccuccucugu

SEQ ID NO: 1760083 - RNA, 23 nt, Human
ucaaauaaagagagaacaggacu

SEQ ID NO: 1760084 - RNA, 15 nt, Human
acaugaagauucuuu

SEQ ID NO: 1760085 - RNA, 17 nt, Human
acaugaagauucuuucc

SEQ ID NO: 1760086 - RNA, 18 nt, Human
acaugaagauucuuuccc

SEQ ID NO: 1760087 - RNA, 22 nt, Human
acaugaagauucuuucccaauu

SEQ ID NO: 1760088 - RNA, 13 nt, Human
acauucaggagcu

SEQ ID NO: 1760089 - RNA, 12 nt, Human
acaugucuuaau

SEQ ID NO: 1760090 - RNA, 18 nt, Human
ucaacaccuuaauaugcu

SEQ ID NO: 1760091 - RNA, 22 nt, Human
ucaacaccuuaauaugcugcaa

SEQ ID NO: 1760092 - RNA, 14 nt, Human
ucaagaagggcugc

SEQ ID NO: 1760093 - RNA, 15 nt, Human
ucaagaagggcugca

SEQ ID NO: 1760094 - RNA, 18 nt, Human
ucaagaagggcugcauga

SEQ ID NO: 1760095 - RNA, 20 nt, Human
ucaagaagggcugcaugaug

SEQ ID NO: 1760096 - RNA, 19 nt, Human
ucaagaugggggcagggcu

SEQ ID NO: 1760097 - RNA, 20 nt, Human
ucaagaugggggcagggcug

SEQ ID NO: 1760098 - RNA, 21 nt, Human
ucaagaugggggcagggcugu

SEQ ID NO: 1760099 - RNA, 21 nt, Human
acaucuugcucugcugacaga

SEQ ID NO: 1760100 - RNA, 18 nt, Human
acaucuugcucugcugac

SEQ ID NO: 1760101 - RNA, 19 nt, Human
acaucuugcucugcugaca

SEQ ID NO: 1760102 - RNA, 13 nt, Human
acaucuugcucug

SEQ ID NO: 1760103 - RNA, 14 nt, Human
acaucuugcucugc

SEQ ID NO: 1760104 - RNA, 16 nt, Human
acaucuucagcaaaua

SEQ ID NO: 1760105 - RNA, 24 nt, Human
acaucuuccauuuccauguccccu

SEQ ID NO: 1760106 - RNA, 20 nt, Human
acaucuugaauacucugccc

SEQ ID NO: 1760107 - RNA, 15 nt, Human
acaucugugucuugu

SEQ ID NO: 1760108 - RNA, 16 nt, Human
acaucugugucuuguu

SEQ ID NO: 1760109 - RNA, 19 nt, Human
acaucacucucaccuucca

SEQ ID NO: 1760110 - RNA, 16 nt, Human
acaucacaccugcccu

SEQ ID NO: 1760111 - RNA, 13 nt, Human
acaucacacacac

SEQ ID NO: 1760112 - RNA, 20 nt, Human
acauauuagugcagccaagu

SEQ ID NO: 1760113 - RNA, 21 nt, Human
acauauuagugcagccaagua

SEQ ID NO: 1760114 - RNA, 19 nt, Human
acauauggucuccauuuua

SEQ ID NO: 1760115 - RNA, 23 nt, Human
acauauggucuccauuuuacagu

SEQ ID NO: 1760116 - RNA, 15 nt, Human
acauaguuuuucagu

SEQ ID NO: 1760117 - RNA, 20 nt, Human
acauauaaacaucacacaca

SEQ ID NO: 1760118 - RNA, 15 nt, Human
acauacgcuuuuaau

SEQ ID NO: 1760119 - RNA, 16 nt, Human
acaguugcucuaugcu

SEQ ID NO: 1760120 - RNA, 19 nt, Human
acaguugcucuaugcuuuc

SEQ ID NO: 1760121 - RNA, 15 nt, Human
uauuucgaaagcugc

SEQ ID NO: 1760122 - RNA, 21 nt, Human
accugaaaacacugugcacau

SEQ ID NO: 1760123 - RNA, 11 nt, Human
accugaaaaca

SEQ ID NO: 1760124 - RNA, 18 nt, Human
accugaaaacacugugca

SEQ ID NO: 1760125 - RNA, 19 nt, Human
accugaaaacacugugcac

SEQ ID NO: 1760126 - RNA, 20 nt, Human
accugaaaacacugugcaca

SEQ ID NO: 1760127 - RNA, 16 nt, Human
accugcaucuggggcc

SEQ ID NO: 1760128 - RNA, 17 nt, Human
accugcaucuggggccc

SEQ ID NO: 1760129 - RNA, 13 nt, Human
accuccugggcua

SEQ ID NO: 1760130 - RNA, 12 nt, Human
ucauucuucugu

SEQ ID NO: 1760131 - RNA, 14 nt, Human
ucauucuuugcagg

SEQ ID NO: 1760132 - RNA, 18 nt, Human
ucauucucugucucaucc

SEQ ID NO: 1760133 - RNA, 19 nt, Human
ucauucucugucucaucca

SEQ ID NO: 1760134 - RNA, 18 nt, Human
ucauucugaaggagcccc

SEQ ID NO: 1760135 - RNA, 21 nt, Human
ucauuaaugacacuugucccc

SEQ ID NO: 1760136 - RNA, 14 nt, Human
ucauucucugucuc

SEQ ID NO: 1760137 - RNA, 15 nt, Human
ucauucucugucuca

SEQ ID NO: 1760138 - RNA, 16 nt, Human
ucauucucugucucau

SEQ ID NO: 1760139 - RNA, 14 nt, Human
ucauuaaugacacu

SEQ ID NO: 1760140 - RNA, 13 nt, Human
ucauuaaugacac

SEQ ID NO: 1760141 - RNA, 15 nt, Human
ucauuaaugacacuu

SEQ ID NO: 1760142 - RNA, 19 nt, Human
ucauuaaugacacuugucc

SEQ ID NO: 1760143 - RNA, 22 nt, Human
ucauuaaugacacuugucccca

SEQ ID NO: 1760144 - RNA, 18 nt, Human
ucauccuauucuuucgaa

SEQ ID NO: 1760145 - RNA, 21 nt, Human
ucaucccgagcaccuccacau

SEQ ID NO: 1760146 - RNA, 23 nt, Human
ucaucccgagcaccuccacaucc

SEQ ID NO: 1760147 - RNA, 23 nt, Human
accuccugccucgaacuggcugc

SEQ ID NO: 1760148 - RNA, 13 nt, Human
accuccugccucg

SEQ ID NO: 1760149 - RNA, 12 nt, Human
accuccugccuc

SEQ ID NO: 1760150 - RNA, 22 nt, Human
ucaggaaaggaaucauuucuau

SEQ ID NO: 1760151 - RNA, 15 nt, Human
accuacccauacacc

SEQ ID NO: 1760152 - RNA, 19 nt, Human
accuacauguuauucuagu

SEQ ID NO: 1760153 - RNA, 22 nt, Human
accugccacccugggccuggca

SEQ ID NO: 1760154 - RNA, 15 nt, Human
accugcauuguaaau

SEQ ID NO: 1760155 - RNA, 16 nt, Human
uccaagcuggucccac

SEQ ID NO: 1760156 - RNA, 20 nt, Human
uccaagcuggucccacucag

SEQ ID NO: 1760157 - RNA, 16 nt, Human
uccaauccuauguuuu

SEQ ID NO: 1760158 - RNA, 21 nt, Human
uccaagcuggucccacucagu

SEQ ID NO: 1760159 - RNA, 12 nt, Human
uccaagcuucca

SEQ ID NO: 1760160 - RNA, 22 nt, Human
uccaagcuuccauagcugcugc

SEQ ID NO: 1760161 - RNA, 18 nt, Human
uccacccaccucagccuc

SEQ ID NO: 1760162 - RNA, 19 nt, Human
uccacccaccucagccucc

SEQ ID NO: 1760163 - RNA, 12 nt, Human
uccacccaggag

SEQ ID NO: 1760164 - RNA, 14 nt, Human
uccacccaggagcc

SEQ ID NO: 1760165 - RNA, 15 nt, Human
uccacccaggagccc

SEQ ID NO: 1760166 - RNA, 19 nt, Human
uccagacccggcugcgugg

SEQ ID NO: 1760167 - RNA, 15 nt, Human
uccagacccggcugc

SEQ ID NO: 1760168 - RNA, 18 nt, Human
uccagacccggcugcgug

SEQ ID NO: 1760169 - RNA, 17 nt, Human
uccacgacugucuccau

SEQ ID NO: 1760170 - RNA, 18 nt, Human
uccacgacugucuccaug

SEQ ID NO: 1760171 - RNA, 19 nt, Human
uccacgacugucuccaugg

SEQ ID NO: 1760172 - RNA, 13 nt, Human
accuuuuggggga

SEQ ID NO: 1760173 - RNA, 17 nt, Human
accuuuugggggagggc

SEQ ID NO: 1760174 - RNA, 14 nt, Human
uccacgacugucuc

SEQ ID NO: 1760175 - RNA, 15 nt, Human
uccacgacugucucc

SEQ ID NO: 1760176 - RNA, 16 nt, Human
uccacgacugucucca

SEQ ID NO: 1760177 - RNA, 22 nt, Human
accuuagauguucuaagucuuu

SEQ ID NO: 1760178 - RNA, 19 nt, Human
accuucaaacuagggccaa

SEQ ID NO: 1760179 - RNA, 14 nt, Human
uccaggcuguaucc

SEQ ID NO: 1760180 - RNA, 14 nt, Human
uccaggcacugaga

SEQ ID NO: 1760181 - RNA, 16 nt, Human
uccaggcacugagaua

SEQ ID NO: 1760182 - RNA, 21 nt, Human
uccaggcuguaucccaugagc

SEQ ID NO: 1760183 - RNA, 14 nt, Human
acgagaaaacaaua

SEQ ID NO: 1760184 - RNA, 19 nt, Human
acgagcuguuuacuaggga

SEQ ID NO: 1760185 - RNA, 19 nt, Human
acgagcaccuccagccuga

SEQ ID NO: 1760186 - RNA, 15 nt, Human
acuacaggcacccac

SEQ ID NO: 1760187 - RNA, 11 nt, Human
acuacaggcac

SEQ ID NO: 1760188 - RNA, 12 nt, Human
acuaaccacgcu

SEQ ID NO: 1760189 - RNA, 17 nt, Human
acuaacaggauauuuaa

SEQ ID NO: 1760190 - RNA, 22 nt, Human
ucccagcacuaugcuuuccuuc

SEQ ID NO: 1760191 - RNA, 17 nt, Human
ucccagcugugcucugg

SEQ ID NO: 1760192 - RNA, 24 nt, Human
uccccauuagcuuucaauuccgua

SEQ ID NO: 1760193 - RNA, 14 nt, Human
ucccaucaaaacuc

SEQ ID NO: 1760194 - RNA, 23 nt, Human
acgugggcugggcccacaaaggc

SEQ ID NO: 1760195 - RNA, 13 nt, Human
ucccaaagugcug

SEQ ID NO: 1760196 - RNA, 14 nt, Human
ucccaaagugcugg

SEQ ID NO: 1760197 - RNA, 12 nt, Human
uccauuugcaag

SEQ ID NO: 1760198 - RNA, 14 nt, Human
acuccucugacuca

SEQ ID NO: 1760199 - RNA, 20 nt, Human
acuccucugacucagggcuc

SEQ ID NO: 1760200 - RNA, 15 nt, Human
acucauucuucugua

SEQ ID NO: 1760201 - RNA, 15 nt, Human
acucauuccagaucc

SEQ ID NO: 1760202 - RNA, 19 nt, Human
acucauuccagaucccagg

SEQ ID NO: 1760203 - RNA, 15 nt, Human
acucauucugaagga

SEQ ID NO: 1760204 - RNA, 19 nt, Human
acucauucugaaggagccc

SEQ ID NO: 1760205 - RNA, 13 nt, Human
acucagaaagcca

SEQ ID NO: 1760206 - RNA, 14 nt, Human
acucagaaagccaa

SEQ ID NO: 1760207 - RNA, 15 nt, Human
acucagaaagccaac

SEQ ID NO: 1760208 - RNA, 15 nt, Human
ucccuuaaacaaaaa

SEQ ID NO: 1760209 - RNA, 22 nt, Human
ucccuuaaacaaaaauuaaaau

SEQ ID NO: 1760210 - RNA, 13 nt, Human
ucccugucaccuc

SEQ ID NO: 1760211 - RNA, 14 nt, Human
ucccugucaccucu

SEQ ID NO: 1760212 - RNA, 15 nt, Human
ucccugucaccucuu

SEQ ID NO: 1760213 - RNA, 17 nt, Human
ucccugucaccucuucc

SEQ ID NO: 1760214 - RNA, 18 nt, Human
ucccugucaccucuuccg

SEQ ID NO: 1760215 - RNA, 20 nt, Human
uccgggggggcccaucucuu

SEQ ID NO: 1760216 - RNA, 16 nt, Human
uccggcucccagccuc

SEQ ID NO: 1760217 - RNA, 17 nt, Human
uccggcucccagccuca

SEQ ID NO: 1760218 - RNA, 18 nt, Human
uccggcucccagccucag

SEQ ID NO: 1760219 - RNA, 21 nt, Human
uccggcucccagccucagcgc

SEQ ID NO: 1760220 - RNA, 21 nt, Human
uccgggaccuggugcugccuc

SEQ ID NO: 1760221 - RNA, 13 nt, Human
uccggcugugcug

SEQ ID NO: 1760222 - RNA, 15 nt, Human
uccggcugugcuggg

SEQ ID NO: 1760223 - RNA, 16 nt, Human
uccggcugugcuggga

SEQ ID NO: 1760224 - RNA, 19 nt, Human
uccggcugugcugggagaa

SEQ ID NO: 1760225 - RNA, 13 nt, Human
ucccuccaucccc

SEQ ID NO: 1760226 - RNA, 15 nt, Human
ucccggcucuguggg

SEQ ID NO: 1760227 - RNA, 14 nt, Human
ucccugacugggag

SEQ ID NO: 1760228 - RNA, 14 nt, Human
ucccugaggauggg

SEQ ID NO: 1760229 - RNA, 15 nt, Human
ucccugaggaugggu

SEQ ID NO: 1760230 - RNA, 22 nt, Human
ucccugaggaugggucagagcu

SEQ ID NO: 1760231 - RNA, 23 nt, Human
ucccugaggaugggucagagcua

SEQ ID NO: 1760232 - RNA, 15 nt, Human
ucccugacugggagu

SEQ ID NO: 1760233 - RNA, 16 nt, Human
ucccugacuuuucugu

SEQ ID NO: 1760234 - RNA, 20 nt, Human
ucccgaauagcugggacuac

SEQ ID NO: 1760235 - RNA, 12 nt, Human
uccccuuuccug

SEQ ID NO: 1760236 - RNA, 13 nt, Human
uccccuuuccugu

SEQ ID NO: 1760237 - RNA, 14 nt, Human
uccccuuuccuguc

SEQ ID NO: 1760238 - RNA, 17 nt, Human
uccccuuuccuguccca

SEQ ID NO: 1760239 - RNA, 15 nt, Human
ucccgaguagcuggg

SEQ ID NO: 1760240 - RNA, 22 nt, Human
ucccgagcaccuccacauccuc

SEQ ID NO: 1760241 - RNA, 20 nt, Human
ucccgaguagcugggacuac

SEQ ID NO: 1760242 - RNA, 18 nt, Human
ucccgaguagcugggacu

SEQ ID NO: 1760243 - RNA, 16 nt, Human
ucccgaguagcuggga

SEQ ID NO: 1760244 - RNA, 17 nt, Human
ucccgaguagcugggac

SEQ ID NO: 1760245 - RNA, 15 nt, Human
uccccucuccuuccu

SEQ ID NO: 1760246 - RNA, 16 nt, Human
uccccucuccuuccug

SEQ ID NO: 1760247 - RNA, 13 nt, Human
uccccucccagag

SEQ ID NO: 1760248 - RNA, 20 nt, Human
uccccuaagcagaccacuga

SEQ ID NO: 1760249 - RNA, 20 nt, Human
ucuaaagccauuguaguccu

SEQ ID NO: 1760250 - RNA, 12 nt, Human
acuguugcccag

SEQ ID NO: 1760251 - RNA, 13 nt, Human
acuguugcccagg

SEQ ID NO: 1760252 - RNA, 14 nt, Human
acuguugcccaggc

SEQ ID NO: 1760253 - RNA, 17 nt, Human
acuguugcccaggcugg

SEQ ID NO: 1760254 - RNA, 18 nt, Human
acuguugcccaggcuggc

SEQ ID NO: 1760255 - RNA, 22 nt, Human
acuguugggguggguauaaaag

SEQ ID NO: 1760256 - RNA, 21 nt, Human
acuguugggguggguauaaaa

SEQ ID NO: 1760257 - RNA, 20 nt, Human
acuguugggguggguauaaa

SEQ ID NO: 1760258 - RNA, 18 nt, Human
acuguugggguggguaua

SEQ ID NO: 1760259 - RNA, 23 nt, Human
acuuacccaggugggucccggcu

SEQ ID NO: 1760260 - RNA, 16 nt, Human
acuuauauuaauagua

SEQ ID NO: 1760261 - RNA, 22 nt, Human
acuuauauuaauaguaauuugu

SEQ ID NO: 1760262 - RNA, 18 nt, Human
acuuauaaaguagaaaug

SEQ ID NO: 1760263 - RNA, 17 nt, Human
acuuauaauuuuccuaa

SEQ ID NO: 1760264 - RNA, 23 nt, Human
acugggaccaacccuggggaagg

SEQ ID NO: 1760265 - RNA, 18 nt, Human
acuguccuacccacccuc

SEQ ID NO: 1760266 - RNA, 23 nt, Human
acuguccuacccacccuccuuuc

SEQ ID NO: 1760267 - RNA, 17 nt, Human
acuguccuacccacccu

SEQ ID NO: 1760268 - RNA, 21 nt, Human
ucgguacccggggcccagggc

SEQ ID NO: 1760269 - RNA, 22 nt, Human
ucgguacccggggcccagggca

SEQ ID NO: 1760270 - RNA, 11 nt, Human
ucuaaaacaau

SEQ ID NO: 1760271 - RNA, 15 nt, Human
ucuaaaacaauaaaa

SEQ ID NO: 1760272 - RNA, 14 nt, Human
ucggcucagcucgg

SEQ ID NO: 1760273 - RNA, 17 nt, Human
ucggcuuuucucagcug

SEQ ID NO: 1760274 - RNA, 13 nt, Human
ucgggcccuuccc

SEQ ID NO: 1760275 - RNA, 14 nt, Human
ucgggcuccagcca

SEQ ID NO: 1760276 - RNA, 22 nt, Human
acugcugugaacccuggggccu

SEQ ID NO: 1760277 - RNA, 23 nt, Human
acugcugugaacccuggggccug

SEQ ID NO: 1760278 - RNA, 14 nt, Human
acugcuuuuggucu

SEQ ID NO: 1760279 - RNA, 18 nt, Human
uccuagaggcccuuugcu

SEQ ID NO: 1760280 - RNA, 19 nt, Human
uccuagaggcccuuugcug

SEQ ID NO: 1760281 - RNA, 20 nt, Human
uccuagaggcccuuugcugu

SEQ ID NO: 1760282 - RNA, 21 nt, Human
uccuagaggcccuuugcuguc

SEQ ID NO: 1760283 - RNA, 18 nt, Human
uccuacuuauaaaguaga

SEQ ID NO: 1760284 - RNA, 11 nt, Human
acugccuuaau

SEQ ID NO: 1760285 - RNA, 23 nt, Human
acugccuuaauaaaaaaugaaaa

SEQ ID NO: 1760286 - RNA, 15 nt, Human
uccuuccagcccaga

SEQ ID NO: 1760287 - RNA, 15 nt, Human
uccuuuagcgcccag

SEQ ID NO: 1760288 - RNA, 19 nt, Human
uccuuuagcgcccaguugg

SEQ ID NO: 1760289 - RNA, 20 nt, Human
uccuuguagcgacuaaacua

SEQ ID NO: 1760290 - RNA, 14 nt, Human
uccuucucccaucu

SEQ ID NO: 1760291 - RNA, 18 nt, Human
uccuucucccaucucuuc

SEQ ID NO: 1760292 - RNA, 18 nt, Human
ucgcucaaucaagaaaau

SEQ ID NO: 1760293 - RNA, 13 nt, Human
ucgaggacaggga

SEQ ID NO: 1760294 - RNA, 22 nt, Human
uccuuuagcgcccaguugggug

SEQ ID NO: 1760295 - RNA, 23 nt, Human
uccuuuagcgcccaguugggugg

SEQ ID NO: 1760296 - RNA, 17 nt, Human
ucgacuucgggcuggcc

SEQ ID NO: 1760297 - RNA, 14 nt, Human
ucgagacagaaccu

SEQ ID NO: 1760298 - RNA, 12 nt, Human
agaaaaagaaca

SEQ ID NO: 1760299 - RNA, 18 nt, Human
agaaaaagaacaugcagu

SEQ ID NO: 1760300 - RNA, 22 nt, Human
agaaaaagaacaugcaguuuga

SEQ ID NO: 1760301 - RNA, 14 nt, Human
agaaacuuccaaau

SEQ ID NO: 1760302 - RNA, 13 nt, Human
agaaacaggaccg

SEQ ID NO: 1760303 - RNA, 20 nt, Human
ucucuuuaaugucacaggca

SEQ ID NO: 1760304 - RNA, 21 nt, Human
ucucuuuaaugucacaggcag

SEQ ID NO: 1760305 - RNA, 12 nt, Human
ucucugcccugu

SEQ ID NO: 1760306 - RNA, 23 nt, Human
ucucugcucugcgugucaccugu

SEQ ID NO: 1760307 - RNA, 18 nt, Human
ucugauucccaagcucug

SEQ ID NO: 1760308 - RNA, 19 nt, Human
agaaacuuccaaauccccu

SEQ ID NO: 1760309 - RNA, 12 nt, Human
ucugacacacag

SEQ ID NO: 1760310 - RNA, 21 nt, Human
ucugaauuuuggggauuuuca

SEQ ID NO: 1760311 - RNA, 22 nt, Human
ucugaauuuuggggauuuucaa

SEQ ID NO: 1760312 - RNA, 13 nt, Human
ucugaauuugcaa

SEQ ID NO: 1760313 - RNA, 14 nt, Human
ucugaauuugcaaa

SEQ ID NO: 1760314 - RNA, 15 nt, Human
ucugaauuugcaaag

SEQ ID NO: 1760315 - RNA, 16 nt, Human
ucugaauuugcaaagu

SEQ ID NO: 1760316 - RNA, 17 nt, Human
ucugaauuugcaaagua

SEQ ID NO: 1760317 - RNA, 19 nt, Human
ucugaauuugcaaaguacu

SEQ ID NO: 1760318 - RNA, 20 nt, Human
ucugaauuugcaaaguacug

SEQ ID NO: 1760319 - RNA, 21 nt, Human
ucugaauuugcaaaguacugu

SEQ ID NO: 1760320 - RNA, 22 nt, Human
ucugaauuugcaaaguacugua

SEQ ID NO: 1760321 - RNA, 13 nt, Human
acuuggauucucu

SEQ ID NO: 1760322 - RNA, 15 nt, Human
acuuggauucucuaa

SEQ ID NO: 1760323 - RNA, 13 nt, Human
acuugccucuuuu

SEQ ID NO: 1760324 - RNA, 20 nt, Human
acuugccucuuuuaccugcu

SEQ ID NO: 1760325 - RNA, 21 nt, Human
acuugccucuuuuaccugcug

SEQ ID NO: 1760326 - RNA, 22 nt, Human
acuugccucuuuuaccugcugc

SEQ ID NO: 1760327 - RNA, 23 nt, Human
acuugccucuuuuaccugcugcu

SEQ ID NO: 1760328 - RNA, 16 nt, Human
acuuguggacacagcu

SEQ ID NO: 1760329 - RNA, 17 nt, Human
acuuguccccaaauccg

SEQ ID NO: 1760330 - RNA, 22 nt, Human
acuuguccccaaauccgaaccu

SEQ ID NO: 1760331 - RNA, 17 nt, Human
acuuguggacacagcuc

SEQ ID NO: 1760332 - RNA, 18 nt, Human
acuuguggacacagcucu

SEQ ID NO: 1760333 - RNA, 20 nt, Human
acuugucauauguagccuuc

SEQ ID NO: 1760334 - RNA, 15 nt, Human
acuucuccacccugc

SEQ ID NO: 1760335 - RNA, 16 nt, Human
acuucuccacccugcu

SEQ ID NO: 1760336 - RNA, 18 nt, Human
acuucuccacccugcucu

SEQ ID NO: 1760337 - RNA, 18 nt, Human
acuuccuuaugcuucuuu

SEQ ID NO: 1760338 - RNA, 14 nt, Human
acuucgggcuggcc

SEQ ID NO: 1760339 - RNA, 16 nt, Human
ucucacuauguugccc

SEQ ID NO: 1760340 - RNA, 16 nt, Human
ucucacuauaccagua

SEQ ID NO: 1760341 - RNA, 23 nt, Human
ucucacucugcccccccccccca

SEQ ID NO: 1760342 - RNA, 16 nt, Human
ucucacucugucgccc

SEQ ID NO: 1760343 - RNA, 12 nt, Human
ucucacucuguc

SEQ ID NO: 1760344 - RNA, 14 nt, Human
acuucuccacccug

SEQ ID NO: 1760345 - RNA, 15 nt, Human
ucucaccuuccaaau

SEQ ID NO: 1760346 - RNA, 16 nt, Human
ucucaccuuccaaauc

SEQ ID NO: 1760347 - RNA, 17 nt, Human
acuucaggccaacaagg

SEQ ID NO: 1760348 - RNA, 14 nt, Human
ucuauuucuccucc

SEQ ID NO: 1760349 - RNA, 15 nt, Human
ucuauuucuccucca

SEQ ID NO: 1760350 - RNA, 16 nt, Human
ucuauuucuccuccau

SEQ ID NO: 1760351 - RNA, 20 nt, Human
ucuauuucuccuccauggga

SEQ ID NO: 1760352 - RNA, 15 nt, Human
ucuccauggcccugc

SEQ ID NO: 1760353 - RNA, 18 nt, Human
ucuccauggcccugcaaa

SEQ ID NO: 1760354 - RNA, 14 nt, Human
ucuccauggcccug

SEQ ID NO: 1760355 - RNA, 16 nt, Human
ucucccagauaaugug

SEQ ID NO: 1760356 - RNA, 18 nt, Human
ucucccagauaaugugaa

SEQ ID NO: 1760357 - RNA, 21 nt, Human
ucucccagauaaugugaaaau

SEQ ID NO: 1760358 - RNA, 23 nt, Human
ucucccagauaaugugaaaaugg

SEQ ID NO: 1760359 - RNA, 18 nt, Human
ucucccaucucuuccuug

SEQ ID NO: 1760360 - RNA, 19 nt, Human
ucucccaucucuuccuuga

SEQ ID NO: 1760361 - RNA, 20 nt, Human
ucuccuccaugggagaaaau

SEQ ID NO: 1760362 - RNA, 16 nt, Human
ucuccaggcuguaucc

SEQ ID NO: 1760363 - RNA, 21 nt, Human
ucuccagggucagaaacagga

SEQ ID NO: 1760364 - RNA, 18 nt, Human
ucuccagggucagaaaca

SEQ ID NO: 1760365 - RNA, 13 nt, Human
ucuccauccacau

SEQ ID NO: 1760366 - RNA, 19 nt, Human
ucuccauccacaugggagc

SEQ ID NO: 1760367 - RNA, 19 nt, Human
ucucauuggacccuuccau

SEQ ID NO: 1760368 - RNA, 23 nt, Human
agaaauuuauuuccuaguucugu

SEQ ID NO: 1760369 - RNA, 15 nt, Human
agaaauuuauuuccu

SEQ ID NO: 1760370 - RNA, 13 nt, Human
agaaauuuauuuc

SEQ ID NO: 1760371 - RNA, 14 nt, Human
agaaccccucugcu

SEQ ID NO: 1760372 - RNA, 16 nt, Human
agaaccccucugcuuu

SEQ ID NO: 1760373 - RNA, 16 nt, Human
agaacccugccaugga

SEQ ID NO: 1760374 - RNA, 23 nt, Human
agaacccugccauggaacuguuu

SEQ ID NO: 1760375 - RNA, 20 nt, Human
agaacccuuggcuugcccac

SEQ ID NO: 1760376 - RNA, 17 nt, Human
agaauguuacugccuua

SEQ ID NO: 1760377 - RNA, 13 nt, Human
agaauguuccaga

SEQ ID NO: 1760378 - RNA, 14 nt, Human
agaauguuccagac

SEQ ID NO: 1760379 - RNA, 19 nt, Human
agaauguuccagacauucu

SEQ ID NO: 1760380 - RNA, 16 nt, Human
agaauuagcugcuucu

SEQ ID NO: 1760381 - RNA, 15 nt, Human
ucugggucagugguc

SEQ ID NO: 1760382 - RNA, 15 nt, Human
ucuggguccuuccug

SEQ ID NO: 1760383 - RNA, 16 nt, Human
ucuggguccuuccuga

SEQ ID NO: 1760384 - RNA, 14 nt, Human
agaauuagcugcuu

SEQ ID NO: 1760385 - RNA, 14 nt, Human
ucuguggggacucc

SEQ ID NO: 1760386 - RNA, 12 nt, Human
ucuguggggccc

SEQ ID NO: 1760387 - RNA, 19 nt, Human
ucugugaccaaugucuuga

SEQ ID NO: 1760388 - RNA, 23 nt, Human
ucugugggaugggaugguggagg

SEQ ID NO: 1760389 - RNA, 18 nt, Human
ucuguacgucugacaggc

SEQ ID NO: 1760390 - RNA, 13 nt, Human
ucugguagccugc

SEQ ID NO: 1760391 - RNA, 12 nt, Human
ucuguagaaaug

SEQ ID NO: 1760392 - RNA, 21 nt, Human
ucuguagaaaugguuguauua

SEQ ID NO: 1760393 - RNA, 17 nt, Human
ucuguagaaaugguugu

SEQ ID NO: 1760394 - RNA, 22 nt, Human
ucuguagaaaugguuguauuag

SEQ ID NO: 1760395 - RNA, 20 nt, Human
ucuguaucaggacccagagg

SEQ ID NO: 1760396 - RNA, 16 nt, Human
ucugugaccaaugucu

SEQ ID NO: 1760397 - RNA, 18 nt, Human
ucugugaccaaugucuug

SEQ ID NO: 1760398 - RNA, 17 nt, Human
agacagaaccuuguuau

SEQ ID NO: 1760399 - RNA, 18 nt, Human
agacagaaccuuguuauu

SEQ ID NO: 1760400 - RNA, 23 nt, Human
agacacaggcccggcuccaggcu

SEQ ID NO: 1760401 - RNA, 22 nt, Human
agacaccuugacagggcacacc

SEQ ID NO: 1760402 - RNA, 12 nt, Human
agacacacacac

SEQ ID NO: 1760403 - RNA, 19 nt, Human
agacacaggcccggcucca

SEQ ID NO: 1760404 - RNA, 20 nt, Human
agacacaggcccggcuccag

SEQ ID NO: 1760405 - RNA, 21 nt, Human
agacacaggcccggcuccagg

SEQ ID NO: 1760406 - RNA, 22 nt, Human
agacacaggcccggcuccaggc

SEQ ID NO: 1760407 - RNA, 17 nt, Human
agacacaggcccggcuc

SEQ ID NO: 1760408 - RNA, 11 nt, Human
agacacacaca

SEQ ID NO: 1760409 - RNA, 13 nt, Human
ucuuacucuuucc

SEQ ID NO: 1760410 - RNA, 14 nt, Human
ucuuacucuuuccu

SEQ ID NO: 1760411 - RNA, 15 nt, Human
ucuuacucuuuccua

SEQ ID NO: 1760412 - RNA, 16 nt, Human
ucuuacucuuuccuau

SEQ ID NO: 1760413 - RNA, 23 nt, Human
ucuuaaugaaguuugaauguuaa

SEQ ID NO: 1760414 - RNA, 22 nt, Human
ucuuaaugaaguuugaauguua

SEQ ID NO: 1760415 - RNA, 21 nt, Human
ucuuaaugaaguuugaauguu

SEQ ID NO: 1760416 - RNA, 20 nt, Human
ucuuaaugaaguuugaaugu

SEQ ID NO: 1760417 - RNA, 19 nt, Human
ucuuaaugaaguuugaaug

SEQ ID NO: 1760418 - RNA, 18 nt, Human
ucuuaaugaaguuugaau

SEQ ID NO: 1760419 - RNA, 17 nt, Human
ucuuaaugaaguuugaa

SEQ ID NO: 1760420 - RNA, 16 nt, Human
ucuuaaugaaguuuga

SEQ ID NO: 1760421 - RNA, 15 nt, Human
ucuuaaugaaguuug

SEQ ID NO: 1760422 - RNA, 19 nt, Human
ucuuguaauccgaaucucu

SEQ ID NO: 1760423 - RNA, 22 nt, Human
ucuuuaaugucacaggcagguc

SEQ ID NO: 1760424 - RNA, 20 nt, Human
ucuuuaaugucacaggcagg

SEQ ID NO: 1760425 - RNA, 13 nt, Human
ucuugguugagga

SEQ ID NO: 1760426 - RNA, 15 nt, Human
ucuugguugaggaaa

SEQ ID NO: 1760427 - RNA, 16 nt, Human
ucuuucuuagaaauuu

SEQ ID NO: 1760428 - RNA, 15 nt, Human
ucuuucuuagaaauu

SEQ ID NO: 1760429 - RNA, 19 nt, Human
ucuuucuuagaaauuuauu

SEQ ID NO: 1760430 - RNA, 16 nt, Human
agagaauguuccagac

SEQ ID NO: 1760431 - RNA, 21 nt, Human
ucuucuguacgucugacaggc

SEQ ID NO: 1760432 - RNA, 22 nt, Human
ucuucuguacgucugacaggca

SEQ ID NO: 1760433 - RNA, 17 nt, Human
ucuucugggagggcagc

SEQ ID NO: 1760434 - RNA, 20 nt, Human
ucuucugggagggcagcagg

SEQ ID NO: 1760435 - RNA, 22 nt, Human
ucuucugcuucagccucccgag

SEQ ID NO: 1760436 - RNA, 23 nt, Human
ucuucuguacgucugacaggcaa

SEQ ID NO: 1760437 - RNA, 13 nt, Human
ucuucuucaccau

SEQ ID NO: 1760438 - RNA, 14 nt, Human
ucuucuucaccauu

SEQ ID NO: 1760439 - RNA, 15 nt, Human
ucuucuucaccauuu

SEQ ID NO: 1760440 - RNA, 14 nt, Human
agacccggcugcgu

SEQ ID NO: 1760441 - RNA, 13 nt, Human
agaccucagggca

SEQ ID NO: 1760442 - RNA, 14 nt, Human
agaccucagggcac

SEQ ID NO: 1760443 - RNA, 15 nt, Human
agaccucagggcaca

SEQ ID NO: 1760444 - RNA, 16 nt, Human
agaccuggacacaggc

SEQ ID NO: 1760445 - RNA, 18 nt, Human
agaccuggacacaggccu

SEQ ID NO: 1760446 - RNA, 19 nt, Human
agaccuggacacaggccug

SEQ ID NO: 1760447 - RNA, 15 nt, Human
agacucauucuucug

SEQ ID NO: 1760448 - RNA, 20 nt, Human
ugacaggcaaugcuggcugu

SEQ ID NO: 1760449 - RNA, 21 nt, Human
ugacacacagcucuguccugg

SEQ ID NO: 1760450 - RNA, 14 nt, Human
ugacagccugcagc

SEQ ID NO: 1760451 - RNA, 15 nt, Human
ugacagccugcagca

SEQ ID NO: 1760452 - RNA, 11 nt, Human
ugacagggcac

SEQ ID NO: 1760453 - RNA, 16 nt, Human
ugacagggcacaccgg

SEQ ID NO: 1760454 - RNA, 21 nt, Human
ugacagggcacaccgggcacu

SEQ ID NO: 1760455 - RNA, 20 nt, Human
ugacagggcacaccgggcac

SEQ ID NO: 1760456 - RNA, 13 nt, Human
ugaccaaugucuu

SEQ ID NO: 1760457 - RNA, 14 nt, Human
ugaccaaugucuug

SEQ ID NO: 1760458 - RNA, 20 nt, Human
ugacauuguuggccaaagcc

SEQ ID NO: 1760459 - RNA, 21 nt, Human
ugacauuguuggccaaagcca

SEQ ID NO: 1760460 - RNA, 17 nt, Human
agauguucuaagucuuu

SEQ ID NO: 1760461 - RNA, 21 nt, Human
agauguggccuuccauuuaua

SEQ ID NO: 1760462 - RNA, 12 nt, Human
ugacccacugcu

SEQ ID NO: 1760463 - RNA, 13 nt, Human
ugacccacugcuu

SEQ ID NO: 1760464 - RNA, 19 nt, Human
agauguucucuaucauuua

SEQ ID NO: 1760465 - RNA, 18 nt, Human
agauguucucuaucauuu

SEQ ID NO: 1760466 - RNA, 17 nt, Human
agauguucucuaucauu

SEQ ID NO: 1760467 - RNA, 15 nt, Human
agauguucucuauca

SEQ ID NO: 1760468 - RNA, 12 nt, Human
agauguucucua

SEQ ID NO: 1760469 - RNA, 20 nt, Human
agauguucuaagucuuucca

SEQ ID NO: 1760470 - RNA, 21 nt, Human
agauguucuaagucuuuccau

SEQ ID NO: 1760471 - RNA, 22 nt, Human
agauguucuaagucuuuccauu

SEQ ID NO: 1760472 - RNA, 14 nt, Human
agauguucccccau

SEQ ID NO: 1760473 - RNA, 22 nt, Human
agaugcgcauucuaaccuggag

SEQ ID NO: 1760474 - RNA, 23 nt, Human
agaugcgcauucuaaccuggagg

SEQ ID NO: 1760475 - RNA, 14 nt, Human
agaugcaccagccc

SEQ ID NO: 1760476 - RNA, 15 nt, Human
agaugcaccagcccu

SEQ ID NO: 1760477 - RNA, 22 nt, Human
ugaaugucuuuuuucaaacuuu

SEQ ID NO: 1760478 - RNA, 15 nt, Human
agagucagcucucug

SEQ ID NO: 1760479 - RNA, 16 nt, Human
agagucagcucucugc

SEQ ID NO: 1760480 - RNA, 17 nt, Human
agagucagcucucugcc

SEQ ID NO: 1760481 - RNA, 18 nt, Human
agagucagcucucugccc

SEQ ID NO: 1760482 - RNA, 19 nt, Human
agagucagcucucugcccu

SEQ ID NO: 1760483 - RNA, 20 nt, Human
agagucagcucucugcccug

SEQ ID NO: 1760484 - RNA, 21 nt, Human
agagucagcucucugcccugu

SEQ ID NO: 1760485 - RNA, 15 nt, Human
agagucuggcccuag

SEQ ID NO: 1760486 - RNA, 13 nt, Human
agagucuggcccu

SEQ ID NO: 1760487 - RNA, 15 nt, Human
agauacucucuucuu

SEQ ID NO: 1760488 - RNA, 18 nt, Human
agauacucucuucuucuc

SEQ ID NO: 1760489 - RNA, 14 nt, Human
agaucacgccacug

SEQ ID NO: 1760490 - RNA, 15 nt, Human
agaucacgccacugc

SEQ ID NO: 1760491 - RNA, 16 nt, Human
agaucacgccacugca

SEQ ID NO: 1760492 - RNA, 13 nt, Human
agauauucugcuc

SEQ ID NO: 1760493 - RNA, 17 nt, Human
agaucacgccacugcac

SEQ ID NO: 1760494 - RNA, 18 nt, Human
agaucacgccacugcacu

SEQ ID NO: 1760495 - RNA, 13 nt, Human
ugaauuuuugcaa

SEQ ID NO: 1760496 - RNA, 14 nt, Human
ugaauuuuugcaau

SEQ ID NO: 1760497 - RNA, 15 nt, Human
ugaauuuuugcaaua

SEQ ID NO: 1760498 - RNA, 16 nt, Human
ugaauuuuugcaauaa

SEQ ID NO: 1760499 - RNA, 17 nt, Human
ugaauuuuugcaauaau

SEQ ID NO: 1760500 - RNA, 22 nt, Human
ugaauuuuugcaauaaugcagu

SEQ ID NO: 1760501 - RNA, 23 nt, Human
ugaauuuuugcaauaaugcagua

SEQ ID NO: 1760502 - RNA, 15 nt, Human
agagcuucuuccagg

SEQ ID NO: 1760503 - RNA, 12 nt, Human
ugaacuccuggc

SEQ ID NO: 1760504 - RNA, 14 nt, Human
ugaacuccuggccu

SEQ ID NO: 1760505 - RNA, 15 nt, Human
ugaacuccuggccuc

SEQ ID NO: 1760506 - RNA, 22 nt, Human
agaggcucguugacuggcugug

SEQ ID NO: 1760507 - RNA, 19 nt, Human
agaggccaugggccuccug

SEQ ID NO: 1760508 - RNA, 10 nt, Human
agaggcaggg

SEQ ID NO: 1760509 - RNA, 13 nt, Human
agaggcagggucu

SEQ ID NO: 1760510 - RNA, 13 nt, Human
agaggcagcccca

SEQ ID NO: 1760511 - RNA, 19 nt, Human
agaggcagccccauucugc

SEQ ID NO: 1760512 - RNA, 22 nt, Human
agagcuucuuccaggugcccag

SEQ ID NO: 1760513 - RNA, 23 nt, Human
agagcuucuuccaggugcccagc

SEQ ID NO: 1760514 - RNA, 13 nt, Human
agagcuuuucaga

SEQ ID NO: 1760515 - RNA, 14 nt, Human
agagcuuuucagau

SEQ ID NO: 1760516 - RNA, 15 nt, Human
agagcuuuucagauu

SEQ ID NO: 1760517 - RNA, 20 nt, Human
agagcuuuucagauugugga

SEQ ID NO: 1760518 - RNA, 13 nt, Human
agaggaaaaauau

SEQ ID NO: 1760519 - RNA, 12 nt, Human
agaggaaaagaa

SEQ ID NO: 1760520 - RNA, 15 nt, Human
agagccaccaagagg

SEQ ID NO: 1760521 - RNA, 19 nt, Human
agagccaccaagagggacg

SEQ ID NO: 1760522 - RNA, 15 nt, Human
ucuuugggaauauuu

SEQ ID NO: 1760523 - RNA, 20 nt, Human
ucuuugggaauauuugaauc

SEQ ID NO: 1760524 - RNA, 18 nt, Human
ucuuugggaauauuugaa

SEQ ID NO: 1760525 - RNA, 16 nt, Human
ucuuugggaauauuug

SEQ ID NO: 1760526 - RNA, 19 nt, Human
agagcuaaacuccuuccug

SEQ ID NO: 1760527 - RNA, 20 nt, Human
agagcuaaacuccuuccugg

SEQ ID NO: 1760528 - RNA, 19 nt, Human
agagccuuuccucaaaacu

SEQ ID NO: 1760529 - RNA, 15 nt, Human
agagcgcgccccuag

SEQ ID NO: 1760530 - RNA, 20 nt, Human
agagcgcgccccuagccggu

SEQ ID NO: 1760531 - RNA, 15 nt, Human
ugaaauuguauuaca

SEQ ID NO: 1760532 - RNA, 12 nt, Human
ugaaauaugcau

SEQ ID NO: 1760533 - RNA, 20 nt, Human
ugaaauaucccggggguggg

SEQ ID NO: 1760534 - RNA, 13 nt, Human
agcagggaaacag

SEQ ID NO: 1760535 - RNA, 14 nt, Human
agcagggaaacagc

SEQ ID NO: 1760536 - RNA, 15 nt, Human
agcagggaaacagcu

SEQ ID NO: 1760537 - RNA, 22 nt, Human
agcagggcucagcggggacagc

SEQ ID NO: 1760538 - RNA, 23 nt, Human
agcagggcuacccugagcugagg

SEQ ID NO: 1760539 - RNA, 17 nt, Human
agcagguagccugcugg

SEQ ID NO: 1760540 - RNA, 18 nt, Human
agcagguagccugcuggu

SEQ ID NO: 1760541 - RNA, 13 nt, Human
agcagggcucagc

SEQ ID NO: 1760542 - RNA, 14 nt, Human
agcagggcucagcg

SEQ ID NO: 1760543 - RNA, 15 nt, Human
agcagggcucagcgg

SEQ ID NO: 1760544 - RNA, 14 nt, Human
agcagcagcccaag

SEQ ID NO: 1760545 - RNA, 21 nt, Human
agcagcagcccaagcuucccu

SEQ ID NO: 1760546 - RNA, 13 nt, Human
agcagcagguagc

SEQ ID NO: 1760547 - RNA, 20 nt, Human
agcagcagguagccugcugg

SEQ ID NO: 1760548 - RNA, 20 nt, Human
agcaggaauauaugugugcc

SEQ ID NO: 1760549 - RNA, 21 nt, Human
agcaggaauauaugugugccu

SEQ ID NO: 1760550 - RNA, 13 nt, Human
agcaggaccucug

SEQ ID NO: 1760551 - RNA, 22 nt, Human
agcaggaccucugaaacccugg

SEQ ID NO: 1760552 - RNA, 14 nt, Human
agcaggaggccagg

SEQ ID NO: 1760553 - RNA, 15 nt, Human
agcaggaggccaggc

SEQ ID NO: 1760554 - RNA, 18 nt, Human
ugagucaccaagcccagu

SEQ ID NO: 1760555 - RNA, 16 nt, Human
agcauaucugauuguu

SEQ ID NO: 1760556 - RNA, 15 nt, Human
ugagucaucuguuag

SEQ ID NO: 1760557 - RNA, 20 nt, Human
ugagucaucuguuagggccu

SEQ ID NO: 1760558 - RNA, 21 nt, Human
ugagucaucuguuagggccuu

SEQ ID NO: 1760559 - RNA, 15 nt, Human
ugagugcaguccuga

SEQ ID NO: 1760560 - RNA, 18 nt, Human
ugaguucauacccuguua

SEQ ID NO: 1760561 - RNA, 13 nt, Human
agcauaucugccu

SEQ ID NO: 1760562 - RNA, 15 nt, Human
agcauaucugccuuu

SEQ ID NO: 1760563 - RNA, 21 nt, Human
agcaguagaaauaauaugcau

SEQ ID NO: 1760564 - RNA, 22 nt, Human
agcaguagaaauaauaugcauu

SEQ ID NO: 1760565 - RNA, 22 nt, Human
ugaugaaaugaggucagagccu

SEQ ID NO: 1760566 - RNA, 23 nt, Human
ugaugaaaugaggucagagccug

SEQ ID NO: 1760567 - RNA, 19 nt, Human
ugaugaucuuugcagacag

SEQ ID NO: 1760568 - RNA, 20 nt, Human
ugaugaucuuugcagacagg

SEQ ID NO: 1760569 - RNA, 21 nt, Human
ugaugaucuuugcagacaggc

SEQ ID NO: 1760570 - RNA, 21 nt, Human
ugaucuaccuugaauugauau

SEQ ID NO: 1760571 - RNA, 21 nt, Human
ugaugggcaacccccagccug

SEQ ID NO: 1760572 - RNA, 22 nt, Human
ugaugggcaacccccagccugc

SEQ ID NO: 1760573 - RNA, 20 nt, Human
ugauuaaagugcucacguua

SEQ ID NO: 1760574 - RNA, 16 nt, Human
ugauggucuucagccu

SEQ ID NO: 1760575 - RNA, 16 nt, Human
agccacggccaggcca

SEQ ID NO: 1760576 - RNA, 15 nt, Human
agccaauuauguuaa

SEQ ID NO: 1760577 - RNA, 17 nt, Human
agccaauuauguuaaac

SEQ ID NO: 1760578 - RNA, 16 nt, Human
agccaauuauguuaaa

SEQ ID NO: 1760579 - RNA, 20 nt, Human
agccaauuauguuaaacuag

SEQ ID NO: 1760580 - RNA, 18 nt, Human
ugauccucccaccucagc

SEQ ID NO: 1760581 - RNA, 19 nt, Human
ugauccucccaccucagcc

SEQ ID NO: 1760582 - RNA, 20 nt, Human
ugauccucccaccucagccu

SEQ ID NO: 1760583 - RNA, 13 nt, Human
agccacaguggga

SEQ ID NO: 1760584 - RNA, 18 nt, Human
ugaucacggcucacugca

SEQ ID NO: 1760585 - RNA, 15 nt, Human
ugaucacggcucacu

SEQ ID NO: 1760586 - RNA, 13 nt, Human
ugaucacggcuca

SEQ ID NO: 1760587 - RNA, 14 nt, Human
ugaucacggcucac

SEQ ID NO: 1760588 - RNA, 18 nt, Human
agcauucacaacuuguuu

SEQ ID NO: 1760589 - RNA, 16 nt, Human
agcauggguucauccu

SEQ ID NO: 1760590 - RNA, 19 nt, Human
agcauguaacuuauauuaa

SEQ ID NO: 1760591 - RNA, 19 nt, Human
agcauucgagacagaaccu

SEQ ID NO: 1760592 - RNA, 19 nt, Human
agcauucucaggcaccagu

SEQ ID NO: 1760593 - RNA, 15 nt, Human
agcauuugaucuguu

SEQ ID NO: 1760594 - RNA, 22 nt, Human
agcauuugaucuguugcaagcc

SEQ ID NO: 1760595 - RNA, 17 nt, Human
agcauuugaaugcauuu

SEQ ID NO: 1760596 - RNA, 23 nt, Human
agcauuuuagcaauuuauacaau

SEQ ID NO: 1760597 - RNA, 14 nt, Human
agccccgaggccuu

SEQ ID NO: 1760598 - RNA, 17 nt, Human
agccccgguggcugggc

SEQ ID NO: 1760599 - RNA, 19 nt, Human
agccccgguggcugggcag

SEQ ID NO: 1760600 - RNA, 13 nt, Human
ugcaccagcccuu

SEQ ID NO: 1760601 - RNA, 23 nt, Human
ugcaccaggguugaccccagagg

SEQ ID NO: 1760602 - RNA, 13 nt, Human
ugcagaaguaagc

SEQ ID NO: 1760603 - RNA, 11 nt, Human
ugcaagggaaa

SEQ ID NO: 1760604 - RNA, 20 nt, Human
ugcaagggaguuagggaaau

SEQ ID NO: 1760605 - RNA, 13 nt, Human
ugcaacaggcugg

SEQ ID NO: 1760606 - RNA, 14 nt, Human
ugcaacaaaaugua

SEQ ID NO: 1760607 - RNA, 16 nt, Human
ugcaacaaaauguaga

SEQ ID NO: 1760608 - RNA, 17 nt, Human
ugcaacaaaauguagaa

SEQ ID NO: 1760609 - RNA, 20 nt, Human
ugcaacaaaauguagaauau

SEQ ID NO: 1760610 - RNA, 19 nt, Human
ugcaaauccuaugugauuu

SEQ ID NO: 1760611 - RNA, 17 nt, Human
ugcaaauccuaugugau

SEQ ID NO: 1760612 - RNA, 18 nt, Human
ugcaaauccuaugugauu

SEQ ID NO: 1760613 - RNA, 21 nt, Human
ugcaaauccuaugugauuuua

SEQ ID NO: 1760614 - RNA, 10 nt, Human
ugcaaauccu

SEQ ID NO: 1760615 - RNA, 12 nt, Human
ugcaaauccuau

SEQ ID NO: 1760616 - RNA, 14 nt, Human
ugcaaauccuaugu

SEQ ID NO: 1760617 - RNA, 15 nt, Human
ugcaaauccuaugug

SEQ ID NO: 1760618 - RNA, 19 nt, Human
ugcaagccccucuuucugu

SEQ ID NO: 1760619 - RNA, 17 nt, Human
agccacggccaggccag

SEQ ID NO: 1760620 - RNA, 18 nt, Human
agccacggccaggccaga

SEQ ID NO: 1760621 - RNA, 17 nt, Human
ugauuuauuugcuucuu

SEQ ID NO: 1760622 - RNA, 16 nt, Human
ugauuuccccccuccg

SEQ ID NO: 1760623 - RNA, 20 nt, Human
ugauuuccccccuccgccuc

SEQ ID NO: 1760624 - RNA, 16 nt, Human
ugcaaagaaaaucaga

SEQ ID NO: 1760625 - RNA, 12 nt, Human
ugcaaagaaaau

SEQ ID NO: 1760626 - RNA, 21 nt, Human
ugcaaaggguaucaggugcug

SEQ ID NO: 1760627 - RNA, 13 nt, Human
ugcaaaguacugu

SEQ ID NO: 1760628 - RNA, 14 nt, Human
ugcaaaguacugua

SEQ ID NO: 1760629 - RNA, 15 nt, Human
ugcaaaguacuguaa

SEQ ID NO: 1760630 - RNA, 21 nt, Human
ugcaaaguacuguaagaauaa

SEQ ID NO: 1760631 - RNA, 10 nt, Human
ugcaaagugu

SEQ ID NO: 1760632 - RNA, 19 nt, Human
ugcaaaguguuuuguacca

SEQ ID NO: 1760633 - RNA, 21 nt, Human
ugcaaaguguuuuguaccagu

SEQ ID NO: 1760634 - RNA, 22 nt, Human
ugcaaaguguuuuguaccagug

SEQ ID NO: 1760635 - RNA, 13 nt, Human
agccugaguagaa

SEQ ID NO: 1760636 - RNA, 22 nt, Human
agccugaguagaaaggccuuua

SEQ ID NO: 1760637 - RNA, 17 nt, Human
agccugaguagaaaggc

SEQ ID NO: 1760638 - RNA, 16 nt, Human
agccugagucaccugc

SEQ ID NO: 1760639 - RNA, 19 nt, Human
agccugagucaccugcaga

SEQ ID NO: 1760640 - RNA, 23 nt, Human
agccugaguagaaaggccuuuaa

SEQ ID NO: 1760641 - RNA, 22 nt, Human
agccuuagaagucacacaguau

SEQ ID NO: 1760642 - RNA, 20 nt, Human
agccuuagaagucacacagu

SEQ ID NO: 1760643 - RNA, 14 nt, Human
ugccaaucaauagc

SEQ ID NO: 1760644 - RNA, 13 nt, Human
ugcauugugcuuc

SEQ ID NO: 1760645 - RNA, 15 nt, Human
ugcauugugcuucuu

SEQ ID NO: 1760646 - RNA, 12 nt, Human
ugcauugugcuu

SEQ ID NO: 1760647 - RNA, 12 nt, Human
ugcauuguaaau

SEQ ID NO: 1760648 - RNA, 18 nt, Human
ugcauuguaucgauguua

SEQ ID NO: 1760649 - RNA, 13 nt, Human
ugccacagccucc

SEQ ID NO: 1760650 - RNA, 17 nt, Human
ugccacagccuccccug

SEQ ID NO: 1760651 - RNA, 21 nt, Human
ugccacagccuccccugccag

SEQ ID NO: 1760652 - RNA, 22 nt, Human
ugccacagccuccccugccagg

SEQ ID NO: 1760653 - RNA, 22 nt, Human
ugccagcucuguaucaggaccc

SEQ ID NO: 1760654 - RNA, 12 nt, Human
ugcagacaggca

SEQ ID NO: 1760655 - RNA, 13 nt, Human
ugcagacaggcaa

SEQ ID NO: 1760656 - RNA, 21 nt, Human
ugcagacaggcaagcaccucc

SEQ ID NO: 1760657 - RNA, 13 nt, Human
ugcagguggggag

SEQ ID NO: 1760658 - RNA, 23 nt, Human
ugcagguggggguugcuguauaa

SEQ ID NO: 1760659 - RNA, 16 nt, Human
ugcaggugaaacccag

SEQ ID NO: 1760660 - RNA, 21 nt, Human
agccucuuucugucccuucug

SEQ ID NO: 1760661 - RNA, 15 nt, Human
agccucuuucugucc

SEQ ID NO: 1760662 - RNA, 18 nt, Human
agccucuuucugucccuu

SEQ ID NO: 1760663 - RNA, 22 nt, Human
agccucugggucagugguccac

SEQ ID NO: 1760664 - RNA, 23 nt, Human
agccucugggucagugguccaca

SEQ ID NO: 1760665 - RNA, 16 nt, Human
ugcaugcccucucagg

SEQ ID NO: 1760666 - RNA, 19 nt, Human
ugcaugcacuguucccccu

SEQ ID NO: 1760667 - RNA, 22 nt, Human
ugcaugcacuguucccccugug

SEQ ID NO: 1760668 - RNA, 14 nt, Human
ugcaugcccucuca

SEQ ID NO: 1760669 - RNA, 15 nt, Human
ugcaugcccucucag

SEQ ID NO: 1760670 - RNA, 21 nt, Human
ugcaucucacuggaugcaaag

SEQ ID NO: 1760671 - RNA, 18 nt, Human
ugcaucuuuuuuucauuu

SEQ ID NO: 1760672 - RNA, 16 nt, Human
ugcaguaugguacauu

SEQ ID NO: 1760673 - RNA, 17 nt, Human
ugcaguaugguacauuu

SEQ ID NO: 1760674 - RNA, 22 nt, Human
ugcaguaugguacauuuuucaa

SEQ ID NO: 1760675 - RNA, 15 nt, Human
ugcagguucauggau

SEQ ID NO: 1760676 - RNA, 13 nt, Human
aggaucagucuga

SEQ ID NO: 1760677 - RNA, 19 nt, Human
aggaugagcucuacccagg

SEQ ID NO: 1760678 - RNA, 13 nt, Human
aggaggcuccaga

SEQ ID NO: 1760679 - RNA, 16 nt, Human
aggaggcuccagaggg

SEQ ID NO: 1760680 - RNA, 17 nt, Human
aggaggcuccagagggc

SEQ ID NO: 1760681 - RNA, 18 nt, Human
aggaggcuccagagggca

SEQ ID NO: 1760682 - RNA, 19 nt, Human
aggaggcuccagagggcac

SEQ ID NO: 1760683 - RNA, 17 nt, Human
uggaagagcccagucug

SEQ ID NO: 1760684 - RNA, 21 nt, Human
uggaagagcccagucuguuga

SEQ ID NO: 1760685 - RNA, 12 nt, Human
ugcuugaggaaa

SEQ ID NO: 1760686 - RNA, 16 nt, Human
ugcuugaggaaaacaa

SEQ ID NO: 1760687 - RNA, 13 nt, Human
ugcuugaggaaaa

SEQ ID NO: 1760688 - RNA, 23 nt, Human
aggagcccuuaucugugcucagg

SEQ ID NO: 1760689 - RNA, 16 nt, Human
ugcuugaaggcccugc

SEQ ID NO: 1760690 - RNA, 19 nt, Human
ugcuugaaggcccugcuga

SEQ ID NO: 1760691 - RNA, 20 nt, Human
ugcuuuugucuaugggacuc

SEQ ID NO: 1760692 - RNA, 18 nt, Human
ugcuuuuggucuguguga

SEQ ID NO: 1760693 - RNA, 18 nt, Human
aggacucagaagccucug

SEQ ID NO: 1760694 - RNA, 15 nt, Human
aggacgugggcuggg

SEQ ID NO: 1760695 - RNA, 19 nt, Human
aggacgugggcugggccca

SEQ ID NO: 1760696 - RNA, 12 nt, Human
aggacucucagg

SEQ ID NO: 1760697 - RNA, 20 nt, Human
aggaccuucgggcugugccc

SEQ ID NO: 1760698 - RNA, 18 nt, Human
aggaccuucgggcugugc

SEQ ID NO: 1760699 - RNA, 19 nt, Human
aggaccuucgggcugugcc

SEQ ID NO: 1760700 - RNA, 21 nt, Human
aggagcccuuaucugugcuca

SEQ ID NO: 1760701 - RNA, 17 nt, Human
aggagccccgaggccuu

SEQ ID NO: 1760702 - RNA, 15 nt, Human
aggagccccauuccu

SEQ ID NO: 1760703 - RNA, 16 nt, Human
aggagccccauuccug

SEQ ID NO: 1760704 - RNA, 18 nt, Human
aggagccccauuccuggg

SEQ ID NO: 1760705 - RNA, 19 nt, Human
aggagccccauuccuggga

SEQ ID NO: 1760706 - RNA, 21 nt, Human
aggagccccauuccugggaaa

SEQ ID NO: 1760707 - RNA, 17 nt, Human
aggagaugcuccuuggg

SEQ ID NO: 1760708 - RNA, 18 nt, Human
aggagaugcuccuugggc

SEQ ID NO: 1760709 - RNA, 22 nt, Human
aggagaugcuccuugggcccuu

SEQ ID NO: 1760710 - RNA, 15 nt, Human
aggagcacacccagc

SEQ ID NO: 1760711 - RNA, 16 nt, Human
aggagaugcuccuugg

SEQ ID NO: 1760712 - RNA, 22 nt, Human
aggacuuuucuuuguggcuucc

SEQ ID NO: 1760713 - RNA, 17 nt, Human
aggacuuuucuuugugg

SEQ ID NO: 1760714 - RNA, 19 nt, Human
aggacuuuucuuuguggcu

SEQ ID NO: 1760715 - RNA, 12 nt, Human
aggcagggucuc

SEQ ID NO: 1760716 - RNA, 22 nt, Human
aggcaggucuugaacuccuggc

SEQ ID NO: 1760717 - RNA, 13 nt, Human
aggcauugccaag

SEQ ID NO: 1760718 - RNA, 14 nt, Human
aggcauugccaagg

SEQ ID NO: 1760719 - RNA, 16 nt, Human
aggcauugccaagggc

SEQ ID NO: 1760720 - RNA, 18 nt, Human
aggcauugccaagggcuu

SEQ ID NO: 1760721 - RNA, 20 nt, Human
aggcauugccaagggcuuug

SEQ ID NO: 1760722 - RNA, 21 nt, Human
aggcauugccaagggcuuugu

SEQ ID NO: 1760723 - RNA, 18 nt, Human
aggauugcuacuguccua

SEQ ID NO: 1760724 - RNA, 15 nt, Human
aggauugcuacuguc

SEQ ID NO: 1760725 - RNA, 17 nt, Human
aggauugcuacuguccu

SEQ ID NO: 1760726 - RNA, 19 nt, Human
uggagcacugggcucccgg

SEQ ID NO: 1760727 - RNA, 21 nt, Human
uggagcacugggcucccgggc

SEQ ID NO: 1760728 - RNA, 12 nt, Human
uggagcacuggg

SEQ ID NO: 1760729 - RNA, 15 nt, Human
uggagcacugggcuc

SEQ ID NO: 1760730 - RNA, 17 nt, Human
uggagcacugggcuccc

SEQ ID NO: 1760731 - RNA, 12 nt, Human
uggagcagaggg

SEQ ID NO: 1760732 - RNA, 13 nt, Human
uggagcagagggg

SEQ ID NO: 1760733 - RNA, 16 nt, Human
uggagcagaggggcug

SEQ ID NO: 1760734 - RNA, 20 nt, Human
aggcaagcaccuccugccuc

SEQ ID NO: 1760735 - RNA, 18 nt, Human
aggcaagcaccuccugcc

SEQ ID NO: 1760736 - RNA, 19 nt, Human
aggcaagcaccuccugccu

SEQ ID NO: 1760737 - RNA, 15 nt, Human
uggagcaucaagcca

SEQ ID NO: 1760738 - RNA, 17 nt, Human
uggagcaucaagccacu

SEQ ID NO: 1760739 - RNA, 17 nt, Human
uggagcagaggggcuga

SEQ ID NO: 1760740 - RNA, 17 nt, Human
aggcaagcaccuccugc

SEQ ID NO: 1760741 - RNA, 18 nt, Human
uggcacccggccccugcu

SEQ ID NO: 1760742 - RNA, 19 nt, Human
uggcacccggccccugcug

SEQ ID NO: 1760743 - RNA, 20 nt, Human
uggcacccggccccugcugg

SEQ ID NO: 1760744 - RNA, 14 nt, Human
aggcccaaccuccu

SEQ ID NO: 1760745 - RNA, 13 nt, Human
aggcccggcucca

SEQ ID NO: 1760746 - RNA, 14 nt, Human
uggagugcagugag

SEQ ID NO: 1760747 - RNA, 14 nt, Human
uggaguugaaaauc

SEQ ID NO: 1760748 - RNA, 19 nt, Human
uggaguguuccccuuccac

SEQ ID NO: 1760749 - RNA, 22 nt, Human
uggaguguuccccuuccacuga

SEQ ID NO: 1760750 - RNA, 20 nt, Human
uggaguguuucuaauaaacu

SEQ ID NO: 1760751 - RNA, 24 nt, Human
uggaguguuucuaauaaacuugga

SEQ ID NO: 1760752 - RNA, 20 nt, Human
uggaggucagcauuugaucu

SEQ ID NO: 1760753 - RNA, 21 nt, Human
uggaugccugguggcagcugc

SEQ ID NO: 1760754 - RNA, 23 nt, Human
uggaugccugguggcagcugcgg

SEQ ID NO: 1760755 - RNA, 17 nt, Human
uggaugcgcagugccuu

SEQ ID NO: 1760756 - RNA, 17 nt, Human
uggauucucuaaccuuu

SEQ ID NO: 1760757 - RNA, 14 nt, Human
uggauucugaaucu

SEQ ID NO: 1760758 - RNA, 24 nt, Human
ugccugcccaggccccugccaccc

SEQ ID NO: 1760759 - RNA, 20 nt, Human
ugccugcccaggccccugcc

SEQ ID NO: 1760760 - RNA, 22 nt, Human
ugccugcccaggccccugccac

SEQ ID NO: 1760761 - RNA, 23 nt, Human
ugccugcccaggccccugccacc

SEQ ID NO: 1760762 - RNA, 14 nt, Human
ugccucagccuccc

SEQ ID NO: 1760763 - RNA, 18 nt, Human
ugccucugccucugacac

SEQ ID NO: 1760764 - RNA, 20 nt, Human
ugccucugccucugacacac

SEQ ID NO: 1760765 - RNA, 17 nt, Human
ugccucugccucugaca

SEQ ID NO: 1760766 - RNA, 19 nt, Human
agcugccuguucagcucca

SEQ ID NO: 1760767 - RNA, 18 nt, Human
agcugccuguucagcucc

SEQ ID NO: 1760768 - RNA, 14 nt, Human
agcugccuguucag

SEQ ID NO: 1760769 - RNA, 16 nt, Human
agcugccuguucagcu

SEQ ID NO: 1760770 - RNA, 19 nt, Human
agcugugcucuggacaggc

SEQ ID NO: 1760771 - RNA, 17 nt, Human
agcugugcucuggacag

SEQ ID NO: 1760772 - RNA, 18 nt, Human
agcugugcucuggacagg

SEQ ID NO: 1760773 - RNA, 20 nt, Human
agcugggacuacaggcaccc

SEQ ID NO: 1760774 - RNA, 23 nt, Human
agcugggacuacaggcacccacc

SEQ ID NO: 1760775 - RNA, 16 nt, Human
agcugggacuacaggu

SEQ ID NO: 1760776 - RNA, 20 nt, Human
ugccuuaauaaaaaaugaaa

SEQ ID NO: 1760777 - RNA, 23 nt, Human
agcugugugacauuuggagaggg

SEQ ID NO: 1760778 - RNA, 17 nt, Human
agcugcccuaugggccu

SEQ ID NO: 1760779 - RNA, 18 nt, Human
agcugcccuaugggccug

SEQ ID NO: 1760780 - RNA, 19 nt, Human
agcugcccuaugggccugc

SEQ ID NO: 1760781 - RNA, 21 nt, Human
agcugcccuaugggccugccg

SEQ ID NO: 1760782 - RNA, 16 nt, Human
agcucuguccugggag

SEQ ID NO: 1760783 - RNA, 21 nt, Human
agcucuguccugggagugagc

SEQ ID NO: 1760784 - RNA, 23 nt, Human
agcucuguccugggagugagcug

SEQ ID NO: 1760785 - RNA, 11 nt, Human
agcugcaaagu

SEQ ID NO: 1760786 - RNA, 12 nt, Human
agcugcaaagug

SEQ ID NO: 1760787 - RNA, 13 nt, Human
agcugcaaagugu

SEQ ID NO: 1760788 - RNA, 14 nt, Human
agcugcaaaguguu

SEQ ID NO: 1760789 - RNA, 15 nt, Human
agcugcaaaguguuu

SEQ ID NO: 1760790 - RNA, 19 nt, Human
agcugcaaaguguuuugua

SEQ ID NO: 1760791 - RNA, 20 nt, Human
agcugcaaaguguuuuguac

SEQ ID NO: 1760792 - RNA, 12 nt, Human
ugccucagccuc

SEQ ID NO: 1760793 - RNA, 13 nt, Human
ugccucagccucc

SEQ ID NO: 1760794 - RNA, 13 nt, Human
ugccgauuucugu

SEQ ID NO: 1760795 - RNA, 18 nt, Human
ugccgauuucuguaaacu

SEQ ID NO: 1760796 - RNA, 20 nt, Human
ugccgauuucuguaaacucu

SEQ ID NO: 1760797 - RNA, 15 nt, Human
ugcccuuaaaucaua

SEQ ID NO: 1760798 - RNA, 23 nt, Human
agcugcccuccccuccggacugg

SEQ ID NO: 1760799 - RNA, 19 nt, Human
agcucugaaaccaguguua

SEQ ID NO: 1760800 - RNA, 16 nt, Human
agcuccuucuguccua

SEQ ID NO: 1760801 - RNA, 21 nt, Human
agcuccuucuguccuacucug

SEQ ID NO: 1760802 - RNA, 14 nt, Human
agcucggcucagcu

SEQ ID NO: 1760803 - RNA, 13 nt, Human
agcucucugcccu

SEQ ID NO: 1760804 - RNA, 14 nt, Human
agcucucugcccug

SEQ ID NO: 1760805 - RNA, 16 nt, Human
agcucucugcccugug

SEQ ID NO: 1760806 - RNA, 17 nt, Human
agcucucugcccugugu

SEQ ID NO: 1760807 - RNA, 18 nt, Human
agcucucugcccugugua

SEQ ID NO: 1760808 - RNA, 19 nt, Human
agcucucugcccuguguac

SEQ ID NO: 1760809 - RNA, 18 nt, Human
agcucugaaaccaguguu

SEQ ID NO: 1760810 - RNA, 22 nt, Human
agcucgguacccggggcccagg

SEQ ID NO: 1760811 - RNA, 15 nt, Human
agcucgguacccggg

SEQ ID NO: 1760812 - RNA, 22 nt, Human
agcuccaucaaugagguaucuu

SEQ ID NO: 1760813 - RNA, 15 nt, Human
agcucccaggugcag

SEQ ID NO: 1760814 - RNA, 15 nt, Human
agcuccuucuguccu

SEQ ID NO: 1760815 - RNA, 20 nt, Human
agcucccaggugcagccaga

SEQ ID NO: 1760816 - RNA, 21 nt, Human
agcucccaggugcagccagag

SEQ ID NO: 1760817 - RNA, 22 nt, Human
agcucccaggugcagccagagg

SEQ ID NO: 1760818 - RNA, 13 nt, Human
ugccaucaucucc

SEQ ID NO: 1760819 - RNA, 15 nt, Human
ugccaucaucuccug

SEQ ID NO: 1760820 - RNA, 16 nt, Human
ugccaucaucuccugc

SEQ ID NO: 1760821 - RNA, 23 nt, Human
ugccaucaucuccugccuuccuc

SEQ ID NO: 1760822 - RNA, 21 nt, Human
ugccauauugcacaugucuua

SEQ ID NO: 1760823 - RNA, 13 nt, Human
ugccauauuuuca

SEQ ID NO: 1760824 - RNA, 14 nt, Human
ugccauauuuucac

SEQ ID NO: 1760825 - RNA, 17 nt, Human
ugccauauuuucaccau

SEQ ID NO: 1760826 - RNA, 21 nt, Human
aggaagaucucugcagggccg

SEQ ID NO: 1760827 - RNA, 20 nt, Human
aggaagaucucugcagggcc

SEQ ID NO: 1760828 - RNA, 13 nt, Human
aggaagauuugga

SEQ ID NO: 1760829 - RNA, 23 nt, Human
aggaaagucauuggcuuuauccu

SEQ ID NO: 1760830 - RNA, 22 nt, Human
aggaaagucauuggcuuuaucc

SEQ ID NO: 1760831 - RNA, 20 nt, Human
aggaaagucauuggcuuuau

SEQ ID NO: 1760832 - RNA, 19 nt, Human
aggaaagucauuggcuuua

SEQ ID NO: 1760833 - RNA, 17 nt, Human
aggaaagucauuggcuu

SEQ ID NO: 1760834 - RNA, 16 nt, Human
aggaaagucauuggcu

SEQ ID NO: 1760835 - RNA, 13 nt, Human
aggaaagucauug

SEQ ID NO: 1760836 - RNA, 14 nt, Human
aggaaagggaggag

SEQ ID NO: 1760837 - RNA, 22 nt, Human
aggaaagggaggaguggaggug

SEQ ID NO: 1760838 - RNA, 16 nt, Human
aggaaaagcugcugac

SEQ ID NO: 1760839 - RNA, 19 nt, Human
ugcuccagggaugauucaa

SEQ ID NO: 1760840 - RNA, 19 nt, Human
ugcucugaucauccacugu

SEQ ID NO: 1760841 - RNA, 16 nt, Human
ugcucugagccacagu

SEQ ID NO: 1760842 - RNA, 14 nt, Human
ugcucugcugacag

SEQ ID NO: 1760843 - RNA, 15 nt, Human
ugcucugcugacaga

SEQ ID NO: 1760844 - RNA, 16 nt, Human
ugcucugcugacagac

SEQ ID NO: 1760845 - RNA, 22 nt, Human
ugcucugcgugucaccugugcu

SEQ ID NO: 1760846 - RNA, 23 nt, Human
ugcucugcgugucaccugugcuu

SEQ ID NO: 1760847 - RNA, 16 nt, Human
agcuguuuacuaggga

SEQ ID NO: 1760848 - RNA, 22 nt, Human
agcuguuuacuagggaucccuc

SEQ ID NO: 1760849 - RNA, 16 nt, Human
ugcuaagugugaacug

SEQ ID NO: 1760850 - RNA, 15 nt, Human
ugcuaagugugaacu

SEQ ID NO: 1760851 - RNA, 14 nt, Human
ugcuaagugugaac

SEQ ID NO: 1760852 - RNA, 13 nt, Human
ugcuaagugugaa

SEQ ID NO: 1760853 - RNA, 19 nt, Human
ugcuaagugugaacuggac

SEQ ID NO: 1760854 - RNA, 17 nt, Human
ugcuaagugugaacugg

SEQ ID NO: 1760855 - RNA, 14 nt, Human
ugcgguccacccag

SEQ ID NO: 1760856 - RNA, 15 nt, Human
ugcgguccacccagg

SEQ ID NO: 1760857 - RNA, 22 nt, Human
agcuuucauguaaacugugcac

SEQ ID NO: 1760858 - RNA, 14 nt, Human
aggaaaagcugcug

SEQ ID NO: 1760859 - RNA, 23 nt, Human
agguggggcagcuugaggguugg

SEQ ID NO: 1760860 - RNA, 14 nt, Human
aggugauccaccca

SEQ ID NO: 1760861 - RNA, 20 nt, Human
aggugauccacccaccucag

SEQ ID NO: 1760862 - RNA, 21 nt, Human
aggugauccacccaccucagc

SEQ ID NO: 1760863 - RNA, 16 nt, Human
aggugccauggaagag

SEQ ID NO: 1760864 - RNA, 17 nt, Human
aggugccauggaagagg

SEQ ID NO: 1760865 - RNA, 21 nt, Human
aggugccauggaagaggcuac

SEQ ID NO: 1760866 - RNA, 15 nt, Human
agguggggguugcug

SEQ ID NO: 1760867 - RNA, 17 nt, Human
aggugugaaccaccaca

SEQ ID NO: 1760868 - RNA, 15 nt, Human
aggugugcucugauc

SEQ ID NO: 1760869 - RNA, 20 nt, Human
aggugugcucugaucaucca

SEQ ID NO: 1760870 - RNA, 12 nt, Human
ugguuaggaugg

SEQ ID NO: 1760871 - RNA, 22 nt, Human
ugguuaggauggcaggacgugg

SEQ ID NO: 1760872 - RNA, 15 nt, Human
uguaaauagcucagg

SEQ ID NO: 1760873 - RNA, 16 nt, Human
uguaaauagcucaggu

SEQ ID NO: 1760874 - RNA, 18 nt, Human
uguaaauagguucuucuu

SEQ ID NO: 1760875 - RNA, 19 nt, Human
uguaaaguugguuggauaa

SEQ ID NO: 1760876 - RNA, 20 nt, Human
uguaaaguugguuggauaag

SEQ ID NO: 1760877 - RNA, 22 nt, Human
aggugacagagugagacucugu

SEQ ID NO: 1760878 - RNA, 19 nt, Human
aggucagcauuugaucugu

SEQ ID NO: 1760879 - RNA, 13 nt, Human
aggugaccccagg

SEQ ID NO: 1760880 - RNA, 18 nt, Human
aggucuugaacuccuggc

SEQ ID NO: 1760881 - RNA, 17 nt, Human
aggucuugaacuccugg

SEQ ID NO: 1760882 - RNA, 13 nt, Human
aggugacagagug

SEQ ID NO: 1760883 - RNA, 15 nt, Human
aggugacagagugag

SEQ ID NO: 1760884 - RNA, 16 nt, Human
aggucuugaacuccug

SEQ ID NO: 1760885 - RNA, 13 nt, Human
aggucagagccug

SEQ ID NO: 1760886 - RNA, 14 nt, Human
aggucagagccugc

SEQ ID NO: 1760887 - RNA, 15 nt, Human
aggucagagccugca

SEQ ID NO: 1760888 - RNA, 17 nt, Human
aggucagagccugcagu

SEQ ID NO: 1760889 - RNA, 18 nt, Human
aggucagagccugcaguu

SEQ ID NO: 1760890 - RNA, 13 nt, Human
ugguggagggcca

SEQ ID NO: 1760891 - RNA, 14 nt, Human
ugguggcagcugcg

SEQ ID NO: 1760892 - RNA, 13 nt, Human
ugguggcagcugc

SEQ ID NO: 1760893 - RNA, 15 nt, Human
ugguggcagcugcgg

SEQ ID NO: 1760894 - RNA, 12 nt, Human
ugguggcagugg

SEQ ID NO: 1760895 - RNA, 16 nt, Human
uggugcgaucuggguu

SEQ ID NO: 1760896 - RNA, 17 nt, Human
uggugcgaucuggguuc

SEQ ID NO: 1760897 - RNA, 16 nt, Human
uggugcuacgccugca

SEQ ID NO: 1760898 - RNA, 23 nt, Human
agucacacaguauuacuucugcu

SEQ ID NO: 1760899 - RNA, 15 nt, Human
agucacacagugagu

SEQ ID NO: 1760900 - RNA, 23 nt, Human
agucacacagugagucgaggaca

SEQ ID NO: 1760901 - RNA, 15 nt, Human
aguaugguggcuggg

SEQ ID NO: 1760902 - RNA, 16 nt, Human
aguaugguggcugggu

SEQ ID NO: 1760903 - RNA, 15 nt, Human
aguauuacuucugcu

SEQ ID NO: 1760904 - RNA, 17 nt, Human
aguaugguggcuggguu

SEQ ID NO: 1760905 - RNA, 18 nt, Human
aguauuacuucugcuaca

SEQ ID NO: 1760906 - RNA, 13 nt, Human
uguaucauaauua

SEQ ID NO: 1760907 - RNA, 16 nt, Human
uguaucauaauuacca

SEQ ID NO: 1760908 - RNA, 19 nt, Human
uguaucauaauuaccaagu

SEQ ID NO: 1760909 - RNA, 15 nt, Human
uguauccaggccugg

SEQ ID NO: 1760910 - RNA, 13 nt, Human
uguauuacaaauc

SEQ ID NO: 1760911 - RNA, 22 nt, Human
uguauuacaaauccaaugaaau

SEQ ID NO: 1760912 - RNA, 18 nt, Human
ugucaagggcagaaugaa

SEQ ID NO: 1760913 - RNA, 14 nt, Human
ugucaagcugcucu

SEQ ID NO: 1760914 - RNA, 15 nt, Human
ugucaagcugcucug

SEQ ID NO: 1760915 - RNA, 18 nt, Human
ugucaagcugcucugagc

SEQ ID NO: 1760916 - RNA, 19 nt, Human
ugucaagcugcucugagcc

SEQ ID NO: 1760917 - RNA, 11 nt, Human
aguagagacag

SEQ ID NO: 1760918 - RNA, 22 nt, Human
aguagccucuccuguauuuaac

SEQ ID NO: 1760919 - RNA, 22 nt, Human
uguagucagaauuagcugcuuc

SEQ ID NO: 1760920 - RNA, 13 nt, Human
aguaaaauccaca

SEQ ID NO: 1760921 - RNA, 23 nt, Human
uguagaaaauuuguuauuuugca

SEQ ID NO: 1760922 - RNA, 21 nt, Human
uguagaaaugguuguauuaga

SEQ ID NO: 1760923 - RNA, 13 nt, Human
uguagaaaugguu

SEQ ID NO: 1760924 - RNA, 16 nt, Human
uguagagccagggucu

SEQ ID NO: 1760925 - RNA, 18 nt, Human
uguagagccagggucuca

SEQ ID NO: 1760926 - RNA, 20 nt, Human
ugggacucaaugcacugaca

SEQ ID NO: 1760927 - RNA, 14 nt, Human
ugggacuacaggca

SEQ ID NO: 1760928 - RNA, 14 nt, Human
agggaggaguggag

SEQ ID NO: 1760929 - RNA, 15 nt, Human
agggaggaguggagg

SEQ ID NO: 1760930 - RNA, 15 nt, Human
ugggacuacaggcac

SEQ ID NO: 1760931 - RNA, 16 nt, Human
ugggacuacaggcacc

SEQ ID NO: 1760932 - RNA, 21 nt, Human
aggcccggcuccaggcuccuu

SEQ ID NO: 1760933 - RNA, 18 nt, Human
aggcccggcuccaggcuc

SEQ ID NO: 1760934 - RNA, 20 nt, Human
aggcccggcuccaggcuccu

SEQ ID NO: 1760935 - RNA, 15 nt, Human
aggcccucgcugcca

SEQ ID NO: 1760936 - RNA, 18 nt, Human
agggaagggccugccaca

SEQ ID NO: 1760937 - RNA, 13 nt, Human
agggaagggccug

SEQ ID NO: 1760938 - RNA, 14 nt, Human
agggaagggccugc

SEQ ID NO: 1760939 - RNA, 16 nt, Human
agggaagggccugcca

SEQ ID NO: 1760940 - RNA, 16 nt, Human
agggaggaguggaggu

SEQ ID NO: 1760941 - RNA, 19 nt, Human
agggcucagcggggacagc

SEQ ID NO: 1760942 - RNA, 20 nt, Human
agggcucagcggggacagcu

SEQ ID NO: 1760943 - RNA, 22 nt, Human
agggcucagcggggacagcucc

SEQ ID NO: 1760944 - RNA, 23 nt, Human
agggcucagcggggacagcuccu

SEQ ID NO: 1760945 - RNA, 20 nt, Human
agggccacaugggaggcuca

SEQ ID NO: 1760946 - RNA, 21 nt, Human
agggccacaugggaggcucac

SEQ ID NO: 1760947 - RNA, 13 nt, Human
agggcaucuugcu

SEQ ID NO: 1760948 - RNA, 18 nt, Human
agggcaucuugcuggcua

SEQ ID NO: 1760949 - RNA, 13 nt, Human
aggggaauguuug

SEQ ID NO: 1760950 - RNA, 14 nt, Human
aggggaacagacug

SEQ ID NO: 1760951 - RNA, 18 nt, Human
agggcuuuguuuugcaca

SEQ ID NO: 1760952 - RNA, 13 nt, Human
uggggucuguaaa

SEQ ID NO: 1760953 - RNA, 16 nt, Human
uggggucuguaaaauc

SEQ ID NO: 1760954 - RNA, 17 nt, Human
ugggguacccacugcuc

SEQ ID NO: 1760955 - RNA, 18 nt, Human
ugggguacccacugcucu

SEQ ID NO: 1760956 - RNA, 19 nt, Human
ugggguacccacugcucug

SEQ ID NO: 1760957 - RNA, 20 nt, Human
ugggguacccacugcucugg

SEQ ID NO: 1760958 - RNA, 21 nt, Human
uggggagacugggcugaggga

SEQ ID NO: 1760959 - RNA, 17 nt, Human
uggggagacugggcuga

SEQ ID NO: 1760960 - RNA, 15 nt, Human
agggcucuaaaaaaa

SEQ ID NO: 1760961 - RNA, 23 nt, Human
agggcucuaaaaaaagccccaaa

SEQ ID NO: 1760962 - RNA, 13 nt, Human
uggggccugacug

SEQ ID NO: 1760963 - RNA, 17 nt, Human
uggggccugacugcuca

SEQ ID NO: 1760964 - RNA, 18 nt, Human
uggggccugacugcucag

SEQ ID NO: 1760965 - RNA, 19 nt, Human
ugggucccggcucuguggg

SEQ ID NO: 1760966 - RNA, 15 nt, Human
uggguccuuccugaa

SEQ ID NO: 1760967 - RNA, 16 nt, Human
aggguggugaccucug

SEQ ID NO: 1760968 - RNA, 18 nt, Human
uggguccaugggcagagc

SEQ ID NO: 1760969 - RNA, 19 nt, Human
aggggaauguuugccucug

SEQ ID NO: 1760970 - RNA, 20 nt, Human
aggggaauguuugccucugc

SEQ ID NO: 1760971 - RNA, 21 nt, Human
aggggaauguuugccucugcc

SEQ ID NO: 1760972 - RNA, 14 nt, Human
agggucucacucug

SEQ ID NO: 1760973 - RNA, 15 nt, Human
agggucucacucugu

SEQ ID NO: 1760974 - RNA, 16 nt, Human
agggucucacucuguc

SEQ ID NO: 1760975 - RNA, 21 nt, Human
agggucucacucugucgccca

SEQ ID NO: 1760976 - RNA, 23 nt, Human
auaaaaucagccaauuauguuaa

SEQ ID NO: 1760977 - RNA, 22 nt, Human
auaaaaucagccaauuauguua

SEQ ID NO: 1760978 - RNA, 18 nt, Human
auaaaaucagccaauuau

SEQ ID NO: 1760979 - RNA, 16 nt, Human
auaaaaucagccaauu

SEQ ID NO: 1760980 - RNA, 15 nt, Human
uuaagaggcaggguc

SEQ ID NO: 1760981 - RNA, 16 nt, Human
uuaagaggcagggucu

SEQ ID NO: 1760982 - RNA, 13 nt, Human
uuaagaggcaggg

SEQ ID NO: 1760983 - RNA, 20 nt, Human
uuaaguuauuuuaccuguuu

SEQ ID NO: 1760984 - RNA, 14 nt, Human
uuaaugaagaaagu

SEQ ID NO: 1760985 - RNA, 18 nt, Human
uuaaugaagaaaguggaa

SEQ ID NO: 1760986 - RNA, 23 nt, Human
uuaaugaagaaaguggaaaacaa

SEQ ID NO: 1760987 - RNA, 15 nt, Human
uuaaugaaguuugaa

SEQ ID NO: 1760988 - RNA, 14 nt, Human
uuaaugaaguuuga

SEQ ID NO: 1760989 - RNA, 19 nt, Human
uuaauuuuuuugagacaga

SEQ ID NO: 1760990 - RNA, 14 nt, Human
uuacaaaaacacuu

SEQ ID NO: 1760991 - RNA, 19 nt, Human
uuacaaaaacacuucguuc

SEQ ID NO: 1760992 - RNA, 17 nt, Human
auaaaauuuuuuuucau

SEQ ID NO: 1760993 - RNA, 19 nt, Human
auaaaauuuuuuuucaugu

SEQ ID NO: 1760994 - RNA, 23 nt, Human
auaaaauuuuuuuucauguuuua

SEQ ID NO: 1760995 - RNA, 13 nt, Human
uuaccugugugcu

SEQ ID NO: 1760996 - RNA, 11 nt, Human
uuagacagagu

SEQ ID NO: 1760997 - RNA, 19 nt, Human
uuacaguaggagcccagcu

SEQ ID NO: 1760998 - RNA, 16 nt, Human
auaacuaagcauccuu

SEQ ID NO: 1760999 - RNA, 15 nt, Human
auaaaguucuguacu

SEQ ID NO: 1761000 - RNA, 14 nt, Human
auaaacacuacaga

SEQ ID NO: 1761001 - RNA, 12 nt, Human
aguucuguagaa

SEQ ID NO: 1761002 - RNA, 23 nt, Human
aguucuguacucaaauguagcca

SEQ ID NO: 1761003 - RNA, 22 nt, Human
aguucuggauggugugccuucc

SEQ ID NO: 1761004 - RNA, 23 nt, Human
aguucuggauggugugccuucca

SEQ ID NO: 1761005 - RNA, 15 nt, Human
aguucugcugaaugc

SEQ ID NO: 1761006 - RNA, 20 nt, Human
uguuuuauggccuaaauuua

SEQ ID NO: 1761007 - RNA, 18 nt, Human
uguuuggaauauugucca

SEQ ID NO: 1761008 - RNA, 11 nt, Human
uguugcuaagc

SEQ ID NO: 1761009 - RNA, 19 nt, Human
uguugcccaggcaggucuu

SEQ ID NO: 1761010 - RNA, 20 nt, Human
uguugcacacccacucagcu

SEQ ID NO: 1761011 - RNA, 21 nt, Human
uguugcacacccacucagcuc

SEQ ID NO: 1761012 - RNA, 22 nt, Human
uguugcacacccacucagcucc

SEQ ID NO: 1761013 - RNA, 23 nt, Human
uguugcacacccacucagcuccg

SEQ ID NO: 1761014 - RNA, 13 nt, Human
uguugcugaauag

SEQ ID NO: 1761015 - RNA, 11 nt, Human
uguugcugaau

SEQ ID NO: 1761016 - RNA, 22 nt, Human
uguugcuaagccccagcaagca

SEQ ID NO: 1761017 - RNA, 21 nt, Human
uguugcuaagccccagcaagc

SEQ ID NO: 1761018 - RNA, 12 nt, Human
uguugcuaagcc

SEQ ID NO: 1761019 - RNA, 19 nt, Human
uguuuauuaaaauucugaa

SEQ ID NO: 1761020 - RNA, 13 nt, Human
uguuuauuaaaua

SEQ ID NO: 1761021 - RNA, 14 nt, Human
uguuuauuaaauag

SEQ ID NO: 1761022 - RNA, 17 nt, Human
uguuucuguucaccuuc

SEQ ID NO: 1761023 - RNA, 15 nt, Human
aguugguuggauaag

SEQ ID NO: 1761024 - RNA, 16 nt, Human
aguuggcuaggacccc

SEQ ID NO: 1761025 - RNA, 21 nt, Human
aguugcucuaugcuuuccaaa

SEQ ID NO: 1761026 - RNA, 16 nt, Human
aguugcucuaugcuuu

SEQ ID NO: 1761027 - RNA, 17 nt, Human
aguugcucuaugcuuuc

SEQ ID NO: 1761028 - RNA, 14 nt, Human
aguugcucuaugcu

SEQ ID NO: 1761029 - RNA, 23 nt, Human
aguugggaacuucagauggaccu

SEQ ID NO: 1761030 - RNA, 21 nt, Human
aguuggguggaugccuggugg

SEQ ID NO: 1761031 - RNA, 19 nt, Human
uuaacaaaaagugcuucau

SEQ ID NO: 1761032 - RNA, 13 nt, Human
uuaaaauguucac

SEQ ID NO: 1761033 - RNA, 14 nt, Human
uuaaaauucugaau

SEQ ID NO: 1761034 - RNA, 15 nt, Human
uuaaaauucugaauu

SEQ ID NO: 1761035 - RNA, 18 nt, Human
uuaaaauucugaauuuug

SEQ ID NO: 1761036 - RNA, 21 nt, Human
uuaaaggcaguauuuuguguc

SEQ ID NO: 1761037 - RNA, 20 nt, Human
uuaaagggagaugguaagaa

SEQ ID NO: 1761038 - RNA, 17 nt, Human
uuaaauaaauuguauau

SEQ ID NO: 1761039 - RNA, 15 nt, Human
uuaaauaaauuguau

SEQ ID NO: 1761040 - RNA, 13 nt, Human
uuaaauaaauugu

SEQ ID NO: 1761041 - RNA, 20 nt, Human
uuaaauaaauuguauauuca

SEQ ID NO: 1761042 - RNA, 18 nt, Human
uuaaauaaauuguauauu

SEQ ID NO: 1761043 - RNA, 18 nt, Human
uguuacaaaguuguaugu

SEQ ID NO: 1761044 - RNA, 17 nt, Human
aguggugcgaucugggu

SEQ ID NO: 1761045 - RNA, 19 nt, Human
aguggugguauguaaugga

SEQ ID NO: 1761046 - RNA, 21 nt, Human
aguguaaauaguuacuccagu

SEQ ID NO: 1761047 - RNA, 13 nt, Human
uguugcccaggca

SEQ ID NO: 1761048 - RNA, 12 nt, Human
uguugcccaggc

SEQ ID NO: 1761049 - RNA, 16 nt, Human
uguugcaagccccucu

SEQ ID NO: 1761050 - RNA, 15 nt, Human
uguugcccaggcagg

SEQ ID NO: 1761051 - RNA, 16 nt, Human
uguugcccaggcaggu

SEQ ID NO: 1761052 - RNA, 17 nt, Human
uguugcccaggcagguc

SEQ ID NO: 1761053 - RNA, 18 nt, Human
uguugcccaggcaggucu

SEQ ID NO: 1761054 - RNA, 16 nt, Human
uguucugggacacagu

SEQ ID NO: 1761055 - RNA, 12 nt, Human
uguuccagacau

SEQ ID NO: 1761056 - RNA, 19 nt, Human
uguuauagaacuucaugga

SEQ ID NO: 1761057 - RNA, 20 nt, Human
uguuauagaacuucauggau

SEQ ID NO: 1761058 - RNA, 21 nt, Human
ugugucuugcaauggcagccu

SEQ ID NO: 1761059 - RNA, 14 nt, Human
ugugugugucagcu

SEQ ID NO: 1761060 - RNA, 15 nt, Human
uguguugaaggaacu

SEQ ID NO: 1761061 - RNA, 16 nt, Human
uguuaaauaaauugua

SEQ ID NO: 1761062 - RNA, 14 nt, Human
uguuaaauaaauug

SEQ ID NO: 1761063 - RNA, 13 nt, Human
uguuaaauaaauu

SEQ ID NO: 1761064 - RNA, 20 nt, Human
uguuaaauaaauuguauauu

SEQ ID NO: 1761065 - RNA, 18 nt, Human
uguuaaauaaauuguaua

SEQ ID NO: 1761066 - RNA, 15 nt, Human
uguuaaguauuuuca

SEQ ID NO: 1761067 - RNA, 17 nt, Human
uguuaaguauuuucaua

SEQ ID NO: 1761068 - RNA, 20 nt, Human
agugcugggauuacaggugu

SEQ ID NO: 1761069 - RNA, 21 nt, Human
agugcugggauuacaggugug

SEQ ID NO: 1761070 - RNA, 13 nt, Human
agugcuguauaaa

SEQ ID NO: 1761071 - RNA, 12 nt, Human
agugcuguauaa

SEQ ID NO: 1761072 - RNA, 22 nt, Human
agugcuguauaaaaucagccaa

SEQ ID NO: 1761073 - RNA, 19 nt, Human
agugcuguauaaaaucagc

SEQ ID NO: 1761074 - RNA, 17 nt, Human
agugcuguauaaaauca

SEQ ID NO: 1761075 - RNA, 16 nt, Human
agugcuguauaaaauc

SEQ ID NO: 1761076 - RNA, 15 nt, Human
agugcuguauaaaau

SEQ ID NO: 1761077 - RNA, 14 nt, Human
agugcuguauaaaa

SEQ ID NO: 1761078 - RNA, 17 nt, Human
agugcugcagcucccug

SEQ ID NO: 1761079 - RNA, 18 nt, Human
agugcugcagcucccugg

SEQ ID NO: 1761080 - RNA, 21 nt, Human
agugcugcagcucccuggcuu

SEQ ID NO: 1761081 - RNA, 22 nt, Human
agugcugcagcucccuggcuuc

SEQ ID NO: 1761082 - RNA, 23 nt, Human
agugcugcagcucccuggcuucu

SEQ ID NO: 1761083 - RNA, 17 nt, Human
ugugggugauggggagg

SEQ ID NO: 1761084 - RNA, 13 nt, Human
uguggguguccug

SEQ ID NO: 1761085 - RNA, 14 nt, Human
uguggguguccugc

SEQ ID NO: 1761086 - RNA, 15 nt, Human
uguggguguccugcc

SEQ ID NO: 1761087 - RNA, 21 nt, Human
uguggguguccugccugucug

SEQ ID NO: 1761088 - RNA, 23 nt, Human
uguggguguccugccugucugcc

SEQ ID NO: 1761089 - RNA, 14 nt, Human
uguggguucuacag

SEQ ID NO: 1761090 - RNA, 23 nt, Human
uguggugugucccccucugucca

SEQ ID NO: 1761091 - RNA, 18 nt, Human
agucucaggagucucugg

SEQ ID NO: 1761092 - RNA, 19 nt, Human
agucuuccacaaagaaaau

SEQ ID NO: 1761093 - RNA, 20 nt, Human
agucuuccacaaagaaaauu

SEQ ID NO: 1761094 - RNA, 21 nt, Human
agucuuccacaaagaaaauuc

SEQ ID NO: 1761095 - RNA, 24 nt, Human
agucacccuuccaccauuguccua

SEQ ID NO: 1761096 - RNA, 19 nt, Human
ugugaaccaccacacccag

SEQ ID NO: 1761097 - RNA, 20 nt, Human
ugugaaccaccacacccagc

SEQ ID NO: 1761098 - RNA, 21 nt, Human
ugugaaccaccacacccagcc

SEQ ID NO: 1761099 - RNA, 22 nt, Human
ugugaacuggacccuguugcua

SEQ ID NO: 1761100 - RNA, 21 nt, Human
ugugaacuggacccuguugcu

SEQ ID NO: 1761101 - RNA, 15 nt, Human
agugagucgaggaca

SEQ ID NO: 1761102 - RNA, 18 nt, Human
ugugcugggagaaauacu

SEQ ID NO: 1761103 - RNA, 20 nt, Human
ugugccagguuuuuggucug

SEQ ID NO: 1761104 - RNA, 12 nt, Human
ugugccaugugc

SEQ ID NO: 1761105 - RNA, 16 nt, Human
ugugccaugugccagg

SEQ ID NO: 1761106 - RNA, 23 nt, Human
ugugccaaucaauagcaccccua

SEQ ID NO: 1761107 - RNA, 19 nt, Human
ugugccaaccuauuuugaa

SEQ ID NO: 1761108 - RNA, 14 nt, Human
ugugaugaauacug

SEQ ID NO: 1761109 - RNA, 16 nt, Human
ugugaugaauacugua

SEQ ID NO: 1761110 - RNA, 18 nt, Human
ugugaugaauacuguauu

SEQ ID NO: 1761111 - RNA, 13 nt, Human
ugugaucgucuga

SEQ ID NO: 1761112 - RNA, 15 nt, Human
agugaaagaaaauaa

SEQ ID NO: 1761113 - RNA, 21 nt, Human
auauuuucaccauuugauuau

SEQ ID NO: 1761114 - RNA, 22 nt, Human
uuccuguguguccaaaacugcc

SEQ ID NO: 1761115 - RNA, 21 nt, Human
uuccuguguguccaaaacugc

SEQ ID NO: 1761116 - RNA, 22 nt, Human
uuccuaauaaaguucuguacuc

SEQ ID NO: 1761117 - RNA, 11 nt, Human
uuccuccuggg

SEQ ID NO: 1761118 - RNA, 14 nt, Human
uuccuccugggccc

SEQ ID NO: 1761119 - RNA, 15 nt, Human
uuccuccugggcccu

SEQ ID NO: 1761120 - RNA, 21 nt, Human
uuccuccugggcccucucugc

SEQ ID NO: 1761121 - RNA, 23 nt, Human
uuccuccugggcccucucugcuc

SEQ ID NO: 1761122 - RNA, 11 nt, Human
uuccuccuuuc

SEQ ID NO: 1761123 - RNA, 15 nt, Human
uuccuaauaaaguuc

SEQ ID NO: 1761124 - RNA, 16 nt, Human
uuccuaauaaaguucu

SEQ ID NO: 1761125 - RNA, 19 nt, Human
uuccuaauaaaguucugua

SEQ ID NO: 1761126 - RNA, 23 nt, Human
auauuugucaauuuaugaauaua

SEQ ID NO: 1761127 - RNA, 17 nt, Human
aucacguuagaggaaaa

SEQ ID NO: 1761128 - RNA, 21 nt, Human
aucacguuagaggaaaaauau

SEQ ID NO: 1761129 - RNA, 22 nt, Human
aucacguuagaggaaaaauauu

SEQ ID NO: 1761130 - RNA, 22 nt, Human
aucacggcucacugcagccuca

SEQ ID NO: 1761131 - RNA, 22 nt, Human
aucacaacgugcauugugcuuc

SEQ ID NO: 1761132 - RNA, 21 nt, Human
aucacaacgugcauugugcuu

SEQ ID NO: 1761133 - RNA, 18 nt, Human
aucacaacgugcauugug

SEQ ID NO: 1761134 - RNA, 17 nt, Human
aucacaacgugcauugu

SEQ ID NO: 1761135 - RNA, 15 nt, Human
aucacaacgugcauu

SEQ ID NO: 1761136 - RNA, 13 nt, Human
aucaagaagggcu

SEQ ID NO: 1761137 - RNA, 14 nt, Human
aucaagaagggcug

SEQ ID NO: 1761138 - RNA, 16 nt, Human
aucaagaagggcugca

SEQ ID NO: 1761139 - RNA, 19 nt, Human
aucaagaagggcugcauga

SEQ ID NO: 1761140 - RNA, 20 nt, Human
aucaagaagggcugcaugau

SEQ ID NO: 1761141 - RNA, 22 nt, Human
aucaagaagggcugcaugaugu

SEQ ID NO: 1761142 - RNA, 20 nt, Human
aucaacuuuuuauugccuuc

SEQ ID NO: 1761143 - RNA, 21 nt, Human
aucaacuuuuuauugccuucu

SEQ ID NO: 1761144 - RNA, 22 nt, Human
aucaacuuuuuauugccuucuc

SEQ ID NO: 1761145 - RNA, 16 nt, Human
auauucuguuggccag

SEQ ID NO: 1761146 - RNA, 16 nt, Human
auauucugcucuauua

SEQ ID NO: 1761147 - RNA, 21 nt, Human
auauucugcucuauuauauaa

SEQ ID NO: 1761148 - RNA, 17 nt, Human
auauucccuagaaacuu

SEQ ID NO: 1761149 - RNA, 23 nt, Human
auauucccuagaaacuuccaaau

SEQ ID NO: 1761150 - RNA, 16 nt, Human
auauugaaaaaauaga

SEQ ID NO: 1761151 - RNA, 20 nt, Human
auauguuuuaagaggcaggg

SEQ ID NO: 1761152 - RNA, 18 nt, Human
auauguuuuaagaggcag

SEQ ID NO: 1761153 - RNA, 22 nt, Human
uucauguugcacacccacucag

SEQ ID NO: 1761154 - RNA, 15 nt, Human
uucauguuuuaacaa

SEQ ID NO: 1761155 - RNA, 17 nt, Human
uucauguuuuaacaaaa

SEQ ID NO: 1761156 - RNA, 18 nt, Human
uucauguuuuaacaaaaa

SEQ ID NO: 1761157 - RNA, 19 nt, Human
auauuaauaguaauuugua

SEQ ID NO: 1761158 - RNA, 14 nt, Human
auauuugaaucuug

SEQ ID NO: 1761159 - RNA, 13 nt, Human
auauuugaaucuu

SEQ ID NO: 1761160 - RNA, 11 nt, Human
auauuugaauc

SEQ ID NO: 1761161 - RNA, 16 nt, Human
auauuugaaucuuguc

SEQ ID NO: 1761162 - RNA, 15 nt, Human
auauuugaaucuugu

SEQ ID NO: 1761163 - RNA, 14 nt, Human
auauuucuauugaa

SEQ ID NO: 1761164 - RNA, 16 nt, Human
auauuucuauugaauu

SEQ ID NO: 1761165 - RNA, 15 nt, Human
auauuucgaaagcug

SEQ ID NO: 1761166 - RNA, 21 nt, Human
auauugcacaugucuuaauga

SEQ ID NO: 1761167 - RNA, 20 nt, Human
auauugcacaugucuuaaug

SEQ ID NO: 1761168 - RNA, 19 nt, Human
auauugcacaugucuuaau

SEQ ID NO: 1761169 - RNA, 17 nt, Human
auauugcacaugucuua

SEQ ID NO: 1761170 - RNA, 16 nt, Human
auauugcacaugucuu

SEQ ID NO: 1761171 - RNA, 15 nt, Human
auauugcacaugucu

SEQ ID NO: 1761172 - RNA, 13 nt, Human
auauugcacaugu

SEQ ID NO: 1761173 - RNA, 23 nt, Human
uucucacaauagccgauaucaga

SEQ ID NO: 1761174 - RNA, 23 nt, Human
uucucagacuuuggaaaaugcau

SEQ ID NO: 1761175 - RNA, 22 nt, Human
uucucagacuuuggaaaaugca

SEQ ID NO: 1761176 - RNA, 23 nt, Human
aucagaaauacagauuuugauag

SEQ ID NO: 1761177 - RNA, 19 nt, Human
aucagaaauacagauuuug

SEQ ID NO: 1761178 - RNA, 15 nt, Human
aucagaaauacagau

SEQ ID NO: 1761179 - RNA, 14 nt, Human
aucagaaauacaga

SEQ ID NO: 1761180 - RNA, 21 nt, Human
uuccuuuuuuaaaaaugcaaa

SEQ ID NO: 1761181 - RNA, 13 nt, Human
uuccuuuuuuccc

SEQ ID NO: 1761182 - RNA, 15 nt, Human
uuccuuuuuucccau

SEQ ID NO: 1761183 - RNA, 19 nt, Human
uuccuuuuuucccauaaga

SEQ ID NO: 1761184 - RNA, 22 nt, Human
uuccuuuuuucccauaagacaa

SEQ ID NO: 1761185 - RNA, 21 nt, Human
aucagaucuggggcagcaccc

SEQ ID NO: 1761186 - RNA, 13 nt, Human
aucauaauuacca

SEQ ID NO: 1761187 - RNA, 14 nt, Human
aucauaauuaccaa

SEQ ID NO: 1761188 - RNA, 18 nt, Human
aucauaauuaccaaguga

SEQ ID NO: 1761189 - RNA, 23 nt, Human
aucagagccuuuccucaaaacug

SEQ ID NO: 1761190 - RNA, 13 nt, Human
aucagucaagcug

SEQ ID NO: 1761191 - RNA, 23 nt, Human
aucauaguggcuuaaaacaacac

SEQ ID NO: 1761192 - RNA, 12 nt, Human
aucaucaagaag

SEQ ID NO: 1761193 - RNA, 14 nt, Human
aucaucaagaaggg

SEQ ID NO: 1761194 - RNA, 16 nt, Human
aucaucaagaagggcu

SEQ ID NO: 1761195 - RNA, 17 nt, Human
aucaucaagaagggcug

SEQ ID NO: 1761196 - RNA, 18 nt, Human
aucaucaagaagggcugc

SEQ ID NO: 1761197 - RNA, 20 nt, Human
aucaucaagaagggcugcau

SEQ ID NO: 1761198 - RNA, 21 nt, Human
aucaucaagaagggcugcaug

SEQ ID NO: 1761199 - RNA, 22 nt, Human
aucaucaagaagggcugcauga

SEQ ID NO: 1761200 - RNA, 17 nt, Human
uucugccaccccuaaac

SEQ ID NO: 1761201 - RNA, 12 nt, Human
uucugccuccuu

SEQ ID NO: 1761202 - RNA, 13 nt, Human
uucugccuccuuu

SEQ ID NO: 1761203 - RNA, 14 nt, Human
uucugccuccuuua

SEQ ID NO: 1761204 - RNA, 17 nt, Human
uucugccuccuuuagua

SEQ ID NO: 1761205 - RNA, 12 nt, Human
uucugccucucc

SEQ ID NO: 1761206 - RNA, 16 nt, Human
uucugccucuccaggc

SEQ ID NO: 1761207 - RNA, 10 nt, Human
uucugggaca

SEQ ID NO: 1761208 - RNA, 11 nt, Human
uucugggacac

SEQ ID NO: 1761209 - RNA, 22 nt, Human
uucugggacacaguucaauucu

SEQ ID NO: 1761210 - RNA, 22 nt, Human
uucuguaaacucugcauccaga

SEQ ID NO: 1761211 - RNA, 17 nt, Human
uucucugucucauccau

SEQ ID NO: 1761212 - RNA, 14 nt, Human
auccagguaaucca

SEQ ID NO: 1761213 - RNA, 15 nt, Human
auccagguucagcuu

SEQ ID NO: 1761214 - RNA, 16 nt, Human
auccagguucagcuug

SEQ ID NO: 1761215 - RNA, 18 nt, Human
uucuguacucaaauguag

SEQ ID NO: 1761216 - RNA, 13 nt, Human
aucccucaucugu

SEQ ID NO: 1761217 - RNA, 17 nt, Human
aucccucaucugucccu

SEQ ID NO: 1761218 - RNA, 18 nt, Human
aucccaggccccuggagg

SEQ ID NO: 1761219 - RNA, 24 nt, Human
aucccaggccccuggaggcugccu

SEQ ID NO: 1761220 - RNA, 17 nt, Human
aucccucuacagagcuu

SEQ ID NO: 1761221 - RNA, 11 nt, Human
aucccucaucu

SEQ ID NO: 1761222 - RNA, 20 nt, Human
aucccucuacagagcuuccc

SEQ ID NO: 1761223 - RNA, 21 nt, Human
aucccucuacagagcuucccu

SEQ ID NO: 1761224 - RNA, 22 nt, Human
aucccucuacagagcuucccug

SEQ ID NO: 1761225 - RNA, 23 nt, Human
aucccucuacagagcuucccuga

SEQ ID NO: 1761226 - RNA, 14 nt, Human
aucccucuccuccc

SEQ ID NO: 1761227 - RNA, 17 nt, Human
auagcugggacuacagg

SEQ ID NO: 1761228 - RNA, 22 nt, Human
uuauuguguuugucauuagccu

SEQ ID NO: 1761229 - RNA, 20 nt, Human
uuauuguguuugucauuagc

SEQ ID NO: 1761230 - RNA, 19 nt, Human
uuauuguguuugucauuag

SEQ ID NO: 1761231 - RNA, 12 nt, Human
auagcugcugcc

SEQ ID NO: 1761232 - RNA, 19 nt, Human
uuauuuccuaguucuguag

SEQ ID NO: 1761233 - RNA, 18 nt, Human
uuauuuccuaguucugua

SEQ ID NO: 1761234 - RNA, 19 nt, Human
auagcucaggugucccugc

SEQ ID NO: 1761235 - RNA, 18 nt, Human
auagcuacuaauuuuaaa

SEQ ID NO: 1761236 - RNA, 22 nt, Human
auagcucaggugucccugcacu

SEQ ID NO: 1761237 - RNA, 20 nt, Human
auagcucaggugucccugca

SEQ ID NO: 1761238 - RNA, 21 nt, Human
auagcucaggugucccugcac

SEQ ID NO: 1761239 - RNA, 12 nt, Human
auagcugggacu

SEQ ID NO: 1761240 - RNA, 16 nt, Human
auaagaguagaaacug

SEQ ID NO: 1761241 - RNA, 16 nt, Human
auaacuucaagcaaac

SEQ ID NO: 1761242 - RNA, 17 nt, Human
auagcuacuaauuuuaa

SEQ ID NO: 1761243 - RNA, 14 nt, Human
auagcuacuaauuu

SEQ ID NO: 1761244 - RNA, 19 nt, Human
uucaauaaaguauuuaauu

SEQ ID NO: 1761245 - RNA, 18 nt, Human
uucaauaaaguauuuaau

SEQ ID NO: 1761246 - RNA, 14 nt, Human
uucaauaaaguauu

SEQ ID NO: 1761247 - RNA, 21 nt, Human
uucaauaaaguauuuaauuag

SEQ ID NO: 1761248 - RNA, 22 nt, Human
uucaccacaugugcacaugcac

SEQ ID NO: 1761249 - RNA, 19 nt, Human
uucaccagaauggaaagac

SEQ ID NO: 1761250 - RNA, 24 nt, Human
uucaccauuuggcaaugccaucau

SEQ ID NO: 1761251 - RNA, 19 nt, Human
uucaauaaagcacugagca

SEQ ID NO: 1761252 - RNA, 13 nt, Human
uucaacuuugaau

SEQ ID NO: 1761253 - RNA, 15 nt, Human
uucaacuuugaauaa

SEQ ID NO: 1761254 - RNA, 16 nt, Human
uucaacuuugaauaaa

SEQ ID NO: 1761255 - RNA, 19 nt, Human
uucaacuuugaauaaagaa

SEQ ID NO: 1761256 - RNA, 20 nt, Human
uucaacuuugaauaaagaau

SEQ ID NO: 1761257 - RNA, 22 nt, Human
uucaacuuugaauaaagaauac

SEQ ID NO: 1761258 - RNA, 18 nt, Human
uucaaaauucuaaaugua

SEQ ID NO: 1761259 - RNA, 21 nt, Human
uuauuuccuaguucuguagaa

SEQ ID NO: 1761260 - RNA, 22 nt, Human
uuauuucucagacuuuggaaaa

SEQ ID NO: 1761261 - RNA, 22 nt, Human
auauaaauucacuuucauuuuu

SEQ ID NO: 1761262 - RNA, 14 nt, Human
auauaaguaaagug

SEQ ID NO: 1761263 - RNA, 22 nt, Human
auauaaguaaagugauuaaagu

SEQ ID NO: 1761264 - RNA, 19 nt, Human
auauagguuucuauucuug

SEQ ID NO: 1761265 - RNA, 12 nt, Human
auagucccugcc

SEQ ID NO: 1761266 - RNA, 16 nt, Human
uucagccacuaagaac

SEQ ID NO: 1761267 - RNA, 13 nt, Human
uucagaucuuaau

SEQ ID NO: 1761268 - RNA, 19 nt, Human
uucagaucuuaauauaaau

SEQ ID NO: 1761269 - RNA, 21 nt, Human
uucagaucuuaauauaaauuc

SEQ ID NO: 1761270 - RNA, 19 nt, Human
uucagacaaaauggauaca

SEQ ID NO: 1761271 - RNA, 15 nt, Human
auauguauuuaccaa

SEQ ID NO: 1761272 - RNA, 16 nt, Human
auauguauuuaccaaa

SEQ ID NO: 1761273 - RNA, 18 nt, Human
auauguauuuaccaaaaa

SEQ ID NO: 1761274 - RNA, 17 nt, Human
uucauggcagaaggcaa

SEQ ID NO: 1761275 - RNA, 13 nt, Human
uucauggaucaga

SEQ ID NO: 1761276 - RNA, 16 nt, Human
uucauggaucagaucu

SEQ ID NO: 1761277 - RNA, 14 nt, Human
uucauguaaacugu

SEQ ID NO: 1761278 - RNA, 17 nt, Human
uucauguaaacugugca

SEQ ID NO: 1761279 - RNA, 18 nt, Human
uucauguaaacugugcac

SEQ ID NO: 1761280 - RNA, 19 nt, Human
uucauguaaacugugcacc

SEQ ID NO: 1761281 - RNA, 23 nt, Human
auaucugccuuuauuguguuugu

SEQ ID NO: 1761282 - RNA, 14 nt, Human
auaucugauuguug

SEQ ID NO: 1761283 - RNA, 22 nt, Human
auaucugauuguugucaggcca

SEQ ID NO: 1761284 - RNA, 20 nt, Human
auaucugccuuuauuguguu

SEQ ID NO: 1761285 - RNA, 18 nt, Human
auaucugccuuuauugug

SEQ ID NO: 1761286 - RNA, 16 nt, Human
auaucugccuuuauug

SEQ ID NO: 1761287 - RNA, 14 nt, Human
auaucugccuuuau

SEQ ID NO: 1761288 - RNA, 15 nt, Human
uucagccucuuucug

SEQ ID NO: 1761289 - RNA, 20 nt, Human
auaucuaauuauuuugcagu

SEQ ID NO: 1761290 - RNA, 23 nt, Human
aucuaauauguaacaagccaccc

SEQ ID NO: 1761291 - RNA, 16 nt, Human
aucuaauuauuuugca

SEQ ID NO: 1761292 - RNA, 13 nt, Human
uugauagcaaagc

SEQ ID NO: 1761293 - RNA, 14 nt, Human
uugagugcucugau

SEQ ID NO: 1761294 - RNA, 15 nt, Human
uugagugcucugauc

SEQ ID NO: 1761295 - RNA, 16 nt, Human
uugagcagggcucagc

SEQ ID NO: 1761296 - RNA, 19 nt, Human
uugagcaugacagccugca

SEQ ID NO: 1761297 - RNA, 20 nt, Human
uugagcaugacagccugcag

SEQ ID NO: 1761298 - RNA, 21 nt, Human
uugagcaugacagccugcagc

SEQ ID NO: 1761299 - RNA, 12 nt, Human
uugagcagggcu

SEQ ID NO: 1761300 - RNA, 15 nt, Human
uugagcaauuucccc

SEQ ID NO: 1761301 - RNA, 23 nt, Human
uugagcagcagguagccugcugg

SEQ ID NO: 1761302 - RNA, 11 nt, Human
uugagacagag

SEQ ID NO: 1761303 - RNA, 10 nt, Human
uugacagggc

SEQ ID NO: 1761304 - RNA, 12 nt, Human
uugacagggcac

SEQ ID NO: 1761305 - RNA, 19 nt, Human
uugacagggcacaccgggc

SEQ ID NO: 1761306 - RNA, 11 nt, Human
uugacacauag

SEQ ID NO: 1761307 - RNA, 14 nt, Human
auccgaaucucuuu

SEQ ID NO: 1761308 - RNA, 16 nt, Human
auccgaaccuccucug

SEQ ID NO: 1761309 - RNA, 19 nt, Human
auccgaaccuccucuguga

SEQ ID NO: 1761310 - RNA, 20 nt, Human
auccgaaccuccucugugaa

SEQ ID NO: 1761311 - RNA, 13 nt, Human
uugcaauaaugca

SEQ ID NO: 1761312 - RNA, 14 nt, Human
uugcaauaaugcag

SEQ ID NO: 1761313 - RNA, 15 nt, Human
uugcaauaaugcagu

SEQ ID NO: 1761314 - RNA, 16 nt, Human
uugcaauaaugcagua

SEQ ID NO: 1761315 - RNA, 17 nt, Human
uugcaauaaugcaguau

SEQ ID NO: 1761316 - RNA, 21 nt, Human
uugcaauaaugcaguauggua

SEQ ID NO: 1761317 - RNA, 14 nt, Human
uugcaauggcagcc

SEQ ID NO: 1761318 - RNA, 13 nt, Human
uugcccaggcagg

SEQ ID NO: 1761319 - RNA, 14 nt, Human
uugcccaggcaggu

SEQ ID NO: 1761320 - RNA, 16 nt, Human
uugcccaggcaggucu

SEQ ID NO: 1761321 - RNA, 18 nt, Human
uugcccaggcaggucuug

SEQ ID NO: 1761322 - RNA, 11 nt, Human
uugcccaggcu

SEQ ID NO: 1761323 - RNA, 12 nt, Human
uugcccaggcug

SEQ ID NO: 1761324 - RNA, 14 nt, Human
uugcccaggcuggc

SEQ ID NO: 1761325 - RNA, 23 nt, Human
uugcccaggcuggcgugcagugg

SEQ ID NO: 1761326 - RNA, 22 nt, Human
aucucaagaugggggcagggcu

SEQ ID NO: 1761327 - RNA, 23 nt, Human
aucucaagaugggggcagggcug

SEQ ID NO: 1761328 - RNA, 19 nt, Human
aucucuuuuugcuuucgaa

SEQ ID NO: 1761329 - RNA, 17 nt, Human
uugguuuugacuucaga

SEQ ID NO: 1761330 - RNA, 17 nt, Human
uugguuaaaaaaaagaa

SEQ ID NO: 1761331 - RNA, 18 nt, Human
uugggguggguauaaaag

SEQ ID NO: 1761332 - RNA, 20 nt, Human
uugggguggguauaaaagau

SEQ ID NO: 1761333 - RNA, 14 nt, Human
augaagaaagugga

SEQ ID NO: 1761334 - RNA, 20 nt, Human
augaaccagccggggccuua

SEQ ID NO: 1761335 - RNA, 14 nt, Human
uuggagcuucaugg

SEQ ID NO: 1761336 - RNA, 16 nt, Human
uuggagcuauucaaga

SEQ ID NO: 1761337 - RNA, 21 nt, Human
uuggaggcaauccuaccuugc

SEQ ID NO: 1761338 - RNA, 23 nt, Human
augaaccacaucuugcucugcug

SEQ ID NO: 1761339 - RNA, 22 nt, Human
augaaccacaucuugcucugcu

SEQ ID NO: 1761340 - RNA, 18 nt, Human
augaacacuuaaauuaug

SEQ ID NO: 1761341 - RNA, 13 nt, Human
augaaauaugcau

SEQ ID NO: 1761342 - RNA, 15 nt, Human
augaaauaugcaucu

SEQ ID NO: 1761343 - RNA, 20 nt, Human
uugcucuguuugugggguga

SEQ ID NO: 1761344 - RNA, 15 nt, Human
uuggaaaaugcauug

SEQ ID NO: 1761345 - RNA, 15 nt, Human
uuggagcccagggca

SEQ ID NO: 1761346 - RNA, 12 nt, Human
aucugucauuug

SEQ ID NO: 1761347 - RNA, 17 nt, Human
aucugucauuugagcag

SEQ ID NO: 1761348 - RNA, 22 nt, Human
aucugucauuugagcagggcuc

SEQ ID NO: 1761349 - RNA, 19 nt, Human
uugccccuuucucuuuucc

SEQ ID NO: 1761350 - RNA, 12 nt, Human
aucugugucuug

SEQ ID NO: 1761351 - RNA, 13 nt, Human
aucugugucuugu

SEQ ID NO: 1761352 - RNA, 14 nt, Human
aucugugucuuguu

SEQ ID NO: 1761353 - RNA, 19 nt, Human
aucugugcucaggacucag

SEQ ID NO: 1761354 - RNA, 17 nt, Human
aucuugcucugcugaca

SEQ ID NO: 1761355 - RNA, 21 nt, Human
aucuuggacucaugaggaggg

SEQ ID NO: 1761356 - RNA, 15 nt, Human
aucuugcucugcuga

SEQ ID NO: 1761357 - RNA, 16 nt, Human
aucuugcucugcugac

SEQ ID NO: 1761358 - RNA, 15 nt, Human
aucuuauaauuuaaa

SEQ ID NO: 1761359 - RNA, 14 nt, Human
aucuugcucugcug

SEQ ID NO: 1761360 - RNA, 12 nt, Human
aucuuaauauaa

SEQ ID NO: 1761361 - RNA, 13 nt, Human
aucuuaauauaaa

SEQ ID NO: 1761362 - RNA, 14 nt, Human
aucuuaauauaaau

SEQ ID NO: 1761363 - RNA, 16 nt, Human
aucuuauaauuuaaaa

SEQ ID NO: 1761364 - RNA, 20 nt, Human
augcgacacugggaggccag

SEQ ID NO: 1761365 - RNA, 22 nt, Human
uuuacugccaaagggaaauauc

SEQ ID NO: 1761366 - RNA, 19 nt, Human
uuuacuggacaaagaauuc

SEQ ID NO: 1761367 - RNA, 15 nt, Human
uuuacuuaacuguuu

SEQ ID NO: 1761368 - RNA, 16 nt, Human
uuuaguuacuuuagau

SEQ ID NO: 1761369 - RNA, 14 nt, Human
augccaucaucucc

SEQ ID NO: 1761370 - RNA, 15 nt, Human
augccaucaucuccu

SEQ ID NO: 1761371 - RNA, 16 nt, Human
augccaucaucuccug

SEQ ID NO: 1761372 - RNA, 18 nt, Human
augcuacaggauuugaaa

SEQ ID NO: 1761373 - RNA, 13 nt, Human
augcucaggcuac

SEQ ID NO: 1761374 - RNA, 16 nt, Human
augcucauaacggauc

SEQ ID NO: 1761375 - RNA, 21 nt, Human
augcucauaacggaucagaaa

SEQ ID NO: 1761376 - RNA, 18 nt, Human
augcuggcuguuggcugg

SEQ ID NO: 1761377 - RNA, 19 nt, Human
augcuggcuguuggcuggg

SEQ ID NO: 1761378 - RNA, 20 nt, Human
augcuggcuguuggcugggg

SEQ ID NO: 1761379 - RNA, 19 nt, Human
auggaagaggcuacagggc

SEQ ID NO: 1761380 - RNA, 15 nt, Human
uuucaaaccagcuuc

SEQ ID NO: 1761381 - RNA, 12 nt, Human
uuucccaauuca

SEQ ID NO: 1761382 - RNA, 15 nt, Human
uuucccaauucacau

SEQ ID NO: 1761383 - RNA, 18 nt, Human
uuucauguaaacugugca

SEQ ID NO: 1761384 - RNA, 19 nt, Human
uuucauguaaacugugcac

SEQ ID NO: 1761385 - RNA, 16 nt, Human
uugugacauuccuucu

SEQ ID NO: 1761386 - RNA, 17 nt, Human
uugugaggaaagucauu

SEQ ID NO: 1761387 - RNA, 16 nt, Human
uugugaggaaagucau

SEQ ID NO: 1761388 - RNA, 22 nt, Human
uugugaggaaagucauuggcuu

SEQ ID NO: 1761389 - RNA, 13 nt, Human
uuguccauugucc

SEQ ID NO: 1761390 - RNA, 21 nt, Human
uugucccagaggcugccccac

SEQ ID NO: 1761391 - RNA, 23 nt, Human
uuguccccaaauccgaaccuccu

SEQ ID NO: 1761392 - RNA, 19 nt, Human
uuguguccuccaggagcuu

SEQ ID NO: 1761393 - RNA, 22 nt, Human
augaggucagagccugcaguua

SEQ ID NO: 1761394 - RNA, 19 nt, Human
augaggucagagccugcag

SEQ ID NO: 1761395 - RNA, 20 nt, Human
augaggucagagccugcagu

SEQ ID NO: 1761396 - RNA, 16 nt, Human
augagguaucuucuuu

SEQ ID NO: 1761397 - RNA, 15 nt, Human
augaggucagagccu

SEQ ID NO: 1761398 - RNA, 16 nt, Human
augaggucagagccug

SEQ ID NO: 1761399 - RNA, 18 nt, Human
augaggucagagccugca

SEQ ID NO: 1761400 - RNA, 17 nt, Human
uugucacacacuuuggc

SEQ ID NO: 1761401 - RNA, 19 nt, Human
uugucaauuuaugaauaua

SEQ ID NO: 1761402 - RNA, 13 nt, Human
uugucauauguag

SEQ ID NO: 1761403 - RNA, 21 nt, Human
uugucauauguagccuucaca

SEQ ID NO: 1761404 - RNA, 23 nt, Human
uugucauauguagccuucacaca

SEQ ID NO: 1761405 - RNA, 12 nt, Human
augaguuuaaaa

SEQ ID NO: 1761406 - RNA, 13 nt, Human
augaguuuaaaaa

SEQ ID NO: 1761407 - RNA, 15 nt, Human
augaguuuaaaaauc

SEQ ID NO: 1761408 - RNA, 22 nt, Human
augaguuuaaaaaucaacuuuu

SEQ ID NO: 1761409 - RNA, 14 nt, Human
uuuaagaggcaggg

SEQ ID NO: 1761410 - RNA, 16 nt, Human
uuuaaauguaaaacau

SEQ ID NO: 1761411 - RNA, 21 nt, Human
uuuaaauauaugcuaagucuu

SEQ ID NO: 1761412 - RNA, 14 nt, Human
augauuuccccccu

SEQ ID NO: 1761413 - RNA, 19 nt, Human
augauuuccccccuccgcc

SEQ ID NO: 1761414 - RNA, 23 nt, Human
augcaaaagguucacuaaagcag

SEQ ID NO: 1761415 - RNA, 21 nt, Human
augcacuguucccccugugca

SEQ ID NO: 1761416 - RNA, 18 nt, Human
uuuaaaaaaauuccaagu

SEQ ID NO: 1761417 - RNA, 22 nt, Human
augcacuguucccccugugcag

SEQ ID NO: 1761418 - RNA, 15 nt, Human
auuugagcagggcuc

SEQ ID NO: 1761419 - RNA, 16 nt, Human
auuugagcagggcuca

SEQ ID NO: 1761420 - RNA, 21 nt, Human
auuuggaguguuccccuucca

SEQ ID NO: 1761421 - RNA, 19 nt, Human
auuuggcaaugccaucauc

SEQ ID NO: 1761422 - RNA, 22 nt, Human
auuuccuaguucuguagaaaug

SEQ ID NO: 1761423 - RNA, 15 nt, Human
auuuccuaguucugu

SEQ ID NO: 1761424 - RNA, 20 nt, Human
auuuccuaguucuguagaaa

SEQ ID NO: 1761425 - RNA, 18 nt, Human
auuuccuaguucuguaga

SEQ ID NO: 1761426 - RNA, 19 nt, Human
auuuccuacacaaaugaua

SEQ ID NO: 1761427 - RNA, 20 nt, Human
auuuccauguccccucccag

SEQ ID NO: 1761428 - RNA, 23 nt, Human
auuuccauguccccucccagagc

SEQ ID NO: 1761429 - RNA, 15 nt, Human
auuuauuuuauaaga

SEQ ID NO: 1761430 - RNA, 16 nt, Human
auuuauuuuauaagaa

SEQ ID NO: 1761431 - RNA, 20 nt, Human
auuuauuuuauaagaaaaac

SEQ ID NO: 1761432 - RNA, 19 nt, Human
auuuauuuuuuacauuauu

SEQ ID NO: 1761433 - RNA, 14 nt, Human
auuuauuuuuuaca

SEQ ID NO: 1761434 - RNA, 18 nt, Human
auuuauuuuuuacauuau

SEQ ID NO: 1761435 - RNA, 19 nt, Human
auuguuuucuuuuucuacc

SEQ ID NO: 1761436 - RNA, 16 nt, Human
auuguaguccuguaau

SEQ ID NO: 1761437 - RNA, 21 nt, Human
auuuaaauacagucuuccauu

SEQ ID NO: 1761438 - RNA, 20 nt, Human
auuuagaaaaagaacaugca

SEQ ID NO: 1761439 - RNA, 21 nt, Human
auuuagaaaaagaacaugcag

SEQ ID NO: 1761440 - RNA, 22 nt, Human
auuuagaaaaagaacaugcagu

SEQ ID NO: 1761441 - RNA, 23 nt, Human
auuuagaaaaagaacaugcaguu

SEQ ID NO: 1761442 - RNA, 18 nt, Human
auugcaugugacucugaa

SEQ ID NO: 1761443 - RNA, 13 nt, Human
auugcaugugacu

SEQ ID NO: 1761444 - RNA, 14 nt, Human
auugcaugugacuc

SEQ ID NO: 1761445 - RNA, 15 nt, Human
auugcaugugacucu

SEQ ID NO: 1761446 - RNA, 17 nt, Human
auugcaugugacucuga

SEQ ID NO: 1761447 - RNA, 15 nt, Human
auugcaucucccaga

SEQ ID NO: 1761448 - RNA, 22 nt, Human
auugcaucucccagauaaugug

SEQ ID NO: 1761449 - RNA, 23 nt, Human
auugcaucucccagauaauguga

SEQ ID NO: 1761450 - RNA, 15 nt, Human
auugccuucucacca

SEQ ID NO: 1761451 - RNA, 18 nt, Human
auugccuucucaccagcu

SEQ ID NO: 1761452 - RNA, 19 nt, Human
auugccuucucaccagcug

SEQ ID NO: 1761453 - RNA, 20 nt, Human
auugccuucucaccagcugc

SEQ ID NO: 1761454 - RNA, 21 nt, Human
auugccuucucaccagcugca

SEQ ID NO: 1761455 - RNA, 22 nt, Human
auugccuucucaccagcugcaa

SEQ ID NO: 1761456 - RNA, 15 nt, Human
auuggacccuuccau

SEQ ID NO: 1761457 - RNA, 17 nt, Human
auugcaacaggcugggc

SEQ ID NO: 1761458 - RNA, 18 nt, Human
auugcaacaggcugggcu

SEQ ID NO: 1761459 - RNA, 19 nt, Human
auugcaacaggcugggcuu

SEQ ID NO: 1761460 - RNA, 14 nt, Human
auugaauuuuuccu

SEQ ID NO: 1761461 - RNA, 17 nt, Human
auugaauuuuuccuaug

SEQ ID NO: 1761462 - RNA, 23 nt, Human
auugaauuuuuccuaugcuauug

SEQ ID NO: 1761463 - RNA, 20 nt, Human
auugaauucuugguugagga

SEQ ID NO: 1761464 - RNA, 22 nt, Human
auugaauucuugguugaggaaa

SEQ ID NO: 1761465 - RNA, 23 nt, Human
auugaauucuugguugaggaaac

SEQ ID NO: 1761466 - RNA, 21 nt, Human
auuccuauacgcagcgugcuu

SEQ ID NO: 1761467 - RNA, 14 nt, Human
auuacuucugcuac

SEQ ID NO: 1761468 - RNA, 13 nt, Human
auuacuucugcua

SEQ ID NO: 1761469 - RNA, 21 nt, Human
uuuuugguuaaaaaaaagaau

SEQ ID NO: 1761470 - RNA, 11 nt, Human
uuuuugcaaua

SEQ ID NO: 1761471 - RNA, 12 nt, Human
uuuuugcaauaa

SEQ ID NO: 1761472 - RNA, 22 nt, Human
uuuuugcaauaaugcaguaugg

SEQ ID NO: 1761473 - RNA, 15 nt, Human
uuuuugaagcuguau

SEQ ID NO: 1761474 - RNA, 15 nt, Human
uuuuucaaagcaauu

SEQ ID NO: 1761475 - RNA, 16 nt, Human
uuuuucaacuuugaau

SEQ ID NO: 1761476 - RNA, 16 nt, Human
uuuuguugccccagaa

SEQ ID NO: 1761477 - RNA, 13 nt, Human
uuuuguucucugg

SEQ ID NO: 1761478 - RNA, 14 nt, Human
uuuuguucucuggg

SEQ ID NO: 1761479 - RNA, 17 nt, Human
uuuuguucucugggaga

SEQ ID NO: 1761480 - RNA, 13 nt, Human
uuuuguucccuau

SEQ ID NO: 1761481 - RNA, 17 nt, Human
uuuuguuuuucauucag

SEQ ID NO: 1761482 - RNA, 11 nt, Human
uuuuguguccu

SEQ ID NO: 1761483 - RNA, 13 nt, Human
uuuuguguccucc

SEQ ID NO: 1761484 - RNA, 20 nt, Human
uuuuguguccuccaggagcu

SEQ ID NO: 1761485 - RNA, 21 nt, Human
uuuugcuuucgaacugcuagu

SEQ ID NO: 1761486 - RNA, 14 nt, Human
auuaaaauccucaa

SEQ ID NO: 1761487 - RNA, 16 nt, Human
auuaaaauccucaauc

SEQ ID NO: 1761488 - RNA, 14 nt, Human
auuaaaauucugaa

SEQ ID NO: 1761489 - RNA, 17 nt, Human
auuaaaauucugaauuu

SEQ ID NO: 1761490 - RNA, 19 nt, Human
auuaaaauucugaauuuug

SEQ ID NO: 1761491 - RNA, 19 nt, Human
auuaaacagaugugaauau

SEQ ID NO: 1761492 - RNA, 14 nt, Human
auucacuugcauuu

SEQ ID NO: 1761493 - RNA, 15 nt, Human
auucacuuucauuuu

SEQ ID NO: 1761494 - RNA, 18 nt, Human
auucacuuucauuuuuga

SEQ ID NO: 1761495 - RNA, 14 nt, Human
auucagugucacug

SEQ ID NO: 1761496 - RNA, 19 nt, Human
auucaguguuaaaugugau

SEQ ID NO: 1761497 - RNA, 18 nt, Human
auuccagagacaucagca

SEQ ID NO: 1761498 - RNA, 18 nt, Human
auucccaagcucugcucc

SEQ ID NO: 1761499 - RNA, 19 nt, Human
auucccaagcucugcuccu

SEQ ID NO: 1761500 - RNA, 17 nt, Human
auucccaagcucugcuc

SEQ ID NO: 1761501 - RNA, 13 nt, Human
auuccaagcuucc

SEQ ID NO: 1761502 - RNA, 23 nt, Human
auuccaagcuuccauagcugcug

SEQ ID NO: 1761503 - RNA, 17 nt, Human
auuccaagugauugaaa

SEQ ID NO: 1761504 - RNA, 20 nt, Human
auuauauggcuugaguuuaa

SEQ ID NO: 1761505 - RNA, 16 nt, Human
auuauaucuaauuauu

SEQ ID NO: 1761506 - RNA, 13 nt, Human
auuauucaguguc

SEQ ID NO: 1761507 - RNA, 14 nt, Human
auuauucaguguca

SEQ ID NO: 1761508 - RNA, 13 nt, Human
auucaccugagca

SEQ ID NO: 1761509 - RNA, 15 nt, Human
auuauucagugucac

SEQ ID NO: 1761510 - RNA, 12 nt, Human
auuauugcauua

SEQ ID NO: 1761511 - RNA, 15 nt, Human
uuugauccaagcugg

SEQ ID NO: 1761512 - RNA, 13 nt, Human
uuugagacagagu

SEQ ID NO: 1761513 - RNA, 21 nt, Human
uuugagaaacaacaauuucua

SEQ ID NO: 1761514 - RNA, 11 nt, Human
uuugcaaagua

SEQ ID NO: 1761515 - RNA, 13 nt, Human
uuugcaaaguacu

SEQ ID NO: 1761516 - RNA, 14 nt, Human
uuugcaaaguacug

SEQ ID NO: 1761517 - RNA, 15 nt, Human
uuugcaaaguacugu

SEQ ID NO: 1761518 - RNA, 16 nt, Human
uuugcaaaguacugua

SEQ ID NO: 1761519 - RNA, 17 nt, Human
uuugcaaaguacuguaa

SEQ ID NO: 1761520 - RNA, 23 nt, Human
uuugcaaaguacuguaagaauaa

SEQ ID NO: 1761521 - RNA, 19 nt, Human
uuugggauagagaauguuc

SEQ ID NO: 1761522 - RNA, 21 nt, Human
uuugggguacccacugcucug

SEQ ID NO: 1761523 - RNA, 22 nt, Human
uuugggguacccacugcucugg

SEQ ID NO: 1761524 - RNA, 17 nt, Human
augugaugaauacugua

SEQ ID NO: 1761525 - RNA, 19 nt, Human
augugaugaauacuguauu

SEQ ID NO: 1761526 - RNA, 23 nt, Human
augucgucaaagcugaaauggac

SEQ ID NO: 1761527 - RNA, 13 nt, Human
auuaaaaauuaua

SEQ ID NO: 1761528 - RNA, 13 nt, Human
auguuuuuaauau

SEQ ID NO: 1761529 - RNA, 17 nt, Human
auguuggccaggcuggu

SEQ ID NO: 1761530 - RNA, 12 nt, Human
uuuuauugccuu

SEQ ID NO: 1761531 - RNA, 13 nt, Human
uuuuauugccuuc

SEQ ID NO: 1761532 - RNA, 14 nt, Human
uuuuauugccuucu

SEQ ID NO: 1761533 - RNA, 15 nt, Human
uuuuauugccuucuc

SEQ ID NO: 1761534 - RNA, 16 nt, Human
uuuuauugccuucuca

SEQ ID NO: 1761535 - RNA, 22 nt, Human
uuuuauugccuucucaccagcu

SEQ ID NO: 1761536 - RNA, 23 nt, Human
uuuuauugccuucucaccagcug

SEQ ID NO: 1761537 - RNA, 24 nt, Human
uuuuauugccuucucaccagcugc

SEQ ID NO: 1761538 - RNA, 15 nt, Human
uuuuaguagagacag

SEQ ID NO: 1761539 - RNA, 16 nt, Human
uuuucuauaauuuaaa

SEQ ID NO: 1761540 - RNA, 20 nt, Human
uuuuccagcuggaugagaau

SEQ ID NO: 1761541 - RNA, 15 nt, Human
uuuucuagauacaau

SEQ ID NO: 1761542 - RNA, 18 nt, Human
uuuucuagauacaauaaa

SEQ ID NO: 1761543 - RNA, 19 nt, Human
uuuucuagauacaauaaau

SEQ ID NO: 1761544 - RNA, 16 nt, Human
uuuucucuccuguccu

SEQ ID NO: 1761545 - RNA, 18 nt, Human
uuuucucuccuguccucc

SEQ ID NO: 1761546 - RNA, 12 nt, Human
uuuguuuugcac

SEQ ID NO: 1761547 - RNA, 13 nt, Human
uuuguuuuuaauu

SEQ ID NO: 1761548 - RNA, 12 nt, Human
uuuguuuuucau

SEQ ID NO: 1761549 - RNA, 21 nt, Human
augugccagguuuuuggucug

SEQ ID NO: 1761550 - RNA, 17 nt, Human
augugccaaucaauagc

SEQ ID NO: 1761551 - RNA, 23 nt, Human
auguguguccacgacugucucca

SEQ ID NO: 1761552 - RNA, 18 nt, Human
auguguuuuguuuauuaa

SEQ ID NO: 1761553 - RNA, 20 nt, Human
auguguuuuguuuauuaaau

SEQ ID NO: 1761554 - RNA, 13 nt, Human
auguuaaauaaau

SEQ ID NO: 1761555 - RNA, 21 nt, Human
auguguguccacgacugucuc

SEQ ID NO: 1761556 - RNA, 22 nt, Human
auguguguccacgacugucucc

SEQ ID NO: 1761557 - RNA, 14 nt, Human
auguucacuuuuga

SEQ ID NO: 1761558 - RNA, 18 nt, Human
auguucacuuuugacaaa

SEQ ID NO: 1761559 - RNA, 13 nt, Human
auguugcccaggc

SEQ ID NO: 1761560 - RNA, 14 nt, Human
auguugcccaggca

SEQ ID NO: 1761561 - RNA, 15 nt, Human
auguugcccaggcag

SEQ ID NO: 1761562 - RNA, 16 nt, Human
auguugcccaggcagg

SEQ ID NO: 1761563 - RNA, 15 nt, Human
auguugcuggaucag

SEQ ID NO: 1761564 - RNA, 13 nt, Human
auguuggccaggc

SEQ ID NO: 1761565 - RNA, 16 nt, Human
auguuggauaaggaau

SEQ ID NO: 1761566 - RNA, 17 nt, Human
auguuggauaaggaauu

SEQ ID NO: 1761567 - RNA, 22 nt, Human
auguuggauaaggaauuauaga

SEQ ID NO: 1761568 - RNA, 18 nt, Human
auguuaaauaaauuguau

SEQ ID NO: 1761569 - RNA, 17 nt, Human
auguuaaauaaauugua

SEQ ID NO: 1761570 - RNA, 16 nt, Human
auguuaaauaaauugu

SEQ ID NO: 1761571 - RNA, 14 nt, Human
auguuaaauaaauu

SEQ ID NO: 1761572 - RNA, 20 nt, Human
auguuaaauaaauuguauau

SEQ ID NO: 1761573 - RNA, 19 nt, Human
auguuaaauaaauuguaua

SEQ ID NO: 1761574 - RNA, 22 nt, Human
auguuaaauaaauuguauauuc

SEQ ID NO: 1761575 - RNA, 14 nt, Human
auguuauucuagua

SEQ ID NO: 1761576 - RNA, 13 nt, Human
auguuauguaaaa

SEQ ID NO: 1761577 - RNA, 14 nt, Human
auguuauguaaaag

SEQ ID NO: 1761578 - RNA, 21 nt, Human
auguuauguaaaaggccaaac

SEQ ID NO: 1761579 - RNA, 13 nt, Human
aaaacacugugca

SEQ ID NO: 1761580 - RNA, 16 nt, Human
aaaagaacaugcaguu

SEQ ID NO: 1761581 - RNA, 17 nt, Human
aaaagaacaugcaguuu

SEQ ID NO: 1761582 - RNA, 18 nt, Human
aaaagaacaugcaguuug

SEQ ID NO: 1761583 - RNA, 22 nt, Human
aaaagaacaugcaguuugaaau

SEQ ID NO: 1761584 - RNA, 20 nt, Human
aaaagaaagaaguuauuuuc

SEQ ID NO: 1761585 - RNA, 20 nt, Human
aaaagacaaggaaaaaauaa

SEQ ID NO: 1761586 - RNA, 15 nt, Human
aaaagacacugcaga

SEQ ID NO: 1761587 - RNA, 13 nt, Human
aaaagagaaugau

SEQ ID NO: 1761588 - RNA, 23 nt, Human
aaaagauauaagugcuguauaaa

SEQ ID NO: 1761589 - RNA, 19 nt, Human
aaaagauauaagugcugua

SEQ ID NO: 1761590 - RNA, 18 nt, Human
aaaagauauaagugcugu

SEQ ID NO: 1761591 - RNA, 15 nt, Human
aaaagauauaagugc

SEQ ID NO: 1761592 - RNA, 14 nt, Human
aaaagauauaagug

SEQ ID NO: 1761593 - RNA, 13 nt, Human
aaaagauauaagu

SEQ ID NO: 1761594 - RNA, 12 nt, Human
aaaagauauaag

SEQ ID NO: 1761595 - RNA, 15 nt, Human
aaaagauaauauuuu

SEQ ID NO: 1761596 - RNA, 19 nt, Human
aaaagauaauauuuuacau

SEQ ID NO: 1761597 - RNA, 22 nt, Human
aaaagauaauauuuuacauaca

SEQ ID NO: 1761598 - RNA, 22 nt, Human
aaaaucagccaauuauguuaaa

SEQ ID NO: 1761599 - RNA, 24 nt, Human
aaaaucagccaauuauguuaaacu

SEQ ID NO: 1761600 - RNA, 19 nt, Human
aaacccaagauuauuaaaa

SEQ ID NO: 1761601 - RNA, 19 nt, Human
aaaccaguguuagggaagg

SEQ ID NO: 1761602 - RNA, 13 nt, Human
aaauguucacuuu

SEQ ID NO: 1761603 - RNA, 16 nt, Human
aaauguucacuuuuga

SEQ ID NO: 1761604 - RNA, 16 nt, Human
aaauggauacauaaag

SEQ ID NO: 1761605 - RNA, 15 nt, Human
aaauauuuauucauu

SEQ ID NO: 1761606 - RNA, 23 nt, Human
aaauauuuauucauuauuuguca

SEQ ID NO: 1761607 - RNA, 12 nt, Human
aaauagcaaaga

SEQ ID NO: 1761608 - RNA, 21 nt, Human
aaauagauaagaguagaaacu

SEQ ID NO: 1761609 - RNA, 17 nt, Human
aaauagaguauaugcac

SEQ ID NO: 1761610 - RNA, 19 nt, Human
aaauagaguauaugcacuu

SEQ ID NO: 1761611 - RNA, 23 nt, Human
aaaucuuucuuucuuagaaauuu

SEQ ID NO: 1761612 - RNA, 22 nt, Human
aaaucuuucuuucuuagaaauu

SEQ ID NO: 1761613 - RNA, 23 nt, Human
aaauggagucauuugagucucuu

SEQ ID NO: 1761614 - RNA, 14 nt, Human
aaaugcuuuagaaa

SEQ ID NO: 1761615 - RNA, 16 nt, Human
aaccgugguaugucug

SEQ ID NO: 1761616 - RNA, 18 nt, Human
aaccgugguaugucugcc

SEQ ID NO: 1761617 - RNA, 11 nt, Human
aacaggcagau

SEQ ID NO: 1761618 - RNA, 17 nt, Human
aacaggccauugugaac

SEQ ID NO: 1761619 - RNA, 23 nt, Human
aacaggccauugugaaccaaugc

SEQ ID NO: 1761620 - RNA, 15 nt, Human
aacagccacuccccu

SEQ ID NO: 1761621 - RNA, 18 nt, Human
aacagccacuccccucca

SEQ ID NO: 1761622 - RNA, 20 nt, Human
aacaugacccuaaaucuuga

SEQ ID NO: 1761623 - RNA, 21 nt, Human
aacaucuugaauacucugccc

SEQ ID NO: 1761624 - RNA, 15 nt, Human
aauaaacacuacaga

SEQ ID NO: 1761625 - RNA, 21 nt, Human
aauaaacuuggauucucuaac

SEQ ID NO: 1761626 - RNA, 16 nt, Human
aaguugguuggauaag

SEQ ID NO: 1761627 - RNA, 21 nt, Human
aaguuggguuaauaccagcuu

SEQ ID NO: 1761628 - RNA, 22 nt, Human
aagugcugggauuacaggugug

SEQ ID NO: 1761629 - RNA, 12 nt, Human
aagugcugggau

SEQ ID NO: 1761630 - RNA, 13 nt, Human
aaguggccucuuu

SEQ ID NO: 1761631 - RNA, 14 nt, Human
aaguggccucuuug

SEQ ID NO: 1761632 - RNA, 17 nt, Human
aaguggccucuuugucu

SEQ ID NO: 1761633 - RNA, 22 nt, Human
aaguggccucuuugucuaaaac

SEQ ID NO: 1761634 - RNA, 15 nt, Human
aauaaagcacugagc

SEQ ID NO: 1761635 - RNA, 13 nt, Human
aauaaagaauacu

SEQ ID NO: 1761636 - RNA, 14 nt, Human
aauaaagaauacuu

SEQ ID NO: 1761637 - RNA, 15 nt, Human
aauaaagaauacuug

SEQ ID NO: 1761638 - RNA, 19 nt, Human
aauaaagaauacuugaacu

SEQ ID NO: 1761639 - RNA, 21 nt, Human
aauauguauuuaccaaaaauu

SEQ ID NO: 1761640 - RNA, 18 nt, Human
aaugaaguuugaauguua

SEQ ID NO: 1761641 - RNA, 17 nt, Human
aaugaaguuugaauguu

SEQ ID NO: 1761642 - RNA, 20 nt, Human
aaugaauacuuuauaaagga

SEQ ID NO: 1761643 - RNA, 22 nt, Human
aaugaaguuugaauguuaaaua

SEQ ID NO: 1761644 - RNA, 21 nt, Human
aaugaaguuugaauguuaaau

SEQ ID NO: 1761645 - RNA, 20 nt, Human
aaugaaguuugaauguuaaa

SEQ ID NO: 1761646 - RNA, 19 nt, Human
aaugaaguuugaauguuaa

SEQ ID NO: 1761647 - RNA, 16 nt, Human
aagcgugagccacugc

SEQ ID NO: 1761648 - RNA, 15 nt, Human
aagcgugagccacug

SEQ ID NO: 1761649 - RNA, 18 nt, Human
aagauaauauuuuacaua

SEQ ID NO: 1761650 - RNA, 20 nt, Human
aagauacagaacucuuucaa

SEQ ID NO: 1761651 - RNA, 22 nt, Human
aagauacagaacucuuucaaaa

SEQ ID NO: 1761652 - RNA, 18 nt, Human
aaggcaagcacuuguggg

SEQ ID NO: 1761653 - RNA, 19 nt, Human
aagacacugcagaaacccu

SEQ ID NO: 1761654 - RNA, 13 nt, Human
aagaaccccucug

SEQ ID NO: 1761655 - RNA, 14 nt, Human
aagaaccccucugc

SEQ ID NO: 1761656 - RNA, 15 nt, Human
aagaaccccucugcu

SEQ ID NO: 1761657 - RNA, 17 nt, Human
aagaaccccucugcuuu

SEQ ID NO: 1761658 - RNA, 15 nt, Human
aagacaaugacauac

SEQ ID NO: 1761659 - RNA, 21 nt, Human
aagacaaggaaaaaauaacaa

SEQ ID NO: 1761660 - RNA, 19 nt, Human
aagaguaguugauguugca

SEQ ID NO: 1761661 - RNA, 22 nt, Human
aagaguaguugauguugcauuu

SEQ ID NO: 1761662 - RNA, 23 nt, Human
aagaguaguugauguugcauuuu

SEQ ID NO: 1761663 - RNA, 19 nt, Human
acucccaagguuggagccc

SEQ ID NO: 1761664 - RNA, 16 nt, Human
acuccgagugaacugg

SEQ ID NO: 1761665 - RNA, 18 nt, Human
acuccgagugaacugguc

SEQ ID NO: 1761666 - RNA, 13 nt, Human
acuccggcugugc

SEQ ID NO: 1761667 - RNA, 14 nt, Human
acuccggcugugcu

SEQ ID NO: 1761668 - RNA, 15 nt, Human
acuccggcugugcug

SEQ ID NO: 1761669 - RNA, 16 nt, Human
acuccggcugugcugg

SEQ ID NO: 1761670 - RNA, 17 nt, Human
acuccggcugugcuggg

SEQ ID NO: 1761671 - RNA, 18 nt, Human
acuccggcugugcuggga

SEQ ID NO: 1761672 - RNA, 15 nt, Human
acucuacagaggcca

SEQ ID NO: 1761673 - RNA, 23 nt, Human
acugaugggcaacccccagccug

SEQ ID NO: 1761674 - RNA, 22 nt, Human
acugacauuguuggccaaagcc

SEQ ID NO: 1761675 - RNA, 15 nt, Human
acugaucacaaaaac

SEQ ID NO: 1761676 - RNA, 18 nt, Human
acugaucaggaccuccaa

SEQ ID NO: 1761677 - RNA, 17 nt, Human
acugacauuguuggcca

SEQ ID NO: 1761678 - RNA, 18 nt, Human
acugacauuguuggccaa

SEQ ID NO: 1761679 - RNA, 13 nt, Human
acuggugcccucc

SEQ ID NO: 1761680 - RNA, 12 nt, Human
acugcccuggcu

SEQ ID NO: 1761681 - RNA, 17 nt, Human
acugugccaugugccag

SEQ ID NO: 1761682 - RNA, 18 nt, Human
acugugccaugugccagg

SEQ ID NO: 1761683 - RNA, 17 nt, Human
acuguaaaauaauaacu

SEQ ID NO: 1761684 - RNA, 14 nt, Human
acuucagauugaac

SEQ ID NO: 1761685 - RNA, 13 nt, Human
acuguuuccuuca

SEQ ID NO: 1761686 - RNA, 12 nt, Human
accucagccucc

SEQ ID NO: 1761687 - RNA, 11 nt, Human
accucagccuc

SEQ ID NO: 1761688 - RNA, 12 nt, Human
accgggcacuca

SEQ ID NO: 1761689 - RNA, 14 nt, Human
accgggcacucaga

SEQ ID NO: 1761690 - RNA, 16 nt, Human
accgggcacucagaag

SEQ ID NO: 1761691 - RNA, 20 nt, Human
accucaggugauccacccac

SEQ ID NO: 1761692 - RNA, 21 nt, Human
accucaggugauccacccacc

SEQ ID NO: 1761693 - RNA, 17 nt, Human
accuccaagccacugag

SEQ ID NO: 1761694 - RNA, 16 nt, Human
acccuaaaucuugacu

SEQ ID NO: 1761695 - RNA, 16 nt, Human
acccuggggagaaagu

SEQ ID NO: 1761696 - RNA, 15 nt, Human
acccuggggaaggag

SEQ ID NO: 1761697 - RNA, 19 nt, Human
acccuggggaaggagccag

SEQ ID NO: 1761698 - RNA, 13 nt, Human
acccuggggccug

SEQ ID NO: 1761699 - RNA, 14 nt, Human
acccuggggccuga

SEQ ID NO: 1761700 - RNA, 18 nt, Human
acccuggggccugacugc

SEQ ID NO: 1761701 - RNA, 22 nt, Human
acccuggggccugacugcucag

SEQ ID NO: 1761702 - RNA, 15 nt, Human
acccugggccuggca

SEQ ID NO: 1761703 - RNA, 22 nt, Human
acccugggccuggcagcucagc

SEQ ID NO: 1761704 - RNA, 23 nt, Human
accugugcuucgggcccuuccca

SEQ ID NO: 1761705 - RNA, 19 nt, Human
accugugcuucgggcccuu

SEQ ID NO: 1761706 - RNA, 22 nt, Human
accugugcuucgggcccuuccc

SEQ ID NO: 1761707 - RNA, 15 nt, Human
accugugccucggcu

SEQ ID NO: 1761708 - RNA, 16 nt, Human
accugugccucggcuu

SEQ ID NO: 1761709 - RNA, 14 nt, Human
accugugccucggc

SEQ ID NO: 1761710 - RNA, 19 nt, Human
accugugaguuuaaagcaa

SEQ ID NO: 1761711 - RNA, 18 nt, Human
accugugaguuuaaagca

SEQ ID NO: 1761712 - RNA, 12 nt, Human
accucugccuga

SEQ ID NO: 1761713 - RNA, 20 nt, Human
accucugccugaagucacac

SEQ ID NO: 1761714 - RNA, 23 nt, Human
accucugccugaagucacacagu

SEQ ID NO: 1761715 - RNA, 14 nt, Human
accucuguucagug

SEQ ID NO: 1761716 - RNA, 15 nt, Human
accucuguucagugu

SEQ ID NO: 1761717 - RNA, 17 nt, Human
accucuguucaguguaa

SEQ ID NO: 1761718 - RNA, 18 nt, Human
accucuguucaguguaaa

SEQ ID NO: 1761719 - RNA, 19 nt, Human
accucuguucaguguaaau

SEQ ID NO: 1761720 - RNA, 22 nt, Human
accucuguucaguguaaauagu

SEQ ID NO: 1761721 - RNA, 12 nt, Human
accuuggcucaa

SEQ ID NO: 1761722 - RNA, 13 nt, Human
accuuggccuggg

SEQ ID NO: 1761723 - RNA, 14 nt, Human
accuuggccugggc

SEQ ID NO: 1761724 - RNA, 15 nt, Human
accuuggccugggcc

SEQ ID NO: 1761725 - RNA, 16 nt, Human
accuuggccugggccg

SEQ ID NO: 1761726 - RNA, 13 nt, Human
accuugcuuuugc

SEQ ID NO: 1761727 - RNA, 15 nt, Human
accuugcuuuugcuu

SEQ ID NO: 1761728 - RNA, 17 nt, Human
accuugcuuuugcuucu

SEQ ID NO: 1761729 - RNA, 18 nt, Human
accuugcuuuugcuucua

SEQ ID NO: 1761730 - RNA, 18 nt, Human
acuaauggggcggugaga

SEQ ID NO: 1761731 - RNA, 17 nt, Human
acguggacguuuuuaau

SEQ ID NO: 1761732 - RNA, 19 nt, Human
acggaauaguuggcuagga

SEQ ID NO: 1761733 - RNA, 22 nt, Human
acgcuugcucuguuuguggggu

SEQ ID NO: 1761734 - RNA, 19 nt, Human
acagcucuucuccaggcug

SEQ ID NO: 1761735 - RNA, 20 nt, Human
acagcucuucuccaggcugu

SEQ ID NO: 1761736 - RNA, 15 nt, Human
acaggcaaugcuggc

SEQ ID NO: 1761737 - RNA, 16 nt, Human
acaggcaaugcuggcu

SEQ ID NO: 1761738 - RNA, 14 nt, Human
acaggcacccacca

SEQ ID NO: 1761739 - RNA, 17 nt, Human
acaggcaaugcuggcug

SEQ ID NO: 1761740 - RNA, 17 nt, Human
acaguggauugcauuuc

SEQ ID NO: 1761741 - RNA, 20 nt, Human
acagugcugcagcucccugg

SEQ ID NO: 1761742 - RNA, 21 nt, Human
acagugcugcagcucccuggc

SEQ ID NO: 1761743 - RNA, 23 nt, Human
acaggcacccaccaucaugucug

SEQ ID NO: 1761744 - RNA, 13 nt, Human
acaggcagagcug

SEQ ID NO: 1761745 - RNA, 18 nt, Human
accacgcuggaccuugaa

SEQ ID NO: 1761746 - RNA, 16 nt, Human
accacgcuggggucug

SEQ ID NO: 1761747 - RNA, 14 nt, Human
accacgcuggaccu

SEQ ID NO: 1761748 - RNA, 16 nt, Human
accacgcuggaccuug

SEQ ID NO: 1761749 - RNA, 19 nt, Human
accaacccuggggaaggag

SEQ ID NO: 1761750 - RNA, 13 nt, Human
acaugcacgugug

SEQ ID NO: 1761751 - RNA, 18 nt, Human
acaucccgggacgcagca

SEQ ID NO: 1761752 - RNA, 15 nt, Human
acaugccugccccaa

SEQ ID NO: 1761753 - RNA, 21 nt, Human
acaugccugccccaaacaaau

SEQ ID NO: 1761754 - RNA, 22 nt, Human
acaugccugccccaaacaaaua

SEQ ID NO: 1761755 - RNA, 22 nt, Human
acauacacuguauguuauagaa

SEQ ID NO: 1761756 - RNA, 19 nt, Human
acauguggcuccucccagc

SEQ ID NO: 1761757 - RNA, 20 nt, Human
acauguguuaaguauuuuca

SEQ ID NO: 1761758 - RNA, 15 nt, Human
aauucuacauuguca

SEQ ID NO: 1761759 - RNA, 13 nt, Human
aauucuaaaugua

SEQ ID NO: 1761760 - RNA, 22 nt, Human
aauucuaucuuuuguuuccuuu

SEQ ID NO: 1761761 - RNA, 21 nt, Human
aauucucauuugucacacacu

SEQ ID NO: 1761762 - RNA, 14 nt, Human
aauucugaauuugc

SEQ ID NO: 1761763 - RNA, 15 nt, Human
aauucugaauuugca

SEQ ID NO: 1761764 - RNA, 16 nt, Human
aauucugaauuugcaa

SEQ ID NO: 1761765 - RNA, 17 nt, Human
aauucugaauuugcaaa

SEQ ID NO: 1761766 - RNA, 18 nt, Human
aauucugaauuugcaaag

SEQ ID NO: 1761767 - RNA, 19 nt, Human
aauucugaauuugcaaagu

SEQ ID NO: 1761768 - RNA, 20 nt, Human
aauucugaauuugcaaagua

SEQ ID NO: 1761769 - RNA, 15 nt, Human
aauucggugugcacc

SEQ ID NO: 1761770 - RNA, 18 nt, Human
aauuauagaccucuagua

SEQ ID NO: 1761771 - RNA, 21 nt, Human
aauuauaggaauaucaauaua

SEQ ID NO: 1761772 - RNA, 22 nt, Human
aauuauagugauguaaucuuga

SEQ ID NO: 1761773 - RNA, 11 nt, Human
aauuguaauag

SEQ ID NO: 1761774 - RNA, 19 nt, Human
aauuucccccuaaaccaac

SEQ ID NO: 1761775 - RNA, 14 nt, Human
acacagcucuucuc

SEQ ID NO: 1761776 - RNA, 16 nt, Human
acacagcucuucucca

SEQ ID NO: 1761777 - RNA, 19 nt, Human
acacagccgauucaccuga

SEQ ID NO: 1761778 - RNA, 23 nt, Human
acacagccgauucaccugagcag

SEQ ID NO: 1761779 - RNA, 14 nt, Human
acacacuuuuuaag

SEQ ID NO: 1761780 - RNA, 19 nt, Human
acacacuuuuuaagaaaua

SEQ ID NO: 1761781 - RNA, 19 nt, Human
acacagcucuucuccaggc

SEQ ID NO: 1761782 - RNA, 18 nt, Human
acacagcucuucuccagg

SEQ ID NO: 1761783 - RNA, 18 nt, Human
acaccagagcccaccuug

SEQ ID NO: 1761784 - RNA, 23 nt, Human
acaccagagcccaccuuggcuca

SEQ ID NO: 1761785 - RNA, 13 nt, Human
acaccagagccca

SEQ ID NO: 1761786 - RNA, 13 nt, Human
acacgcaggagca

SEQ ID NO: 1761787 - RNA, 14 nt, Human
acacgcaggagcac

SEQ ID NO: 1761788 - RNA, 15 nt, Human
acacgcaggagcaca

SEQ ID NO: 1761789 - RNA, 22 nt, Human
acacgccugcaaacgcugccug

SEQ ID NO: 1761790 - RNA, 19 nt, Human
acaagguuauaugaauaua

SEQ ID NO: 1761791 - RNA, 17 nt, Human
acaaacugguauucugu

SEQ ID NO: 1761792 - RNA, 14 nt, Human
acaaacaugacccu

SEQ ID NO: 1761793 - RNA, 17 nt, Human
acaacauuuacaacuca

SEQ ID NO: 1761794 - RNA, 13 nt, Human
aucaugagccugc

SEQ ID NO: 1761795 - RNA, 15 nt, Human
aucaugagccugcug

SEQ ID NO: 1761796 - RNA, 16 nt, Human
aucaugagccugcugg

SEQ ID NO: 1761797 - RNA, 17 nt, Human
aucaugagccugcugga

SEQ ID NO: 1761798 - RNA, 21 nt, Human
aucaugagccugcuggaagcc

SEQ ID NO: 1761799 - RNA, 15 nt, Human
aucaaauaaagagag

SEQ ID NO: 1761800 - RNA, 17 nt, Human
aucaaauaaagagagaa

SEQ ID NO: 1761801 - RNA, 14 nt, Human
auccacuucuuuca

SEQ ID NO: 1761802 - RNA, 22 nt, Human
auccacuucuuucagcagacug

SEQ ID NO: 1761803 - RNA, 21 nt, Human
auccacugugccaugugccag

SEQ ID NO: 1761804 - RNA, 21 nt, Human
auccccaguaaaauugccaua

SEQ ID NO: 1761805 - RNA, 15 nt, Human
auccccaguaaaauu

SEQ ID NO: 1761806 - RNA, 15 nt, Human
augcuuuccaaaccu

SEQ ID NO: 1761807 - RNA, 12 nt, Human
augcuuuccuuc

SEQ ID NO: 1761808 - RNA, 14 nt, Human
augcuuuccuucuu

SEQ ID NO: 1761809 - RNA, 20 nt, Human
augcuuuccaaaccuuaucu

SEQ ID NO: 1761810 - RNA, 18 nt, Human
auggagcaucaagccacu

SEQ ID NO: 1761811 - RNA, 11 nt, Human
augccuggugg

SEQ ID NO: 1761812 - RNA, 12 nt, Human
augccugguggc

SEQ ID NO: 1761813 - RNA, 13 nt, Human
augccugguggca

SEQ ID NO: 1761814 - RNA, 14 nt, Human
augccugguggcag

SEQ ID NO: 1761815 - RNA, 19 nt, Human
augccugguggcagcugcg

SEQ ID NO: 1761816 - RNA, 18 nt, Human
augccugguggcagcugc

SEQ ID NO: 1761817 - RNA, 21 nt, Human
augccugguggcagcugcggu

SEQ ID NO: 1761818 - RNA, 22 nt, Human
augcaucucacuggaugcaaag

SEQ ID NO: 1761819 - RNA, 16 nt, Human
augaauauaaugaaug

SEQ ID NO: 1761820 - RNA, 21 nt, Human
augagccucagcauccuggca

SEQ ID NO: 1761821 - RNA, 12 nt, Human
augagccugcug

SEQ ID NO: 1761822 - RNA, 14 nt, Human
augagccugcugga

SEQ ID NO: 1761823 - RNA, 17 nt, Human
augagccugcuggaagc

SEQ ID NO: 1761824 - RNA, 20 nt, Human
augagccugcuggaagccca

SEQ ID NO: 1761825 - RNA, 23 nt, Human
augaagcauuuacuuuguguuca

SEQ ID NO: 1761826 - RNA, 21 nt, Human
augaauacuguauuuuguauu

SEQ ID NO: 1761827 - RNA, 14 nt, Human
aguccucuuuucug

SEQ ID NO: 1761828 - RNA, 17 nt, Human
aguccucccugacuuuu

SEQ ID NO: 1761829 - RNA, 19 nt, Human
aguccucccugacuuuucu

SEQ ID NO: 1761830 - RNA, 22 nt, Human
aguccucccugacuuuucugug

SEQ ID NO: 1761831 - RNA, 16 nt, Human
agucauuugagucucu

SEQ ID NO: 1761832 - RNA, 18 nt, Human
agucauuugagucucuua

SEQ ID NO: 1761833 - RNA, 21 nt, Human
agucugauucccaagcucugc

SEQ ID NO: 1761834 - RNA, 22 nt, Human
agucugauucccaagcucugcu

SEQ ID NO: 1761835 - RNA, 19 nt, Human
agucgauagagcuguauua

SEQ ID NO: 1761836 - RNA, 16 nt, Human
agucgaggacagggag

SEQ ID NO: 1761837 - RNA, 13 nt, Human
agucuggcccuag

SEQ ID NO: 1761838 - RNA, 22 nt, Human
agucuggcccuagacucggggu

SEQ ID NO: 1761839 - RNA, 15 nt, Human
agucuguccaggcuc

SEQ ID NO: 1761840 - RNA, 16 nt, Human
agugacagaggcagcc

SEQ ID NO: 1761841 - RNA, 19 nt, Human
agugacagaggcagcccca

SEQ ID NO: 1761842 - RNA, 14 nt, Human
agugacagaggcag

SEQ ID NO: 1761843 - RNA, 16 nt, Human
agugaaugauucagug

SEQ ID NO: 1761844 - RNA, 17 nt, Human
agugaaugauucagugu

SEQ ID NO: 1761845 - RNA, 19 nt, Human
agugaaugauucaguguua

SEQ ID NO: 1761846 - RNA, 13 nt, Human
agugaaugauuca

SEQ ID NO: 1761847 - RNA, 20 nt, Human
agugauccucccaccucagc

SEQ ID NO: 1761848 - RNA, 22 nt, Human
agugauccucccaccucagccu

SEQ ID NO: 1761849 - RNA, 23 nt, Human
agugauccucccaccucagccuc

SEQ ID NO: 1761850 - RNA, 16 nt, Human
agugauguaccaugaa

SEQ ID NO: 1761851 - RNA, 18 nt, Human
agugauucuccugccuca

SEQ ID NO: 1761852 - RNA, 19 nt, Human
agugauucuccugccucag

SEQ ID NO: 1761853 - RNA, 20 nt, Human
agugauucuccugccucagc

SEQ ID NO: 1761854 - RNA, 13 nt, Human
agugcuaagugug

SEQ ID NO: 1761855 - RNA, 15 nt, Human
agugccuucuguggg

SEQ ID NO: 1761856 - RNA, 17 nt, Human
agugccuucugugggga

SEQ ID NO: 1761857 - RNA, 18 nt, Human
agugccuucuguggggac

SEQ ID NO: 1761858 - RNA, 15 nt, Human
agugcguccacgagc

SEQ ID NO: 1761859 - RNA, 20 nt, Human
aguacuucuccacccugcuc

SEQ ID NO: 1761860 - RNA, 19 nt, Human
aguacuucuccacccugcu

SEQ ID NO: 1761861 - RNA, 21 nt, Human
aguacuucuccacccugcucu

SEQ ID NO: 1761862 - RNA, 22 nt, Human
aguacuucuccacccugcucuc

SEQ ID NO: 1761863 - RNA, 22 nt, Human
aguaaaauugccauauugcaca

SEQ ID NO: 1761864 - RNA, 23 nt, Human
aguaaaauugccauauugcacau

SEQ ID NO: 1761865 - RNA, 21 nt, Human
aguaaaauugccauauugcac

SEQ ID NO: 1761866 - RNA, 20 nt, Human
aguaaaauugccauauugca

SEQ ID NO: 1761867 - RNA, 19 nt, Human
aguaaaauugccauauugc

SEQ ID NO: 1761868 - RNA, 17 nt, Human
aguaaaauugccauauu

SEQ ID NO: 1761869 - RNA, 16 nt, Human
aguaaaauugccauau

SEQ ID NO: 1761870 - RNA, 14 nt, Human
aguaaaauugccau

SEQ ID NO: 1761871 - RNA, 17 nt, Human
aggggccagaggcucgu

SEQ ID NO: 1761872 - RNA, 12 nt, Human
aggggccagagg

SEQ ID NO: 1761873 - RNA, 13 nt, Human
aggggccagaggc

SEQ ID NO: 1761874 - RNA, 14 nt, Human
aggggccagaggcu

SEQ ID NO: 1761875 - RNA, 15 nt, Human
aggggccagaggcuc

SEQ ID NO: 1761876 - RNA, 15 nt, Human
aggggcauugcugac

SEQ ID NO: 1761877 - RNA, 22 nt, Human
auacacccccucuucugagcac

SEQ ID NO: 1761878 - RNA, 23 nt, Human
auacacccccucuucugagcaca

SEQ ID NO: 1761879 - RNA, 20 nt, Human
auacacuguauguuauagaa

SEQ ID NO: 1761880 - RNA, 22 nt, Human
auacacuauuugugagcaaagg

SEQ ID NO: 1761881 - RNA, 19 nt, Human
auacuguauuuuguauugu

SEQ ID NO: 1761882 - RNA, 16 nt, Human
auacuuuugcccuuug

SEQ ID NO: 1761883 - RNA, 12 nt, Human
auacuugaacuu

SEQ ID NO: 1761884 - RNA, 13 nt, Human
auacuugaacuug

SEQ ID NO: 1761885 - RNA, 21 nt, Human
auacuugaacuugccucuuuu

SEQ ID NO: 1761886 - RNA, 14 nt, Human
auacuugaacuugu

SEQ ID NO: 1761887 - RNA, 10 nt, Human
auaaaagaug

SEQ ID NO: 1761888 - RNA, 20 nt, Human
auaaagagagaacaggacua

SEQ ID NO: 1761889 - RNA, 15 nt, Human
auacaauucuacauu

SEQ ID NO: 1761890 - RNA, 20 nt, Human
auaagugcuguauaaaauca

SEQ ID NO: 1761891 - RNA, 19 nt, Human
auaagugcuguauaaaauc

SEQ ID NO: 1761892 - RNA, 18 nt, Human
auaagugcuguauaaaau

SEQ ID NO: 1761893 - RNA, 17 nt, Human
auaagugcuguauaaaa

SEQ ID NO: 1761894 - RNA, 22 nt, Human
auaagugcuguauaaaaucagc

SEQ ID NO: 1761895 - RNA, 16 nt, Human
auaagugcuguauaaa

SEQ ID NO: 1761896 - RNA, 15 nt, Human
auaagugcuguauaa

SEQ ID NO: 1761897 - RNA, 14 nt, Human
auaagugcuguaua

SEQ ID NO: 1761898 - RNA, 13 nt, Human
auaagugcuguau

SEQ ID NO: 1761899 - RNA, 23 nt, Human
auaaguaaagugauuaaagugcu

SEQ ID NO: 1761900 - RNA, 20 nt, Human
auaagcuauccguguugcag

SEQ ID NO: 1761901 - RNA, 15 nt, Human
auaaaagacagugaa

SEQ ID NO: 1761902 - RNA, 16 nt, Human
auaaaagacagugaaa

SEQ ID NO: 1761903 - RNA, 13 nt, Human
auaaaaaaugaaa

SEQ ID NO: 1761904 - RNA, 13 nt, Human
auaaaaaauaugu

SEQ ID NO: 1761905 - RNA, 14 nt, Human
auaaaaaauaugua

SEQ ID NO: 1761906 - RNA, 17 nt, Human
auaaaaaauauguauuu

SEQ ID NO: 1761907 - RNA, 20 nt, Human
auaaaaaauauguauuuacc

SEQ ID NO: 1761908 - RNA, 22 nt, Human
aguuugccggauacaaacuggu

SEQ ID NO: 1761909 - RNA, 14 nt, Human
aguucauacccugu

SEQ ID NO: 1761910 - RNA, 20 nt, Human
aguuacacagaaaugcugcu

SEQ ID NO: 1761911 - RNA, 21 nt, Human
aguuacacagaaaugcugcug

SEQ ID NO: 1761912 - RNA, 22 nt, Human
aguuacacagaaaugcugcugg

SEQ ID NO: 1761913 - RNA, 11 nt, Human
agugcucccuc

SEQ ID NO: 1761914 - RNA, 14 nt, Human
agugcucgcuguug

SEQ ID NO: 1761915 - RNA, 14 nt, Human
agugcucccucaca

SEQ ID NO: 1761916 - RNA, 17 nt, Human
agugcucccucacaugu

SEQ ID NO: 1761917 - RNA, 23 nt, Human
aguuaaauagaguauaugcacuu

SEQ ID NO: 1761918 - RNA, 14 nt, Human
aguguuuuguacca

SEQ ID NO: 1761919 - RNA, 16 nt, Human
aguguuuuguaccagu

SEQ ID NO: 1761920 - RNA, 22 nt, Human
aguguuuuguaccagugaauuu

SEQ ID NO: 1761921 - RNA, 16 nt, Human
agaucucugcagggcc

SEQ ID NO: 1761922 - RNA, 17 nt, Human
agaucucugcagggccg

SEQ ID NO: 1761923 - RNA, 17 nt, Human
agaugggugaaggcugg

SEQ ID NO: 1761924 - RNA, 21 nt, Human
agaugggugaaggcuggcaug

SEQ ID NO: 1761925 - RNA, 12 nt, Human
agauucuuuccc

SEQ ID NO: 1761926 - RNA, 19 nt, Human
agauggggucuguaaaauc

SEQ ID NO: 1761927 - RNA, 18 nt, Human
agauggggucuguaaaau

SEQ ID NO: 1761928 - RNA, 16 nt, Human
agauggggucuguaaa

SEQ ID NO: 1761929 - RNA, 22 nt, Human
agaugggggcagggcugugcuu

SEQ ID NO: 1761930 - RNA, 16 nt, Human
agauugcaacaggcug

SEQ ID NO: 1761931 - RNA, 17 nt, Human
agauugcaacaggcugg

SEQ ID NO: 1761932 - RNA, 19 nt, Human
agauugcaacaggcugggc

SEQ ID NO: 1761933 - RNA, 22 nt, Human
agauugcaugugacucugaagc

SEQ ID NO: 1761934 - RNA, 13 nt, Human
agauugcauguga

SEQ ID NO: 1761935 - RNA, 15 nt, Human
agauugcaugugacu

SEQ ID NO: 1761936 - RNA, 16 nt, Human
agauugcaugugacuc

SEQ ID NO: 1761937 - RNA, 18 nt, Human
agauugcaugugacucug

SEQ ID NO: 1761938 - RNA, 19 nt, Human
agauugcaugugacucuga

SEQ ID NO: 1761939 - RNA, 23 nt, Human
agauugcaugugacucugaagcu

SEQ ID NO: 1761940 - RNA, 17 nt, Human
agcaaaggggacagcug

SEQ ID NO: 1761941 - RNA, 19 nt, Human
agcaaauaaacuaggaaau

SEQ ID NO: 1761942 - RNA, 20 nt, Human
agagggucugaggaauccag

SEQ ID NO: 1761943 - RNA, 12 nt, Human
agauagggaaaa

SEQ ID NO: 1761944 - RNA, 15 nt, Human
agauagggaaaaggg

SEQ ID NO: 1761945 - RNA, 22 nt, Human
agauagggaaaaggggcuccuu

SEQ ID NO: 1761946 - RNA, 15 nt, Human
agauauaagugcugu

SEQ ID NO: 1761947 - RNA, 13 nt, Human
agauauaagugcu

SEQ ID NO: 1761948 - RNA, 20 nt, Human
agauagauaggucagugcaa

SEQ ID NO: 1761949 - RNA, 23 nt, Human
agauauaagugcuguauaaaauc

SEQ ID NO: 1761950 - RNA, 22 nt, Human
agauauaagugcuguauaaaau

SEQ ID NO: 1761951 - RNA, 21 nt, Human
agauauaagugcuguauaaaa

SEQ ID NO: 1761952 - RNA, 20 nt, Human
agauauaagugcuguauaaa

SEQ ID NO: 1761953 - RNA, 18 nt, Human
agauauaagugcuguaua

SEQ ID NO: 1761954 - RNA, 17 nt, Human
agauauaagugcuguau

SEQ ID NO: 1761955 - RNA, 16 nt, Human
agauauaagugcugua

SEQ ID NO: 1761956 - RNA, 20 nt, Human
agcaauuuauacaauaucau

SEQ ID NO: 1761957 - RNA, 22 nt, Human
agcaauuucccccuaaaccaac

SEQ ID NO: 1761958 - RNA, 24 nt, Human
agcaauuucccccuaaaccaacug

SEQ ID NO: 1761959 - RNA, 17 nt, Human
agcacugagcaaguuga

SEQ ID NO: 1761960 - RNA, 20 nt, Human
agcagcuaaaccaaggacug

SEQ ID NO: 1761961 - RNA, 11 nt, Human
agcacugagca

SEQ ID NO: 1761962 - RNA, 12 nt, Human
agcacugagcaa

SEQ ID NO: 1761963 - RNA, 17 nt, Human
agcacuaugcuuuccuu

SEQ ID NO: 1761964 - RNA, 18 nt, Human
agcacuaugcuuuccuuc

SEQ ID NO: 1761965 - RNA, 22 nt, Human
agccaagaccucacacacacaa

SEQ ID NO: 1761966 - RNA, 15 nt, Human
agcaucuacuucagg

SEQ ID NO: 1761967 - RNA, 13 nt, Human
agcccaccuuggc

SEQ ID NO: 1761968 - RNA, 16 nt, Human
agccauuuuucaaagc

SEQ ID NO: 1761969 - RNA, 18 nt, Human
agccauuuuucaaagcaa

SEQ ID NO: 1761970 - RNA, 19 nt, Human
agccauuuuucaaagcaau

SEQ ID NO: 1761971 - RNA, 20 nt, Human
agccauuuuucaaagcaauu

SEQ ID NO: 1761972 - RNA, 14 nt, Human
agcaucggccuagg

SEQ ID NO: 1761973 - RNA, 15 nt, Human
agcaucggccuaggg

SEQ ID NO: 1761974 - RNA, 19 nt, Human
agcaucggccuagggcccc

SEQ ID NO: 1761975 - RNA, 21 nt, Human
agcaucggccuagggccccca

SEQ ID NO: 1761976 - RNA, 19 nt, Human
agaagggagcuagccagag

SEQ ID NO: 1761977 - RNA, 18 nt, Human
agaagggagcuagccaga

SEQ ID NO: 1761978 - RNA, 15 nt, Human
agaagggcugcauga

SEQ ID NO: 1761979 - RNA, 16 nt, Human
agaagggcugcaugau

SEQ ID NO: 1761980 - RNA, 20 nt, Human
agaagggcugcaugauguuu

SEQ ID NO: 1761981 - RNA, 14 nt, Human
agaagucacacagu

SEQ ID NO: 1761982 - RNA, 15 nt, Human
agaaguccuuauguu

SEQ ID NO: 1761983 - RNA, 17 nt, Human
agaaguccuuauguuaa

SEQ ID NO: 1761984 - RNA, 13 nt, Human
agaaccaaauuaa

SEQ ID NO: 1761985 - RNA, 22 nt, Human
agaaccaucccuauuuuguauu

SEQ ID NO: 1761986 - RNA, 16 nt, Human
agaaugaaagggccca

SEQ ID NO: 1761987 - RNA, 13 nt, Human
agaaucucuuucg

SEQ ID NO: 1761988 - RNA, 13 nt, Human
agaaugaugcuca

SEQ ID NO: 1761989 - RNA, 13 nt, Human
agaacaugcaguu

SEQ ID NO: 1761990 - RNA, 14 nt, Human
agaacaugcaguuu

SEQ ID NO: 1761991 - RNA, 16 nt, Human
agaacaugcaguuuga

SEQ ID NO: 1761992 - RNA, 17 nt, Human
agaacaugcaguuugaa

SEQ ID NO: 1761993 - RNA, 18 nt, Human
agaacaugcaguuugaaa

SEQ ID NO: 1761994 - RNA, 19 nt, Human
agaacaugcaguuugaaau

SEQ ID NO: 1761995 - RNA, 20 nt, Human
agaacaugcaguuugaaauu

SEQ ID NO: 1761996 - RNA, 21 nt, Human
agaacaugcaguuugaaauuc

SEQ ID NO: 1761997 - RNA, 22 nt, Human
agaacaugcaguuugaaauucu

SEQ ID NO: 1761998 - RNA, 23 nt, Human
agaacaugcaguuugaaauucug

SEQ ID NO: 1761999 - RNA, 14 nt, Human
agaacaguaugaau

SEQ ID NO: 1762000 - RNA, 17 nt, Human
agaacaguaugaauuug

SEQ ID NO: 1762001 - RNA, 20 nt, Human
agaacaguaugaauuugagc

SEQ ID NO: 1762002 - RNA, 11 nt, Human
agaacaggacu

SEQ ID NO: 1762003 - RNA, 12 nt, Human
agaacaggacua

SEQ ID NO: 1762004 - RNA, 15 nt, Human
agaacaaugugcuau

SEQ ID NO: 1762005 - RNA, 21 nt, Human
agaacacagccgauucaccug

SEQ ID NO: 1762006 - RNA, 15 nt, Human
agacucuuugcauau

SEQ ID NO: 1762007 - RNA, 13 nt, Human
agagaacaggacu

SEQ ID NO: 1762008 - RNA, 14 nt, Human
agagaacaggacua

SEQ ID NO: 1762009 - RNA, 15 nt, Human
agagaggcaauggcu

SEQ ID NO: 1762010 - RNA, 13 nt, Human
agagccugaggga

SEQ ID NO: 1762011 - RNA, 14 nt, Human
agagccugagggau

SEQ ID NO: 1762012 - RNA, 11 nt, Human
agagccugagg

SEQ ID NO: 1762013 - RNA, 19 nt, Human
agacaaggaaaaaauaaca

SEQ ID NO: 1762014 - RNA, 16 nt, Human
agacaaaauggauaca

SEQ ID NO: 1762015 - RNA, 22 nt, Human
agacaaaauggauacauaaaga

SEQ ID NO: 1762016 - RNA, 20 nt, Human
agaccauguggagacuucau

SEQ ID NO: 1762017 - RNA, 20 nt, Human
agaccuuuuuuuuuuuucca

SEQ ID NO: 1762018 - RNA, 21 nt, Human
agaccuuuuuuuuuuuuccaa

SEQ ID NO: 1762019 - RNA, 22 nt, Human
agaccuuuuuuuuuuuuccaau

SEQ ID NO: 1762020 - RNA, 22 nt, Human
agcucaccagccccagugccca

SEQ ID NO: 1762021 - RNA, 23 nt, Human
agcucaccagccccagugcccac

SEQ ID NO: 1762022 - RNA, 20 nt, Human
agcugacuugcacagggauu

SEQ ID NO: 1762023 - RNA, 19 nt, Human
agcugacgaacuuccaugg

SEQ ID NO: 1762024 - RNA, 17 nt, Human
agcucuugugaggaaag

SEQ ID NO: 1762025 - RNA, 16 nt, Human
agcucuugugaggaaa

SEQ ID NO: 1762026 - RNA, 13 nt, Human
agcucuugugagg

SEQ ID NO: 1762027 - RNA, 12 nt, Human
agcucuugugag

SEQ ID NO: 1762028 - RNA, 21 nt, Human
agcucuugugaggaaagucau

SEQ ID NO: 1762029 - RNA, 17 nt, Human
agcugguggaacauaug

SEQ ID NO: 1762030 - RNA, 15 nt, Human
agcugguggacccag

SEQ ID NO: 1762031 - RNA, 15 nt, Human
agcugguggcagagu

SEQ ID NO: 1762032 - RNA, 16 nt, Human
agcugguggcagaguc

SEQ ID NO: 1762033 - RNA, 15 nt, Human
agcuggucccacuca

SEQ ID NO: 1762034 - RNA, 13 nt, Human
agcugccuuagcu

SEQ ID NO: 1762035 - RNA, 16 nt, Human
agcugccuuagcuuca

SEQ ID NO: 1762036 - RNA, 17 nt, Human
agcugccuuagcuucag

SEQ ID NO: 1762037 - RNA, 18 nt, Human
agcugccuuagcuucagg

SEQ ID NO: 1762038 - RNA, 20 nt, Human
agcugccuuagcuucaggaa

SEQ ID NO: 1762039 - RNA, 22 nt, Human
agcugccuuagcuucaggaacc

SEQ ID NO: 1762040 - RNA, 23 nt, Human
agcugccuuagcuucaggaaccu

SEQ ID NO: 1762041 - RNA, 15 nt, Human
agcuguauuuugaaa

SEQ ID NO: 1762042 - RNA, 15 nt, Human
aggaagaaagaaugu

SEQ ID NO: 1762043 - RNA, 18 nt, Human
aggaaaaaauaacaauga

SEQ ID NO: 1762044 - RNA, 19 nt, Human
agcuuuguuucaaccaagu

SEQ ID NO: 1762045 - RNA, 11 nt, Human
agccugcugga

SEQ ID NO: 1762046 - RNA, 12 nt, Human
agccugcuggaa

SEQ ID NO: 1762047 - RNA, 14 nt, Human
agccugcuggaagc

SEQ ID NO: 1762048 - RNA, 19 nt, Human
agccugcuggaagcccagc

SEQ ID NO: 1762049 - RNA, 17 nt, Human
agccuggccagccuaca

SEQ ID NO: 1762050 - RNA, 16 nt, Human
agccuggccccauggu

SEQ ID NO: 1762051 - RNA, 17 nt, Human
agccuggccccaugguc

SEQ ID NO: 1762052 - RNA, 23 nt, Human
agccuuuccucaaaacuggaguc

SEQ ID NO: 1762053 - RNA, 18 nt, Human
agcuaaacuccuuccugg

SEQ ID NO: 1762054 - RNA, 23 nt, Human
agcuaaacuccuuccuggccuga

SEQ ID NO: 1762055 - RNA, 17 nt, Human
agcgauucuucugcuuc

SEQ ID NO: 1762056 - RNA, 19 nt, Human
agcgauucuucugcuucag

SEQ ID NO: 1762057 - RNA, 15 nt, Human
agcgauucuucugcu

SEQ ID NO: 1762058 - RNA, 13 nt, Human
agcucaccagccc

SEQ ID NO: 1762059 - RNA, 14 nt, Human
agcucaccagcccc

SEQ ID NO: 1762060 - RNA, 15 nt, Human
agcucaccagcccca

SEQ ID NO: 1762061 - RNA, 21 nt, Human
agcucaccagccccagugccc

SEQ ID NO: 1762062 - RNA, 13 nt, Human
agcuacaaaugca

SEQ ID NO: 1762063 - RNA, 13 nt, Human
agcuaaugggaca

SEQ ID NO: 1762064 - RNA, 14 nt, Human
agcuaaugggacac

SEQ ID NO: 1762065 - RNA, 15 nt, Human
agcuaaugggacacu

SEQ ID NO: 1762066 - RNA, 12 nt, Human
agcuacaaaugc

SEQ ID NO: 1762067 - RNA, 14 nt, Human
agccaaguagccuc

SEQ ID NO: 1762068 - RNA, 13 nt, Human
aggcagauacagg

SEQ ID NO: 1762069 - RNA, 12 nt, Human
aggcauguucuc

SEQ ID NO: 1762070 - RNA, 20 nt, Human
aggcauguucucugaggaca

SEQ ID NO: 1762071 - RNA, 22 nt, Human
aggcauguucucugaggacacu

SEQ ID NO: 1762072 - RNA, 14 nt, Human
aggccaugggccuc

SEQ ID NO: 1762073 - RNA, 16 nt, Human
aggccaugggccuccu

SEQ ID NO: 1762074 - RNA, 17 nt, Human
aggccaugggccuccug

SEQ ID NO: 1762075 - RNA, 12 nt, Human
aggccaggccgg

SEQ ID NO: 1762076 - RNA, 13 nt, Human
aggccagggcaga

SEQ ID NO: 1762077 - RNA, 15 nt, Human
aggccagggcagagu

SEQ ID NO: 1762078 - RNA, 15 nt, Human
aggauggcaggacgu

SEQ ID NO: 1762079 - RNA, 22 nt, Human
aggauggcaggacgugggcugg

SEQ ID NO: 1762080 - RNA, 14 nt, Human
aggagugagcacua

SEQ ID NO: 1762081 - RNA, 12 nt, Human
aggagugagcac

SEQ ID NO: 1762082 - RNA, 16 nt, Human
aggaggguguaaugga

SEQ ID NO: 1762083 - RNA, 19 nt, Human
aggagagcaucggccuagg

SEQ ID NO: 1762084 - RNA, 16 nt, Human
aggagacggaggggag

SEQ ID NO: 1762085 - RNA, 13 nt, Human
aggagacaggcag

SEQ ID NO: 1762086 - RNA, 18 nt, Human
aggagacaggcagagcug

SEQ ID NO: 1762087 - RNA, 16 nt, Human
aggaugggucagagcu

SEQ ID NO: 1762088 - RNA, 17 nt, Human
aggaugggucagagcua

SEQ ID NO: 1762089 - RNA, 15 nt, Human
agggcuacccugagc

SEQ ID NO: 1762090 - RNA, 16 nt, Human
agggauucucacaaua

SEQ ID NO: 1762091 - RNA, 17 nt, Human
agggauucucacaauag

SEQ ID NO: 1762092 - RNA, 17 nt, Human
agggcuacccugagcug

SEQ ID NO: 1762093 - RNA, 18 nt, Human
agggcuacccugagcuga

SEQ ID NO: 1762094 - RNA, 20 nt, Human
agggcuacccugagcugagg

SEQ ID NO: 1762095 - RNA, 21 nt, Human
agggcuacccugagcugaggc

SEQ ID NO: 1762096 - RNA, 22 nt, Human
agggcuacccugagcugaggca

SEQ ID NO: 1762097 - RNA, 23 nt, Human
agggcuacccugagcugaggcag

SEQ ID NO: 1762098 - RNA, 18 nt, Human
agggaugauucaagccau

SEQ ID NO: 1762099 - RNA, 19 nt, Human
agggaugauucaagccauu

SEQ ID NO: 1762100 - RNA, 18 nt, Human
agggauucacaucugcau

SEQ ID NO: 1762101 - RNA, 24 nt, Human
aggcuguaucccaugagccucagc

SEQ ID NO: 1762102 - RNA, 23 nt, Human
aggcuguaucccaugagccucag

SEQ ID NO: 1762103 - RNA, 20 nt, Human
cacccaagaccucagggcac

SEQ ID NO: 1762104 - RNA, 23 nt, Human
caccauacgagcaccuccagccu

SEQ ID NO: 1762105 - RNA, 20 nt, Human
caccauuuuaagucccuguc

SEQ ID NO: 1762106 - RNA, 17 nt, Human
caccauuuggcaaugcc

SEQ ID NO: 1762107 - RNA, 18 nt, Human
cacagcucuucuccaggc

SEQ ID NO: 1762108 - RNA, 14 nt, Human
cacaggcccggcuc

SEQ ID NO: 1762109 - RNA, 17 nt, Human
cacaggaucagucugau

SEQ ID NO: 1762110 - RNA, 15 nt, Human
cacaggacccucgcc

SEQ ID NO: 1762111 - RNA, 15 nt, Human
cacaggacauuucuc

SEQ ID NO: 1762112 - RNA, 17 nt, Human
cacaggacauuucucua

SEQ ID NO: 1762113 - RNA, 21 nt, Human
cacagcucuucuccaggcugu

SEQ ID NO: 1762114 - RNA, 19 nt, Human
cacagcucuucuccaggcu

SEQ ID NO: 1762115 - RNA, 20 nt, Human
cacagcucuucuccaggcug

SEQ ID NO: 1762116 - RNA, 18 nt, Human
cacaugcacgugugugca

SEQ ID NO: 1762117 - RNA, 20 nt, Human
cacaugucaguaccuucaaa

SEQ ID NO: 1762118 - RNA, 20 nt, Human
cacaugcucaggcuacuaua

SEQ ID NO: 1762119 - RNA, 13 nt, Human
caccaagcccagu

SEQ ID NO: 1762120 - RNA, 12 nt, Human
caccaagcccag

SEQ ID NO: 1762121 - RNA, 21 nt, Human
caccaagcaggaaaugaaaau

SEQ ID NO: 1762122 - RNA, 15 nt, Human
caccaacuuacaaaa

SEQ ID NO: 1762123 - RNA, 16 nt, Human
caccaacuuacaaaaa

SEQ ID NO: 1762124 - RNA, 15 nt, Human
caccaagaaagcagg

SEQ ID NO: 1762125 - RNA, 19 nt, Human
caccacgcuggggucuggg

SEQ ID NO: 1762126 - RNA, 19 nt, Human
caccacacccagcccacuu

SEQ ID NO: 1762127 - RNA, 17 nt, Human
caccagagcccaccuug

SEQ ID NO: 1762128 - RNA, 18 nt, Human
caccagagcccaccuugg

SEQ ID NO: 1762129 - RNA, 20 nt, Human
caccagagcccaccuuggcu

SEQ ID NO: 1762130 - RNA, 22 nt, Human
caccagagcccaccuuggcuca

SEQ ID NO: 1762131 - RNA, 15 nt, Human
caccagagcccaccu

SEQ ID NO: 1762132 - RNA, 15 nt, Human
caccaucaugucugg

SEQ ID NO: 1762133 - RNA, 17 nt, Human
caccaucaugucuggcu

SEQ ID NO: 1762134 - RNA, 18 nt, Human
caccaucaugucuggcua

SEQ ID NO: 1762135 - RNA, 13 nt, Human
caccauaugaauu

SEQ ID NO: 1762136 - RNA, 14 nt, Human
caccauaugaauug

SEQ ID NO: 1762137 - RNA, 15 nt, Human
caccauaugaauugu

SEQ ID NO: 1762138 - RNA, 18 nt, Human
caccauaugaauuguaca

SEQ ID NO: 1762139 - RNA, 19 nt, Human
caccauaugaauuguacag

SEQ ID NO: 1762140 - RNA, 20 nt, Human
caccauaugaauuguacaga

SEQ ID NO: 1762141 - RNA, 19 nt, Human
caccaggguugaccccaga

SEQ ID NO: 1762142 - RNA, 22 nt, Human
caccaggguugaccccagagga

SEQ ID NO: 1762143 - RNA, 23 nt, Human
caccaggguugaccccagaggau

SEQ ID NO: 1762144 - RNA, 14 nt, Human
caccagucccuguc

SEQ ID NO: 1762145 - RNA, 20 nt, Human
caccagucccuguccggaau

SEQ ID NO: 1762146 - RNA, 14 nt, Human
cacacccagcccac

SEQ ID NO: 1762147 - RNA, 20 nt, Human
cacacccagcccacuucugc

SEQ ID NO: 1762148 - RNA, 15 nt, Human
cacaccuagccagcu

SEQ ID NO: 1762149 - RNA, 16 nt, Human
cacacagcucuguccu

SEQ ID NO: 1762150 - RNA, 21 nt, Human
cacaccagagcccaccuuggc

SEQ ID NO: 1762151 - RNA, 22 nt, Human
cacaccagagcccaccuuggcu

SEQ ID NO: 1762152 - RNA, 13 nt, Human
cacacagcucugu

SEQ ID NO: 1762153 - RNA, 14 nt, Human
cacacagcucuguc

SEQ ID NO: 1762154 - RNA, 15 nt, Human
cacacagcucugucc

SEQ ID NO: 1762155 - RNA, 15 nt, Human
cacacaccagagccc

SEQ ID NO: 1762156 - RNA, 16 nt, Human
cacacaccagagccca

SEQ ID NO: 1762157 - RNA, 20 nt, Human
cacacaccagagcccaccuu

SEQ ID NO: 1762158 - RNA, 14 nt, Human
cacacacuuuggcu

SEQ ID NO: 1762159 - RNA, 14 nt, Human
cacacaccuagcca

SEQ ID NO: 1762160 - RNA, 12 nt, Human
cacacacacaca

SEQ ID NO: 1762161 - RNA, 15 nt, Human
cacaaucccuuucua

SEQ ID NO: 1762162 - RNA, 12 nt, Human
cacaacuuguuu

SEQ ID NO: 1762163 - RNA, 20 nt, Human
cacaacuuguuuuugguuuu

SEQ ID NO: 1762164 - RNA, 15 nt, Human
caauuauguuaaacu

SEQ ID NO: 1762165 - RNA, 13 nt, Human
caauuauguuaaa

SEQ ID NO: 1762166 - RNA, 13 nt, Human
cacacacacacaa

SEQ ID NO: 1762167 - RNA, 15 nt, Human
caaugaaaaaaugua

SEQ ID NO: 1762168 - RNA, 18 nt, Human
caaugcaagacgcccucu

SEQ ID NO: 1762169 - RNA, 14 nt, Human
caaugcacugacau

SEQ ID NO: 1762170 - RNA, 23 nt, Human
caaucgguguguagugauguuuc

SEQ ID NO: 1762171 - RNA, 16 nt, Human
caagugccugcuuuua

SEQ ID NO: 1762172 - RNA, 20 nt, Human
caacaggcugggcuucagug

SEQ ID NO: 1762173 - RNA, 17 nt, Human
caaagaauuccaaagca

SEQ ID NO: 1762174 - RNA, 18 nt, Human
caaagaauuccaaagcaa

SEQ ID NO: 1762175 - RNA, 19 nt, Human
caaagaauuccaaagcaaa

SEQ ID NO: 1762176 - RNA, 15 nt, Human
auuuuaagucccugu

SEQ ID NO: 1762177 - RNA, 19 nt, Human
auuuuaagucccugucacc

SEQ ID NO: 1762178 - RNA, 20 nt, Human
auuuuaagucccugucaccu

SEQ ID NO: 1762179 - RNA, 22 nt, Human
auuuuaagucccugucaccucu

SEQ ID NO: 1762180 - RNA, 23 nt, Human
auuuuaaugaagaaaguggaaaa

SEQ ID NO: 1762181 - RNA, 20 nt, Human
caaaggguaucaggugcugc

SEQ ID NO: 1762182 - RNA, 21 nt, Human
caaaggguaucaggugcugcc

SEQ ID NO: 1762183 - RNA, 13 nt, Human
caaaggggacagc

SEQ ID NO: 1762184 - RNA, 18 nt, Human
caaaggggacagcugugu

SEQ ID NO: 1762185 - RNA, 23 nt, Human
caaaggguaucaggugcugccau

SEQ ID NO: 1762186 - RNA, 15 nt, Human
caaagggaaauauca

SEQ ID NO: 1762187 - RNA, 17 nt, Human
caaagggaaauaucauu

SEQ ID NO: 1762188 - RNA, 18 nt, Human
caaagggaaauaucauuu

SEQ ID NO: 1762189 - RNA, 16 nt, Human
caaaggguccagaagg

SEQ ID NO: 1762190 - RNA, 16 nt, Human
caaauauugguguugu

SEQ ID NO: 1762191 - RNA, 21 nt, Human
caaauuggagcuucauggcag

SEQ ID NO: 1762192 - RNA, 21 nt, Human
caaccugccugacauuuggag

SEQ ID NO: 1762193 - RNA, 13 nt, Human
caacucuuugaga

SEQ ID NO: 1762194 - RNA, 14 nt, Human
caacucuuugagaa

SEQ ID NO: 1762195 - RNA, 15 nt, Human
caacucuuugagaaa

SEQ ID NO: 1762196 - RNA, 16 nt, Human
caacucuuugagaaac

SEQ ID NO: 1762197 - RNA, 21 nt, Human
caacugaaggcuaaaaagcaa

SEQ ID NO: 1762198 - RNA, 22 nt, Human
caacugaaggcuaaaaagcaac

SEQ ID NO: 1762199 - RNA, 16 nt, Human
caaccuauuuugaagu

SEQ ID NO: 1762200 - RNA, 15 nt, Human
caaccuauuuugaag

SEQ ID NO: 1762201 - RNA, 17 nt, Human
caacaggcugggcuuca

SEQ ID NO: 1762202 - RNA, 17 nt, Human
caacaguggggaagagu

SEQ ID NO: 1762203 - RNA, 14 nt, Human
caacaggcugggcu

SEQ ID NO: 1762204 - RNA, 21 nt, Human
caagcuuccauagcugcugcc

SEQ ID NO: 1762205 - RNA, 12 nt, Human
caagcuucccuc

SEQ ID NO: 1762206 - RNA, 19 nt, Human
caagcuucccuccaucccc

SEQ ID NO: 1762207 - RNA, 12 nt, Human
caaggacugagc

SEQ ID NO: 1762208 - RNA, 13 nt, Human
caaggacugagca

SEQ ID NO: 1762209 - RNA, 20 nt, Human
caaggacugagcacccucug

SEQ ID NO: 1762210 - RNA, 17 nt, Human
caagcccagcacugcuu

SEQ ID NO: 1762211 - RNA, 17 nt, Human
caagcaggaaaugaaaa

SEQ ID NO: 1762212 - RNA, 23 nt, Human
caagcaggaaaugaaaaugucuu

SEQ ID NO: 1762213 - RNA, 13 nt, Human
caagcauguaacu

SEQ ID NO: 1762214 - RNA, 12 nt, Human
caagagggucug

SEQ ID NO: 1762215 - RNA, 16 nt, Human
caagagggucugagga

SEQ ID NO: 1762216 - RNA, 17 nt, Human
caagagggucugaggaa

SEQ ID NO: 1762217 - RNA, 16 nt, Human
caagaccucacacaca

SEQ ID NO: 1762218 - RNA, 15 nt, Human
caagaccucagggca

SEQ ID NO: 1762219 - RNA, 16 nt, Human
caagaccucagggcac

SEQ ID NO: 1762220 - RNA, 23 nt, Human
caagaccucagggcacaaagaug

SEQ ID NO: 1762221 - RNA, 24 nt, Human
caagaccucagggcacaaagaugg

SEQ ID NO: 1762222 - RNA, 13 nt, Human
caagguuggagcc

SEQ ID NO: 1762223 - RNA, 14 nt, Human
caagguuggagccc

SEQ ID NO: 1762224 - RNA, 17 nt, Human
caagguuggagcccagg

SEQ ID NO: 1762225 - RNA, 21 nt, Human
caagguuggagcccagggcau

SEQ ID NO: 1762226 - RNA, 21 nt, Human
caagugauucuccugccucag

SEQ ID NO: 1762227 - RNA, 20 nt, Human
caagugauucuccugccuca

SEQ ID NO: 1762228 - RNA, 19 nt, Human
caagugauucuccugccuc

SEQ ID NO: 1762229 - RNA, 18 nt, Human
caagugauucuccugccu

SEQ ID NO: 1762230 - RNA, 23 nt, Human
caaggggaauguuugccucugcc

SEQ ID NO: 1762231 - RNA, 17 nt, Human
caagguuauaugaauau

SEQ ID NO: 1762232 - RNA, 21 nt, Human
caaggggaauguuugccucug

SEQ ID NO: 1762233 - RNA, 21 nt, Human
caagggcagaaugaaucuaug

SEQ ID NO: 1762234 - RNA, 11 nt, Human
cauuugaaugc

SEQ ID NO: 1762235 - RNA, 10 nt, Human
cauuugaaug

SEQ ID NO: 1762236 - RNA, 20 nt, Human
cauuugagcagggcucagcg

SEQ ID NO: 1762237 - RNA, 17 nt, Human
cauuugagcagggcuca

SEQ ID NO: 1762238 - RNA, 18 nt, Human
cauuugagcagggcucag

SEQ ID NO: 1762239 - RNA, 12 nt, Human
cauuugaaugca

SEQ ID NO: 1762240 - RNA, 14 nt, Human
cauuuuucaaagca

SEQ ID NO: 1762241 - RNA, 17 nt, Human
cauuuuucaaagcaauu

SEQ ID NO: 1762242 - RNA, 14 nt, Human
cauuuuucaacuuu

SEQ ID NO: 1762243 - RNA, 17 nt, Human
cauuuuucaacuuugaa

SEQ ID NO: 1762244 - RNA, 18 nt, Human
cauuuuucaacuuugaau

SEQ ID NO: 1762245 - RNA, 19 nt, Human
cauuuuucaacuuugaaua

SEQ ID NO: 1762246 - RNA, 20 nt, Human
cauuuuucaacuuugaauaa

SEQ ID NO: 1762247 - RNA, 21 nt, Human
cauuuuucaacuuugaauaaa

SEQ ID NO: 1762248 - RNA, 12 nt, Human
cauuuccugugu

SEQ ID NO: 1762249 - RNA, 13 nt, Human
cauuuccuguguc

SEQ ID NO: 1762250 - RNA, 15 nt, Human
cauugccaagggcuu

SEQ ID NO: 1762251 - RNA, 19 nt, Human
cauuguccaauccuauguu

SEQ ID NO: 1762252 - RNA, 21 nt, Human
cauuguccaauccuauguuuu

SEQ ID NO: 1762253 - RNA, 16 nt, Human
cauuguaucgauguua

SEQ ID NO: 1762254 - RNA, 17 nt, Human
cauuguaucgauguuau

SEQ ID NO: 1762255 - RNA, 21 nt, Human
cauuguaucgauguuauguaa

SEQ ID NO: 1762256 - RNA, 22 nt, Human
cauuguaucgauguuauguaaa

SEQ ID NO: 1762257 - RNA, 15 nt, Human
cauugugaaccaaug

SEQ ID NO: 1762258 - RNA, 17 nt, Human
cauugugaaccaaugca

SEQ ID NO: 1762259 - RNA, 18 nt, Human
cauuguuggccaaagcca

SEQ ID NO: 1762260 - RNA, 17 nt, Human
cauuguuggccaaagcc

SEQ ID NO: 1762261 - RNA, 13 nt, Human
cauugugcuucuu

SEQ ID NO: 1762262 - RNA, 17 nt, Human
cauugugcuucuuucuu

SEQ ID NO: 1762263 - RNA, 15 nt, Human
ccaaguagccucucc

SEQ ID NO: 1762264 - RNA, 22 nt, Human
ccaaggggaauguuugccucug

SEQ ID NO: 1762265 - RNA, 21 nt, Human
ccaagggcuuuguuuugcaca

SEQ ID NO: 1762266 - RNA, 12 nt, Human
ccaagccacuga

SEQ ID NO: 1762267 - RNA, 15 nt, Human
ccaagcaagacugag

SEQ ID NO: 1762268 - RNA, 17 nt, Human
ccaacauguggcuccuc

SEQ ID NO: 1762269 - RNA, 22 nt, Human
ccaacauguggcuccucccagc

SEQ ID NO: 1762270 - RNA, 22 nt, Human
ccaacaauccuagugcuuuccu

SEQ ID NO: 1762271 - RNA, 13 nt, Human
ccaacacgcagga

SEQ ID NO: 1762272 - RNA, 21 nt, Human
ccaaagcuaggccuggccaga

SEQ ID NO: 1762273 - RNA, 16 nt, Human
ccaaagcuuucaugua

SEQ ID NO: 1762274 - RNA, 16 nt, Human
ccaaagcuaggccugg

SEQ ID NO: 1762275 - RNA, 17 nt, Human
ccaaagcuaggccuggc

SEQ ID NO: 1762276 - RNA, 15 nt, Human
ccaaagcuaggccug

SEQ ID NO: 1762277 - RNA, 19 nt, Human
ccaaagccaaagcuaggcc

SEQ ID NO: 1762278 - RNA, 23 nt, Human
ccacggccaggccagagggagug

SEQ ID NO: 1762279 - RNA, 18 nt, Human
ccacgcuggagugcagug

SEQ ID NO: 1762280 - RNA, 19 nt, Human
ccacgcuggagugcaguga

SEQ ID NO: 1762281 - RNA, 16 nt, Human
ccacggccaggccaga

SEQ ID NO: 1762282 - RNA, 18 nt, Human
ccacggccaggccagagg

SEQ ID NO: 1762283 - RNA, 16 nt, Human
ccacgcuggagugcag

SEQ ID NO: 1762284 - RNA, 18 nt, Human
ccacucaguccauagcag

SEQ ID NO: 1762285 - RNA, 11 nt, Human
ccacucagcuc

SEQ ID NO: 1762286 - RNA, 15 nt, Human
ccacucagcuccgug

SEQ ID NO: 1762287 - RNA, 21 nt, Human
ccagacaccuugacagggcac

SEQ ID NO: 1762288 - RNA, 13 nt, Human
ccagaacaguaug

SEQ ID NO: 1762289 - RNA, 15 nt, Human
ccagaacaguaugaa

SEQ ID NO: 1762290 - RNA, 13 nt, Human
ccacuuaaaaugu

SEQ ID NO: 1762291 - RNA, 23 nt, Human
ccacccaggagccccgaggccuu

SEQ ID NO: 1762292 - RNA, 14 nt, Human
ccacaguugcucua

SEQ ID NO: 1762293 - RNA, 20 nt, Human
ccacaucccgggacgcagca

SEQ ID NO: 1762294 - RNA, 13 nt, Human
ccacauccuccac

SEQ ID NO: 1762295 - RNA, 11 nt, Human
ccacagggcac

SEQ ID NO: 1762296 - RNA, 19 nt, Human
ccacagggcaccugccacc

SEQ ID NO: 1762297 - RNA, 20 nt, Human
ccacaucuugcucugcugac

SEQ ID NO: 1762298 - RNA, 19 nt, Human
ccacaucuugcucugcuga

SEQ ID NO: 1762299 - RNA, 18 nt, Human
ccacaucuugcucugcug

SEQ ID NO: 1762300 - RNA, 17 nt, Human
ccacaucuugcucugcu

SEQ ID NO: 1762301 - RNA, 16 nt, Human
ccacaugugcacaugc

SEQ ID NO: 1762302 - RNA, 16 nt, Human
ccacaugggaggcuca

SEQ ID NO: 1762303 - RNA, 21 nt, Human
ccaccaagagggacgccuggg

SEQ ID NO: 1762304 - RNA, 17 nt, Human
ccaccaagagggacgcc

SEQ ID NO: 1762305 - RNA, 20 nt, Human
ccacacccagcccacuucug

SEQ ID NO: 1762306 - RNA, 15 nt, Human
ccacacccagcccac

SEQ ID NO: 1762307 - RNA, 21 nt, Human
ccacacccagcccacuucugc

SEQ ID NO: 1762308 - RNA, 22 nt, Human
ccacacccagcccacuucugcc

SEQ ID NO: 1762309 - RNA, 17 nt, Human
ccacaggacccucgccg

SEQ ID NO: 1762310 - RNA, 16 nt, Human
ccacaggaucagucug

SEQ ID NO: 1762311 - RNA, 16 nt, Human
ccacaggacauuucuc

SEQ ID NO: 1762312 - RNA, 21 nt, Human
ccacaggacauuucucuaaga

SEQ ID NO: 1762313 - RNA, 14 nt, Human
cccauuccugggaa

SEQ ID NO: 1762314 - RNA, 15 nt, Human
cccagugcccacagg

SEQ ID NO: 1762315 - RNA, 20 nt, Human
cccagugcccacaggaucag

SEQ ID NO: 1762316 - RNA, 13 nt, Human
cccauucugccug

SEQ ID NO: 1762317 - RNA, 19 nt, Human
ccccaccauaugaauugua

SEQ ID NO: 1762318 - RNA, 18 nt, Human
cccaacacgcaggagcac

SEQ ID NO: 1762319 - RNA, 20 nt, Human
cccagauugcaacaggcugg

SEQ ID NO: 1762320 - RNA, 16 nt, Human
cccagauuccccugug

SEQ ID NO: 1762321 - RNA, 17 nt, Human
cccagauuccccugugu

SEQ ID NO: 1762322 - RNA, 19 nt, Human
cccagauuccccuguguca

SEQ ID NO: 1762323 - RNA, 21 nt, Human
cccagauugcaacaggcuggg

SEQ ID NO: 1762324 - RNA, 22 nt, Human
cccagauugcaacaggcugggc

SEQ ID NO: 1762325 - RNA, 16 nt, Human
cccagcaagugagagc

SEQ ID NO: 1762326 - RNA, 18 nt, Human
cccagcaagugagagcug

SEQ ID NO: 1762327 - RNA, 12 nt, Human
cccagccugcua

SEQ ID NO: 1762328 - RNA, 21 nt, Human
cccagccugcuagcuagcuca

SEQ ID NO: 1762329 - RNA, 11 nt, Human
cccagccugcu

SEQ ID NO: 1762330 - RNA, 14 nt, Human
cccagccugcuagc

SEQ ID NO: 1762331 - RNA, 15 nt, Human
cccagccugcuagcu

SEQ ID NO: 1762332 - RNA, 16 nt, Human
cccagccugcuagcua

SEQ ID NO: 1762333 - RNA, 11 nt, Human
cccagccugcg

SEQ ID NO: 1762334 - RNA, 18 nt, Human
cccagccugcgccugcug

SEQ ID NO: 1762335 - RNA, 19 nt, Human
cccagccugcgccugcugc

SEQ ID NO: 1762336 - RNA, 22 nt, Human
cccagccugcgccugcugcaug

SEQ ID NO: 1762337 - RNA, 23 nt, Human
cccagccugcgccugcugcaugc

SEQ ID NO: 1762338 - RNA, 19 nt, Human
cccagcaagugagagcugg

SEQ ID NO: 1762339 - RNA, 20 nt, Human
cccagcaagugagagcuggg

SEQ ID NO: 1762340 - RNA, 21 nt, Human
cccagcaagugagagcugggu

SEQ ID NO: 1762341 - RNA, 22 nt, Human
cccagcaagugagagcugggug

SEQ ID NO: 1762342 - RNA, 23 nt, Human
cccagcaagugagagcugggugu

SEQ ID NO: 1762343 - RNA, 23 nt, Human
cccagauugcaacaggcugggcu

SEQ ID NO: 1762344 - RNA, 15 nt, Human
cccagccccuacugc

SEQ ID NO: 1762345 - RNA, 18 nt, Human
cccagccccuacugcugu

SEQ ID NO: 1762346 - RNA, 19 nt, Human
cccagccccuacugcugug

SEQ ID NO: 1762347 - RNA, 20 nt, Human
cccagccccgguggcugggc

SEQ ID NO: 1762348 - RNA, 22 nt, Human
cccagccccgguggcugggcag

SEQ ID NO: 1762349 - RNA, 19 nt, Human
cccagcgagcccugguggc

SEQ ID NO: 1762350 - RNA, 23 nt, Human
cccagcgagcccugguggcagug

SEQ ID NO: 1762351 - RNA, 17 nt, Human
cccagcgagcccuggug

SEQ ID NO: 1762352 - RNA, 18 nt, Human
cccagcgagcccuggugg

SEQ ID NO: 1762353 - RNA, 15 nt, Human
cccagcgagcccugg

SEQ ID NO: 1762354 - RNA, 14 nt, Human
cccaggcauugcca

SEQ ID NO: 1762355 - RNA, 21 nt, Human
cccaggcauugccaagggcuu

SEQ ID NO: 1762356 - RNA, 17 nt, Human
cccaggcaggucuugaa

SEQ ID NO: 1762357 - RNA, 11 nt, Human
cccaggccccu

SEQ ID NO: 1762358 - RNA, 16 nt, Human
cccaggccccugccac

SEQ ID NO: 1762359 - RNA, 18 nt, Human
cccaggccccugccaccc

SEQ ID NO: 1762360 - RNA, 21 nt, Human
cccaggccccugccacccugg

SEQ ID NO: 1762361 - RNA, 22 nt, Human
cccaggccccugccacccuggg

SEQ ID NO: 1762362 - RNA, 11 nt, Human
cccaggcaggu

SEQ ID NO: 1762363 - RNA, 13 nt, Human
cccaggcaggucu

SEQ ID NO: 1762364 - RNA, 23 nt, Human
cccaggaucagauugcaugugac

SEQ ID NO: 1762365 - RNA, 21 nt, Human
cccaggagccccgaggccuuc

SEQ ID NO: 1762366 - RNA, 16 nt, Human
cccaggccccuggagg

SEQ ID NO: 1762367 - RNA, 18 nt, Human
cccaggccccuggaggcu

SEQ ID NO: 1762368 - RNA, 23 nt, Human
cccaggccccuggaggcugccuc

SEQ ID NO: 1762369 - RNA, 12 nt, Human
cccaggccccug

SEQ ID NO: 1762370 - RNA, 13 nt, Human
cccagugcccaca

SEQ ID NO: 1762371 - RNA, 20 nt, Human
cccagucuggaaugcagugg

SEQ ID NO: 1762372 - RNA, 21 nt, Human
cccaggugcagccagaggcac

SEQ ID NO: 1762373 - RNA, 15 nt, Human
cccaggugggucccg

SEQ ID NO: 1762374 - RNA, 15 nt, Human
cccaggugcagccag

SEQ ID NO: 1762375 - RNA, 20 nt, Human
cccaggugcagccagaggca

SEQ ID NO: 1762376 - RNA, 16 nt, Human
ccagcugcccuauggg

SEQ ID NO: 1762377 - RNA, 20 nt, Human
ccagcugcccuaugggccug

SEQ ID NO: 1762378 - RNA, 21 nt, Human
ccagcugcccuaugggccugc

SEQ ID NO: 1762379 - RNA, 12 nt, Human
ccagcugcuccc

SEQ ID NO: 1762380 - RNA, 14 nt, Human
ccagcugcucccca

SEQ ID NO: 1762381 - RNA, 22 nt, Human
ccagagcccaccuuggcucaag

SEQ ID NO: 1762382 - RNA, 16 nt, Human
ccagagcccaccuugg

SEQ ID NO: 1762383 - RNA, 14 nt, Human
ccagcgagcccugg

SEQ ID NO: 1762384 - RNA, 15 nt, Human
ccagcgagcccuggu

SEQ ID NO: 1762385 - RNA, 16 nt, Human
ccagcgagcccuggug

SEQ ID NO: 1762386 - RNA, 11 nt, Human
ccaggacucug

SEQ ID NO: 1762387 - RNA, 13 nt, Human
ccaggacucugac

SEQ ID NO: 1762388 - RNA, 14 nt, Human
ccaggacucugacc

SEQ ID NO: 1762389 - RNA, 18 nt, Human
ccaggacucugaccccag

SEQ ID NO: 1762390 - RNA, 22 nt, Human
ccaggacucugaccccagcauu

SEQ ID NO: 1762391 - RNA, 16 nt, Human
ccaggcauugccaagg

SEQ ID NO: 1762392 - RNA, 21 nt, Human
ccaggagcuucuuguuuccuu

SEQ ID NO: 1762393 - RNA, 22 nt, Human
ccaggagcuucuuguuuccuug

SEQ ID NO: 1762394 - RNA, 16 nt, Human
ccaggagccccgaggc

SEQ ID NO: 1762395 - RNA, 15 nt, Human
ccaggagccccgagg

SEQ ID NO: 1762396 - RNA, 12 nt, Human
ccaggcuuggaa

SEQ ID NO: 1762397 - RNA, 19 nt, Human
ccagggcaucuugcuggcu

SEQ ID NO: 1762398 - RNA, 20 nt, Human
ccagggcaucuugcuggcua

SEQ ID NO: 1762399 - RNA, 21 nt, Human
ccagggcaucuugcuggcuac

SEQ ID NO: 1762400 - RNA, 20 nt, Human
ccaggcuguaucccaugagc

SEQ ID NO: 1762401 - RNA, 19 nt, Human
ccaggcuggucucaaacuc

SEQ ID NO: 1762402 - RNA, 13 nt, Human
ccaggccccugcc

SEQ ID NO: 1762403 - RNA, 20 nt, Human
ccaggcauuuagcccucaca

SEQ ID NO: 1762404 - RNA, 13 nt, Human
ccaggugcccagc

SEQ ID NO: 1762405 - RNA, 15 nt, Human
ccaggugcccagcua

SEQ ID NO: 1762406 - RNA, 21 nt, Human
ccaggugaguccuagagcuac

SEQ ID NO: 1762407 - RNA, 13 nt, Human
ccaguacuuguca

SEQ ID NO: 1762408 - RNA, 14 nt, Human
ccaguacuugucau

SEQ ID NO: 1762409 - RNA, 15 nt, Human
ccaguacuugucaua

SEQ ID NO: 1762410 - RNA, 22 nt, Human
ccaggugcuacacccuuuucca

SEQ ID NO: 1762411 - RNA, 22 nt, Human
ccaggugggucccggcucugug

SEQ ID NO: 1762412 - RNA, 14 nt, Human
ccagguucagcuug

SEQ ID NO: 1762413 - RNA, 15 nt, Human
ccagguucagcuugu

SEQ ID NO: 1762414 - RNA, 12 nt, Human
ccauauccuggu

SEQ ID NO: 1762415 - RNA, 15 nt, Human
ccauauccuggugcc

SEQ ID NO: 1762416 - RNA, 12 nt, Human
ccauaugaauug

SEQ ID NO: 1762417 - RNA, 14 nt, Human
ccauaugaauugua

SEQ ID NO: 1762418 - RNA, 17 nt, Human
ccauaugaauuguacag

SEQ ID NO: 1762419 - RNA, 19 nt, Human
ccauaucagaacugugcca

SEQ ID NO: 1762420 - RNA, 18 nt, Human
ccaucuccccucagcucg

SEQ ID NO: 1762421 - RNA, 23 nt, Human
ccaucuccccucagcucggcuca

SEQ ID NO: 1762422 - RNA, 14 nt, Human
ccaucuccccucag

SEQ ID NO: 1762423 - RNA, 15 nt, Human
ccaucuccccucagc

SEQ ID NO: 1762424 - RNA, 16 nt, Human
ccaucuccccucagcu

SEQ ID NO: 1762425 - RNA, 17 nt, Human
ccaucuccccucagcuc

SEQ ID NO: 1762426 - RNA, 18 nt, Human
ccaucucgcucccuccca

SEQ ID NO: 1762427 - RNA, 22 nt, Human
ccaucucgcucccucccaggac

SEQ ID NO: 1762428 - RNA, 12 nt, Human
ccaucagugcuc

SEQ ID NO: 1762429 - RNA, 17 nt, Human
ccaucagugcucccuca

SEQ ID NO: 1762430 - RNA, 16 nt, Human
ccaucaucaugugugu

SEQ ID NO: 1762431 - RNA, 22 nt, Human
ccaucauuuuccauauccuggu

SEQ ID NO: 1762432 - RNA, 17 nt, Human
ccauccacaugggagcc

SEQ ID NO: 1762433 - RNA, 16 nt, Human
ccaucuggucauuugg

SEQ ID NO: 1762434 - RNA, 22 nt, Human
ccaucugguuaggauggcagga

SEQ ID NO: 1762435 - RNA, 23 nt, Human
ccaucugguuaggauggcaggac

SEQ ID NO: 1762436 - RNA, 21 nt, Human
ccauucugccugcccaggccc

SEQ ID NO: 1762437 - RNA, 19 nt, Human
ccauucugccugcccaggc

SEQ ID NO: 1762438 - RNA, 20 nt, Human
ccauucugccugcccaggcc

SEQ ID NO: 1762439 - RNA, 17 nt, Human
ccauucugccugcccag

SEQ ID NO: 1762440 - RNA, 18 nt, Human
ccauucugccugcccagg

SEQ ID NO: 1762441 - RNA, 22 nt, Human
ccauuuugggguacccacugcu

SEQ ID NO: 1762442 - RNA, 20 nt, Human
ccauuuugggguacccacug

SEQ ID NO: 1762443 - RNA, 18 nt, Human
cccaaaauuuauuuuaua

SEQ ID NO: 1762444 - RNA, 17 nt, Human
cccaaacaaauaugcaa

SEQ ID NO: 1762445 - RNA, 20 nt, Human
cccaaacaaauaugcaaaag

SEQ ID NO: 1762446 - RNA, 17 nt, Human
cgcccaggaucagauug

SEQ ID NO: 1762447 - RNA, 23 nt, Human
cgcccaggaucagauugcaugug

SEQ ID NO: 1762448 - RNA, 11 nt, Human
cgcccucuccu

SEQ ID NO: 1762449 - RNA, 20 nt, Human
cgcccucuccuuuguucccg

SEQ ID NO: 1762450 - RNA, 16 nt, Human
cgcgugcacacaccag

SEQ ID NO: 1762451 - RNA, 19 nt, Human
cgcgugcacacaccagagc

SEQ ID NO: 1762452 - RNA, 20 nt, Human
cgcgugcacacaccagagcc

SEQ ID NO: 1762453 - RNA, 14 nt, Human
cgcgaugggucagg

SEQ ID NO: 1762454 - RNA, 14 nt, Human
cgaggacagggagg

SEQ ID NO: 1762455 - RNA, 13 nt, Human
cgaggacagggag

SEQ ID NO: 1762456 - RNA, 12 nt, Human
cgaggacaggga

SEQ ID NO: 1762457 - RNA, 18 nt, Human
cgaggccuucucugaagg

SEQ ID NO: 1762458 - RNA, 19 nt, Human
cgaggccuucucugaagga

SEQ ID NO: 1762459 - RNA, 10 nt, Human
cgaggccuga

SEQ ID NO: 1762460 - RNA, 11 nt, Human
cgaggccugaa

SEQ ID NO: 1762461 - RNA, 19 nt, Human
cgaucuggguucacugcaa

SEQ ID NO: 1762462 - RNA, 21 nt, Human
cgauucuucugcuucagccuc

SEQ ID NO: 1762463 - RNA, 13 nt, Human
cgauucuucugcu

SEQ ID NO: 1762464 - RNA, 19 nt, Human
cgauucuucugcuucagcc

SEQ ID NO: 1762465 - RNA, 13 nt, Human
cgauuucuguaaa

SEQ ID NO: 1762466 - RNA, 17 nt, Human
cgauuucuguaaacucu

SEQ ID NO: 1762467 - RNA, 23 nt, Human
cgcagaacgaaccuuggccuggg

SEQ ID NO: 1762468 - RNA, 19 nt, Human
cgcagaacgaaccuuggcc

SEQ ID NO: 1762469 - RNA, 20 nt, Human
cgcagaacgaaccuuggccu

SEQ ID NO: 1762470 - RNA, 19 nt, Human
ccuuugagugcaguccuga

SEQ ID NO: 1762471 - RNA, 22 nt, Human
ccuuugagugcaguccugauca

SEQ ID NO: 1762472 - RNA, 21 nt, Human
ccuuugauuaaagacuccagu

SEQ ID NO: 1762473 - RNA, 18 nt, Human
ccuuugcugucccauagu

SEQ ID NO: 1762474 - RNA, 11 nt, Human
ccuuugcuguc

SEQ ID NO: 1762475 - RNA, 12 nt, Human
ccuuggcugcag

SEQ ID NO: 1762476 - RNA, 13 nt, Human
ccuuggcugcagg

SEQ ID NO: 1762477 - RNA, 14 nt, Human
ccuuggcugcaggg

SEQ ID NO: 1762478 - RNA, 12 nt, Human
ccuuuaaaauuu

SEQ ID NO: 1762479 - RNA, 21 nt, Human
ccuuuaaaauuuuuuuagaaa

SEQ ID NO: 1762480 - RNA, 20 nt, Human
ccuuuaaaauuuuuuuagaa

SEQ ID NO: 1762481 - RNA, 20 nt, Human
ccuuucucuuuuccccuuuc

SEQ ID NO: 1762482 - RNA, 22 nt, Human
ccuuucucuuuuccccuuuccu

SEQ ID NO: 1762483 - RNA, 19 nt, Human
ccuuucuggcagguccucc

SEQ ID NO: 1762484 - RNA, 21 nt, Human
cgggaggauguucugggacac

SEQ ID NO: 1762485 - RNA, 20 nt, Human
cgggaggauguucugggaca

SEQ ID NO: 1762486 - RNA, 13 nt, Human
cggcugugcuggg

SEQ ID NO: 1762487 - RNA, 14 nt, Human
cggcugugcuggga

SEQ ID NO: 1762488 - RNA, 20 nt, Human
cggcccauccccaggcaccu

SEQ ID NO: 1762489 - RNA, 20 nt, Human
cggaaugaaccacaucuugc

SEQ ID NO: 1762490 - RNA, 17 nt, Human
cggaacuguccuuuccu

SEQ ID NO: 1762491 - RNA, 15 nt, Human
cggacagccacggcc

SEQ ID NO: 1762492 - RNA, 16 nt, Human
cggacagccacggcca

SEQ ID NO: 1762493 - RNA, 18 nt, Human
cggacagccacggccagg

SEQ ID NO: 1762494 - RNA, 13 nt, Human
cgcuccugugucu

SEQ ID NO: 1762495 - RNA, 20 nt, Human
cgcuccuuuguguguguguc

SEQ ID NO: 1762496 - RNA, 20 nt, Human
cggaaccgcccaggaucaga

SEQ ID NO: 1762497 - RNA, 20 nt, Human
cggacagccacggccaggcc

SEQ ID NO: 1762498 - RNA, 16 nt, Human
cggacccucuaaccuc

SEQ ID NO: 1762499 - RNA, 15 nt, Human
cggacuggugcccuc

SEQ ID NO: 1762500 - RNA, 16 nt, Human
cggacuggugcccucc

SEQ ID NO: 1762501 - RNA, 16 nt, Human
cggauggauggaaggu

SEQ ID NO: 1762502 - RNA, 14 nt, Human
cggcacagaugcuc

SEQ ID NO: 1762503 - RNA, 18 nt, Human
cggcacagaugcuccagg

SEQ ID NO: 1762504 - RNA, 20 nt, Human
cguccauaucagaacugugc

SEQ ID NO: 1762505 - RNA, 15 nt, Human
cguaucuccggcucc

SEQ ID NO: 1762506 - RNA, 18 nt, Human
cguaucuccggcucccag

SEQ ID NO: 1762507 - RNA, 21 nt, Human
cguaucuccggcucccagccu

SEQ ID NO: 1762508 - RNA, 22 nt, Human
cguaucuccggcucccagccuc

SEQ ID NO: 1762509 - RNA, 16 nt, Human
cguagccagcugcucc

SEQ ID NO: 1762510 - RNA, 19 nt, Human
cguagccagcugcucccca

SEQ ID NO: 1762511 - RNA, 14 nt, Human
cggggcccagggca

SEQ ID NO: 1762512 - RNA, 20 nt, Human
cggggcccagggcaagcucc

SEQ ID NO: 1762513 - RNA, 21 nt, Human
cggggcccagggcaagcuccg

SEQ ID NO: 1762514 - RNA, 12 nt, Human
cgugacaacacu

SEQ ID NO: 1762515 - RNA, 20 nt, Human
cgugcacacaccagagccca

SEQ ID NO: 1762516 - RNA, 21 nt, Human
cgugcacacaccagagcccac

SEQ ID NO: 1762517 - RNA, 22 nt, Human
cgugcacacaccagagcccacc

SEQ ID NO: 1762518 - RNA, 18 nt, Human
cguccuccguccauauca

SEQ ID NO: 1762519 - RNA, 13 nt, Human
cgucugacaggca

SEQ ID NO: 1762520 - RNA, 14 nt, Human
cgucugacaggcaa

SEQ ID NO: 1762521 - RNA, 16 nt, Human
cguuuuguuuugugcc

SEQ ID NO: 1762522 - RNA, 14 nt, Human
cguucugcucauca

SEQ ID NO: 1762523 - RNA, 21 nt, Human
cguucgcagagcuuuucagau

SEQ ID NO: 1762524 - RNA, 17 nt, Human
cuaaaaaaaaaaaagua

SEQ ID NO: 1762525 - RNA, 15 nt, Human
ccuucaucuuccugu

SEQ ID NO: 1762526 - RNA, 16 nt, Human
ccuucaucuuccugug

SEQ ID NO: 1762527 - RNA, 17 nt, Human
ccuucaucuuccugugu

SEQ ID NO: 1762528 - RNA, 18 nt, Human
ccuucaucuuccuguguc

SEQ ID NO: 1762529 - RNA, 19 nt, Human
ccuucaucuuccugugucc

SEQ ID NO: 1762530 - RNA, 23 nt, Human
ccuucauaugaaaggugccaugg

SEQ ID NO: 1762531 - RNA, 17 nt, Human
ccuucaucaugaguucu

SEQ ID NO: 1762532 - RNA, 21 nt, Human
ccuucaucaugaguucugcug

SEQ ID NO: 1762533 - RNA, 22 nt, Human
ccuucaucaugaguucugcuga

SEQ ID NO: 1762534 - RNA, 13 nt, Human
ccuucagccuuaa

SEQ ID NO: 1762535 - RNA, 16 nt, Human
ccuucaguaaccccca

SEQ ID NO: 1762536 - RNA, 22 nt, Human
ccuucaguaacccccacuggac

SEQ ID NO: 1762537 - RNA, 15 nt, Human
ccuuccacugagggc

SEQ ID NO: 1762538 - RNA, 17 nt, Human
ccuuccacugagggcag

SEQ ID NO: 1762539 - RNA, 10 nt, Human
ccuuccagau

SEQ ID NO: 1762540 - RNA, 22 nt, Human
ccugugcuucgggcccuuccca

SEQ ID NO: 1762541 - RNA, 13 nt, Human
ccuugacagggca

SEQ ID NO: 1762542 - RNA, 14 nt, Human
ccuugacagggcac

SEQ ID NO: 1762543 - RNA, 15 nt, Human
ccuugacagggcaca

SEQ ID NO: 1762544 - RNA, 17 nt, Human
ccuugacagggcacacc

SEQ ID NO: 1762545 - RNA, 19 nt, Human
ccuucuuugggauagagaa

SEQ ID NO: 1762546 - RNA, 13 nt, Human
ccuucgcuccugu

SEQ ID NO: 1762547 - RNA, 14 nt, Human
ccuucgcuccugug

SEQ ID NO: 1762548 - RNA, 15 nt, Human
ccuucgcuccugugu

SEQ ID NO: 1762549 - RNA, 18 nt, Human
ccuucgcuccugugucuu

SEQ ID NO: 1762550 - RNA, 14 nt, Human
ccuugaacugggua

SEQ ID NO: 1762551 - RNA, 16 nt, Human
ccuugaacuggguacu

SEQ ID NO: 1762552 - RNA, 17 nt, Human
ccugcuaauuccccaga

SEQ ID NO: 1762553 - RNA, 13 nt, Human
ccugcugguucag

SEQ ID NO: 1762554 - RNA, 19 nt, Human
ccugcugguucaggguugg

SEQ ID NO: 1762555 - RNA, 13 nt, Human
ccugcugguuuua

SEQ ID NO: 1762556 - RNA, 21 nt, Human
ccuggacaugaagauucuuuc

SEQ ID NO: 1762557 - RNA, 23 nt, Human
ccuggacaugaagauucuuuccc

SEQ ID NO: 1762558 - RNA, 24 nt, Human
ccuggacaugaagauucuuuccca

SEQ ID NO: 1762559 - RNA, 12 nt, Human
ccuggcacugga

SEQ ID NO: 1762560 - RNA, 15 nt, Human
ccuggcacuggaccc

SEQ ID NO: 1762561 - RNA, 16 nt, Human
ccuggcacuggacccc

SEQ ID NO: 1762562 - RNA, 20 nt, Human
ccuggcacuggaccccagca

SEQ ID NO: 1762563 - RNA, 13 nt, Human
ccugggcaaagcc

SEQ ID NO: 1762564 - RNA, 21 nt, Human
ccugggaugagaguuuuggau

SEQ ID NO: 1762565 - RNA, 18 nt, Human
ccuggccccauggucagc

SEQ ID NO: 1762566 - RNA, 12 nt, Human
ccugguggcagc

SEQ ID NO: 1762567 - RNA, 13 nt, Human
ccugguggcagcu

SEQ ID NO: 1762568 - RNA, 15 nt, Human
ccuggugcugccucu

SEQ ID NO: 1762569 - RNA, 20 nt, Human
ccuggugcugccucuaccug

SEQ ID NO: 1762570 - RNA, 13 nt, Human
ccuguccucccag

SEQ ID NO: 1762571 - RNA, 22 nt, Human
ccuguccucccagcuccucacu

SEQ ID NO: 1762572 - RNA, 18 nt, Human
ccugugcagccgcugagc

SEQ ID NO: 1762573 - RNA, 20 nt, Human
ccugugcagccgcugagcga

SEQ ID NO: 1762574 - RNA, 21 nt, Human
ccugugcagccgcugagcgag

SEQ ID NO: 1762575 - RNA, 16 nt, Human
ccugugccuccaucag

SEQ ID NO: 1762576 - RNA, 17 nt, Human
ccucugacacacagcuc

SEQ ID NO: 1762577 - RNA, 18 nt, Human
ccucugacacacagcucu

SEQ ID NO: 1762578 - RNA, 17 nt, Human
ccucugggucagugguc

SEQ ID NO: 1762579 - RNA, 20 nt, Human
ccucugggucagugguccac

SEQ ID NO: 1762580 - RNA, 23 nt, Human
ccuccugugugugcgccuacagg

SEQ ID NO: 1762581 - RNA, 23 nt, Human
ccucucaggccggcagccccagc

SEQ ID NO: 1762582 - RNA, 16 nt, Human
ccucugacacacagcu

SEQ ID NO: 1762583 - RNA, 12 nt, Human
ccucugaaacag

SEQ ID NO: 1762584 - RNA, 13 nt, Human
ccucugaaacagc

SEQ ID NO: 1762585 - RNA, 14 nt, Human
ccucugaaacagcu

SEQ ID NO: 1762586 - RNA, 15 nt, Human
ccucugaaacagcug

SEQ ID NO: 1762587 - RNA, 16 nt, Human
ccucugaaacagcugc

SEQ ID NO: 1762588 - RNA, 17 nt, Human
ccucugaaacagcugcc

SEQ ID NO: 1762589 - RNA, 18 nt, Human
ccucugaaacagcugccu

SEQ ID NO: 1762590 - RNA, 19 nt, Human
ccucugaaacagcugccuu

SEQ ID NO: 1762591 - RNA, 20 nt, Human
ccucugaaacagcugccuua

SEQ ID NO: 1762592 - RNA, 21 nt, Human
ccucugaaacagcugccuuag

SEQ ID NO: 1762593 - RNA, 22 nt, Human
ccucugaaacagcugccuuagc

SEQ ID NO: 1762594 - RNA, 23 nt, Human
ccucugaaacagcugccuuagcu

SEQ ID NO: 1762595 - RNA, 18 nt, Human
ccucucuggggcuguguu

SEQ ID NO: 1762596 - RNA, 17 nt, Human
ccucucuucucaccuuu

SEQ ID NO: 1762597 - RNA, 12 nt, Human
ccucucugcucu

SEQ ID NO: 1762598 - RNA, 15 nt, Human
ccucucugcucugcg

SEQ ID NO: 1762599 - RNA, 16 nt, Human
ccucucugcucugcgu

SEQ ID NO: 1762600 - RNA, 13 nt, Human
ccuccugggcuaa

SEQ ID NO: 1762601 - RNA, 15 nt, Human
ccuccuggcccaggu

SEQ ID NO: 1762602 - RNA, 13 nt, Human
ccuccugugugug

SEQ ID NO: 1762603 - RNA, 21 nt, Human
ccuccugggcccucucugcuc

SEQ ID NO: 1762604 - RNA, 15 nt, Human
ccuccugugugugcg

SEQ ID NO: 1762605 - RNA, 22 nt, Human
ccuccugugugugcgccuacag

SEQ ID NO: 1762606 - RNA, 10 nt, Human
ccuccucuga

SEQ ID NO: 1762607 - RNA, 12 nt, Human
ccuccucugaaa

SEQ ID NO: 1762608 - RNA, 13 nt, Human
ccuccucugaaac

SEQ ID NO: 1762609 - RNA, 15 nt, Human
ccuccucugaaacag

SEQ ID NO: 1762610 - RNA, 16 nt, Human
ccuccucugaaacagc

SEQ ID NO: 1762611 - RNA, 17 nt, Human
ccuccucugaaacagcu

SEQ ID NO: 1762612 - RNA, 18 nt, Human
ccuccucugaaacagcug

SEQ ID NO: 1762613 - RNA, 19 nt, Human
ccuccucugaaacagcugc

SEQ ID NO: 1762614 - RNA, 20 nt, Human
ccuccucugaaacagcugcc

SEQ ID NO: 1762615 - RNA, 21 nt, Human
ccuccucugaaacagcugccu

SEQ ID NO: 1762616 - RNA, 23 nt, Human
ccuccucugaaacagcugccuua

SEQ ID NO: 1762617 - RNA, 18 nt, Human
ccuccucugacuugggga

SEQ ID NO: 1762618 - RNA, 13 nt, Human
ccuccugccucga

SEQ ID NO: 1762619 - RNA, 13 nt, Human
ccuccccucucuu

SEQ ID NO: 1762620 - RNA, 17 nt, Human
ccuccccucuccuuccu

SEQ ID NO: 1762621 - RNA, 22 nt, Human
ccucaggugauccacccaccuc

SEQ ID NO: 1762622 - RNA, 14 nt, Human
ccucaggugcuguc

SEQ ID NO: 1762623 - RNA, 16 nt, Human
ccucaggugcugucca

SEQ ID NO: 1762624 - RNA, 18 nt, Human
ccucaggugcuguccaug

SEQ ID NO: 1762625 - RNA, 17 nt, Human
ccucaggugauccaccc

SEQ ID NO: 1762626 - RNA, 19 nt, Human
ccucaggugauccacccac

SEQ ID NO: 1762627 - RNA, 11 nt, Human
ccucagggcac

SEQ ID NO: 1762628 - RNA, 16 nt, Human
ccucagcauccuggca

SEQ ID NO: 1762629 - RNA, 17 nt, Human
ccucagcauccuggcac

SEQ ID NO: 1762630 - RNA, 22 nt, Human
ccucagaacccuuggcuugccc

SEQ ID NO: 1762631 - RNA, 14 nt, Human
ccucagcauccugg

SEQ ID NO: 1762632 - RNA, 16 nt, Human
ccucagaacccuuggc

SEQ ID NO: 1762633 - RNA, 21 nt, Human
ccucagaacccuuggcuugcc

SEQ ID NO: 1762634 - RNA, 16 nt, Human
ccugauucaacuaaaa

SEQ ID NO: 1762635 - RNA, 15 nt, Human
ccucuguccaggcac

SEQ ID NO: 1762636 - RNA, 19 nt, Human
ccucuguccaggcacugag

SEQ ID NO: 1762637 - RNA, 20 nt, Human
ccucuguccaggcacugaga

SEQ ID NO: 1762638 - RNA, 21 nt, Human
ccucuguccaggcacugagau

SEQ ID NO: 1762639 - RNA, 16 nt, Human
ccucuguucaguguaa

SEQ ID NO: 1762640 - RNA, 22 nt, Human
ccucuguucaguguaaauaguu

SEQ ID NO: 1762641 - RNA, 18 nt, Human
ccucugugaccaaugucu

SEQ ID NO: 1762642 - RNA, 19 nt, Human
ccucugugaccaaugucuu

SEQ ID NO: 1762643 - RNA, 21 nt, Human
ccucugugaccaaugucuuga

SEQ ID NO: 1762644 - RNA, 17 nt, Human
ccucuuccgacucuuuc

SEQ ID NO: 1762645 - RNA, 19 nt, Human
ccucuuccgacucuuucug

SEQ ID NO: 1762646 - RNA, 14 nt, Human
ccucuuccuacccu

SEQ ID NO: 1762647 - RNA, 20 nt, Human
ccucuuccuacccugccucc

SEQ ID NO: 1762648 - RNA, 14 nt, Human
ccucuuugucuaaa

SEQ ID NO: 1762649 - RNA, 15 nt, Human
ccucuuugucuaaaa

SEQ ID NO: 1762650 - RNA, 19 nt, Human
ccucuuugucuaaaacaau

SEQ ID NO: 1762651 - RNA, 22 nt, Human
ccucuuugucuaaaacaauaaa

SEQ ID NO: 1762652 - RNA, 17 nt, Human
ccugaaaacacugugca

SEQ ID NO: 1762653 - RNA, 23 nt, Human
ccucuuugucuaaaacaauaaaa

SEQ ID NO: 1762654 - RNA, 15 nt, Human
ccucuuuuaccugcu

SEQ ID NO: 1762655 - RNA, 16 nt, Human
ccucuuuuaccugcug

SEQ ID NO: 1762656 - RNA, 17 nt, Human
ccucuuuuaccugcugc

SEQ ID NO: 1762657 - RNA, 18 nt, Human
ccucuuuuaccugcugcu

SEQ ID NO: 1762658 - RNA, 19 nt, Human
ccucuuuuaccugcugcuu

SEQ ID NO: 1762659 - RNA, 21 nt, Human
ccucuuuuaccugcugcuucu

SEQ ID NO: 1762660 - RNA, 22 nt, Human
ccucuuuuaccugcugcuucuc

SEQ ID NO: 1762661 - RNA, 21 nt, Human
ccugaagacucauucuucugu

SEQ ID NO: 1762662 - RNA, 14 nt, Human
ccugaacagaagcu

SEQ ID NO: 1762663 - RNA, 15 nt, Human
ccugaagucacacag

SEQ ID NO: 1762664 - RNA, 16 nt, Human
ccugaagucacacagu

SEQ ID NO: 1762665 - RNA, 17 nt, Human
ccugaagucacacagug

SEQ ID NO: 1762666 - RNA, 19 nt, Human
ccugaagucacacagugag

SEQ ID NO: 1762667 - RNA, 13 nt, Human
ccccuacugcugu

SEQ ID NO: 1762668 - RNA, 14 nt, Human
ccccuacugcugug

SEQ ID NO: 1762669 - RNA, 21 nt, Human
cccugguggcagugggagcug

SEQ ID NO: 1762670 - RNA, 16 nt, Human
cccugguggcaguggg

SEQ ID NO: 1762671 - RNA, 19 nt, Human
cccugguggcagugggagc

SEQ ID NO: 1762672 - RNA, 20 nt, Human
ccccuccccauuagcuuuca

SEQ ID NO: 1762673 - RNA, 11 nt, Human
cccuguugcua

SEQ ID NO: 1762674 - RNA, 14 nt, Human
cccuuacaguagga

SEQ ID NO: 1762675 - RNA, 16 nt, Human
cccccaucuucgggac

SEQ ID NO: 1762676 - RNA, 18 nt, Human
cccccaucuucgggacca

SEQ ID NO: 1762677 - RNA, 21 nt, Human
cccccaucuucgggaccagga

SEQ ID NO: 1762678 - RNA, 13 nt, Human
cccccaauccaug

SEQ ID NO: 1762679 - RNA, 23 nt, Human
ccccaccccuggaagagcccagu

SEQ ID NO: 1762680 - RNA, 12 nt, Human
ccccacuggacu

SEQ ID NO: 1762681 - RNA, 19 nt, Human
ccccacuggacugaccugg

SEQ ID NO: 1762682 - RNA, 20 nt, Human
ccccacuggacugaccuggu

SEQ ID NO: 1762683 - RNA, 20 nt, Human
ccccaagaggaaguucagau

SEQ ID NO: 1762684 - RNA, 14 nt, Human
cccuuuuuucugcc

SEQ ID NO: 1762685 - RNA, 19 nt, Human
cccuuuuuucugccuccuu

SEQ ID NO: 1762686 - RNA, 21 nt, Human
cccuuuuuucugccuccuuua

SEQ ID NO: 1762687 - RNA, 17 nt, Human
ccgagugaacuggucuu

SEQ ID NO: 1762688 - RNA, 20 nt, Human
ccgagugaacuggucuuccu

SEQ ID NO: 1762689 - RNA, 22 nt, Human
ccgaguuaaggugggcccggcc

SEQ ID NO: 1762690 - RNA, 17 nt, Human
ccgauaucagaauuugu

SEQ ID NO: 1762691 - RNA, 22 nt, Human
ccgagggaggggaagcuucugu

SEQ ID NO: 1762692 - RNA, 23 nt, Human
ccgagggaggggaagcuucuguc

SEQ ID NO: 1762693 - RNA, 18 nt, Human
ccgagaucacgccacugc

SEQ ID NO: 1762694 - RNA, 9 nt, Human
cccuuuccu

SEQ ID NO: 1762695 - RNA, 12 nt, Human
cccuuuccuguc

SEQ ID NO: 1762696 - RNA, 14 nt, Human
cccuuuccuguccc

SEQ ID NO: 1762697 - RNA, 15 nt, Human
cccuuuccuguccca

SEQ ID NO: 1762698 - RNA, 21 nt, Human
cccuuucucuuuuccccuuuc

SEQ ID NO: 1762699 - RNA, 13 nt, Human
cccuuugcugucc

SEQ ID NO: 1762700 - RNA, 12 nt, Human
cccuuugcuguc

SEQ ID NO: 1762701 - RNA, 12 nt, Human
cccuuugagugc

SEQ ID NO: 1762702 - RNA, 14 nt, Human
cccuuugagugcag

SEQ ID NO: 1762703 - RNA, 22 nt, Human
cccuuccuauuccaagcuucca

SEQ ID NO: 1762704 - RNA, 13 nt, Human
ccuaccuugcuuu

SEQ ID NO: 1762705 - RNA, 14 nt, Human
ccuaaacuccaggg

SEQ ID NO: 1762706 - RNA, 14 nt, Human
ccgugggcucccug

SEQ ID NO: 1762707 - RNA, 12 nt, Human
ccuaaaacaaau

SEQ ID NO: 1762708 - RNA, 20 nt, Human
ccgggcacucagaagacacu

SEQ ID NO: 1762709 - RNA, 13 nt, Human
ccgggccagggcu

SEQ ID NO: 1762710 - RNA, 14 nt, Human
ccgggccagggcug

SEQ ID NO: 1762711 - RNA, 15 nt, Human
ccgggccagggcugc

SEQ ID NO: 1762712 - RNA, 13 nt, Human
ccgggccccacag

SEQ ID NO: 1762713 - RNA, 16 nt, Human
ccggaaugccacccac

SEQ ID NO: 1762714 - RNA, 20 nt, Human
ccggaaugccacccacaucu

SEQ ID NO: 1762715 - RNA, 17 nt, Human
ccggacccucuaaccuc

SEQ ID NO: 1762716 - RNA, 21 nt, Human
ccggacccucuaaccucgccc

SEQ ID NO: 1762717 - RNA, 12 nt, Human
ccggcucugugg

SEQ ID NO: 1762718 - RNA, 15 nt, Human
ccggcucugugggug

SEQ ID NO: 1762719 - RNA, 15 nt, Human
ccgggcacucagaag

SEQ ID NO: 1762720 - RNA, 17 nt, Human
ccgcuuggagcagaggg

SEQ ID NO: 1762721 - RNA, 18 nt, Human
ccgcuuggagcagagggg

SEQ ID NO: 1762722 - RNA, 15 nt, Human
ccgcuuggagcagag

SEQ ID NO: 1762723 - RNA, 17 nt, Human
ccucacccccuccuuca

SEQ ID NO: 1762724 - RNA, 17 nt, Human
ccuaugggccugccggg

SEQ ID NO: 1762725 - RNA, 19 nt, Human
ccuaugggccugccgggcu

SEQ ID NO: 1762726 - RNA, 17 nt, Human
ccuagaggcccuuugcu

SEQ ID NO: 1762727 - RNA, 20 nt, Human
ccuagaggcccuuugcuguc

SEQ ID NO: 1762728 - RNA, 13 nt, Human
ccuagaggcccca

SEQ ID NO: 1762729 - RNA, 15 nt, Human
ccucacaggccccag

SEQ ID NO: 1762730 - RNA, 13 nt, Human
ccucaauccagcu

SEQ ID NO: 1762731 - RNA, 18 nt, Human
ccucaauccagcuauguu

SEQ ID NO: 1762732 - RNA, 17 nt, Human
ccuaugugauuuuaacu

SEQ ID NO: 1762733 - RNA, 22 nt, Human
ccuaugugauuuuaacucuguc

SEQ ID NO: 1762734 - RNA, 20 nt, Human
ccuaugugauuuuaacucug

SEQ ID NO: 1762735 - RNA, 11 nt, Human
cugcccggcug

SEQ ID NO: 1762736 - RNA, 15 nt, Human
cugcccggcugcgga

SEQ ID NO: 1762737 - RNA, 22 nt, Human
cugcccuccccuccggacuggu

SEQ ID NO: 1762738 - RNA, 13 nt, Human
cugcccaggcccc

SEQ ID NO: 1762739 - RNA, 17 nt, Human
cugccauggaacuguuu

SEQ ID NO: 1762740 - RNA, 18 nt, Human
cugccauggaacuguuuc

SEQ ID NO: 1762741 - RNA, 20 nt, Human
cugccauggaacuguuuccu

SEQ ID NO: 1762742 - RNA, 22 nt, Human
cugccauggaacuguuuccuuc

SEQ ID NO: 1762743 - RNA, 18 nt, Human
cugcagggccgccaggga

SEQ ID NO: 1762744 - RNA, 19 nt, Human
cugcagggccgccagggag

SEQ ID NO: 1762745 - RNA, 21 nt, Human
cugccacagccuccccugcca

SEQ ID NO: 1762746 - RNA, 22 nt, Human
cugccacagccuccccugccag

SEQ ID NO: 1762747 - RNA, 23 nt, Human
cugccacagccuccccugccagg

SEQ ID NO: 1762748 - RNA, 15 nt, Human
cugccacccugggga

SEQ ID NO: 1762749 - RNA, 16 nt, Human
cugccacccuggggag

SEQ ID NO: 1762750 - RNA, 20 nt, Human
cugccacccuggggagaaag

SEQ ID NO: 1762751 - RNA, 20 nt, Human
cugcggaaugaaccacaucu

SEQ ID NO: 1762752 - RNA, 14 nt, Human
cugccuuagcuuca

SEQ ID NO: 1762753 - RNA, 15 nt, Human
cugccuuagcuucag

SEQ ID NO: 1762754 - RNA, 16 nt, Human
cugccuuagcuucagg

SEQ ID NO: 1762755 - RNA, 17 nt, Human
cugccuuagcuucagga

SEQ ID NO: 1762756 - RNA, 18 nt, Human
cugccuuagcuucaggaa

SEQ ID NO: 1762757 - RNA, 15 nt, Human
cugcgguccacccag

SEQ ID NO: 1762758 - RNA, 20 nt, Human
cugcggagagaggccuuguc

SEQ ID NO: 1762759 - RNA, 21 nt, Human
cugcggaaugaaccacaucuu

SEQ ID NO: 1762760 - RNA, 17 nt, Human
cugcgguccacccagga

SEQ ID NO: 1762761 - RNA, 19 nt, Human
cugcgugucaccugugcuu

SEQ ID NO: 1762762 - RNA, 16 nt, Human
cugcgguccacccagg

SEQ ID NO: 1762763 - RNA, 14 nt, Human
cugcuaacaaguca

SEQ ID NO: 1762764 - RNA, 21 nt, Human
cugcuccccucugcacggacc

SEQ ID NO: 1762765 - RNA, 16 nt, Human
cugcuccucuccccag

SEQ ID NO: 1762766 - RNA, 17 nt, Human
cugcuccucuccccagc

SEQ ID NO: 1762767 - RNA, 18 nt, Human
cugcuccucuccccagca

SEQ ID NO: 1762768 - RNA, 15 nt, Human
cugcucgccuuagca

SEQ ID NO: 1762769 - RNA, 20 nt, Human
cugcucucuuuuucuccagg

SEQ ID NO: 1762770 - RNA, 24 nt, Human
cugcucucuuuuucuccaggguca

SEQ ID NO: 1762771 - RNA, 16 nt, Human
cugcucgccuuagcac

SEQ ID NO: 1762772 - RNA, 13 nt, Human
cugccugcccagg

SEQ ID NO: 1762773 - RNA, 14 nt, Human
cugccugcccaggc

SEQ ID NO: 1762774 - RNA, 15 nt, Human
cugccugcccaggcc

SEQ ID NO: 1762775 - RNA, 20 nt, Human
cugccugacauuuggagugu

SEQ ID NO: 1762776 - RNA, 23 nt, Human
cugccugacauuuggaguguucc

SEQ ID NO: 1762777 - RNA, 16 nt, Human
cugccugcccacacag

SEQ ID NO: 1762778 - RNA, 14 nt, Human
cugccucagccucc

SEQ ID NO: 1762779 - RNA, 13 nt, Human
cugccucagccuc

SEQ ID NO: 1762780 - RNA, 22 nt, Human
cugccucaggaggcaggaccuu

SEQ ID NO: 1762781 - RNA, 23 nt, Human
cugccucaggaggcaggaccuuc

SEQ ID NO: 1762782 - RNA, 12 nt, Human
cugcagggaaaa

SEQ ID NO: 1762783 - RNA, 22 nt, Human
cugcagggaaaauuauuugcau

SEQ ID NO: 1762784 - RNA, 23 nt, Human
cugcagggaaaauuauuugcaua

SEQ ID NO: 1762785 - RNA, 22 nt, Human
cugcagggaguccgaaagggac

SEQ ID NO: 1762786 - RNA, 22 nt, Human
cugcagccucaaccuccugggc

SEQ ID NO: 1762787 - RNA, 19 nt, Human
cugcagccucaaccuccug

SEQ ID NO: 1762788 - RNA, 20 nt, Human
cugcagccucaaccuccugg

SEQ ID NO: 1762789 - RNA, 11 nt, Human
cugcagccuca

SEQ ID NO: 1762790 - RNA, 14 nt, Human
cugcacuugcagac

SEQ ID NO: 1762791 - RNA, 16 nt, Human
cugcacuugcagacuc

SEQ ID NO: 1762792 - RNA, 17 nt, Human
cugcacuugcagacucu

SEQ ID NO: 1762793 - RNA, 21 nt, Human
cugcagagaaacuuaagcaaa

SEQ ID NO: 1762794 - RNA, 22 nt, Human
cugcagagaaacuuaagcaaag

SEQ ID NO: 1762795 - RNA, 23 nt, Human
cugcagagaaacuuaagcaaagg

SEQ ID NO: 1762796 - RNA, 12 nt, Human
cugcaauuucua

SEQ ID NO: 1762797 - RNA, 15 nt, Human
cugcaauuucuacua

SEQ ID NO: 1762798 - RNA, 18 nt, Human
cugcaaaaggacucucag

SEQ ID NO: 1762799 - RNA, 13 nt, Human
cugcaaacgcugc

SEQ ID NO: 1762800 - RNA, 15 nt, Human
cugcaaacgcugccu

SEQ ID NO: 1762801 - RNA, 16 nt, Human
cugcaaacgcugccug

SEQ ID NO: 1762802 - RNA, 18 nt, Human
cugcaaacgcugccugcc

SEQ ID NO: 1762803 - RNA, 17 nt, Human
cugcaaacgcugccugc

SEQ ID NO: 1762804 - RNA, 12 nt, Human
cugacccacugc

SEQ ID NO: 1762805 - RNA, 15 nt, Human
cugagggccugcugg

SEQ ID NO: 1762806 - RNA, 16 nt, Human
cugagggccugcugga

SEQ ID NO: 1762807 - RNA, 19 nt, Human
cugagggccugcuggaggc

SEQ ID NO: 1762808 - RNA, 16 nt, Human
cugagggcagucgaua

SEQ ID NO: 1762809 - RNA, 13 nt, Human
cugagugccuucu

SEQ ID NO: 1762810 - RNA, 17 nt, Human
cugagugccuucugugg

SEQ ID NO: 1762811 - RNA, 18 nt, Human
cugagugccuucuguggg

SEQ ID NO: 1762812 - RNA, 20 nt, Human
cugagugccuucugugggga

SEQ ID NO: 1762813 - RNA, 21 nt, Human
cugagugccuucuguggggac

SEQ ID NO: 1762814 - RNA, 23 nt, Human
cugagugccuucuguggggacuc

SEQ ID NO: 1762815 - RNA, 19 nt, Human
cugauaaaaccauguagaa

SEQ ID NO: 1762816 - RNA, 23 nt, Human
cugauaaaaccauguagaaaauu

SEQ ID NO: 1762817 - RNA, 12 nt, Human
cugaucccucua

SEQ ID NO: 1762818 - RNA, 13 nt, Human
cugaucccucuac

SEQ ID NO: 1762819 - RNA, 22 nt, Human
cugauucccaagcucugcuccu

SEQ ID NO: 1762820 - RNA, 19 nt, Human
cugauucccaagcucugcu

SEQ ID NO: 1762821 - RNA, 20 nt, Human
cugauucccaagcucugcuc

SEQ ID NO: 1762822 - RNA, 17 nt, Human
cugauucccaagcucug

SEQ ID NO: 1762823 - RNA, 18 nt, Human
cugauucccaagcucugc

SEQ ID NO: 1762824 - RNA, 15 nt, Human
cugauucccaagcuc

SEQ ID NO: 1762825 - RNA, 18 nt, Human
cugauucaacuaaaaaaa

SEQ ID NO: 1762826 - RNA, 15 nt, Human
cugauucaacuaaaa

SEQ ID NO: 1762827 - RNA, 17 nt, Human
cugauucaacuaaaaaa

SEQ ID NO: 1762828 - RNA, 14 nt, Human
cugauucaacuaaa

SEQ ID NO: 1762829 - RNA, 16 nt, Human
cugggaaauauucccu

SEQ ID NO: 1762830 - RNA, 18 nt, Human
cugggaaauauucccuag

SEQ ID NO: 1762831 - RNA, 14 nt, Human
cuggcuucuguggg

SEQ ID NO: 1762832 - RNA, 16 nt, Human
cuggcuucuguggggc

SEQ ID NO: 1762833 - RNA, 17 nt, Human
cuggcuucuguggggcc

SEQ ID NO: 1762834 - RNA, 19 nt, Human
cuggcuucuguggggcccc

SEQ ID NO: 1762835 - RNA, 21 nt, Human
cuggcuucuguggggccccuc

SEQ ID NO: 1762836 - RNA, 23 nt, Human
cuggcuucuguggggccccucac

SEQ ID NO: 1762837 - RNA, 20 nt, Human
cuggcuguuggcugggggcc

SEQ ID NO: 1762838 - RNA, 19 nt, Human
cuggcuguuggcugggggc

SEQ ID NO: 1762839 - RNA, 15 nt, Human
cuggccugagaguca

SEQ ID NO: 1762840 - RNA, 19 nt, Human
cuggccugagagucagcuc

SEQ ID NO: 1762841 - RNA, 20 nt, Human
cuggccugagagucagcucu

SEQ ID NO: 1762842 - RNA, 23 nt, Human
cuggccugagagucagcucucug

SEQ ID NO: 1762843 - RNA, 16 nt, Human
cugggagugagcuggu

SEQ ID NO: 1762844 - RNA, 22 nt, Human
cugggagggcagcagggcuacc

SEQ ID NO: 1762845 - RNA, 23 nt, Human
cugggaguugaucgccuuuccca

SEQ ID NO: 1762846 - RNA, 13 nt, Human
cugggagugagcu

SEQ ID NO: 1762847 - RNA, 15 nt, Human
cugggagggcagcag

SEQ ID NO: 1762848 - RNA, 17 nt, Human
cugggagggcagcaggg

SEQ ID NO: 1762849 - RNA, 19 nt, Human
cugggagggcagcagggcu

SEQ ID NO: 1762850 - RNA, 20 nt, Human
cugggagggcagcagggcua

SEQ ID NO: 1762851 - RNA, 14 nt, Human
cugggaggccagug

SEQ ID NO: 1762852 - RNA, 11 nt, Human
cugggagggca

SEQ ID NO: 1762853 - RNA, 13 nt, Human
cugggagggcagc

SEQ ID NO: 1762854 - RNA, 21 nt, Human
cuggguacuuguggacacagc

SEQ ID NO: 1762855 - RNA, 23 nt, Human
cuggguacuuguggacacagcuc

SEQ ID NO: 1762856 - RNA, 20 nt, Human
cuggguacuuguggacacag

SEQ ID NO: 1762857 - RNA, 13 nt, Human
cugggggccucag

SEQ ID NO: 1762858 - RNA, 17 nt, Human
cugggggccucagugcc

SEQ ID NO: 1762859 - RNA, 18 nt, Human
cugggggccucagugcca

SEQ ID NO: 1762860 - RNA, 18 nt, Human
cugggcucccgggcccca

SEQ ID NO: 1762861 - RNA, 18 nt, Human
cugggcuucaguggcagc

SEQ ID NO: 1762862 - RNA, 17 nt, Human
cugggcuucaguggcag

SEQ ID NO: 1762863 - RNA, 19 nt, Human
cugggcuucaguggcagcu

SEQ ID NO: 1762864 - RNA, 20 nt, Human
cugggcuucaguggcagcug

SEQ ID NO: 1762865 - RNA, 21 nt, Human
cugggcuucaguggcagcugc

SEQ ID NO: 1762866 - RNA, 22 nt, Human
cugggcuucaguggcagcugcu

SEQ ID NO: 1762867 - RNA, 23 nt, Human
cugggcuucaguggcagcugcuu

SEQ ID NO: 1762868 - RNA, 21 nt, Human
cugggcucccgggccccacag

SEQ ID NO: 1762869 - RNA, 19 nt, Human
cugguggcagugggagcug

SEQ ID NO: 1762870 - RNA, 23 nt, Human
cugguggcagugggagcugccug

SEQ ID NO: 1762871 - RNA, 15 nt, Human
cugguggacccaggg

SEQ ID NO: 1762872 - RNA, 13 nt, Human
cuggguuggaggg

SEQ ID NO: 1762873 - RNA, 12 nt, Human
cugggucagugg

SEQ ID NO: 1762874 - RNA, 15 nt, Human
cuggucccacucagu

SEQ ID NO: 1762875 - RNA, 18 nt, Human
cuggucccacucagucca

SEQ ID NO: 1762876 - RNA, 22 nt, Human
cuggccucaagugauucuccug

SEQ ID NO: 1762877 - RNA, 22 nt, Human
cuggccagaugcaccagcccuu

SEQ ID NO: 1762878 - RNA, 21 nt, Human
cuggccagaugcaccagcccu

SEQ ID NO: 1762879 - RNA, 17 nt, Human
cuggccagaugcaccag

SEQ ID NO: 1762880 - RNA, 18 nt, Human
cuggccagaugcaccagc

SEQ ID NO: 1762881 - RNA, 19 nt, Human
cuggccagaugcaccagcc

SEQ ID NO: 1762882 - RNA, 20 nt, Human
cuggccagaugcaccagccc

SEQ ID NO: 1762883 - RNA, 16 nt, Human
cuggccagaugcacca

SEQ ID NO: 1762884 - RNA, 16 nt, Human
cuggccaaauagcaaa

SEQ ID NO: 1762885 - RNA, 17 nt, Human
cuggccaaauagcaaag

SEQ ID NO: 1762886 - RNA, 18 nt, Human
cuggccaaauagcaaaga

SEQ ID NO: 1762887 - RNA, 18 nt, Human
cuggauggugugccuucc

SEQ ID NO: 1762888 - RNA, 21 nt, Human
cuggauggugugccuuccaga

SEQ ID NO: 1762889 - RNA, 13 nt, Human
cuggaggccucag

SEQ ID NO: 1762890 - RNA, 14 nt, Human
cuggaggccucagg

SEQ ID NO: 1762891 - RNA, 15 nt, Human
cuggaggccucaggu

SEQ ID NO: 1762892 - RNA, 16 nt, Human
cuggaggccucaggug

SEQ ID NO: 1762893 - RNA, 18 nt, Human
cuggaggccucaggugcu

SEQ ID NO: 1762894 - RNA, 19 nt, Human
cuggaggccucaggugcug

SEQ ID NO: 1762895 - RNA, 21 nt, Human
cuggaggccucaggugcuguc

SEQ ID NO: 1762896 - RNA, 16 nt, Human
cuggaggcugccuccc

SEQ ID NO: 1762897 - RNA, 18 nt, Human
cuggaggcugccucccaa

SEQ ID NO: 1762898 - RNA, 21 nt, Human
cuggaggcugccucccaacag

SEQ ID NO: 1762899 - RNA, 23 nt, Human
cuggacaugaagauucuuuccca

SEQ ID NO: 1762900 - RNA, 21 nt, Human
cuggagcacugggcucccggg

SEQ ID NO: 1762901 - RNA, 23 nt, Human
cuggagcacugggcucccgggcc

SEQ ID NO: 1762902 - RNA, 16 nt, Human
cuggagcacugggcuc

SEQ ID NO: 1762903 - RNA, 17 nt, Human
cuggagcacugggcucc

SEQ ID NO: 1762904 - RNA, 19 nt, Human
cuggagcacugggcucccg

SEQ ID NO: 1762905 - RNA, 20 nt, Human
cuggagcacugggcucccgg

SEQ ID NO: 1762906 - RNA, 17 nt, Human
cuggaggaaagggagga

SEQ ID NO: 1762907 - RNA, 18 nt, Human
cuggaggaaagggaggag

SEQ ID NO: 1762908 - RNA, 20 nt, Human
cuggaggaaagggaggagug

SEQ ID NO: 1762909 - RNA, 13 nt, Human
cugcucugagcca

SEQ ID NO: 1762910 - RNA, 16 nt, Human
cugcucugagccacag

SEQ ID NO: 1762911 - RNA, 17 nt, Human
cugcuuuuaacucuaga

SEQ ID NO: 1762912 - RNA, 19 nt, Human
cugcuuuuaacucuagaau

SEQ ID NO: 1762913 - RNA, 14 nt, Human
cuggaaugcagugg

SEQ ID NO: 1762914 - RNA, 15 nt, Human
cuggaaugcaguggu

SEQ ID NO: 1762915 - RNA, 15 nt, Human
cuggaagcacagcuu

SEQ ID NO: 1762916 - RNA, 18 nt, Human
cuggaagcacagcuucau

SEQ ID NO: 1762917 - RNA, 23 nt, Human
cuggaauaauccuaaacauauga

SEQ ID NO: 1762918 - RNA, 23 nt, Human
cucccauagauacucucuucuuc

SEQ ID NO: 1762919 - RNA, 13 nt, Human
cucccuggcuucu

SEQ ID NO: 1762920 - RNA, 15 nt, Human
cucccuggcuucugu

SEQ ID NO: 1762921 - RNA, 18 nt, Human
cucccuggcuucuguggg

SEQ ID NO: 1762922 - RNA, 19 nt, Human
cucccuggcuucugugggg

SEQ ID NO: 1762923 - RNA, 23 nt, Human
cucccuugacuuugcuccucaca

SEQ ID NO: 1762924 - RNA, 21 nt, Human
cucccuugccuuucgaggccu

SEQ ID NO: 1762925 - RNA, 22 nt, Human
cucccuugccuuucgaggccug

SEQ ID NO: 1762926 - RNA, 23 nt, Human
cucccuugccuuucgaggccuga

SEQ ID NO: 1762927 - RNA, 19 nt, Human
cuccugacccauugcuguu

SEQ ID NO: 1762928 - RNA, 18 nt, Human
cuccugacccauugcugu

SEQ ID NO: 1762929 - RNA, 20 nt, Human
cuccugagaaaaaagguucc

SEQ ID NO: 1762930 - RNA, 17 nt, Human
cuccucacucaccuuca

SEQ ID NO: 1762931 - RNA, 14 nt, Human
cuccugugugugcg

SEQ ID NO: 1762932 - RNA, 14 nt, Human
cuccugccaaggag

SEQ ID NO: 1762933 - RNA, 15 nt, Human
cuccugugucuugca

SEQ ID NO: 1762934 - RNA, 23 nt, Human
cuccugugucuugcaauggcagc

SEQ ID NO: 1762935 - RNA, 11 nt, Human
cuccugugugu

SEQ ID NO: 1762936 - RNA, 14 nt, Human
cuccuucuguccua

SEQ ID NO: 1762937 - RNA, 22 nt, Human
cuccuucauaugaaaggugcca

SEQ ID NO: 1762938 - RNA, 15 nt, Human
cuccuucuguccuac

SEQ ID NO: 1762939 - RNA, 20 nt, Human
cuccuucuguccuacucugu

SEQ ID NO: 1762940 - RNA, 22 nt, Human
cucgccaagcaggacagugcuu

SEQ ID NO: 1762941 - RNA, 13 nt, Human
cucgaguacugug

SEQ ID NO: 1762942 - RNA, 14 nt, Human
cucgaguacugugg

SEQ ID NO: 1762943 - RNA, 16 nt, Human
cucgaguacugugggc

SEQ ID NO: 1762944 - RNA, 17 nt, Human
cucgaguacugugggca

SEQ ID NO: 1762945 - RNA, 18 nt, Human
cucgaguacugugggcaa

SEQ ID NO: 1762946 - RNA, 20 nt, Human
cucgaguacugugggcaauu

SEQ ID NO: 1762947 - RNA, 22 nt, Human
cucgaguacugugggcaauuua

SEQ ID NO: 1762948 - RNA, 14 nt, Human
cuccacucucuacc

SEQ ID NO: 1762949 - RNA, 19 nt, Human
cuccacucucuaccagaua

SEQ ID NO: 1762950 - RNA, 19 nt, Human
cuccagcucaccagcccca

SEQ ID NO: 1762951 - RNA, 20 nt, Human
cuccagcucaccagccccag

SEQ ID NO: 1762952 - RNA, 11 nt, Human
cuccagccuga

SEQ ID NO: 1762953 - RNA, 12 nt, Human
cuccagccugaa

SEQ ID NO: 1762954 - RNA, 20 nt, Human
cuccagccugaacagaagcu

SEQ ID NO: 1762955 - RNA, 12 nt, Human
cuccacagggcc

SEQ ID NO: 1762956 - RNA, 11 nt, Human
cuccacccugc

SEQ ID NO: 1762957 - RNA, 12 nt, Human
cuccacccugcu

SEQ ID NO: 1762958 - RNA, 14 nt, Human
cuccaugugggcua

SEQ ID NO: 1762959 - RNA, 18 nt, Human
cucccaagguuggagccc

SEQ ID NO: 1762960 - RNA, 21 nt, Human
cucccaagguuggagcccagg

SEQ ID NO: 1762961 - RNA, 12 nt, Human
cuccagcuuccc

SEQ ID NO: 1762962 - RNA, 13 nt, Human
cuccagcuucccg

SEQ ID NO: 1762963 - RNA, 20 nt, Human
cuccaggcauuuagcccuca

SEQ ID NO: 1762964 - RNA, 22 nt, Human
cuccaggcauuuagcccucaca

SEQ ID NO: 1762965 - RNA, 11 nt, Human
cuccaggcucc

SEQ ID NO: 1762966 - RNA, 21 nt, Human
cuaaaagauauaagugcugua

SEQ ID NO: 1762967 - RNA, 20 nt, Human
cuaaaagauauaagugcugu

SEQ ID NO: 1762968 - RNA, 17 nt, Human
cuaaaagauauaagugc

SEQ ID NO: 1762969 - RNA, 16 nt, Human
cuaaaaaaaaaaaagu

SEQ ID NO: 1762970 - RNA, 15 nt, Human
cucaggugucccugc

SEQ ID NO: 1762971 - RNA, 16 nt, Human
cucaggugucccugca

SEQ ID NO: 1762972 - RNA, 17 nt, Human
cucaggugucccugcac

SEQ ID NO: 1762973 - RNA, 18 nt, Human
cucaggugucccugcacu

SEQ ID NO: 1762974 - RNA, 19 nt, Human
cucaggugucccugcacuu

SEQ ID NO: 1762975 - RNA, 20 nt, Human
cucauaguaugguggcuggg

SEQ ID NO: 1762976 - RNA, 16 nt, Human
cucauagguugagcaa

SEQ ID NO: 1762977 - RNA, 19 nt, Human
cucauagguugagcaauuu

SEQ ID NO: 1762978 - RNA, 18 nt, Human
cucauaguaugguggcug

SEQ ID NO: 1762979 - RNA, 19 nt, Human
cucauaguaugguggcugg

SEQ ID NO: 1762980 - RNA, 21 nt, Human
cucauaacggaucagaaauac

SEQ ID NO: 1762981 - RNA, 19 nt, Human
cucauaacggaucagaaau

SEQ ID NO: 1762982 - RNA, 17 nt, Human
cucauaacggaucagaa

SEQ ID NO: 1762983 - RNA, 23 nt, Human
cucaucauucucugucucaucca

SEQ ID NO: 1762984 - RNA, 16 nt, Human
cucauccaucaucaug

SEQ ID NO: 1762985 - RNA, 19 nt, Human
cucauccaucaucaugugu

SEQ ID NO: 1762986 - RNA, 13 nt, Human
cucauuggacccu

SEQ ID NO: 1762987 - RNA, 17 nt, Human
cucauuggacccuucca

SEQ ID NO: 1762988 - RNA, 18 nt, Human
cucauuggacccuuccau

SEQ ID NO: 1762989 - RNA, 23 nt, Human
cucauucuucuguacgucugaca

SEQ ID NO: 1762990 - RNA, 12 nt, Human
cucauuccagau

SEQ ID NO: 1762991 - RNA, 14 nt, Human
cucauuccagaucc

SEQ ID NO: 1762992 - RNA, 13 nt, Human
cucauucuucugu

SEQ ID NO: 1762993 - RNA, 14 nt, Human
cucauucuucugua

SEQ ID NO: 1762994 - RNA, 18 nt, Human
cucauucccuccccagaa

SEQ ID NO: 1762995 - RNA, 14 nt, Human
cucuggacaggcau

SEQ ID NO: 1762996 - RNA, 16 nt, Human
cucuggacaaagcguu

SEQ ID NO: 1762997 - RNA, 14 nt, Human
cucugccucugaca

SEQ ID NO: 1762998 - RNA, 16 nt, Human
cucugccucugacaca

SEQ ID NO: 1762999 - RNA, 16 nt, Human
cucugcccucuagagc

SEQ ID NO: 1763000 - RNA, 13 nt, Human
cucugcccugugu

SEQ ID NO: 1763001 - RNA, 14 nt, Human
cucugcccugugua

SEQ ID NO: 1763002 - RNA, 15 nt, Human
cucugagcugugcag

SEQ ID NO: 1763003 - RNA, 13 nt, Human
cucugagcaguga

SEQ ID NO: 1763004 - RNA, 16 nt, Human
cucugagccacagugg

SEQ ID NO: 1763005 - RNA, 18 nt, Human
cucugagccacaguggga

SEQ ID NO: 1763006 - RNA, 12 nt, Human
cucucugcucug

SEQ ID NO: 1763007 - RNA, 12 nt, Human
cucucugcccug

SEQ ID NO: 1763008 - RNA, 13 nt, Human
cucucugcccugu

SEQ ID NO: 1763009 - RNA, 14 nt, Human
cucucugcccugug

SEQ ID NO: 1763010 - RNA, 15 nt, Human
cucucugcccugugu

SEQ ID NO: 1763011 - RNA, 16 nt, Human
cucucugcccugugua

SEQ ID NO: 1763012 - RNA, 17 nt, Human
cucucugcccuguguac

SEQ ID NO: 1763013 - RNA, 14 nt, Human
cucucugcucugcg

SEQ ID NO: 1763014 - RNA, 22 nt, Human
cucucugcucugcgugucaccu

SEQ ID NO: 1763015 - RNA, 11 nt, Human
cucucugcccu

SEQ ID NO: 1763016 - RNA, 14 nt, Human
cucugacuugggga

SEQ ID NO: 1763017 - RNA, 12 nt, Human
cucugaucccuc

SEQ ID NO: 1763018 - RNA, 21 nt, Human
cucugaucccucuacagagcu

SEQ ID NO: 1763019 - RNA, 22 nt, Human
cucugaucccucuacagagcuu

SEQ ID NO: 1763020 - RNA, 14 nt, Human
cucugcauccagag

SEQ ID NO: 1763021 - RNA, 18 nt, Human
cucuccuuuguucccggc

SEQ ID NO: 1763022 - RNA, 13 nt, Human
cucuccccagcaa

SEQ ID NO: 1763023 - RNA, 10 nt, Human
cucuccaggg

SEQ ID NO: 1763024 - RNA, 18 nt, Human
cucucagucucugagcag

SEQ ID NO: 1763025 - RNA, 18 nt, Human
cucucaggccggcagccc

SEQ ID NO: 1763026 - RNA, 21 nt, Human
cucucaggccggcagccccag

SEQ ID NO: 1763027 - RNA, 13 nt, Human
cucucagucucug

SEQ ID NO: 1763028 - RNA, 14 nt, Human
cucucagucucuga

SEQ ID NO: 1763029 - RNA, 15 nt, Human
cucucagucucugag

SEQ ID NO: 1763030 - RNA, 16 nt, Human
cucucagucucugagc

SEQ ID NO: 1763031 - RNA, 17 nt, Human
cucucagucucugagca

SEQ ID NO: 1763032 - RNA, 16 nt, Human
cucuugaccucaggug

SEQ ID NO: 1763033 - RNA, 13 nt, Human
cucuugaccucag

SEQ ID NO: 1763034 - RNA, 15 nt, Human
cucuugaccucaggu

SEQ ID NO: 1763035 - RNA, 12 nt, Human
cucuuucaaaac

SEQ ID NO: 1763036 - RNA, 21 nt, Human
cucuuguaauccgaaucucuu

SEQ ID NO: 1763037 - RNA, 20 nt, Human
cucuugugaggaaagucauu

SEQ ID NO: 1763038 - RNA, 16 nt, Human
cucuuucugagugccu

SEQ ID NO: 1763039 - RNA, 17 nt, Human
cucuuucugagugccuu

SEQ ID NO: 1763040 - RNA, 18 nt, Human
cucuuucugagugccuuc

SEQ ID NO: 1763041 - RNA, 19 nt, Human
cucuuucugagugccuucu

SEQ ID NO: 1763042 - RNA, 23 nt, Human
cucuuucugagugccuucugugg

SEQ ID NO: 1763043 - RNA, 21 nt, Human
cucuucugggagggcagcagg

SEQ ID NO: 1763044 - RNA, 22 nt, Human
cucuucugggagggcagcaggg

SEQ ID NO: 1763045 - RNA, 12 nt, Human
cucuucuccagg

SEQ ID NO: 1763046 - RNA, 21 nt, Human
cugaagacucauucuucugua

SEQ ID NO: 1763047 - RNA, 14 nt, Human
cugaagucacacag

SEQ ID NO: 1763048 - RNA, 15 nt, Human
cugaagucacacagu

SEQ ID NO: 1763049 - RNA, 16 nt, Human
cugaagucacacagug

SEQ ID NO: 1763050 - RNA, 13 nt, Human
cugaaucaugagc

SEQ ID NO: 1763051 - RNA, 18 nt, Human
cugaaucaugagccugcu

SEQ ID NO: 1763052 - RNA, 20 nt, Human
cugaaucaugagccugcugg

SEQ ID NO: 1763053 - RNA, 21 nt, Human
cugaaucaugagccugcugga

SEQ ID NO: 1763054 - RNA, 18 nt, Human
cugaauaggcgaucacaa

SEQ ID NO: 1763055 - RNA, 15 nt, Human
cugaauagcagaagg

SEQ ID NO: 1763056 - RNA, 23 nt, Human
cugaauaggcgaucacaacgugc

SEQ ID NO: 1763057 - RNA, 21 nt, Human
cugaauaggcgaucacaacgu

SEQ ID NO: 1763058 - RNA, 19 nt, Human
cugacagacacaggcccgg

SEQ ID NO: 1763059 - RNA, 11 nt, Human
cugacaggcaa

SEQ ID NO: 1763060 - RNA, 21 nt, Human
cugacagacacaggcccggcu

SEQ ID NO: 1763061 - RNA, 17 nt, Human
cugacauuguuggccaa

SEQ ID NO: 1763062 - RNA, 20 nt, Human
cugacaggcaaugcuggcug

SEQ ID NO: 1763063 - RNA, 16 nt, Human
cugacaggcaaugcug

SEQ ID NO: 1763064 - RNA, 17 nt, Human
cugacaggcaaugcugg

SEQ ID NO: 1763065 - RNA, 18 nt, Human
cugacaggcaaugcuggc

SEQ ID NO: 1763066 - RNA, 19 nt, Human
cugacaggcaaugcuggcu

SEQ ID NO: 1763067 - RNA, 11 nt, Human
cugacccacug

SEQ ID NO: 1763068 - RNA, 21 nt, Human
cugacauuguuggccaaagcc

SEQ ID NO: 1763069 - RNA, 15 nt, Human
cuguuuuuguuucuu

SEQ ID NO: 1763070 - RNA, 12 nt, Human
cuuaagcaaagg

SEQ ID NO: 1763071 - RNA, 19 nt, Human
cuuaagcaaaggggacagc

SEQ ID NO: 1763072 - RNA, 22 nt, Human
cuuaagcaaaggggacagcugu

SEQ ID NO: 1763073 - RNA, 21 nt, Human
cuguuuucuuuaugucuuuug

SEQ ID NO: 1763074 - RNA, 21 nt, Human
cugguuggcucccgcggugcc

SEQ ID NO: 1763075 - RNA, 15 nt, Human
cuuagaaauuuauuu

SEQ ID NO: 1763076 - RNA, 14 nt, Human
cuuagaaauuuauu

SEQ ID NO: 1763077 - RNA, 15 nt, Human
cuuagaagucacaca

SEQ ID NO: 1763078 - RNA, 15 nt, Human
cuuacuguagccuca

SEQ ID NO: 1763079 - RNA, 16 nt, Human
cuuacuguagccucag

SEQ ID NO: 1763080 - RNA, 17 nt, Human
cuuacuguagccucaga

SEQ ID NO: 1763081 - RNA, 19 nt, Human
cuuaauggaagguuggauc

SEQ ID NO: 1763082 - RNA, 23 nt, Human
cuuacgaauacuuuugcccuuug

SEQ ID NO: 1763083 - RNA, 14 nt, Human
cuuauaauuuaaaa

SEQ ID NO: 1763084 - RNA, 16 nt, Human
cuuaggguuuggagcu

SEQ ID NO: 1763085 - RNA, 13 nt, Human
cuuauaauuuaaa

SEQ ID NO: 1763086 - RNA, 19 nt, Human
cuuaugaaugauuugcaua

SEQ ID NO: 1763087 - RNA, 20 nt, Human
cuuaugaaugauuugcauau

SEQ ID NO: 1763088 - RNA, 18 nt, Human
cuuaugaaugauuugcau

SEQ ID NO: 1763089 - RNA, 18 nt, Human
cuuaucuccacaaccucu

SEQ ID NO: 1763090 - RNA, 22 nt, Human
cuuaucugugcucaggacucag

SEQ ID NO: 1763091 - RNA, 14 nt, Human
cuuaucugugcuca

SEQ ID NO: 1763092 - RNA, 16 nt, Human
cuuaucugugcucagg

SEQ ID NO: 1763093 - RNA, 16 nt, Human
cuuccaggugcccagc

SEQ ID NO: 1763094 - RNA, 19 nt, Human
cuuccaggugcccagcuau

SEQ ID NO: 1763095 - RNA, 13 nt, Human
cuuccagcccaga

SEQ ID NO: 1763096 - RNA, 16 nt, Human
cuuccaaauccccuaa

SEQ ID NO: 1763097 - RNA, 19 nt, Human
cuuccaaauccccuaagca

SEQ ID NO: 1763098 - RNA, 20 nt, Human
cuuccaaauccccuaagcag

SEQ ID NO: 1763099 - RNA, 18 nt, Human
cuucauuuccugugucuu

SEQ ID NO: 1763100 - RNA, 17 nt, Human
cuucuccaggcuguauc

SEQ ID NO: 1763101 - RNA, 14 nt, Human
cuucuccauccaca

SEQ ID NO: 1763102 - RNA, 16 nt, Human
cuucuccauccacaug

SEQ ID NO: 1763103 - RNA, 16 nt, Human
cuucuccacccugcuc

SEQ ID NO: 1763104 - RNA, 19 nt, Human
cuucuccaaaaaucugccu

SEQ ID NO: 1763105 - RNA, 20 nt, Human
cuucuccaaaaaucugccug

SEQ ID NO: 1763106 - RNA, 21 nt, Human
cuucuccaaaaaucugccugg

SEQ ID NO: 1763107 - RNA, 22 nt, Human
cuucuccaaaaaucugccuggg

SEQ ID NO: 1763108 - RNA, 14 nt, Human
cuucuccacccugc

SEQ ID NO: 1763109 - RNA, 15 nt, Human
cuucuccacccugcu

SEQ ID NO: 1763110 - RNA, 16 nt, Human
cuucucgcuuuugcca

SEQ ID NO: 1763111 - RNA, 17 nt, Human
cuucucccaucucuucc

SEQ ID NO: 1763112 - RNA, 18 nt, Human
cuucucccaucucuuccu

SEQ ID NO: 1763113 - RNA, 20 nt, Human
cuucucccaucucuuccuug

SEQ ID NO: 1763114 - RNA, 18 nt, Human
cuucugcuucagccuccc

SEQ ID NO: 1763115 - RNA, 14 nt, Human
cuucuggaaacugu

SEQ ID NO: 1763116 - RNA, 18 nt, Human
cuucuggaaacugugaag

SEQ ID NO: 1763117 - RNA, 16 nt, Human
cuucugcuucagccuc

SEQ ID NO: 1763118 - RNA, 17 nt, Human
cuucugcuucagccucc

SEQ ID NO: 1763119 - RNA, 21 nt, Human
cuucugccauauucuguuggc

SEQ ID NO: 1763120 - RNA, 15 nt, Human
cuucugccauauucu

SEQ ID NO: 1763121 - RNA, 17 nt, Human
cuucugccauauucugu

SEQ ID NO: 1763122 - RNA, 12 nt, Human
cuucucuauaaa

SEQ ID NO: 1763123 - RNA, 13 nt, Human
cuucucuauaaaa

SEQ ID NO: 1763124 - RNA, 15 nt, Human
cuucucuauaaaaaa

SEQ ID NO: 1763125 - RNA, 17 nt, Human
cuucucuauaaaaaaua

SEQ ID NO: 1763126 - RNA, 18 nt, Human
cuucucuauaaaaaauau

SEQ ID NO: 1763127 - RNA, 16 nt, Human
cuucgggcccuuccca

SEQ ID NO: 1763128 - RNA, 17 nt, Human
cuucgggcccuucccac

SEQ ID NO: 1763129 - RNA, 14 nt, Human
cuucgggcugugcc

SEQ ID NO: 1763130 - RNA, 15 nt, Human
cuucgggcugugccc

SEQ ID NO: 1763131 - RNA, 16 nt, Human
cuucgcuccugugucu

SEQ ID NO: 1763132 - RNA, 18 nt, Human
cuucguuuacuaugccug

SEQ ID NO: 1763133 - RNA, 19 nt, Human
cuucgggcuggccaucugg

SEQ ID NO: 1763134 - RNA, 19 nt, Human
cuucguuuacuaugccugu

SEQ ID NO: 1763135 - RNA, 21 nt, Human
cuucguuuacuaugccugugu

SEQ ID NO: 1763136 - RNA, 19 nt, Human
cuucucauagguguccagc

SEQ ID NO: 1763137 - RNA, 14 nt, Human
cuucgcuccugugu

SEQ ID NO: 1763138 - RNA, 15 nt, Human
cuucgcuccuguguc

SEQ ID NO: 1763139 - RNA, 13 nt, Human
cuucgcuccugug

SEQ ID NO: 1763140 - RNA, 14 nt, Human
cuucgaaaaucuag

SEQ ID NO: 1763141 - RNA, 16 nt, Human
cuuccuacccugccuc

SEQ ID NO: 1763142 - RNA, 17 nt, Human
cuuccuacccugccucc

SEQ ID NO: 1763143 - RNA, 22 nt, Human
cuuccuugaccugcauuguaaa

SEQ ID NO: 1763144 - RNA, 23 nt, Human
cuuccuugaccugcauuguaaau

SEQ ID NO: 1763145 - RNA, 15 nt, Human
cuuucugccaccccu

SEQ ID NO: 1763146 - RNA, 18 nt, Human
cuuucugucccuucuguc

SEQ ID NO: 1763147 - RNA, 23 nt, Human
cuuucugucccuucugucccuca

SEQ ID NO: 1763148 - RNA, 13 nt, Human
cuuuccuccucug

SEQ ID NO: 1763149 - RNA, 14 nt, Human
cuuuccuccucuga

SEQ ID NO: 1763150 - RNA, 15 nt, Human
cuuuccuccucugac

SEQ ID NO: 1763151 - RNA, 17 nt, Human
cuuuccuccucugacuu

SEQ ID NO: 1763152 - RNA, 12 nt, Human
cuuuccuccuuu

SEQ ID NO: 1763153 - RNA, 13 nt, Human
cuuuccuccuuuc

SEQ ID NO: 1763154 - RNA, 14 nt, Human
cuuuccuccuuucc

SEQ ID NO: 1763155 - RNA, 16 nt, Human
cuuuccucucuauauu

SEQ ID NO: 1763156 - RNA, 17 nt, Human
cuuuccucucuauauuu

SEQ ID NO: 1763157 - RNA, 18 nt, Human
cuuuccucucuauauuuc

SEQ ID NO: 1763158 - RNA, 16 nt, Human
cuuucugagugccuuc

SEQ ID NO: 1763159 - RNA, 17 nt, Human
cuuucugagugccuucu

SEQ ID NO: 1763160 - RNA, 18 nt, Human
cuuucugagugccuucug

SEQ ID NO: 1763161 - RNA, 19 nt, Human
cuuucugagugccuucugu

SEQ ID NO: 1763162 - RNA, 20 nt, Human
cuuucugagugccuucugug

SEQ ID NO: 1763163 - RNA, 21 nt, Human
cuuucugagugccuucugugg

SEQ ID NO: 1763164 - RNA, 13 nt, Human
cuuucucuuuucc

SEQ ID NO: 1763165 - RNA, 21 nt, Human
cuuucucuuuuccccuuuccu

SEQ ID NO: 1763166 - RNA, 22 nt, Human
cuuucucuuuuccccuuuccug

SEQ ID NO: 1763167 - RNA, 23 nt, Human
cuuucucuuuuccccuuuccugu

SEQ ID NO: 1763168 - RNA, 16 nt, Human
cuuuaggguucugccu

SEQ ID NO: 1763169 - RNA, 18 nt, Human
cuuuaggguucugccucu

SEQ ID NO: 1763170 - RNA, 17 nt, Human
cuuuagaguuagacugu

SEQ ID NO: 1763171 - RNA, 20 nt, Human
cuuuagaguuagacuguugg

SEQ ID NO: 1763172 - RNA, 14 nt, Human
cuuuagaguuagac

SEQ ID NO: 1763173 - RNA, 11 nt, Human
cuuuggcagug

SEQ ID NO: 1763174 - RNA, 20 nt, Human
cuuuggaaaaugcauuguau

SEQ ID NO: 1763175 - RNA, 21 nt, Human
cuuuggaaaaugcauuguauc

SEQ ID NO: 1763176 - RNA, 13 nt, Human
cuuuguggcuucc

SEQ ID NO: 1763177 - RNA, 18 nt, Human
cuuuccucauuaaauuac

SEQ ID NO: 1763178 - RNA, 19 nt, Human
cuuuggaaaaugcauugua

SEQ ID NO: 1763179 - RNA, 17 nt, Human
cuuuugacaaaggcaag

SEQ ID NO: 1763180 - RNA, 19 nt, Human
cuuuuguuuccuuuuuucc

SEQ ID NO: 1763181 - RNA, 20 nt, Human
cuuuuguuuccuuuuuuccc

SEQ ID NO: 1763182 - RNA, 15 nt, Human
cuuuuguuuccuuuu

SEQ ID NO: 1763183 - RNA, 13 nt, Human
cuuuuugcuuucg

SEQ ID NO: 1763184 - RNA, 19 nt, Human
cuuuguuuugcacacuuug

SEQ ID NO: 1763185 - RNA, 23 nt, Human
cuuuguuuugcacacuuugccau

SEQ ID NO: 1763186 - RNA, 21 nt, Human
cuuuuuuacuuaguagauuaa

SEQ ID NO: 1763187 - RNA, 16 nt, Human
gaaaaauauuuauuca

SEQ ID NO: 1763188 - RNA, 18 nt, Human
gaaaaauauuuauucauu

SEQ ID NO: 1763189 - RNA, 12 nt, Human
gaaaacaaggaa

SEQ ID NO: 1763190 - RNA, 14 nt, Human
gaaaacaaggaagu

SEQ ID NO: 1763191 - RNA, 19 nt, Human
gaaaauaacaauaaaagac

SEQ ID NO: 1763192 - RNA, 14 nt, Human
cuugggcccuuuga

SEQ ID NO: 1763193 - RNA, 16 nt, Human
cuugggcccuuugagu

SEQ ID NO: 1763194 - RNA, 17 nt, Human
cuugggcccuuugagug

SEQ ID NO: 1763195 - RNA, 19 nt, Human
cuugggcccuuugagugca

SEQ ID NO: 1763196 - RNA, 11 nt, Human
cuuggacucau

SEQ ID NO: 1763197 - RNA, 21 nt, Human
cuugggcucccuguaaccucu

SEQ ID NO: 1763198 - RNA, 13 nt, Human
cuugggcucccug

SEQ ID NO: 1763199 - RNA, 22 nt, Human
cuuguagcgacuaaacuagauu

SEQ ID NO: 1763200 - RNA, 17 nt, Human
cuuguagcgacuaaacu

SEQ ID NO: 1763201 - RNA, 19 nt, Human
cuuguucugagauucaaua

SEQ ID NO: 1763202 - RNA, 13 nt, Human
cuuguuuccuugu

SEQ ID NO: 1763203 - RNA, 15 nt, Human
cuugcaauggcagcc

SEQ ID NO: 1763204 - RNA, 16 nt, Human
cuugcaauggcagccu

SEQ ID NO: 1763205 - RNA, 17 nt, Human
cuugcaauggcagccuu

SEQ ID NO: 1763206 - RNA, 18 nt, Human
cuugcaauggcagccuug

SEQ ID NO: 1763207 - RNA, 21 nt, Human
cuugcagacucuacagaggcc

SEQ ID NO: 1763208 - RNA, 14 nt, Human
cuugcacagggauu

SEQ ID NO: 1763209 - RNA, 20 nt, Human
cuugcacagggauucucaca

SEQ ID NO: 1763210 - RNA, 15 nt, Human
cuucugggagggcag

SEQ ID NO: 1763211 - RNA, 15 nt, Human
cuugaggguugggcu

SEQ ID NO: 1763212 - RNA, 17 nt, Human
cuugaggguugggcugg

SEQ ID NO: 1763213 - RNA, 18 nt, Human
cuugcucuguuugugggg

SEQ ID NO: 1763214 - RNA, 19 nt, Human
cuugcucuguuuguggggu

SEQ ID NO: 1763215 - RNA, 22 nt, Human
cuugcucugcugacagacacag

SEQ ID NO: 1763216 - RNA, 20 nt, Human
cuuggaagcuccgcuuucua

SEQ ID NO: 1763217 - RNA, 14 nt, Human
cuuggaagcuccgc

SEQ ID NO: 1763218 - RNA, 20 nt, Human
cuugcuugauuguauggugg

SEQ ID NO: 1763219 - RNA, 17 nt, Human
gacagacacaggcccgg

SEQ ID NO: 1763220 - RNA, 20 nt, Human
gacagacacaggcccggcuc

SEQ ID NO: 1763221 - RNA, 22 nt, Human
gacagacacaggcccggcucca

SEQ ID NO: 1763222 - RNA, 12 nt, Human
gacagaggcagc

SEQ ID NO: 1763223 - RNA, 23 nt, Human
gacagaggcagccccauucugcc

SEQ ID NO: 1763224 - RNA, 15 nt, Human
gacagaggaugagcu

SEQ ID NO: 1763225 - RNA, 19 nt, Human
gacagagugagacucuguc

SEQ ID NO: 1763226 - RNA, 21 nt, Human
gacagagucucacuguugccc

SEQ ID NO: 1763227 - RNA, 16 nt, Human
gacagagugagacucu

SEQ ID NO: 1763228 - RNA, 22 nt, Human
gacaggcauguucucugaggac

SEQ ID NO: 1763229 - RNA, 24 nt, Human
gacaggcaaugcuggcuguuggcu

SEQ ID NO: 1763230 - RNA, 23 nt, Human
gacaggcaaugcuggcuguuggc

SEQ ID NO: 1763231 - RNA, 20 nt, Human
gacaggcauguucucugagg

SEQ ID NO: 1763232 - RNA, 21 nt, Human
gacaggcauguucucugagga

SEQ ID NO: 1763233 - RNA, 20 nt, Human
gacaggcaagcaccuccugc

SEQ ID NO: 1763234 - RNA, 21 nt, Human
gacaggcaagcaccuccugcc

SEQ ID NO: 1763235 - RNA, 18 nt, Human
gacaggcaaugcuggcug

SEQ ID NO: 1763236 - RNA, 19 nt, Human
gacaggcaaugcuggcugu

SEQ ID NO: 1763237 - RNA, 13 nt, Human
gacaggcaagcac

SEQ ID NO: 1763238 - RNA, 17 nt, Human
gacaggcaagcaccucc

SEQ ID NO: 1763239 - RNA, 18 nt, Human
gacaggcaagcaccuccu

SEQ ID NO: 1763240 - RNA, 14 nt, Human
gacagauuaauauu

SEQ ID NO: 1763241 - RNA, 23 nt, Human
gaccagacaccuugacagggcac

SEQ ID NO: 1763242 - RNA, 24 nt, Human
gaccagacaccuugacagggcaca

SEQ ID NO: 1763243 - RNA, 22 nt, Human
gaccagacaccuugacagggca

SEQ ID NO: 1763244 - RNA, 19 nt, Human
gaccccagcaagugguccu

SEQ ID NO: 1763245 - RNA, 12 nt, Human
gaccccagagga

SEQ ID NO: 1763246 - RNA, 13 nt, Human
gacccauugcugu

SEQ ID NO: 1763247 - RNA, 14 nt, Human
gacccauugcuguu

SEQ ID NO: 1763248 - RNA, 15 nt, Human
gacccauugcuguug

SEQ ID NO: 1763249 - RNA, 16 nt, Human
gacccagcccucaucc

SEQ ID NO: 1763250 - RNA, 17 nt, Human
gacccagcccucauccc

SEQ ID NO: 1763251 - RNA, 12 nt, Human
gaccagccagca

SEQ ID NO: 1763252 - RNA, 16 nt, Human
gaccagccagcagcag

SEQ ID NO: 1763253 - RNA, 18 nt, Human
gaccagccagcagcagcc

SEQ ID NO: 1763254 - RNA, 15 nt, Human
gacugaccuggucca

SEQ ID NO: 1763255 - RNA, 19 nt, Human
gacugaccugguccacagg

SEQ ID NO: 1763256 - RNA, 20 nt, Human
gacugaccugguccacaggg

SEQ ID NO: 1763257 - RNA, 22 nt, Human
gacugaccugguccacagggca

SEQ ID NO: 1763258 - RNA, 23 nt, Human
gacugaccugguccacagggcac

SEQ ID NO: 1763259 - RNA, 21 nt, Human
gacucuacagaggccaugggc

SEQ ID NO: 1763260 - RNA, 15 nt, Human
gacucuacagaggcc

SEQ ID NO: 1763261 - RNA, 18 nt, Human
gacuacaggcacccacca

SEQ ID NO: 1763262 - RNA, 13 nt, Human
gacuacaggcacc

SEQ ID NO: 1763263 - RNA, 15 nt, Human
gacuacaggcaccca

SEQ ID NO: 1763264 - RNA, 16 nt, Human
gacugagcacccucug

SEQ ID NO: 1763265 - RNA, 17 nt, Human
gacugagcacccucugg

SEQ ID NO: 1763266 - RNA, 18 nt, Human
gacugagcacccucugga

SEQ ID NO: 1763267 - RNA, 15 nt, Human
gacugaucaggaccu

SEQ ID NO: 1763268 - RNA, 12 nt, Human
gacuucagauug

SEQ ID NO: 1763269 - RNA, 15 nt, Human
gacugcucagaacuu

SEQ ID NO: 1763270 - RNA, 19 nt, Human
gacugcucagaacuugcug

SEQ ID NO: 1763271 - RNA, 20 nt, Human
gacugcucagaacuugcugc

SEQ ID NO: 1763272 - RNA, 23 nt, Human
gacugcucagaacuugcugcugu

SEQ ID NO: 1763273 - RNA, 17 nt, Human
gaccugguccacagggc

SEQ ID NO: 1763274 - RNA, 18 nt, Human
gaccugguccacagggca

SEQ ID NO: 1763275 - RNA, 19 nt, Human
gaccugguccacagggcac

SEQ ID NO: 1763276 - RNA, 17 nt, Human
gaccuggugcugccucu

SEQ ID NO: 1763277 - RNA, 22 nt, Human
gaccuggugcugccucuaccug

SEQ ID NO: 1763278 - RNA, 18 nt, Human
gaccuucgggcugugccc

SEQ ID NO: 1763279 - RNA, 19 nt, Human
gaccuucgggcugugcccg

SEQ ID NO: 1763280 - RNA, 14 nt, Human
gaccuugaacuggg

SEQ ID NO: 1763281 - RNA, 16 nt, Human
gaccuucgggcugugc

SEQ ID NO: 1763282 - RNA, 12 nt, Human
gacggaggggag

SEQ ID NO: 1763283 - RNA, 21 nt, Human
gacggaggggaguagagaagu

SEQ ID NO: 1763284 - RNA, 12 nt, Human
gacggcuccacu

SEQ ID NO: 1763285 - RNA, 18 nt, Human
gacggcuccacuaggacu

SEQ ID NO: 1763286 - RNA, 13 nt, Human
gacgcuugcucug

SEQ ID NO: 1763287 - RNA, 13 nt, Human
gacggagucccac

SEQ ID NO: 1763288 - RNA, 13 nt, Human
gacgugggcuggg

SEQ ID NO: 1763289 - RNA, 20 nt, Human
gacgugggcugggcccacaa

SEQ ID NO: 1763290 - RNA, 23 nt, Human
gacuaaaagauauaagugcugua

SEQ ID NO: 1763291 - RNA, 22 nt, Human
gacuaaaagauauaagugcugu

SEQ ID NO: 1763292 - RNA, 21 nt, Human
gacuaaaagauauaagugcug

SEQ ID NO: 1763293 - RNA, 20 nt, Human
gacuaaaagauauaagugcu

SEQ ID NO: 1763294 - RNA, 19 nt, Human
gacuaaaagauauaagugc

SEQ ID NO: 1763295 - RNA, 18 nt, Human
gacuaaaagauauaagug

SEQ ID NO: 1763296 - RNA, 17 nt, Human
gacuaaaagauauaagu

SEQ ID NO: 1763297 - RNA, 13 nt, Human
gacuaaaagauau

SEQ ID NO: 1763298 - RNA, 12 nt, Human
gacuaaaagaua

SEQ ID NO: 1763299 - RNA, 23 nt, Human
gaaauuuauuuccuaguucugua

SEQ ID NO: 1763300 - RNA, 22 nt, Human
gaaauuuauuuccuaguucugu

SEQ ID NO: 1763301 - RNA, 18 nt, Human
gaaauuguauuacaaauc

SEQ ID NO: 1763302 - RNA, 14 nt, Human
gaaaauauaaguaa

SEQ ID NO: 1763303 - RNA, 16 nt, Human
gaaauuguauuacaaa

SEQ ID NO: 1763304 - RNA, 15 nt, Human
gaaccucgaguacug

SEQ ID NO: 1763305 - RNA, 16 nt, Human
gaaccucgaguacugu

SEQ ID NO: 1763306 - RNA, 17 nt, Human
gaaccucgaguacugug

SEQ ID NO: 1763307 - RNA, 20 nt, Human
gaaccucgaguacugugggc

SEQ ID NO: 1763308 - RNA, 22 nt, Human
gaaccucgaguacugugggcaa

SEQ ID NO: 1763309 - RNA, 15 nt, Human
gaaccuccccagccu

SEQ ID NO: 1763310 - RNA, 16 nt, Human
gaaccuccccagccug

SEQ ID NO: 1763311 - RNA, 17 nt, Human
gaaccuccccagccugc

SEQ ID NO: 1763312 - RNA, 18 nt, Human
gaaccuccccagccugcg

SEQ ID NO: 1763313 - RNA, 22 nt, Human
gaaccuccccagccugcgccug

SEQ ID NO: 1763314 - RNA, 13 nt, Human
gaaccuccucugu

SEQ ID NO: 1763315 - RNA, 14 nt, Human
gaaccuccucugug

SEQ ID NO: 1763316 - RNA, 15 nt, Human
gaaccuccucuguga

SEQ ID NO: 1763317 - RNA, 16 nt, Human
gaaccuccucugugaa

SEQ ID NO: 1763318 - RNA, 20 nt, Human
gaacuaccuugguuccccca

SEQ ID NO: 1763319 - RNA, 19 nt, Human
gaacuaccuugguuccccc

SEQ ID NO: 1763320 - RNA, 21 nt, Human
gaacgaaccuuggccugggcc

SEQ ID NO: 1763321 - RNA, 22 nt, Human
gaacgaaccuuggccugggccg

SEQ ID NO: 1763322 - RNA, 14 nt, Human
gaagagcccagucu

SEQ ID NO: 1763323 - RNA, 16 nt, Human
gaagagcccagucugu

SEQ ID NO: 1763324 - RNA, 17 nt, Human
gaagagcccagucuguu

SEQ ID NO: 1763325 - RNA, 17 nt, Human
gaagcauuuacuuugug

SEQ ID NO: 1763326 - RNA, 18 nt, Human
gaagcauuuacuuugugu

SEQ ID NO: 1763327 - RNA, 23 nt, Human
gaagaguaagucaaccugccuga

SEQ ID NO: 1763328 - RNA, 12 nt, Human
gaaguuugaaug

SEQ ID NO: 1763329 - RNA, 18 nt, Human
gaagucauaccaaugaaa

SEQ ID NO: 1763330 - RNA, 13 nt, Human
gaaguaggaagua

SEQ ID NO: 1763331 - RNA, 17 nt, Human
gaaguuugaauguuaaa

SEQ ID NO: 1763332 - RNA, 16 nt, Human
gaaguuugaauguuaa

SEQ ID NO: 1763333 - RNA, 14 nt, Human
gaaguuugaauguu

SEQ ID NO: 1763334 - RNA, 13 nt, Human
gaaguuugaaugu

SEQ ID NO: 1763335 - RNA, 20 nt, Human
gaaguuugaauguuaaauaa

SEQ ID NO: 1763336 - RNA, 19 nt, Human
gaaguuugaauguuaaaua

SEQ ID NO: 1763337 - RNA, 21 nt, Human
gaauaacucuguggcauuauu

SEQ ID NO: 1763338 - RNA, 22 nt, Human
gaauaauuuauaguaaugaguu

SEQ ID NO: 1763339 - RNA, 16 nt, Human
gaauaggcgaucacaa

SEQ ID NO: 1763340 - RNA, 23 nt, Human
gaauagcugggacuacaggugug

SEQ ID NO: 1763341 - RNA, 22 nt, Human
gaauagcugggacuacaggugu

SEQ ID NO: 1763342 - RNA, 16 nt, Human
gaauauuugaaucuug

SEQ ID NO: 1763343 - RNA, 14 nt, Human
gaauauuugaaucu

SEQ ID NO: 1763344 - RNA, 23 nt, Human
gaauaggcgaucacaacgugcau

SEQ ID NO: 1763345 - RNA, 22 nt, Human
gaauaggcgaucacaacgugca

SEQ ID NO: 1763346 - RNA, 22 nt, Human
gaauauuugaaucuugucucaa

SEQ ID NO: 1763347 - RNA, 18 nt, Human
gaauauuugaaucuuguc

SEQ ID NO: 1763348 - RNA, 12 nt, Human
gaauuguacaga

SEQ ID NO: 1763349 - RNA, 16 nt, Human
gaauuuaauaaucugu

SEQ ID NO: 1763350 - RNA, 20 nt, Human
gaauucuugguugaggaaac

SEQ ID NO: 1763351 - RNA, 19 nt, Human
gaauucuugguugaggaaa

SEQ ID NO: 1763352 - RNA, 12 nt, Human
gaauuccaaagc

SEQ ID NO: 1763353 - RNA, 14 nt, Human
gaauuccaaagcaa

SEQ ID NO: 1763354 - RNA, 15 nt, Human
gaauuccaaagcaaa

SEQ ID NO: 1763355 - RNA, 17 nt, Human
gaauucggugugcacca

SEQ ID NO: 1763356 - RNA, 18 nt, Human
gaaugccgcgauggguca

SEQ ID NO: 1763357 - RNA, 19 nt, Human
gaaugccgcgaugggucag

SEQ ID NO: 1763358 - RNA, 14 nt, Human
gaaugcauuuuguu

SEQ ID NO: 1763359 - RNA, 17 nt, Human
gaaugccacccacaucu

SEQ ID NO: 1763360 - RNA, 11 nt, Human
gaaugcagugg

SEQ ID NO: 1763361 - RNA, 22 nt, Human
gaaugaaccacaucuugcucug

SEQ ID NO: 1763362 - RNA, 18 nt, Human
gaaugaaccacaucuugc

SEQ ID NO: 1763363 - RNA, 23 nt, Human
gaaugaaccacaucuugcucugc

SEQ ID NO: 1763364 - RNA, 15 nt, Human
gaaugaaaaaacagu

SEQ ID NO: 1763365 - RNA, 12 nt, Human
gaguucugcuga

SEQ ID NO: 1763366 - RNA, 15 nt, Human
gacuuccaugccuua

SEQ ID NO: 1763367 - RNA, 18 nt, Human
gacuuccccggagggcug

SEQ ID NO: 1763368 - RNA, 19 nt, Human
gacuuccccggagggcugc

SEQ ID NO: 1763369 - RNA, 20 nt, Human
gacuuccccggagggcugcg

SEQ ID NO: 1763370 - RNA, 23 nt, Human
gacuuccccggagggcugcggcg

SEQ ID NO: 1763371 - RNA, 19 nt, Human
gaguguuccccuuccacug

SEQ ID NO: 1763372 - RNA, 17 nt, Human
gagugugugauaaauca

SEQ ID NO: 1763373 - RNA, 21 nt, Human
gacuucaucaaacauggguuu

SEQ ID NO: 1763374 - RNA, 13 nt, Human
gauaucagaauuu

SEQ ID NO: 1763375 - RNA, 17 nt, Human
gauaucagaauuugugu

SEQ ID NO: 1763376 - RNA, 23 nt, Human
gaucacggcucacugcagccuca

SEQ ID NO: 1763377 - RNA, 20 nt, Human
gaucacggcucacugcagcc

SEQ ID NO: 1763378 - RNA, 21 nt, Human
gauaauauuuuacauacacug

SEQ ID NO: 1763379 - RNA, 17 nt, Human
gauaggucagugcaaau

SEQ ID NO: 1763380 - RNA, 16 nt, Human
gauccucccaccucag

SEQ ID NO: 1763381 - RNA, 17 nt, Human
gauccucccaccucagc

SEQ ID NO: 1763382 - RNA, 18 nt, Human
gauccucccaccucagcc

SEQ ID NO: 1763383 - RNA, 13 nt, Human
gaucauccacugu

SEQ ID NO: 1763384 - RNA, 16 nt, Human
gaucauccacugugcc

SEQ ID NO: 1763385 - RNA, 12 nt, Human
gaucccucaucu

SEQ ID NO: 1763386 - RNA, 14 nt, Human
gaucccucaucugu

SEQ ID NO: 1763387 - RNA, 18 nt, Human
gaucccucaucugucccu

SEQ ID NO: 1763388 - RNA, 23 nt, Human
gaucccucuacagagcuucccug

SEQ ID NO: 1763389 - RNA, 12 nt, Human
gauccucucugg

SEQ ID NO: 1763390 - RNA, 16 nt, Human
gauccucucuggggcu

SEQ ID NO: 1763391 - RNA, 14 nt, Human
gaugccugguggca

SEQ ID NO: 1763392 - RNA, 15 nt, Human
gaugccugguggcag

SEQ ID NO: 1763393 - RNA, 16 nt, Human
gaugccugguggcagc

SEQ ID NO: 1763394 - RNA, 14 nt, Human
gaugcaccagcccu

SEQ ID NO: 1763395 - RNA, 15 nt, Human
gaugcaccagcccuu

SEQ ID NO: 1763396 - RNA, 23 nt, Human
gaugcaccagcccuuagcaggga

SEQ ID NO: 1763397 - RNA, 15 nt, Human
gaugaaaugagguca

SEQ ID NO: 1763398 - RNA, 21 nt, Human
gaugaaaugaggucagagccu

SEQ ID NO: 1763399 - RNA, 20 nt, Human
gaugaaccagccggggccuu

SEQ ID NO: 1763400 - RNA, 21 nt, Human
gaugaauagaaguuuuaaauu

SEQ ID NO: 1763401 - RNA, 17 nt, Human
gcaaacgcugccugccg

SEQ ID NO: 1763402 - RNA, 14 nt, Human
gcaaacgcugccug

SEQ ID NO: 1763403 - RNA, 15 nt, Human
gcaaacgcugccugc

SEQ ID NO: 1763404 - RNA, 16 nt, Human
gcaaacgcugccugcc

SEQ ID NO: 1763405 - RNA, 18 nt, Human
gcaaacgcugccugcccg

SEQ ID NO: 1763406 - RNA, 19 nt, Human
gcaaacccaucaacaaaaa

SEQ ID NO: 1763407 - RNA, 15 nt, Human
gcaaacccagacggc

SEQ ID NO: 1763408 - RNA, 12 nt, Human
gcaaaguguuuu

SEQ ID NO: 1763409 - RNA, 14 nt, Human
gcaaaguguuuugu

SEQ ID NO: 1763410 - RNA, 17 nt, Human
gcaaaguguuuuguacc

SEQ ID NO: 1763411 - RNA, 18 nt, Human
gcaaaguguuuuguacca

SEQ ID NO: 1763412 - RNA, 20 nt, Human
gcaagcaauccuagguaggg

SEQ ID NO: 1763413 - RNA, 15 nt, Human
gcaagcaccuccugc

SEQ ID NO: 1763414 - RNA, 16 nt, Human
gcaagcaccuccugcc

SEQ ID NO: 1763415 - RNA, 18 nt, Human
gcaagcaccuccugccuc

SEQ ID NO: 1763416 - RNA, 20 nt, Human
gcaagcaccuccugccucga

SEQ ID NO: 1763417 - RNA, 22 nt, Human
gcaagcauguaacuuauauuaa

SEQ ID NO: 1763418 - RNA, 18 nt, Human
gcaagguccggcccaucc

SEQ ID NO: 1763419 - RNA, 15 nt, Human
gauucccaagcucug

SEQ ID NO: 1763420 - RNA, 20 nt, Human
gauucaguguuaaaugugau

SEQ ID NO: 1763421 - RNA, 13 nt, Human
gauuacaagcgug

SEQ ID NO: 1763422 - RNA, 21 nt, Human
gauuacaagcgugagccacug

SEQ ID NO: 1763423 - RNA, 14 nt, Human
gauguucugggaca

SEQ ID NO: 1763424 - RNA, 13 nt, Human
gauguuucauuuu

SEQ ID NO: 1763425 - RNA, 13 nt, Human
gauguuugcccaa

SEQ ID NO: 1763426 - RNA, 14 nt, Human
gauguuugcccaaa

SEQ ID NO: 1763427 - RNA, 18 nt, Human
gauguuugcccaaaauuu

SEQ ID NO: 1763428 - RNA, 21 nt, Human
gauguucucuaucauuuaaua

SEQ ID NO: 1763429 - RNA, 19 nt, Human
gauguucucuaucauuuaa

SEQ ID NO: 1763430 - RNA, 15 nt, Human
gauguucucuaucau

SEQ ID NO: 1763431 - RNA, 19 nt, Human
gauguucuaagucuuucca

SEQ ID NO: 1763432 - RNA, 14 nt, Human
gaugcgcagugccu

SEQ ID NO: 1763433 - RNA, 23 nt, Human
gaugcgcauucuaaccuggaggu

SEQ ID NO: 1763434 - RNA, 17 nt, Human
gaugccugguggcagcu

SEQ ID NO: 1763435 - RNA, 22 nt, Human
gaugcagugcucgcuguugcug

SEQ ID NO: 1763436 - RNA, 17 nt, Human
gauugcaacaggcuggg

SEQ ID NO: 1763437 - RNA, 18 nt, Human
gauugcaacaggcugggc

SEQ ID NO: 1763438 - RNA, 16 nt, Human
gauugcugccccauca

SEQ ID NO: 1763439 - RNA, 20 nt, Human
gauugcugccccaucagugc

SEQ ID NO: 1763440 - RNA, 21 nt, Human
gauugcugccccaucagugcu

SEQ ID NO: 1763441 - RNA, 16 nt, Human
gauucccaagcucugc

SEQ ID NO: 1763442 - RNA, 17 nt, Human
gauucccaagcucugcu

SEQ ID NO: 1763443 - RNA, 18 nt, Human
gauucccaagcucugcuc

SEQ ID NO: 1763444 - RNA, 18 nt, Human
gauuccaaaaagcacaua

SEQ ID NO: 1763445 - RNA, 16 nt, Human
gauugcaacaggcugg

SEQ ID NO: 1763446 - RNA, 23 nt, Human
gauucuuuuguauguaacaauug

SEQ ID NO: 1763447 - RNA, 22 nt, Human
gauuucuuuuguaauaaacuau

SEQ ID NO: 1763448 - RNA, 23 nt, Human
gauuucuuuuguaauaaacuauu

SEQ ID NO: 1763449 - RNA, 19 nt, Human
gcagccucaaccuccuggg

SEQ ID NO: 1763450 - RNA, 20 nt, Human
gcagccucaaccuccugggc

SEQ ID NO: 1763451 - RNA, 12 nt, Human
gcagcagggcua

SEQ ID NO: 1763452 - RNA, 17 nt, Human
gcagcagggcuacccug

SEQ ID NO: 1763453 - RNA, 19 nt, Human
gcagcagggcuacccugag

SEQ ID NO: 1763454 - RNA, 20 nt, Human
gcagcagggcuacccugagc

SEQ ID NO: 1763455 - RNA, 18 nt, Human
gcagcagguagccugcug

SEQ ID NO: 1763456 - RNA, 19 nt, Human
gcagcagguagccugcugg

SEQ ID NO: 1763457 - RNA, 23 nt, Human
gcagccugcgccaccgcccagag

SEQ ID NO: 1763458 - RNA, 21 nt, Human
gcagccucaaccuccugggcu

SEQ ID NO: 1763459 - RNA, 22 nt, Human
gcagccucaaccuccugggcua

SEQ ID NO: 1763460 - RNA, 16 nt, Human
gcaggagcacacccag

SEQ ID NO: 1763461 - RNA, 17 nt, Human
gcaggagcacacccagc

SEQ ID NO: 1763462 - RNA, 20 nt, Human
gcaggagcacacccagcccc

SEQ ID NO: 1763463 - RNA, 12 nt, Human
gcaggaccucug

SEQ ID NO: 1763464 - RNA, 20 nt, Human
gcaggaccuucgggcugugc

SEQ ID NO: 1763465 - RNA, 20 nt, Human
gcaggaccugccuguagccc

SEQ ID NO: 1763466 - RNA, 20 nt, Human
gcaggaccucugaaacccug

SEQ ID NO: 1763467 - RNA, 14 nt, Human
gcaggaccugccug

SEQ ID NO: 1763468 - RNA, 15 nt, Human
gcaggaccugccugu

SEQ ID NO: 1763469 - RNA, 16 nt, Human
gcaggaccugccugua

SEQ ID NO: 1763470 - RNA, 19 nt, Human
gcagagaaugaaagggccc

SEQ ID NO: 1763471 - RNA, 20 nt, Human
gcagagaaugaaagggccca

SEQ ID NO: 1763472 - RNA, 21 nt, Human
gcagagaaugaaagggcccag

SEQ ID NO: 1763473 - RNA, 22 nt, Human
gcagagaaugaaagggcccaga

SEQ ID NO: 1763474 - RNA, 23 nt, Human
gcagagaaugaaagggcccagag

SEQ ID NO: 1763475 - RNA, 14 nt, Human
gcagaguccuggag

SEQ ID NO: 1763476 - RNA, 17 nt, Human
gcagcacccuauaaauc

SEQ ID NO: 1763477 - RNA, 19 nt, Human
gcagcacccuauaaaucaa

SEQ ID NO: 1763478 - RNA, 14 nt, Human
gcacccggccccug

SEQ ID NO: 1763479 - RNA, 15 nt, Human
gcacccggccccugc

SEQ ID NO: 1763480 - RNA, 17 nt, Human
gcacccggccccugcug

SEQ ID NO: 1763481 - RNA, 14 nt, Human
gcaccuccugccuc

SEQ ID NO: 1763482 - RNA, 15 nt, Human
gcaccuccugccucg

SEQ ID NO: 1763483 - RNA, 22 nt, Human
gcacaugucuuaaugaaguuug

SEQ ID NO: 1763484 - RNA, 21 nt, Human
gcacaugucuuaaugaaguuu

SEQ ID NO: 1763485 - RNA, 20 nt, Human
gcacaugucuuaaugaaguu

SEQ ID NO: 1763486 - RNA, 17 nt, Human
gcacaugucuuaaugaa

SEQ ID NO: 1763487 - RNA, 15 nt, Human
gcacaugucuuaaug

SEQ ID NO: 1763488 - RNA, 13 nt, Human
gcacaugucuuaa

SEQ ID NO: 1763489 - RNA, 16 nt, Human
gcacagcuucauuucc

SEQ ID NO: 1763490 - RNA, 24 nt, Human
gcacuagacugguggcaggggcuu

SEQ ID NO: 1763491 - RNA, 19 nt, Human
gcacuaaggugugcucuga

SEQ ID NO: 1763492 - RNA, 18 nt, Human
gcacuaaggugugcucug

SEQ ID NO: 1763493 - RNA, 21 nt, Human
gcacuaccacuccugccaagg

SEQ ID NO: 1763494 - RNA, 17 nt, Human
gcacuaaggugugcucu

SEQ ID NO: 1763495 - RNA, 18 nt, Human
gcacccggccccugcugg

SEQ ID NO: 1763496 - RNA, 21 nt, Human
gcagugcucgcuguugcugaa

SEQ ID NO: 1763497 - RNA, 19 nt, Human
gcagugcucgcuguugcug

SEQ ID NO: 1763498 - RNA, 18 nt, Human
gcagugcucgcuguugcu

SEQ ID NO: 1763499 - RNA, 17 nt, Human
gcagugcucgcuguugc

SEQ ID NO: 1763500 - RNA, 16 nt, Human
gcagugggagcugccu

SEQ ID NO: 1763501 - RNA, 20 nt, Human
gcaggugcuggagcacuggg

SEQ ID NO: 1763502 - RNA, 21 nt, Human
gcaggugcuggagcacugggc

SEQ ID NO: 1763503 - RNA, 16 nt, Human
gcaggugcuggagcac

SEQ ID NO: 1763504 - RNA, 18 nt, Human
gcaggugcuggagcacug

SEQ ID NO: 1763505 - RNA, 19 nt, Human
gcaggugcuggagcacugg

SEQ ID NO: 1763506 - RNA, 17 nt, Human
gcagguggggagacugg

SEQ ID NO: 1763507 - RNA, 21 nt, Human
gcagguggggagacugggcug

SEQ ID NO: 1763508 - RNA, 13 nt, Human
gcagugccuugca

SEQ ID NO: 1763509 - RNA, 17 nt, Human
gcagggcuacccugagc

SEQ ID NO: 1763510 - RNA, 20 nt, Human
gcagggcuacccugagcuga

SEQ ID NO: 1763511 - RNA, 14 nt, Human
gcagggcucagcgg

SEQ ID NO: 1763512 - RNA, 21 nt, Human
gcagggcuacccugagcugag

SEQ ID NO: 1763513 - RNA, 22 nt, Human
gcagggcuacccugagcugagg

SEQ ID NO: 1763514 - RNA, 12 nt, Human
gcagggcucagc

SEQ ID NO: 1763515 - RNA, 23 nt, Human
gcagggcuacccugagcugaggc

SEQ ID NO: 1763516 - RNA, 17 nt, Human
gcagugggagcugccug

SEQ ID NO: 1763517 - RNA, 18 nt, Human
gcagugggagcugccugu

SEQ ID NO: 1763518 - RNA, 13 nt, Human
gcagugugccccc

SEQ ID NO: 1763519 - RNA, 14 nt, Human
gcagugugcccccc

SEQ ID NO: 1763520 - RNA, 22 nt, Human
gcagugugccccccagccccgg

SEQ ID NO: 1763521 - RNA, 21 nt, Human
gcagugugaggccagggcaga

SEQ ID NO: 1763522 - RNA, 19 nt, Human
gcagugugaggccagggca

SEQ ID NO: 1763523 - RNA, 18 nt, Human
gcauagcccauguuaagu

SEQ ID NO: 1763524 - RNA, 23 nt, Human
gcaugcacuguucccccugugca

SEQ ID NO: 1763525 - RNA, 16 nt, Human
gcaugcacuguucccc

SEQ ID NO: 1763526 - RNA, 17 nt, Human
gcaugcacuguuccccc

SEQ ID NO: 1763527 - RNA, 21 nt, Human
gcaugcacuguucccccugug

SEQ ID NO: 1763528 - RNA, 22 nt, Human
gcaugcacuguucccccugugc

SEQ ID NO: 1763529 - RNA, 12 nt, Human
gcaucaagccac

SEQ ID NO: 1763530 - RNA, 14 nt, Human
gcauugccaagggc

SEQ ID NO: 1763531 - RNA, 17 nt, Human
gcauucuaaccuggagg

SEQ ID NO: 1763532 - RNA, 16 nt, Human
gcauugccaagggcuu

SEQ ID NO: 1763533 - RNA, 16 nt, Human
gcauugcucuggaucu

SEQ ID NO: 1763534 - RNA, 16 nt, Human
gcauugcuggacucug

SEQ ID NO: 1763535 - RNA, 16 nt, Human
gcauuuuguuugguau

SEQ ID NO: 1763536 - RNA, 19 nt, Human
gccagagggagugacagag

SEQ ID NO: 1763537 - RNA, 20 nt, Human
gccagagggagugacagagg

SEQ ID NO: 1763538 - RNA, 12 nt, Human
gccagcguccuc

SEQ ID NO: 1763539 - RNA, 13 nt, Human
gccagcguccucc

SEQ ID NO: 1763540 - RNA, 19 nt, Human
gccagcguccuccucugug

SEQ ID NO: 1763541 - RNA, 22 nt, Human
gccagcguccuccucugugacc

SEQ ID NO: 1763542 - RNA, 14 nt, Human
gccagcugcucccc

SEQ ID NO: 1763543 - RNA, 15 nt, Human
gccagcugcucccca

SEQ ID NO: 1763544 - RNA, 16 nt, Human
gccagcugcuccccag

SEQ ID NO: 1763545 - RNA, 13 nt, Human
gccagcucuguau

SEQ ID NO: 1763546 - RNA, 13 nt, Human
gccagcugcuccc

SEQ ID NO: 1763547 - RNA, 18 nt, Human
gccagagggagugacaga

SEQ ID NO: 1763548 - RNA, 19 nt, Human
gccacugcaccgggccaca

SEQ ID NO: 1763549 - RNA, 17 nt, Human
gccacugcaccgggcca

SEQ ID NO: 1763550 - RNA, 18 nt, Human
gccacugcaccgggccac

SEQ ID NO: 1763551 - RNA, 14 nt, Human
gccacggccaggcc

SEQ ID NO: 1763552 - RNA, 15 nt, Human
gccacggccaggcca

SEQ ID NO: 1763553 - RNA, 19 nt, Human
gccaaagggaaauaucauu

SEQ ID NO: 1763554 - RNA, 14 nt, Human
gccaaauagcaaag

SEQ ID NO: 1763555 - RNA, 15 nt, Human
gccaaauagcaaaga

SEQ ID NO: 1763556 - RNA, 13 nt, Human
gccaaaggcuggc

SEQ ID NO: 1763557 - RNA, 16 nt, Human
gccacggccaggccag

SEQ ID NO: 1763558 - RNA, 23 nt, Human
gccacguguuugugcuguggugu

SEQ ID NO: 1763559 - RNA, 14 nt, Human
gccagggcugcccc

SEQ ID NO: 1763560 - RNA, 15 nt, Human
gccagggcugccccu

SEQ ID NO: 1763561 - RNA, 16 nt, Human
gccagggcugccccua

SEQ ID NO: 1763562 - RNA, 11 nt, Human
gccagggcugc

SEQ ID NO: 1763563 - RNA, 15 nt, Human
gccaguccugcuacc

SEQ ID NO: 1763564 - RNA, 22 nt, Human
gccaguccugcuaccucccuug

SEQ ID NO: 1763565 - RNA, 19 nt, Human
gccauccagguucagcuug

SEQ ID NO: 1763566 - RNA, 20 nt, Human
gccauccagguucagcuugu

SEQ ID NO: 1763567 - RNA, 12 nt, Human
gccauugugaac

SEQ ID NO: 1763568 - RNA, 17 nt, Human
gccauugugaaccaaug

SEQ ID NO: 1763569 - RNA, 19 nt, Human
gccauugugaaccaaugca

SEQ ID NO: 1763570 - RNA, 19 nt, Human
gcccacaggaucagucuga

SEQ ID NO: 1763571 - RNA, 13 nt, Human
gcccacaggauca

SEQ ID NO: 1763572 - RNA, 18 nt, Human
gcccacaggaucagucug

SEQ ID NO: 1763573 - RNA, 23 nt, Human
gcccacaaaggcaaaggguccag

SEQ ID NO: 1763574 - RNA, 22 nt, Human
gcccacaaucccuuucuaagga

SEQ ID NO: 1763575 - RNA, 14 nt, Human
gcccaucucaggac

SEQ ID NO: 1763576 - RNA, 12 nt, Human
gccccagcccag

SEQ ID NO: 1763577 - RNA, 13 nt, Human
gccccagcccaga

SEQ ID NO: 1763578 - RNA, 14 nt, Human
gccccagcccagau

SEQ ID NO: 1763579 - RNA, 11 nt, Human
gccccagccug

SEQ ID NO: 1763580 - RNA, 12 nt, Human
gccccagccugc

SEQ ID NO: 1763581 - RNA, 13 nt, Human
gccccagccugcu

SEQ ID NO: 1763582 - RNA, 14 nt, Human
gccccagccugcua

SEQ ID NO: 1763583 - RNA, 15 nt, Human
gccccagccugcuag

SEQ ID NO: 1763584 - RNA, 17 nt, Human
gccccagccugcuagcu

SEQ ID NO: 1763585 - RNA, 15 nt, Human
gccccaggaaaggcc

SEQ ID NO: 1763586 - RNA, 22 nt, Human
gccccaggaaaggcccagccac

SEQ ID NO: 1763587 - RNA, 22 nt, Human
gccccagccugcuagcuagcuc

SEQ ID NO: 1763588 - RNA, 16 nt, Human
gccccagugcccacag

SEQ ID NO: 1763589 - RNA, 17 nt, Human
gccccagugcccacagg

SEQ ID NO: 1763590 - RNA, 21 nt, Human
gccccagugcccacaggauca

SEQ ID NO: 1763591 - RNA, 12 nt, Human
gccccaucuccc

SEQ ID NO: 1763592 - RNA, 17 nt, Human
gccccaucuccccucag

SEQ ID NO: 1763593 - RNA, 18 nt, Human
gccccaucuccccucagc

SEQ ID NO: 1763594 - RNA, 19 nt, Human
gccccaucuccccucagcu

SEQ ID NO: 1763595 - RNA, 21 nt, Human
gccccaucuccccucagcucg

SEQ ID NO: 1763596 - RNA, 20 nt, Human
gccccaucuccccucagcuc

SEQ ID NO: 1763597 - RNA, 17 nt, Human
gccccauucugccugcc

SEQ ID NO: 1763598 - RNA, 18 nt, Human
gccccauucugccugccc

SEQ ID NO: 1763599 - RNA, 20 nt, Human
gccccauucugccugcccag

SEQ ID NO: 1763600 - RNA, 21 nt, Human
gccccauucugccugcccagg

SEQ ID NO: 1763601 - RNA, 18 nt, Human
gcccauccccaggcaccu

SEQ ID NO: 1763602 - RNA, 14 nt, Human
gcccagucuguuga

SEQ ID NO: 1763603 - RNA, 15 nt, Human
gcccagucuguugag

SEQ ID NO: 1763604 - RNA, 22 nt, Human
gcccagucuggaaugcaguggu

SEQ ID NO: 1763605 - RNA, 21 nt, Human
gcccaggugaguccuagagcu

SEQ ID NO: 1763606 - RNA, 16 nt, Human
gcccaggcuggcgugc

SEQ ID NO: 1763607 - RNA, 14 nt, Human
gcccaggcuggcgu

SEQ ID NO: 1763608 - RNA, 15 nt, Human
gcccaggcuggcgug

SEQ ID NO: 1763609 - RNA, 11 nt, Human
gcccaggcugg

SEQ ID NO: 1763610 - RNA, 13 nt, Human
gcccagcucugaa

SEQ ID NO: 1763611 - RNA, 20 nt, Human
gcccagcuauaccugugccu

SEQ ID NO: 1763612 - RNA, 17 nt, Human
gcccgcgccacaggacc

SEQ ID NO: 1763613 - RNA, 23 nt, Human
gcccgcgccacaggacccucgcc

SEQ ID NO: 1763614 - RNA, 13 nt, Human
gcccggcuccagg

SEQ ID NO: 1763615 - RNA, 14 nt, Human
gcccggcuccaggc

SEQ ID NO: 1763616 - RNA, 15 nt, Human
gcccggcuccaggcu

SEQ ID NO: 1763617 - RNA, 22 nt, Human
gcccuccccuccggacuggugc

SEQ ID NO: 1763618 - RNA, 23 nt, Human
gcccuccccuccggacuggugcc

SEQ ID NO: 1763619 - RNA, 18 nt, Human
gccccuagccgguuccug

SEQ ID NO: 1763620 - RNA, 19 nt, Human
gccccuagccgguuccugu

SEQ ID NO: 1763621 - RNA, 13 nt, Human
gccccuacugcug

SEQ ID NO: 1763622 - RNA, 14 nt, Human
gccccuacugcugu

SEQ ID NO: 1763623 - RNA, 15 nt, Human
gccccuacugcugug

SEQ ID NO: 1763624 - RNA, 19 nt, Human
gccccuacugcugugaacc

SEQ ID NO: 1763625 - RNA, 15 nt, Human
gccccuaaucucugu

SEQ ID NO: 1763626 - RNA, 17 nt, Human
gccccuaaucucuguag

SEQ ID NO: 1763627 - RNA, 19 nt, Human
gccccuaaucucuguagga

SEQ ID NO: 1763628 - RNA, 20 nt, Human
gccccuagccgguuccuguc

SEQ ID NO: 1763629 - RNA, 22 nt, Human
gccccauucugccugcccaggc

SEQ ID NO: 1763630 - RNA, 23 nt, Human
gccccauucugccugcccaggcc

SEQ ID NO: 1763631 - RNA, 23 nt, Human
gccccgaggccuucucugaagga

SEQ ID NO: 1763632 - RNA, 17 nt, Human
gccccgguggcugggca

SEQ ID NO: 1763633 - RNA, 18 nt, Human
gccccgguggcugggcag

SEQ ID NO: 1763634 - RNA, 19 nt, Human
gccccgguggcugggcaga

SEQ ID NO: 1763635 - RNA, 17 nt, Human
gccgauucaccugagca

SEQ ID NO: 1763636 - RNA, 17 nt, Human
gccgauuucuguaaacu

SEQ ID NO: 1763637 - RNA, 14 nt, Human
gccgggucugccuc

SEQ ID NO: 1763638 - RNA, 21 nt, Human
gccgggucugccucuucuggg

SEQ ID NO: 1763639 - RNA, 22 nt, Human
gccucaagugauucuccugccu

SEQ ID NO: 1763640 - RNA, 24 nt, Human
gccucaagugauucuccugccuca

SEQ ID NO: 1763641 - RNA, 18 nt, Human
gccucagcauccuggcac

SEQ ID NO: 1763642 - RNA, 21 nt, Human
gccucagcauccuggcacccg

SEQ ID NO: 1763643 - RNA, 13 nt, Human
gccuauuugugug

SEQ ID NO: 1763644 - RNA, 23 nt, Human
gccggggccuuaucgggcuccag

SEQ ID NO: 1763645 - RNA, 12 nt, Human
gccucagccucc

SEQ ID NO: 1763646 - RNA, 14 nt, Human
gccucagccuccca

SEQ ID NO: 1763647 - RNA, 22 nt, Human
gccucagccucccaaagugcug

SEQ ID NO: 1763648 - RNA, 18 nt, Human
gccucccgaauagcuggg

SEQ ID NO: 1763649 - RNA, 19 nt, Human
gccucccgaauagcuggga

SEQ ID NO: 1763650 - RNA, 21 nt, Human
gccucccgaguagcugggacu

SEQ ID NO: 1763651 - RNA, 23 nt, Human
gccucccgaguagcugggacuac

SEQ ID NO: 1763652 - RNA, 20 nt, Human
gccucccgaauagcugggac

SEQ ID NO: 1763653 - RNA, 11 nt, Human
gccugcccagg

SEQ ID NO: 1763654 - RNA, 12 nt, Human
gccugcccaggc

SEQ ID NO: 1763655 - RNA, 17 nt, Human
gccugcuggaagcccag

SEQ ID NO: 1763656 - RNA, 18 nt, Human
gccugcuggaagcccagc

SEQ ID NO: 1763657 - RNA, 19 nt, Human
gccugcuggaagcccagcc

SEQ ID NO: 1763658 - RNA, 13 nt, Human
gccugcuggaggc

SEQ ID NO: 1763659 - RNA, 15 nt, Human
gccugcuggaggccu

SEQ ID NO: 1763660 - RNA, 17 nt, Human
gccugcuggaggccuca

SEQ ID NO: 1763661 - RNA, 18 nt, Human
gccugcuggaggccucag

SEQ ID NO: 1763662 - RNA, 19 nt, Human
gccugcuggaggccucagg

SEQ ID NO: 1763663 - RNA, 23 nt, Human
gccugcuggaggccucaggugcu

SEQ ID NO: 1763664 - RNA, 14 nt, Human
gccugcaggaccug

SEQ ID NO: 1763665 - RNA, 16 nt, Human
gccugcaggaccugcc

SEQ ID NO: 1763666 - RNA, 17 nt, Human
gccugcaggaccugccu

SEQ ID NO: 1763667 - RNA, 18 nt, Human
gccugcaggaccugccug

SEQ ID NO: 1763668 - RNA, 19 nt, Human
gccugcaggaccugccugu

SEQ ID NO: 1763669 - RNA, 20 nt, Human
gccugcaggaccugccugua

SEQ ID NO: 1763670 - RNA, 21 nt, Human
gccugcaggaccugccuguag

SEQ ID NO: 1763671 - RNA, 14 nt, Human
gccugagccuggcc

SEQ ID NO: 1763672 - RNA, 13 nt, Human
gccugcagcagga

SEQ ID NO: 1763673 - RNA, 14 nt, Human
gccugaaaggagcc

SEQ ID NO: 1763674 - RNA, 17 nt, Human
gccugaaaggagcccuu

SEQ ID NO: 1763675 - RNA, 23 nt, Human
gccugaaaggagcccuuaucugu

SEQ ID NO: 1763676 - RNA, 15 nt, Human
gccugaacagaagcu

SEQ ID NO: 1763677 - RNA, 20 nt, Human
gccugaacagaagcucuuac

SEQ ID NO: 1763678 - RNA, 15 nt, Human
gccugaagucacaca

SEQ ID NO: 1763679 - RNA, 15 nt, Human
gccugaagccagcug

SEQ ID NO: 1763680 - RNA, 16 nt, Human
gccugaagccagcugc

SEQ ID NO: 1763681 - RNA, 20 nt, Human
gccugagagucagcucucug

SEQ ID NO: 1763682 - RNA, 16 nt, Human
gccucugacacacagc

SEQ ID NO: 1763683 - RNA, 15 nt, Human
gccucugacacacag

SEQ ID NO: 1763684 - RNA, 20 nt, Human
gcgccuacaggagugagcac

SEQ ID NO: 1763685 - RNA, 21 nt, Human
gcgccuacaggagugagcacu

SEQ ID NO: 1763686 - RNA, 23 nt, Human
gcgcugccccaucuccccucagc

SEQ ID NO: 1763687 - RNA, 13 nt, Human
gcgccaguccugc

SEQ ID NO: 1763688 - RNA, 14 nt, Human
gcgccaguccugcu

SEQ ID NO: 1763689 - RNA, 22 nt, Human
gcgacguuagucgugagcucuu

SEQ ID NO: 1763690 - RNA, 21 nt, Human
gcgacguuagucgugagcucu

SEQ ID NO: 1763691 - RNA, 17 nt, Human
gcgacuaaacuagauuu

SEQ ID NO: 1763692 - RNA, 19 nt, Human
gcggaaugaaccacaucuu

SEQ ID NO: 1763693 - RNA, 19 nt, Human
gcggacagccacggccagg

SEQ ID NO: 1763694 - RNA, 23 nt, Human
gcggacagccacggccaggccag

SEQ ID NO: 1763695 - RNA, 19 nt, Human
gcggggacagcuccuucug

SEQ ID NO: 1763696 - RNA, 23 nt, Human
gcggggacagcuccuucuguccu

SEQ ID NO: 1763697 - RNA, 23 nt, Human
gcgguccacccaggagccccgag

SEQ ID NO: 1763698 - RNA, 14 nt, Human
gcguccuccucugu

SEQ ID NO: 1763699 - RNA, 15 nt, Human
gcguccuccucugug

SEQ ID NO: 1763700 - RNA, 16 nt, Human
gcguccuccucuguga

SEQ ID NO: 1763701 - RNA, 17 nt, Human
gcuacacccuuuuccag

SEQ ID NO: 1763702 - RNA, 19 nt, Human
gcuacacccuuuuccagcu

SEQ ID NO: 1763703 - RNA, 14 nt, Human
gcgugagccacugc

SEQ ID NO: 1763704 - RNA, 16 nt, Human
gcgugagccacugcac

SEQ ID NO: 1763705 - RNA, 15 nt, Human
gcgugagccacugca

SEQ ID NO: 1763706 - RNA, 21 nt, Human
gcuaccaacuuguauccaggc

SEQ ID NO: 1763707 - RNA, 12 nt, Human
gcuacccugagc

SEQ ID NO: 1763708 - RNA, 14 nt, Human
gcuacccugagcug

SEQ ID NO: 1763709 - RNA, 16 nt, Human
gcuacccugagcugag

SEQ ID NO: 1763710 - RNA, 20 nt, Human
gcuacccugagcugaggcag

SEQ ID NO: 1763711 - RNA, 19 nt, Human
gcuacccugagcugaggca

SEQ ID NO: 1763712 - RNA, 20 nt, Human
gccuuagaagucacacagua

SEQ ID NO: 1763713 - RNA, 19 nt, Human
gccuuauuagagugucuuu

SEQ ID NO: 1763714 - RNA, 12 nt, Human
gccuuagcuuca

SEQ ID NO: 1763715 - RNA, 14 nt, Human
gccuuagcuucagg

SEQ ID NO: 1763716 - RNA, 15 nt, Human
gccuuagcuucagga

SEQ ID NO: 1763717 - RNA, 16 nt, Human
gccuuagcuucaggaa

SEQ ID NO: 1763718 - RNA, 17 nt, Human
gccuuagcuucaggaac

SEQ ID NO: 1763719 - RNA, 18 nt, Human
gccuuagcuucaggaacc

SEQ ID NO: 1763720 - RNA, 19 nt, Human
gccuuagcuucaggaaccu

SEQ ID NO: 1763721 - RNA, 15 nt, Human
gccugguggcagcug

SEQ ID NO: 1763722 - RNA, 16 nt, Human
gccugguggcagcugc

SEQ ID NO: 1763723 - RNA, 17 nt, Human
gccugguggcagcugcg

SEQ ID NO: 1763724 - RNA, 22 nt, Human
gccuucacacagauagaccuuu

SEQ ID NO: 1763725 - RNA, 21 nt, Human
gccuuuaaaauuuuuuuagaa

SEQ ID NO: 1763726 - RNA, 14 nt, Human
gccuuuagaaaaua

SEQ ID NO: 1763727 - RNA, 13 nt, Human
gccuuuauugugu

SEQ ID NO: 1763728 - RNA, 20 nt, Human
gccuuuauuguguuugucau

SEQ ID NO: 1763729 - RNA, 14 nt, Human
gccuuuauuguguu

SEQ ID NO: 1763730 - RNA, 23 nt, Human
gccuuuauuguguuugucauuag

SEQ ID NO: 1763731 - RNA, 22 nt, Human
gccuuuauuguguuugucauua

SEQ ID NO: 1763732 - RNA, 21 nt, Human
ggucucacuauguugcccagg

SEQ ID NO: 1763733 - RNA, 22 nt, Human
ggucucacucugucgcccaguc

SEQ ID NO: 1763734 - RNA, 23 nt, Human
ggucucacucugucgcccagucu

SEQ ID NO: 1763735 - RNA, 14 nt, Human
ggucugacccacug

SEQ ID NO: 1763736 - RNA, 23 nt, Human
ggucugccucuucugggagggca

SEQ ID NO: 1763737 - RNA, 21 nt, Human
ggugacgggacucaggcggga

SEQ ID NO: 1763738 - RNA, 15 nt, Human
ggugcugccauccag

SEQ ID NO: 1763739 - RNA, 21 nt, Human
ggugcugccauccagguucag

SEQ ID NO: 1763740 - RNA, 19 nt, Human
gguggcagugggagcugcc

SEQ ID NO: 1763741 - RNA, 22 nt, Human
gguggcagugggagcugccugu

SEQ ID NO: 1763742 - RNA, 15 nt, Human
ggugcgaucuggguu

SEQ ID NO: 1763743 - RNA, 23 nt, Human
ggugcuacacccuuuuccagcug

SEQ ID NO: 1763744 - RNA, 15 nt, Human
ggugcuacgccugca

SEQ ID NO: 1763745 - RNA, 22 nt, Human
ggugcuacacccuuuuccagcu

SEQ ID NO: 1763746 - RNA, 16 nt, Human
ggugagaggggaacag

SEQ ID NO: 1763747 - RNA, 16 nt, Human
gguggugaccucugcc

SEQ ID NO: 1763748 - RNA, 14 nt, Human
gguggugaccucug

SEQ ID NO: 1763749 - RNA, 15 nt, Human
gguggugaccucugc

SEQ ID NO: 1763750 - RNA, 14 nt, Human
gguggguauaaaag

SEQ ID NO: 1763751 - RNA, 10 nt, Human
ggugggucca

SEQ ID NO: 1763752 - RNA, 14 nt, Human
gguggguccauggg

SEQ ID NO: 1763753 - RNA, 11 nt, Human
gguggcugggc

SEQ ID NO: 1763754 - RNA, 12 nt, Human
gguggcugggca

SEQ ID NO: 1763755 - RNA, 13 nt, Human
gguggcugggcag

SEQ ID NO: 1763756 - RNA, 17 nt, Human
gguggguccaugggcag

SEQ ID NO: 1763757 - RNA, 20 nt, Human
gguggguccaugggcagagc

SEQ ID NO: 1763758 - RNA, 18 nt, Human
ggugggucccggcucugu

SEQ ID NO: 1763759 - RNA, 19 nt, Human
ggugggucccggcucugug

SEQ ID NO: 1763760 - RNA, 20 nt, Human
ggugggucccggcucugugg

SEQ ID NO: 1763761 - RNA, 19 nt, Human
ggugucaccugaagacuca

SEQ ID NO: 1763762 - RNA, 14 nt, Human
gguguaauggagca

SEQ ID NO: 1763763 - RNA, 21 nt, Human
gguguccagcauugcuggacu

SEQ ID NO: 1763764 - RNA, 19 nt, Human
ggugucaagagggucugag

SEQ ID NO: 1763765 - RNA, 17 nt, Human
ggugucaagagggucug

SEQ ID NO: 1763766 - RNA, 23 nt, Human
gguguagcucuuagaggaaggag

SEQ ID NO: 1763767 - RNA, 22 nt, Human
gguuagacagccaaaggcuggc

SEQ ID NO: 1763768 - RNA, 15 nt, Human
gguuaauaccagcuu

SEQ ID NO: 1763769 - RNA, 22 nt, Human
gguuaacccuucaucuuccugu

SEQ ID NO: 1763770 - RNA, 13 nt, Human
gguuaaggccuga

SEQ ID NO: 1763771 - RNA, 14 nt, Human
gguuaaggccugaa

SEQ ID NO: 1763772 - RNA, 15 nt, Human
gguguccugccuguc

SEQ ID NO: 1763773 - RNA, 18 nt, Human
gguguccugccugucugc

SEQ ID NO: 1763774 - RNA, 19 nt, Human
gguguccugccugucugcc

SEQ ID NO: 1763775 - RNA, 20 nt, Human
gguguccugccugucugccc

SEQ ID NO: 1763776 - RNA, 21 nt, Human
gguguccugccugucugcccc

SEQ ID NO: 1763777 - RNA, 20 nt, Human
gguucacgugcagcucaagg

SEQ ID NO: 1763778 - RNA, 15 nt, Human
gguucacuaaagcag

SEQ ID NO: 1763779 - RNA, 11 nt, Human
gguugaggaaa

SEQ ID NO: 1763780 - RNA, 23 nt, Human
gguauuguauuuauucaauaaag

SEQ ID NO: 1763781 - RNA, 22 nt, Human
gguauuguauuuauucaauaaa

SEQ ID NO: 1763782 - RNA, 20 nt, Human
gguauuguauuuauucaaua

SEQ ID NO: 1763783 - RNA, 19 nt, Human
gguauuguauuuauucaau

SEQ ID NO: 1763784 - RNA, 11 nt, Human
gguacccacug

SEQ ID NO: 1763785 - RNA, 16 nt, Human
gguacccacugcucug

SEQ ID NO: 1763786 - RNA, 13 nt, Human
gguacccacugcu

SEQ ID NO: 1763787 - RNA, 20 nt, Human
gguacuuguggacacagcuc

SEQ ID NO: 1763788 - RNA, 16 nt, Human
gguacuuguggacaca

SEQ ID NO: 1763789 - RNA, 17 nt, Human
gguacuuguggacacag

SEQ ID NO: 1763790 - RNA, 11 nt, Human
ggucagagccu

SEQ ID NO: 1763791 - RNA, 15 nt, Human
ggucagaaacaggac

SEQ ID NO: 1763792 - RNA, 16 nt, Human
ggucagaaacaggacc

SEQ ID NO: 1763793 - RNA, 17 nt, Human
ggucagaaacaggaccg

SEQ ID NO: 1763794 - RNA, 18 nt, Human
ggucagaaacaggaccgg

SEQ ID NO: 1763795 - RNA, 12 nt, Human
gggugaaggcug

SEQ ID NO: 1763796 - RNA, 13 nt, Human
gggugaaggcugg

SEQ ID NO: 1763797 - RNA, 14 nt, Human
gggugaaggcuggc

SEQ ID NO: 1763798 - RNA, 15 nt, Human
gggugaaggcuggca

SEQ ID NO: 1763799 - RNA, 20 nt, Human
gggucuguaaaaucuuucuu

SEQ ID NO: 1763800 - RNA, 17 nt, Human
gggucuguaaaaucuuu

SEQ ID NO: 1763801 - RNA, 16 nt, Human
gggucuguaaaaucuu

SEQ ID NO: 1763802 - RNA, 15 nt, Human
gggucuguaaaaucu

SEQ ID NO: 1763803 - RNA, 21 nt, Human
gggucuguaaaaucuuucuuu

SEQ ID NO: 1763804 - RNA, 18 nt, Human
gggugacgggacucaggc

SEQ ID NO: 1763805 - RNA, 22 nt, Human
gggugacgggacucaggcggga

SEQ ID NO: 1763806 - RNA, 15 nt, Human
gggugauggggaggg

SEQ ID NO: 1763807 - RNA, 11 nt, Human
ggguguggguu

SEQ ID NO: 1763808 - RNA, 22 nt, Human
ggguucaagcgauucuucugcu

SEQ ID NO: 1763809 - RNA, 14 nt, Human
ggguuaaggccuga

SEQ ID NO: 1763810 - RNA, 15 nt, Human
ggguuaaggccugaa

SEQ ID NO: 1763811 - RNA, 22 nt, Human
ggguuaacccuucaucuuccug

SEQ ID NO: 1763812 - RNA, 23 nt, Human
ggguucaagcgauucuucugcuu

SEQ ID NO: 1763813 - RNA, 20 nt, Human
ggguugcuguauaaguuauu

SEQ ID NO: 1763814 - RNA, 14 nt, Human
ggggagggcugcga

SEQ ID NO: 1763815 - RNA, 15 nt, Human
gggguggguauaaaa

SEQ ID NO: 1763816 - RNA, 14 nt, Human
ggggugcuuccuug

SEQ ID NO: 1763817 - RNA, 16 nt, Human
ggggugcuuccuugua

SEQ ID NO: 1763818 - RNA, 12 nt, Human
gggucugaggaa

SEQ ID NO: 1763819 - RNA, 21 nt, Human
gggucugaggaauccagaccc

SEQ ID NO: 1763820 - RNA, 14 nt, Human
gggucuguaaaauc

SEQ ID NO: 1763821 - RNA, 13 nt, Human
gggucuguaaaau

SEQ ID NO: 1763822 - RNA, 14 nt, Human
gggucucacucugu

SEQ ID NO: 1763823 - RNA, 19 nt, Human
gggguuuccuggcacugga

SEQ ID NO: 1763824 - RNA, 11 nt, Human
gggguggguca

SEQ ID NO: 1763825 - RNA, 13 nt, Human
gggcccaucucuu

SEQ ID NO: 1763826 - RNA, 13 nt, Human
gggccccccugcc

SEQ ID NO: 1763827 - RNA, 15 nt, Human
gggccccccugcccu

SEQ ID NO: 1763828 - RNA, 17 nt, Human
gggccccccugcccugu

SEQ ID NO: 1763829 - RNA, 14 nt, Human
gggcccucucuucu

SEQ ID NO: 1763830 - RNA, 21 nt, Human
gggccugggacuuccaugccu

SEQ ID NO: 1763831 - RNA, 16 nt, Human
gggcaucuugcuggcu

SEQ ID NO: 1763832 - RNA, 17 nt, Human
gggcaucuugcuggcua

SEQ ID NO: 1763833 - RNA, 17 nt, Human
gggcagucauuauccag

SEQ ID NO: 1763834 - RNA, 23 nt, Human
gggccacagagaaaguacuucuc

SEQ ID NO: 1763835 - RNA, 19 nt, Human
gggccacaugggaggcuca

SEQ ID NO: 1763836 - RNA, 16 nt, Human
gggccacagagaaagu

SEQ ID NO: 1763837 - RNA, 13 nt, Human
gggccaagcccag

SEQ ID NO: 1763838 - RNA, 15 nt, Human
gggccaaacgcugag

SEQ ID NO: 1763839 - RNA, 17 nt, Human
gggccaaacgcugagcc

SEQ ID NO: 1763840 - RNA, 18 nt, Human
gggccaaacgcugagcca

SEQ ID NO: 1763841 - RNA, 17 nt, Human
gggcccagagagggugg

SEQ ID NO: 1763842 - RNA, 22 nt, Human
gggauacuuuagaaguagaauu

SEQ ID NO: 1763843 - RNA, 14 nt, Human
gggcaauuuagaaa

SEQ ID NO: 1763844 - RNA, 18 nt, Human
gggcaauuuagaaaaaga

SEQ ID NO: 1763845 - RNA, 20 nt, Human
gggcaaggguuaaggccuga

SEQ ID NO: 1763846 - RNA, 20 nt, Human
gggcaagcuccgcaggacuu

SEQ ID NO: 1763847 - RNA, 13 nt, Human
gggauagagagag

SEQ ID NO: 1763848 - RNA, 17 nt, Human
gggacuccggcugugcu

SEQ ID NO: 1763849 - RNA, 18 nt, Human
gggacuccggcugugcug

SEQ ID NO: 1763850 - RNA, 19 nt, Human
gggacuccggcugugcugg

SEQ ID NO: 1763851 - RNA, 20 nt, Human
gggacuccggcugugcuggg

SEQ ID NO: 1763852 - RNA, 16 nt, Human
gggaggugaccccagg

SEQ ID NO: 1763853 - RNA, 18 nt, Human
gggagugacagaggcagc

SEQ ID NO: 1763854 - RNA, 11 nt, Human
gggagugagcu

SEQ ID NO: 1763855 - RNA, 14 nt, Human
gggagugagcuggu

SEQ ID NO: 1763856 - RNA, 22 nt, Human
gggcaggugcuggagcacuggg

SEQ ID NO: 1763857 - RNA, 11 nt, Human
gggcagggcug

SEQ ID NO: 1763858 - RNA, 12 nt, Human
gggcagggcugu

SEQ ID NO: 1763859 - RNA, 16 nt, Human
gggcagggcugugcuu

SEQ ID NO: 1763860 - RNA, 20 nt, Human
gggcacucagaagacacuga

SEQ ID NO: 1763861 - RNA, 12 nt, Human
gggcaccugcca

SEQ ID NO: 1763862 - RNA, 16 nt, Human
gggcacucagaagaca

SEQ ID NO: 1763863 - RNA, 19 nt, Human
gggcacucagaagacacug

SEQ ID NO: 1763864 - RNA, 23 nt, Human
gggcacaccgggcacucagaaga

SEQ ID NO: 1763865 - RNA, 12 nt, Human
ggcugcagggag

SEQ ID NO: 1763866 - RNA, 13 nt, Human
ggcugcagggagu

SEQ ID NO: 1763867 - RNA, 20 nt, Human
ggccccugcccggcugcgga

SEQ ID NO: 1763868 - RNA, 16 nt, Human
ggccccugcccggcug

SEQ ID NO: 1763869 - RNA, 17 nt, Human
ggccccugcccggcugc

SEQ ID NO: 1763870 - RNA, 16 nt, Human
ggcugagggagccugg

SEQ ID NO: 1763871 - RNA, 12 nt, Human
ggcugagggccu

SEQ ID NO: 1763872 - RNA, 13 nt, Human
ggcugagggccug

SEQ ID NO: 1763873 - RNA, 14 nt, Human
ggcugagggccugc

SEQ ID NO: 1763874 - RNA, 15 nt, Human
ggcugagggccugcu

SEQ ID NO: 1763875 - RNA, 16 nt, Human
ggcugagggccugcug

SEQ ID NO: 1763876 - RNA, 17 nt, Human
ggcugagggccugcugg

SEQ ID NO: 1763877 - RNA, 18 nt, Human
ggcugagggccugcugga

SEQ ID NO: 1763878 - RNA, 21 nt, Human
ggcugagggccugcuggaggc

SEQ ID NO: 1763879 - RNA, 24 nt, Human
ggcugcaaaggguaucaggugcug

SEQ ID NO: 1763880 - RNA, 22 nt, Human
ggcugcaaaggguaucaggugc

SEQ ID NO: 1763881 - RNA, 23 nt, Human
ggcugcaaaggguaucaggugcu

SEQ ID NO: 1763882 - RNA, 18 nt, Human
ggcugcaaaggguaucag

SEQ ID NO: 1763883 - RNA, 18 nt, Human
ggcugggcuucaguggca

SEQ ID NO: 1763884 - RNA, 13 nt, Human
ggcugggcuucag

SEQ ID NO: 1763885 - RNA, 17 nt, Human
ggcugggcuucaguggc

SEQ ID NO: 1763886 - RNA, 12 nt, Human
ggcugggcuuca

SEQ ID NO: 1763887 - RNA, 14 nt, Human
ggcuuuucucagcu

SEQ ID NO: 1763888 - RNA, 15 nt, Human
ggcuuuucucagcug

SEQ ID NO: 1763889 - RNA, 22 nt, Human
ggcuugaguuuaaauuguaaua

SEQ ID NO: 1763890 - RNA, 21 nt, Human
ggcuuuauccucuuuagaguu

SEQ ID NO: 1763891 - RNA, 20 nt, Human
ggcuuuauccucuuuagagu

SEQ ID NO: 1763892 - RNA, 18 nt, Human
ggcuuuauccucuuuaga

SEQ ID NO: 1763893 - RNA, 15 nt, Human
ggcuuuauccucuuu

SEQ ID NO: 1763894 - RNA, 14 nt, Human
ggcuuuauccucuu

SEQ ID NO: 1763895 - RNA, 17 nt, Human
gggacuacaggcaccca

SEQ ID NO: 1763896 - RNA, 16 nt, Human
gggacucaaugcacug

SEQ ID NO: 1763897 - RNA, 19 nt, Human
gcugggacuacagguguga

SEQ ID NO: 1763898 - RNA, 13 nt, Human
gcugggacuacag

SEQ ID NO: 1763899 - RNA, 18 nt, Human
gcugggacuacaggcacc

SEQ ID NO: 1763900 - RNA, 19 nt, Human
gcugggacuacaggcaccc

SEQ ID NO: 1763901 - RNA, 20 nt, Human
gcugggacuacaggcaccca

SEQ ID NO: 1763902 - RNA, 18 nt, Human
gcuggaccuugaacuggg

SEQ ID NO: 1763903 - RNA, 21 nt, Human
gcuggaccuugaacuggguac

SEQ ID NO: 1763904 - RNA, 22 nt, Human
gcuggaccuugaacuggguacu

SEQ ID NO: 1763905 - RNA, 20 nt, Human
gcuggaugagaauuugagug

SEQ ID NO: 1763906 - RNA, 15 nt, Human
gcuggaugauggucu

SEQ ID NO: 1763907 - RNA, 19 nt, Human
gcugcgguccacccaggag

SEQ ID NO: 1763908 - RNA, 17 nt, Human
gcugcgguccacccagg

SEQ ID NO: 1763909 - RNA, 18 nt, Human
gcugcgguccacccagga

SEQ ID NO: 1763910 - RNA, 18 nt, Human
gcugcgacgcuugcucug

SEQ ID NO: 1763911 - RNA, 18 nt, Human
gcugggcuucaguggcag

SEQ ID NO: 1763912 - RNA, 19 nt, Human
gcugggcuucaguggcagc

SEQ ID NO: 1763913 - RNA, 13 nt, Human
gcugggggccuca

SEQ ID NO: 1763914 - RNA, 15 nt, Human
gcuggucccacucag

SEQ ID NO: 1763915 - RNA, 19 nt, Human
gcuggucccacucagucca

SEQ ID NO: 1763916 - RNA, 19 nt, Human
gcugggggccucagugcca

SEQ ID NO: 1763917 - RNA, 20 nt, Human
gcugggggccucagugccac

SEQ ID NO: 1763918 - RNA, 17 nt, Human
gcugggcuucaguggca

SEQ ID NO: 1763919 - RNA, 23 nt, Human
gcugucuuguugcggauggaugg

SEQ ID NO: 1763920 - RNA, 15 nt, Human
gcugguucaggguug

SEQ ID NO: 1763921 - RNA, 13 nt, Human
gcuguauuuugaa

SEQ ID NO: 1763922 - RNA, 22 nt, Human
gcugguucaggguuggccccug

SEQ ID NO: 1763923 - RNA, 16 nt, Human
gcuggugucaccugaa

SEQ ID NO: 1763924 - RNA, 18 nt, Human
gcuggugucaccugaaga

SEQ ID NO: 1763925 - RNA, 20 nt, Human
gcuggucccacucaguccau

SEQ ID NO: 1763926 - RNA, 16 nt, Human
gcugguggacccaggg

SEQ ID NO: 1763927 - RNA, 21 nt, Human
gcugguggacccagggaacag

SEQ ID NO: 1763928 - RNA, 14 nt, Human
gcugguggcagagu

SEQ ID NO: 1763929 - RNA, 14 nt, Human
gcuucucucugugg

SEQ ID NO: 1763930 - RNA, 16 nt, Human
gcuucucucuguggga

SEQ ID NO: 1763931 - RNA, 18 nt, Human
gcuucuguggggccccuc

SEQ ID NO: 1763932 - RNA, 11 nt, Human
gcuucugucuc

SEQ ID NO: 1763933 - RNA, 12 nt, Human
gcuucugucucc

SEQ ID NO: 1763934 - RNA, 13 nt, Human
gcuucugucucca

SEQ ID NO: 1763935 - RNA, 15 nt, Human
gcuucugucuccagc

SEQ ID NO: 1763936 - RNA, 13 nt, Human
gcuugauacagga

SEQ ID NO: 1763937 - RNA, 15 nt, Human
gcuuuggcagugcca

SEQ ID NO: 1763938 - RNA, 16 nt, Human
gcuuuggcagugccau

SEQ ID NO: 1763939 - RNA, 19 nt, Human
gcuuuauccucuuuagagu

SEQ ID NO: 1763940 - RNA, 17 nt, Human
gcuuuauccucuuuaga

SEQ ID NO: 1763941 - RNA, 16 nt, Human
gcuuuauccucuuuag

SEQ ID NO: 1763942 - RNA, 15 nt, Human
gcuuuauccucuuua

SEQ ID NO: 1763943 - RNA, 20 nt, Human
gcuuuauccucuuuagaguu

SEQ ID NO: 1763944 - RNA, 16 nt, Human
gcuuggagcagagggg

SEQ ID NO: 1763945 - RNA, 18 nt, Human
gcuuggagcagaggggcu

SEQ ID NO: 1763946 - RNA, 13 nt, Human
ggaaaaauaaaca

SEQ ID NO: 1763947 - RNA, 17 nt, Human
ggaaaagaaagaaguua

SEQ ID NO: 1763948 - RNA, 20 nt, Human
gcuuuuaaugaaaaggaauc

SEQ ID NO: 1763949 - RNA, 20 nt, Human
ggaaaaaauaacaaugaaag

SEQ ID NO: 1763950 - RNA, 19 nt, Human
ggaagaggcuacagggcca

SEQ ID NO: 1763951 - RNA, 19 nt, Human
ggaagagugacucuccagg

SEQ ID NO: 1763952 - RNA, 20 nt, Human
ggaagagugacucuccaggg

SEQ ID NO: 1763953 - RNA, 15 nt, Human
ggaagagcccagucu

SEQ ID NO: 1763954 - RNA, 16 nt, Human
ggaagagcccagucug

SEQ ID NO: 1763955 - RNA, 20 nt, Human
ggaagagcccagucuguuga

SEQ ID NO: 1763956 - RNA, 17 nt, Human
ggaagcacagcuucauu

SEQ ID NO: 1763957 - RNA, 17 nt, Human
ggaagauuuggaagcuc

SEQ ID NO: 1763958 - RNA, 19 nt, Human
ggaagaucucugcagggcc

SEQ ID NO: 1763959 - RNA, 20 nt, Human
ggaagaucucugcagggccg

SEQ ID NO: 1763960 - RNA, 17 nt, Human
ggaacagacuggaagca

SEQ ID NO: 1763961 - RNA, 21 nt, Human
ggaaagucauuggcuuuaucc

SEQ ID NO: 1763962 - RNA, 16 nt, Human
ggaaagucauuggcuu

SEQ ID NO: 1763963 - RNA, 19 nt, Human
ggaacagacuggaagcaca

SEQ ID NO: 1763964 - RNA, 20 nt, Human
ggaacagacuggaagcacag

SEQ ID NO: 1763965 - RNA, 24 nt, Human
ggaacccuuacaguaggagcccag

SEQ ID NO: 1763966 - RNA, 21 nt, Human
ggaaccgugguaugucugcca

SEQ ID NO: 1763967 - RNA, 16 nt, Human
ggaaccguaggaccca

SEQ ID NO: 1763968 - RNA, 21 nt, Human
ggaaccguaggacccaagcag

SEQ ID NO: 1763969 - RNA, 14 nt, Human
ggaaccuccccagc

SEQ ID NO: 1763970 - RNA, 20 nt, Human
ggagcccuuaucugugcuca

SEQ ID NO: 1763971 - RNA, 22 nt, Human
ggagcccuuaucugugcucagg

SEQ ID NO: 1763972 - RNA, 15 nt, Human
ggagaugcuccuugg

SEQ ID NO: 1763973 - RNA, 9 nt, Human
ggacuggug

SEQ ID NO: 1763974 - RNA, 11 nt, Human
ggacuggugcc

SEQ ID NO: 1763975 - RNA, 14 nt, Human
ggacuggugcccuc

SEQ ID NO: 1763976 - RNA, 15 nt, Human
ggacuggugcccucc

SEQ ID NO: 1763977 - RNA, 17 nt, Human
ggacuggugcccuccuc

SEQ ID NO: 1763978 - RNA, 21 nt, Human
ggacuggugcccuccucacuc

SEQ ID NO: 1763979 - RNA, 21 nt, Human
ggagaccuggacacaggccug

SEQ ID NO: 1763980 - RNA, 17 nt, Human
ggacucucagucucuga

SEQ ID NO: 1763981 - RNA, 18 nt, Human
ggacucucagucucugag

SEQ ID NO: 1763982 - RNA, 20 nt, Human
ggacucucagucucugagca

SEQ ID NO: 1763983 - RNA, 21 nt, Human
ggacucucagucucugagcag

SEQ ID NO: 1763984 - RNA, 20 nt, Human
ggacucugaaauaucccggg

SEQ ID NO: 1763985 - RNA, 21 nt, Human
ggaccccagcaagugguccua

SEQ ID NO: 1763986 - RNA, 17 nt, Human
ggaccuggugcugccuc

SEQ ID NO: 1763987 - RNA, 14 nt, Human
ggaccugccuguag

SEQ ID NO: 1763988 - RNA, 15 nt, Human
ggaccugccuguagc

SEQ ID NO: 1763989 - RNA, 12 nt, Human
ggaaggagccag

SEQ ID NO: 1763990 - RNA, 13 nt, Human
ggaaggagccagu

SEQ ID NO: 1763991 - RNA, 21 nt, Human
ggaaggagccaguuugccgga

SEQ ID NO: 1763992 - RNA, 16 nt, Human
ggacccagggaacagc

SEQ ID NO: 1763993 - RNA, 22 nt, Human
ggacccagggaacagccacucc

SEQ ID NO: 1763994 - RNA, 21 nt, Human
ggacccagaggaaggggccag

SEQ ID NO: 1763995 - RNA, 11 nt, Human
ggagugacaga

SEQ ID NO: 1763996 - RNA, 16 nt, Human
ggagugacagaggcag

SEQ ID NO: 1763997 - RNA, 20 nt, Human
ggagucccaccuuggcugca

SEQ ID NO: 1763998 - RNA, 21 nt, Human
ggagucccaccuuggcugcag

SEQ ID NO: 1763999 - RNA, 18 nt, Human
ggagucauuugagucucu

SEQ ID NO: 1764000 - RNA, 21 nt, Human
ggagucauuugagucucuuaa

SEQ ID NO: 1764001 - RNA, 16 nt, Human
ggaucagaaauacaga

SEQ ID NO: 1764002 - RNA, 14 nt, Human
ggaucagaaauaca

SEQ ID NO: 1764003 - RNA, 17 nt, Human
ggagugacagaggcagc

SEQ ID NO: 1764004 - RNA, 18 nt, Human
ggagugacagaggcagcc

SEQ ID NO: 1764005 - RNA, 19 nt, Human
ggagugacagaggcagccc

SEQ ID NO: 1764006 - RNA, 21 nt, Human
ggagugacagaggcagcccca

SEQ ID NO: 1764007 - RNA, 12 nt, Human
ggagugagcugg

SEQ ID NO: 1764008 - RNA, 14 nt, Human
ggagugagcugguu

SEQ ID NO: 1764009 - RNA, 13 nt, Human
ggagggcagcagg

SEQ ID NO: 1764010 - RNA, 15 nt, Human
ggagggcagcagggc

SEQ ID NO: 1764011 - RNA, 16 nt, Human
ggagggcagcagggcu

SEQ ID NO: 1764012 - RNA, 17 nt, Human
ggagggcagcagggcua

SEQ ID NO: 1764013 - RNA, 15 nt, Human
ggaggauguucuggg

SEQ ID NO: 1764014 - RNA, 15 nt, Human
ggccccucaccuacu

SEQ ID NO: 1764015 - RNA, 17 nt, Human
ggccccugccacccugg

SEQ ID NO: 1764016 - RNA, 18 nt, Human
ggccccugccacccuggg

SEQ ID NO: 1764017 - RNA, 13 nt, Human
ggccccugcccgg

SEQ ID NO: 1764018 - RNA, 13 nt, Human
ggccccugccacc

SEQ ID NO: 1764019 - RNA, 16 nt, Human
ggccccugccacccug

SEQ ID NO: 1764020 - RNA, 12 nt, Human
ggccccugccac

SEQ ID NO: 1764021 - RNA, 12 nt, Human
ggccaggcuggu

SEQ ID NO: 1764022 - RNA, 13 nt, Human
ggccaugggccuc

SEQ ID NO: 1764023 - RNA, 16 nt, Human
ggccccccugcccugu

SEQ ID NO: 1764024 - RNA, 14 nt, Human
ggccccccugcccu

SEQ ID NO: 1764025 - RNA, 14 nt, Human
ggccaggccagagg

SEQ ID NO: 1764026 - RNA, 16 nt, Human
ggccaggccagaggga

SEQ ID NO: 1764027 - RNA, 11 nt, Human
ggccaggcugg

SEQ ID NO: 1764028 - RNA, 22 nt, Human
ggcagguguuuauuaaaauucu

SEQ ID NO: 1764029 - RNA, 23 nt, Human
ggcauguucucugaggacacuaa

SEQ ID NO: 1764030 - RNA, 21 nt, Human
ggcagcuugaggguugggcug

SEQ ID NO: 1764031 - RNA, 19 nt, Human
ggcagcugcgguccaccca

SEQ ID NO: 1764032 - RNA, 23 nt, Human
ggcaggucuugaacuccuggccu

SEQ ID NO: 1764033 - RNA, 18 nt, Human
ggcagguccuccccucuc

SEQ ID NO: 1764034 - RNA, 19 nt, Human
ggcaggugcuggagcacug

SEQ ID NO: 1764035 - RNA, 20 nt, Human
ggcaggugcuggagcacugg

SEQ ID NO: 1764036 - RNA, 21 nt, Human
ggcaggugcuggagcacuggg

SEQ ID NO: 1764037 - RNA, 13 nt, Human
ggcagguccaggg

SEQ ID NO: 1764038 - RNA, 13 nt, Human
ggcagagcuucuu

SEQ ID NO: 1764039 - RNA, 23 nt, Human
ggcagauacaggaaaagcugcug

SEQ ID NO: 1764040 - RNA, 17 nt, Human
ggcagcacccuauaaau

SEQ ID NO: 1764041 - RNA, 19 nt, Human
ggcagcacccuauaaauca

SEQ ID NO: 1764042 - RNA, 21 nt, Human
ggcagcaccugucuccuuuca

SEQ ID NO: 1764043 - RNA, 17 nt, Human
ggcaaggguuaaggccu

SEQ ID NO: 1764044 - RNA, 19 nt, Human
ggcaaggguuaaggccuga

SEQ ID NO: 1764045 - RNA, 17 nt, Human
ggcacccggccccugcu

SEQ ID NO: 1764046 - RNA, 15 nt, Human
ggcacccggccccug

SEQ ID NO: 1764047 - RNA, 16 nt, Human
ggcacccggccccugc

SEQ ID NO: 1764048 - RNA, 16 nt, Human
ggcaccucacaggccc

SEQ ID NO: 1764049 - RNA, 19 nt, Human
ggcaccucacaggccccag

SEQ ID NO: 1764050 - RNA, 22 nt, Human
ggcaccugccacccugggccug

SEQ ID NO: 1764051 - RNA, 21 nt, Human
ggaucagucugauucccaagc

SEQ ID NO: 1764052 - RNA, 13 nt, Human
ggaucaggaagcc

SEQ ID NO: 1764053 - RNA, 21 nt, Human
ggaucagaucuggggcagcac

SEQ ID NO: 1764054 - RNA, 16 nt, Human
ggaucagauugcaugu

SEQ ID NO: 1764055 - RNA, 19 nt, Human
ggcaacccccagccugcua

SEQ ID NO: 1764056 - RNA, 23 nt, Human
uauaaaucaacaccuuaauaugc

SEQ ID NO: 1764057 - RNA, 21 nt, Human
uaguuugauuauucaguguca

SEQ ID NO: 1764058 - RNA, 19 nt, Human
uauaauggacagauuaaua

SEQ ID NO: 1764059 - RNA, 20 nt, Human
uauaauggacagauuaauau

SEQ ID NO: 1764060 - RNA, 14 nt, Human
uauaccugugccuc

SEQ ID NO: 1764061 - RNA, 13 nt, Human
uauaccugugccu

SEQ ID NO: 1764062 - RNA, 14 nt, Human
uagugcuaagugug

SEQ ID NO: 1764063 - RNA, 19 nt, Human
uagugcuaagugugaacug

SEQ ID NO: 1764064 - RNA, 18 nt, Human
uagugcuaagugugaacu

SEQ ID NO: 1764065 - RNA, 17 nt, Human
uagugcuaagugugaac

SEQ ID NO: 1764066 - RNA, 15 nt, Human
uagugcuaaguguga

SEQ ID NO: 1764067 - RNA, 23 nt, Human
uagugcuuuccuuuuuuaaaaau

SEQ ID NO: 1764068 - RNA, 13 nt, Human
uaggcgaucacaa

SEQ ID NO: 1764069 - RNA, 23 nt, Human
uaggcgaucacaacgugcauugu

SEQ ID NO: 1764070 - RNA, 16 nt, Human
uaguuggcagaaauac

SEQ ID NO: 1764071 - RNA, 17 nt, Human
uaguuggcagaaauaca

SEQ ID NO: 1764072 - RNA, 18 nt, Human
uaguuggcagaaauacag

SEQ ID NO: 1764073 - RNA, 17 nt, Human
uaucaggugcugccauc

SEQ ID NO: 1764074 - RNA, 20 nt, Human
uaucaggacccagaggaagg

SEQ ID NO: 1764075 - RNA, 21 nt, Human
uaucaggacccagaggaaggg

SEQ ID NO: 1764076 - RNA, 16 nt, Human
uaucaguuacccacuc

SEQ ID NO: 1764077 - RNA, 11 nt, Human
uauccuggugc

SEQ ID NO: 1764078 - RNA, 18 nt, Human
uauccugccaaaaucauu

SEQ ID NO: 1764079 - RNA, 19 nt, Human
uaucgauguuauguaaaag

SEQ ID NO: 1764080 - RNA, 21 nt, Human
uauaugcacuuauaauuuucc

SEQ ID NO: 1764081 - RNA, 15 nt, Human
uauaccugugccucg

SEQ ID NO: 1764082 - RNA, 21 nt, Human
uauacuuguggacuaaaagau

SEQ ID NO: 1764083 - RNA, 17 nt, Human
uauacuuguggacuaaa

SEQ ID NO: 1764084 - RNA, 23 nt, Human
uauacuuguggacuaaaagauau

SEQ ID NO: 1764085 - RNA, 22 nt, Human
uauacuuguggacuaaaagaua

SEQ ID NO: 1764086 - RNA, 23 nt, Human
uagcagaagguugcaccuccccc

SEQ ID NO: 1764087 - RNA, 23 nt, Human
uagauguucucuaucauuuaaua

SEQ ID NO: 1764088 - RNA, 12 nt, Human
uagauguuuccu

SEQ ID NO: 1764089 - RNA, 16 nt, Human
uagauuaaaaauuaua

SEQ ID NO: 1764090 - RNA, 19 nt, Human
uagcagagaaugaaagggc

SEQ ID NO: 1764091 - RNA, 23 nt, Human
uagcagagaaugaaagggcccag

SEQ ID NO: 1764092 - RNA, 12 nt, Human
uagauacaauaa

SEQ ID NO: 1764093 - RNA, 13 nt, Human
uagauacaauaaa

SEQ ID NO: 1764094 - RNA, 14 nt, Human
uagauacaauaaau

SEQ ID NO: 1764095 - RNA, 16 nt, Human
uagauacaauaaauug

SEQ ID NO: 1764096 - RNA, 17 nt, Human
uagauacaauaaauugc

SEQ ID NO: 1764097 - RNA, 22 nt, Human
uagauguucucuaucauuuaau

SEQ ID NO: 1764098 - RNA, 21 nt, Human
uagauguucucuaucauuuaa

SEQ ID NO: 1764099 - RNA, 19 nt, Human
uagauguucucuaucauuu

SEQ ID NO: 1764100 - RNA, 18 nt, Human
uagauguucucuaucauu

SEQ ID NO: 1764101 - RNA, 14 nt, Human
uagauguucucuau

SEQ ID NO: 1764102 - RNA, 21 nt, Human
uagauguucuaagucuuucca

SEQ ID NO: 1764103 - RNA, 16 nt, Human
uagagagagaccacuu

SEQ ID NO: 1764104 - RNA, 14 nt, Human
uagaguauaugcac

SEQ ID NO: 1764105 - RNA, 14 nt, Human
uagaaauucuuuau

SEQ ID NO: 1764106 - RNA, 22 nt, Human
uaggaaccgugguaugucugcc

SEQ ID NO: 1764107 - RNA, 14 nt, Human
uaggccuggccaga

SEQ ID NO: 1764108 - RNA, 13 nt, Human
uaggccuggccag

SEQ ID NO: 1764109 - RNA, 20 nt, Human
uaggccucaacuccucccau

SEQ ID NO: 1764110 - RNA, 22 nt, Human
uaggccucaacuccucccauag

SEQ ID NO: 1764111 - RNA, 16 nt, Human
uaggaaguaaauuaua

SEQ ID NO: 1764112 - RNA, 16 nt, Human
uagcccucacauuaga

SEQ ID NO: 1764113 - RNA, 20 nt, Human
uagccucagaugauuucccc

SEQ ID NO: 1764114 - RNA, 15 nt, Human
uagccugaguagaaa

SEQ ID NO: 1764115 - RNA, 18 nt, Human
uagccauuuuucaaagca

SEQ ID NO: 1764116 - RNA, 19 nt, Human
uagccauuuuucaaagcaa

SEQ ID NO: 1764117 - RNA, 20 nt, Human
uagccauuuuucaaagcaau

SEQ ID NO: 1764118 - RNA, 22 nt, Human
uagccauuuuucaaagcaauug

SEQ ID NO: 1764119 - RNA, 15 nt, Human
uagcccacucugcuc

SEQ ID NO: 1764120 - RNA, 11 nt, Human
uagcugggacu

SEQ ID NO: 1764121 - RNA, 23 nt, Human
uagccugcagaaguaagccucau

SEQ ID NO: 1764122 - RNA, 18 nt, Human
uagcugggacuacaggug

SEQ ID NO: 1764123 - RNA, 12 nt, Human
uagcugggacua

SEQ ID NO: 1764124 - RNA, 20 nt, Human
uagcugggacuacaggcacc

SEQ ID NO: 1764125 - RNA, 21 nt, Human
uacacacacacgcgugcacac

SEQ ID NO: 1764126 - RNA, 15 nt, Human
uacacacacauacac

SEQ ID NO: 1764127 - RNA, 20 nt, Human
uacacuguauguuauagaac

SEQ ID NO: 1764128 - RNA, 15 nt, Human
uacacagaaaugcug

SEQ ID NO: 1764129 - RNA, 17 nt, Human
uacacagaaaugcugcu

SEQ ID NO: 1764130 - RNA, 18 nt, Human
uacacagaaaugcugcug

SEQ ID NO: 1764131 - RNA, 19 nt, Human
uacacagaaaugcugcugg

SEQ ID NO: 1764132 - RNA, 20 nt, Human
uacacagaaaugcugcuggc

SEQ ID NO: 1764133 - RNA, 21 nt, Human
uacacagaaaugcugcuggcc

SEQ ID NO: 1764134 - RNA, 22 nt, Human
uacacagaaaugcugcuggcca

SEQ ID NO: 1764135 - RNA, 23 nt, Human
uacacagaaaugcugcuggccaa

SEQ ID NO: 1764136 - RNA, 23 nt, Human
uacacaaaugauagcauaacaua

SEQ ID NO: 1764137 - RNA, 17 nt, Human
uacaggaaaagcugcug

SEQ ID NO: 1764138 - RNA, 18 nt, Human
uacaggaaaagcugcuga

SEQ ID NO: 1764139 - RNA, 19 nt, Human
uacaggaaaagcugcugac

SEQ ID NO: 1764140 - RNA, 16 nt, Human
uacaggcacccaccau

SEQ ID NO: 1764141 - RNA, 14 nt, Human
uacaggauuugaaa

SEQ ID NO: 1764142 - RNA, 13 nt, Human
uacagaauuuuau

SEQ ID NO: 1764143 - RNA, 13 nt, Human
uacagaauauuuc

SEQ ID NO: 1764144 - RNA, 18 nt, Human
uacagaauauuucuauug

SEQ ID NO: 1764145 - RNA, 21 nt, Human
uacagaauauuucuauugaau

SEQ ID NO: 1764146 - RNA, 16 nt, Human
uacagaacucuuucaa

SEQ ID NO: 1764147 - RNA, 17 nt, Human
uacagaacucuuucaaa

SEQ ID NO: 1764148 - RNA, 19 nt, Human
uacagaacucuuucaaaac

SEQ ID NO: 1764149 - RNA, 11 nt, Human
uacccacugcu

SEQ ID NO: 1764150 - RNA, 12 nt, Human
uacccacugcuc

SEQ ID NO: 1764151 - RNA, 13 nt, Human
uacccacugcucu

SEQ ID NO: 1764152 - RNA, 14 nt, Human
uacccacugcucug

SEQ ID NO: 1764153 - RNA, 18 nt, Human
uacccagcgagcccuggu

SEQ ID NO: 1764154 - RNA, 13 nt, Human
uaccaaugaaaaa

SEQ ID NO: 1764155 - RNA, 15 nt, Human
uaccaaugaaaaaau

SEQ ID NO: 1764156 - RNA, 17 nt, Human
uaccaaugaaaaaaugu

SEQ ID NO: 1764157 - RNA, 23 nt, Human
uaccauuuugggguacccacugc

SEQ ID NO: 1764158 - RNA, 18 nt, Human
uacaguuaaggaauauaa

SEQ ID NO: 1764159 - RNA, 16 nt, Human
uacaugacauuuauuu

SEQ ID NO: 1764160 - RNA, 21 nt, Human
uacaugacauuuauuuuucau

SEQ ID NO: 1764161 - RNA, 15 nt, Human
uaccaaaaauuuugu

SEQ ID NO: 1764162 - RNA, 14 nt, Human
uacgaauacuuuug

SEQ ID NO: 1764163 - RNA, 13 nt, Human
uaccuugguuccc

SEQ ID NO: 1764164 - RNA, 22 nt, Human
uaccuugguucccccacugauc

SEQ ID NO: 1764165 - RNA, 18 nt, Human
uaccuugccaauuaguaa

SEQ ID NO: 1764166 - RNA, 16 nt, Human
uaccuugcuuuugcuu

SEQ ID NO: 1764167 - RNA, 18 nt, Human
uaccuugcuuuugcuucu

SEQ ID NO: 1764168 - RNA, 21 nt, Human
uaccuugcuuuugcuucuaga

SEQ ID NO: 1764169 - RNA, 23 nt, Human
uacccauacacccccucuucuga

SEQ ID NO: 1764170 - RNA, 16 nt, Human
uacccauacacccccu

SEQ ID NO: 1764171 - RNA, 16 nt, Human
uacccagggccugcag

SEQ ID NO: 1764172 - RNA, 17 nt, Human
uacccacucggucccag

SEQ ID NO: 1764173 - RNA, 15 nt, Human
uacccaggugggucc

SEQ ID NO: 1764174 - RNA, 18 nt, Human
uaccuugacacauaguuu

SEQ ID NO: 1764175 - RNA, 17 nt, Human
uacuccucuuuacacug

SEQ ID NO: 1764176 - RNA, 15 nt, Human
uagaaacuuccaaau

SEQ ID NO: 1764177 - RNA, 14 nt, Human
uagaaagcauuuga

SEQ ID NO: 1764178 - RNA, 13 nt, Human
uagaaagcauuug

SEQ ID NO: 1764179 - RNA, 21 nt, Human
uacuuuagauggcaagcaugu

SEQ ID NO: 1764180 - RNA, 16 nt, Human
uagaaaggccuuuaaa

SEQ ID NO: 1764181 - RNA, 15 nt, Human
uagaaaggccuuuaa

SEQ ID NO: 1764182 - RNA, 14 nt, Human
uagaaaggccuuua

SEQ ID NO: 1764183 - RNA, 13 nt, Human
uagaaaggccuuu

SEQ ID NO: 1764184 - RNA, 22 nt, Human
uagaaagcauuugaaugcauuu

SEQ ID NO: 1764185 - RNA, 21 nt, Human
uagaaagcauuugaaugcauu

SEQ ID NO: 1764186 - RNA, 20 nt, Human
uagaaagcauuugaaugcau

SEQ ID NO: 1764187 - RNA, 19 nt, Human
uagaaagcauuugaaugca

SEQ ID NO: 1764188 - RNA, 18 nt, Human
uagaaagcauuugaaugc

SEQ ID NO: 1764189 - RNA, 17 nt, Human
uagaaagcauuugaaug

SEQ ID NO: 1764190 - RNA, 16 nt, Human
uagaaagcauuugaau

SEQ ID NO: 1764191 - RNA, 15 nt, Human
uagaaagcauuugaa

SEQ ID NO: 1764192 - RNA, 15 nt, Human
uagaaauaauaugca

SEQ ID NO: 1764193 - RNA, 16 nt, Human
uagaaauaauaugcau

SEQ ID NO: 1764194 - RNA, 23 nt, Human
uagaaaugguuguauuagauguu

SEQ ID NO: 1764195 - RNA, 20 nt, Human
uagaaaugguuguauuagau

SEQ ID NO: 1764196 - RNA, 19 nt, Human
uagaaaugguuguauuaga

SEQ ID NO: 1764197 - RNA, 17 nt, Human
uagaaaugguuguauua

SEQ ID NO: 1764198 - RNA, 16 nt, Human
uagaaaugguuguauu

SEQ ID NO: 1764199 - RNA, 15 nt, Human
uagaaaugguuguau

SEQ ID NO: 1764200 - RNA, 23 nt, Human
uagaaauuuauuuccuaguucug

SEQ ID NO: 1764201 - RNA, 19 nt, Human
uacuuguggacacagcucu

SEQ ID NO: 1764202 - RNA, 15 nt, Human
uacuuguggacacag

SEQ ID NO: 1764203 - RNA, 18 nt, Human
uacuuguggacacagcuc

SEQ ID NO: 1764204 - RNA, 23 nt, Human
uacuugccuuauuagagugucuu

SEQ ID NO: 1764205 - RNA, 19 nt, Human
uacuuacccaggugggucc

SEQ ID NO: 1764206 - RNA, 17 nt, Human
uacuguauuuuguauug

SEQ ID NO: 1764207 - RNA, 23 nt, Human
uacuguauuuuguauuguuucaa

SEQ ID NO: 1764208 - RNA, 12 nt, Human
uacugugggcaa

SEQ ID NO: 1764209 - RNA, 16 nt, Human
uacugugggcaauuua

SEQ ID NO: 1764210 - RNA, 17 nt, Human
uacugugggcaauuuag

SEQ ID NO: 1764211 - RNA, 18 nt, Human
uacugugggcaauuuaga

SEQ ID NO: 1764212 - RNA, 19 nt, Human
uacugugggcaauuuagaa

SEQ ID NO: 1764213 - RNA, 17 nt, Human
uaauuuuccuaauaaag

SEQ ID NO: 1764214 - RNA, 12 nt, Human
uaauuuguaaag

SEQ ID NO: 1764215 - RNA, 13 nt, Human
uaauuuguaaagu

SEQ ID NO: 1764216 - RNA, 16 nt, Human
uaauuuguaaaguugg

SEQ ID NO: 1764217 - RNA, 18 nt, Human
uaauugggucauagaaau

SEQ ID NO: 1764218 - RNA, 21 nt, Human
uaauaguucagguaacaggca

SEQ ID NO: 1764219 - RNA, 13 nt, Human
uaauauaaauuca

SEQ ID NO: 1764220 - RNA, 14 nt, Human
uaauauaaauucac

SEQ ID NO: 1764221 - RNA, 18 nt, Human
uaauauaaauucacuuuc

SEQ ID NO: 1764222 - RNA, 21 nt, Human
uaauauaaauucacuuucauu

SEQ ID NO: 1764223 - RNA, 14 nt, Human
uaauaauauacuug

SEQ ID NO: 1764224 - RNA, 13 nt, Human
uaauaauauacuu

SEQ ID NO: 1764225 - RNA, 22 nt, Human
uaauaauauacuuguggacuaa

SEQ ID NO: 1764226 - RNA, 19 nt, Human
uaauaauauacuuguggac

SEQ ID NO: 1764227 - RNA, 16 nt, Human
uaauaauauacuugug

SEQ ID NO: 1764228 - RNA, 21 nt, Human
uaauaauauacuuguggacua

SEQ ID NO: 1764229 - RNA, 23 nt, Human
uaagugcuguauaaaaucagcca

SEQ ID NO: 1764230 - RNA, 19 nt, Human
uaaggccauuauuguacuu

SEQ ID NO: 1764231 - RNA, 14 nt, Human
uaaggccugaauca

SEQ ID NO: 1764232 - RNA, 22 nt, Human
uaagugcuguauaaaaucagcc

SEQ ID NO: 1764233 - RNA, 20 nt, Human
uaagugcuguauaaaaucag

SEQ ID NO: 1764234 - RNA, 19 nt, Human
uaagugcuguauaaaauca

SEQ ID NO: 1764235 - RNA, 18 nt, Human
uaagugcuguauaaaauc

SEQ ID NO: 1764236 - RNA, 17 nt, Human
uaagugcuguauaaaau

SEQ ID NO: 1764237 - RNA, 15 nt, Human
uaagugcuguauaaa

SEQ ID NO: 1764238 - RNA, 16 nt, Human
uaaugcaguaugguac

SEQ ID NO: 1764239 - RNA, 17 nt, Human
uaaugcaguaugguaca

SEQ ID NO: 1764240 - RNA, 20 nt, Human
uaaugcaguaugguacauuu

SEQ ID NO: 1764241 - RNA, 21 nt, Human
uaaugcaguaugguacauuuu

SEQ ID NO: 1764242 - RNA, 21 nt, Human
uaauauacuuguggacuaaaa

SEQ ID NO: 1764243 - RNA, 17 nt, Human
uaauauacuuguggacu

SEQ ID NO: 1764244 - RNA, 15 nt, Human
uaauauacuugugga

SEQ ID NO: 1764245 - RNA, 13 nt, Human
uaauauacuugug

SEQ ID NO: 1764246 - RNA, 21 nt, Human
uaagaguagaaacugcaggga

SEQ ID NO: 1764247 - RNA, 22 nt, Human
uaagaggcagggucucacucug

SEQ ID NO: 1764248 - RNA, 19 nt, Human
uaagccucaucaucagagc

SEQ ID NO: 1764249 - RNA, 20 nt, Human
uaagccacuuaaaauguuca

SEQ ID NO: 1764250 - RNA, 17 nt, Human
uaagccacuuaaaaugu

SEQ ID NO: 1764251 - RNA, 19 nt, Human
uaagccacuuaaaauguuc

SEQ ID NO: 1764252 - RNA, 15 nt, Human
uaagcaucuacuuca

SEQ ID NO: 1764253 - RNA, 17 nt, Human
uaagcaucuacuucagg

SEQ ID NO: 1764254 - RNA, 14 nt, Human
uaaccucaucuucu

SEQ ID NO: 1764255 - RNA, 18 nt, Human
uaaccucaucuucuucac

SEQ ID NO: 1764256 - RNA, 18 nt, Human
uaacccuucaucuuccug

SEQ ID NO: 1764257 - RNA, 19 nt, Human
uaacccuucaucuuccugu

SEQ ID NO: 1764258 - RNA, 20 nt, Human
uaacccuucaucuuccugug

SEQ ID NO: 1764259 - RNA, 21 nt, Human
uaacccuucaucuuccugugu

SEQ ID NO: 1764260 - RNA, 19 nt, Human
uaacaggcagauacaggaa

SEQ ID NO: 1764261 - RNA, 16 nt, Human
uaaauugcuaauguug

SEQ ID NO: 1764262 - RNA, 17 nt, Human
uaaauugcuaauguugc

SEQ ID NO: 1764263 - RNA, 19 nt, Human
uaaauuguauauucacuuu

SEQ ID NO: 1764264 - RNA, 18 nt, Human
uaaauuguauauucacuu

SEQ ID NO: 1764265 - RNA, 17 nt, Human
uaaauuguauauucacu

SEQ ID NO: 1764266 - RNA, 14 nt, Human
uaaauuguauauuc

SEQ ID NO: 1764267 - RNA, 13 nt, Human
uaaauuguauauu

SEQ ID NO: 1764268 - RNA, 13 nt, Human
uaacaauuccucu

SEQ ID NO: 1764269 - RNA, 14 nt, Human
uaacaauuccucua

SEQ ID NO: 1764270 - RNA, 22 nt, Human
uaaaucagucaagcuguugaag

SEQ ID NO: 1764271 - RNA, 22 nt, Human
uaaauaaaaugcacaaaacuuu

SEQ ID NO: 1764272 - RNA, 18 nt, Human
uaaauauaugcuaagucu

SEQ ID NO: 1764273 - RNA, 17 nt, Human
uaaauaaaaauaauccu

SEQ ID NO: 1764274 - RNA, 14 nt, Human
uaaaggaauuuaaa

SEQ ID NO: 1764275 - RNA, 22 nt, Human
uaaaagauauaagugcuguaua

SEQ ID NO: 1764276 - RNA, 19 nt, Human
uaaaaaugcaaauccuaug

SEQ ID NO: 1764277 - RNA, 20 nt, Human
uaaaaaugcaaauccuaugu

SEQ ID NO: 1764278 - RNA, 16 nt, Human
uaaaaaugcaaauccu

SEQ ID NO: 1764279 - RNA, 23 nt, Human
uaaaaauggaaaaauaaacacua

SEQ ID NO: 1764280 - RNA, 19 nt, Human
uaaaagauggggucuguaa

SEQ ID NO: 1764281 - RNA, 18 nt, Human
uaaaagauggggucugua

SEQ ID NO: 1764282 - RNA, 22 nt, Human
uaaaagauggggucuguaaaau

SEQ ID NO: 1764283 - RNA, 21 nt, Human
uaaaagauggggucuguaaaa

SEQ ID NO: 1764284 - RNA, 20 nt, Human
uaaaagauggggucuguaaa

SEQ ID NO: 1764285 - RNA, 18 nt, Human
uaaaaucuuucuuucuua

SEQ ID NO: 1764286 - RNA, 22 nt, Human
uaaaaucuuucuuucuuagaaa

SEQ ID NO: 1764287 - RNA, 21 nt, Human
uaaaaucuuucuuucuuagaa

SEQ ID NO: 1764288 - RNA, 20 nt, Human
uaaaaucuuucuuucuuaga

SEQ ID NO: 1764289 - RNA, 19 nt, Human
uaaaaucuuucuuucuuag

SEQ ID NO: 1764290 - RNA, 23 nt, Human
uaaaaucagccaauuauguuaaa

SEQ ID NO: 1764291 - RNA, 22 nt, Human
uaaaaucagccaauuauguuaa

SEQ ID NO: 1764292 - RNA, 21 nt, Human
uaaaaucagccaauuauguua

SEQ ID NO: 1764293 - RNA, 15 nt, Human
uaaaauccucaaucc

SEQ ID NO: 1764294 - RNA, 17 nt, Human
uaaaaucagccaauuau

SEQ ID NO: 1764295 - RNA, 15 nt, Human
uaaaaucagccaauu

SEQ ID NO: 1764296 - RNA, 14 nt, Human
uaaaaucagccaau

SEQ ID NO: 1764297 - RNA, 13 nt, Human
uaaaaucagccaa

SEQ ID NO: 1764298 - RNA, 17 nt, Human
guuugaaauucugaauu

SEQ ID NO: 1764299 - RNA, 18 nt, Human
guuugaaauucugaauuu

SEQ ID NO: 1764300 - RNA, 19 nt, Human
guuugaaauucugaauuug

SEQ ID NO: 1764301 - RNA, 21 nt, Human
guuugaaauucugaauuugca

SEQ ID NO: 1764302 - RNA, 22 nt, Human
guuugaaauucugaauuugcaa

SEQ ID NO: 1764303 - RNA, 23 nt, Human
guuugaaauucugaauuugcaaa

SEQ ID NO: 1764304 - RNA, 14 nt, Human
guuugaauguuaaa

SEQ ID NO: 1764305 - RNA, 15 nt, Human
guuugaauguuaaau

SEQ ID NO: 1764306 - RNA, 19 nt, Human
guuuccuggcacuggaccc

SEQ ID NO: 1764307 - RNA, 17 nt, Human
guuuccuuccagcccag

SEQ ID NO: 1764308 - RNA, 14 nt, Human
guuuccuuuuuucc

SEQ ID NO: 1764309 - RNA, 15 nt, Human
guuuccuuuuuuccc

SEQ ID NO: 1764310 - RNA, 17 nt, Human
guuuccuggcacuggac

SEQ ID NO: 1764311 - RNA, 14 nt, Human
guuucauuuugguu

SEQ ID NO: 1764312 - RNA, 21 nt, Human
gguuggccccugcccggcugc

SEQ ID NO: 1764313 - RNA, 13 nt, Human
gguuggcucccgc

SEQ ID NO: 1764314 - RNA, 12 nt, Human
guuuuguauucu

SEQ ID NO: 1764315 - RNA, 15 nt, Human
guuuuguauucucug

SEQ ID NO: 1764316 - RNA, 11 nt, Human
uaaaaaugcaa

SEQ ID NO: 1764317 - RNA, 14 nt, Human
ucaaugcacugaca

SEQ ID NO: 1764318 - RNA, 18 nt, Human
ucaaugcacugacauugu

SEQ ID NO: 1764319 - RNA, 14 nt, Human
ucaaugcucauaac

SEQ ID NO: 1764320 - RNA, 13 nt, Human
ucaaugcucauaa

SEQ ID NO: 1764321 - RNA, 12 nt, Human
ucaaugcucaua

SEQ ID NO: 1764322 - RNA, 21 nt, Human
ucacaauagccgauaucagaa

SEQ ID NO: 1764323 - RNA, 22 nt, Human
ucacaauagccgauaucagaau

SEQ ID NO: 1764324 - RNA, 21 nt, Human
ucacacaguauuacuucugcu

SEQ ID NO: 1764325 - RNA, 10 nt, Human
ucacacacac

SEQ ID NO: 1764326 - RNA, 22 nt, Human
ucacacaguauuacuucugcua

SEQ ID NO: 1764327 - RNA, 13 nt, Human
ucacacagugagu

SEQ ID NO: 1764328 - RNA, 24 nt, Human
ucacacacacaaaaaaugcacaaa

SEQ ID NO: 1764329 - RNA, 22 nt, Human
ucacacagugagucgaggacag

SEQ ID NO: 1764330 - RNA, 23 nt, Human
ucacacagugagucgaggacagg

SEQ ID NO: 1764331 - RNA, 11 nt, Human
ucacaggcagg

SEQ ID NO: 1764332 - RNA, 16 nt, Human
ucaagcgauucuucug

SEQ ID NO: 1764333 - RNA, 17 nt, Human
ucaagcgauucuucugc

SEQ ID NO: 1764334 - RNA, 14 nt, Human
ucaagcugcucuga

SEQ ID NO: 1764335 - RNA, 22 nt, Human
ucaagugauucuccugccucag

SEQ ID NO: 1764336 - RNA, 19 nt, Human
ucaagcuguugaagucuca

SEQ ID NO: 1764337 - RNA, 22 nt, Human
ucaaacucuugaccucagguga

SEQ ID NO: 1764338 - RNA, 13 nt, Human
ucaaccuccuggg

SEQ ID NO: 1764339 - RNA, 14 nt, Human
ucaaccuccugggc

SEQ ID NO: 1764340 - RNA, 19 nt, Human
ucaacuaaaaaaaaaaaag

SEQ ID NO: 1764341 - RNA, 20 nt, Human
ucaacuaaaaaaaaaaaagu

SEQ ID NO: 1764342 - RNA, 21 nt, Human
ucaacuagugggguuuccugg

SEQ ID NO: 1764343 - RNA, 22 nt, Human
ucaacuagugggguuuccuggc

SEQ ID NO: 1764344 - RNA, 15 nt, Human
ucaaaaccuuuugaa

SEQ ID NO: 1764345 - RNA, 13 nt, Human
uauuuucaccauu

SEQ ID NO: 1764346 - RNA, 14 nt, Human
uauuuucaccauuu

SEQ ID NO: 1764347 - RNA, 12 nt, Human
uauuuauucauu

SEQ ID NO: 1764348 - RNA, 22 nt, Human
uauuuauucauuauuugucaaa

SEQ ID NO: 1764349 - RNA, 23 nt, Human
uauuuauucauuauuugucaaau

SEQ ID NO: 1764350 - RNA, 11 nt, Human
uauuucuauug

SEQ ID NO: 1764351 - RNA, 22 nt, Human
uauuucucagacuuuggaaaau

SEQ ID NO: 1764352 - RNA, 14 nt, Human
uauuuuauaagaaa

SEQ ID NO: 1764353 - RNA, 15 nt, Human
uauuuuauaagaaaa

SEQ ID NO: 1764354 - RNA, 17 nt, Human
uauuuuauaagaaaaac

SEQ ID NO: 1764355 - RNA, 16 nt, Human
ucacgccacugcacua

SEQ ID NO: 1764356 - RNA, 13 nt, Human
ucacgccacugca

SEQ ID NO: 1764357 - RNA, 14 nt, Human
ucacgccacugcac

SEQ ID NO: 1764358 - RNA, 14 nt, Human
ucacgcaccugggu

SEQ ID NO: 1764359 - RNA, 12 nt, Human
ucacaggcaggu

SEQ ID NO: 1764360 - RNA, 15 nt, Human
ucacaggcaggucca

SEQ ID NO: 1764361 - RNA, 19 nt, Human
ucacaggccccaggaaagg

SEQ ID NO: 1764362 - RNA, 22 nt, Human
ucaccuucguuuacuaugccug

SEQ ID NO: 1764363 - RNA, 13 nt, Human
ucacggcucacug

SEQ ID NO: 1764364 - RNA, 15 nt, Human
ucacggcucacugca

SEQ ID NO: 1764365 - RNA, 20 nt, Human
ucacggcucacugcagccuc

SEQ ID NO: 1764366 - RNA, 17 nt, Human
ucacuccugacugcccg

SEQ ID NO: 1764367 - RNA, 18 nt, Human
ucagaggcccucgcugcc

SEQ ID NO: 1764368 - RNA, 21 nt, Human
ucagaggcccucgcugccagc

SEQ ID NO: 1764369 - RNA, 22 nt, Human
ucagaggcccucgcugccagcu

SEQ ID NO: 1764370 - RNA, 22 nt, Human
ucacucugucgcccagucugga

SEQ ID NO: 1764371 - RNA, 19 nt, Human
ucacucugucgcccagucu

SEQ ID NO: 1764372 - RNA, 12 nt, Human
ucacucugucgc

SEQ ID NO: 1764373 - RNA, 16 nt, Human
ucacucugucgcccag

SEQ ID NO: 1764374 - RNA, 20 nt, Human
ucacuggcgacacguagcag

SEQ ID NO: 1764375 - RNA, 22 nt, Human
ucacuggcgacacguagcagcu

SEQ ID NO: 1764376 - RNA, 13 nt, Human
ucacuuucauuuu

SEQ ID NO: 1764377 - RNA, 14 nt, Human
ucacuuucauuuuu

SEQ ID NO: 1764378 - RNA, 18 nt, Human
ucacuuuugacaaaggca

SEQ ID NO: 1764379 - RNA, 16 nt, Human
ucagaaaaaaauucau

SEQ ID NO: 1764380 - RNA, 20 nt, Human
ucagaaauacagauuuugau

SEQ ID NO: 1764381 - RNA, 16 nt, Human
ucagaaauacagauuu

SEQ ID NO: 1764382 - RNA, 13 nt, Human
ucagaaauacaga

SEQ ID NO: 1764383 - RNA, 24 nt, Human
ucagucugauucccaagcucugcu

SEQ ID NO: 1764384 - RNA, 13 nt, Human
ucagcagacugau

SEQ ID NO: 1764385 - RNA, 21 nt, Human
ucagugguccacaucccggga

SEQ ID NO: 1764386 - RNA, 23 nt, Human
ucaguguaaauaguuacuccagu

SEQ ID NO: 1764387 - RNA, 12 nt, Human
ucauaauuacca

SEQ ID NO: 1764388 - RNA, 15 nt, Human
ucauaccaaugaaaa

SEQ ID NO: 1764389 - RNA, 15 nt, Human
ucauagguugagcaa

SEQ ID NO: 1764390 - RNA, 17 nt, Human
ucauagguugagcaauu

SEQ ID NO: 1764391 - RNA, 21 nt, Human
ucaucuccugccuuccuccug

SEQ ID NO: 1764392 - RNA, 22 nt, Human
ucaucuccugccuuccuccugg

SEQ ID NO: 1764393 - RNA, 23 nt, Human
ucaucuccugccuuccuccuggg

SEQ ID NO: 1764394 - RNA, 12 nt, Human
ucaucugucccu

SEQ ID NO: 1764395 - RNA, 17 nt, Human
ucaucugucccuccggg

SEQ ID NO: 1764396 - RNA, 18 nt, Human
ucaucugucccuccggga

SEQ ID NO: 1764397 - RNA, 16 nt, Human
ucaucuguuagggccu

SEQ ID NO: 1764398 - RNA, 19 nt, Human
ucaucuguuagggccuugg

SEQ ID NO: 1764399 - RNA, 13 nt, Human
ucauguaaacugu

SEQ ID NO: 1764400 - RNA, 14 nt, Human
ucauguaaacugug

SEQ ID NO: 1764401 - RNA, 17 nt, Human
ucauguaaacugugcac

SEQ ID NO: 1764402 - RNA, 16 nt, Human
ucauguaaacugugca

SEQ ID NO: 1764403 - RNA, 13 nt, Human
ucauuauuuguca

SEQ ID NO: 1764404 - RNA, 14 nt, Human
ucauuauuugucaa

SEQ ID NO: 1764405 - RNA, 15 nt, Human
ucauuauuugucaaa

SEQ ID NO: 1764406 - RNA, 19 nt, Human
ucauuauuugucaaauugu

SEQ ID NO: 1764407 - RNA, 22 nt, Human
uccacaaccucuuccccccaaa

SEQ ID NO: 1764408 - RNA, 12 nt, Human
uccacaaaauaa

SEQ ID NO: 1764409 - RNA, 20 nt, Human
uccacaaaauaaccaauccu

SEQ ID NO: 1764410 - RNA, 14 nt, Human
uccacaaagaaaau

SEQ ID NO: 1764411 - RNA, 19 nt, Human
uccacaaagaaaauuccua

SEQ ID NO: 1764412 - RNA, 20 nt, Human
uccacaaagaaaauuccuau

SEQ ID NO: 1764413 - RNA, 21 nt, Human
uccacaaagaaaauuccuaua

SEQ ID NO: 1764414 - RNA, 20 nt, Human
uccacuucuuucagcagacu

SEQ ID NO: 1764415 - RNA, 19 nt, Human
uccagaaggagacaggcag

SEQ ID NO: 1764416 - RNA, 14 nt, Human
uccagaaggagaca

SEQ ID NO: 1764417 - RNA, 18 nt, Human
uccaagauauuuuaaaau

SEQ ID NO: 1764418 - RNA, 22 nt, Human
uccaagauauuuuaaaaucugu

SEQ ID NO: 1764419 - RNA, 19 nt, Human
uccaaaaguggccucuuug

SEQ ID NO: 1764420 - RNA, 23 nt, Human
uccaaaaguggccucuuugucua

SEQ ID NO: 1764421 - RNA, 11 nt, Human
uccaaagcaaa

SEQ ID NO: 1764422 - RNA, 19 nt, Human
uccaaagcaaaaccagaac

SEQ ID NO: 1764423 - RNA, 15 nt, Human
ucauuucuuaugaau

SEQ ID NO: 1764424 - RNA, 20 nt, Human
uccauggcccugcaaaagga

SEQ ID NO: 1764425 - RNA, 15 nt, Human
uccauccacauggga

SEQ ID NO: 1764426 - RNA, 23 nt, Human
uccagcucaccagccccagugcc

SEQ ID NO: 1764427 - RNA, 17 nt, Human
uccagcauugcuggacu

SEQ ID NO: 1764428 - RNA, 17 nt, Human
ucccaagcucugcuccu

SEQ ID NO: 1764429 - RNA, 12 nt, Human
ucccaagcucug

SEQ ID NO: 1764430 - RNA, 13 nt, Human
ucccaagcucugc

SEQ ID NO: 1764431 - RNA, 14 nt, Human
ucccaagcucugcu

SEQ ID NO: 1764432 - RNA, 15 nt, Human
ucccaagcucugcuc

SEQ ID NO: 1764433 - RNA, 13 nt, Human
ucccaccucagcc

SEQ ID NO: 1764434 - RNA, 17 nt, Human
ucccaagguuggagccc

SEQ ID NO: 1764435 - RNA, 20 nt, Human
ucccaagguuggagcccagg

SEQ ID NO: 1764436 - RNA, 21 nt, Human
ucccaagguuggagcccaggg

SEQ ID NO: 1764437 - RNA, 23 nt, Human
ucccaagguuggagcccagggca

SEQ ID NO: 1764438 - RNA, 14 nt, Human
ucccaccucagccu

SEQ ID NO: 1764439 - RNA, 15 nt, Human
ucccaccucagccuc

SEQ ID NO: 1764440 - RNA, 15 nt, Human
ucccaucuggucauu

SEQ ID NO: 1764441 - RNA, 17 nt, Human
ucccaucuggucauuug

SEQ ID NO: 1764442 - RNA, 20 nt, Human
ucccaucuggucauuugguu

SEQ ID NO: 1764443 - RNA, 15 nt, Human
ucccaucucuuccuu

SEQ ID NO: 1764444 - RNA, 16 nt, Human
ucccaucucuuccuug

SEQ ID NO: 1764445 - RNA, 17 nt, Human
uccccagaauggaggca

SEQ ID NO: 1764446 - RNA, 23 nt, Human
ucccccaucucgcucccucccag

SEQ ID NO: 1764447 - RNA, 15 nt, Human
uccccccuccucuga

SEQ ID NO: 1764448 - RNA, 17 nt, Human
uccccccuccucugaaa

SEQ ID NO: 1764449 - RNA, 18 nt, Human
uccccccuccucugaaac

SEQ ID NO: 1764450 - RNA, 19 nt, Human
uccccccuccucugaaaca

SEQ ID NO: 1764451 - RNA, 22 nt, Human
uccccccuccucugaaacagcu

SEQ ID NO: 1764452 - RNA, 17 nt, Human
ucccccuaaaccaacug

SEQ ID NO: 1764453 - RNA, 15 nt, Human
ucccccucuguccag

SEQ ID NO: 1764454 - RNA, 12 nt, Human
ucccccucuguc

SEQ ID NO: 1764455 - RNA, 19 nt, Human
uccccagccugcgccugcu

SEQ ID NO: 1764456 - RNA, 20 nt, Human
uccccagccugcgccugcug

SEQ ID NO: 1764457 - RNA, 11 nt, Human
uccccagccug

SEQ ID NO: 1764458 - RNA, 12 nt, Human
uccccagccugc

SEQ ID NO: 1764459 - RNA, 13 nt, Human
uccccagccugcg

SEQ ID NO: 1764460 - RNA, 14 nt, Human
uccccagccugcgc

SEQ ID NO: 1764461 - RNA, 17 nt, Human
uccccagccugcgccug

SEQ ID NO: 1764462 - RNA, 20 nt, Human
uccccugccagggcagggcc

SEQ ID NO: 1764463 - RNA, 12 nt, Human
uccccugccagg

SEQ ID NO: 1764464 - RNA, 14 nt, Human
uccccugccagggc

SEQ ID NO: 1764465 - RNA, 15 nt, Human
uccccugccagggca

SEQ ID NO: 1764466 - RNA, 13 nt, Human
uccccuuccacug

SEQ ID NO: 1764467 - RNA, 17 nt, Human
uccccuuccacugaggg

SEQ ID NO: 1764468 - RNA, 18 nt, Human
uccccuuccacugagggc

SEQ ID NO: 1764469 - RNA, 12 nt, Human
uccccuguguca

SEQ ID NO: 1764470 - RNA, 11 nt, Human
ucucucugugg

SEQ ID NO: 1764471 - RNA, 22 nt, Human
ucucuaucauuuaauaauauac

SEQ ID NO: 1764472 - RNA, 20 nt, Human
ucucuaucauuuaauaauau

SEQ ID NO: 1764473 - RNA, 14 nt, Human
ucucugaggacacu

SEQ ID NO: 1764474 - RNA, 13 nt, Human
ucucugaggacac

SEQ ID NO: 1764475 - RNA, 14 nt, Human
ucucugagcaguga

SEQ ID NO: 1764476 - RNA, 15 nt, Human
ucucugagcugugca

SEQ ID NO: 1764477 - RNA, 16 nt, Human
ucucugagcugugcag

SEQ ID NO: 1764478 - RNA, 13 nt, Human
ucucuaccagaua

SEQ ID NO: 1764479 - RNA, 13 nt, Human
ucucuauaaaaaa

SEQ ID NO: 1764480 - RNA, 16 nt, Human
ucucuauaaaaaauau

SEQ ID NO: 1764481 - RNA, 17 nt, Human
ucucuaucauuuaauaa

SEQ ID NO: 1764482 - RNA, 16 nt, Human
ucucuaucauuuaaua

SEQ ID NO: 1764483 - RNA, 15 nt, Human
ucucuaucauuuaau

SEQ ID NO: 1764484 - RNA, 14 nt, Human
ucucuaucauuuaa

SEQ ID NO: 1764485 - RNA, 13 nt, Human
ucucuaucauuua

SEQ ID NO: 1764486 - RNA, 12 nt, Human
ucucuaucauuu

SEQ ID NO: 1764487 - RNA, 22 nt, Human
ucuccugccucagccucccaaa

SEQ ID NO: 1764488 - RNA, 16 nt, Human
ucuccugccuuccucc

SEQ ID NO: 1764489 - RNA, 17 nt, Human
ucuccugccuuccuccu

SEQ ID NO: 1764490 - RNA, 18 nt, Human
ucuccugccuuccuccug

SEQ ID NO: 1764491 - RNA, 20 nt, Human
ucuccugccuuccuccuggg

SEQ ID NO: 1764492 - RNA, 12 nt, Human
ucugagcacaga

SEQ ID NO: 1764493 - RNA, 18 nt, Human
ucugagauucaauauuga

SEQ ID NO: 1764494 - RNA, 23 nt, Human
ucugauucccaagcucugcuccu

SEQ ID NO: 1764495 - RNA, 19 nt, Human
ucugagcagugaaugauuc

SEQ ID NO: 1764496 - RNA, 16 nt, Human
ucugaggaauccagac

SEQ ID NO: 1764497 - RNA, 17 nt, Human
ucugaggaauccagacc

SEQ ID NO: 1764498 - RNA, 20 nt, Human
ucugaggacacuaaccacgc

SEQ ID NO: 1764499 - RNA, 23 nt, Human
ucugaggacacuaaccacgcugg

SEQ ID NO: 1764500 - RNA, 16 nt, Human
ucugaaauaucccggg

SEQ ID NO: 1764501 - RNA, 15 nt, Human
ucucuuuucaaaaca

SEQ ID NO: 1764502 - RNA, 16 nt, Human
ucucuuuucaaaacau

SEQ ID NO: 1764503 - RNA, 18 nt, Human
ucucuuuuugcuuucgaa

SEQ ID NO: 1764504 - RNA, 20 nt, Human
ucucuuuuccccuuuccugu

SEQ ID NO: 1764505 - RNA, 21 nt, Human
ucucuuuuccccuuuccuguc

SEQ ID NO: 1764506 - RNA, 22 nt, Human
ucucuuuuccccuuuccugucc

SEQ ID NO: 1764507 - RNA, 12 nt, Human
ucucuuccuuga

SEQ ID NO: 1764508 - RNA, 21 nt, Human
ucucuuccuugaccugcauug

SEQ ID NO: 1764509 - RNA, 13 nt, Human
ucuaaccucaucu

SEQ ID NO: 1764510 - RNA, 18 nt, Human
ucuaaccucaucuucuuc

SEQ ID NO: 1764511 - RNA, 20 nt, Human
ucuaaccucaucuucuucac

SEQ ID NO: 1764512 - RNA, 18 nt, Human
ucuaaccucgcccucucc

SEQ ID NO: 1764513 - RNA, 13 nt, Human
ucuaaccuggagg

SEQ ID NO: 1764514 - RNA, 18 nt, Human
ucucacuguugcccaggc

SEQ ID NO: 1764515 - RNA, 19 nt, Human
ucucacuguugcccaggcu

SEQ ID NO: 1764516 - RNA, 20 nt, Human
ucucacuguugcccaggcug

SEQ ID NO: 1764517 - RNA, 21 nt, Human
ucucacuguugcccaggcugg

SEQ ID NO: 1764518 - RNA, 18 nt, Human
ucucacucugucgcccag

SEQ ID NO: 1764519 - RNA, 22 nt, Human
ucucacucugucgcccagucug

SEQ ID NO: 1764520 - RNA, 17 nt, Human
ucucacucugucgccca

SEQ ID NO: 1764521 - RNA, 22 nt, Human
ucucaaacucuugaccucaggu

SEQ ID NO: 1764522 - RNA, 13 nt, Human
ucucaaacucuug

SEQ ID NO: 1764523 - RNA, 21 nt, Human
ucucaaacucuugaccucagg

SEQ ID NO: 1764524 - RNA, 16 nt, Human
ucuaguagcugaaaug

SEQ ID NO: 1764525 - RNA, 18 nt, Human
ucuaguagcugaaaugca

SEQ ID NO: 1764526 - RNA, 19 nt, Human
ucuaguagcugaaaugcaa

SEQ ID NO: 1764527 - RNA, 14 nt, Human
ucuaguacuagaaa

SEQ ID NO: 1764528 - RNA, 17 nt, Human
ucgcagagcuuuucaga

SEQ ID NO: 1764529 - RNA, 19 nt, Human
ucgcagagcuuuucagauu

SEQ ID NO: 1764530 - RNA, 18 nt, Human
ucggaacuguccuuuccu

SEQ ID NO: 1764531 - RNA, 19 nt, Human
ucggaacuguccuuuccuu

SEQ ID NO: 1764532 - RNA, 17 nt, Human
ucgcuguugcugaauag

SEQ ID NO: 1764533 - RNA, 15 nt, Human
ucgcuguugcugaau

SEQ ID NO: 1764534 - RNA, 14 nt, Human
ucgcuguugcugaa

SEQ ID NO: 1764535 - RNA, 12 nt, Human
ucgcuguugcug

SEQ ID NO: 1764536 - RNA, 19 nt, Human
ucgcuucccugaaagacug

SEQ ID NO: 1764537 - RNA, 19 nt, Human
uccuuuuuaaccauuccaa

SEQ ID NO: 1764538 - RNA, 21 nt, Human
uccuugcagguggggguugcu

SEQ ID NO: 1764539 - RNA, 20 nt, Human
uccuuggcuuuaugcacauu

SEQ ID NO: 1764540 - RNA, 13 nt, Human
uccuugggcccuu

SEQ ID NO: 1764541 - RNA, 14 nt, Human
uccuugggcccuuu

SEQ ID NO: 1764542 - RNA, 16 nt, Human
uccuugggcccuuuga

SEQ ID NO: 1764543 - RNA, 16 nt, Human
uccuuuuugguuuuua

SEQ ID NO: 1764544 - RNA, 11 nt, Human
uccuuuuuucc

SEQ ID NO: 1764545 - RNA, 12 nt, Human
uccuuuuuuccc

SEQ ID NO: 1764546 - RNA, 22 nt, Human
uccuuuuuucccauaagacaau

SEQ ID NO: 1764547 - RNA, 12 nt, Human
uccuucuguccu

SEQ ID NO: 1764548 - RNA, 19 nt, Human
uccuucuguccuacucugu

SEQ ID NO: 1764549 - RNA, 20 nt, Human
ugaacuggacccuguugcua

SEQ ID NO: 1764550 - RNA, 19 nt, Human
ugaacuggacccuguugcu

SEQ ID NO: 1764551 - RNA, 18 nt, Human
ugaacuggacccuguugc

SEQ ID NO: 1764552 - RNA, 17 nt, Human
ugaacuggacccuguug

SEQ ID NO: 1764553 - RNA, 20 nt, Human
ugaaccacaucuugcucugc

SEQ ID NO: 1764554 - RNA, 21 nt, Human
ugaaccacaucuugcucugcu

SEQ ID NO: 1764555 - RNA, 22 nt, Human
ugaaccacaucuugcucugcug

SEQ ID NO: 1764556 - RNA, 16 nt, Human
ugaacagaagcucuua

SEQ ID NO: 1764557 - RNA, 21 nt, Human
ugaacagaagcucuuacucuu

SEQ ID NO: 1764558 - RNA, 14 nt, Human
ugaacacuuaaauu

SEQ ID NO: 1764559 - RNA, 17 nt, Human
ugaacacuuaaauuaug

SEQ ID NO: 1764560 - RNA, 19 nt, Human
ugaaauggacuuuuguaca

SEQ ID NO: 1764561 - RNA, 17 nt, Human
ugaaggcuaaaaagcaa

SEQ ID NO: 1764562 - RNA, 18 nt, Human
ugaaggcuaaaaagcaac

SEQ ID NO: 1764563 - RNA, 11 nt, Human
ugaaggcuggc

SEQ ID NO: 1764564 - RNA, 12 nt, Human
ugaaggcuggca

SEQ ID NO: 1764565 - RNA, 13 nt, Human
ugaaggcuggcau

SEQ ID NO: 1764566 - RNA, 16 nt, Human
ugaaggcuggcaugau

SEQ ID NO: 1764567 - RNA, 11 nt, Human
ugaaggagccc

SEQ ID NO: 1764568 - RNA, 22 nt, Human
ugaaggagccccauuccuggga

SEQ ID NO: 1764569 - RNA, 23 nt, Human
ugaaggagccccauuccugggaa

SEQ ID NO: 1764570 - RNA, 19 nt, Human
ugaacuggguacuugugga

SEQ ID NO: 1764571 - RNA, 23 nt, Human
ugaacuggacccuguugcuaagc

SEQ ID NO: 1764572 - RNA, 22 nt, Human
ugaacuggacccuguugcuaag

SEQ ID NO: 1764573 - RNA, 21 nt, Human
ugaacuggacccuguugcuaa

SEQ ID NO: 1764574 - RNA, 22 nt, Human
ugaacuuguaaaggaauuuaaa

SEQ ID NO: 1764575 - RNA, 23 nt, Human
ugaacuggguacuuguggacaca

SEQ ID NO: 1764576 - RNA, 16 nt, Human
ugaacuugccucuuuu

SEQ ID NO: 1764577 - RNA, 20 nt, Human
ugaacuugccucuuuuaccu

SEQ ID NO: 1764578 - RNA, 19 nt, Human
ucuuuuguaauaaacuauu

SEQ ID NO: 1764579 - RNA, 12 nt, Human
ucuuuuucuacc

SEQ ID NO: 1764580 - RNA, 17 nt, Human
ucuuucacauuuaaaua

SEQ ID NO: 1764581 - RNA, 23 nt, Human
ugaaaugaggucagagccugcag

SEQ ID NO: 1764582 - RNA, 21 nt, Human
ugaaaugaggucagagccugc

SEQ ID NO: 1764583 - RNA, 22 nt, Human
ugaaaugaggucagagccugca

SEQ ID NO: 1764584 - RNA, 19 nt, Human
ugaaaugaggucagagccu

SEQ ID NO: 1764585 - RNA, 20 nt, Human
ugaaaugaggucagagccug

SEQ ID NO: 1764586 - RNA, 22 nt, Human
ugaaaggagagcaucggccuag

SEQ ID NO: 1764587 - RNA, 14 nt, Human
ugaaaggagcccuu

SEQ ID NO: 1764588 - RNA, 16 nt, Human
ugaaagggcccagaga

SEQ ID NO: 1764589 - RNA, 17 nt, Human
ugaaagggcccagagag

SEQ ID NO: 1764590 - RNA, 18 nt, Human
ugaaagggcccagagagg

SEQ ID NO: 1764591 - RNA, 16 nt, Human
ugaaaagagaaugaug

SEQ ID NO: 1764592 - RNA, 21 nt, Human
ugaaaagagaaugaugcucaa

SEQ ID NO: 1764593 - RNA, 17 nt, Human
ugaaagcugguggcaga

SEQ ID NO: 1764594 - RNA, 13 nt, Human
ucugggacacagu

SEQ ID NO: 1764595 - RNA, 12 nt, Human
ucugggacacag

SEQ ID NO: 1764596 - RNA, 12 nt, Human
ucuguaaaaucu

SEQ ID NO: 1764597 - RNA, 11 nt, Human
ucuguaaaauc

SEQ ID NO: 1764598 - RNA, 17 nt, Human
ucuguaaaaucuuucuu

SEQ ID NO: 1764599 - RNA, 14 nt, Human
ucuguaaaaucuuu

SEQ ID NO: 1764600 - RNA, 13 nt, Human
ucuguaaaaucuu

SEQ ID NO: 1764601 - RNA, 15 nt, Human
ucugcaauuucuacu

SEQ ID NO: 1764602 - RNA, 14 nt, Human
ucuggaggaaaggg

SEQ ID NO: 1764603 - RNA, 18 nt, Human
ucuggaggaaagggagga

SEQ ID NO: 1764604 - RNA, 19 nt, Human
ucuggaggaaagggaggag

SEQ ID NO: 1764605 - RNA, 12 nt, Human
ucuguucagugu

SEQ ID NO: 1764606 - RNA, 14 nt, Human
ucuguuagggccuu

SEQ ID NO: 1764607 - RNA, 13 nt, Human
ucuguucaccuuc

SEQ ID NO: 1764608 - RNA, 16 nt, Human
ucuguucaguguaaau

SEQ ID NO: 1764609 - RNA, 12 nt, Human
ucugugucuugu

SEQ ID NO: 1764610 - RNA, 17 nt, Human
ucuguacgucugacagg

SEQ ID NO: 1764611 - RNA, 14 nt, Human
ucugucccucacag

SEQ ID NO: 1764612 - RNA, 15 nt, Human
ucugucccucacagc

SEQ ID NO: 1764613 - RNA, 15 nt, Human
ucugucccuguuaga

SEQ ID NO: 1764614 - RNA, 19 nt, Human
ucugucccuucugucccuc

SEQ ID NO: 1764615 - RNA, 20 nt, Human
ucugucccuucugucccuca

SEQ ID NO: 1764616 - RNA, 22 nt, Human
ucugucccuucugucccucaca

SEQ ID NO: 1764617 - RNA, 23 nt, Human
ucugucccuucugucccucacag

SEQ ID NO: 1764618 - RNA, 22 nt, Human
ucugugggugauggggaggggc

SEQ ID NO: 1764619 - RNA, 12 nt, Human
ucuugcucugcu

SEQ ID NO: 1764620 - RNA, 13 nt, Human
ucuugcucugcug

SEQ ID NO: 1764621 - RNA, 11 nt, Human
ucuugcucugc

SEQ ID NO: 1764622 - RNA, 13 nt, Human
ucuugaauuuaau

SEQ ID NO: 1764623 - RNA, 21 nt, Human
ucuugaauuuaauaaucugua

SEQ ID NO: 1764624 - RNA, 23 nt, Human
ucuugaauuuaauaaucuguagg

SEQ ID NO: 1764625 - RNA, 15 nt, Human
ucuucuccaggcugu

SEQ ID NO: 1764626 - RNA, 16 nt, Human
ucuugaacuccuggcc

SEQ ID NO: 1764627 - RNA, 17 nt, Human
ucuugaacuccuggccu

SEQ ID NO: 1764628 - RNA, 18 nt, Human
ucuugaacuccuggccuc

SEQ ID NO: 1764629 - RNA, 13 nt, Human
ucuucuccaggcu

SEQ ID NO: 1764630 - RNA, 14 nt, Human
ucuucuccaggcug

SEQ ID NO: 1764631 - RNA, 12 nt, Human
ucuucuccaggc

SEQ ID NO: 1764632 - RNA, 17 nt, Human
ucuuccacaaagaaaau

SEQ ID NO: 1764633 - RNA, 18 nt, Human
ucuuccacaaagaaaauu

SEQ ID NO: 1764634 - RNA, 23 nt, Human
ucuuccacaaagaaaauuccuau

SEQ ID NO: 1764635 - RNA, 14 nt, Human
ugcucaggacucag

SEQ ID NO: 1764636 - RNA, 17 nt, Human
ugcucaggacucagaag

SEQ ID NO: 1764637 - RNA, 23 nt, Human
ugcucaggacucagaagccucug

SEQ ID NO: 1764638 - RNA, 19 nt, Human
ugcuccucuccccagcaag

SEQ ID NO: 1764639 - RNA, 15 nt, Human
ugcucaucauucucu

SEQ ID NO: 1764640 - RNA, 17 nt, Human
ugcucaucauucucugu

SEQ ID NO: 1764641 - RNA, 19 nt, Human
ugcucaucauucucugucu

SEQ ID NO: 1764642 - RNA, 20 nt, Human
ugcucaucauucucugucuc

SEQ ID NO: 1764643 - RNA, 21 nt, Human
ugcucaucauucucugucuca

SEQ ID NO: 1764644 - RNA, 23 nt, Human
ugcucaucauucucugucucauc

SEQ ID NO: 1764645 - RNA, 13 nt, Human
ugcuagcuagcuc

SEQ ID NO: 1764646 - RNA, 19 nt, Human
ugcguccacgagcuguuua

SEQ ID NO: 1764647 - RNA, 20 nt, Human
ugcguaugccaccaacuuac

SEQ ID NO: 1764648 - RNA, 12 nt, Human
ugcuccuugggc

SEQ ID NO: 1764649 - RNA, 14 nt, Human
ugcuccuugggccc

SEQ ID NO: 1764650 - RNA, 15 nt, Human
ugcuccuugggcccu

SEQ ID NO: 1764651 - RNA, 16 nt, Human
ugcuccuugggcccuu

SEQ ID NO: 1764652 - RNA, 18 nt, Human
ugcuccuugggcccuuug

SEQ ID NO: 1764653 - RNA, 19 nt, Human
ugcuccuugggcccuuuga

SEQ ID NO: 1764654 - RNA, 21 nt, Human
ugcuccuugggcccuuugagu

SEQ ID NO: 1764655 - RNA, 21 nt, Human
ugcugaauaggcgaucacaac

SEQ ID NO: 1764656 - RNA, 18 nt, Human
ugcugaauaggcgaucac

SEQ ID NO: 1764657 - RNA, 11 nt, Human
ugcugaauagg

SEQ ID NO: 1764658 - RNA, 23 nt, Human
ugcugaaugccgcgaugggucag

SEQ ID NO: 1764659 - RNA, 22 nt, Human
ugcugcagagaaacuuaagcaa

SEQ ID NO: 1764660 - RNA, 14 nt, Human
ugcugcagcucccu

SEQ ID NO: 1764661 - RNA, 15 nt, Human
ugcugcagcucccug

SEQ ID NO: 1764662 - RNA, 16 nt, Human
ugcugcagcucccugg

SEQ ID NO: 1764663 - RNA, 19 nt, Human
ugcugcagcucccuggcuu

SEQ ID NO: 1764664 - RNA, 21 nt, Human
ugcugcagcucccuggcuucu

SEQ ID NO: 1764665 - RNA, 15 nt, Human
ugcugacagacacag

SEQ ID NO: 1764666 - RNA, 16 nt, Human
ugcugacagacacagg

SEQ ID NO: 1764667 - RNA, 19 nt, Human
ugcugacagacacaggccc

SEQ ID NO: 1764668 - RNA, 21 nt, Human
ugccuuauuagagugucuuuc

SEQ ID NO: 1764669 - RNA, 23 nt, Human
ugccuuauuagagugucuuucca

SEQ ID NO: 1764670 - RNA, 12 nt, Human
ugccuuccagau

SEQ ID NO: 1764671 - RNA, 15 nt, Human
ugccuuccagauccu

SEQ ID NO: 1764672 - RNA, 17 nt, Human
ugccuuccagauccucu

SEQ ID NO: 1764673 - RNA, 20 nt, Human
ugccuuccagauccucucug

SEQ ID NO: 1764674 - RNA, 22 nt, Human
ugccuuccagauccucucuggg

SEQ ID NO: 1764675 - RNA, 14 nt, Human
ugccuuccuccugg

SEQ ID NO: 1764676 - RNA, 15 nt, Human
ugccuuccuccuggg

SEQ ID NO: 1764677 - RNA, 16 nt, Human
ugccuuccuccugggc

SEQ ID NO: 1764678 - RNA, 13 nt, Human
ugcgccuacagga

SEQ ID NO: 1764679 - RNA, 13 nt, Human
ugccuucucacca

SEQ ID NO: 1764680 - RNA, 16 nt, Human
ugccuucucaccagcu

SEQ ID NO: 1764681 - RNA, 17 nt, Human
ugccuucucaccagcug

SEQ ID NO: 1764682 - RNA, 18 nt, Human
ugccuucucaccagcugc

SEQ ID NO: 1764683 - RNA, 19 nt, Human
ugccuucucaccagcugca

SEQ ID NO: 1764684 - RNA, 20 nt, Human
ugccuucucaccagcugcaa

SEQ ID NO: 1764685 - RNA, 21 nt, Human
ugccuucucaccagcugcaaa

SEQ ID NO: 1764686 - RNA, 22 nt, Human
ugccuucucaccagcugcaaag

SEQ ID NO: 1764687 - RNA, 23 nt, Human
ugccuucucaccagcugcaaagu

SEQ ID NO: 1764688 - RNA, 11 nt, Human
ugccuucugug

SEQ ID NO: 1764689 - RNA, 14 nt, Human
ugccuucugugggg

SEQ ID NO: 1764690 - RNA, 22 nt, Human
ugccuucuguggggacuccggc

SEQ ID NO: 1764691 - RNA, 20 nt, Human
ugccuuccuccugggcccuc

SEQ ID NO: 1764692 - RNA, 17 nt, Human
ugccuuccuccugggcc

SEQ ID NO: 1764693 - RNA, 19 nt, Human
ugccuuccuccugggcccu

SEQ ID NO: 1764694 - RNA, 23 nt, Human
ugcccaggcuggcgugcaguggu

SEQ ID NO: 1764695 - RNA, 17 nt, Human
ugccuccccucuccuuc

SEQ ID NO: 1764696 - RNA, 15 nt, Human
ugccuagaggcccca

SEQ ID NO: 1764697 - RNA, 22 nt, Human
ugccugaagucacacagugagu

SEQ ID NO: 1764698 - RNA, 18 nt, Human
ugccugaagucacacagu

SEQ ID NO: 1764699 - RNA, 17 nt, Human
ugccugaagucacacag

SEQ ID NO: 1764700 - RNA, 18 nt, Human
ugccuccccucuccuucc

SEQ ID NO: 1764701 - RNA, 18 nt, Human
ugccauggaacuguuucc

SEQ ID NO: 1764702 - RNA, 20 nt, Human
ugccauggaacuguuuccuu

SEQ ID NO: 1764703 - RNA, 14 nt, Human
ugccauggaagagg

SEQ ID NO: 1764704 - RNA, 16 nt, Human
ugccauggaagaggcu

SEQ ID NO: 1764705 - RNA, 22 nt, Human
ugccauggaagaggcuacaggg

SEQ ID NO: 1764706 - RNA, 23 nt, Human
ugccauggaagaggcuacagggc

SEQ ID NO: 1764707 - RNA, 18 nt, Human
ugccauguaaauccccac

SEQ ID NO: 1764708 - RNA, 20 nt, Human
ugccauguaaauccccacug

SEQ ID NO: 1764709 - RNA, 11 nt, Human
ugccagggcag

SEQ ID NO: 1764710 - RNA, 12 nt, Human
ugccagggcagg

SEQ ID NO: 1764711 - RNA, 13 nt, Human
ugccaccccuaaa

SEQ ID NO: 1764712 - RNA, 20 nt, Human
ugccaccccuaaacuccagg

SEQ ID NO: 1764713 - RNA, 21 nt, Human
ugccaccccuaaacuccaggg

SEQ ID NO: 1764714 - RNA, 24 nt, Human
ugccagguuuuuggucugacccac

SEQ ID NO: 1764715 - RNA, 20 nt, Human
ugcauccagagauucauuuu

SEQ ID NO: 1764716 - RNA, 16 nt, Human
ugcaucauccuugcag

SEQ ID NO: 1764717 - RNA, 13 nt, Human
ugcaugugacucu

SEQ ID NO: 1764718 - RNA, 14 nt, Human
ugcaugugacucug

SEQ ID NO: 1764719 - RNA, 15 nt, Human
ugcaugugacucuga

SEQ ID NO: 1764720 - RNA, 16 nt, Human
ugcaugugacucugaa

SEQ ID NO: 1764721 - RNA, 20 nt, Human
ugcaugugacucugaagcug

SEQ ID NO: 1764722 - RNA, 17 nt, Human
ugcaugugacucugaag

SEQ ID NO: 1764723 - RNA, 16 nt, Human
ugcaggaccugccugu

SEQ ID NO: 1764724 - RNA, 17 nt, Human
ugcaggaccugccugua

SEQ ID NO: 1764725 - RNA, 18 nt, Human
ugcaggaccugccuguag

SEQ ID NO: 1764726 - RNA, 19 nt, Human
ugcaggaccugccuguagc

SEQ ID NO: 1764727 - RNA, 19 nt, Human
ugccaaaaucauuuuaaug

SEQ ID NO: 1764728 - RNA, 17 nt, Human
ugccaaccuauuuugaa

SEQ ID NO: 1764729 - RNA, 23 nt, Human
ugcauuuuguuugguauuguauu

SEQ ID NO: 1764730 - RNA, 21 nt, Human
ugcagccaaguagccucuccu

SEQ ID NO: 1764731 - RNA, 11 nt, Human
ugcagccagag

SEQ ID NO: 1764732 - RNA, 13 nt, Human
ugcagccagaggc

SEQ ID NO: 1764733 - RNA, 14 nt, Human
ugcagccagaggca

SEQ ID NO: 1764734 - RNA, 15 nt, Human
ugcaggaccugccug

SEQ ID NO: 1764735 - RNA, 21 nt, Human
ugcacuugcagacucuacaga

SEQ ID NO: 1764736 - RNA, 16 nt, Human
ugcacuugcagacucu

SEQ ID NO: 1764737 - RNA, 19 nt, Human
ugcacguacacacacauac

SEQ ID NO: 1764738 - RNA, 16 nt, Human
ugcacguacacacaca

SEQ ID NO: 1764739 - RNA, 22 nt, Human
ugcacacuuugccauauuuuca

SEQ ID NO: 1764740 - RNA, 14 nt, Human
ugcacacuuugcca

SEQ ID NO: 1764741 - RNA, 14 nt, Human
ugcacagaagcaca

SEQ ID NO: 1764742 - RNA, 20 nt, Human
ugaaggcuggcaugauccaa

SEQ ID NO: 1764743 - RNA, 18 nt, Human
ugcacagggauucucaca

SEQ ID NO: 1764744 - RNA, 19 nt, Human
ugcacagggauucucacaa

SEQ ID NO: 1764745 - RNA, 15 nt, Human
ugcacaucugugucu

SEQ ID NO: 1764746 - RNA, 16 nt, Human
ugcacaucugugucuu

SEQ ID NO: 1764747 - RNA, 18 nt, Human
ugcacaucugugucuugu

SEQ ID NO: 1764748 - RNA, 19 nt, Human
ugcacaucugugucuuguu

SEQ ID NO: 1764749 - RNA, 23 nt, Human
ugcaccuacccauacacccccuc

SEQ ID NO: 1764750 - RNA, 15 nt, Human
uggaauauuguccau

SEQ ID NO: 1764751 - RNA, 20 nt, Human
uggaauauuguccauugucc

SEQ ID NO: 1764752 - RNA, 15 nt, Human
uggaauguuggauaa

SEQ ID NO: 1764753 - RNA, 16 nt, Human
uggaauguuggauaag

SEQ ID NO: 1764754 - RNA, 21 nt, Human
uggaauguuggauaaggaauu

SEQ ID NO: 1764755 - RNA, 16 nt, Human
uggaaaaauaaacacu

SEQ ID NO: 1764756 - RNA, 13 nt, Human
uggaacuguuucc

SEQ ID NO: 1764757 - RNA, 15 nt, Human
uggaacuguuuccuu

SEQ ID NO: 1764758 - RNA, 14 nt, Human
uggaacuuagccau

SEQ ID NO: 1764759 - RNA, 16 nt, Human
uggaacuuagccauuu

SEQ ID NO: 1764760 - RNA, 21 nt, Human
uggaacuuagccauuuuucaa

SEQ ID NO: 1764761 - RNA, 21 nt, Human
uggaacugcguuaugaagagc

SEQ ID NO: 1764762 - RNA, 15 nt, Human
ugcuucgggcccuuc

SEQ ID NO: 1764763 - RNA, 18 nt, Human
ugcuucgggcccuuccca

SEQ ID NO: 1764764 - RNA, 14 nt, Human
ugcuucuagagcuu

SEQ ID NO: 1764765 - RNA, 16 nt, Human
ugcuucugaauacaaa

SEQ ID NO: 1764766 - RNA, 19 nt, Human
ugcuucuuucuuugggaau

SEQ ID NO: 1764767 - RNA, 14 nt, Human
ugcuuuccaaaccu

SEQ ID NO: 1764768 - RNA, 20 nt, Human
ugcuuuccaaaccuuaucuc

SEQ ID NO: 1764769 - RNA, 16 nt, Human
uggagagggggccugg

SEQ ID NO: 1764770 - RNA, 12 nt, Human
uggacaggcaug

SEQ ID NO: 1764771 - RNA, 16 nt, Human
uggacaggcauguucu

SEQ ID NO: 1764772 - RNA, 17 nt, Human
uggacaggcauguucuc

SEQ ID NO: 1764773 - RNA, 13 nt, Human
uggauacauaaag

SEQ ID NO: 1764774 - RNA, 14 nt, Human
uggauacauaaaga

SEQ ID NO: 1764775 - RNA, 16 nt, Human
uggauacauaaagacu

SEQ ID NO: 1764776 - RNA, 17 nt, Human
uggauacauaaagacua

SEQ ID NO: 1764777 - RNA, 23 nt, Human
uggauagaacaugggauacuuua

SEQ ID NO: 1764778 - RNA, 17 nt, Human
uggaugagcccucagaa

SEQ ID NO: 1764779 - RNA, 20 nt, Human
uggaugauggucuucagccu

SEQ ID NO: 1764780 - RNA, 21 nt, Human
uggaugauggucuucagccuc

SEQ ID NO: 1764781 - RNA, 15 nt, Human
uggaugagcccucag

SEQ ID NO: 1764782 - RNA, 16 nt, Human
uggaggcugccuccca

SEQ ID NO: 1764783 - RNA, 17 nt, Human
uggaggcugccucccaa

SEQ ID NO: 1764784 - RNA, 20 nt, Human
uggaggcugccucccaacag

SEQ ID NO: 1764785 - RNA, 14 nt, Human
uggaggccucaggu

SEQ ID NO: 1764786 - RNA, 17 nt, Human
uggaggccucaggugcu

SEQ ID NO: 1764787 - RNA, 20 nt, Human
uggaggccucaggugcuguc

SEQ ID NO: 1764788 - RNA, 24 nt, Human
uggaggccucaggugcuguccaug

SEQ ID NO: 1764789 - RNA, 23 nt, Human
uggcagcugcgguccacccagga

SEQ ID NO: 1764790 - RNA, 21 nt, Human
uggcagcugcgguccacccag

SEQ ID NO: 1764791 - RNA, 22 nt, Human
uggcagcugcgguccacccagg

SEQ ID NO: 1764792 - RNA, 23 nt, Human
uggcagaaauacagucuuccaca

SEQ ID NO: 1764793 - RNA, 14 nt, Human
uggaugccuggugg

SEQ ID NO: 1764794 - RNA, 15 nt, Human
uggaugccugguggc

SEQ ID NO: 1764795 - RNA, 22 nt, Human
uggaugccgauuucuguaaacu

SEQ ID NO: 1764796 - RNA, 23 nt, Human
uggaugcagugcucgcuguugcu

SEQ ID NO: 1764797 - RNA, 14 nt, Human
uggcagugggagcu

SEQ ID NO: 1764798 - RNA, 15 nt, Human
uggcagugggagcug

SEQ ID NO: 1764799 - RNA, 16 nt, Human
uggcagugggagcugc

SEQ ID NO: 1764800 - RNA, 19 nt, Human
uggcagugggagcugccug

SEQ ID NO: 1764801 - RNA, 20 nt, Human
uggcagugggagcugccugu

SEQ ID NO: 1764802 - RNA, 14 nt, Human
ugggccuccugugu

SEQ ID NO: 1764803 - RNA, 16 nt, Human
ugggccuccugugugu

SEQ ID NO: 1764804 - RNA, 22 nt, Human
ugggccuccugugugugcgccu

SEQ ID NO: 1764805 - RNA, 24 nt, Human
ugggagcugccuguucagcuccag

SEQ ID NO: 1764806 - RNA, 18 nt, Human
ugggcuucaguggcagcu

SEQ ID NO: 1764807 - RNA, 19 nt, Human
ugggcuucaguggcagcug

SEQ ID NO: 1764808 - RNA, 20 nt, Human
ugggcuucaguggcagcugc

SEQ ID NO: 1764809 - RNA, 16 nt, Human
uggggcagcuugaggg

SEQ ID NO: 1764810 - RNA, 21 nt, Human
ugggugucaagagggucugag

SEQ ID NO: 1764811 - RNA, 23 nt, Human
ugggugucaagagggucugagga

SEQ ID NO: 1764812 - RNA, 14 nt, Human
uggguccaugggca

SEQ ID NO: 1764813 - RNA, 17 nt, Human
uggguccaugggcagag

SEQ ID NO: 1764814 - RNA, 12 nt, Human
uggguguccugc

SEQ ID NO: 1764815 - RNA, 13 nt, Human
uggguguccugcc

SEQ ID NO: 1764816 - RNA, 15 nt, Human
uggguguccugccug

SEQ ID NO: 1764817 - RNA, 17 nt, Human
uggguguccugccuguc

SEQ ID NO: 1764818 - RNA, 19 nt, Human
uggguguccugccugucug

SEQ ID NO: 1764819 - RNA, 23 nt, Human
uggguguccugccugucugcccc

SEQ ID NO: 1764820 - RNA, 23 nt, Human
uggguucaagcgauucuucugcu

SEQ ID NO: 1764821 - RNA, 16 nt, Human
uggguucacugcaacc

SEQ ID NO: 1764822 - RNA, 21 nt, Human
uggguucauccuauucuuucg

SEQ ID NO: 1764823 - RNA, 12 nt, Human
uggguauaaaag

SEQ ID NO: 1764824 - RNA, 9 nt, Human
ugggucaga

SEQ ID NO: 1764825 - RNA, 17 nt, Human
ugggucagaacccugcc

SEQ ID NO: 1764826 - RNA, 18 nt, Human
ugggucagaacccugcca

SEQ ID NO: 1764827 - RNA, 19 nt, Human
ugggucagaacccugccau

SEQ ID NO: 1764828 - RNA, 14 nt, Human
ugggucauagaaau

SEQ ID NO: 1764829 - RNA, 16 nt, Human
ugggucauagaaauuc

SEQ ID NO: 1764830 - RNA, 23 nt, Human
ugggagcugccuguucagcucca

SEQ ID NO: 1764831 - RNA, 23 nt, Human
ugggagccgggucugccucuucu

SEQ ID NO: 1764832 - RNA, 14 nt, Human
ugggagccgggucu

SEQ ID NO: 1764833 - RNA, 18 nt, Human
ugggagccgggucugccu

SEQ ID NO: 1764834 - RNA, 23 nt, Human
ugggaccaacccuggggaaggag

SEQ ID NO: 1764835 - RNA, 22 nt, Human
ugggacccacgaaacugcccug

SEQ ID NO: 1764836 - RNA, 14 nt, Human
uggcugggggccuc

SEQ ID NO: 1764837 - RNA, 15 nt, Human
uggcugggggccuca

SEQ ID NO: 1764838 - RNA, 22 nt, Human
uggcgugcaguggugcgaucug

SEQ ID NO: 1764839 - RNA, 15 nt, Human
uggccagaugcacca

SEQ ID NO: 1764840 - RNA, 12 nt, Human
uggcugggggcc

SEQ ID NO: 1764841 - RNA, 16 nt, Human
uuaaauguaaauaauc

SEQ ID NO: 1764842 - RNA, 11 nt, Human
uguuuuucauu

SEQ ID NO: 1764843 - RNA, 11 nt, Human
uuaaggccuga

SEQ ID NO: 1764844 - RNA, 15 nt, Human
uuaaggccugaauca

SEQ ID NO: 1764845 - RNA, 18 nt, Human
uuaaugucacaggcaggu

SEQ ID NO: 1764846 - RNA, 16 nt, Human
uuaauuagugcuaagu

SEQ ID NO: 1764847 - RNA, 20 nt, Human
uuaauuagugcuaaguguga

SEQ ID NO: 1764848 - RNA, 18 nt, Human
uuaauuagugcuaagugu

SEQ ID NO: 1764849 - RNA, 21 nt, Human
uuaauuagugcuaagugugaa

SEQ ID NO: 1764850 - RNA, 17 nt, Human
uuaaugucacaggcagg

SEQ ID NO: 1764851 - RNA, 22 nt, Human
uuaaugucaauucuugccaaau

SEQ ID NO: 1764852 - RNA, 15 nt, Human
uuaauaguaauuugu

SEQ ID NO: 1764853 - RNA, 17 nt, Human
uuaauaguaauuuguaa

SEQ ID NO: 1764854 - RNA, 18 nt, Human
uuaauaguaauuuguaaa

SEQ ID NO: 1764855 - RNA, 19 nt, Human
uuaauaguaauuuguaaag

SEQ ID NO: 1764856 - RNA, 18 nt, Human
uuaauaugcugcaacaaa

SEQ ID NO: 1764857 - RNA, 19 nt, Human
uuaauaugcugcaacaaaa

SEQ ID NO: 1764858 - RNA, 20 nt, Human
uuaauaugcugcaacaaaau

SEQ ID NO: 1764859 - RNA, 22 nt, Human
uuacaugguuaagguaaaguaa

SEQ ID NO: 1764860 - RNA, 15 nt, Human
uguucaguguaaaua

SEQ ID NO: 1764861 - RNA, 16 nt, Human
uguucucugaggacac

SEQ ID NO: 1764862 - RNA, 18 nt, Human
uguucucugaggacacua

SEQ ID NO: 1764863 - RNA, 13 nt, Human
uguucucugggag

SEQ ID NO: 1764864 - RNA, 14 nt, Human
uguucucugggaga

SEQ ID NO: 1764865 - RNA, 15 nt, Human
uguucucugggagaa

SEQ ID NO: 1764866 - RNA, 16 nt, Human
uguucucugggagaaa

SEQ ID NO: 1764867 - RNA, 17 nt, Human
uguucucugggagaaaa

SEQ ID NO: 1764868 - RNA, 23 nt, Human
uguugcugaauaggcgaucacaa

SEQ ID NO: 1764869 - RNA, 14 nt, Human
uguugcugaauagg

SEQ ID NO: 1764870 - RNA, 22 nt, Human
uguugaguuaguuaaguugggu

SEQ ID NO: 1764871 - RNA, 20 nt, Human
uguugagcaugacagccugc

SEQ ID NO: 1764872 - RNA, 16 nt, Human
uguuggaguguuucua

SEQ ID NO: 1764873 - RNA, 11 nt, Human
uguuggauaag

SEQ ID NO: 1764874 - RNA, 21 nt, Human
uguuggauaaggaauuauaga

SEQ ID NO: 1764875 - RNA, 11 nt, Human
uguuggccagg

SEQ ID NO: 1764876 - RNA, 16 nt, Human
uguugcuggaucagga

SEQ ID NO: 1764877 - RNA, 14 nt, Human
uguuggccaggcug

SEQ ID NO: 1764878 - RNA, 21 nt, Human
uguucugagauucaauauuga

SEQ ID NO: 1764879 - RNA, 19 nt, Human
uguuaaacuagcauaucug

SEQ ID NO: 1764880 - RNA, 18 nt, Human
uguuaaacuagcauaucu

SEQ ID NO: 1764881 - RNA, 23 nt, Human
uguuaaacuagcauaucugccuu

SEQ ID NO: 1764882 - RNA, 22 nt, Human
uguuaaacuagcauaucugccu

SEQ ID NO: 1764883 - RNA, 20 nt, Human
uguuaaacuagcauaucugc

SEQ ID NO: 1764884 - RNA, 17 nt, Human
uguguuugucauuagcc

SEQ ID NO: 1764885 - RNA, 14 nt, Human
uguguuugucauua

SEQ ID NO: 1764886 - RNA, 19 nt, Human
uguguuugucauuagccug

SEQ ID NO: 1764887 - RNA, 15 nt, Human
uguucagcuccagcu

SEQ ID NO: 1764888 - RNA, 16 nt, Human
uguucagcuccagcuc

SEQ ID NO: 1764889 - RNA, 18 nt, Human
uguucagcuccagcucac

SEQ ID NO: 1764890 - RNA, 14 nt, Human
uguucagcuccagc

SEQ ID NO: 1764891 - RNA, 16 nt, Human
uguucaauguuuaaug

SEQ ID NO: 1764892 - RNA, 22 nt, Human
uguguguccacgacugucucca

SEQ ID NO: 1764893 - RNA, 12 nt, Human
ugugugauaaau

SEQ ID NO: 1764894 - RNA, 16 nt, Human
uguguguccaaaacug

SEQ ID NO: 1764895 - RNA, 19 nt, Human
uguguguccaaaacugccu

SEQ ID NO: 1764896 - RNA, 21 nt, Human
ugucauuagccugaguagaaa

SEQ ID NO: 1764897 - RNA, 20 nt, Human
ugucauuagccugaguagaa

SEQ ID NO: 1764898 - RNA, 17 nt, Human
ugucauuagccugagua

SEQ ID NO: 1764899 - RNA, 14 nt, Human
ugucauuagccuga

SEQ ID NO: 1764900 - RNA, 13 nt, Human
ugucauuagccug

SEQ ID NO: 1764901 - RNA, 20 nt, Human
ugucauauguagccuucaca

SEQ ID NO: 1764902 - RNA, 23 nt, Human
ugucccaaaaagaaaggagggga

SEQ ID NO: 1764903 - RNA, 14 nt, Human
uguccauuguccaa

SEQ ID NO: 1764904 - RNA, 17 nt, Human
uguccauuguccaaucc

SEQ ID NO: 1764905 - RNA, 18 nt, Human
ugucccauagucccugcc

SEQ ID NO: 1764906 - RNA, 19 nt, Human
ugucccaucuggucauuug

SEQ ID NO: 1764907 - RNA, 20 nt, Human
ugucccaucuggucauuugg

SEQ ID NO: 1764908 - RNA, 19 nt, Human
ugucccauagucccugcca

SEQ ID NO: 1764909 - RNA, 20 nt, Human
ugucccagaggcugccccac

SEQ ID NO: 1764910 - RNA, 20 nt, Human
ugucacguuuuguuuugugc

SEQ ID NO: 1764911 - RNA, 21 nt, Human
uguauuuaacaaaaagugcuu

SEQ ID NO: 1764912 - RNA, 13 nt, Human
uguauuuaccaaa

SEQ ID NO: 1764913 - RNA, 19 nt, Human
uguaucccaugagccucag

SEQ ID NO: 1764914 - RNA, 23 nt, Human
uguaucccaugagccucagcauc

SEQ ID NO: 1764915 - RNA, 13 nt, Human
uguauaaguuauu

SEQ ID NO: 1764916 - RNA, 23 nt, Human
uguauaaguuauuuuuguacaug

SEQ ID NO: 1764917 - RNA, 17 nt, Human
uguacgucugacaggca

SEQ ID NO: 1764918 - RNA, 16 nt, Human
uguacgucugacaggc

SEQ ID NO: 1764919 - RNA, 17 nt, Human
uguagauaauacaguuc

SEQ ID NO: 1764920 - RNA, 18 nt, Human
uguaccugcccccaaucc

SEQ ID NO: 1764921 - RNA, 20 nt, Human
uguaauggagcaucaagcca

SEQ ID NO: 1764922 - RNA, 22 nt, Human
uguaauggagcaucaagccacu

SEQ ID NO: 1764923 - RNA, 19 nt, Human
uguaaccucuucagaggcc

SEQ ID NO: 1764924 - RNA, 16 nt, Human
ugucuuuuuucacuac

SEQ ID NO: 1764925 - RNA, 22 nt, Human
ugucucaaugcucauaacggau

SEQ ID NO: 1764926 - RNA, 19 nt, Human
ugucucaaugcucauaacg

SEQ ID NO: 1764927 - RNA, 17 nt, Human
ugucucaaugcucauaa

SEQ ID NO: 1764928 - RNA, 16 nt, Human
ugucucaaugcucaua

SEQ ID NO: 1764929 - RNA, 15 nt, Human
ugucucaaugcucau

SEQ ID NO: 1764930 - RNA, 14 nt, Human
ugucucaaugcuca

SEQ ID NO: 1764931 - RNA, 21 nt, Human
uguccccaaauccgaaccucc

SEQ ID NO: 1764932 - RNA, 22 nt, Human
uguccccaaauccgaaccuccu

SEQ ID NO: 1764933 - RNA, 14 nt, Human
uguccccaaauccg

SEQ ID NO: 1764934 - RNA, 19 nt, Human
uguccccaaauccgaaccu

SEQ ID NO: 1764935 - RNA, 16 nt, Human
ugucugcagugugccc

SEQ ID NO: 1764936 - RNA, 19 nt, Human
ugucugcagugugcccccc

SEQ ID NO: 1764937 - RNA, 18 nt, Human
ugucugccauguugcccc

SEQ ID NO: 1764938 - RNA, 14 nt, Human
ugucugccccagcc

SEQ ID NO: 1764939 - RNA, 19 nt, Human
ugucugccccagcccagau

SEQ ID NO: 1764940 - RNA, 16 nt, Human
ugugauaaaucaguca

SEQ ID NO: 1764941 - RNA, 21 nt, Human
ugugacaaggauugcuacugu

SEQ ID NO: 1764942 - RNA, 15 nt, Human
uguggacacagcucu

SEQ ID NO: 1764943 - RNA, 16 nt, Human
uguggacacagcucuu

SEQ ID NO: 1764944 - RNA, 21 nt, Human
uguggacuaaaagauauaagu

SEQ ID NO: 1764945 - RNA, 14 nt, Human
uguggacacagcuc

SEQ ID NO: 1764946 - RNA, 13 nt, Human
uguggacacagcu

SEQ ID NO: 1764947 - RNA, 13 nt, Human
uguggggacuccg

SEQ ID NO: 1764948 - RNA, 20 nt, Human
uguggcuccucccagcccau

SEQ ID NO: 1764949 - RNA, 12 nt, Human
uguggggccccu

SEQ ID NO: 1764950 - RNA, 20 nt, Human
uguggggugacgggacucag

SEQ ID NO: 1764951 - RNA, 22 nt, Human
ugugcacaugcacgugugugca

SEQ ID NO: 1764952 - RNA, 13 nt, Human
ugugcaccagggu

SEQ ID NO: 1764953 - RNA, 14 nt, Human
ugugcaccaggguu

SEQ ID NO: 1764954 - RNA, 19 nt, Human
ugugcagccgcugagcgag

SEQ ID NO: 1764955 - RNA, 16 nt, Human
ugugcagguggggaga

SEQ ID NO: 1764956 - RNA, 23 nt, Human
ugugcagguggggagacugggcu

SEQ ID NO: 1764957 - RNA, 19 nt, Human
ugugcuucgggcccuuccc

SEQ ID NO: 1764958 - RNA, 15 nt, Human
ugugcuugaaggccc

SEQ ID NO: 1764959 - RNA, 21 nt, Human
ugugcuucuuucuuugggaau

SEQ ID NO: 1764960 - RNA, 14 nt, Human
ugugcuucuuucuu

SEQ ID NO: 1764961 - RNA, 14 nt, Human
uugaaucuugucuc

SEQ ID NO: 1764962 - RNA, 23 nt, Human
uugaaucuugucucaaugcucau

SEQ ID NO: 1764963 - RNA, 22 nt, Human
uugaaucuugucucaaugcuca

SEQ ID NO: 1764964 - RNA, 20 nt, Human
uugaaucuugucucaaugcu

SEQ ID NO: 1764965 - RNA, 17 nt, Human
uugaaucuugucucaau

SEQ ID NO: 1764966 - RNA, 16 nt, Human
uugaaucuugucucaa

SEQ ID NO: 1764967 - RNA, 15 nt, Human
uugaaucuugucuca

SEQ ID NO: 1764968 - RNA, 19 nt, Human
uucuguccuacucuguguc

SEQ ID NO: 1764969 - RNA, 17 nt, Human
uucuguccuacucugug

SEQ ID NO: 1764970 - RNA, 18 nt, Human
uucuguggggacuccggc

SEQ ID NO: 1764971 - RNA, 16 nt, Human
uucuguggggccccuc

SEQ ID NO: 1764972 - RNA, 19 nt, Human
uucuguggggccccucacc

SEQ ID NO: 1764973 - RNA, 20 nt, Human
uucuguggggccccucaccu

SEQ ID NO: 1764974 - RNA, 22 nt, Human
uucuguggggccccucaccuac

SEQ ID NO: 1764975 - RNA, 23 nt, Human
uucuguggggccccucaccuacu

SEQ ID NO: 1764976 - RNA, 22 nt, Human
uucuguggaugccgauuucugu

SEQ ID NO: 1764977 - RNA, 14 nt, Human
uucugagcauuuaa

SEQ ID NO: 1764978 - RNA, 15 nt, Human
uucuguucuggagga

SEQ ID NO: 1764979 - RNA, 16 nt, Human
uucuguucuggaggaa

SEQ ID NO: 1764980 - RNA, 16 nt, Human
uucuugguugaggaaa

SEQ ID NO: 1764981 - RNA, 22 nt, Human
uucuugguugaggaaacaaaca

SEQ ID NO: 1764982 - RNA, 19 nt, Human
uugaggggagagggaacgg

SEQ ID NO: 1764983 - RNA, 13 nt, Human
uugaggaaaacaa

SEQ ID NO: 1764984 - RNA, 23 nt, Human
uugaggaaaacaagcauucacaa

SEQ ID NO: 1764985 - RNA, 15 nt, Human
uugaccucaggugau

SEQ ID NO: 1764986 - RNA, 16 nt, Human
uugaaugcauuuuguu

SEQ ID NO: 1764987 - RNA, 23 nt, Human
uugaaugcauuuuguuugguauu

SEQ ID NO: 1764988 - RNA, 13 nt, Human
uugaaugcauuuu

SEQ ID NO: 1764989 - RNA, 12 nt, Human
uugaaugcauuu

SEQ ID NO: 1764990 - RNA, 17 nt, Human
uugaccugcauuguaaa

SEQ ID NO: 1764991 - RNA, 19 nt, Human
uugaccugcauuguaaaua

SEQ ID NO: 1764992 - RNA, 22 nt, Human
uugaucuguugcaagccccucu

SEQ ID NO: 1764993 - RNA, 14 nt, Human
uugcaacaggcugg

SEQ ID NO: 1764994 - RNA, 17 nt, Human
uugcaacaggcugggcu

SEQ ID NO: 1764995 - RNA, 16 nt, Human
uugcagacaggcaagc

SEQ ID NO: 1764996 - RNA, 14 nt, Human
uugcaaccucgcug

SEQ ID NO: 1764997 - RNA, 22 nt, Human
uugcagacaggcaagcaccucc

SEQ ID NO: 1764998 - RNA, 23 nt, Human
uugcagguggggguugcuguaua

SEQ ID NO: 1764999 - RNA, 16 nt, Human
uugcagguucauggau

SEQ ID NO: 1765000 - RNA, 14 nt, Human
uuggccaggcuggu

SEQ ID NO: 1765001 - RNA, 24 nt, Human
uuggccaaagccaaagcuaggccu

SEQ ID NO: 1765002 - RNA, 13 nt, Human
uuggcauuccgca

SEQ ID NO: 1765003 - RNA, 18 nt, Human
uuggcugggggccucagu

SEQ ID NO: 1765004 - RNA, 21 nt, Human
uuggcugggggccucagugcc

SEQ ID NO: 1765005 - RNA, 22 nt, Human
uuggcugggggccucagugcca

SEQ ID NO: 1765006 - RNA, 16 nt, Human
uuggguggaugccugg

SEQ ID NO: 1765007 - RNA, 17 nt, Human
uuguacagaauauuucu

SEQ ID NO: 1765008 - RNA, 21 nt, Human
uuguacagaauauuucuauug

SEQ ID NO: 1765009 - RNA, 22 nt, Human
uuguacagaauauuucuauuga

SEQ ID NO: 1765010 - RNA, 21 nt, Human
uuguaaaguugguuggauaag

SEQ ID NO: 1765011 - RNA, 16 nt, Human
uuguaaaggaauuuaa

SEQ ID NO: 1765012 - RNA, 14 nt, Human
uuguagagccaggg

SEQ ID NO: 1765013 - RNA, 15 nt, Human
uuguagagccagggu

SEQ ID NO: 1765014 - RNA, 17 nt, Human
uuguauuagauguucuc

SEQ ID NO: 1765015 - RNA, 16 nt, Human
uuguauuagauguucu

SEQ ID NO: 1765016 - RNA, 15 nt, Human
uuguauuagauguuc

SEQ ID NO: 1765017 - RNA, 13 nt, Human
uuguauuagaugu

SEQ ID NO: 1765018 - RNA, 14 nt, Human
uuguauuacaaauc

SEQ ID NO: 1765019 - RNA, 18 nt, Human
uuguaucgauguuaugua

SEQ ID NO: 1765020 - RNA, 21 nt, Human
uuguaucgauguuauguaaaa

SEQ ID NO: 1765021 - RNA, 19 nt, Human
uugcugccccaucagugcu

SEQ ID NO: 1765022 - RNA, 20 nt, Human
uugcugccccaucagugcuc

SEQ ID NO: 1765023 - RNA, 12 nt, Human
uugcugcagaga

SEQ ID NO: 1765024 - RNA, 21 nt, Human
uugcugcagagaaacuuaagc

SEQ ID NO: 1765025 - RNA, 20 nt, Human
uugccucuuuuaccugcugc

SEQ ID NO: 1765026 - RNA, 21 nt, Human
uugccucuuuuaccugcugcu

SEQ ID NO: 1765027 - RNA, 16 nt, Human
uugccucugccucuga

SEQ ID NO: 1765028 - RNA, 18 nt, Human
uugccucugccucugaca

SEQ ID NO: 1765029 - RNA, 11 nt, Human
uugccucugcc

SEQ ID NO: 1765030 - RNA, 14 nt, Human
uugccucugccucu

SEQ ID NO: 1765031 - RNA, 17 nt, Human
uugccauauugcacaug

SEQ ID NO: 1765032 - RNA, 15 nt, Human
uugccauauugcaca

SEQ ID NO: 1765033 - RNA, 13 nt, Human
uugccauauugca

SEQ ID NO: 1765034 - RNA, 23 nt, Human
uugcccacgcuggagugcaguga

SEQ ID NO: 1765035 - RNA, 23 nt, Human
uugccauauugcacaugucuuaa

SEQ ID NO: 1765036 - RNA, 22 nt, Human
uugccauauugcacaugucuua

SEQ ID NO: 1765037 - RNA, 11 nt, Human
uugcccaggca

SEQ ID NO: 1765038 - RNA, 16 nt, Human
uugcuguauaaguuau

SEQ ID NO: 1765039 - RNA, 17 nt, Human
uuggaaccaugccuucc

SEQ ID NO: 1765040 - RNA, 14 nt, Human
uuggaccagaucua

SEQ ID NO: 1765041 - RNA, 12 nt, Human
uucucugucuca

SEQ ID NO: 1765042 - RNA, 12 nt, Human
uucucugggaga

SEQ ID NO: 1765043 - RNA, 15 nt, Human
uucucugggagaaaa

SEQ ID NO: 1765044 - RNA, 16 nt, Human
uucucugggagaaaau

SEQ ID NO: 1765045 - RNA, 19 nt, Human
uucucugggagaaaaucau

SEQ ID NO: 1765046 - RNA, 20 nt, Human
uucucugggagaaaaucauc

SEQ ID NO: 1765047 - RNA, 23 nt, Human
uucucugggagaaaaucaucaag

SEQ ID NO: 1765048 - RNA, 13 nt, Human
uucucugucucau

SEQ ID NO: 1765049 - RNA, 11 nt, Human
uucuccaggcu

SEQ ID NO: 1765050 - RNA, 13 nt, Human
uucuccacccugc

SEQ ID NO: 1765051 - RNA, 20 nt, Human
uucuccauccacaugggagc

SEQ ID NO: 1765052 - RNA, 14 nt, Human
uucuccagggucag

SEQ ID NO: 1765053 - RNA, 17 nt, Human
uucucuccuguccuccc

SEQ ID NO: 1765054 - RNA, 19 nt, Human
uucucuccuguccucccuc

SEQ ID NO: 1765055 - RNA, 21 nt, Human
uucucuccuguccucccucac

SEQ ID NO: 1765056 - RNA, 22 nt, Human
uucucuccuguccucccucacc

SEQ ID NO: 1765057 - RNA, 19 nt, Human
uucuccaaaaaucugccug

SEQ ID NO: 1765058 - RNA, 21 nt, Human
uucuccaaaaaucugccuggg

SEQ ID NO: 1765059 - RNA, 17 nt, Human
uucuauuucuccuccau

SEQ ID NO: 1765060 - RNA, 19 nt, Human
uucuauuucuccuccaugg

SEQ ID NO: 1765061 - RNA, 14 nt, Human
uucuauugaauucg

SEQ ID NO: 1765062 - RNA, 13 nt, Human
uuccuucucccau

SEQ ID NO: 1765063 - RNA, 15 nt, Human
uuccuucucccaucu

SEQ ID NO: 1765064 - RNA, 20 nt, Human
uuccuucucccaucucuucc

SEQ ID NO: 1765065 - RNA, 14 nt, Human
uuccuuccagccca

SEQ ID NO: 1765066 - RNA, 16 nt, Human
uucccuuguaaacaga

SEQ ID NO: 1765067 - RNA, 20 nt, Human
uuccuccucugacuugggga

SEQ ID NO: 1765068 - RNA, 23 nt, Human
uuccucauaguaugguggcuggg

SEQ ID NO: 1765069 - RNA, 20 nt, Human
uuccuaguucuguagaaaug

SEQ ID NO: 1765070 - RNA, 17 nt, Human
uuccuaguucuguagaa

SEQ ID NO: 1765071 - RNA, 16 nt, Human
uuccuaguucuguaga

SEQ ID NO: 1765072 - RNA, 17 nt, Human
uucauaaguauuucaaa

SEQ ID NO: 1765073 - RNA, 13 nt, Human
uucaguggcagcu

SEQ ID NO: 1765074 - RNA, 13 nt, Human
uucaucuuccugu

SEQ ID NO: 1765075 - RNA, 14 nt, Human
uucaucuuccugug

SEQ ID NO: 1765076 - RNA, 15 nt, Human
uucaucuuccugugu

SEQ ID NO: 1765077 - RNA, 17 nt, Human
uucaucuuccugugucc

SEQ ID NO: 1765078 - RNA, 18 nt, Human
uucaucuuccuguguccu

SEQ ID NO: 1765079 - RNA, 20 nt, Human
uucaucuuccuguguccuga

SEQ ID NO: 1765080 - RNA, 13 nt, Human
uuccauuugcaag

SEQ ID NO: 1765081 - RNA, 17 nt, Human
uuccauuugcaagggaa

SEQ ID NO: 1765082 - RNA, 20 nt, Human
uuccacugucaagaaagagc

SEQ ID NO: 1765083 - RNA, 16 nt, Human
uuccacugagggcagu

SEQ ID NO: 1765084 - RNA, 14 nt, Human
uucauuuucuagau

SEQ ID NO: 1765085 - RNA, 19 nt, Human
uucauuuucuagauacaau

SEQ ID NO: 1765086 - RNA, 20 nt, Human
uucauuuucuagauacaaua

SEQ ID NO: 1765087 - RNA, 21 nt, Human
uucauuuucuagauacaauaa

SEQ ID NO: 1765088 - RNA, 22 nt, Human
uucauuuucuagauacaauaaa

SEQ ID NO: 1765089 - RNA, 15 nt, Human
uuccacugagggcag

SEQ ID NO: 1765090 - RNA, 14 nt, Human
uucauuuuuaaaug

SEQ ID NO: 1765091 - RNA, 16 nt, Human
uucauuuuuaaaugug

SEQ ID NO: 1765092 - RNA, 23 nt, Human
uucagcuccagcucaccagcccc

SEQ ID NO: 1765093 - RNA, 17 nt, Human
uucaccccagggccuga

SEQ ID NO: 1765094 - RNA, 20 nt, Human
uucaccccagggccugagcc

SEQ ID NO: 1765095 - RNA, 22 nt, Human
uucaccccagggccugagccug

SEQ ID NO: 1765096 - RNA, 23 nt, Human
uucagaggcccucgcugccagcu

SEQ ID NO: 1765097 - RNA, 22 nt, Human
uucagaggcccucgcugccagc

SEQ ID NO: 1765098 - RNA, 13 nt, Human
uuauuuuccaaaa

SEQ ID NO: 1765099 - RNA, 21 nt, Human
uucaaauugugugugcucugc

SEQ ID NO: 1765100 - RNA, 14 nt, Human
uucaaauugugugu

SEQ ID NO: 1765101 - RNA, 16 nt, Human
uucaaagccaagaccu

SEQ ID NO: 1765102 - RNA, 21 nt, Human
uucaaagccaagaccucacac

SEQ ID NO: 1765103 - RNA, 13 nt, Human
uucaaagccagcg

SEQ ID NO: 1765104 - RNA, 21 nt, Human
uucaaagccagcguccuccuc

SEQ ID NO: 1765105 - RNA, 12 nt, Human
uucaaagcaauu

SEQ ID NO: 1765106 - RNA, 19 nt, Human
uucaaagcaauugaaaugc

SEQ ID NO: 1765107 - RNA, 22 nt, Human
uucaaagcaauugaaaugcauu

SEQ ID NO: 1765108 - RNA, 18 nt, Human
uucaauucucauuuguca

SEQ ID NO: 1765109 - RNA, 18 nt, Human
uuuagaguuagacuguug

SEQ ID NO: 1765110 - RNA, 17 nt, Human
uuuagaguuagacuguu

SEQ ID NO: 1765111 - RNA, 16 nt, Human
uuuagaguuagacugu

SEQ ID NO: 1765112 - RNA, 14 nt, Human
uuuaugaauauaau

SEQ ID NO: 1765113 - RNA, 18 nt, Human
uuuaugaaagguuuacau

SEQ ID NO: 1765114 - RNA, 19 nt, Human
uuuaugaaagguuuacauu

SEQ ID NO: 1765115 - RNA, 17 nt, Human
uuuauuguguuugucau

SEQ ID NO: 1765116 - RNA, 16 nt, Human
uuuauuguguuuguca

SEQ ID NO: 1765117 - RNA, 22 nt, Human
uuuauuguguuugucauuagcc

SEQ ID NO: 1765118 - RNA, 21 nt, Human
uuuauuguguuugucauuagc

SEQ ID NO: 1765119 - RNA, 13 nt, Human
uuuauucaauaaa

SEQ ID NO: 1765120 - RNA, 12 nt, Human
uuuauugccuuc

SEQ ID NO: 1765121 - RNA, 13 nt, Human
uuuauugccuucu

SEQ ID NO: 1765122 - RNA, 22 nt, Human
uuuauugccuucucaccagcug

SEQ ID NO: 1765123 - RNA, 15 nt, Human
uuuacuuuguguuca

SEQ ID NO: 1765124 - RNA, 19 nt, Human
uuuagaaaaagaacaugca

SEQ ID NO: 1765125 - RNA, 20 nt, Human
uuuagaaaaagaacaugcag

SEQ ID NO: 1765126 - RNA, 21 nt, Human
uuuagaaaaagaacaugcagu

SEQ ID NO: 1765127 - RNA, 22 nt, Human
uuuagaaaaagaacaugcaguu

SEQ ID NO: 1765128 - RNA, 11 nt, Human
uuuagaaaaua

SEQ ID NO: 1765129 - RNA, 13 nt, Human
uuuagaaaauaua

SEQ ID NO: 1765130 - RNA, 14 nt, Human
uuuagaaguagaau

SEQ ID NO: 1765131 - RNA, 15 nt, Human
uuguauuguuucaau

SEQ ID NO: 1765132 - RNA, 14 nt, Human
uuguauucucugag

SEQ ID NO: 1765133 - RNA, 15 nt, Human
uuguauucucugagc

SEQ ID NO: 1765134 - RNA, 16 nt, Human
uuguauucucugagcu

SEQ ID NO: 1765135 - RNA, 20 nt, Human
uuguauucucugagcugugc

SEQ ID NO: 1765136 - RNA, 22 nt, Human
uuguauucucugagcugugcag

SEQ ID NO: 1765137 - RNA, 20 nt, Human
uuguauuuauucaauaaagu

SEQ ID NO: 1765138 - RNA, 16 nt, Human
uuguauuuauucaaua

SEQ ID NO: 1765139 - RNA, 15 nt, Human
uuguauuuauucaau

SEQ ID NO: 1765140 - RNA, 14 nt, Human
uuguauuuauucaa

SEQ ID NO: 1765141 - RNA, 16 nt, Human
uuguauuguuucaauu

SEQ ID NO: 1765142 - RNA, 22 nt, Human
uuuaauccccaguaaaauugcc

SEQ ID NO: 1765143 - RNA, 16 nt, Human
uuuaauccccaguaaa

SEQ ID NO: 1765144 - RNA, 15 nt, Human
uuuaauccccaguaa

SEQ ID NO: 1765145 - RNA, 16 nt, Human
uuuccaaaccuuaucu

SEQ ID NO: 1765146 - RNA, 24 nt, Human
uuuccaaaaguggccucuuugucu

SEQ ID NO: 1765147 - RNA, 15 nt, Human
uuucagcagcugcag

SEQ ID NO: 1765148 - RNA, 13 nt, Human
uuuauuugguucc

SEQ ID NO: 1765149 - RNA, 14 nt, Human
uuuauuugcuucuu

SEQ ID NO: 1765150 - RNA, 21 nt, Human
uuucuaauaaacuuggauucu

SEQ ID NO: 1765151 - RNA, 15 nt, Human
uuucuagauacaaua

SEQ ID NO: 1765152 - RNA, 16 nt, Human
uuucuagauacaauaa

SEQ ID NO: 1765153 - RNA, 17 nt, Human
uuucuagauacaauaaa

SEQ ID NO: 1765154 - RNA, 18 nt, Human
uuucuagauacaauaaau

SEQ ID NO: 1765155 - RNA, 20 nt, Human
uuucuagauacaauaaauug

SEQ ID NO: 1765156 - RNA, 23 nt, Human
uuucuagauacaauaaauugcua

SEQ ID NO: 1765157 - RNA, 14 nt, Human
uuucuccuccaugg

SEQ ID NO: 1765158 - RNA, 16 nt, Human
uuuccuauuucagugu

SEQ ID NO: 1765159 - RNA, 17 nt, Human
uuuccucuuccugccua

SEQ ID NO: 1765160 - RNA, 15 nt, Human
uuuccuaugcuauug

SEQ ID NO: 1765161 - RNA, 21 nt, Human
uuuccuaguucuguagaaaug

SEQ ID NO: 1765162 - RNA, 20 nt, Human
uuuccuacuuauaaaguaga

SEQ ID NO: 1765163 - RNA, 13 nt, Human
uuuuaugcauguu

SEQ ID NO: 1765164 - RNA, 13 nt, Human
uuuucaacuuuga

SEQ ID NO: 1765165 - RNA, 15 nt, Human
uuuucaacuuugaau

SEQ ID NO: 1765166 - RNA, 16 nt, Human
uuuucaacuuugaaua

SEQ ID NO: 1765167 - RNA, 18 nt, Human
uuuucaacuuugaauaaa

SEQ ID NO: 1765168 - RNA, 21 nt, Human
uuuucaacuuugaauaaagaa

SEQ ID NO: 1765169 - RNA, 24 nt, Human
uuuucaacuuugaauaaagaauac

SEQ ID NO: 1765170 - RNA, 14 nt, Human
uuuucacuuaugaa

SEQ ID NO: 1765171 - RNA, 18 nt, Human
uuuuccauuaugcuguag

SEQ ID NO: 1765172 - RNA, 15 nt, Human
uuuuccuaugcuauu

SEQ ID NO: 1765173 - RNA, 19 nt, Human
uuuuccuaugcuauugaca

SEQ ID NO: 1765174 - RNA, 20 nt, Human
uuuuccuaugcuauugacaa

SEQ ID NO: 1765175 - RNA, 14 nt, Human
uuuucgccuuuccu

SEQ ID NO: 1765176 - RNA, 17 nt, Human
uuuguuuauuaaauagu

SEQ ID NO: 1765177 - RNA, 18 nt, Human
uuugguuaaaaaaaagaa

SEQ ID NO: 1765178 - RNA, 13 nt, Human
uuuggaauaaagu

SEQ ID NO: 1765179 - RNA, 19 nt, Human
uuugucaauuuaugaauau

SEQ ID NO: 1765180 - RNA, 23 nt, Human
uuugucauuagccugaguagaaa

SEQ ID NO: 1765181 - RNA, 20 nt, Human
uuugucauuagccugaguag

SEQ ID NO: 1765182 - RNA, 13 nt, Human
uuugucauaucaa

SEQ ID NO: 1765183 - RNA, 20 nt, Human
uuuguguuguuggaaaaagu

SEQ ID NO: 1765184 - RNA, 21 nt, Human
uuuguguuguuggaaaaaguc

SEQ ID NO: 1765185 - RNA, 16 nt, Human
uuuguuauuuugcaac

SEQ ID NO: 1765186 - RNA, 14 nt, Human
uuucuuagaaauuu

SEQ ID NO: 1765187 - RNA, 22 nt, Human
uuucuuagaaauuuauuuccua

SEQ ID NO: 1765188 - RNA, 15 nt, Human
uuugagcagggcuca

SEQ ID NO: 1765189 - RNA, 16 nt, Human
uuugagcauggguuca

SEQ ID NO: 1765190 - RNA, 17 nt, Human
uuucugagugccuucug

SEQ ID NO: 1765191 - RNA, 14 nt, Human
uuugcagacaggca

SEQ ID NO: 1765192 - RNA, 18 nt, Human
uuugccauguuggccagg

SEQ ID NO: 1765193 - RNA, 15 nt, Human
uuuggaagcucuucu

SEQ ID NO: 1765194 - RNA, 23 nt, Human
uuuuuuagaaagcauuugaaugc

SEQ ID NO: 1765195 - RNA, 12 nt, Human
uuuuucugccuc

SEQ ID NO: 1765196 - RNA, 13 nt, Human
uuuuucugccucc

SEQ ID NO: 1765197 - RNA, 14 nt, Human
uuuuucugccuccu

SEQ ID NO: 1765198 - RNA, 15 nt, Human
cugacagacacaggc

SEQ ID NO: 1765199 - RNA, 12 nt, Human
cugacagacaca

SEQ ID NO: 1765200 - RNA, 14 nt, Human
cugacagacacagg

SEQ ID NO: 1765201 - RNA, 23 nt, Human
cucuuagaggaaggagauaggga

SEQ ID NO: 1765202 - RNA, 17 nt, Human
cugaaaacacugugcac

SEQ ID NO: 1765203 - RNA, 19 nt, Human
cugaaggacauugcggaca

SEQ ID NO: 1765204 - RNA, 20 nt, Human
cugaaggacauugcggacag

SEQ ID NO: 1765205 - RNA, 21 nt, Human
cugaaggacauugcggacagc

SEQ ID NO: 1765206 - RNA, 22 nt, Human
cucugcgugucaccugugcuuc

SEQ ID NO: 1765207 - RNA, 17 nt, Human
cucugcugacagacaca

SEQ ID NO: 1765208 - RNA, 18 nt, Human
cucugcugacagacacag

SEQ ID NO: 1765209 - RNA, 19 nt, Human
cucugcugacagacacagg

SEQ ID NO: 1765210 - RNA, 20 nt, Human
cucugcugacagacacaggc

SEQ ID NO: 1765211 - RNA, 22 nt, Human
cucuguaucaggacccagagga

SEQ ID NO: 1765212 - RNA, 13 nt, Human
cuccguccauauc

SEQ ID NO: 1765213 - RNA, 23 nt, Human
cuccguccauaucagaacugugc

SEQ ID NO: 1765214 - RNA, 19 nt, Human
cucggcuuuucucagcugg

SEQ ID NO: 1765215 - RNA, 15 nt, Human
cucugaaggacauug

SEQ ID NO: 1765216 - RNA, 19 nt, Human
cuccgcuuucuacccagcg

SEQ ID NO: 1765217 - RNA, 12 nt, Human
cucccaccucag

SEQ ID NO: 1765218 - RNA, 13 nt, Human
cucccaccucagc

SEQ ID NO: 1765219 - RNA, 13 nt, Human
cuccagugaaacu

SEQ ID NO: 1765220 - RNA, 24 nt, Human
cuccccuccggacuggugcccucc

SEQ ID NO: 1765221 - RNA, 14 nt, Human
cucccugacuuuuc

SEQ ID NO: 1765222 - RNA, 16 nt, Human
cucccugacuuuucug

SEQ ID NO: 1765223 - RNA, 21 nt, Human
cuccagggucagaaacaggac

SEQ ID NO: 1765224 - RNA, 19 nt, Human
cuccaggggggacaauaug

SEQ ID NO: 1765225 - RNA, 20 nt, Human
cuccagggguccuaggccuc

SEQ ID NO: 1765226 - RNA, 22 nt, Human
cuccagggguccuaggccucaa

SEQ ID NO: 1765227 - RNA, 20 nt, Human
cuccagggucagaaacagga

SEQ ID NO: 1765228 - RNA, 14 nt, Human
cucagucucugagc

SEQ ID NO: 1765229 - RNA, 20 nt, Human
cucagucucugagcagugaa

SEQ ID NO: 1765230 - RNA, 13 nt, Human
cucagugccacua

SEQ ID NO: 1765231 - RNA, 17 nt, Human
cucaucuucuucaccau

SEQ ID NO: 1765232 - RNA, 13 nt, Human
cucagucucugag

SEQ ID NO: 1765233 - RNA, 22 nt, Human
cucagccucccaaagugcuggg

SEQ ID NO: 1765234 - RNA, 13 nt, Human
cucagccucccga

SEQ ID NO: 1765235 - RNA, 23 nt, Human
cucagccucccgaauagcuggga

SEQ ID NO: 1765236 - RNA, 21 nt, Human
cucagccucccaaagugcugg

SEQ ID NO: 1765237 - RNA, 14 nt, Human
cucagccucccaaa

SEQ ID NO: 1765238 - RNA, 16 nt, Human
cucagccucccaaagu

SEQ ID NO: 1765239 - RNA, 13 nt, Human
cucagccucccaa

SEQ ID NO: 1765240 - RNA, 13 nt, Human
cucagcggggaca

SEQ ID NO: 1765241 - RNA, 14 nt, Human
cucagcgcggcccu

SEQ ID NO: 1765242 - RNA, 16 nt, Human
cucagcgcggcccucc

SEQ ID NO: 1765243 - RNA, 20 nt, Human
cggcucugugggugaugggg

SEQ ID NO: 1765244 - RNA, 22 nt, Human
cggcucugugggugauggggag

SEQ ID NO: 1765245 - RNA, 15 nt, Human
cgugguaugucugcc

SEQ ID NO: 1765246 - RNA, 16 nt, Human
cgugguaugucugcca

SEQ ID NO: 1765247 - RNA, 17 nt, Human
cgugguaugucugccau

SEQ ID NO: 1765248 - RNA, 16 nt, Human
cguggucccugaggau

SEQ ID NO: 1765249 - RNA, 14 nt, Human
cuaagucuuuccau

SEQ ID NO: 1765250 - RNA, 16 nt, Human
cuaagucuuuccauug

SEQ ID NO: 1765251 - RNA, 20 nt, Human
cuaagugauccucccaccuc

SEQ ID NO: 1765252 - RNA, 22 nt, Human
cuaagugauccucccaccucag

SEQ ID NO: 1765253 - RNA, 23 nt, Human
cuaauuuuuaagaaauuuugccu

SEQ ID NO: 1765254 - RNA, 17 nt, Human
cuaauuuuuaagcaaaa

SEQ ID NO: 1765255 - RNA, 19 nt, Human
cuaccugacacucccuugg

SEQ ID NO: 1765256 - RNA, 20 nt, Human
cuaccugacacucccuuggg

SEQ ID NO: 1765257 - RNA, 15 nt, Human
cuagccgguuccugu

SEQ ID NO: 1765258 - RNA, 16 nt, Human
cuagccgguuccuguc

SEQ ID NO: 1765259 - RNA, 19 nt, Human
cuagccgguuccugucccu

SEQ ID NO: 1765260 - RNA, 13 nt, Human
cuagggaucccuc

SEQ ID NO: 1765261 - RNA, 17 nt, Human
cuagggaucccucaucu

SEQ ID NO: 1765262 - RNA, 23 nt, Human
cuagggaucccucaucugucccu

SEQ ID NO: 1765263 - RNA, 16 nt, Human
cuagggccaagcccag

SEQ ID NO: 1765264 - RNA, 17 nt, Human
cuagggccaagcccagc

SEQ ID NO: 1765265 - RNA, 18 nt, Human
cuagggccaagcccagca

SEQ ID NO: 1765266 - RNA, 16 nt, Human
cuaguucuguagaaau

SEQ ID NO: 1765267 - RNA, 23 nt, Human
cuaguucuguagaaaugguugua

SEQ ID NO: 1765268 - RNA, 17 nt, Human
cuaguucuguagaaaug

SEQ ID NO: 1765269 - RNA, 22 nt, Human
cuauaaaucaacaccuuaauau

SEQ ID NO: 1765270 - RNA, 23 nt, Human
cuauaagauuccaaaaagcacau

SEQ ID NO: 1765271 - RNA, 14 nt, Human
cgccuacaggagug

SEQ ID NO: 1765272 - RNA, 13 nt, Human
cgaguagcuggga

SEQ ID NO: 1765273 - RNA, 14 nt, Human
cgaguagcugggac

SEQ ID NO: 1765274 - RNA, 15 nt, Human
cgaguagcugggacu

SEQ ID NO: 1765275 - RNA, 16 nt, Human
cgaguagcugggacua

SEQ ID NO: 1765276 - RNA, 14 nt, Human
cggagucccaccuu

SEQ ID NO: 1765277 - RNA, 19 nt, Human
cggcucacugcagccucaa

SEQ ID NO: 1765278 - RNA, 18 nt, Human
cggcucacugcagccuca

SEQ ID NO: 1765279 - RNA, 11 nt, Human
cggagccacuc

SEQ ID NO: 1765280 - RNA, 13 nt, Human
cggagccacuccu

SEQ ID NO: 1765281 - RNA, 17 nt, Human
cggagccacuccucuga

SEQ ID NO: 1765282 - RNA, 18 nt, Human
cggagccacuccucugac

SEQ ID NO: 1765283 - RNA, 21 nt, Human
cggagccacuccucugacuca

SEQ ID NO: 1765284 - RNA, 16 nt, Human
ccuucuggaaacugug

SEQ ID NO: 1765285 - RNA, 19 nt, Human
ccuucuggaaacugugaag

SEQ ID NO: 1765286 - RNA, 13 nt, Human
ccuggccugagag

SEQ ID NO: 1765287 - RNA, 16 nt, Human
ccuggccugagaguca

SEQ ID NO: 1765288 - RNA, 19 nt, Human
ccuucugucccucacagca

SEQ ID NO: 1765289 - RNA, 18 nt, Human
ccuucugucccucacagc

SEQ ID NO: 1765290 - RNA, 14 nt, Human
ccuuuagcgcccag

SEQ ID NO: 1765291 - RNA, 20 nt, Human
ccuuuagcgcccaguugggu

SEQ ID NO: 1765292 - RNA, 18 nt, Human
ccuuuaggguucugccuc

SEQ ID NO: 1765293 - RNA, 19 nt, Human
ccuuuaggguucugccucu

SEQ ID NO: 1765294 - RNA, 13 nt, Human
ccuugcuuuugcu

SEQ ID NO: 1765295 - RNA, 15 nt, Human
ccuugcuuuugcuuc

SEQ ID NO: 1765296 - RNA, 16 nt, Human
ccuugcuuuugcuucu

SEQ ID NO: 1765297 - RNA, 17 nt, Human
ccuugcuuuugcuucua

SEQ ID NO: 1765298 - RNA, 18 nt, Human
ccuugcuuuugcuucuag

SEQ ID NO: 1765299 - RNA, 21 nt, Human
ccuugcuuuugcuucuagagc

SEQ ID NO: 1765300 - RNA, 19 nt, Human
ccuuucccaggugcuacac

SEQ ID NO: 1765301 - RNA, 17 nt, Human
ccuuuucgccuuuccuc

SEQ ID NO: 1765302 - RNA, 19 nt, Human
ccuuuucgccuuuccucuc

SEQ ID NO: 1765303 - RNA, 21 nt, Human
ccuuuugaaauuaaccucuca

SEQ ID NO: 1765304 - RNA, 19 nt, Human
ccuuuucuuuguucaagau

SEQ ID NO: 1765305 - RNA, 23 nt, Human
cgaccagacaccuugacagggca

SEQ ID NO: 1765306 - RNA, 12 nt, Human
ccuuuuggggga

SEQ ID NO: 1765307 - RNA, 23 nt, Human
ccagaugcaccagcccuuagcag

SEQ ID NO: 1765308 - RNA, 18 nt, Human
ccagaugcaccagcccuu

SEQ ID NO: 1765309 - RNA, 17 nt, Human
ccagaugcaccagcccu

SEQ ID NO: 1765310 - RNA, 15 nt, Human
ccagaugcaccagcc

SEQ ID NO: 1765311 - RNA, 16 nt, Human
ccaccuuggcucaagu

SEQ ID NO: 1765312 - RNA, 13 nt, Human
ccagaucccaggc

SEQ ID NO: 1765313 - RNA, 18 nt, Human
ccagaucccaggccccug

SEQ ID NO: 1765314 - RNA, 19 nt, Human
ccagaucccaggccccugg

SEQ ID NO: 1765315 - RNA, 22 nt, Human
ccagaucccaggccccuggagg

SEQ ID NO: 1765316 - RNA, 16 nt, Human
ccagauccucucuggg

SEQ ID NO: 1765317 - RNA, 15 nt, Human
ccagcucaccagccc

SEQ ID NO: 1765318 - RNA, 16 nt, Human
ccagcucaccagcccc

SEQ ID NO: 1765319 - RNA, 22 nt, Human
ccagcucaccagccccagugcc

SEQ ID NO: 1765320 - RNA, 24 nt, Human
ccagcagcggaaccgcccaggauc

SEQ ID NO: 1765321 - RNA, 15 nt, Human
ccagcagcagcccaa

SEQ ID NO: 1765322 - RNA, 23 nt, Human
ccagcagcagcccaagcuucccu

SEQ ID NO: 1765323 - RNA, 20 nt, Human
ccaggcuccuuuagcgccca

SEQ ID NO: 1765324 - RNA, 21 nt, Human
ccaggcuccuuuagcgcccag

SEQ ID NO: 1765325 - RNA, 19 nt, Human
ccaggcuggcgugcagugg

SEQ ID NO: 1765326 - RNA, 17 nt, Human
ccaggcuggcgugcagu

SEQ ID NO: 1765327 - RNA, 18 nt, Human
ccaggcuggcgugcagug

SEQ ID NO: 1765328 - RNA, 10 nt, Human
ccagggucag

SEQ ID NO: 1765329 - RNA, 17 nt, Human
ccagggucagaaacagg

SEQ ID NO: 1765330 - RNA, 18 nt, Human
ccagggucagaaacagga

SEQ ID NO: 1765331 - RNA, 19 nt, Human
ccagggucagaaacaggac

SEQ ID NO: 1765332 - RNA, 17 nt, Human
ccaguuggguggaugcc

SEQ ID NO: 1765333 - RNA, 19 nt, Human
ccaguuggguggaugccug

SEQ ID NO: 1765334 - RNA, 20 nt, Human
ccaguuggguggaugccugg

SEQ ID NO: 1765335 - RNA, 21 nt, Human
ccaugagccucagcauccugg

SEQ ID NO: 1765336 - RNA, 23 nt, Human
ccaugagccucagcauccuggca

SEQ ID NO: 1765337 - RNA, 18 nt, Human
ccauggugugaucgucug

SEQ ID NO: 1765338 - RNA, 19 nt, Human
ccauggugugaucgucuga

SEQ ID NO: 1765339 - RNA, 23 nt, Human
ccauguaaauccccacugggacc

SEQ ID NO: 1765340 - RNA, 22 nt, Human
cccacugcuuuuggucugugug

SEQ ID NO: 1765341 - RNA, 19 nt, Human
cccacugcuuuuggucugu

SEQ ID NO: 1765342 - RNA, 12 nt, Human
cccacugcucug

SEQ ID NO: 1765343 - RNA, 13 nt, Human
cccacugcucugg

SEQ ID NO: 1765344 - RNA, 18 nt, Human
cccacucagcuccgugaa

SEQ ID NO: 1765345 - RNA, 16 nt, Human
cccaggaaaggcccag

SEQ ID NO: 1765346 - RNA, 13 nt, Human
cccaggcuggcgu

SEQ ID NO: 1765347 - RNA, 17 nt, Human
cccaggcuggcgugcag

SEQ ID NO: 1765348 - RNA, 15 nt, Human
cccauagucccugcc

SEQ ID NO: 1765349 - RNA, 20 nt, Human
cccauagauacucucuucuu

SEQ ID NO: 1765350 - RNA, 13 nt, Human
cccagggccugag

SEQ ID NO: 1765351 - RNA, 15 nt, Human
cccagggccugagcc

SEQ ID NO: 1765352 - RNA, 19 nt, Human
cccagggccugagccuggc

SEQ ID NO: 1765353 - RNA, 14 nt, Human
cccagggccugcag

SEQ ID NO: 1765354 - RNA, 16 nt, Human
cccagggccugcagga

SEQ ID NO: 1765355 - RNA, 19 nt, Human
cccagggccugcaggaccu

SEQ ID NO: 1765356 - RNA, 12 nt, Human
ccccucugucca

SEQ ID NO: 1765357 - RNA, 14 nt, Human
cccgaauagcuggg

SEQ ID NO: 1765358 - RNA, 14 nt, Human
ccccucuguccagg

SEQ ID NO: 1765359 - RNA, 22 nt, Human
ccccucuguccaggcacugaga

SEQ ID NO: 1765360 - RNA, 14 nt, Human
ccccucuucugagc

SEQ ID NO: 1765361 - RNA, 13 nt, Human
ccccuuuccuguc

SEQ ID NO: 1765362 - RNA, 12 nt, Human
cccggcuccagg

SEQ ID NO: 1765363 - RNA, 13 nt, Human
cccggcuccaggc

SEQ ID NO: 1765364 - RNA, 14 nt, Human
cccggcuccaggcu

SEQ ID NO: 1765365 - RNA, 15 nt, Human
cccggcuccaggcuc

SEQ ID NO: 1765366 - RNA, 16 nt, Human
cccggcuccaggcucc

SEQ ID NO: 1765367 - RNA, 18 nt, Human
cccgggacgcagcaggag

SEQ ID NO: 1765368 - RNA, 16 nt, Human
cccggcucugugggug

SEQ ID NO: 1765369 - RNA, 22 nt, Human
cccggcucugugggugaugggg

SEQ ID NO: 1765370 - RNA, 20 nt, Human
ccccuuuacccucuuugcug

SEQ ID NO: 1765371 - RNA, 23 nt, Human
ccccgaggccuucucugaaggac

SEQ ID NO: 1765372 - RNA, 15 nt, Human
ccccggagggcugcg

SEQ ID NO: 1765373 - RNA, 19 nt, Human
ccccaucuccccucagcuc

SEQ ID NO: 1765374 - RNA, 22 nt, Human
ccccaucucgcucccucccagg

SEQ ID NO: 1765375 - RNA, 22 nt, Human
ccccagcaagugagagcugggu

SEQ ID NO: 1765376 - RNA, 22 nt, Human
ccccagcaagugguccuagagg

SEQ ID NO: 1765377 - RNA, 14 nt, Human
ccugcccaggcccc

SEQ ID NO: 1765378 - RNA, 15 nt, Human
ccugcccaggccccu

SEQ ID NO: 1765379 - RNA, 16 nt, Human
ccugcccaggccccug

SEQ ID NO: 1765380 - RNA, 18 nt, Human
ccugcccaggccccugcc

SEQ ID NO: 1765381 - RNA, 16 nt, Human
ccuggaggcugccucc

SEQ ID NO: 1765382 - RNA, 17 nt, Human
ccuggaggcugccuccc

SEQ ID NO: 1765383 - RNA, 18 nt, Human
ccuggaggcugccuccca

SEQ ID NO: 1765384 - RNA, 19 nt, Human
ccuggaggcugccucccaa

SEQ ID NO: 1765385 - RNA, 21 nt, Human
ccuggaggcugccucccaaca

SEQ ID NO: 1765386 - RNA, 18 nt, Human
ccuggcacccggccccug

SEQ ID NO: 1765387 - RNA, 13 nt, Human
ccucuuggguuca

SEQ ID NO: 1765388 - RNA, 19 nt, Human
ccucuuuagaguuagacug

SEQ ID NO: 1765389 - RNA, 17 nt, Human
ccucuuuagaguuagac

SEQ ID NO: 1765390 - RNA, 12 nt, Human
ccucuuuagagu

SEQ ID NO: 1765391 - RNA, 13 nt, Human
ccugacugcucag

SEQ ID NO: 1765392 - RNA, 14 nt, Human
ccugacugcucaga

SEQ ID NO: 1765393 - RNA, 13 nt, Human
ccugacuuuucug

SEQ ID NO: 1765394 - RNA, 18 nt, Human
ccugacuuuucuguggau

SEQ ID NO: 1765395 - RNA, 22 nt, Human
ccugcacuugcagacucuacag

SEQ ID NO: 1765396 - RNA, 22 nt, Human
ccugcagaaguaagccucauca

SEQ ID NO: 1765397 - RNA, 20 nt, Human
ccugaguagaaaggccuuua

SEQ ID NO: 1765398 - RNA, 14 nt, Human
ccugaguagaaagg

SEQ ID NO: 1765399 - RNA, 21 nt, Human
ccugaguagaaaggccuuuaa

SEQ ID NO: 1765400 - RNA, 15 nt, Human
ccugagagucagcuc

SEQ ID NO: 1765401 - RNA, 20 nt, Human
ccugagagucagcucucugc

SEQ ID NO: 1765402 - RNA, 22 nt, Human
ccugagagucagcucucugccc

SEQ ID NO: 1765403 - RNA, 23 nt, Human
ccugagagucagcucucugcccu

SEQ ID NO: 1765404 - RNA, 15 nt, Human
ccugcaggaccugcc

SEQ ID NO: 1765405 - RNA, 16 nt, Human
ccugcaggaccugccu

SEQ ID NO: 1765406 - RNA, 17 nt, Human
ccugcaggaccugccug

SEQ ID NO: 1765407 - RNA, 18 nt, Human
ccugcaggaccugccugu

SEQ ID NO: 1765408 - RNA, 22 nt, Human
ccucugccugaagucacacagu

SEQ ID NO: 1765409 - RNA, 16 nt, Human
cccuucgcuccugugu

SEQ ID NO: 1765410 - RNA, 18 nt, Human
cccuucgcuccugugucu

SEQ ID NO: 1765411 - RNA, 21 nt, Human
ccgacccaggguucccgcggg

SEQ ID NO: 1765412 - RNA, 20 nt, Human
ccgccagggagaccuggaca

SEQ ID NO: 1765413 - RNA, 20 nt, Human
ccgaauagcugggacuacag

SEQ ID NO: 1765414 - RNA, 16 nt, Human
cccuucugucccucac

SEQ ID NO: 1765415 - RNA, 17 nt, Human
cccuucugucccucaca

SEQ ID NO: 1765416 - RNA, 23 nt, Human
ccgaaucucuuuuugcuuucgaa

SEQ ID NO: 1765417 - RNA, 20 nt, Human
ccgaauguugagguggacuc

SEQ ID NO: 1765418 - RNA, 14 nt, Human
cccugcccuguggg

SEQ ID NO: 1765419 - RNA, 12 nt, Human
cccugcccugug

SEQ ID NO: 1765420 - RNA, 13 nt, Human
cccugcccugugg

SEQ ID NO: 1765421 - RNA, 17 nt, Human
cccucacccccuccuuc

SEQ ID NO: 1765422 - RNA, 13 nt, Human
cccuggcuucugu

SEQ ID NO: 1765423 - RNA, 14 nt, Human
cccuggcuucugug

SEQ ID NO: 1765424 - RNA, 15 nt, Human
cccuggcuucugugg

SEQ ID NO: 1765425 - RNA, 17 nt, Human
cccuggcuucugugggg

SEQ ID NO: 1765426 - RNA, 22 nt, Human
cccuggcuucuguggggccccu

SEQ ID NO: 1765427 - RNA, 20 nt, Human
cccuauuuuucucuccuguc

SEQ ID NO: 1765428 - RNA, 19 nt, Human
ccuauuucaguguuaccug

SEQ ID NO: 1765429 - RNA, 23 nt, Human
ccuauuucaguguuaccugugug

SEQ ID NO: 1765430 - RNA, 16 nt, Human
ccucaacuccucccau

SEQ ID NO: 1765431 - RNA, 17 nt, Human
ccucaacuccucccaua

SEQ ID NO: 1765432 - RNA, 15 nt, Human
ccuauuuuuaaauaa

SEQ ID NO: 1765433 - RNA, 19 nt, Human
ccuauuuuucucuccuguc

SEQ ID NO: 1765434 - RNA, 12 nt, Human
ccuauuugugug

SEQ ID NO: 1765435 - RNA, 11 nt, Human
ccucagccucc

SEQ ID NO: 1765436 - RNA, 22 nt, Human
ccucagccucccaaagugcugg

SEQ ID NO: 1765437 - RNA, 22 nt, Human
ccucccaggacucugaccccag

SEQ ID NO: 1765438 - RNA, 17 nt, Human
ccucccaggacucugac

SEQ ID NO: 1765439 - RNA, 15 nt, Human
ccucccacacuccca

SEQ ID NO: 1765440 - RNA, 16 nt, Human
ccucccacacucccaa

SEQ ID NO: 1765441 - RNA, 19 nt, Human
ccucccacacucccaaggu

SEQ ID NO: 1765442 - RNA, 15 nt, Human
ccucccagcccauaa

SEQ ID NO: 1765443 - RNA, 12 nt, Human
ccucauuaaauu

SEQ ID NO: 1765444 - RNA, 15 nt, Human
ccucauuaaugacac

SEQ ID NO: 1765445 - RNA, 17 nt, Human
ccucauuaaugacacuu

SEQ ID NO: 1765446 - RNA, 23 nt, Human
ccucagccucccaaagugcuggg

SEQ ID NO: 1765447 - RNA, 22 nt, Human
ccucagccucccgaauagcugg

SEQ ID NO: 1765448 - RNA, 16 nt, Human
ccuaauaaaguucugu

SEQ ID NO: 1765449 - RNA, 21 nt, Human
ccuaauaaaguucuguacuca

SEQ ID NO: 1765450 - RNA, 12 nt, Human
ccggcuccaggc

SEQ ID NO: 1765451 - RNA, 17 nt, Human
ccguaggacccaagcag

SEQ ID NO: 1765452 - RNA, 20 nt, Human
ccguaucuccggcucccagc

SEQ ID NO: 1765453 - RNA, 22 nt, Human
ccguaucuccggcucccagccu

SEQ ID NO: 1765454 - RNA, 16 nt, Human
ccguagguuauuuuca

SEQ ID NO: 1765455 - RNA, 20 nt, Human
auugcuacuguccuacccac

SEQ ID NO: 1765456 - RNA, 22 nt, Human
auugcuacuguccuacccaccc

SEQ ID NO: 1765457 - RNA, 15 nt, Human
auugcuacuguccua

SEQ ID NO: 1765458 - RNA, 15 nt, Human
auugaguuuucagug

SEQ ID NO: 1765459 - RNA, 16 nt, Human
auugaguuuucagugg

SEQ ID NO: 1765460 - RNA, 21 nt, Human
auucuuucccaauucacaucu

SEQ ID NO: 1765461 - RNA, 14 nt, Human
auucugaauuugca

SEQ ID NO: 1765462 - RNA, 15 nt, Human
auucugaauuugcaa

SEQ ID NO: 1765463 - RNA, 16 nt, Human
auucugaauuugcaaa

SEQ ID NO: 1765464 - RNA, 17 nt, Human
auucugaauuugcaaag

SEQ ID NO: 1765465 - RNA, 18 nt, Human
auucugaauuugcaaagu

SEQ ID NO: 1765466 - RNA, 19 nt, Human
auucugaauuugcaaagua

SEQ ID NO: 1765467 - RNA, 20 nt, Human
auucugaauuugcaaaguac

SEQ ID NO: 1765468 - RNA, 22 nt, Human
auucugaauuugcaaaguacug

SEQ ID NO: 1765469 - RNA, 23 nt, Human
auucugaauuugcaaaguacugu

SEQ ID NO: 1765470 - RNA, 14 nt, Human
auucugaaucucaa

SEQ ID NO: 1765471 - RNA, 11 nt, Human
auucuucugcu

SEQ ID NO: 1765472 - RNA, 12 nt, Human
auucuucugcuu

SEQ ID NO: 1765473 - RNA, 15 nt, Human
auucugaaggagccc

SEQ ID NO: 1765474 - RNA, 16 nt, Human
auucugaaggagcccc

SEQ ID NO: 1765475 - RNA, 14 nt, Human
auucuucugcuuca

SEQ ID NO: 1765476 - RNA, 15 nt, Human
auugcugacugugua

SEQ ID NO: 1765477 - RNA, 12 nt, Human
auugcugacugu

SEQ ID NO: 1765478 - RNA, 20 nt, Human
auugcugccccaucagugcu

SEQ ID NO: 1765479 - RNA, 21 nt, Human
auugcugccccaucagugcuc

SEQ ID NO: 1765480 - RNA, 19 nt, Human
auugugugugcucugcuuc

SEQ ID NO: 1765481 - RNA, 18 nt, Human
auuagguuucagcagagc

SEQ ID NO: 1765482 - RNA, 19 nt, Human
auuagguuucagcagagcu

SEQ ID NO: 1765483 - RNA, 21 nt, Human
auuagcugcuucuauguuuca

SEQ ID NO: 1765484 - RNA, 13 nt, Human
auuagcugcuucu

SEQ ID NO: 1765485 - RNA, 18 nt, Human
auguuugccucugccucu

SEQ ID NO: 1765486 - RNA, 22 nt, Human
auuacaagcgugagccacugca

SEQ ID NO: 1765487 - RNA, 23 nt, Human
auuagauguucucuaucauuuaa

SEQ ID NO: 1765488 - RNA, 21 nt, Human
auuagauguucucuaucauuu

SEQ ID NO: 1765489 - RNA, 19 nt, Human
auuagauguucucuaucau

SEQ ID NO: 1765490 - RNA, 17 nt, Human
auuagccugaguagaaa

SEQ ID NO: 1765491 - RNA, 12 nt, Human
auuagcugcuuc

SEQ ID NO: 1765492 - RNA, 16 nt, Human
auuagccugaguagaa

SEQ ID NO: 1765493 - RNA, 14 nt, Human
auuagccugaguag

SEQ ID NO: 1765494 - RNA, 14 nt, Human
auuugcugccaaau

SEQ ID NO: 1765495 - RNA, 15 nt, Human
auuugcugccaaaug

SEQ ID NO: 1765496 - RNA, 19 nt, Human
auuugcugccaaaugcgua

SEQ ID NO: 1765497 - RNA, 20 nt, Human
auuugcugccaaaugcguau

SEQ ID NO: 1765498 - RNA, 19 nt, Human
auuuuauagcuacuaauuu

SEQ ID NO: 1765499 - RNA, 17 nt, Human
auuuuauagcuacuaau

SEQ ID NO: 1765500 - RNA, 21 nt, Human
auuuuaugaaagguuuacauu

SEQ ID NO: 1765501 - RNA, 15 nt, Human
auuugcaagggaaaa

SEQ ID NO: 1765502 - RNA, 20 nt, Human
auuugcaagggaaaagucuc

SEQ ID NO: 1765503 - RNA, 21 nt, Human
auuugcauaacaauuccucua

SEQ ID NO: 1765504 - RNA, 22 nt, Human
auuugcauaacaauuccucuac

SEQ ID NO: 1765505 - RNA, 11 nt, Human
auuugcaaagu

SEQ ID NO: 1765506 - RNA, 13 nt, Human
auuugcaaaguac

SEQ ID NO: 1765507 - RNA, 15 nt, Human
auuugcaaaguacug

SEQ ID NO: 1765508 - RNA, 16 nt, Human
auuugcaaaguacugu

SEQ ID NO: 1765509 - RNA, 17 nt, Human
auuugcaaaguacugua

SEQ ID NO: 1765510 - RNA, 18 nt, Human
auuugcaaaguacuguaa

SEQ ID NO: 1765511 - RNA, 19 nt, Human
auuugcaaaguacuguaag

SEQ ID NO: 1765512 - RNA, 11 nt, Human
caaaguacugu

SEQ ID NO: 1765513 - RNA, 12 nt, Human
caaaguacugua

SEQ ID NO: 1765514 - RNA, 13 nt, Human
caaaguacuguaa

SEQ ID NO: 1765515 - RNA, 14 nt, Human
caaaguacuguaag

SEQ ID NO: 1765516 - RNA, 17 nt, Human
caaaguacuguaagaau

SEQ ID NO: 1765517 - RNA, 22 nt, Human
caaaguacuguaagaauaauuu

SEQ ID NO: 1765518 - RNA, 22 nt, Human
caaauccgaaccuccucuguga

SEQ ID NO: 1765519 - RNA, 16 nt, Human
caaauccgaaccuccu

SEQ ID NO: 1765520 - RNA, 21 nt, Human
caaauccgaaccuccucugug

SEQ ID NO: 1765521 - RNA, 13 nt, Human
caaauccuaugug

SEQ ID NO: 1765522 - RNA, 15 nt, Human
caaauccuaugugau

SEQ ID NO: 1765523 - RNA, 16 nt, Human
caaauccuaugugauu

SEQ ID NO: 1765524 - RNA, 17 nt, Human
caaauccuaugugauuu

SEQ ID NO: 1765525 - RNA, 18 nt, Human
caaauccuaugugauuuu

SEQ ID NO: 1765526 - RNA, 20 nt, Human
caaagaugggugaaggcugg

SEQ ID NO: 1765527 - RNA, 21 nt, Human
caaagaugggugaaggcuggc

SEQ ID NO: 1765528 - RNA, 22 nt, Human
caaagaugggugaaggcuggca

SEQ ID NO: 1765529 - RNA, 18 nt, Human
caaagcaauugaaaugca

SEQ ID NO: 1765530 - RNA, 15 nt, Human
caaagcaaaaccaga

SEQ ID NO: 1765531 - RNA, 13 nt, Human
caaagcaaggaaa

SEQ ID NO: 1765532 - RNA, 15 nt, Human
caaagcaaggaaacu

SEQ ID NO: 1765533 - RNA, 15 nt, Human
caacacgcaggagca

SEQ ID NO: 1765534 - RNA, 16 nt, Human
caacacgcaggagcac

SEQ ID NO: 1765535 - RNA, 18 nt, Human
caacaauccuagugcuuu

SEQ ID NO: 1765536 - RNA, 15 nt, Human
caacaauccuagugc

SEQ ID NO: 1765537 - RNA, 17 nt, Human
caacaauccuagugcuu

SEQ ID NO: 1765538 - RNA, 19 nt, Human
caacaagguuauaugaaua

SEQ ID NO: 1765539 - RNA, 21 nt, Human
caaauccuaugugauuuuaac

SEQ ID NO: 1765540 - RNA, 22 nt, Human
caaauccuaugugauuuuaacu

SEQ ID NO: 1765541 - RNA, 23 nt, Human
caaauccuaugugauuuuaacuc

SEQ ID NO: 1765542 - RNA, 20 nt, Human
caaacccagacggcuccacu

SEQ ID NO: 1765543 - RNA, 24 nt, Human
caaacccagacggcuccacuagga

SEQ ID NO: 1765544 - RNA, 13 nt, Human
caaaagauaauau

SEQ ID NO: 1765545 - RNA, 20 nt, Human
caaaagauaauauuuuacau

SEQ ID NO: 1765546 - RNA, 19 nt, Human
auuuuuuuuuuaaauuauu

SEQ ID NO: 1765547 - RNA, 13 nt, Human
caccugcccuuuu

SEQ ID NO: 1765548 - RNA, 22 nt, Human
caccugcccuuuuuucugccuc

SEQ ID NO: 1765549 - RNA, 23 nt, Human
caccugcccuuuuuucugccucc

SEQ ID NO: 1765550 - RNA, 17 nt, Human
cacccuggggagaaagu

SEQ ID NO: 1765551 - RNA, 14 nt, Human
caccucagccuccc

SEQ ID NO: 1765552 - RNA, 13 nt, Human
caccucagccucc

SEQ ID NO: 1765553 - RNA, 15 nt, Human
cacccuggggagaaa

SEQ ID NO: 1765554 - RNA, 16 nt, Human
cacccuggggagaaag

SEQ ID NO: 1765555 - RNA, 14 nt, Human
caccuuggcugcag

SEQ ID NO: 1765556 - RNA, 15 nt, Human
caccuuggcucaagu

SEQ ID NO: 1765557 - RNA, 13 nt, Human
caccuuggcugca

SEQ ID NO: 1765558 - RNA, 21 nt, Human
cacuuaugaaugauuugcaua

SEQ ID NO: 1765559 - RNA, 13 nt, Human
cacugcagccuca

SEQ ID NO: 1765560 - RNA, 17 nt, Human
cacugcagaaacccuga

SEQ ID NO: 1765561 - RNA, 19 nt, Human
cacugcacuauagccuagg

SEQ ID NO: 1765562 - RNA, 12 nt, Human
cacugcagccuc

SEQ ID NO: 1765563 - RNA, 15 nt, Human
caauaaagcacugag

SEQ ID NO: 1765564 - RNA, 16 nt, Human
caauaaagcacugagc

SEQ ID NO: 1765565 - RNA, 17 nt, Human
caauaaagcacugagca

SEQ ID NO: 1765566 - RNA, 13 nt, Human
caauaaaguauuu

SEQ ID NO: 1765567 - RNA, 13 nt, Human
caagcucugcucc

SEQ ID NO: 1765568 - RNA, 14 nt, Human
caagcucugcuccu

SEQ ID NO: 1765569 - RNA, 20 nt, Human
caagucaccaaaagacacug

SEQ ID NO: 1765570 - RNA, 20 nt, Human
cacaguauuacuucugcuac

SEQ ID NO: 1765571 - RNA, 21 nt, Human
cacaguauuacuucugcuaca

SEQ ID NO: 1765572 - RNA, 20 nt, Human
cacagguucacgugcagcuc

SEQ ID NO: 1765573 - RNA, 18 nt, Human
cacacagugagucgagga

SEQ ID NO: 1765574 - RNA, 20 nt, Human
cacacaguauuacuucugcu

SEQ ID NO: 1765575 - RNA, 23 nt, Human
cacacaguauuacuucugcuaca

SEQ ID NO: 1765576 - RNA, 15 nt, Human
cacacauacacacac

SEQ ID NO: 1765577 - RNA, 21 nt, Human
cacacauauaaacaucacaca

SEQ ID NO: 1765578 - RNA, 23 nt, Human
cacacauauaaacaucacacaca

SEQ ID NO: 1765579 - RNA, 21 nt, Human
cacacagugagucgaggacag

SEQ ID NO: 1765580 - RNA, 23 nt, Human
cacacagugagucgaggacaggg

SEQ ID NO: 1765581 - RNA, 17 nt, Human
cacacagcucuguccug

SEQ ID NO: 1765582 - RNA, 20 nt, Human
cacacagcucuguccuggga

SEQ ID NO: 1765583 - RNA, 11 nt, Human
caauggcagcc

SEQ ID NO: 1765584 - RNA, 12 nt, Human
caauggcagccu

SEQ ID NO: 1765585 - RNA, 15 nt, Human
caauucuugccaaau

SEQ ID NO: 1765586 - RNA, 11 nt, Human
caauuuagaaa

SEQ ID NO: 1765587 - RNA, 14 nt, Human
caauugaaaugcau

SEQ ID NO: 1765588 - RNA, 21 nt, Human
caguuugccggauacaaacug

SEQ ID NO: 1765589 - RNA, 19 nt, Human
cauagcccauguuaagucc

SEQ ID NO: 1765590 - RNA, 19 nt, Human
cauccugugccuccaucag

SEQ ID NO: 1765591 - RNA, 21 nt, Human
cauccuuuaggguucugccuc

SEQ ID NO: 1765592 - RNA, 22 nt, Human
cauccuuuaggguucugccucu

SEQ ID NO: 1765593 - RNA, 16 nt, Human
caucugucccuccggg

SEQ ID NO: 1765594 - RNA, 17 nt, Human
caucugucccuccggga

SEQ ID NO: 1765595 - RNA, 18 nt, Human
caucugucccuccgggac

SEQ ID NO: 1765596 - RNA, 20 nt, Human
caucugucccuccgggaccu

SEQ ID NO: 1765597 - RNA, 14 nt, Human
ccaccuuggcucaa

SEQ ID NO: 1765598 - RNA, 15 nt, Human
ccaccuuggcucaag

SEQ ID NO: 1765599 - RNA, 13 nt, Human
ccacccugcucuc

SEQ ID NO: 1765600 - RNA, 15 nt, Human
ccaaauccccuaagc

SEQ ID NO: 1765601 - RNA, 23 nt, Human
ccaaauccgaaccuccucuguga

SEQ ID NO: 1765602 - RNA, 17 nt, Human
ccaaauccgaaccuccu

SEQ ID NO: 1765603 - RNA, 21 nt, Human
ccaaauccgaaccuccucugu

SEQ ID NO: 1765604 - RNA, 22 nt, Human
ccaaauccgaaccuccucugug

SEQ ID NO: 1765605 - RNA, 24 nt, Human
ccaaauccgaaccuccucugugaa

SEQ ID NO: 1765606 - RNA, 21 nt, Human
ccaagcuuccauagcugcugc

SEQ ID NO: 1765607 - RNA, 22 nt, Human
ccaagcuuccauagcugcugcc

SEQ ID NO: 1765608 - RNA, 11 nt, Human
ccaagcuuccc

SEQ ID NO: 1765609 - RNA, 12 nt, Human
ccaagcuucccu

SEQ ID NO: 1765610 - RNA, 13 nt, Human
ccaagcuucccuc

SEQ ID NO: 1765611 - RNA, 15 nt, Human
cauguucucugagga

SEQ ID NO: 1765612 - RNA, 23 nt, Human
cauuagccugaguagaaaggccu

SEQ ID NO: 1765613 - RNA, 19 nt, Human
cauuagccugaguagaaag

SEQ ID NO: 1765614 - RNA, 18 nt, Human
cauuagccugaguagaaa

SEQ ID NO: 1765615 - RNA, 17 nt, Human
cauuagccugaguagaa

SEQ ID NO: 1765616 - RNA, 14 nt, Human
cauuagccugagua

SEQ ID NO: 1765617 - RNA, 9 nt, Human
cauuagccu

SEQ ID NO: 1765618 - RNA, 12 nt, Human
cauuagccaagg

SEQ ID NO: 1765619 - RNA, 14 nt, Human
cauuagccaaggau

SEQ ID NO: 1765620 - RNA, 13 nt, Human
cauucucaggcac

SEQ ID NO: 1765621 - RNA, 14 nt, Human
cauucucaggcacc

SEQ ID NO: 1765622 - RNA, 15 nt, Human
cauucucaggcacca

SEQ ID NO: 1765623 - RNA, 16 nt, Human
cauucucaggcaccag

SEQ ID NO: 1765624 - RNA, 17 nt, Human
cauucucaggcaccagu

SEQ ID NO: 1765625 - RNA, 14 nt, Human
cauugcggacagcc

SEQ ID NO: 1765626 - RNA, 15 nt, Human
cauugcggacagcca

SEQ ID NO: 1765627 - RNA, 17 nt, Human
cauugcggacagccacg

SEQ ID NO: 1765628 - RNA, 21 nt, Human
cauugcggacagccacggcca

SEQ ID NO: 1765629 - RNA, 17 nt, Human
cauuuauuuuuuacauu

SEQ ID NO: 1765630 - RNA, 19 nt, Human
cauuuauuuuuuacauuau

SEQ ID NO: 1765631 - RNA, 16 nt, Human
cauuuauucugcucac

SEQ ID NO: 1765632 - RNA, 22 nt, Human
cauuggcuuuauccucuuuaga

SEQ ID NO: 1765633 - RNA, 13 nt, Human
cauuggcuuuauc

SEQ ID NO: 1765634 - RNA, 16 nt, Human
cauugcuggacucuga

SEQ ID NO: 1765635 - RNA, 19 nt, Human
cauugcuguuguccaacua

SEQ ID NO: 1765636 - RNA, 21 nt, Human
cauugcuguuguccaacuauu

SEQ ID NO: 1765637 - RNA, 22 nt, Human
cauugcuguuguccaacuauuu

SEQ ID NO: 1765638 - RNA, 16 nt, Human
cauuugguuggcacua

SEQ ID NO: 1765639 - RNA, 16 nt, Human
ccaaaaaucugccugg

SEQ ID NO: 1765640 - RNA, 17 nt, Human
ccaaaaaucugccuggg

SEQ ID NO: 1765641 - RNA, 13 nt, Human
ccaaaaagcacau

SEQ ID NO: 1765642 - RNA, 14 nt, Human
ccaaaaagcacaua

SEQ ID NO: 1765643 - RNA, 21 nt, Human
cagauugcaacaggcugggcu

SEQ ID NO: 1765644 - RNA, 12 nt, Human
cagauugcaugu

SEQ ID NO: 1765645 - RNA, 13 nt, Human
cagauugcaugug

SEQ ID NO: 1765646 - RNA, 15 nt, Human
cagauugcaugugac

SEQ ID NO: 1765647 - RNA, 16 nt, Human
cagauugcaugugacu

SEQ ID NO: 1765648 - RNA, 18 nt, Human
cagauugcaugugacucu

SEQ ID NO: 1765649 - RNA, 20 nt, Human
cagauugcaugugacucuga

SEQ ID NO: 1765650 - RNA, 23 nt, Human
cagauugcaugugacucugaagc

SEQ ID NO: 1765651 - RNA, 21 nt, Human
cagauugcaugugacucugaa

SEQ ID NO: 1765652 - RNA, 16 nt, Human
cagcacugcuugagga

SEQ ID NO: 1765653 - RNA, 18 nt, Human
cagcacugcuugaggaaa

SEQ ID NO: 1765654 - RNA, 19 nt, Human
cagcacugcuugaggaaaa

SEQ ID NO: 1765655 - RNA, 13 nt, Human
cagccagcagcag

SEQ ID NO: 1765656 - RNA, 17 nt, Human
cagccagcagcagccca

SEQ ID NO: 1765657 - RNA, 13 nt, Human
cagccagaggcac

SEQ ID NO: 1765658 - RNA, 14 nt, Human
cagcggggacagcu

SEQ ID NO: 1765659 - RNA, 19 nt, Human
cagcgugcuuuaaaaaaua

SEQ ID NO: 1765660 - RNA, 13 nt, Human
cagccugcgccug

SEQ ID NO: 1765661 - RNA, 15 nt, Human
cagccugcgccugcu

SEQ ID NO: 1765662 - RNA, 16 nt, Human
cagccugcgccugcug

SEQ ID NO: 1765663 - RNA, 18 nt, Human
cagccugcgccugcugca

SEQ ID NO: 1765664 - RNA, 17 nt, Human
cagccugcgccugcugc

SEQ ID NO: 1765665 - RNA, 13 nt, Human
cagcccuuagcag

SEQ ID NO: 1765666 - RNA, 15 nt, Human
cagcccuuagcaggg

SEQ ID NO: 1765667 - RNA, 23 nt, Human
cagccccauucugccugcccagg

SEQ ID NO: 1765668 - RNA, 24 nt, Human
cagccccauucugccugcccaggc

SEQ ID NO: 1765669 - RNA, 17 nt, Human
cagcccccacauccugu

SEQ ID NO: 1765670 - RNA, 19 nt, Human
cagccccauucugccugcc

SEQ ID NO: 1765671 - RNA, 20 nt, Human
cagccccauucugccugccc

SEQ ID NO: 1765672 - RNA, 22 nt, Human
cagccccauucugccugcccag

SEQ ID NO: 1765673 - RNA, 14 nt, Human
cagccccuacugcu

SEQ ID NO: 1765674 - RNA, 15 nt, Human
cagccccuacugcug

SEQ ID NO: 1765675 - RNA, 16 nt, Human
cagccccuacugcugu

SEQ ID NO: 1765676 - RNA, 17 nt, Human
cagccccuacugcugug

SEQ ID NO: 1765677 - RNA, 20 nt, Human
cagccccuacugcugugaac

SEQ ID NO: 1765678 - RNA, 18 nt, Human
cagccccgguggcugggc

SEQ ID NO: 1765679 - RNA, 19 nt, Human
cagccccgguggcugggca

SEQ ID NO: 1765680 - RNA, 20 nt, Human
cagccccgguggcugggcag

SEQ ID NO: 1765681 - RNA, 17 nt, Human
cagagcgcgccccuagc

SEQ ID NO: 1765682 - RNA, 18 nt, Human
cagagcgcgccccuagcc

SEQ ID NO: 1765683 - RNA, 19 nt, Human
cagagcgcgccccuagccg

SEQ ID NO: 1765684 - RNA, 18 nt, Human
cagagcuaaacuccuucc

SEQ ID NO: 1765685 - RNA, 19 nt, Human
cagagcuaaacuccuuccu

SEQ ID NO: 1765686 - RNA, 20 nt, Human
cagagcuaaacuccuuccug

SEQ ID NO: 1765687 - RNA, 21 nt, Human
cagagcuaaacuccuuccugg

SEQ ID NO: 1765688 - RNA, 22 nt, Human
cagagcuaaacuccuuccuggc

SEQ ID NO: 1765689 - RNA, 14 nt, Human
cagagccugcaguu

SEQ ID NO: 1765690 - RNA, 23 nt, Human
cagauacaggaaaagcugcugac

SEQ ID NO: 1765691 - RNA, 19 nt, Human
caggaaaagcugcugacag

SEQ ID NO: 1765692 - RNA, 20 nt, Human
caggaaaagcugcugacagu

SEQ ID NO: 1765693 - RNA, 23 nt, Human
cagcugugugacauuuggagagg

SEQ ID NO: 1765694 - RNA, 23 nt, Human
caggcacugagauaccagcgagg

SEQ ID NO: 1765695 - RNA, 21 nt, Human
caggcaaugcuggcuguuggc

SEQ ID NO: 1765696 - RNA, 19 nt, Human
caggcaaugcuggcuguug

SEQ ID NO: 1765697 - RNA, 20 nt, Human
caggcaaugcuggcuguugg

SEQ ID NO: 1765698 - RNA, 15 nt, Human
caggaggcaggaccu

SEQ ID NO: 1765699 - RNA, 18 nt, Human
caggaggcaggaccuucg

SEQ ID NO: 1765700 - RNA, 17 nt, Human
caggcuggcgugcagug

SEQ ID NO: 1765701 - RNA, 18 nt, Human
caggcuggcgugcagugg

SEQ ID NO: 1765702 - RNA, 19 nt, Human
caggcuggcgugcaguggu

SEQ ID NO: 1765703 - RNA, 20 nt, Human
cagggcucagcggggacagc

SEQ ID NO: 1765704 - RNA, 12 nt, Human
cagggcucagcg

SEQ ID NO: 1765705 - RNA, 15 nt, Human
cagggcucagcgggg

SEQ ID NO: 1765706 - RNA, 14 nt, Human
caggcugggcuuca

SEQ ID NO: 1765707 - RNA, 15 nt, Human
caggcugggcuucag

SEQ ID NO: 1765708 - RNA, 13 nt, Human
cagggcugugcuu

SEQ ID NO: 1765709 - RNA, 14 nt, Human
cagggcugugcuug

SEQ ID NO: 1765710 - RNA, 19 nt, Human
cagggcugugcuugaaggc

SEQ ID NO: 1765711 - RNA, 23 nt, Human
cagggcugugcuugaaggcccug

SEQ ID NO: 1765712 - RNA, 15 nt, Human
caggguuggccccug

SEQ ID NO: 1765713 - RNA, 16 nt, Human
caggguuggccccugc

SEQ ID NO: 1765714 - RNA, 23 nt, Human
cagggucucacucugucgcccag

SEQ ID NO: 1765715 - RNA, 18 nt, Human
caguaaaauugccauauu

SEQ ID NO: 1765716 - RNA, 16 nt, Human
caguaaaauugccaua

SEQ ID NO: 1765717 - RNA, 15 nt, Human
caguaaaauugccau

SEQ ID NO: 1765718 - RNA, 11 nt, Human
caguaaaauug

SEQ ID NO: 1765719 - RNA, 13 nt, Human
caggugcugccau

SEQ ID NO: 1765720 - RNA, 14 nt, Human
caggugcugccauc

SEQ ID NO: 1765721 - RNA, 17 nt, Human
caggguuggccccugcc

SEQ ID NO: 1765722 - RNA, 21 nt, Human
caggguuggccccugcccggc

SEQ ID NO: 1765723 - RNA, 23 nt, Human
cagguuuuuggucugacccacug

SEQ ID NO: 1765724 - RNA, 21 nt, Human
gggaagagugacucuccaggg

SEQ ID NO: 1765725 - RNA, 20 nt, Human
gggaagcuucugucuccagc

SEQ ID NO: 1765726 - RNA, 21 nt, Human
gggaagcuucugucuccagcu

SEQ ID NO: 1765727 - RNA, 21 nt, Human
gggacagcuccuucuguccua

SEQ ID NO: 1765728 - RNA, 13 nt, Human
gggaaggagccag

SEQ ID NO: 1765729 - RNA, 18 nt, Human
gggaccaacccuggggaa

SEQ ID NO: 1765730 - RNA, 11 nt, Human
gggacagcugu

SEQ ID NO: 1765731 - RNA, 12 nt, Human
aaaaauauguau

SEQ ID NO: 1765732 - RNA, 11 nt, Human
aaaaauauuua

SEQ ID NO: 1765733 - RNA, 22 nt, Human
aaaaaucaacuuuuuauugccu

SEQ ID NO: 1765734 - RNA, 23 nt, Human
aaaaaucaacuuuuuauugccuu

SEQ ID NO: 1765735 - RNA, 16 nt, Human
aaaaaucaauuaacca

SEQ ID NO: 1765736 - RNA, 13 nt, Human
aaaaccugacaaa

SEQ ID NO: 1765737 - RNA, 19 nt, Human
aaaaauggaaaaauaaaca

SEQ ID NO: 1765738 - RNA, 13 nt, Human
aaaaggggcuccu

SEQ ID NO: 1765739 - RNA, 18 nt, Human
gggcagaucuuggacuca

SEQ ID NO: 1765740 - RNA, 20 nt, Human
gggcagaucuuggacucaug

SEQ ID NO: 1765741 - RNA, 22 nt, Human
gggcagaucuuggacucaugag

SEQ ID NO: 1765742 - RNA, 17 nt, Human
gggcagagugagaccca

SEQ ID NO: 1765743 - RNA, 15 nt, Human
gggauuacaggugug

SEQ ID NO: 1765744 - RNA, 14 nt, Human
gggcaaagccuagu

SEQ ID NO: 1765745 - RNA, 16 nt, Human
gggcaacccccagccu

SEQ ID NO: 1765746 - RNA, 18 nt, Human
gggcaacccccagccugc

SEQ ID NO: 1765747 - RNA, 20 nt, Human
gggcaacccccagccugcua

SEQ ID NO: 1765748 - RNA, 18 nt, Human
gggaugguggagggccac

SEQ ID NO: 1765749 - RNA, 17 nt, Human
gggaugguggagggcca

SEQ ID NO: 1765750 - RNA, 19 nt, Human
aaaagauggggucuguaaa

SEQ ID NO: 1765751 - RNA, 21 nt, Human
aaaagauggggucuguaaaau

SEQ ID NO: 1765752 - RNA, 17 nt, Human
gggaggccagugagcca

SEQ ID NO: 1765753 - RNA, 13 nt, Human
gggagaccuggac

SEQ ID NO: 1765754 - RNA, 13 nt, Human
gggcuacccugag

SEQ ID NO: 1765755 - RNA, 16 nt, Human
gggcuacccugagcug

SEQ ID NO: 1765756 - RNA, 19 nt, Human
gggcuacccugagcugagg

SEQ ID NO: 1765757 - RNA, 15 nt, Human
gggcgggaggauguu

SEQ ID NO: 1765758 - RNA, 21 nt, Human
gggccugcaggaccugccugu

SEQ ID NO: 1765759 - RNA, 15 nt, Human
gggccuccugugugu

SEQ ID NO: 1765760 - RNA, 13 nt, Human
gggccuccugugu

SEQ ID NO: 1765761 - RNA, 14 nt, Human
gggccugacugcuc

SEQ ID NO: 1765762 - RNA, 17 nt, Human
gggccugacugcucaga

SEQ ID NO: 1765763 - RNA, 15 nt, Human
gggccugagccuggc

SEQ ID NO: 1765764 - RNA, 16 nt, Human
gggccugagccuggcc

SEQ ID NO: 1765765 - RNA, 18 nt, Human
gggccugagccuggccag

SEQ ID NO: 1765766 - RNA, 18 nt, Human
gggccugcaggaccugcc

SEQ ID NO: 1765767 - RNA, 17 nt, Human
gggcccuuugagugcag

SEQ ID NO: 1765768 - RNA, 14 nt, Human
gggccgccagggag

SEQ ID NO: 1765769 - RNA, 20 nt, Human
gggccgccagggagaccugg

SEQ ID NO: 1765770 - RNA, 16 nt, Human
gggccguaucuccggc

SEQ ID NO: 1765771 - RNA, 19 nt, Human
gggccguaucuccggcucc

SEQ ID NO: 1765772 - RNA, 20 nt, Human
gggccguaucuccggcuccc

SEQ ID NO: 1765773 - RNA, 23 nt, Human
gggccguaucuccggcucccagc

SEQ ID NO: 1765774 - RNA, 24 nt, Human
gggccguaucuccggcucccagcc

SEQ ID NO: 1765775 - RNA, 23 nt, Human
aaaaucuuucuuucuuagaaauu

SEQ ID NO: 1765776 - RNA, 22 nt, Human
aaaaucuuucuuucuuagaaau

SEQ ID NO: 1765777 - RNA, 21 nt, Human
aaaaucuuucuuucuuagaaa

SEQ ID NO: 1765778 - RNA, 20 nt, Human
aaaaucuuucuuucuuagaa

SEQ ID NO: 1765779 - RNA, 19 nt, Human
aaaaucuuucuuucuuaga

SEQ ID NO: 1765780 - RNA, 17 nt, Human
aaaaucuuucuuucuua

SEQ ID NO: 1765781 - RNA, 14 nt, Human
aaaaguauuauuuu

SEQ ID NO: 1765782 - RNA, 20 nt, Human
aaaaguauuauuuuccaaaa

SEQ ID NO: 1765783 - RNA, 22 nt, Human
aaaaguauuauuuuccaaaagu

SEQ ID NO: 1765784 - RNA, 16 nt, Human
gggccagggcugcccc

SEQ ID NO: 1765785 - RNA, 12 nt, Human
gggccagggcug

SEQ ID NO: 1765786 - RNA, 13 nt, Human
gggccagggcugc

SEQ ID NO: 1765787 - RNA, 20 nt, Human
gggcugccccuaaucucugu

SEQ ID NO: 1765788 - RNA, 20 nt, Human
gggcuacccugagcugaggc

SEQ ID NO: 1765789 - RNA, 11 nt, Human
gggcugcauga

SEQ ID NO: 1765790 - RNA, 16 nt, Human
gggcugcaugauguuu

SEQ ID NO: 1765791 - RNA, 20 nt, Human
gggcugcaugauguuugccc

SEQ ID NO: 1765792 - RNA, 18 nt, Human
aaaaugucuuguguuacc

SEQ ID NO: 1765793 - RNA, 14 nt, Human
aaaauuuuuuuaga

SEQ ID NO: 1765794 - RNA, 18 nt, Human
aaaauuuguuauuuugca

SEQ ID NO: 1765795 - RNA, 19 nt, Human
aaacaaaaauuaaaauccu

SEQ ID NO: 1765796 - RNA, 16 nt, Human
aaaauuuuuuuagaaa

SEQ ID NO: 1765797 - RNA, 15 nt, Human
aaaauuuuuuuucau

SEQ ID NO: 1765798 - RNA, 16 nt, Human
aaaauuuuuuuucaug

SEQ ID NO: 1765799 - RNA, 17 nt, Human
aaaauuuuuuuucaugu

SEQ ID NO: 1765800 - RNA, 18 nt, Human
aaaauuuuuuuucauguu

SEQ ID NO: 1765801 - RNA, 19 nt, Human
aaaauuuuuuuucauguuu

SEQ ID NO: 1765802 - RNA, 20 nt, Human
aaacaagcacuaaacaaaga

SEQ ID NO: 1765803 - RNA, 14 nt, Human
aaacaucacacaca

SEQ ID NO: 1765804 - RNA, 22 nt, Human
aaacaucacacacacagacaga

SEQ ID NO: 1765805 - RNA, 12 nt, Human
ggggacagcucc

SEQ ID NO: 1765806 - RNA, 19 nt, Human
aaacaugacccuaaaucuu

SEQ ID NO: 1765807 - RNA, 21 nt, Human
aaacaugacccuaaaucuuga

SEQ ID NO: 1765808 - RNA, 14 nt, Human
ggggacagcuccuu

SEQ ID NO: 1765809 - RNA, 20 nt, Human
ggggacagcuccuucugucc

SEQ ID NO: 1765810 - RNA, 13 nt, Human
ggggacagcugug

SEQ ID NO: 1765811 - RNA, 14 nt, Human
ggggacagcugugu

SEQ ID NO: 1765812 - RNA, 12 nt, Human
ggggccagaggc

SEQ ID NO: 1765813 - RNA, 14 nt, Human
ggggcauugcugac

SEQ ID NO: 1765814 - RNA, 21 nt, Human
ggggcauugcugacuguguau

SEQ ID NO: 1765815 - RNA, 14 nt, Human
ggggccugacugcu

SEQ ID NO: 1765816 - RNA, 13 nt, Human
ggggccagaggcu

SEQ ID NO: 1765817 - RNA, 21 nt, Human
aaaguuucucuuuucaaaaca

SEQ ID NO: 1765818 - RNA, 23 nt, Human
aaaguuucucuuuucaaaacauu

SEQ ID NO: 1765819 - RNA, 21 nt, Human
guaaaaucuuucuuucuuaga

SEQ ID NO: 1765820 - RNA, 15 nt, Human
guaaaaucuuucuuu

SEQ ID NO: 1765821 - RNA, 14 nt, Human
guaaaaucuuucuu

SEQ ID NO: 1765822 - RNA, 13 nt, Human
gguggggcagcuu

SEQ ID NO: 1765823 - RNA, 22 nt, Human
ggugggcccggcccgcgccaca

SEQ ID NO: 1765824 - RNA, 17 nt, Human
gguggggcagcuugagg

SEQ ID NO: 1765825 - RNA, 16 nt, Human
ggugggggugggucag

SEQ ID NO: 1765826 - RNA, 17 nt, Human
ggugggggugggucaga

SEQ ID NO: 1765827 - RNA, 18 nt, Human
ggugugagucaccaagcc

SEQ ID NO: 1765828 - RNA, 15 nt, Human
ggugugaucgucuga

SEQ ID NO: 1765829 - RNA, 18 nt, Human
ggugugaucgucugacug

SEQ ID NO: 1765830 - RNA, 16 nt, Human
ggugugcaccaggguu

SEQ ID NO: 1765831 - RNA, 17 nt, Human
ggugugcaccaggguug

SEQ ID NO: 1765832 - RNA, 17 nt, Human
ggugugccuuccagauc

SEQ ID NO: 1765833 - RNA, 18 nt, Human
ggugugccuuccagaucc

SEQ ID NO: 1765834 - RNA, 13 nt, Human
ggugugcucugau

SEQ ID NO: 1765835 - RNA, 22 nt, Human
gguucaggguuggccccugccc

SEQ ID NO: 1765836 - RNA, 18 nt, Human
gguucaggguuggccccu

SEQ ID NO: 1765837 - RNA, 21 nt, Human
gguucaggguuggccccugcc

SEQ ID NO: 1765838 - RNA, 12 nt, Human
gguucccuuccu

SEQ ID NO: 1765839 - RNA, 16 nt, Human
gguucccuuccuauuc

SEQ ID NO: 1765840 - RNA, 12 nt, Human
gguucugccucu

SEQ ID NO: 1765841 - RNA, 13 nt, Human
gguagccugcugg

SEQ ID NO: 1765842 - RNA, 14 nt, Human
gguccacagggcac

SEQ ID NO: 1765843 - RNA, 22 nt, Human
gguaugaucacggcucacugca

SEQ ID NO: 1765844 - RNA, 17 nt, Human
gguccacccaggagccc

SEQ ID NO: 1765845 - RNA, 17 nt, Human
gguccacaucccgggac

SEQ ID NO: 1765846 - RNA, 15 nt, Human
gguccacagggcacc

SEQ ID NO: 1765847 - RNA, 12 nt, Human
gguccacccagg

SEQ ID NO: 1765848 - RNA, 13 nt, Human
gguccacccagga

SEQ ID NO: 1765849 - RNA, 15 nt, Human
gguccacccaggagc

SEQ ID NO: 1765850 - RNA, 16 nt, Human
gguccacccaggagcc

SEQ ID NO: 1765851 - RNA, 18 nt, Human
aaagaaguuauuuuccag

SEQ ID NO: 1765852 - RNA, 13 nt, Human
aaagaauacuuga

SEQ ID NO: 1765853 - RNA, 14 nt, Human
aaagaauacuugaa

SEQ ID NO: 1765854 - RNA, 15 nt, Human
aaagaauacuugaac

SEQ ID NO: 1765855 - RNA, 16 nt, Human
aaagaauacuugaacu

SEQ ID NO: 1765856 - RNA, 17 nt, Human
aaagaauacuugaacuu

SEQ ID NO: 1765857 - RNA, 14 nt, Human
gguccaugggcaga

SEQ ID NO: 1765858 - RNA, 16 nt, Human
gguccaugggcagagc

SEQ ID NO: 1765859 - RNA, 13 nt, Human
gguccaugggcag

SEQ ID NO: 1765860 - RNA, 12 nt, Human
ggguggugaccu

SEQ ID NO: 1765861 - RNA, 12 nt, Human
ggguggguauaa

SEQ ID NO: 1765862 - RNA, 11 nt, Human
gggugggggug

SEQ ID NO: 1765863 - RNA, 16 nt, Human
ggguggggguggguca

SEQ ID NO: 1765864 - RNA, 11 nt, Human
gggugggucag

SEQ ID NO: 1765865 - RNA, 20 nt, Human
gggugggucagaacccugcc

SEQ ID NO: 1765866 - RNA, 21 nt, Human
gggugggucagaacccugcca

SEQ ID NO: 1765867 - RNA, 17 nt, Human
ggguguccugccugucu

SEQ ID NO: 1765868 - RNA, 19 nt, Human
ggguguccugccugucugc

SEQ ID NO: 1765869 - RNA, 22 nt, Human
ggguguccugccugucugcccc

SEQ ID NO: 1765870 - RNA, 13 nt, Human
ggguggaugccug

SEQ ID NO: 1765871 - RNA, 17 nt, Human
ggguggaugccuggugg

SEQ ID NO: 1765872 - RNA, 16 nt, Human
gguacauuuuucaacu

SEQ ID NO: 1765873 - RNA, 17 nt, Human
gguacauuuuucaacuu

SEQ ID NO: 1765874 - RNA, 23 nt, Human
gguacauuuuucaacuuugaaua

SEQ ID NO: 1765875 - RNA, 14 nt, Human
gguaacaggcagau

SEQ ID NO: 1765876 - RNA, 20 nt, Human
gguaacaggcagauacagga

SEQ ID NO: 1765877 - RNA, 18 nt, Human
ggucuucagccucuuucu

SEQ ID NO: 1765878 - RNA, 11 nt, Human
ggugcugucca

SEQ ID NO: 1765879 - RNA, 14 nt, Human
gguggaugccuggu

SEQ ID NO: 1765880 - RNA, 21 nt, Human
gguggaugccugguggcagcu

SEQ ID NO: 1765881 - RNA, 16 nt, Human
gguccuccccucucuu

SEQ ID NO: 1765882 - RNA, 17 nt, Human
gguccuccccucucuug

SEQ ID NO: 1765883 - RNA, 22 nt, Human
gguccuagaggcccuuugcugu

SEQ ID NO: 1765884 - RNA, 15 nt, Human
ggagugcagugagcc

SEQ ID NO: 1765885 - RNA, 12 nt, Human
ggauggccgugg

SEQ ID NO: 1765886 - RNA, 18 nt, Human
ggauggccguggauggcc

SEQ ID NO: 1765887 - RNA, 21 nt, Human
ggauggcaggacgugggcugg

SEQ ID NO: 1765888 - RNA, 22 nt, Human
ggauggcaggacgugggcuggg

SEQ ID NO: 1765889 - RNA, 20 nt, Human
ggaguugaucgccuuuccca

SEQ ID NO: 1765890 - RNA, 23 nt, Human
ggaguugaucgccuuucccaggu

SEQ ID NO: 1765891 - RNA, 23 nt, Human
ggauaagcuauccguguugcagg

SEQ ID NO: 1765892 - RNA, 15 nt, Human
ggauguucugggaca

SEQ ID NO: 1765893 - RNA, 16 nt, Human
ggauguucugggacac

SEQ ID NO: 1765894 - RNA, 13 nt, Human
ggcaauuuagaaa

SEQ ID NO: 1765895 - RNA, 16 nt, Human
ggcaauuuagaaaaag

SEQ ID NO: 1765896 - RNA, 15 nt, Human
ggcacagaugcucca

SEQ ID NO: 1765897 - RNA, 15 nt, Human
ggagcaucaagccac

SEQ ID NO: 1765898 - RNA, 16 nt, Human
ggagcaucaagccacu

SEQ ID NO: 1765899 - RNA, 17 nt, Human
ggagcaucaagccacuc

SEQ ID NO: 1765900 - RNA, 13 nt, Human
ggaggccucaggu

SEQ ID NO: 1765901 - RNA, 15 nt, Human
ggaggccucaggugc

SEQ ID NO: 1765902 - RNA, 16 nt, Human
ggaggccucaggugcu

SEQ ID NO: 1765903 - RNA, 17 nt, Human
ggaggccucaggugcug

SEQ ID NO: 1765904 - RNA, 19 nt, Human
ggaggccucaggugcuguc

SEQ ID NO: 1765905 - RNA, 17 nt, Human
ggaggcccgcagagcgc

SEQ ID NO: 1765906 - RNA, 14 nt, Human
ggaggugaccccag

SEQ ID NO: 1765907 - RNA, 23 nt, Human
ggaggugaacaagcaaacccaga

SEQ ID NO: 1765908 - RNA, 20 nt, Human
ggagcuucauggcagaaggc

SEQ ID NO: 1765909 - RNA, 19 nt, Human
ggagcuuccuguccuccca

SEQ ID NO: 1765910 - RNA, 16 nt, Human
ggagccacuccucuga

SEQ ID NO: 1765911 - RNA, 19 nt, Human
ggagccacuccucugacuc

SEQ ID NO: 1765912 - RNA, 21 nt, Human
ggagccacuccucugacucag

SEQ ID NO: 1765913 - RNA, 16 nt, Human
ggagcccagcucugaa

SEQ ID NO: 1765914 - RNA, 16 nt, Human
ggagccccgaggccuu

SEQ ID NO: 1765915 - RNA, 12 nt, Human
ggagcccagggc

SEQ ID NO: 1765916 - RNA, 13 nt, Human
ggagcccagggca

SEQ ID NO: 1765917 - RNA, 15 nt, Human
ggagcccagggcauc

SEQ ID NO: 1765918 - RNA, 22 nt, Human
ggagccccgaggccuucucuga

SEQ ID NO: 1765919 - RNA, 12 nt, Human
ggagcugccugu

SEQ ID NO: 1765920 - RNA, 21 nt, Human
ggagcugccuguucagcucca

SEQ ID NO: 1765921 - RNA, 18 nt, Human
ggccggcagccccagccu

SEQ ID NO: 1765922 - RNA, 20 nt, Human
ggccggcagccccagccugc

SEQ ID NO: 1765923 - RNA, 21 nt, Human
ggccggcagccccagccugcu

SEQ ID NO: 1765924 - RNA, 15 nt, Human
ggccuucucugaagg

SEQ ID NO: 1765925 - RNA, 16 nt, Human
ggccuucucugaagga

SEQ ID NO: 1765926 - RNA, 22 nt, Human
ggccuuuaaaauuuuuuuagaa

SEQ ID NO: 1765927 - RNA, 14 nt, Human
ggccuuuaaaauuu

SEQ ID NO: 1765928 - RNA, 12 nt, Human
ggccuuguccca

SEQ ID NO: 1765929 - RNA, 14 nt, Human
ggcguacaggcugg

SEQ ID NO: 1765930 - RNA, 21 nt, Human
ggccuggccagaugcaccagc

SEQ ID NO: 1765931 - RNA, 12 nt, Human
ggccuucucuga

SEQ ID NO: 1765932 - RNA, 17 nt, Human
ggcucacugcagccuca

SEQ ID NO: 1765933 - RNA, 16 nt, Human
ggcucacugcagccuc

SEQ ID NO: 1765934 - RNA, 14 nt, Human
ggcgugcaguggug

SEQ ID NO: 1765935 - RNA, 19 nt, Human
ggcgugcaguggugcgauc

SEQ ID NO: 1765936 - RNA, 21 nt, Human
ggcucagcggggacagcuccu

SEQ ID NO: 1765937 - RNA, 22 nt, Human
ggcucagcggggacagcuccuu

SEQ ID NO: 1765938 - RNA, 23 nt, Human
ggcucagcggggacagcuccuuc

SEQ ID NO: 1765939 - RNA, 15 nt, Human
ggcccaggugagucc

SEQ ID NO: 1765940 - RNA, 12 nt, Human
ggccccuggagg

SEQ ID NO: 1765941 - RNA, 14 nt, Human
ggccccuggaggcu

SEQ ID NO: 1765942 - RNA, 22 nt, Human
ggccccuggaggcugccuccca

SEQ ID NO: 1765943 - RNA, 19 nt, Human
ggcccuucccacaggacau

SEQ ID NO: 1765944 - RNA, 18 nt, Human
ggcagugggagcugccug

SEQ ID NO: 1765945 - RNA, 19 nt, Human
ggcagugggagcugccugu

SEQ ID NO: 1765946 - RNA, 15 nt, Human
ggcaucuugcuggcu

SEQ ID NO: 1765947 - RNA, 16 nt, Human
ggcaucuugcuggcua

SEQ ID NO: 1765948 - RNA, 17 nt, Human
ggcaucuugcuggcuac

SEQ ID NO: 1765949 - RNA, 17 nt, Human
ggcagugggagcugccu

SEQ ID NO: 1765950 - RNA, 17 nt, Human
ggcacuggaccccagca

SEQ ID NO: 1765951 - RNA, 21 nt, Human
ggccaucugguuaggauggca

SEQ ID NO: 1765952 - RNA, 22 nt, Human
ggccaucugguuaggauggcag

SEQ ID NO: 1765953 - RNA, 16 nt, Human
ggccagugugacaagg

SEQ ID NO: 1765954 - RNA, 11 nt, Human
ggccagggcug

SEQ ID NO: 1765955 - RNA, 13 nt, Human
ggccagggcagag

SEQ ID NO: 1765956 - RNA, 16 nt, Human
ggccaggcuggucuca

SEQ ID NO: 1765957 - RNA, 18 nt, Human
ggccaggcuggucucaaa

SEQ ID NO: 1765958 - RNA, 14 nt, Human
ggccaggcuggucu

SEQ ID NO: 1765959 - RNA, 15 nt, Human
ggccaaaccucuguu

SEQ ID NO: 1765960 - RNA, 16 nt, Human
ggccaaaccucuguuc

SEQ ID NO: 1765961 - RNA, 12 nt, Human
ggccaaaccucu

SEQ ID NO: 1765962 - RNA, 14 nt, Human
gcuggagcacuggg

SEQ ID NO: 1765963 - RNA, 15 nt, Human
gcuggagcacugggc

SEQ ID NO: 1765964 - RNA, 16 nt, Human
gcuggagcacugggcu

SEQ ID NO: 1765965 - RNA, 18 nt, Human
gcuggagcacugggcucc

SEQ ID NO: 1765966 - RNA, 21 nt, Human
gcuggagcacugggcucccgg

SEQ ID NO: 1765967 - RNA, 14 nt, Human
gcugcugucuuguu

SEQ ID NO: 1765968 - RNA, 19 nt, Human
gcugcuccccagcagcgga

SEQ ID NO: 1765969 - RNA, 16 nt, Human
gcugcuccccagcagc

SEQ ID NO: 1765970 - RNA, 17 nt, Human
gcugccauccagguuca

SEQ ID NO: 1765971 - RNA, 12 nt, Human
gcugcugacagu

SEQ ID NO: 1765972 - RNA, 15 nt, Human
gcugagucaucuguu

SEQ ID NO: 1765973 - RNA, 23 nt, Human
gcugagucaucuguuagggccuu

SEQ ID NO: 1765974 - RNA, 13 nt, Human
gcugcagagaaac

SEQ ID NO: 1765975 - RNA, 20 nt, Human
gcugcagagaaacuuaagca

SEQ ID NO: 1765976 - RNA, 12 nt, Human
gcugccauccag

SEQ ID NO: 1765977 - RNA, 13 nt, Human
gcugccauccagg

SEQ ID NO: 1765978 - RNA, 14 nt, Human
gcugcagcucccug

SEQ ID NO: 1765979 - RNA, 15 nt, Human
gcugcagcucccugg

SEQ ID NO: 1765980 - RNA, 16 nt, Human
gcugcagcucccuggc

SEQ ID NO: 1765981 - RNA, 19 nt, Human
gcugcagcucccuggcuuc

SEQ ID NO: 1765982 - RNA, 23 nt, Human
gcugcagcucccuggcuucugug

SEQ ID NO: 1765983 - RNA, 21 nt, Human
gcugcagccugcgccaccgcc

SEQ ID NO: 1765984 - RNA, 20 nt, Human
gcucugaucauccacugugc

SEQ ID NO: 1765985 - RNA, 16 nt, Human
gcucugaaaccagugu

SEQ ID NO: 1765986 - RNA, 22 nt, Human
gcucucuuuuucuccaggguca

SEQ ID NO: 1765987 - RNA, 23 nt, Human
gcucucuuuuucuccagggucag

SEQ ID NO: 1765988 - RNA, 21 nt, Human
gcucugaucauccacugugcc

SEQ ID NO: 1765989 - RNA, 22 nt, Human
gcucugaucauccacugugcca

SEQ ID NO: 1765990 - RNA, 13 nt, Human
gcugacagacaca

SEQ ID NO: 1765991 - RNA, 14 nt, Human
gcucuguccuggga

SEQ ID NO: 1765992 - RNA, 18 nt, Human
gcucuguaucaggaccca

SEQ ID NO: 1765993 - RNA, 19 nt, Human
gcucuguaucaggacccag

SEQ ID NO: 1765994 - RNA, 22 nt, Human
gcucuguaucaggacccagagg

SEQ ID NO: 1765995 - RNA, 23 nt, Human
gcucuguaucaggacccagagga

SEQ ID NO: 1765996 - RNA, 19 nt, Human
gcugaaagcugguggcaga

SEQ ID NO: 1765997 - RNA, 13 nt, Human
gcucuguggguga

SEQ ID NO: 1765998 - RNA, 16 nt, Human
gcucugugggugaugg

SEQ ID NO: 1765999 - RNA, 23 nt, Human
gcucugugggugauggggagggg

SEQ ID NO: 1766000 - RNA, 12 nt, Human
gcuccagagggc

SEQ ID NO: 1766001 - RNA, 20 nt, Human
gcuccagagggcacucugcu

SEQ ID NO: 1766002 - RNA, 21 nt, Human
gcuccagagggcacucugcuu

SEQ ID NO: 1766003 - RNA, 15 nt, Human
gcuccucuccccagc

SEQ ID NO: 1766004 - RNA, 17 nt, Human
gcuccagcucaccagcc

SEQ ID NO: 1766005 - RNA, 12 nt, Human
gcucccagggca

SEQ ID NO: 1766006 - RNA, 14 nt, Human
gcucccaggugcag

SEQ ID NO: 1766007 - RNA, 19 nt, Human
gcucccaggugcagccaga

SEQ ID NO: 1766008 - RNA, 20 nt, Human
gcucccaggugcagccagag

SEQ ID NO: 1766009 - RNA, 22 nt, Human
gcucccaggugcagccagaggc

SEQ ID NO: 1766010 - RNA, 13 nt, Human
gcuccagcucacc

SEQ ID NO: 1766011 - RNA, 14 nt, Human
gcuccagcucacca

SEQ ID NO: 1766012 - RNA, 13 nt, Human
gcuccagccaucu

SEQ ID NO: 1766013 - RNA, 14 nt, Human
gcuccagccaucuc

SEQ ID NO: 1766014 - RNA, 17 nt, Human
gcucuaugcuuuccaaa

SEQ ID NO: 1766015 - RNA, 21 nt, Human
gcucuauuauauaaacuuuau

SEQ ID NO: 1766016 - RNA, 14 nt, Human
gcucuacccagggc

SEQ ID NO: 1766017 - RNA, 15 nt, Human
gcucuacccagggcc

SEQ ID NO: 1766018 - RNA, 18 nt, Human
gcucuacccagggccugc

SEQ ID NO: 1766019 - RNA, 19 nt, Human
gcucuacccagggccugca

SEQ ID NO: 1766020 - RNA, 16 nt, Human
gcuccucuccccagca

SEQ ID NO: 1766021 - RNA, 19 nt, Human
gcuccucuccccagcaagu

SEQ ID NO: 1766022 - RNA, 23 nt, Human
gcugguucaggguuggccccugc

SEQ ID NO: 1766023 - RNA, 15 nt, Human
gcuucaguggcagcu

SEQ ID NO: 1766024 - RNA, 14 nt, Human
gcuucaguggcagc

SEQ ID NO: 1766025 - RNA, 13 nt, Human
gcuguuggcuggg

SEQ ID NO: 1766026 - RNA, 19 nt, Human
gcuguugcugaauaggcga

SEQ ID NO: 1766027 - RNA, 16 nt, Human
gcuguugcugaauagg

SEQ ID NO: 1766028 - RNA, 14 nt, Human
gcuguuggcugggg

SEQ ID NO: 1766029 - RNA, 15 nt, Human
gcuguugcugaauag

SEQ ID NO: 1766030 - RNA, 14 nt, Human
gcuguugcugaaua

SEQ ID NO: 1766031 - RNA, 16 nt, Human
gcuuccauagcugcug

SEQ ID NO: 1766032 - RNA, 18 nt, Human
gcuuccauagcugcugcc

SEQ ID NO: 1766033 - RNA, 20 nt, Human
gcuuccauagcugcugcccu

SEQ ID NO: 1766034 - RNA, 16 nt, Human
gcuuccuguccuccca

SEQ ID NO: 1766035 - RNA, 21 nt, Human
gcuuccuguccucccagcucc

SEQ ID NO: 1766036 - RNA, 15 nt, Human
gcuugaaggcccugc

SEQ ID NO: 1766037 - RNA, 16 nt, Human
gcuugaaggcccugcu

SEQ ID NO: 1766038 - RNA, 18 nt, Human
gcuugaaggcccugcuga

SEQ ID NO: 1766039 - RNA, 20 nt, Human
gcuugaaggcccugcugagu

SEQ ID NO: 1766040 - RNA, 13 nt, Human
gcuuucugccacc

SEQ ID NO: 1766041 - RNA, 18 nt, Human
gcuuguaaauagcucagg

SEQ ID NO: 1766042 - RNA, 19 nt, Human
gcuuguaaauagcucaggu

SEQ ID NO: 1766043 - RNA, 17 nt, Human
gcuuguaaauagcucag

SEQ ID NO: 1766044 - RNA, 11 nt, Human
ggaacuugucu

SEQ ID NO: 1766045 - RNA, 18 nt, Human
ggaacuugucucuucauc

SEQ ID NO: 1766046 - RNA, 15 nt, Human
ggaagaaagaauguu

SEQ ID NO: 1766047 - RNA, 18 nt, Human
ggaaaugucacagaagca

SEQ ID NO: 1766048 - RNA, 16 nt, Human
ggaaacuacugccuuu

SEQ ID NO: 1766049 - RNA, 14 nt, Human
gcuuuucucagcug

SEQ ID NO: 1766050 - RNA, 15 nt, Human
gcuuuuggucugugu

SEQ ID NO: 1766051 - RNA, 18 nt, Human
gcuuuugucuaugggacu

SEQ ID NO: 1766052 - RNA, 13 nt, Human
gccagugugacaa

SEQ ID NO: 1766053 - RNA, 16 nt, Human
gccauaugaaaaggcu

SEQ ID NO: 1766054 - RNA, 17 nt, Human
gccauauuuucaccauu

SEQ ID NO: 1766055 - RNA, 15 nt, Human
gccaggccagaggga

SEQ ID NO: 1766056 - RNA, 22 nt, Human
gccaggccagagggagugacag

SEQ ID NO: 1766057 - RNA, 17 nt, Human
gcccaggccccugccac

SEQ ID NO: 1766058 - RNA, 18 nt, Human
gcccaggccccugccacc

SEQ ID NO: 1766059 - RNA, 13 nt, Human
gcccaggcagguc

SEQ ID NO: 1766060 - RNA, 14 nt, Human
gcccaggcaggucu

SEQ ID NO: 1766061 - RNA, 16 nt, Human
gcccaggcaggucuug

SEQ ID NO: 1766062 - RNA, 15 nt, Human
gcccaggccccugcc

SEQ ID NO: 1766063 - RNA, 13 nt, Human
gcccaggccccug

SEQ ID NO: 1766064 - RNA, 14 nt, Human
gccaugugccaggu

SEQ ID NO: 1766065 - RNA, 12 nt, Human
gcccucaucccg

SEQ ID NO: 1766066 - RNA, 19 nt, Human
gcccucagaacccuuggcu

SEQ ID NO: 1766067 - RNA, 14 nt, Human
gcccucagaacccu

SEQ ID NO: 1766068 - RNA, 17 nt, Human
gcccucagaacccuugg

SEQ ID NO: 1766069 - RNA, 18 nt, Human
gcccucagaacccuuggc

SEQ ID NO: 1766070 - RNA, 23 nt, Human
gcccucagaacccuuggcuugcc

SEQ ID NO: 1766071 - RNA, 13 nt, Human
gcccuaugggccu

SEQ ID NO: 1766072 - RNA, 14 nt, Human
gcccuaugggccug

SEQ ID NO: 1766073 - RNA, 15 nt, Human
gcccuaugggccugc

SEQ ID NO: 1766074 - RNA, 16 nt, Human
gcccuaugggccugcc

SEQ ID NO: 1766075 - RNA, 19 nt, Human
gcccuaugggccugccggg

SEQ ID NO: 1766076 - RNA, 21 nt, Human
gcccuaugggccugccgggcu

SEQ ID NO: 1766077 - RNA, 11 nt, Human
gccccuggagg

SEQ ID NO: 1766078 - RNA, 19 nt, Human
gccccuggaggcugccucc

SEQ ID NO: 1766079 - RNA, 20 nt, Human
gccccuggaggcugccuccc

SEQ ID NO: 1766080 - RNA, 21 nt, Human
gccccuggaggcugccuccca

SEQ ID NO: 1766081 - RNA, 22 nt, Human
gccccuggaggcugccucccaa

SEQ ID NO: 1766082 - RNA, 22 nt, Human
gccccugcugguucaggguugg

SEQ ID NO: 1766083 - RNA, 14 nt, Human
gccccccugcccug

SEQ ID NO: 1766084 - RNA, 15 nt, Human
gccccccugcccugu

SEQ ID NO: 1766085 - RNA, 22 nt, Human
gcggagagaggccuugucccag

SEQ ID NO: 1766086 - RNA, 19 nt, Human
gcgugcacacaccagagcc

SEQ ID NO: 1766087 - RNA, 18 nt, Human
gcgugcacacaccagagc

SEQ ID NO: 1766088 - RNA, 14 nt, Human
gcgugcacacacca

SEQ ID NO: 1766089 - RNA, 19 nt, Human
gcuacuguccuacccaccc

SEQ ID NO: 1766090 - RNA, 20 nt, Human
gcuacuguccuacccacccu

SEQ ID NO: 1766091 - RNA, 16 nt, Human
gcuaauuuuucauuuu

SEQ ID NO: 1766092 - RNA, 17 nt, Human
gcgauucuucugcuuca

SEQ ID NO: 1766093 - RNA, 14 nt, Human
gcgauucuucugcu

SEQ ID NO: 1766094 - RNA, 13 nt, Human
gcgauucuucugc

SEQ ID NO: 1766095 - RNA, 16 nt, Human
gccugcccguaaacac

SEQ ID NO: 1766096 - RNA, 21 nt, Human
gccugcccguaaacacgccug

SEQ ID NO: 1766097 - RNA, 10 nt, Human
gccuccuuua

SEQ ID NO: 1766098 - RNA, 17 nt, Human
gccugcuaauuccccag

SEQ ID NO: 1766099 - RNA, 23 nt, Human
gccugcuaauuccccagauugca

SEQ ID NO: 1766100 - RNA, 23 nt, Human
gccugcuagcuagcucaacuagu

SEQ ID NO: 1766101 - RNA, 16 nt, Human
gccugcuagcuagcuc

SEQ ID NO: 1766102 - RNA, 20 nt, Human
gccugcuagcuagcucaacu

SEQ ID NO: 1766103 - RNA, 22 nt, Human
gccugcuagcuagcucaacuag

SEQ ID NO: 1766104 - RNA, 13 nt, Human
gccugcgccugcu

SEQ ID NO: 1766105 - RNA, 14 nt, Human
gccugcgccugcug

SEQ ID NO: 1766106 - RNA, 16 nt, Human
gccugcgccugcugca

SEQ ID NO: 1766107 - RNA, 22 nt, Human
gccugcgccugcugcaugcccu

SEQ ID NO: 1766108 - RNA, 12 nt, Human
gagauucauuuu

SEQ ID NO: 1766109 - RNA, 13 nt, Human
gagauucauuuuc

SEQ ID NO: 1766110 - RNA, 21 nt, Human
gagauucauuuucuagauaca

SEQ ID NO: 1766111 - RNA, 18 nt, Human
gagcugggugucaagagg

SEQ ID NO: 1766112 - RNA, 13 nt, Human
gagccccgaggcc

SEQ ID NO: 1766113 - RNA, 21 nt, Human
gagcugccuguucagcuccag

SEQ ID NO: 1766114 - RNA, 22 nt, Human
gagcugccuguucagcuccagc

SEQ ID NO: 1766115 - RNA, 14 nt, Human
gagcagggcucagc

SEQ ID NO: 1766116 - RNA, 17 nt, Human
gagcauggguucauccu

SEQ ID NO: 1766117 - RNA, 21 nt, Human
gagcagggcucagcggggaca

SEQ ID NO: 1766118 - RNA, 16 nt, Human
gagccccauuccuggg

SEQ ID NO: 1766119 - RNA, 17 nt, Human
gagccccauuccuggga

SEQ ID NO: 1766120 - RNA, 18 nt, Human
gagccccauuccugggaa

SEQ ID NO: 1766121 - RNA, 21 nt, Human
gacuuuucuuuguggcuuccu

SEQ ID NO: 1766122 - RNA, 19 nt, Human
gacugguggcaggggcuuc

SEQ ID NO: 1766123 - RNA, 10 nt, Human
gacuggugcc

SEQ ID NO: 1766124 - RNA, 16 nt, Human
gacuggugcccuccuc

SEQ ID NO: 1766125 - RNA, 18 nt, Human
gagacccagcccucaucc

SEQ ID NO: 1766126 - RNA, 12 nt, Human
gacucugucuca

SEQ ID NO: 1766127 - RNA, 13 nt, Human
gacucuggguccu

SEQ ID NO: 1766128 - RNA, 14 nt, Human
gacucuggguccuu

SEQ ID NO: 1766129 - RNA, 18 nt, Human
gacucuggguccuuccug

SEQ ID NO: 1766130 - RNA, 19 nt, Human
gacucuggguccuuccuga

SEQ ID NO: 1766131 - RNA, 20 nt, Human
gacucuggguccuuccugaa

SEQ ID NO: 1766132 - RNA, 19 nt, Human
gacucugaaauaucccggg

SEQ ID NO: 1766133 - RNA, 16 nt, Human
gacucuuucugagugc

SEQ ID NO: 1766134 - RNA, 19 nt, Human
gacucuuucugagugccuu

SEQ ID NO: 1766135 - RNA, 21 nt, Human
gacucuuucugagugccuucu

SEQ ID NO: 1766136 - RNA, 13 nt, Human
gacacugaugggc

SEQ ID NO: 1766137 - RNA, 15 nt, Human
gacacugaugggcaa

SEQ ID NO: 1766138 - RNA, 12 nt, Human
gacagacacagg

SEQ ID NO: 1766139 - RNA, 20 nt, Human
gacaggguuuugccauguug

SEQ ID NO: 1766140 - RNA, 22 nt, Human
gacaggguuuugccauguuggc

SEQ ID NO: 1766141 - RNA, 23 nt, Human
gacacugcagaaacccugagcag

SEQ ID NO: 1766142 - RNA, 13 nt, Human
gacagacacacac

SEQ ID NO: 1766143 - RNA, 15 nt, Human
gacagacacacacac

SEQ ID NO: 1766144 - RNA, 11 nt, Human
gacagcuccuu

SEQ ID NO: 1766145 - RNA, 14 nt, Human
gacagugaaagaaa

SEQ ID NO: 1766146 - RNA, 17 nt, Human
gacaaaauggauacaua

SEQ ID NO: 1766147 - RNA, 21 nt, Human
gacacacagcucuguccuggg

SEQ ID NO: 1766148 - RNA, 21 nt, Human
gaauuuguguugaaggaacuu

SEQ ID NO: 1766149 - RNA, 20 nt, Human
gaauuuuggggauuuucaaa

SEQ ID NO: 1766150 - RNA, 16 nt, Human
gaauuuuguucucugg

SEQ ID NO: 1766151 - RNA, 17 nt, Human
gaauuuuguucucuggg

SEQ ID NO: 1766152 - RNA, 18 nt, Human
gaauuuuguucucuggga

SEQ ID NO: 1766153 - RNA, 20 nt, Human
gaauuuuguucucugggaga

SEQ ID NO: 1766154 - RNA, 23 nt, Human
gaauuuuguucucugggagaaaa

SEQ ID NO: 1766155 - RNA, 14 nt, Human
gaauuuuuccuaug

SEQ ID NO: 1766156 - RNA, 22 nt, Human
gaauuuuuccuaugcuauugac

SEQ ID NO: 1766157 - RNA, 13 nt, Human
gaauuuuugcaau

SEQ ID NO: 1766158 - RNA, 14 nt, Human
gaauuuuugcaaua

SEQ ID NO: 1766159 - RNA, 15 nt, Human
gaauuuuugcaauaa

SEQ ID NO: 1766160 - RNA, 15 nt, Human
gacacacagcucugu

SEQ ID NO: 1766161 - RNA, 17 nt, Human
gacacacagcucugucc

SEQ ID NO: 1766162 - RNA, 18 nt, Human
gacacacagcucuguccu

SEQ ID NO: 1766163 - RNA, 19 nt, Human
gacacacagcucuguccug

SEQ ID NO: 1766164 - RNA, 14 nt, Human
gacacacagcucug

SEQ ID NO: 1766165 - RNA, 14 nt, Human
gaagugaacauuuc

SEQ ID NO: 1766166 - RNA, 17 nt, Human
gaagggagcuagccaga

SEQ ID NO: 1766167 - RNA, 14 nt, Human
gaaggcuaaaaagc

SEQ ID NO: 1766168 - RNA, 16 nt, Human
gaaggcuaaaaagcaa

SEQ ID NO: 1766169 - RNA, 17 nt, Human
gaaggcuaaaaagcaac

SEQ ID NO: 1766170 - RNA, 16 nt, Human
gaagugcaucuacuug

SEQ ID NO: 1766171 - RNA, 14 nt, Human
gaaugagaaaugga

SEQ ID NO: 1766172 - RNA, 19 nt, Human
gcaccgugucaagcugcuc

SEQ ID NO: 1766173 - RNA, 20 nt, Human
gcaccgugucaagcugcucu

SEQ ID NO: 1766174 - RNA, 21 nt, Human
gcaccgugucaagcugcucug

SEQ ID NO: 1766175 - RNA, 12 nt, Human
gcacugacauug

SEQ ID NO: 1766176 - RNA, 16 nt, Human
gcagaaauacagucuu

SEQ ID NO: 1766177 - RNA, 13 nt, Human
gcaagugagagcu

SEQ ID NO: 1766178 - RNA, 11 nt, Human
gcaagucucuu

SEQ ID NO: 1766179 - RNA, 17 nt, Human
gcacaugcaccuaccca

SEQ ID NO: 1766180 - RNA, 19 nt, Human
gcacauauuagugcagcca

SEQ ID NO: 1766181 - RNA, 20 nt, Human
gcacauauuagugcagccaa

SEQ ID NO: 1766182 - RNA, 22 nt, Human
gcacauauuagugcagccaagu

SEQ ID NO: 1766183 - RNA, 17 nt, Human
gcacaucugugucuugu

SEQ ID NO: 1766184 - RNA, 18 nt, Human
gcacaucugugucuuguu

SEQ ID NO: 1766185 - RNA, 18 nt, Human
gcauacccaaaccaggug

SEQ ID NO: 1766186 - RNA, 19 nt, Human
gcaguccugaucagagccg

SEQ ID NO: 1766187 - RNA, 19 nt, Human
gcagucauuauccagguaa

SEQ ID NO: 1766188 - RNA, 11 nt, Human
gcaguuugaaa

SEQ ID NO: 1766189 - RNA, 13 nt, Human
gcaguuugaaauu

SEQ ID NO: 1766190 - RNA, 14 nt, Human
gcaguuugaaauuc

SEQ ID NO: 1766191 - RNA, 17 nt, Human
gcaguuugaaauucuga

SEQ ID NO: 1766192 - RNA, 18 nt, Human
gcaguuugaaauucugaa

SEQ ID NO: 1766193 - RNA, 19 nt, Human
gcaguuugaaauucugaau

SEQ ID NO: 1766194 - RNA, 21 nt, Human
gcaguuugaaauucugaauuu

SEQ ID NO: 1766195 - RNA, 22 nt, Human
gcaguuugaaauucugaauuug

SEQ ID NO: 1766196 - RNA, 17 nt, Human
gcagcugcgguccaccc

SEQ ID NO: 1766197 - RNA, 19 nt, Human
gcagcugcgguccacccag

SEQ ID NO: 1766198 - RNA, 13 nt, Human
gcagggaaacagc

SEQ ID NO: 1766199 - RNA, 21 nt, Human
gcagggaaaauuauuugcaua

SEQ ID NO: 1766200 - RNA, 13 nt, Human
gcaguaugguaca

SEQ ID NO: 1766201 - RNA, 17 nt, Human
gcaguaugguacauuuu

SEQ ID NO: 1766202 - RNA, 16 nt, Human
gcaguauuuugugucc

SEQ ID NO: 1766203 - RNA, 17 nt, Human
gcaguauuuuguguccu

SEQ ID NO: 1766204 - RNA, 23 nt, Human
gcaguauuuuguguccuccagga

SEQ ID NO: 1766205 - RNA, 19 nt, Human
gcaguagaaauaauaugca

SEQ ID NO: 1766206 - RNA, 20 nt, Human
gcaguagaaauaauaugcau

SEQ ID NO: 1766207 - RNA, 21 nt, Human
gcaguagaaauaauaugcauu

SEQ ID NO: 1766208 - RNA, 16 nt, Human
gcagagcccaagggaa

SEQ ID NO: 1766209 - RNA, 18 nt, Human
gcagagcgcgccccuagc

SEQ ID NO: 1766210 - RNA, 19 nt, Human
gcagagcgcgccccuagcc

SEQ ID NO: 1766211 - RNA, 12 nt, Human
gcagccagaggc

SEQ ID NO: 1766212 - RNA, 14 nt, Human
gcagccagaggcac

SEQ ID NO: 1766213 - RNA, 14 nt, Human
gcagccccagccug

SEQ ID NO: 1766214 - RNA, 15 nt, Human
gcagccccagccugc

SEQ ID NO: 1766215 - RNA, 16 nt, Human
gcagccccagccugcu

SEQ ID NO: 1766216 - RNA, 17 nt, Human
gcagccccagccugcua

SEQ ID NO: 1766217 - RNA, 13 nt, Human
gcagccccagccu

SEQ ID NO: 1766218 - RNA, 12 nt, Human
gauucugaaucu

SEQ ID NO: 1766219 - RNA, 19 nt, Human
gauuauguagcaaaauaca

SEQ ID NO: 1766220 - RNA, 19 nt, Human
gauuagguuucagcagagc

SEQ ID NO: 1766221 - RNA, 20 nt, Human
gauuagguuucagcagagcu

SEQ ID NO: 1766222 - RNA, 20 nt, Human
gauuacaggugugaaccacc

SEQ ID NO: 1766223 - RNA, 13 nt, Human
gauuaccuccuga

SEQ ID NO: 1766224 - RNA, 14 nt, Human
gauuaccuccugag

SEQ ID NO: 1766225 - RNA, 17 nt, Human
gauuaccuccugagaaa

SEQ ID NO: 1766226 - RNA, 14 nt, Human
gauuacaugcaugu

SEQ ID NO: 1766227 - RNA, 18 nt, Human
gauuacuucucuauaaaa

SEQ ID NO: 1766228 - RNA, 19 nt, Human
gauuacuucucuauaaaaa

SEQ ID NO: 1766229 - RNA, 20 nt, Human
gauuacuucucuauaaaaaa

SEQ ID NO: 1766230 - RNA, 21 nt, Human
gaucucauuggacccuuccau

SEQ ID NO: 1766231 - RNA, 18 nt, Human
gaugagaguuuuggaugc

SEQ ID NO: 1766232 - RNA, 13 nt, Human
gaugagaguuuug

SEQ ID NO: 1766233 - RNA, 21 nt, Human
gaugaugaaaugaggucagag

SEQ ID NO: 1766234 - RNA, 20 nt, Human
gaugaucuuugcagacaggc

SEQ ID NO: 1766235 - RNA, 21 nt, Human
gaugaucuuugcagacaggca

SEQ ID NO: 1766236 - RNA, 21 nt, Human
gaugagaguuuuggaugcagu

SEQ ID NO: 1766237 - RNA, 15 nt, Human
gaugagcccucagaa

SEQ ID NO: 1766238 - RNA, 19 nt, Human
gaugagcccucagaacccu

SEQ ID NO: 1766239 - RNA, 22 nt, Human
gaugagcccucagaacccuugg

SEQ ID NO: 1766240 - RNA, 14 nt, Human
gauacucauuucuu

SEQ ID NO: 1766241 - RNA, 12 nt, Human
gauacucucuuc

SEQ ID NO: 1766242 - RNA, 20 nt, Human
gauauguauguugugaauua

SEQ ID NO: 1766243 - RNA, 13 nt, Human
gagugcagugagc

SEQ ID NO: 1766244 - RNA, 17 nt, Human
gagugcaguccugauca

SEQ ID NO: 1766245 - RNA, 18 nt, Human
gagugcaguccugaucag

SEQ ID NO: 1766246 - RNA, 22 nt, Human
gagugcaguccugaucagagcc

SEQ ID NO: 1766247 - RNA, 14 nt, Human
gagugccuucugug

SEQ ID NO: 1766248 - RNA, 15 nt, Human
gagugccuucugugg

SEQ ID NO: 1766249 - RNA, 16 nt, Human
gagugccuucuguggg

SEQ ID NO: 1766250 - RNA, 16 nt, Human
gagucccaccuuggcu

SEQ ID NO: 1766251 - RNA, 20 nt, Human
gagucccaccuuggcugcag

SEQ ID NO: 1766252 - RNA, 15 nt, Human
gagucaccaagccca

SEQ ID NO: 1766253 - RNA, 13 nt, Human
gagucaccaagcc

SEQ ID NO: 1766254 - RNA, 14 nt, Human
gagucaccaagccc

SEQ ID NO: 1766255 - RNA, 11 nt, Human
gagugcaguga

SEQ ID NO: 1766256 - RNA, 12 nt, Human
gagugcagugag

SEQ ID NO: 1766257 - RNA, 14 nt, Human
gagugcaguccuga

SEQ ID NO: 1766258 - RNA, 24 nt, Human
gagugagcacuaaggugugcucug

SEQ ID NO: 1766259 - RNA, 21 nt, Human
gagucccaccuuggcugcagg

SEQ ID NO: 1766260 - RNA, 12 nt, Human
gagugagcuggu

SEQ ID NO: 1766261 - RNA, 15 nt, Human
cuuccauagcugcug

SEQ ID NO: 1766262 - RNA, 17 nt, Human
cuuccauagcugcugcc

SEQ ID NO: 1766263 - RNA, 21 nt, Human
cuuccauagcugcugcccuag

SEQ ID NO: 1766264 - RNA, 22 nt, Human
cuucaugcaggugaaacccagu

SEQ ID NO: 1766265 - RNA, 20 nt, Human
cuucauaugaaaggugccau

SEQ ID NO: 1766266 - RNA, 22 nt, Human
cuucauaugaaaggugccaugg

SEQ ID NO: 1766267 - RNA, 23 nt, Human
cuucauaugaaaggugccaugga

SEQ ID NO: 1766268 - RNA, 13 nt, Human
cuucaucuuccug

SEQ ID NO: 1766269 - RNA, 14 nt, Human
cuucaucuuccugu

SEQ ID NO: 1766270 - RNA, 15 nt, Human
cuucaucuuccugug

SEQ ID NO: 1766271 - RNA, 16 nt, Human
cuucaucuuccugugu

SEQ ID NO: 1766272 - RNA, 19 nt, Human
cuucaucuuccuguguccu

SEQ ID NO: 1766273 - RNA, 20 nt, Human
cuucaucuuccuguguccug

SEQ ID NO: 1766274 - RNA, 21 nt, Human
cuucaucuuccuguguccuga

SEQ ID NO: 1766275 - RNA, 22 nt, Human
cuucaucuuccuguguccugaa

SEQ ID NO: 1766276 - RNA, 15 nt, Human
cuucacuguaaaaua

SEQ ID NO: 1766277 - RNA, 17 nt, Human
cuuauuagagugucuuu

SEQ ID NO: 1766278 - RNA, 20 nt, Human
cuuauuagagugucuuucca

SEQ ID NO: 1766279 - RNA, 21 nt, Human
cuuauuagagugucuuuccac

SEQ ID NO: 1766280 - RNA, 18 nt, Human
cuugccuuauuagagugu

SEQ ID NO: 1766281 - RNA, 20 nt, Human
cuugccuuauuagagugucu

SEQ ID NO: 1766282 - RNA, 21 nt, Human
cuugaugcaugcacuguuccc

SEQ ID NO: 1766283 - RNA, 21 nt, Human
cuugccuuauuagagugucuu

SEQ ID NO: 1766284 - RNA, 17 nt, Human
cuugccuuucgaggccu

SEQ ID NO: 1766285 - RNA, 18 nt, Human
cuugccuuucgaggccug

SEQ ID NO: 1766286 - RNA, 19 nt, Human
cuugccuuucgaggccuga

SEQ ID NO: 1766287 - RNA, 20 nt, Human
cuugccuuucgaggccugaa

SEQ ID NO: 1766288 - RNA, 21 nt, Human
cuuggcacccaagaccucagg

SEQ ID NO: 1766289 - RNA, 18 nt, Human
cuuggcagcaccugucuc

SEQ ID NO: 1766290 - RNA, 19 nt, Human
cuuggcagcaccugucucc

SEQ ID NO: 1766291 - RNA, 20 nt, Human
cuuggcagcaccugucuccu

SEQ ID NO: 1766292 - RNA, 14 nt, Human
cuugacagggcaca

SEQ ID NO: 1766293 - RNA, 15 nt, Human
cuugacagggcacac

SEQ ID NO: 1766294 - RNA, 13 nt, Human
cuugacagggcac

SEQ ID NO: 1766295 - RNA, 20 nt, Human
cuugacagggcacaccgggc

SEQ ID NO: 1766296 - RNA, 19 nt, Human
cuucuuccaggugcccagc

SEQ ID NO: 1766297 - RNA, 13 nt, Human
cuucuagagcuua

SEQ ID NO: 1766298 - RNA, 17 nt, Human
cuucuagcugacuugca

SEQ ID NO: 1766299 - RNA, 15 nt, Human
cuuccuccugggccc

SEQ ID NO: 1766300 - RNA, 22 nt, Human
cuuccuccugggcccucucugc

SEQ ID NO: 1766301 - RNA, 12 nt, Human
cuuccuccuggg

SEQ ID NO: 1766302 - RNA, 14 nt, Human
cuuccuccugggcc

SEQ ID NO: 1766303 - RNA, 19 nt, Human
gaaagggacuuggaagcuc

SEQ ID NO: 1766304 - RNA, 22 nt, Human
gaaagggacuuggaagcuccgc

SEQ ID NO: 1766305 - RNA, 18 nt, Human
gaaaggugccauggaaga

SEQ ID NO: 1766306 - RNA, 22 nt, Human
gaaaggugccauggaagaggcu

SEQ ID NO: 1766307 - RNA, 23 nt, Human
gaaaggugccauggaagaggcua

SEQ ID NO: 1766308 - RNA, 15 nt, Human
cuuuugcccuuugau

SEQ ID NO: 1766309 - RNA, 18 nt, Human
cuuuugucuaugggacuc

SEQ ID NO: 1766310 - RNA, 12 nt, Human
cuuuuguaauaa

SEQ ID NO: 1766311 - RNA, 14 nt, Human
cuuuuguaauaaac

SEQ ID NO: 1766312 - RNA, 15 nt, Human
cuuuuuuuuuuuucc

SEQ ID NO: 1766313 - RNA, 16 nt, Human
cuuuuuuuuuuuucca

SEQ ID NO: 1766314 - RNA, 11 nt, Human
cuuuuuuuccc

SEQ ID NO: 1766315 - RNA, 17 nt, Human
gaaaauuuguuauuuug

SEQ ID NO: 1766316 - RNA, 21 nt, Human
gaaaauuuguuauuuugcaac

SEQ ID NO: 1766317 - RNA, 18 nt, Human
gaaaauuccuauaaggaa

SEQ ID NO: 1766318 - RNA, 18 nt, Human
gaaaauggaaccaggcuu

SEQ ID NO: 1766319 - RNA, 18 nt, Human
gaaaaugguccaggagaa

SEQ ID NO: 1766320 - RNA, 21 nt, Human
gaaaaugcauuguaucgaugu

SEQ ID NO: 1766321 - RNA, 15 nt, Human
gaaaauggaaccagg

SEQ ID NO: 1766322 - RNA, 15 nt, Human
cuuuccuuggcuuua

SEQ ID NO: 1766323 - RNA, 17 nt, Human
cuuuccuuggcuuuaug

SEQ ID NO: 1766324 - RNA, 17 nt, Human
cuuucuacccagcgagc

SEQ ID NO: 1766325 - RNA, 16 nt, Human
cuuuuauagaugguca

SEQ ID NO: 1766326 - RNA, 9 nt, Human
cuuuccugu

SEQ ID NO: 1766327 - RNA, 10 nt, Human
cuuuccuguc

SEQ ID NO: 1766328 - RNA, 13 nt, Human
cuuuccuguccca

SEQ ID NO: 1766329 - RNA, 21 nt, Human
cuuucaauuccguagccagcu

SEQ ID NO: 1766330 - RNA, 14 nt, Human
cuggguucacugca

SEQ ID NO: 1766331 - RNA, 12 nt, Human
cuggggaaggag

SEQ ID NO: 1766332 - RNA, 15 nt, Human
cuggggaaggagcca

SEQ ID NO: 1766333 - RNA, 16 nt, Human
cuggggaaggagccag

SEQ ID NO: 1766334 - RNA, 17 nt, Human
cuggggaaggagccagu

SEQ ID NO: 1766335 - RNA, 18 nt, Human
cuggggaaggagccaguu

SEQ ID NO: 1766336 - RNA, 12 nt, Human
cuggcagcucag

SEQ ID NO: 1766337 - RNA, 17 nt, Human
cuggcuccagugaaacu

SEQ ID NO: 1766338 - RNA, 12 nt, Human
cugggacacagu

SEQ ID NO: 1766339 - RNA, 13 nt, Human
cugggacacaguu

SEQ ID NO: 1766340 - RNA, 20 nt, Human
cugucauuugagcagggcuc

SEQ ID NO: 1766341 - RNA, 17 nt, Human
cugucauuugagcaggg

SEQ ID NO: 1766342 - RNA, 18 nt, Human
cugucauuugagcagggc

SEQ ID NO: 1766343 - RNA, 16 nt, Human
cugucauuugagcagg

SEQ ID NO: 1766344 - RNA, 22 nt, Human
cuguaaaaucuuucuuucuuag

SEQ ID NO: 1766345 - RNA, 11 nt, Human
cuguaaaaucu

SEQ ID NO: 1766346 - RNA, 10 nt, Human
cuguaaaauc

SEQ ID NO: 1766347 - RNA, 13 nt, Human
cugucaccucuuc

SEQ ID NO: 1766348 - RNA, 15 nt, Human
cugucaccucuuccg

SEQ ID NO: 1766349 - RNA, 21 nt, Human
cugugaagcauucgagacaga

SEQ ID NO: 1766350 - RNA, 23 nt, Human
cugugaagcauucgagacagaac

SEQ ID NO: 1766351 - RNA, 14 nt, Human
cugugaagaucuca

SEQ ID NO: 1766352 - RNA, 20 nt, Human
cugugaagaucucacucugc

SEQ ID NO: 1766353 - RNA, 21 nt, Human
cugugaagaucucacucugcc

SEQ ID NO: 1766354 - RNA, 14 nt, Human
cugugcucuggaca

SEQ ID NO: 1766355 - RNA, 15 nt, Human
cugugcucuggacag

SEQ ID NO: 1766356 - RNA, 18 nt, Human
cugugcucaggacucaga

SEQ ID NO: 1766357 - RNA, 19 nt, Human
cugugcucaggacucagaa

SEQ ID NO: 1766358 - RNA, 23 nt, Human
cugugcucaggacucagaagccu

SEQ ID NO: 1766359 - RNA, 13 nt, Human
cugucgcccaguc

SEQ ID NO: 1766360 - RNA, 14 nt, Human
cugcuucagccucc

SEQ ID NO: 1766361 - RNA, 16 nt, Human
cugcuucagccucccg

SEQ ID NO: 1766362 - RNA, 13 nt, Human
cugcuucagccuc

SEQ ID NO: 1766363 - RNA, 23 nt, Human
cugcuucagccucccgaguagcu

SEQ ID NO: 1766364 - RNA, 15 nt, Human
cugcugacagacaca

SEQ ID NO: 1766365 - RNA, 18 nt, Human
cugcugacagacacaggc

SEQ ID NO: 1766366 - RNA, 19 nt, Human
cugcugacagacacaggcc

SEQ ID NO: 1766367 - RNA, 20 nt, Human
cugcugacagacacaggccc

SEQ ID NO: 1766368 - RNA, 21 nt, Human
cugcugacagacacaggcccg

SEQ ID NO: 1766369 - RNA, 23 nt, Human
cugcugacagacacaggcccggc

SEQ ID NO: 1766370 - RNA, 11 nt, Human
cugcugacagu

SEQ ID NO: 1766371 - RNA, 15 nt, Human
cugccucgaacuggc

SEQ ID NO: 1766372 - RNA, 17 nt, Human
cugccucgaacuggcug

SEQ ID NO: 1766373 - RNA, 18 nt, Human
cugccucgaacuggcugc

SEQ ID NO: 1766374 - RNA, 19 nt, Human
cugccucgaacuggcugca

SEQ ID NO: 1766375 - RNA, 14 nt, Human
cugccuguucagcu

SEQ ID NO: 1766376 - RNA, 15 nt, Human
cugccuguucagcuc

SEQ ID NO: 1766377 - RNA, 12 nt, Human
cugccuggguuu

SEQ ID NO: 1766378 - RNA, 20 nt, Human
cugccuggguuuuguucccu

SEQ ID NO: 1766379 - RNA, 17 nt, Human
cugcucagaacuugcug

SEQ ID NO: 1766380 - RNA, 18 nt, Human
cugcucagaacuugcugc

SEQ ID NO: 1766381 - RNA, 19 nt, Human
cugcucagaacuugcugcu

SEQ ID NO: 1766382 - RNA, 22 nt, Human
cugcucagaacuugcugcuguc

SEQ ID NO: 1766383 - RNA, 16 nt, Human
cugcuaauuccccaga

SEQ ID NO: 1766384 - RNA, 21 nt, Human
cugccaaagggaaauaucauu

SEQ ID NO: 1766385 - RNA, 13 nt, Human
cugccccaucucc

SEQ ID NO: 1766386 - RNA, 16 nt, Human
cugccccaucuccccu

SEQ ID NO: 1766387 - RNA, 17 nt, Human
cugccccaucuccccuc

SEQ ID NO: 1766388 - RNA, 19 nt, Human
cugccccaucuccccucag

SEQ ID NO: 1766389 - RNA, 20 nt, Human
cugccccaucuccccucagc

SEQ ID NO: 1766390 - RNA, 21 nt, Human
cugccccaucuccccucagcu

SEQ ID NO: 1766391 - RNA, 12 nt, Human
cugccauccagg

SEQ ID NO: 1766392 - RNA, 20 nt, Human
cugccauauucuguuggcca

SEQ ID NO: 1766393 - RNA, 21 nt, Human
cugccauauucuguuggccag

SEQ ID NO: 1766394 - RNA, 22 nt, Human
cugccauauucuguuggccagu

SEQ ID NO: 1766395 - RNA, 23 nt, Human
cugccauauucuguuggccagug

SEQ ID NO: 1766396 - RNA, 14 nt, Human
gugaugaauacugu

SEQ ID NO: 1766397 - RNA, 16 nt, Human
gugaugcccugcccuu

SEQ ID NO: 1766398 - RNA, 12 nt, Human
aacuucauggau

SEQ ID NO: 1766399 - RNA, 15 nt, Human
aacuucauggaucag

SEQ ID NO: 1766400 - RNA, 14 nt, Human
aacuggucuuccuu

SEQ ID NO: 1766401 - RNA, 15 nt, Human
aacuggucuuccuuu

SEQ ID NO: 1766402 - RNA, 17 nt, Human
aacuggucuuccuuuuu

SEQ ID NO: 1766403 - RNA, 19 nt, Human
aacuggucuuccuuuuugg

SEQ ID NO: 1766404 - RNA, 21 nt, Human
aacugguauucuguucuggag

SEQ ID NO: 1766405 - RNA, 22 nt, Human
aacugguauucuguucuggagg

SEQ ID NO: 1766406 - RNA, 18 nt, Human
aacuguacuuuuaaggca

SEQ ID NO: 1766407 - RNA, 22 nt, Human
gugccucggcuuuucucagcug

SEQ ID NO: 1766408 - RNA, 21 nt, Human
gugcacacaccagagcccacc

SEQ ID NO: 1766409 - RNA, 20 nt, Human
gugcaugggacccacgaaac

SEQ ID NO: 1766410 - RNA, 18 nt, Human
gugcacaucugugucuug

SEQ ID NO: 1766411 - RNA, 22 nt, Human
gugagucgaggacagggaggug

SEQ ID NO: 1766412 - RNA, 14 nt, Human
gugaggccagggca

SEQ ID NO: 1766413 - RNA, 15 nt, Human
gugaggccagggcag

SEQ ID NO: 1766414 - RNA, 17 nt, Human
gugaggccagggcagag

SEQ ID NO: 1766415 - RNA, 23 nt, Human
gugaacuggacccuguugcuaag

SEQ ID NO: 1766416 - RNA, 22 nt, Human
gugaacuggacccuguugcuaa

SEQ ID NO: 1766417 - RNA, 21 nt, Human
gugaacuggacccuguugcua

SEQ ID NO: 1766418 - RNA, 20 nt, Human
gugaacuggacccuguugcu

SEQ ID NO: 1766419 - RNA, 19 nt, Human
gugaacuggacccuguugc

SEQ ID NO: 1766420 - RNA, 11 nt, Human
aacuggcugca

SEQ ID NO: 1766421 - RNA, 22 nt, Human
aacuggacccuguugcuaagcc

SEQ ID NO: 1766422 - RNA, 21 nt, Human
aacuggacccuguugcuaagc

SEQ ID NO: 1766423 - RNA, 20 nt, Human
aacuggacccuguugcuaag

SEQ ID NO: 1766424 - RNA, 19 nt, Human
aacuggacccuguugcuaa

SEQ ID NO: 1766425 - RNA, 18 nt, Human
aacuggacccuguugcua

SEQ ID NO: 1766426 - RNA, 17 nt, Human
aacuggacccuguugcu

SEQ ID NO: 1766427 - RNA, 14 nt, Human
aacuggacccuguu

SEQ ID NO: 1766428 - RNA, 16 nt, Human
aacuggguacuugugg

SEQ ID NO: 1766429 - RNA, 21 nt, Human
aacuggguacuuguggacaca

SEQ ID NO: 1766430 - RNA, 21 nt, Human
aacccagacggcuccacuagg

SEQ ID NO: 1766431 - RNA, 12 nt, Human
aacccccacugg

SEQ ID NO: 1766432 - RNA, 16 nt, Human
aacccccacuggacug

SEQ ID NO: 1766433 - RNA, 20 nt, Human
aacccccacuggacugaccu

SEQ ID NO: 1766434 - RNA, 16 nt, Human
aaccucaucuucuuca

SEQ ID NO: 1766435 - RNA, 14 nt, Human
aaccuccccagccu

SEQ ID NO: 1766436 - RNA, 15 nt, Human
aaccuccccagccug

SEQ ID NO: 1766437 - RNA, 19 nt, Human
aaccugacaaaaaaaaagu

SEQ ID NO: 1766438 - RNA, 14 nt, Human
aaccucgcuggacu

SEQ ID NO: 1766439 - RNA, 19 nt, Human
aaccucgcuggacucucag

SEQ ID NO: 1766440 - RNA, 14 nt, Human
aaccucgaguacug

SEQ ID NO: 1766441 - RNA, 15 nt, Human
aaccucgaguacugu

SEQ ID NO: 1766442 - RNA, 16 nt, Human
aaccucgaguacugug

SEQ ID NO: 1766443 - RNA, 17 nt, Human
aaccucgaguacugugg

SEQ ID NO: 1766444 - RNA, 19 nt, Human
aaccucgaguacugugggc

SEQ ID NO: 1766445 - RNA, 14 nt, Human
aaccucgcccucuc

SEQ ID NO: 1766446 - RNA, 17 nt, Human
aaccucgcccucuccuu

SEQ ID NO: 1766447 - RNA, 20 nt, Human
aaccucgcccucuccuuugu

SEQ ID NO: 1766448 - RNA, 20 nt, Human
aaccaagucaugugcauuuc

SEQ ID NO: 1766449 - RNA, 21 nt, Human
aaccaccacacccagcccacu

SEQ ID NO: 1766450 - RNA, 20 nt, Human
gucuccuuucaccccagggc

SEQ ID NO: 1766451 - RNA, 19 nt, Human
aaccaccacacccagccca

SEQ ID NO: 1766452 - RNA, 16 nt, Human
aaccaagucaugugca

SEQ ID NO: 1766453 - RNA, 18 nt, Human
gucuccuuucaccccagg

SEQ ID NO: 1766454 - RNA, 20 nt, Human
gucuggcccuagacucgggg

SEQ ID NO: 1766455 - RNA, 12 nt, Human
gucuguaaaauc

SEQ ID NO: 1766456 - RNA, 11 nt, Human
gucuguaaaau

SEQ ID NO: 1766457 - RNA, 18 nt, Human
gucuguaaaaucuuucuu

SEQ ID NO: 1766458 - RNA, 15 nt, Human
gucuguaaaaucuuu

SEQ ID NO: 1766459 - RNA, 14 nt, Human
gucuguaaaaucuu

SEQ ID NO: 1766460 - RNA, 13 nt, Human
gucuguaaaaucu

SEQ ID NO: 1766461 - RNA, 16 nt, Human
gucuuucacauuuaaa

SEQ ID NO: 1766462 - RNA, 18 nt, Human
gucuucucacaagccagc

SEQ ID NO: 1766463 - RNA, 22 nt, Human
gugaaccaccacacccagccca

SEQ ID NO: 1766464 - RNA, 23 nt, Human
gugaaccaccacacccagcccac

SEQ ID NO: 1766465 - RNA, 14 nt, Human
gugaacccuggggc

SEQ ID NO: 1766466 - RNA, 18 nt, Human
gugaacccuggggccuga

SEQ ID NO: 1766467 - RNA, 19 nt, Human
gugaacccuggggccugac

SEQ ID NO: 1766468 - RNA, 21 nt, Human
gugaacccuggggccugacug

SEQ ID NO: 1766469 - RNA, 12 nt, Human
aacuccuggccu

SEQ ID NO: 1766470 - RNA, 14 nt, Human
aacucauuccagau

SEQ ID NO: 1766471 - RNA, 15 nt, Human
aacucauuccagauc

SEQ ID NO: 1766472 - RNA, 21 nt, Human
aacucauuccagaucccaggc

SEQ ID NO: 1766473 - RNA, 14 nt, Human
aacuccuuccuggc

SEQ ID NO: 1766474 - RNA, 17 nt, Human
aacuccuuccuggccug

SEQ ID NO: 1766475 - RNA, 20 nt, Human
aacuccuuccuggccugaga

SEQ ID NO: 1766476 - RNA, 17 nt, Human
aacuacugccuuuagaa

SEQ ID NO: 1766477 - RNA, 19 nt, Human
aacuacugccuuuagaaaa

SEQ ID NO: 1766478 - RNA, 20 nt, Human
aacuacugccuuuagaaaau

SEQ ID NO: 1766479 - RNA, 17 nt, Human
aaccuuggccugggccg

SEQ ID NO: 1766480 - RNA, 21 nt, Human
aaaugugaugaauacuguauu

SEQ ID NO: 1766481 - RNA, 22 nt, Human
aaauguguuuuguuuauuaaau

SEQ ID NO: 1766482 - RNA, 23 nt, Human
aaauguguuuuguuuauuaaaua

SEQ ID NO: 1766483 - RNA, 13 nt, Human
aaaugucuugugu

SEQ ID NO: 1766484 - RNA, 13 nt, Human
aaaugugaugaau

SEQ ID NO: 1766485 - RNA, 20 nt, Human
guaugccaccaacuuacaaa

SEQ ID NO: 1766486 - RNA, 16 nt, Human
guauguaacaauuguu

SEQ ID NO: 1766487 - RNA, 16 nt, Human
guauguaauggaacuu

SEQ ID NO: 1766488 - RNA, 17 nt, Human
aaaugucacagaagcag

SEQ ID NO: 1766489 - RNA, 21 nt, Human
aaaugucacguuuuguuuugu

SEQ ID NO: 1766490 - RNA, 13 nt, Human
aaauuuauuuccu

SEQ ID NO: 1766491 - RNA, 20 nt, Human
aaauuuauuuccuaguucug

SEQ ID NO: 1766492 - RNA, 18 nt, Human
aaauuuauuuuauaagaa

SEQ ID NO: 1766493 - RNA, 19 nt, Human
aaauuuauuuuauaagaaa

SEQ ID NO: 1766494 - RNA, 22 nt, Human
aaauuuauuuuauaagaaaaac

SEQ ID NO: 1766495 - RNA, 23 nt, Human
aaauuuauuuuauaagaaaaacu

SEQ ID NO: 1766496 - RNA, 13 nt, Human
gucaaaauuugcu

SEQ ID NO: 1766497 - RNA, 13 nt, Human
aaauuauuugcau

SEQ ID NO: 1766498 - RNA, 12 nt, Human
aaauucugaauu

SEQ ID NO: 1766499 - RNA, 13 nt, Human
aaauucugaauuu

SEQ ID NO: 1766500 - RNA, 14 nt, Human
aaauucugaauuug

SEQ ID NO: 1766501 - RNA, 16 nt, Human
aaauucugaauuugca

SEQ ID NO: 1766502 - RNA, 17 nt, Human
aaauucugaauuugcaa

SEQ ID NO: 1766503 - RNA, 18 nt, Human
aaauucugaauuugcaaa

SEQ ID NO: 1766504 - RNA, 19 nt, Human
aaauucugaauuugcaaag

SEQ ID NO: 1766505 - RNA, 20 nt, Human
aaauucugaauuugcaaagu

SEQ ID NO: 1766506 - RNA, 21 nt, Human
aaauucugaauuugcaaagua

SEQ ID NO: 1766507 - RNA, 22 nt, Human
aaauucugaauuugcaaaguac

SEQ ID NO: 1766508 - RNA, 15 nt, Human
aaauucugaauuuug

SEQ ID NO: 1766509 - RNA, 16 nt, Human
aaauuguauauucacu

SEQ ID NO: 1766510 - RNA, 15 nt, Human
aaauuguauauucac

SEQ ID NO: 1766511 - RNA, 14 nt, Human
aaauuguauauuca

SEQ ID NO: 1766512 - RNA, 13 nt, Human
aaauugugugugc

SEQ ID NO: 1766513 - RNA, 21 nt, Human
aaauugugugugcucugcuuc

SEQ ID NO: 1766514 - RNA, 22 nt, Human
aaauugugugugcucugcuuca

SEQ ID NO: 1766515 - RNA, 14 nt, Human
aaauuuauuaaaua

SEQ ID NO: 1766516 - RNA, 19 nt, Human
aaaugguuguauuagaugu

SEQ ID NO: 1766517 - RNA, 17 nt, Human
aaaugguuguauuagau

SEQ ID NO: 1766518 - RNA, 16 nt, Human
aaaugguuguauuaga

SEQ ID NO: 1766519 - RNA, 14 nt, Human
aaaugguuguauua

SEQ ID NO: 1766520 - RNA, 22 nt, Human
aaaugguuguauuagauguucu

SEQ ID NO: 1766521 - RNA, 20 nt, Human
aaaugguuguauuagauguu

SEQ ID NO: 1766522 - RNA, 12 nt, Human
guaacaggcaga

SEQ ID NO: 1766523 - RNA, 13 nt, Human
aaaugguuguauu

SEQ ID NO: 1766524 - RNA, 14 nt, Human
aaaugguccaggag

SEQ ID NO: 1766525 - RNA, 19 nt, Human
guaucccaugagccucagc

SEQ ID NO: 1766526 - RNA, 11 nt, Human
guauccaguca

SEQ ID NO: 1766527 - RNA, 22 nt, Human
guaucaggugcugccauccagg

SEQ ID NO: 1766528 - RNA, 19 nt, Human
guaucauaauuaccaagug

SEQ ID NO: 1766529 - RNA, 21 nt, Human
guaucccaugagccucagcau

SEQ ID NO: 1766530 - RNA, 15 nt, Human
guaugguggcugggu

SEQ ID NO: 1766531 - RNA, 16 nt, Human
guaugguggcuggguu

SEQ ID NO: 1766532 - RNA, 14 nt, Human
guaugguggcuggg

SEQ ID NO: 1766533 - RNA, 11 nt, Human
guauaaaagau

SEQ ID NO: 1766534 - RNA, 12 nt, Human
guauaaguuauu

SEQ ID NO: 1766535 - RNA, 21 nt, Human
guauaaguuauuuuuguacau

SEQ ID NO: 1766536 - RNA, 22 nt, Human
guauaaguuauuuuuguacaug

SEQ ID NO: 1766537 - RNA, 23 nt, Human
guauaaguuauuuuuguacaugu

SEQ ID NO: 1766538 - RNA, 16 nt, Human
guaucaggugcugcca

SEQ ID NO: 1766539 - RNA, 18 nt, Human
guaucaggugcugccauc

SEQ ID NO: 1766540 - RNA, 16 nt, Human
guccuacccacccucc

SEQ ID NO: 1766541 - RNA, 15 nt, Human
guccuacccacccuc

SEQ ID NO: 1766542 - RNA, 12 nt, Human
guccuacucugu

SEQ ID NO: 1766543 - RNA, 22 nt, Human
aacagaagcucuuacucuuucc

SEQ ID NO: 1766544 - RNA, 14 nt, Human
gucccaccuuggcu

SEQ ID NO: 1766545 - RNA, 15 nt, Human
gucccaccuuggcug

SEQ ID NO: 1766546 - RNA, 16 nt, Human
gucccaccuuggcugc

SEQ ID NO: 1766547 - RNA, 22 nt, Human
gucaguaccuucaaacuagggc

SEQ ID NO: 1766548 - RNA, 19 nt, Human
aaauuuguuauuuugcaac

SEQ ID NO: 1766549 - RNA, 19 nt, Human
gucagaauuagcugcuucu

SEQ ID NO: 1766550 - RNA, 21 nt, Human
gucacacaguauuacuucugc

SEQ ID NO: 1766551 - RNA, 22 nt, Human
gucacacaguauuacuucugcu

SEQ ID NO: 1766552 - RNA, 12 nt, Human
aacaauaaaaga

SEQ ID NO: 1766553 - RNA, 23 nt, Human
aacaauaaaauuuuuuuucaugu

SEQ ID NO: 1766554 - RNA, 21 nt, Human
aaauuuuauaaaauuaagcaa

SEQ ID NO: 1766555 - RNA, 15 nt, Human
aaauuuuuuuagaaa

SEQ ID NO: 1766556 - RNA, 13 nt, Human
aaauuuuuuuaga

SEQ ID NO: 1766557 - RNA, 21 nt, Human
aaauuuuuuuagaaagcauuu

SEQ ID NO: 1766558 - RNA, 14 nt, Human
aaggaaaggccuga

SEQ ID NO: 1766559 - RNA, 15 nt, Human
aagcuccaucaauga

SEQ ID NO: 1766560 - RNA, 13 nt, Human
aaggaacuugucu

SEQ ID NO: 1766561 - RNA, 20 nt, Human
aaggaggggauagagagaga

SEQ ID NO: 1766562 - RNA, 17 nt, Human
aaggagauagggaaaag

SEQ ID NO: 1766563 - RNA, 13 nt, Human
aaggaauauaaug

SEQ ID NO: 1766564 - RNA, 17 nt, Human
aaggauagaagcugcag

SEQ ID NO: 1766565 - RNA, 17 nt, Human
aaggccaaaccucuguu

SEQ ID NO: 1766566 - RNA, 16 nt, Human
aaggccaaaccucugu

SEQ ID NO: 1766567 - RNA, 13 nt, Human
aaggcccugcuga

SEQ ID NO: 1766568 - RNA, 18 nt, Human
aaggcccugcugagucau

SEQ ID NO: 1766569 - RNA, 23 nt, Human
guugcccaggcaggucuugaacu

SEQ ID NO: 1766570 - RNA, 12 nt, Human
guugcccaggcu

SEQ ID NO: 1766571 - RNA, 13 nt, Human
guugcccaggcug

SEQ ID NO: 1766572 - RNA, 20 nt, Human
guugcggauggauggaaggu

SEQ ID NO: 1766573 - RNA, 13 nt, Human
guugggcuggugu

SEQ ID NO: 1766574 - RNA, 15 nt, Human
guugggcugguguca

SEQ ID NO: 1766575 - RNA, 21 nt, Human
guuuaauccccaguaaaauug

SEQ ID NO: 1766576 - RNA, 19 nt, Human
guuuaauccccaguaaaau

SEQ ID NO: 1766577 - RNA, 14 nt, Human
aaggucaaauuuau

SEQ ID NO: 1766578 - RNA, 19 nt, Human
guuucuauguguagggcgg

SEQ ID NO: 1766579 - RNA, 17 nt, Human
aaggggccagaggcucg

SEQ ID NO: 1766580 - RNA, 16 nt, Human
guuuugccauguuggc

SEQ ID NO: 1766581 - RNA, 20 nt, Human
guuuugccauguuggccagg

SEQ ID NO: 1766582 - RNA, 21 nt, Human
guuuugccauguuggccaggc

SEQ ID NO: 1766583 - RNA, 22 nt, Human
guuuugccauguuggccaggcu

SEQ ID NO: 1766584 - RNA, 18 nt, Human
aaguauuuaauuagugcu

SEQ ID NO: 1766585 - RNA, 17 nt, Human
aaguauuuaauuagugc

SEQ ID NO: 1766586 - RNA, 16 nt, Human
aaguauuuaauuagug

SEQ ID NO: 1766587 - RNA, 23 nt, Human
aaguauuuaauuagugcuaagug

SEQ ID NO: 1766588 - RNA, 22 nt, Human
aaguauuuaauuagugcuaagu

SEQ ID NO: 1766589 - RNA, 21 nt, Human
aaguauuuaauuagugcuaag

SEQ ID NO: 1766590 - RNA, 20 nt, Human
aaguauuuaauuagugcuaa

SEQ ID NO: 1766591 - RNA, 19 nt, Human
aaguauuuaauuagugcua

SEQ ID NO: 1766592 - RNA, 15 nt, Human
aagugagagcugggu

SEQ ID NO: 1766593 - RNA, 14 nt, Human
aagugagagcuggg

SEQ ID NO: 1766594 - RNA, 17 nt, Human
aaguauuuucauaagua

SEQ ID NO: 1766595 - RNA, 22 nt, Human
aaguauuuucauaaguauuuca

SEQ ID NO: 1766596 - RNA, 13 nt, Human
aaguauuucaaau

SEQ ID NO: 1766597 - RNA, 21 nt, Human
aaguauuucaaauuggagcuu

SEQ ID NO: 1766598 - RNA, 22 nt, Human
aaguauuucaaauuggagcuuc

SEQ ID NO: 1766599 - RNA, 20 nt, Human
aagucauuggcuuuauccuc

SEQ ID NO: 1766600 - RNA, 13 nt, Human
aagucauuggcuu

SEQ ID NO: 1766601 - RNA, 14 nt, Human
aagucaugugcauu

SEQ ID NO: 1766602 - RNA, 15 nt, Human
aagucaugugcauuu

SEQ ID NO: 1766603 - RNA, 16 nt, Human
aagucuuucacauuua

SEQ ID NO: 1766604 - RNA, 13 nt, Human
uaaaaaucaacuu

SEQ ID NO: 1766605 - RNA, 14 nt, Human
uaaaaaucaacuuu

SEQ ID NO: 1766606 - RNA, 15 nt, Human
uaaaaaucaacuuuu

SEQ ID NO: 1766607 - RNA, 15 nt, Human
uaaaauauuauugaa

SEQ ID NO: 1766608 - RNA, 16 nt, Human
uaaaauauuauugaac

SEQ ID NO: 1766609 - RNA, 20 nt, Human
aagugauucuccugccucag

SEQ ID NO: 1766610 - RNA, 19 nt, Human
aagugauucuccugccuca

SEQ ID NO: 1766611 - RNA, 15 nt, Human
aagugauucuccugc

SEQ ID NO: 1766612 - RNA, 16 nt, Human
aagugauucuccugcc

SEQ ID NO: 1766613 - RNA, 17 nt, Human
aagugauucuccugccu

SEQ ID NO: 1766614 - RNA, 18 nt, Human
aagugauucuccugccuc

SEQ ID NO: 1766615 - RNA, 20 nt, Human
uaaaagacagugaaagaaaa

SEQ ID NO: 1766616 - RNA, 23 nt, Human
aagcccugauuguguauauucau

SEQ ID NO: 1766617 - RNA, 14 nt, Human
aagccccucuuucu

SEQ ID NO: 1766618 - RNA, 15 nt, Human
aagccaagaccucac

SEQ ID NO: 1766619 - RNA, 14 nt, Human
aagccccagcaagc

SEQ ID NO: 1766620 - RNA, 22 nt, Human
aagccaaagcuaggccuggcca

SEQ ID NO: 1766621 - RNA, 17 nt, Human
aagcauuugaaugcauu

SEQ ID NO: 1766622 - RNA, 16 nt, Human
aagcauuugaaugcau

SEQ ID NO: 1766623 - RNA, 15 nt, Human
aagcauuugaaugca

SEQ ID NO: 1766624 - RNA, 12 nt, Human
aagcauuugaau

SEQ ID NO: 1766625 - RNA, 14 nt, Human
aagcauuugaaugc

SEQ ID NO: 1766626 - RNA, 13 nt, Human
aagcauuugaaug

SEQ ID NO: 1766627 - RNA, 16 nt, Human
aagcauuuacuuugug

SEQ ID NO: 1766628 - RNA, 23 nt, Human
aagcauccuuuaggguucugccu

SEQ ID NO: 1766629 - RNA, 12 nt, Human
aagcaucuacuu

SEQ ID NO: 1766630 - RNA, 13 nt, Human
aagcaucuacuuc

SEQ ID NO: 1766631 - RNA, 13 nt, Human
aagcauucacaac

SEQ ID NO: 1766632 - RNA, 12 nt, Human
aagcauucacaa

SEQ ID NO: 1766633 - RNA, 20 nt, Human
aagcaguagaaauaauaugc

SEQ ID NO: 1766634 - RNA, 21 nt, Human
aagcaguagaaauaauaugca

SEQ ID NO: 1766635 - RNA, 22 nt, Human
aagcaguagaaauaauaugcau

SEQ ID NO: 1766636 - RNA, 21 nt, Human
gugugugcgccuacaggagug

SEQ ID NO: 1766637 - RNA, 17 nt, Human
gugugugcucugcuuca

SEQ ID NO: 1766638 - RNA, 22 nt, Human
aagccucaacuagucauuuuuu

SEQ ID NO: 1766639 - RNA, 22 nt, Human
aagccuagugaaggcuucucuc

SEQ ID NO: 1766640 - RNA, 15 nt, Human
guucagcuccagcuc

SEQ ID NO: 1766641 - RNA, 13 nt, Human
guucagcuccagc

SEQ ID NO: 1766642 - RNA, 12 nt, Human
aagcuaggccug

SEQ ID NO: 1766643 - RNA, 16 nt, Human
aagcuaggccuggcca

SEQ ID NO: 1766644 - RNA, 15 nt, Human
guuaggauggcagga

SEQ ID NO: 1766645 - RNA, 18 nt, Human
guucaagcgauucuucug

SEQ ID NO: 1766646 - RNA, 12 nt, Human
guucaaagccag

SEQ ID NO: 1766647 - RNA, 13 nt, Human
guucaaagccagc

SEQ ID NO: 1766648 - RNA, 14 nt, Human
guucaaaauucuaa

SEQ ID NO: 1766649 - RNA, 13 nt, Human
guuauuuugcaac

SEQ ID NO: 1766650 - RNA, 14 nt, Human
guuauuuuuguaca

SEQ ID NO: 1766651 - RNA, 15 nt, Human
guuauuuuuguacau

SEQ ID NO: 1766652 - RNA, 20 nt, Human
guuauucuaguacuagaaac

SEQ ID NO: 1766653 - RNA, 20 nt, Human
aagaguagaaacugcaggga

SEQ ID NO: 1766654 - RNA, 22 nt, Human
aagagggucugaggaauccaga

SEQ ID NO: 1766655 - RNA, 15 nt, Human
aagaggcuacagggc

SEQ ID NO: 1766656 - RNA, 12 nt, Human
gugggggugggu

SEQ ID NO: 1766657 - RNA, 14 nt, Human
guggggguggguca

SEQ ID NO: 1766658 - RNA, 15 nt, Human
gugggggugggucag

SEQ ID NO: 1766659 - RNA, 18 nt, Human
guggggguugcuguauaa

SEQ ID NO: 1766660 - RNA, 18 nt, Human
aagaucucugcagggccg

SEQ ID NO: 1766661 - RNA, 21 nt, Human
aagaucucacucugccccccc

SEQ ID NO: 1766662 - RNA, 14 nt, Human
gugucagcugaggc

SEQ ID NO: 1766663 - RNA, 16 nt, Human
gugucagcugaggcug

SEQ ID NO: 1766664 - RNA, 17 nt, Human
gugucagcugaggcugg

SEQ ID NO: 1766665 - RNA, 18 nt, Human
gugucagcugaggcuggg

SEQ ID NO: 1766666 - RNA, 16 nt, Human
gugucaagcugcucug

SEQ ID NO: 1766667 - RNA, 17 nt, Human
gugucaagcugcucuga

SEQ ID NO: 1766668 - RNA, 21 nt, Human
gugucaagcugcucugagcca

SEQ ID NO: 1766669 - RNA, 20 nt, Human
gugucaagagggucugagga

SEQ ID NO: 1766670 - RNA, 22 nt, Human
aagauggggucuguaaaaucuu

SEQ ID NO: 1766671 - RNA, 18 nt, Human
aagaugggugaaggcugg

SEQ ID NO: 1766672 - RNA, 21 nt, Human
aagauggggucuguaaaaucu

SEQ ID NO: 1766673 - RNA, 20 nt, Human
aagauggggucuguaaaauc

SEQ ID NO: 1766674 - RNA, 19 nt, Human
aagauggggucuguaaaau

SEQ ID NO: 1766675 - RNA, 18 nt, Human
aagauggggucuguaaaa

SEQ ID NO: 1766676 - RNA, 17 nt, Human
aagauggggucuguaaa

SEQ ID NO: 1766677 - RNA, 15 nt, Human
aagauggggucugua

SEQ ID NO: 1766678 - RNA, 18 nt, Human
aagaugggggcagggcug

SEQ ID NO: 1766679 - RNA, 19 nt, Human
aagaugggggcagggcugu

SEQ ID NO: 1766680 - RNA, 21 nt, Human
aagaugggggcagggcugugc

SEQ ID NO: 1766681 - RNA, 23 nt, Human
aagaugggggcagggcugugcuu

SEQ ID NO: 1766682 - RNA, 20 nt, Human
aagaugguguggguguccug

SEQ ID NO: 1766683 - RNA, 16 nt, Human
gugugucagcugaggc

SEQ ID NO: 1766684 - RNA, 19 nt, Human
guguguccaaaacugccuc

SEQ ID NO: 1766685 - RNA, 18 nt, Human
guguguccaaaacugccu

SEQ ID NO: 1766686 - RNA, 14 nt, Human
guguggguguccug

SEQ ID NO: 1766687 - RNA, 23 nt, Human
guguggguguccugccugucugc

SEQ ID NO: 1766688 - RNA, 15 nt, Human
guguggguucuacag

SEQ ID NO: 1766689 - RNA, 22 nt, Human
gugugacaaggauugcuacugu

SEQ ID NO: 1766690 - RNA, 18 nt, Human
gugugacauuuggagagg

SEQ ID NO: 1766691 - RNA, 19 nt, Human
gugugacauuuggagaggg

SEQ ID NO: 1766692 - RNA, 14 nt, Human
gugggagcugccug

SEQ ID NO: 1766693 - RNA, 15 nt, Human
gugggagcugccugu

SEQ ID NO: 1766694 - RNA, 18 nt, Human
gugggagcugccuguuca

SEQ ID NO: 1766695 - RNA, 12 nt, Human
guggggccccuc

SEQ ID NO: 1766696 - RNA, 13 nt, Human
guggccucuuugu

SEQ ID NO: 1766697 - RNA, 16 nt, Human
guggccucuuugucua

SEQ ID NO: 1766698 - RNA, 19 nt, Human
guggccucuuugucuaaaa

SEQ ID NO: 1766699 - RNA, 14 nt, Human
aagacgcccucuau

SEQ ID NO: 1766700 - RNA, 14 nt, Human
aacuugcugcuguc

SEQ ID NO: 1766701 - RNA, 16 nt, Human
aacuugcugcugucuu

SEQ ID NO: 1766702 - RNA, 13 nt, Human
aacuugccucuuu

SEQ ID NO: 1766703 - RNA, 18 nt, Human
aacuugccucuuuuaccu

SEQ ID NO: 1766704 - RNA, 22 nt, Human
aacuugccucuuuuaccugcug

SEQ ID NO: 1766705 - RNA, 23 nt, Human
aacuugccucuuuuaccugcugc

SEQ ID NO: 1766706 - RNA, 22 nt, Human
uaacauguguuaaguauuuuca

SEQ ID NO: 1766707 - RNA, 15 nt, Human
uaacauguaggaagu

SEQ ID NO: 1766708 - RNA, 21 nt, Human
aauaguucagguaacaggcag

SEQ ID NO: 1766709 - RNA, 13 nt, Human
aauaguuaauaua

SEQ ID NO: 1766710 - RNA, 15 nt, Human
aauaguuacuccagu

SEQ ID NO: 1766711 - RNA, 18 nt, Human
aauaguuacuccagugcc

SEQ ID NO: 1766712 - RNA, 20 nt, Human
aauaguuacuccagugccaa

SEQ ID NO: 1766713 - RNA, 15 nt, Human
uaacuuauauuaaua

SEQ ID NO: 1766714 - RNA, 14 nt, Human
uaacuuacuuccaa

SEQ ID NO: 1766715 - RNA, 13 nt, Human
uaacggaucagaa

SEQ ID NO: 1766716 - RNA, 19 nt, Human
uaacggaucagaaauacag

SEQ ID NO: 1766717 - RNA, 14 nt, Human
uaacggaucagaaa

SEQ ID NO: 1766718 - RNA, 21 nt, Human
uaacggaucagaaauacagau

SEQ ID NO: 1766719 - RNA, 15 nt, Human
uaaauguguuuuguu

SEQ ID NO: 1766720 - RNA, 21 nt, Human
uaaauguguuuuguuuauuaa

SEQ ID NO: 1766721 - RNA, 18 nt, Human
uaaaugaaaaucgugaca

SEQ ID NO: 1766722 - RNA, 22 nt, Human
aagugcguccacgagcuguuua

SEQ ID NO: 1766723 - RNA, 14 nt, Human
uaacaaucagcucc

SEQ ID NO: 1766724 - RNA, 20 nt, Human
aauacagauuuugauagcaa

SEQ ID NO: 1766725 - RNA, 19 nt, Human
aauacagauuuugauagca

SEQ ID NO: 1766726 - RNA, 23 nt, Human
aauacagauuuugauagcaaagc

SEQ ID NO: 1766727 - RNA, 21 nt, Human
aauacagauuuugauagcaaa

SEQ ID NO: 1766728 - RNA, 17 nt, Human
aauacaugacauuuauu

SEQ ID NO: 1766729 - RNA, 23 nt, Human
aauacaugacauuuauuuuucau

SEQ ID NO: 1766730 - RNA, 13 nt, Human
aauacaugcaucu

SEQ ID NO: 1766731 - RNA, 14 nt, Human
aauagagccugagg

SEQ ID NO: 1766732 - RNA, 18 nt, Human
aauagaguauaugcacuu

SEQ ID NO: 1766733 - RNA, 16 nt, Human
aauagagccugaggga

SEQ ID NO: 1766734 - RNA, 15 nt, Human
aauagaguauaugca

SEQ ID NO: 1766735 - RNA, 16 nt, Human
aauagaguauaugcac

SEQ ID NO: 1766736 - RNA, 17 nt, Human
aauagaguauaugcacu

SEQ ID NO: 1766737 - RNA, 23 nt, Human
aaucagcuauuuacugccaaagg

SEQ ID NO: 1766738 - RNA, 20 nt, Human
aaucagcuccuuccuggaga

SEQ ID NO: 1766739 - RNA, 21 nt, Human
aaucagccaauuauguuaaac

SEQ ID NO: 1766740 - RNA, 20 nt, Human
aaucagccaauuauguuaaa

SEQ ID NO: 1766741 - RNA, 19 nt, Human
aaucagccaauuauguuaa

SEQ ID NO: 1766742 - RNA, 18 nt, Human
aaucagccaauuauguua

SEQ ID NO: 1766743 - RNA, 14 nt, Human
aaucagccaauuau

SEQ ID NO: 1766744 - RNA, 14 nt, Human
aauauuuauucauu

SEQ ID NO: 1766745 - RNA, 20 nt, Human
aauauuuauucauuauuugu

SEQ ID NO: 1766746 - RNA, 22 nt, Human
aauauuuauucauuauuuguca

SEQ ID NO: 1766747 - RNA, 21 nt, Human
uaaguuuccuuccagcccaga

SEQ ID NO: 1766748 - RNA, 19 nt, Human
uaaguuuccuuccagccca

SEQ ID NO: 1766749 - RNA, 15 nt, Human
uaaguuacaauguuu

SEQ ID NO: 1766750 - RNA, 13 nt, Human
uaaguauuucaaa

SEQ ID NO: 1766751 - RNA, 17 nt, Human
uaaggauacuuuacaug

SEQ ID NO: 1766752 - RNA, 20 nt, Human
aauccucaguuuuugugaaa

SEQ ID NO: 1766753 - RNA, 15 nt, Human
aauccccaguaaaau

SEQ ID NO: 1766754 - RNA, 21 nt, Human
aauccccaguaaaauugccau

SEQ ID NO: 1766755 - RNA, 17 nt, Human
aauccccaguaaaauug

SEQ ID NO: 1766756 - RNA, 16 nt, Human
aauccccaguaaaauu

SEQ ID NO: 1766757 - RNA, 12 nt, Human
uacaauguuuua

SEQ ID NO: 1766758 - RNA, 13 nt, Human
uacaauguuuuau

SEQ ID NO: 1766759 - RNA, 18 nt, Human
uacaauucuacauuguca

SEQ ID NO: 1766760 - RNA, 18 nt, Human
uaauuuuuuugagacaga

SEQ ID NO: 1766761 - RNA, 21 nt, Human
aaugcuggcuguuggcugggg

SEQ ID NO: 1766762 - RNA, 22 nt, Human
aaugcuggcuguuggcuggggg

SEQ ID NO: 1766763 - RNA, 16 nt, Human
aauggaaccaggcuug

SEQ ID NO: 1766764 - RNA, 17 nt, Human
aauggaaccaggcuugg

SEQ ID NO: 1766765 - RNA, 18 nt, Human
aaugcuuuagaaagguuu

SEQ ID NO: 1766766 - RNA, 19 nt, Human
aaugcuuuagaaagguuuu

SEQ ID NO: 1766767 - RNA, 14 nt, Human
aauggaaccaggcu

SEQ ID NO: 1766768 - RNA, 19 nt, Human
aauggagucaguuugcagu

SEQ ID NO: 1766769 - RNA, 22 nt, Human
aauggagucauuugagucucuu

SEQ ID NO: 1766770 - RNA, 16 nt, Human
aauggauacauaaaga

SEQ ID NO: 1766771 - RNA, 17 nt, Human
aauggauacauaaagac

SEQ ID NO: 1766772 - RNA, 18 nt, Human
aauggauacauaaagacu

SEQ ID NO: 1766773 - RNA, 20 nt, Human
aauggaggccauauuuccau

SEQ ID NO: 1766774 - RNA, 20 nt, Human
uacacccccucuucugagca

SEQ ID NO: 1766775 - RNA, 22 nt, Human
uacacccccucuucugagcaca

SEQ ID NO: 1766776 - RNA, 15 nt, Human
uacacccuuuuccag

SEQ ID NO: 1766777 - RNA, 16 nt, Human
uacacccuuuuccagc

SEQ ID NO: 1766778 - RNA, 21 nt, Human
aaugauucaguguuaaaugug

SEQ ID NO: 1766779 - RNA, 22 nt, Human
aaugauucaguguuaaauguga

SEQ ID NO: 1766780 - RNA, 23 nt, Human
aaugauucaguguuaaaugugau

SEQ ID NO: 1766781 - RNA, 13 nt, Human
aaugauucagugu

SEQ ID NO: 1766782 - RNA, 14 nt, Human
aaugauucaguguu

SEQ ID NO: 1766783 - RNA, 14 nt, Human
aaugaguuuaaaaa

SEQ ID NO: 1766784 - RNA, 17 nt, Human
aaugaguuuaaaaauca

SEQ ID NO: 1766785 - RNA, 21 nt, Human
aaugaguuuaaaaaucaacuu

SEQ ID NO: 1766786 - RNA, 16 nt, Human
aaugaggucagagccu

SEQ ID NO: 1766787 - RNA, 18 nt, Human
aaugaggucagagccugc

SEQ ID NO: 1766788 - RNA, 22 nt, Human
aaugagaagaaaauggaaccag

SEQ ID NO: 1766789 - RNA, 13 nt, Human
aaugagaaaugga

SEQ ID NO: 1766790 - RNA, 22 nt, Human
uaauuccguagguuauuuucag

SEQ ID NO: 1766791 - RNA, 20 nt, Human
uaauuuacuggacaaagaau

SEQ ID NO: 1766792 - RNA, 13 nt, Human
uaccagcgaggag

SEQ ID NO: 1766793 - RNA, 15 nt, Human
uaccagcgaggaggc

SEQ ID NO: 1766794 - RNA, 20 nt, Human
uaccagcgaggaggcuccag

SEQ ID NO: 1766795 - RNA, 13 nt, Human
uaccagugaauuu

SEQ ID NO: 1766796 - RNA, 14 nt, Human
uaccagugaauuuu

SEQ ID NO: 1766797 - RNA, 18 nt, Human
uaccagugaauuuuugca

SEQ ID NO: 1766798 - RNA, 19 nt, Human
uaccagugaauuuuugcaa

SEQ ID NO: 1766799 - RNA, 20 nt, Human
uaccagugaauuuuugcaau

SEQ ID NO: 1766800 - RNA, 21 nt, Human
uaccagugaauuuuugcaaua

SEQ ID NO: 1766801 - RNA, 22 nt, Human
uaccagugaauuuuugcaauaa

SEQ ID NO: 1766802 - RNA, 23 nt, Human
uaccagugaauuuuugcaauaau

SEQ ID NO: 1766803 - RNA, 13 nt, Human
aauguuggauaag

SEQ ID NO: 1766804 - RNA, 16 nt, Human
aauguuggauaaggaa

SEQ ID NO: 1766805 - RNA, 17 nt, Human
aauguuggauaaggaau

SEQ ID NO: 1766806 - RNA, 18 nt, Human
aauguuggauaaggaauu

SEQ ID NO: 1766807 - RNA, 12 nt, Human
aauguuccagac

SEQ ID NO: 1766808 - RNA, 17 nt, Human
aauguuccagacauucu

SEQ ID NO: 1766809 - RNA, 17 nt, Human
uacagggguucuggaaa

SEQ ID NO: 1766810 - RNA, 22 nt, Human
uacagggccaaacgcugagcca

SEQ ID NO: 1766811 - RNA, 13 nt, Human
aauguuacugccu

SEQ ID NO: 1766812 - RNA, 15 nt, Human
aauguuacugccuua

SEQ ID NO: 1766813 - RNA, 17 nt, Human
aauguuacugccuuaau

SEQ ID NO: 1766814 - RNA, 20 nt, Human
uaccugacacucccuugggc

SEQ ID NO: 1766815 - RNA, 13 nt, Human
uaccugugugcuu

SEQ ID NO: 1766816 - RNA, 16 nt, Human
uaccugugccucggcu

SEQ ID NO: 1766817 - RNA, 17 nt, Human
aauuacauguaaaacau

SEQ ID NO: 1766818 - RNA, 18 nt, Human
uacccggggcccagggca

SEQ ID NO: 1766819 - RNA, 13 nt, Human
uaccugaaaacac

SEQ ID NO: 1766820 - RNA, 20 nt, Human
uaccugaaaacacugugcac

SEQ ID NO: 1766821 - RNA, 21 nt, Human
uaccugaaaacacugugcaca

SEQ ID NO: 1766822 - RNA, 17 nt, Human
uaccugacacucccuug

SEQ ID NO: 1766823 - RNA, 12 nt, Human
aauuauuugcau

SEQ ID NO: 1766824 - RNA, 23 nt, Human
aauuauguuaaacuagcauaucu

SEQ ID NO: 1766825 - RNA, 19 nt, Human
aauuauguuaaacuagcau

SEQ ID NO: 1766826 - RNA, 13 nt, Human
aauuauguuaaac

SEQ ID NO: 1766827 - RNA, 15 nt, Human
aauuauguuaaacua

SEQ ID NO: 1766828 - RNA, 14 nt, Human
aauuauguuaaacu

SEQ ID NO: 1766829 - RNA, 13 nt, Human
uaucagaauuugu

SEQ ID NO: 1766830 - RNA, 20 nt, Human
uaucagaauuuguguugaag

SEQ ID NO: 1766831 - RNA, 19 nt, Human
uaucaccgugggcucccug

SEQ ID NO: 1766832 - RNA, 23 nt, Human
uaucaccgugggcucccugacug

SEQ ID NO: 1766833 - RNA, 19 nt, Human
acacuuaggguuuggagcu

SEQ ID NO: 1766834 - RNA, 14 nt, Human
acagaaaugcugcu

SEQ ID NO: 1766835 - RNA, 15 nt, Human
acagaaaugcugcug

SEQ ID NO: 1766836 - RNA, 16 nt, Human
acagaaaugcugcugg

SEQ ID NO: 1766837 - RNA, 19 nt, Human
acagaaaugcugcuggcca

SEQ ID NO: 1766838 - RNA, 20 nt, Human
acagaaaugcugcuggccaa

SEQ ID NO: 1766839 - RNA, 21 nt, Human
acagaaaugcugcuggccaaa

SEQ ID NO: 1766840 - RNA, 17 nt, Human
acacuuuuggaaccaug

SEQ ID NO: 1766841 - RNA, 16 nt, Human
acacuucguucgcaga

SEQ ID NO: 1766842 - RNA, 21 nt, Human
uauaagugcuguauaaaauca

SEQ ID NO: 1766843 - RNA, 20 nt, Human
uauaagugcuguauaaaauc

SEQ ID NO: 1766844 - RNA, 19 nt, Human
uauaagugcuguauaaaau

SEQ ID NO: 1766845 - RNA, 17 nt, Human
uauaagugcuguauaaa

SEQ ID NO: 1766846 - RNA, 16 nt, Human
uauaagugcuguauaa

SEQ ID NO: 1766847 - RNA, 15 nt, Human
uauaagugcuguaua

SEQ ID NO: 1766848 - RNA, 14 nt, Human
uauaagugcuguau

SEQ ID NO: 1766849 - RNA, 13 nt, Human
uauaagugcugua

SEQ ID NO: 1766850 - RNA, 18 nt, Human
uauagccuaggugacaga

SEQ ID NO: 1766851 - RNA, 14 nt, Human
uaguaauuuguaaa

SEQ ID NO: 1766852 - RNA, 14 nt, Human
uaugucugccaugu

SEQ ID NO: 1766853 - RNA, 16 nt, Human
uaugugauuuuaacuc

SEQ ID NO: 1766854 - RNA, 18 nt, Human
uaugugauuuuaacucug

SEQ ID NO: 1766855 - RNA, 19 nt, Human
uaugugauuuuaacucugu

SEQ ID NO: 1766856 - RNA, 21 nt, Human
uaugugauuuuaacucugucu

SEQ ID NO: 1766857 - RNA, 18 nt, Human
acaggcccggcuccaggc

SEQ ID NO: 1766858 - RNA, 20 nt, Human
acaggcccggcuccaggcuc

SEQ ID NO: 1766859 - RNA, 21 nt, Human
acaggcccggcuccaggcucc

SEQ ID NO: 1766860 - RNA, 22 nt, Human
acaggcccggcuccaggcuccu

SEQ ID NO: 1766861 - RNA, 13 nt, Human
acaggcaggucca

SEQ ID NO: 1766862 - RNA, 16 nt, Human
acaggcccggcuccag

SEQ ID NO: 1766863 - RNA, 17 nt, Human
acaggcccggcuccagg

SEQ ID NO: 1766864 - RNA, 19 nt, Human
acaggccauugugaaccaa

SEQ ID NO: 1766865 - RNA, 15 nt, Human
acaggcagauacagg

SEQ ID NO: 1766866 - RNA, 19 nt, Human
acaggaaaagcugcugaca

SEQ ID NO: 1766867 - RNA, 20 nt, Human
acaggaaaagcugcugacag

SEQ ID NO: 1766868 - RNA, 21 nt, Human
acaggaaaagcugcugacagu

SEQ ID NO: 1766869 - RNA, 17 nt, Human
acagcuucauuuccugu

SEQ ID NO: 1766870 - RNA, 19 nt, Human
acagcuucauuuccugugu

SEQ ID NO: 1766871 - RNA, 21 nt, Human
acagcuucauuuccugugucu

SEQ ID NO: 1766872 - RNA, 15 nt, Human
acagcuaaugggaca

SEQ ID NO: 1766873 - RNA, 16 nt, Human
acagcuaaugggacac

SEQ ID NO: 1766874 - RNA, 17 nt, Human
acagcuaaugggacacu

SEQ ID NO: 1766875 - RNA, 19 nt, Human
acagcuaaugggacacuaa

SEQ ID NO: 1766876 - RNA, 10 nt, Human
acagcugugu

SEQ ID NO: 1766877 - RNA, 23 nt, Human
acagcugugugacauuuggagag

SEQ ID NO: 1766878 - RNA, 20 nt, Human
acagauuuugauagcaaagc

SEQ ID NO: 1766879 - RNA, 19 nt, Human
acagauuuugauagcaaag

SEQ ID NO: 1766880 - RNA, 17 nt, Human
acagauuuugauagcaa

SEQ ID NO: 1766881 - RNA, 17 nt, Human
uaugcuauugacaauaa

SEQ ID NO: 1766882 - RNA, 18 nt, Human
uaugcuauugacaauaaa

SEQ ID NO: 1766883 - RNA, 20 nt, Human
uaugcuauugacaauaaaau

SEQ ID NO: 1766884 - RNA, 21 nt, Human
uaugccaccaacuuacaaaaa

SEQ ID NO: 1766885 - RNA, 20 nt, Human
uaugauagcgggaaaaggag

SEQ ID NO: 1766886 - RNA, 16 nt, Human
uaugggacucaaugca

SEQ ID NO: 1766887 - RNA, 23 nt, Human
uaugggacucaaugcacugacau

SEQ ID NO: 1766888 - RNA, 15 nt, Human
acaaaaagugcuuca

SEQ ID NO: 1766889 - RNA, 23 nt, Human
acaaaaagugcuucauucuuugc

SEQ ID NO: 1766890 - RNA, 14 nt, Human
acaaaaauuaaaau

SEQ ID NO: 1766891 - RNA, 14 nt, Human
uagagccagggucu

SEQ ID NO: 1766892 - RNA, 14 nt, Human
uagagccugaggga

SEQ ID NO: 1766893 - RNA, 22 nt, Human
acaaaauaaccaauccuggaca

SEQ ID NO: 1766894 - RNA, 16 nt, Human
uagcacuaccacuccu

SEQ ID NO: 1766895 - RNA, 20 nt, Human
uagcacuaccacuccugcca

SEQ ID NO: 1766896 - RNA, 19 nt, Human
uagaaaaagaacaugcagu

SEQ ID NO: 1766897 - RNA, 20 nt, Human
uagaaaaagaacaugcaguu

SEQ ID NO: 1766898 - RNA, 21 nt, Human
uagaaaaagaacaugcaguuu

SEQ ID NO: 1766899 - RNA, 23 nt, Human
uagaaaaagaacaugcaguuuga

SEQ ID NO: 1766900 - RNA, 15 nt, Human
uacuuuugcccuuug

SEQ ID NO: 1766901 - RNA, 22 nt, Human
uagaaaauuuguuauuuugcaa

SEQ ID NO: 1766902 - RNA, 23 nt, Human
uagaaaauuuguuauuuugcaac

SEQ ID NO: 1766903 - RNA, 14 nt, Human
uagaaaauauaagu

SEQ ID NO: 1766904 - RNA, 22 nt, Human
uagaaaauauaaguaaagugau

SEQ ID NO: 1766905 - RNA, 10 nt, Human
uagacagagu

SEQ ID NO: 1766906 - RNA, 14 nt, Human
uagaaguagaauug

SEQ ID NO: 1766907 - RNA, 17 nt, Human
uagaaguagaauugaca

SEQ ID NO: 1766908 - RNA, 16 nt, Human
aauuuuaaugaagaaa

SEQ ID NO: 1766909 - RNA, 21 nt, Human
uagacagagucucacuguugc

SEQ ID NO: 1766910 - RNA, 15 nt, Human
uaguaaugaguuuaa

SEQ ID NO: 1766911 - RNA, 17 nt, Human
uaguaaugaguuuaaaa

SEQ ID NO: 1766912 - RNA, 14 nt, Human
uaguagagacaggg

SEQ ID NO: 1766913 - RNA, 15 nt, Human
uaguagagacagggu

SEQ ID NO: 1766914 - RNA, 22 nt, Human
uaguagagacaggguuuugcca

SEQ ID NO: 1766915 - RNA, 21 nt, Human
uaguaaaaaaucaauuaacca

SEQ ID NO: 1766916 - RNA, 16 nt, Human
acacaguauuacuucu

SEQ ID NO: 1766917 - RNA, 16 nt, Human
acacagguucacgugc

SEQ ID NO: 1766918 - RNA, 16 nt, Human
acacaggcccggcucc

SEQ ID NO: 1766919 - RNA, 17 nt, Human
acacaggcccggcucca

SEQ ID NO: 1766920 - RNA, 18 nt, Human
acacaggcccggcuccag

SEQ ID NO: 1766921 - RNA, 23 nt, Human
acacaggcccggcuccaggcucc

SEQ ID NO: 1766922 - RNA, 24 nt, Human
acacaggcccggcuccaggcuccu

SEQ ID NO: 1766923 - RNA, 16 nt, Human
acacaggccugcucuc

SEQ ID NO: 1766924 - RNA, 19 nt, Human
acacaggcccggcuccagg

SEQ ID NO: 1766925 - RNA, 20 nt, Human
acacaggcccggcuccaggc

SEQ ID NO: 1766926 - RNA, 21 nt, Human
acacaggcccggcuccaggcu

SEQ ID NO: 1766927 - RNA, 22 nt, Human
acacaggcccggcuccaggcuc

SEQ ID NO: 1766928 - RNA, 21 nt, Human
uaggguuuaauccccaguaaa

SEQ ID NO: 1766929 - RNA, 19 nt, Human
uaggguuuaauccccagua

SEQ ID NO: 1766930 - RNA, 12 nt, Human
uaggguuuaauc

SEQ ID NO: 1766931 - RNA, 14 nt, Human
uaggguucugccuc

SEQ ID NO: 1766932 - RNA, 15 nt, Human
uaggguucugccucu

SEQ ID NO: 1766933 - RNA, 16 nt, Human
uaggguggagagccac

SEQ ID NO: 1766934 - RNA, 12 nt, Human
acacaaaugaua

SEQ ID NO: 1766935 - RNA, 17 nt, Human
uagggaucccucaucug

SEQ ID NO: 1766936 - RNA, 16 nt, Human
uagggccaagcccagc

SEQ ID NO: 1766937 - RNA, 23 nt, Human
uagggccaagcccagcacugcuu

SEQ ID NO: 1766938 - RNA, 13 nt, Human
uagggccuugguu

SEQ ID NO: 1766939 - RNA, 11 nt, Human
uagcuucagga

SEQ ID NO: 1766940 - RNA, 12 nt, Human
uagcuucaggaa

SEQ ID NO: 1766941 - RNA, 15 nt, Human
uagcuucaggaaccu

SEQ ID NO: 1766942 - RNA, 18 nt, Human
uagcuucaggaaccucga

SEQ ID NO: 1766943 - RNA, 17 nt, Human
uagcuuucaauuccgua

SEQ ID NO: 1766944 - RNA, 23 nt, Human
uagcuuucaauuccguagccagc

SEQ ID NO: 1766945 - RNA, 15 nt, Human
uagcuuucaauuccg

SEQ ID NO: 1766946 - RNA, 20 nt, Human
uagccuuagaagucacacag

SEQ ID NO: 1766947 - RNA, 18 nt, Human
acaaucagcuccuuccug

SEQ ID NO: 1766948 - RNA, 22 nt, Human
acaaucagcuccuuccuggaga

SEQ ID NO: 1766949 - RNA, 21 nt, Human
uagccuuagaagucacacagu

SEQ ID NO: 1766950 - RNA, 14 nt, Human
uagcgcccaguugg

SEQ ID NO: 1766951 - RNA, 17 nt, Human
uagcgcccaguugggug

SEQ ID NO: 1766952 - RNA, 20 nt, Human
uagcgacuaaacuagauuuu

SEQ ID NO: 1766953 - RNA, 22 nt, Human
ucccugacucauucugaaggag

SEQ ID NO: 1766954 - RNA, 14 nt, Human
ucccugacucauuc

SEQ ID NO: 1766955 - RNA, 16 nt, Human
ucccugacucauucug

SEQ ID NO: 1766956 - RNA, 19 nt, Human
ucccugacucauucugaag

SEQ ID NO: 1766957 - RNA, 13 nt, Human
ucccucccaggac

SEQ ID NO: 1766958 - RNA, 14 nt, Human
ucccucccaggacu

SEQ ID NO: 1766959 - RNA, 23 nt, Human
uccccucuuccuacccugccucc

SEQ ID NO: 1766960 - RNA, 14 nt, Human
acucagaagacacu

SEQ ID NO: 1766961 - RNA, 15 nt, Human
acucagaagacacug

SEQ ID NO: 1766962 - RNA, 16 nt, Human
acucagaagacacuga

SEQ ID NO: 1766963 - RNA, 17 nt, Human
acucagaagacacugau

SEQ ID NO: 1766964 - RNA, 18 nt, Human
acucagaagacacugaug

SEQ ID NO: 1766965 - RNA, 12 nt, Human
acucagaagccu

SEQ ID NO: 1766966 - RNA, 15 nt, Human
acucagaagccucug

SEQ ID NO: 1766967 - RNA, 16 nt, Human
acucagaagccucugg

SEQ ID NO: 1766968 - RNA, 20 nt, Human
acucagaagccucuggguca

SEQ ID NO: 1766969 - RNA, 17 nt, Human
acucagaagggagcuag

SEQ ID NO: 1766970 - RNA, 14 nt, Human
acuauguaacaugu

SEQ ID NO: 1766971 - RNA, 12 nt, Human
acuaugccugug

SEQ ID NO: 1766972 - RNA, 21 nt, Human
acucacauuuauucugcucac

SEQ ID NO: 1766973 - RNA, 15 nt, Human
uccccggagggcugc

SEQ ID NO: 1766974 - RNA, 19 nt, Human
acucacauuuauucugcuc

SEQ ID NO: 1766975 - RNA, 20 nt, Human
acucacauuuauucugcuca

SEQ ID NO: 1766976 - RNA, 14 nt, Human
acucaaugcacuga

SEQ ID NO: 1766977 - RNA, 21 nt, Human
uccccucucuugucagaugcc

SEQ ID NO: 1766978 - RNA, 14 nt, Human
uccccaguaaaauu

SEQ ID NO: 1766979 - RNA, 15 nt, Human
uccccaguaaaauug

SEQ ID NO: 1766980 - RNA, 13 nt, Human
acguacacacaca

SEQ ID NO: 1766981 - RNA, 18 nt, Human
acuaccuugguuccccca

SEQ ID NO: 1766982 - RNA, 18 nt, Human
acuacggaauaguuggcu

SEQ ID NO: 1766983 - RNA, 16 nt, Human
uccugacccauugcug

SEQ ID NO: 1766984 - RNA, 17 nt, Human
uccugacccauugcugu

SEQ ID NO: 1766985 - RNA, 18 nt, Human
uccugacccauugcuguu

SEQ ID NO: 1766986 - RNA, 15 nt, Human
acucuuucugagugc

SEQ ID NO: 1766987 - RNA, 17 nt, Human
acucuuucugagugccu

SEQ ID NO: 1766988 - RNA, 18 nt, Human
acucuuucugagugccuu

SEQ ID NO: 1766989 - RNA, 20 nt, Human
acucuuucugagugccuucu

SEQ ID NO: 1766990 - RNA, 21 nt, Human
acucuuucugagugccuucug

SEQ ID NO: 1766991 - RNA, 22 nt, Human
acucuuucugagugccuucugu

SEQ ID NO: 1766992 - RNA, 13 nt, Human
acucuuugagaaa

SEQ ID NO: 1766993 - RNA, 16 nt, Human
acucuuugagaaacaa

SEQ ID NO: 1766994 - RNA, 18 nt, Human
acucuuugagaaacaaca

SEQ ID NO: 1766995 - RNA, 18 nt, Human
uccucugacucagggcuc

SEQ ID NO: 1766996 - RNA, 21 nt, Human
uccucuuuagaguuagacugu

SEQ ID NO: 1766997 - RNA, 20 nt, Human
uccucuuuagaguuagacug

SEQ ID NO: 1766998 - RNA, 15 nt, Human
uccucuuuagaguua

SEQ ID NO: 1766999 - RNA, 14 nt, Human
uccucccaccucag

SEQ ID NO: 1767000 - RNA, 15 nt, Human
uccucccaccucagc

SEQ ID NO: 1767001 - RNA, 16 nt, Human
uccucccaccucagcc

SEQ ID NO: 1767002 - RNA, 18 nt, Human
uccucccaccucagccuc

SEQ ID NO: 1767003 - RNA, 20 nt, Human
uccucccaccucagccuccc

SEQ ID NO: 1767004 - RNA, 21 nt, Human
uccucccaccucagccucccg

SEQ ID NO: 1767005 - RNA, 20 nt, Human
uccuccccccuccucugaaa

SEQ ID NO: 1767006 - RNA, 21 nt, Human
uccuccccccuccucugaaac

SEQ ID NO: 1767007 - RNA, 16 nt, Human
uccucugacucagggc

SEQ ID NO: 1767008 - RNA, 17 nt, Human
uccucugacucagggcu

SEQ ID NO: 1767009 - RNA, 19 nt, Human
uccucucuggggcuguguu

SEQ ID NO: 1767010 - RNA, 23 nt, Human
uccucucuggggcuguguuuuga

SEQ ID NO: 1767011 - RNA, 14 nt, Human
uccucucuauauuu

SEQ ID NO: 1767012 - RNA, 15 nt, Human
uccucugacucaggg

SEQ ID NO: 1767013 - RNA, 10 nt, Human
uccucugaaa

SEQ ID NO: 1767014 - RNA, 11 nt, Human
uccucugaaac

SEQ ID NO: 1767015 - RNA, 12 nt, Human
uccucugaaaca

SEQ ID NO: 1767016 - RNA, 13 nt, Human
uccucugaaacag

SEQ ID NO: 1767017 - RNA, 14 nt, Human
uccucugaaacagc

SEQ ID NO: 1767018 - RNA, 15 nt, Human
uccucugaaacagcu

SEQ ID NO: 1767019 - RNA, 16 nt, Human
uccucugaaacagcug

SEQ ID NO: 1767020 - RNA, 17 nt, Human
uccucugaaacagcugc

SEQ ID NO: 1767021 - RNA, 18 nt, Human
uccucugaaacagcugcc

SEQ ID NO: 1767022 - RNA, 19 nt, Human
uccucugaaacagcugccu

SEQ ID NO: 1767023 - RNA, 20 nt, Human
uccucugaaacagcugccuu

SEQ ID NO: 1767024 - RNA, 21 nt, Human
uccucugaaacagcugccuua

SEQ ID NO: 1767025 - RNA, 13 nt, Human
uccucucuauauu

SEQ ID NO: 1767026 - RNA, 17 nt, Human
acucucagucucugagc

SEQ ID NO: 1767027 - RNA, 18 nt, Human
acucucagucucugagca

SEQ ID NO: 1767028 - RNA, 22 nt, Human
acucucaggaccaaagcuuuca

SEQ ID NO: 1767029 - RNA, 13 nt, Human
acucucagucucu

SEQ ID NO: 1767030 - RNA, 14 nt, Human
acucucagucucug

SEQ ID NO: 1767031 - RNA, 16 nt, Human
acucucagucucugag

SEQ ID NO: 1767032 - RNA, 18 nt, Human
acucugcucgccuuagca

SEQ ID NO: 1767033 - RNA, 21 nt, Human
acucuuauugcccacgcugga

SEQ ID NO: 1767034 - RNA, 12 nt, Human
uccuacucugug

SEQ ID NO: 1767035 - RNA, 14 nt, Human
uccuaccuugcuuu

SEQ ID NO: 1767036 - RNA, 22 nt, Human
uccguguugcagguucauggau

SEQ ID NO: 1767037 - RNA, 12 nt, Human
uccggcucccag

SEQ ID NO: 1767038 - RNA, 15 nt, Human
uccggcucccagccu

SEQ ID NO: 1767039 - RNA, 14 nt, Human
accuucgggcugug

SEQ ID NO: 1767040 - RNA, 15 nt, Human
accuucgggcugugc

SEQ ID NO: 1767041 - RNA, 21 nt, Human
accuucguuuacuaugccugu

SEQ ID NO: 1767042 - RNA, 18 nt, Human
accuucgggcugugcccg

SEQ ID NO: 1767043 - RNA, 16 nt, Human
accuucgggcugugcc

SEQ ID NO: 1767044 - RNA, 17 nt, Human
accuucgggcugugccc

SEQ ID NO: 1767045 - RNA, 22 nt, Human
accuucaguaacccccacugga

SEQ ID NO: 1767046 - RNA, 22 nt, Human
accuucguuuacuaugccugug

SEQ ID NO: 1767047 - RNA, 23 nt, Human
accuucguuuacuaugccugugu

SEQ ID NO: 1767048 - RNA, 17 nt, Human
accuugccaauuaguaa

SEQ ID NO: 1767049 - RNA, 12 nt, Human
uccacccaccuc

SEQ ID NO: 1767050 - RNA, 13 nt, Human
uccacccaccuca

SEQ ID NO: 1767051 - RNA, 17 nt, Human
uccacccaccucagccu

SEQ ID NO: 1767052 - RNA, 17 nt, Human
uccacccaggagccccg

SEQ ID NO: 1767053 - RNA, 20 nt, Human
uccacccaggagccccgagg

SEQ ID NO: 1767054 - RNA, 14 nt, Human
uccacaucccggga

SEQ ID NO: 1767055 - RNA, 12 nt, Human
uccacauccucc

SEQ ID NO: 1767056 - RNA, 13 nt, Human
uccacauccucca

SEQ ID NO: 1767057 - RNA, 19 nt, Human
uccacauccuccacguucu

SEQ ID NO: 1767058 - RNA, 15 nt, Human
uccacaugggagccg

SEQ ID NO: 1767059 - RNA, 11 nt, Human
accugccugua

SEQ ID NO: 1767060 - RNA, 14 nt, Human
accugccuguagcc

SEQ ID NO: 1767061 - RNA, 21 nt, Human
accugccugacauuuggagug

SEQ ID NO: 1767062 - RNA, 11 nt, Human
accugcugcuu

SEQ ID NO: 1767063 - RNA, 13 nt, Human
accugcugcuucu

SEQ ID NO: 1767064 - RNA, 14 nt, Human
accugcugcuucuc

SEQ ID NO: 1767065 - RNA, 15 nt, Human
accugcugcuucucc

SEQ ID NO: 1767066 - RNA, 17 nt, Human
accugcugcuucuccaa

SEQ ID NO: 1767067 - RNA, 17 nt, Human
accuggacacaggccug

SEQ ID NO: 1767068 - RNA, 14 nt, Human
accuggacacaggc

SEQ ID NO: 1767069 - RNA, 16 nt, Human
ucauuugucacacacu

SEQ ID NO: 1767070 - RNA, 17 nt, Human
ucauuugguuggcacua

SEQ ID NO: 1767071 - RNA, 12 nt, Human
ucauuuucuaga

SEQ ID NO: 1767072 - RNA, 14 nt, Human
ucauuuucuagaua

SEQ ID NO: 1767073 - RNA, 20 nt, Human
ucauuuucuagauacaauaa

SEQ ID NO: 1767074 - RNA, 21 nt, Human
ucauuuucuagauacaauaaa

SEQ ID NO: 1767075 - RNA, 23 nt, Human
ucauuuucuagauacaauaaauu

SEQ ID NO: 1767076 - RNA, 14 nt, Human
ucauuugucacaca

SEQ ID NO: 1767077 - RNA, 19 nt, Human
ucauuuuuaguagagacag

SEQ ID NO: 1767078 - RNA, 14 nt, Human
ucauuuuuaaaugu

SEQ ID NO: 1767079 - RNA, 15 nt, Human
ucauuuuuaaaugug

SEQ ID NO: 1767080 - RNA, 19 nt, Human
accugauucaacuaaaaaa

SEQ ID NO: 1767081 - RNA, 17 nt, Human
accugauuaacugaggc

SEQ ID NO: 1767082 - RNA, 22 nt, Human
accugauuaacugaggcaucca

SEQ ID NO: 1767083 - RNA, 11 nt, Human
accugauucaa

SEQ ID NO: 1767084 - RNA, 19 nt, Human
accugacacucccuugggc

SEQ ID NO: 1767085 - RNA, 18 nt, Human
accugagcaggaccucug

SEQ ID NO: 1767086 - RNA, 16 nt, Human
accugacacucccuug

SEQ ID NO: 1767087 - RNA, 17 nt, Human
accugacacucccuugg

SEQ ID NO: 1767088 - RNA, 18 nt, Human
accugaagacucauucuu

SEQ ID NO: 1767089 - RNA, 16 nt, Human
ucauaauaaguugcau

SEQ ID NO: 1767090 - RNA, 12 nt, Human
acgacugucucc

SEQ ID NO: 1767091 - RNA, 22 nt, Human
uccacgagcuguuuacuaggga

SEQ ID NO: 1767092 - RNA, 14 nt, Human
uccacggagccacu

SEQ ID NO: 1767093 - RNA, 15 nt, Human
uccacggagccacuc

SEQ ID NO: 1767094 - RNA, 20 nt, Human
uccacggagccacuccucug

SEQ ID NO: 1767095 - RNA, 21 nt, Human
uccacggagccacuccucuga

SEQ ID NO: 1767096 - RNA, 22 nt, Human
uccacggagccacuccucugac

SEQ ID NO: 1767097 - RNA, 14 nt, Human
acgaauacuuuugc

SEQ ID NO: 1767098 - RNA, 22 nt, Human
acgaauacuuuugcccuuugau

SEQ ID NO: 1767099 - RNA, 18 nt, Human
uccagggaugauucaagc

SEQ ID NO: 1767100 - RNA, 22 nt, Human
uccagggaugauucaagccauu

SEQ ID NO: 1767101 - RNA, 23 nt, Human
uccagggaugauucaagccauuc

SEQ ID NO: 1767102 - RNA, 18 nt, Human
acgaaccuuggccugggc

SEQ ID NO: 1767103 - RNA, 14 nt, Human
acgaacuuccaugg

SEQ ID NO: 1767104 - RNA, 19 nt, Human
acggagucccaccuuggcu

SEQ ID NO: 1767105 - RNA, 21 nt, Human
acggagccacuccucugacuc

SEQ ID NO: 1767106 - RNA, 14 nt, Human
acgcugagccaccu

SEQ ID NO: 1767107 - RNA, 15 nt, Human
acgcugagccaccug

SEQ ID NO: 1767108 - RNA, 17 nt, Human
acgcugagccaccugcc

SEQ ID NO: 1767109 - RNA, 22 nt, Human
acgcugagccaccugcccuuuu

SEQ ID NO: 1767110 - RNA, 12 nt, Human
acgcugccugcc

SEQ ID NO: 1767111 - RNA, 13 nt, Human
acgcugccugccc

SEQ ID NO: 1767112 - RNA, 15 nt, Human
acgcugccugcccac

SEQ ID NO: 1767113 - RNA, 14 nt, Human
acgcugccugcccg

SEQ ID NO: 1767114 - RNA, 16 nt, Human
acggccaggccagagg

SEQ ID NO: 1767115 - RNA, 21 nt, Human
acggagucccaccuuggcugc

SEQ ID NO: 1767116 - RNA, 15 nt, Human
acgcccaucucagga

SEQ ID NO: 1767117 - RNA, 23 nt, Human
acgcgugcacacaccagagccca

SEQ ID NO: 1767118 - RNA, 21 nt, Human
acgcccucuaucauggugaaa

SEQ ID NO: 1767119 - RNA, 15 nt, Human
acggcucacugcagc

SEQ ID NO: 1767120 - RNA, 18 nt, Human
uccagugaaacuugggca

SEQ ID NO: 1767121 - RNA, 14 nt, Human
acggcucacugcag

SEQ ID NO: 1767122 - RNA, 18 nt, Human
acggaggggaguagagaa

SEQ ID NO: 1767123 - RNA, 16 nt, Human
uccauuggaucucauu

SEQ ID NO: 1767124 - RNA, 23 nt, Human
acggguuagacagccaaaggcug

SEQ ID NO: 1767125 - RNA, 17 nt, Human
ucccacaggacauuucu

SEQ ID NO: 1767126 - RNA, 18 nt, Human
ucccacaggacauuucuc

SEQ ID NO: 1767127 - RNA, 21 nt, Human
ucccacaggacauuucucuaa

SEQ ID NO: 1767128 - RNA, 21 nt, Human
ucccaaagugcugggauuaca

SEQ ID NO: 1767129 - RNA, 15 nt, Human
ucccaauucacaucu

SEQ ID NO: 1767130 - RNA, 16 nt, Human
ucccaaagugcuggga

SEQ ID NO: 1767131 - RNA, 15 nt, Human
ucccaaagugcuggg

SEQ ID NO: 1767132 - RNA, 15 nt, Human
uccauuugcaaggga

SEQ ID NO: 1767133 - RNA, 17 nt, Human
uauuuuuguagagccag

SEQ ID NO: 1767134 - RNA, 13 nt, Human
uauuuuuguacau

SEQ ID NO: 1767135 - RNA, 14 nt, Human
uauuuuuguacaug

SEQ ID NO: 1767136 - RNA, 14 nt, Human
uauuuuuccuuuuu

SEQ ID NO: 1767137 - RNA, 16 nt, Human
uauuuuugcugcuucu

SEQ ID NO: 1767138 - RNA, 18 nt, Human
uauuuuugcugcuucuga

SEQ ID NO: 1767139 - RNA, 13 nt, Human
uauuuuuaaauaa

SEQ ID NO: 1767140 - RNA, 23 nt, Human
uauuuuguguccuccaggagcuu

SEQ ID NO: 1767141 - RNA, 16 nt, Human
uauuuugucauaucaa

SEQ ID NO: 1767142 - RNA, 18 nt, Human
uauuuugucauaucaaau

SEQ ID NO: 1767143 - RNA, 22 nt, Human
acaucuugcucugcugacagac

SEQ ID NO: 1767144 - RNA, 17 nt, Human
acaucuugcucugcuga

SEQ ID NO: 1767145 - RNA, 15 nt, Human
acaucuugcucugcu

SEQ ID NO: 1767146 - RNA, 16 nt, Human
acaucuugcucugcug

SEQ ID NO: 1767147 - RNA, 10 nt, Human
uauuugucaa

SEQ ID NO: 1767148 - RNA, 12 nt, Human
uauuugucaaau

SEQ ID NO: 1767149 - RNA, 18 nt, Human
uauuuuaaaaucugucac

SEQ ID NO: 1767150 - RNA, 23 nt, Human
acaugucuuaaugaaguuugaau

SEQ ID NO: 1767151 - RNA, 22 nt, Human
acaugucuuaaugaaguuugaa

SEQ ID NO: 1767152 - RNA, 21 nt, Human
acaugucuuaaugaaguuuga

SEQ ID NO: 1767153 - RNA, 20 nt, Human
acaugucuuaaugaaguuug

SEQ ID NO: 1767154 - RNA, 18 nt, Human
acaugucuuaaugaaguu

SEQ ID NO: 1767155 - RNA, 16 nt, Human
acaugucuuaaugaag

SEQ ID NO: 1767156 - RNA, 15 nt, Human
acaugucuuaaugaa

SEQ ID NO: 1767157 - RNA, 23 nt, Human
acauggugcuacgccugcaugua

SEQ ID NO: 1767158 - RNA, 19 nt, Human
acauggugcuacgccugca

SEQ ID NO: 1767159 - RNA, 18 nt, Human
acaugguggguccauggg

SEQ ID NO: 1767160 - RNA, 19 nt, Human
acaugguggguccaugggc

SEQ ID NO: 1767161 - RNA, 15 nt, Human
ucaaagcaaggaaac

SEQ ID NO: 1767162 - RNA, 16 nt, Human
ucaaagcaaggaaacu

SEQ ID NO: 1767163 - RNA, 20 nt, Human
ucaaagcaaggaaacuaugu

SEQ ID NO: 1767164 - RNA, 12 nt, Human
ucaaagcaauug

SEQ ID NO: 1767165 - RNA, 19 nt, Human
ucaaagcaauugaaaugca

SEQ ID NO: 1767166 - RNA, 21 nt, Human
ucaaagcaauugaaaugcauu

SEQ ID NO: 1767167 - RNA, 19 nt, Human
acaugacccuaaaucuuga

SEQ ID NO: 1767168 - RNA, 21 nt, Human
acaugacccuaaaucuugacu

SEQ ID NO: 1767169 - RNA, 17 nt, Human
ucaccagccccagugcc

SEQ ID NO: 1767170 - RNA, 13 nt, Human
ucacauuagaucu

SEQ ID NO: 1767171 - RNA, 21 nt, Human
ucacaugucaguaccuucaaa

SEQ ID NO: 1767172 - RNA, 21 nt, Human
ucacauggugcuacgccugca

SEQ ID NO: 1767173 - RNA, 15 nt, Human
accacacccagccca

SEQ ID NO: 1767174 - RNA, 16 nt, Human
accacacccagcccac

SEQ ID NO: 1767175 - RNA, 20 nt, Human
accacacccagcccacuucu

SEQ ID NO: 1767176 - RNA, 21 nt, Human
accacacccagcccacuucug

SEQ ID NO: 1767177 - RNA, 23 nt, Human
accacacccagcccacuucugcc

SEQ ID NO: 1767178 - RNA, 13 nt, Human
accaauccuggac

SEQ ID NO: 1767179 - RNA, 14 nt, Human
accaaugaaaaaau

SEQ ID NO: 1767180 - RNA, 17 nt, Human
accaaugaaaaaaugua

SEQ ID NO: 1767181 - RNA, 13 nt, Human
accaaugucuuga

SEQ ID NO: 1767182 - RNA, 12 nt, Human
accaaugucuug

SEQ ID NO: 1767183 - RNA, 20 nt, Human
accaaauuaacuuacuucca

SEQ ID NO: 1767184 - RNA, 21 nt, Human
acauugcggacagccacggcc

SEQ ID NO: 1767185 - RNA, 22 nt, Human
acauugcggacagccacggcca

SEQ ID NO: 1767186 - RNA, 14 nt, Human
acauuuuucaacuu

SEQ ID NO: 1767187 - RNA, 15 nt, Human
acauuuuucaacuuu

SEQ ID NO: 1767188 - RNA, 16 nt, Human
acauuuuucaacuuug

SEQ ID NO: 1767189 - RNA, 19 nt, Human
acauuuuucaacuuugaau

SEQ ID NO: 1767190 - RNA, 21 nt, Human
acauuuuucaacuuugaauaa

SEQ ID NO: 1767191 - RNA, 22 nt, Human
acauuuuucaacuuugaauaaa

SEQ ID NO: 1767192 - RNA, 23 nt, Human
acauuuuucaacuuugaauaaag

SEQ ID NO: 1767193 - RNA, 21 nt, Human
accaaaaaagcuguauuuuga

SEQ ID NO: 1767194 - RNA, 16 nt, Human
ucaagugauucuccug

SEQ ID NO: 1767195 - RNA, 17 nt, Human
ucaagugauucuccugc

SEQ ID NO: 1767196 - RNA, 15 nt, Human
ucaauccagcuaugu

SEQ ID NO: 1767197 - RNA, 17 nt, Human
ucaagagggucugagga

SEQ ID NO: 1767198 - RNA, 16 nt, Human
ucagguaggggggaaa

SEQ ID NO: 1767199 - RNA, 23 nt, Human
ucaggguuggccccugcccggcu

SEQ ID NO: 1767200 - RNA, 18 nt, Human
ucaggguuggccccugcc

SEQ ID NO: 1767201 - RNA, 19 nt, Human
ucaggguuggccccugccc

SEQ ID NO: 1767202 - RNA, 12 nt, Human
acccccagccug

SEQ ID NO: 1767203 - RNA, 17 nt, Human
acccccacuggacugac

SEQ ID NO: 1767204 - RNA, 13 nt, Human
acccccagccugc

SEQ ID NO: 1767205 - RNA, 13 nt, Human
acccugccaugga

SEQ ID NO: 1767206 - RNA, 14 nt, Human
acccugccauggaa

SEQ ID NO: 1767207 - RNA, 22 nt, Human
acccugccauggaacuguuucc

SEQ ID NO: 1767208 - RNA, 23 nt, Human
acccugccauggaacuguuuccu

SEQ ID NO: 1767209 - RNA, 17 nt, Human
acccugagcugaggcag

SEQ ID NO: 1767210 - RNA, 22 nt, Human
acccugagcugaggcagcagug

SEQ ID NO: 1767211 - RNA, 23 nt, Human
acccugagcugaggcagcagugu

SEQ ID NO: 1767212 - RNA, 21 nt, Human
acccuccuuucaccacaugug

SEQ ID NO: 1767213 - RNA, 15 nt, Human
ucaggugucccugca

SEQ ID NO: 1767214 - RNA, 17 nt, Human
ucaggugucccugcacu

SEQ ID NO: 1767215 - RNA, 18 nt, Human
ucaggugucccugcacuu

SEQ ID NO: 1767216 - RNA, 17 nt, Human
acccuggaccagugguc

SEQ ID NO: 1767217 - RNA, 20 nt, Human
acccuggaccaguggucuca

SEQ ID NO: 1767218 - RNA, 23 nt, Human
acccugccucccuugacuuugcu

SEQ ID NO: 1767219 - RNA, 17 nt, Human
acccuuggcuugcccac

SEQ ID NO: 1767220 - RNA, 22 nt, Human
ucaggugucccugcacuugcag

SEQ ID NO: 1767221 - RNA, 15 nt, Human
ucauaaguauuucaa

SEQ ID NO: 1767222 - RNA, 20 nt, Human
ucauaaguauuucaaauugg

SEQ ID NO: 1767223 - RNA, 14 nt, Human
ucaguggcagcugc

SEQ ID NO: 1767224 - RNA, 15 nt, Human
ucaguggcagcugcu

SEQ ID NO: 1767225 - RNA, 16 nt, Human
ucaguggcagcugcuu

SEQ ID NO: 1767226 - RNA, 12 nt, Human
ucagugcucccu

SEQ ID NO: 1767227 - RNA, 13 nt, Human
ucagugcucccuc

SEQ ID NO: 1767228 - RNA, 19 nt, Human
ucagugcucccucacaugu

SEQ ID NO: 1767229 - RNA, 18 nt, Human
ucagaauuagcugcuucu

SEQ ID NO: 1767230 - RNA, 15 nt, Human
acccagcccacuucu

SEQ ID NO: 1767231 - RNA, 16 nt, Human
ucagagccgugguccu

SEQ ID NO: 1767232 - RNA, 20 nt, Human
ucagagccgugguccuuugg

SEQ ID NO: 1767233 - RNA, 13 nt, Human
accccagguuucu

SEQ ID NO: 1767234 - RNA, 17 nt, Human
accccagggccugagcc

SEQ ID NO: 1767235 - RNA, 24 nt, Human
accccagggccugagccuggccag

SEQ ID NO: 1767236 - RNA, 11 nt, Human
accccagggcc

SEQ ID NO: 1767237 - RNA, 13 nt, Human
accccagggccug

SEQ ID NO: 1767238 - RNA, 14 nt, Human
accccagggccuga

SEQ ID NO: 1767239 - RNA, 15 nt, Human
accccagggccugag

SEQ ID NO: 1767240 - RNA, 17 nt, Human
acccagggccugcagga

SEQ ID NO: 1767241 - RNA, 21 nt, Human
acccaggguucccgcggggcu

SEQ ID NO: 1767242 - RNA, 22 nt, Human
acccaggguucccgcggggcug

SEQ ID NO: 1767243 - RNA, 13 nt, Human
acccaggagcccc

SEQ ID NO: 1767244 - RNA, 15 nt, Human
acccaggagccccga

SEQ ID NO: 1767245 - RNA, 15 nt, Human
acccagggccugcag

SEQ ID NO: 1767246 - RNA, 13 nt, Human
acccagcgagccc

SEQ ID NO: 1767247 - RNA, 23 nt, Human
ucagcccuaggguggagagccac

SEQ ID NO: 1767248 - RNA, 16 nt, Human
acccagcgagcccugg

SEQ ID NO: 1767249 - RNA, 17 nt, Human
acccagcgagcccuggu

SEQ ID NO: 1767250 - RNA, 14 nt, Human
ucagauugcaugug

SEQ ID NO: 1767251 - RNA, 15 nt, Human
ucagauugcauguga

SEQ ID NO: 1767252 - RNA, 16 nt, Human
ucagauugcaugugac

SEQ ID NO: 1767253 - RNA, 17 nt, Human
ucagauugcaugugacu

SEQ ID NO: 1767254 - RNA, 18 nt, Human
ucagauugcaugugacuc

SEQ ID NO: 1767255 - RNA, 19 nt, Human
ucagauugcaugugacucu

SEQ ID NO: 1767256 - RNA, 21 nt, Human
ucagauugcaugugacucuga

SEQ ID NO: 1767257 - RNA, 22 nt, Human
ucagauugcaugugacucugaa

SEQ ID NO: 1767258 - RNA, 18 nt, Human
ucagauuguggaauguug

SEQ ID NO: 1767259 - RNA, 23 nt, Human
ucagauuguggaauguuggauaa

SEQ ID NO: 1767260 - RNA, 19 nt, Human
ucagcccuaggguggagag

SEQ ID NO: 1767261 - RNA, 21 nt, Human
accauuuugggguacccacug

SEQ ID NO: 1767262 - RNA, 20 nt, Human
acccacugcuuuuggucugu

SEQ ID NO: 1767263 - RNA, 22 nt, Human
accauuuugggguacccacugc

SEQ ID NO: 1767264 - RNA, 22 nt, Human
accaugcgacacugggaggcca

SEQ ID NO: 1767265 - RNA, 23 nt, Human
accaugcgacacugggaggccag

SEQ ID NO: 1767266 - RNA, 14 nt, Human
accaggugggagcg

SEQ ID NO: 1767267 - RNA, 22 nt, Human
accaggugggagcguuuuguug

SEQ ID NO: 1767268 - RNA, 20 nt, Human
accaggguugaccccagagg

SEQ ID NO: 1767269 - RNA, 21 nt, Human
accaggguugaccccagagga

SEQ ID NO: 1767270 - RNA, 15 nt, Human
ucacuguugcccagg

SEQ ID NO: 1767271 - RNA, 22 nt, Human
ucacuuaugaaugauuugcaua

SEQ ID NO: 1767272 - RNA, 14 nt, Human
ucacuguugcccag

SEQ ID NO: 1767273 - RNA, 18 nt, Human
ucacugcaaccuccgccu

SEQ ID NO: 1767274 - RNA, 22 nt, Human
ucaccagccccagugcccacag

SEQ ID NO: 1767275 - RNA, 21 nt, Human
ucacuauguugcccaggcagg

SEQ ID NO: 1767276 - RNA, 12 nt, Human
ucaccagcugca

SEQ ID NO: 1767277 - RNA, 13 nt, Human
ucaccagcugcaa

SEQ ID NO: 1767278 - RNA, 14 nt, Human
ucaccagcugcaaa

SEQ ID NO: 1767279 - RNA, 15 nt, Human
ucaccagcugcaaag

SEQ ID NO: 1767280 - RNA, 16 nt, Human
ucaccagcugcaaagu

SEQ ID NO: 1767281 - RNA, 17 nt, Human
ucaccagcugcaaagug

SEQ ID NO: 1767282 - RNA, 18 nt, Human
ucaccagcugcaaagugu

SEQ ID NO: 1767283 - RNA, 19 nt, Human
ucaccagcugcaaaguguu

SEQ ID NO: 1767284 - RNA, 21 nt, Human
ucaccagcugcaaaguguuuu

SEQ ID NO: 1767285 - RNA, 22 nt, Human
ucucacauggugcuacgccugc

SEQ ID NO: 1767286 - RNA, 23 nt, Human
ucucacauggugcuacgccugca

SEQ ID NO: 1767287 - RNA, 13 nt, Human
ucucaccagcugc

SEQ ID NO: 1767288 - RNA, 14 nt, Human
ucucaccagcugca

SEQ ID NO: 1767289 - RNA, 15 nt, Human
ucucaccagcugcaa

SEQ ID NO: 1767290 - RNA, 16 nt, Human
ucucaccagcugcaaa

SEQ ID NO: 1767291 - RNA, 17 nt, Human
ucucaccagcugcaaag

SEQ ID NO: 1767292 - RNA, 18 nt, Human
ucucaccagcugcaaagu

SEQ ID NO: 1767293 - RNA, 19 nt, Human
ucucaccagcugcaaagug

SEQ ID NO: 1767294 - RNA, 20 nt, Human
ucucaccagcugcaaagugu

SEQ ID NO: 1767295 - RNA, 19 nt, Human
acuucucuauaaaaaauau

SEQ ID NO: 1767296 - RNA, 21 nt, Human
acuucucuauaaaaaauaugu

SEQ ID NO: 1767297 - RNA, 23 nt, Human
acuucucuauaaaaaauauguau

SEQ ID NO: 1767298 - RNA, 14 nt, Human
acuucucuuccuug

SEQ ID NO: 1767299 - RNA, 20 nt, Human
acuuguauccaggccuggga

SEQ ID NO: 1767300 - RNA, 14 nt, Human
acuuggaagcuccg

SEQ ID NO: 1767301 - RNA, 11 nt, Human
acuugcauuuc

SEQ ID NO: 1767302 - RNA, 14 nt, Human
acuugaacuugccu

SEQ ID NO: 1767303 - RNA, 15 nt, Human
acuugaacuugccuc

SEQ ID NO: 1767304 - RNA, 16 nt, Human
acuugaacuugccucu

SEQ ID NO: 1767305 - RNA, 12 nt, Human
acuugaacuugu

SEQ ID NO: 1767306 - RNA, 20 nt, Human
acuuccauggcccucauuaa

SEQ ID NO: 1767307 - RNA, 13 nt, Human
ucuauaauuuaaa

SEQ ID NO: 1767308 - RNA, 15 nt, Human
ucuauaaaaaauaug

SEQ ID NO: 1767309 - RNA, 19 nt, Human
acuuccaaauccccuaagc

SEQ ID NO: 1767310 - RNA, 21 nt, Human
acuuccaaauccccuaagcag

SEQ ID NO: 1767311 - RNA, 12 nt, Human
acuuccaugccu

SEQ ID NO: 1767312 - RNA, 14 nt, Human
acuuccaugccuua

SEQ ID NO: 1767313 - RNA, 20 nt, Human
acuuccaugccuuaaaccua

SEQ ID NO: 1767314 - RNA, 17 nt, Human
acuuccauggcccucau

SEQ ID NO: 1767315 - RNA, 18 nt, Human
acuuccauggcccucauu

SEQ ID NO: 1767316 - RNA, 16 nt, Human
acuucaugcaggugaa

SEQ ID NO: 1767317 - RNA, 12 nt, Human
ucuacaucacuc

SEQ ID NO: 1767318 - RNA, 22 nt, Human
acuuagccauuuuucaaagcaa

SEQ ID NO: 1767319 - RNA, 23 nt, Human
acuuagccauuuuucaaagcaau

SEQ ID NO: 1767320 - RNA, 18 nt, Human
acuuauccuaaaacaaau

SEQ ID NO: 1767321 - RNA, 19 nt, Human
acuuauccuaaaacaaaua

SEQ ID NO: 1767322 - RNA, 14 nt, Human
ucgcuccugugucu

SEQ ID NO: 1767323 - RNA, 15 nt, Human
acuggguacuugugg

SEQ ID NO: 1767324 - RNA, 13 nt, Human
acugggcugaggg

SEQ ID NO: 1767325 - RNA, 14 nt, Human
acugggcugaggga

SEQ ID NO: 1767326 - RNA, 17 nt, Human
acugggcugagggagcc

SEQ ID NO: 1767327 - RNA, 19 nt, Human
ucgcugccagcucuguauc

SEQ ID NO: 1767328 - RNA, 20 nt, Human
ucgcugccagcucuguauca

SEQ ID NO: 1767329 - RNA, 20 nt, Human
ucgcuggacucucagucucu

SEQ ID NO: 1767330 - RNA, 22 nt, Human
ucgcuggacucucagucucuga

SEQ ID NO: 1767331 - RNA, 23 nt, Human
ucgcuggacucucagucucugag

SEQ ID NO: 1767332 - RNA, 16 nt, Human
acugggcucccgggcc

SEQ ID NO: 1767333 - RNA, 22 nt, Human
acugggcucccgggccccacag

SEQ ID NO: 1767334 - RNA, 17 nt, Human
acuggguacuuguggac

SEQ ID NO: 1767335 - RNA, 18 nt, Human
acuggguacuuguggaca

SEQ ID NO: 1767336 - RNA, 12 nt, Human
acuguauguuau

SEQ ID NO: 1767337 - RNA, 16 nt, Human
acuguauguuauagaa

SEQ ID NO: 1767338 - RNA, 21 nt, Human
acuguauguuauagaacuuca

SEQ ID NO: 1767339 - RNA, 21 nt, Human
acuguauuuuguauuguuuca

SEQ ID NO: 1767340 - RNA, 20 nt, Human
ucuaagagaacaaugugcua

SEQ ID NO: 1767341 - RNA, 13 nt, Human
ucuaagucuuucc

SEQ ID NO: 1767342 - RNA, 14 nt, Human
ucuaagucuuucca

SEQ ID NO: 1767343 - RNA, 17 nt, Human
acuguuaauaguucagg

SEQ ID NO: 1767344 - RNA, 21 nt, Human
acuguuaauaguucagguaac

SEQ ID NO: 1767345 - RNA, 10 nt, Human
ucgggaccag

SEQ ID NO: 1767346 - RNA, 11 nt, Human
ucgggaccagg

SEQ ID NO: 1767347 - RNA, 14 nt, Human
acugugggcaauuu

SEQ ID NO: 1767348 - RNA, 15 nt, Human
acugugggcaauuua

SEQ ID NO: 1767349 - RNA, 17 nt, Human
acugugggcaauuuaga

SEQ ID NO: 1767350 - RNA, 18 nt, Human
acugugggcaauuuagaa

SEQ ID NO: 1767351 - RNA, 19 nt, Human
acugugggcaauuuagaaa

SEQ ID NO: 1767352 - RNA, 20 nt, Human
acugugggcaauuuagaaaa

SEQ ID NO: 1767353 - RNA, 13 nt, Human
ucgggcugugccc

SEQ ID NO: 1767354 - RNA, 12 nt, Human
ucgggcugugcc

SEQ ID NO: 1767355 - RNA, 22 nt, Human
ucguucgcagagcuuuucagau

SEQ ID NO: 1767356 - RNA, 15 nt, Human
ucguuuacuaugccu

SEQ ID NO: 1767357 - RNA, 13 nt, Human
ucucgccaagcag

SEQ ID NO: 1767358 - RNA, 15 nt, Human
ucucgcucccuccca

SEQ ID NO: 1767359 - RNA, 16 nt, Human
ucucgcucccucccag

SEQ ID NO: 1767360 - RNA, 18 nt, Human
ucucgcucccucccagga

SEQ ID NO: 1767361 - RNA, 15 nt, Human
ucucgcuucccugaa

SEQ ID NO: 1767362 - RNA, 15 nt, Human
ucuccuguccucccu

SEQ ID NO: 1767363 - RNA, 17 nt, Human
ucuccuguccucccuca

SEQ ID NO: 1767364 - RNA, 13 nt, Human
agaaaaaaauuca

SEQ ID NO: 1767365 - RNA, 15 nt, Human
agaaaaaaauucaug

SEQ ID NO: 1767366 - RNA, 18 nt, Human
acuuuguguucaccuugu

SEQ ID NO: 1767367 - RNA, 17 nt, Human
agaaaaaaagauuuauu

SEQ ID NO: 1767368 - RNA, 16 nt, Human
acuuuguguucaccuu

SEQ ID NO: 1767369 - RNA, 13 nt, Human
acuuugcuccuca

SEQ ID NO: 1767370 - RNA, 15 nt, Human
acuuugcuccucaca

SEQ ID NO: 1767371 - RNA, 15 nt, Human
acuuuggaaaaugca

SEQ ID NO: 1767372 - RNA, 18 nt, Human
acuuuggaaaaugcauug

SEQ ID NO: 1767373 - RNA, 21 nt, Human
acuuuagaaguagaauugaca

SEQ ID NO: 1767374 - RNA, 15 nt, Human
acuuuacgcccaucu

SEQ ID NO: 1767375 - RNA, 20 nt, Human
acuugucucuucaucuaaua

SEQ ID NO: 1767376 - RNA, 15 nt, Human
acuuguggacacagc

SEQ ID NO: 1767377 - RNA, 16 nt, Human
acuuuaaaaggagcca

SEQ ID NO: 1767378 - RNA, 14 nt, Human
acuuguggacacag

SEQ ID NO: 1767379 - RNA, 16 nt, Human
agaaacuuaagcaaag

SEQ ID NO: 1767380 - RNA, 18 nt, Human
agaaacuuaagcaaaggg

SEQ ID NO: 1767381 - RNA, 13 nt, Human
agaaagcauuuga

SEQ ID NO: 1767382 - RNA, 14 nt, Human
agaaagcauuugaa

SEQ ID NO: 1767383 - RNA, 19 nt, Human
agaaauacaauucuacauu

SEQ ID NO: 1767384 - RNA, 16 nt, Human
agaaaugguuguauua

SEQ ID NO: 1767385 - RNA, 15 nt, Human
agaaaugguuguauu

SEQ ID NO: 1767386 - RNA, 20 nt, Human
ucugaaggagccccauuccu

SEQ ID NO: 1767387 - RNA, 19 nt, Human
agaaauggugagauuguuu

SEQ ID NO: 1767388 - RNA, 21 nt, Human
ucugaaggagccccauuccug

SEQ ID NO: 1767389 - RNA, 13 nt, Human
agaaaugcugcug

SEQ ID NO: 1767390 - RNA, 14 nt, Human
agaaaugcugcugg

SEQ ID NO: 1767391 - RNA, 15 nt, Human
agaaaugcugcuggc

SEQ ID NO: 1767392 - RNA, 17 nt, Human
agaaaugcugcuggcca

SEQ ID NO: 1767393 - RNA, 21 nt, Human
agaaauacagauuuugauagc

SEQ ID NO: 1767394 - RNA, 16 nt, Human
agaaauacagauuuug

SEQ ID NO: 1767395 - RNA, 12 nt, Human
agaaauacaguc

SEQ ID NO: 1767396 - RNA, 14 nt, Human
agaaauacagucuu

SEQ ID NO: 1767397 - RNA, 19 nt, Human
agaaauacagucuuccaca

SEQ ID NO: 1767398 - RNA, 14 nt, Human
agaaacaaugaaug

SEQ ID NO: 1767399 - RNA, 20 nt, Human
agaaacaacucuuugagaaa

SEQ ID NO: 1767400 - RNA, 20 nt, Human
agaagcucuuacucuuuccu

SEQ ID NO: 1767401 - RNA, 19 nt, Human
agaagcucucgggcuagga

SEQ ID NO: 1767402 - RNA, 16 nt, Human
agaaggagacaggcag

SEQ ID NO: 1767403 - RNA, 18 nt, Human
agaagugagaauaggcag

SEQ ID NO: 1767404 - RNA, 21 nt, Human
agaagugagaauaggcagccc

SEQ ID NO: 1767405 - RNA, 20 nt, Human
agaauaaagguaugaaaggg

SEQ ID NO: 1767406 - RNA, 16 nt, Human
agaaguuuuaaauuuu

SEQ ID NO: 1767407 - RNA, 17 nt, Human
agaaguuuuaaauuuug

SEQ ID NO: 1767408 - RNA, 13 nt, Human
agaauaauuuaua

SEQ ID NO: 1767409 - RNA, 16 nt, Human
agaauaauuuauagua

SEQ ID NO: 1767410 - RNA, 17 nt, Human
agaauaauuuauaguaa

SEQ ID NO: 1767411 - RNA, 22 nt, Human
agaauaauuuauaguaaugagu

SEQ ID NO: 1767412 - RNA, 15 nt, Human
ucugcccuguguacu

SEQ ID NO: 1767413 - RNA, 16 nt, Human
ucuggauucugaaucu

SEQ ID NO: 1767414 - RNA, 21 nt, Human
ucuggauucugaaucucaaga

SEQ ID NO: 1767415 - RNA, 21 nt, Human
ucuggccguccuugucucugg

SEQ ID NO: 1767416 - RNA, 22 nt, Human
agaagccucugggucagugguc

SEQ ID NO: 1767417 - RNA, 23 nt, Human
agaagccucugggucaguggucc

SEQ ID NO: 1767418 - RNA, 22 nt, Human
agaagccauggaaaaacuuccu

SEQ ID NO: 1767419 - RNA, 18 nt, Human
agaacuuggauguaccug

SEQ ID NO: 1767420 - RNA, 23 nt, Human
agaacuuggauguaccugccccc

SEQ ID NO: 1767421 - RNA, 20 nt, Human
ucugccccccccccccaucu

SEQ ID NO: 1767422 - RNA, 15 nt, Human
ucugccccagcccag

SEQ ID NO: 1767423 - RNA, 16 nt, Human
ucugccccagcccaga

SEQ ID NO: 1767424 - RNA, 17 nt, Human
ucugccccagcccagau

SEQ ID NO: 1767425 - RNA, 20 nt, Human
ucugccccagcccagauucc

SEQ ID NO: 1767426 - RNA, 16 nt, Human
agaacuugcugcuguc

SEQ ID NO: 1767427 - RNA, 19 nt, Human
ucugaaucucaagaugggg

SEQ ID NO: 1767428 - RNA, 16 nt, Human
agagcaucggccuagg

SEQ ID NO: 1767429 - RNA, 15 nt, Human
ugaaagacugaagaa

SEQ ID NO: 1767430 - RNA, 16 nt, Human
ugaaagacugaagaaa

SEQ ID NO: 1767431 - RNA, 22 nt, Human
ugaaagacugaagaaaguguag

SEQ ID NO: 1767432 - RNA, 22 nt, Human
agagaucaaccccuucgcuccu

SEQ ID NO: 1767433 - RNA, 16 nt, Human
agagagaacaggacua

SEQ ID NO: 1767434 - RNA, 18 nt, Human
ucuuucugagugccuucu

SEQ ID NO: 1767435 - RNA, 22 nt, Human
ucuuucugagugccuucugugg

SEQ ID NO: 1767436 - RNA, 14 nt, Human
ucuuucuuagaaau

SEQ ID NO: 1767437 - RNA, 13 nt, Human
ucuuucuuagaaa

SEQ ID NO: 1767438 - RNA, 14 nt, Human
ucuuucugucccuu

SEQ ID NO: 1767439 - RNA, 16 nt, Human
ucuuucuguccccucu

SEQ ID NO: 1767440 - RNA, 19 nt, Human
ucuuucuguccccucuucc

SEQ ID NO: 1767441 - RNA, 13 nt, Human
ucuuucugucccu

SEQ ID NO: 1767442 - RNA, 18 nt, Human
ugaaaaaauguauaugca

SEQ ID NO: 1767443 - RNA, 22 nt, Human
ugaaaaaauagagccugaggga

SEQ ID NO: 1767444 - RNA, 14 nt, Human
ucuuuguucaagau

SEQ ID NO: 1767445 - RNA, 16 nt, Human
ucuuuguucaagauga

SEQ ID NO: 1767446 - RNA, 13 nt, Human
ucuuuuaccugcu

SEQ ID NO: 1767447 - RNA, 14 nt, Human
ucuuuuaccugcug

SEQ ID NO: 1767448 - RNA, 15 nt, Human
ucuuuuaccugcugc

SEQ ID NO: 1767449 - RNA, 20 nt, Human
ucuuuuaccugcugcuucuc

SEQ ID NO: 1767450 - RNA, 21 nt, Human
ucuuuuaccugcugcuucucc

SEQ ID NO: 1767451 - RNA, 16 nt, Human
ugaaaaucgugacaac

SEQ ID NO: 1767452 - RNA, 12 nt, Human
ugaaaaggaauc

SEQ ID NO: 1767453 - RNA, 14 nt, Human
ugaaaaugucuugu

SEQ ID NO: 1767454 - RNA, 15 nt, Human
ugaaaaugucuugug

SEQ ID NO: 1767455 - RNA, 13 nt, Human
ugaaaaugucuug

SEQ ID NO: 1767456 - RNA, 19 nt, Human
ugaaaaucgugacaacacu

SEQ ID NO: 1767457 - RNA, 20 nt, Human
ugaaaaucuuauaauuuaaa

SEQ ID NO: 1767458 - RNA, 21 nt, Human
ugaaacuauauuuugucauau

SEQ ID NO: 1767459 - RNA, 20 nt, Human
ugaaacgcuccuuugugugu

SEQ ID NO: 1767460 - RNA, 13 nt, Human
ugaaacuauauuu

SEQ ID NO: 1767461 - RNA, 19 nt, Human
ugaaacuauauuuugucau

SEQ ID NO: 1767462 - RNA, 18 nt, Human
ucuugauuuauuugcuuc

SEQ ID NO: 1767463 - RNA, 16 nt, Human
ucuugacuacagucag

SEQ ID NO: 1767464 - RNA, 19 nt, Human
ucuugcaauggcagccuug

SEQ ID NO: 1767465 - RNA, 18 nt, Human
ucuugcaauggcagccuu

SEQ ID NO: 1767466 - RNA, 22 nt, Human
ucuugcaauggcagccuuggca

SEQ ID NO: 1767467 - RNA, 23 nt, Human
ucuugcaauggcagccuuggcaa

SEQ ID NO: 1767468 - RNA, 18 nt, Human
ucuuggcagcaccugucu

SEQ ID NO: 1767469 - RNA, 19 nt, Human
ucuuggcagcaccugucuc

SEQ ID NO: 1767470 - RNA, 12 nt, Human
ucuucugcuuca

SEQ ID NO: 1767471 - RNA, 19 nt, Human
ucuucugcuucagccuccc

SEQ ID NO: 1767472 - RNA, 22 nt, Human
ucuucugggagggcagcagggc

SEQ ID NO: 1767473 - RNA, 23 nt, Human
ucuucugggagggcagcagggcu

SEQ ID NO: 1767474 - RNA, 12 nt, Human
ucuucugucccu

SEQ ID NO: 1767475 - RNA, 13 nt, Human
ucuucugucccug

SEQ ID NO: 1767476 - RNA, 15 nt, Human
ucuucugucccuguu

SEQ ID NO: 1767477 - RNA, 15 nt, Human
ucuucuguacgucug

SEQ ID NO: 1767478 - RNA, 20 nt, Human
ucuucuguacgucugacagg

SEQ ID NO: 1767479 - RNA, 20 nt, Human
agacauucucgcuucccuga

SEQ ID NO: 1767480 - RNA, 21 nt, Human
agacauucucgcuucccugaa

SEQ ID NO: 1767481 - RNA, 13 nt, Human
ucuuccauuugca

SEQ ID NO: 1767482 - RNA, 14 nt, Human
ucuuccauuugcaa

SEQ ID NO: 1767483 - RNA, 23 nt, Human
ucuucccagcacuaugcuuuccu

SEQ ID NO: 1767484 - RNA, 14 nt, Human
agaggcccucgcug

SEQ ID NO: 1767485 - RNA, 19 nt, Human
agaggcccucgcugccagc

SEQ ID NO: 1767486 - RNA, 19 nt, Human
agaggcuggccucuacauc

SEQ ID NO: 1767487 - RNA, 13 nt, Human
agaguauaugcac

SEQ ID NO: 1767488 - RNA, 19 nt, Human
ugaauaggcgaucacaacg

SEQ ID NO: 1767489 - RNA, 18 nt, Human
ugaauaggcgaucacaac

SEQ ID NO: 1767490 - RNA, 17 nt, Human
ugaauaggcgaucacaa

SEQ ID NO: 1767491 - RNA, 15 nt, Human
ugaauacuuuauaaa

SEQ ID NO: 1767492 - RNA, 16 nt, Human
ugaauacuguauuuug

SEQ ID NO: 1767493 - RNA, 20 nt, Human
ugaauacucugcccucuaga

SEQ ID NO: 1767494 - RNA, 22 nt, Human
ugaauacucugcccucuagagc

SEQ ID NO: 1767495 - RNA, 14 nt, Human
ugaagucacacagu

SEQ ID NO: 1767496 - RNA, 20 nt, Human
agauacaggaaaagcugcug

SEQ ID NO: 1767497 - RNA, 20 nt, Human
agauaauauuuuacauacac

SEQ ID NO: 1767498 - RNA, 19 nt, Human
agaguuuuggaugcagugc

SEQ ID NO: 1767499 - RNA, 18 nt, Human
agaguuuuggaugcagug

SEQ ID NO: 1767500 - RNA, 17 nt, Human
agaguuuuggaugcagu

SEQ ID NO: 1767501 - RNA, 13 nt, Human
agaguuuuggaug

SEQ ID NO: 1767502 - RNA, 21 nt, Human
agaguuuuggaugcagugcuc

SEQ ID NO: 1767503 - RNA, 20 nt, Human
agaguuuuggaugcagugcu

SEQ ID NO: 1767504 - RNA, 19 nt, Human
ugacacacagcucuguccu

SEQ ID NO: 1767505 - RNA, 20 nt, Human
ugacacacagcucuguccug

SEQ ID NO: 1767506 - RNA, 17 nt, Human
ugacaaaggcaagcacu

SEQ ID NO: 1767507 - RNA, 16 nt, Human
ugacacacagcucugu

SEQ ID NO: 1767508 - RNA, 18 nt, Human
ugacacacagcucugucc

SEQ ID NO: 1767509 - RNA, 17 nt, Human
ugacacauaguuuuuca

SEQ ID NO: 1767510 - RNA, 20 nt, Human
ugacacgucucgccaagcag

SEQ ID NO: 1767511 - RNA, 22 nt, Human
ugacacucccuugggcucccug

SEQ ID NO: 1767512 - RNA, 11 nt, Human
ugaauuugcaa

SEQ ID NO: 1767513 - RNA, 12 nt, Human
ugaauuugcaaa

SEQ ID NO: 1767514 - RNA, 14 nt, Human
ugaauuugcaaagu

SEQ ID NO: 1767515 - RNA, 15 nt, Human
ugaauuugcaaagua

SEQ ID NO: 1767516 - RNA, 17 nt, Human
ugaauuugcaaaguacu

SEQ ID NO: 1767517 - RNA, 18 nt, Human
ugaauuugcaaaguacug

SEQ ID NO: 1767518 - RNA, 19 nt, Human
ugaauuugcaaaguacugu

SEQ ID NO: 1767519 - RNA, 20 nt, Human
ugaauuugcaaaguacugua

SEQ ID NO: 1767520 - RNA, 21 nt, Human
ugaauuugcaaaguacuguaa

SEQ ID NO: 1767521 - RNA, 17 nt, Human
ugaauuuuguucucugg

SEQ ID NO: 1767522 - RNA, 18 nt, Human
ugaauuuuguucucuggg

SEQ ID NO: 1767523 - RNA, 19 nt, Human
ugaauuuuguucucuggga

SEQ ID NO: 1767524 - RNA, 20 nt, Human
ugaauuuuguucucugggag

SEQ ID NO: 1767525 - RNA, 22 nt, Human
ugaauuuuguucucugggagaa

SEQ ID NO: 1767526 - RNA, 13 nt, Human
ugaauuuugggga

SEQ ID NO: 1767527 - RNA, 20 nt, Human
ugaauuuuggggauuuucaa

SEQ ID NO: 1767528 - RNA, 21 nt, Human
ugaauuuuggggauuuucaaa

SEQ ID NO: 1767529 - RNA, 22 nt, Human
ugaauuuuggggauuuucaaaa

SEQ ID NO: 1767530 - RNA, 15 nt, Human
ugaauuuuuccuaug

SEQ ID NO: 1767531 - RNA, 20 nt, Human
ugagaagaaaauggaaccag

SEQ ID NO: 1767532 - RNA, 22 nt, Human
ugagaagaaaauggaaccaggc

SEQ ID NO: 1767533 - RNA, 18 nt, Human
agcaagaagggaguucca

SEQ ID NO: 1767534 - RNA, 16 nt, Human
agauucgcuuuccaug

SEQ ID NO: 1767535 - RNA, 15 nt, Human
agauuccccuguguc

SEQ ID NO: 1767536 - RNA, 16 nt, Human
agauuccccuguguca

SEQ ID NO: 1767537 - RNA, 15 nt, Human
agauucauuuucuag

SEQ ID NO: 1767538 - RNA, 16 nt, Human
agauucauuuucuaga

SEQ ID NO: 1767539 - RNA, 17 nt, Human
agauucauuuucuagau

SEQ ID NO: 1767540 - RNA, 19 nt, Human
agauuuugauagcaaagcg

SEQ ID NO: 1767541 - RNA, 18 nt, Human
agauuuugauagcaaagc

SEQ ID NO: 1767542 - RNA, 15 nt, Human
agauuuugauagcaa

SEQ ID NO: 1767543 - RNA, 14 nt, Human
ugacacucccuugg

SEQ ID NO: 1767544 - RNA, 15 nt, Human
ugacacuugucccca

SEQ ID NO: 1767545 - RNA, 15 nt, Human
agaugcuccuugggc

SEQ ID NO: 1767546 - RNA, 20 nt, Human
agaugcuccuugggcccuuu

SEQ ID NO: 1767547 - RNA, 18 nt, Human
agaugcccgagggagggg

SEQ ID NO: 1767548 - RNA, 19 nt, Human
agaugcccgagggagggga

SEQ ID NO: 1767549 - RNA, 14 nt, Human
ugacccauugcugu

SEQ ID NO: 1767550 - RNA, 15 nt, Human
ugacccauugcuguu

SEQ ID NO: 1767551 - RNA, 13 nt, Human
ugacccauugcug

SEQ ID NO: 1767552 - RNA, 15 nt, Human
agauuaaaaauuaua

SEQ ID NO: 1767553 - RNA, 16 nt, Human
agauuaaaaauuauag

SEQ ID NO: 1767554 - RNA, 21 nt, Human
agauuaaaaauuauaggaaua

SEQ ID NO: 1767555 - RNA, 13 nt, Human
agaugcuccaggg

SEQ ID NO: 1767556 - RNA, 20 nt, Human
agauguucucuaucauuuaa

SEQ ID NO: 1767557 - RNA, 21 nt, Human
agauguucucuaucauuuaau

SEQ ID NO: 1767558 - RNA, 13 nt, Human
ugaccccagagga

SEQ ID NO: 1767559 - RNA, 22 nt, Human
ugaccccagcauucucaggcac

SEQ ID NO: 1767560 - RNA, 15 nt, Human
ugauacuuuuaagag

SEQ ID NO: 1767561 - RNA, 16 nt, Human
ugauacucauuucuua

SEQ ID NO: 1767562 - RNA, 20 nt, Human
ugaucacggcucacugcagc

SEQ ID NO: 1767563 - RNA, 21 nt, Human
ugaucacggcucacugcagcc

SEQ ID NO: 1767564 - RNA, 13 nt, Human
agcaucaagccac

SEQ ID NO: 1767565 - RNA, 20 nt, Human
agcaucacaugaacuuguaa

SEQ ID NO: 1767566 - RNA, 19 nt, Human
ugaucacggcucacugcag

SEQ ID NO: 1767567 - RNA, 16 nt, Human
ugauauuuuuucucuc

SEQ ID NO: 1767568 - RNA, 15 nt, Human
agcauugcuggacuc

SEQ ID NO: 1767569 - RNA, 18 nt, Human
agcauggcucaaagugca

SEQ ID NO: 1767570 - RNA, 20 nt, Human
agcaugucgucaaagcugaa

SEQ ID NO: 1767571 - RNA, 17 nt, Human
agcaugucgucaaagcu

SEQ ID NO: 1767572 - RNA, 14 nt, Human
ugagucaccaagcc

SEQ ID NO: 1767573 - RNA, 16 nt, Human
ugagucaccaagccca

SEQ ID NO: 1767574 - RNA, 17 nt, Human
ugagucaccaagcccag

SEQ ID NO: 1767575 - RNA, 12 nt, Human
ugagugcucuga

SEQ ID NO: 1767576 - RNA, 13 nt, Human
ugagugcucugau

SEQ ID NO: 1767577 - RNA, 19 nt, Human
ugagugcucugaucccucu

SEQ ID NO: 1767578 - RNA, 12 nt, Human
ugagugccuucu

SEQ ID NO: 1767579 - RNA, 13 nt, Human
ugagugccuucug

SEQ ID NO: 1767580 - RNA, 18 nt, Human
ugagugccuucugugggg

SEQ ID NO: 1767581 - RNA, 21 nt, Human
ugagugccuucuguggggacu

SEQ ID NO: 1767582 - RNA, 17 nt, Human
ugaguucauacccuguu

SEQ ID NO: 1767583 - RNA, 23 nt, Human
agcauaucugccuuuauuguguu

SEQ ID NO: 1767584 - RNA, 22 nt, Human
agcauaucugccuuuauugugu

SEQ ID NO: 1767585 - RNA, 20 nt, Human
agcauaucugccuuuauugu

SEQ ID NO: 1767586 - RNA, 17 nt, Human
agcauaucugccuuuau

SEQ ID NO: 1767587 - RNA, 13 nt, Human
agcauaacauaug

SEQ ID NO: 1767588 - RNA, 20 nt, Human
ugagaauuugagugcucuga

SEQ ID NO: 1767589 - RNA, 23 nt, Human
ugaguagaaaggccuuuaaaauu

SEQ ID NO: 1767590 - RNA, 18 nt, Human
ugaguagaaaggccuuua

SEQ ID NO: 1767591 - RNA, 17 nt, Human
ugaguagaaaggccuuu

SEQ ID NO: 1767592 - RNA, 16 nt, Human
agcauaucugccuuua

SEQ ID NO: 1767593 - RNA, 22 nt, Human
ugaguaacugauuuguaacaag

SEQ ID NO: 1767594 - RNA, 22 nt, Human
agccaccgaagccgccugugga

SEQ ID NO: 1767595 - RNA, 14 nt, Human
agccacggccaggc

SEQ ID NO: 1767596 - RNA, 15 nt, Human
agccaccgaagccgc

SEQ ID NO: 1767597 - RNA, 20 nt, Human
agccaccgaagccgccugug

SEQ ID NO: 1767598 - RNA, 21 nt, Human
agccaccgaagccgccugugg

SEQ ID NO: 1767599 - RNA, 16 nt, Human
agcauuugaaugcauu

SEQ ID NO: 1767600 - RNA, 15 nt, Human
agcauuugaaugcau

SEQ ID NO: 1767601 - RNA, 14 nt, Human
agcauuugaaugca

SEQ ID NO: 1767602 - RNA, 13 nt, Human
agcauuugaaugc

SEQ ID NO: 1767603 - RNA, 12 nt, Human
agcauuugaaug

SEQ ID NO: 1767604 - RNA, 11 nt, Human
agcauuugaau

SEQ ID NO: 1767605 - RNA, 15 nt, Human
ugaucgccuuuccca

SEQ ID NO: 1767606 - RNA, 17 nt, Human
ugaucgccuuucccagg

SEQ ID NO: 1767607 - RNA, 14 nt, Human
ugaugaauacugua

SEQ ID NO: 1767608 - RNA, 15 nt, Human
agccacggccaggcc

SEQ ID NO: 1767609 - RNA, 14 nt, Human
agccacuccucuga

SEQ ID NO: 1767610 - RNA, 15 nt, Human
agccacuccucugac

SEQ ID NO: 1767611 - RNA, 21 nt, Human
agccacuccucugacucaggg

SEQ ID NO: 1767612 - RNA, 22 nt, Human
agccacuccucugacucagggc

SEQ ID NO: 1767613 - RNA, 15 nt, Human
agccacugagcaaug

SEQ ID NO: 1767614 - RNA, 12 nt, Human
ugauuaaagugc

SEQ ID NO: 1767615 - RNA, 13 nt, Human
agccacugcaccg

SEQ ID NO: 1767616 - RNA, 21 nt, Human
agccacugcaccgggccacag

SEQ ID NO: 1767617 - RNA, 22 nt, Human
agccacugcaccgggccacaga

SEQ ID NO: 1767618 - RNA, 17 nt, Human
agccacuuaaaauguuc

SEQ ID NO: 1767619 - RNA, 20 nt, Human
agccacuggcugcuaacaag

SEQ ID NO: 1767620 - RNA, 13 nt, Human
ugauguuucauuu

SEQ ID NO: 1767621 - RNA, 15 nt, Human
ugauguuugcccaaa

SEQ ID NO: 1767622 - RNA, 19 nt, Human
ugauguuugcccaaaauuu

SEQ ID NO: 1767623 - RNA, 19 nt, Human
ugauucccaagcucugcuc

SEQ ID NO: 1767624 - RNA, 21 nt, Human
ugauucccaagcucugcuccu

SEQ ID NO: 1767625 - RNA, 15 nt, Human
ugauucccaagcucu

SEQ ID NO: 1767626 - RNA, 16 nt, Human
ugauucccaagcucug

SEQ ID NO: 1767627 - RNA, 18 nt, Human
ugauucccaagcucugcu

SEQ ID NO: 1767628 - RNA, 24 nt, Human
ugauucaguguuaaaugugaugaa

SEQ ID NO: 1767629 - RNA, 12 nt, Human
ugauucaguguu

SEQ ID NO: 1767630 - RNA, 21 nt, Human
ugauucaguguuaaaugugau

SEQ ID NO: 1767631 - RNA, 14 nt, Human
agcccagcucugaa

SEQ ID NO: 1767632 - RNA, 12 nt, Human
agcccagccccu

SEQ ID NO: 1767633 - RNA, 17 nt, Human
agcccagccccuacugc

SEQ ID NO: 1767634 - RNA, 19 nt, Human
agcccagccccuacugcug

SEQ ID NO: 1767635 - RNA, 20 nt, Human
agcccagccccuacugcugu

SEQ ID NO: 1767636 - RNA, 12 nt, Human
agcccagacaaa

SEQ ID NO: 1767637 - RNA, 14 nt, Human
agccagcugcccua

SEQ ID NO: 1767638 - RNA, 16 nt, Human
agccagcugcucccca

SEQ ID NO: 1767639 - RNA, 12 nt, Human
agccagggucuc

SEQ ID NO: 1767640 - RNA, 21 nt, Human
agccaguuugccggauacaaa

SEQ ID NO: 1767641 - RNA, 18 nt, Human
agcggagacggaguccca

SEQ ID NO: 1767642 - RNA, 15 nt, Human
agccuugucccccuc

SEQ ID NO: 1767643 - RNA, 21 nt, Human
ugccaagggcuuuguuuugca

SEQ ID NO: 1767644 - RNA, 20 nt, Human
ugcauugcucuggaucuguu

SEQ ID NO: 1767645 - RNA, 16 nt, Human
agccuucagccuuaau

SEQ ID NO: 1767646 - RNA, 18 nt, Human
ugcauaagguuuuuaugc

SEQ ID NO: 1767647 - RNA, 12 nt, Human
agcuagccagag

SEQ ID NO: 1767648 - RNA, 17 nt, Human
agcuagccagaggacug

SEQ ID NO: 1767649 - RNA, 19 nt, Human
agcuagccagaggacugug

SEQ ID NO: 1767650 - RNA, 15 nt, Human
agcuagcucaacuag

SEQ ID NO: 1767651 - RNA, 16 nt, Human
agcuagcucaacuagu

SEQ ID NO: 1767652 - RNA, 20 nt, Human
agcgggggaggcccgcagag

SEQ ID NO: 1767653 - RNA, 14 nt, Human
agcgggggaggccc

SEQ ID NO: 1767654 - RNA, 19 nt, Human
agcgugagccacugcaccg

SEQ ID NO: 1767655 - RNA, 22 nt, Human
agcgugagccacugcaccgggc

SEQ ID NO: 1767656 - RNA, 19 nt, Human
agcuacuaauuuuaaaaug

SEQ ID NO: 1767657 - RNA, 12 nt, Human
agcuaggccugg

SEQ ID NO: 1767658 - RNA, 16 nt, Human
agcuaggccuggccag

SEQ ID NO: 1767659 - RNA, 14 nt, Human
agcuaggccuggcc

SEQ ID NO: 1767660 - RNA, 15 nt, Human
agcuaggccuggcca

SEQ ID NO: 1767661 - RNA, 18 nt, Human
agcucaggugucccugca

SEQ ID NO: 1767662 - RNA, 22 nt, Human
agcucaggugucccugcacuug

SEQ ID NO: 1767663 - RNA, 20 nt, Human
agcucaggugucccugcacu

SEQ ID NO: 1767664 - RNA, 21 nt, Human
agcucaggugucccugcacuu

SEQ ID NO: 1767665 - RNA, 20 nt, Human
ugcccacaggaucagucuga

SEQ ID NO: 1767666 - RNA, 19 nt, Human
ugcccacaggaucagucug

SEQ ID NO: 1767667 - RNA, 16 nt, Human
ugcccacaggaucagu

SEQ ID NO: 1767668 - RNA, 18 nt, Human
ugcacacccacucagcuc

SEQ ID NO: 1767669 - RNA, 16 nt, Human
ugcacacccacucagc

SEQ ID NO: 1767670 - RNA, 17 nt, Human
ugcacacccacucagcu

SEQ ID NO: 1767671 - RNA, 14 nt, Human
ugcacacccacuca

SEQ ID NO: 1767672 - RNA, 14 nt, Human
ugcacgugugugca

SEQ ID NO: 1767673 - RNA, 15 nt, Human
ugcacgugugugcac

SEQ ID NO: 1767674 - RNA, 21 nt, Human
agcccugguggcagugggagc

SEQ ID NO: 1767675 - RNA, 22 nt, Human
agcccugguggcagugggagcu

SEQ ID NO: 1767676 - RNA, 23 nt, Human
agcccugguggcagugggagcug

SEQ ID NO: 1767677 - RNA, 15 nt, Human
ugauucuccugccuc

SEQ ID NO: 1767678 - RNA, 19 nt, Human
ugauucuccugccucagcc

SEQ ID NO: 1767679 - RNA, 20 nt, Human
ugauucuccugccucagccu

SEQ ID NO: 1767680 - RNA, 14 nt, Human
agcccauaaccagu

SEQ ID NO: 1767681 - RNA, 17 nt, Human
agccccgaggccuucuc

SEQ ID NO: 1767682 - RNA, 22 nt, Human
agccccgaggccuucucugaag

SEQ ID NO: 1767683 - RNA, 16 nt, Human
agccccgaggccuucu

SEQ ID NO: 1767684 - RNA, 15 nt, Human
agccccuacugcugu

SEQ ID NO: 1767685 - RNA, 16 nt, Human
agccccuacugcugug

SEQ ID NO: 1767686 - RNA, 17 nt, Human
agccccuacugcuguga

SEQ ID NO: 1767687 - RNA, 23 nt, Human
agccccuacugcugugaacccug

SEQ ID NO: 1767688 - RNA, 16 nt, Human
agccugaacagaagcu

SEQ ID NO: 1767689 - RNA, 19 nt, Human
ugcaguccugaucagagcc

SEQ ID NO: 1767690 - RNA, 22 nt, Human
ugcaguccugaucagagccgug

SEQ ID NO: 1767691 - RNA, 14 nt, Human
ugcagccugcgcca

SEQ ID NO: 1767692 - RNA, 21 nt, Human
ugcagcucaaggaaaggccug

SEQ ID NO: 1767693 - RNA, 17 nt, Human
agccucccaaagugcug

SEQ ID NO: 1767694 - RNA, 17 nt, Human
agccucagcauccuggc

SEQ ID NO: 1767695 - RNA, 19 nt, Human
agccucagcauccuggcac

SEQ ID NO: 1767696 - RNA, 20 nt, Human
agccucagcauccuggcacc

SEQ ID NO: 1767697 - RNA, 21 nt, Human
agccucagcauccuggcaccc

SEQ ID NO: 1767698 - RNA, 15 nt, Human
agccguggucccuga

SEQ ID NO: 1767699 - RNA, 22 nt, Human
agccucagcauccuggcacccg

SEQ ID NO: 1767700 - RNA, 23 nt, Human
agccucagcauccuggcacccgg

SEQ ID NO: 1767701 - RNA, 16 nt, Human
agccucccaaagugcu

SEQ ID NO: 1767702 - RNA, 16 nt, Human
agccgugguccuuugg

SEQ ID NO: 1767703 - RNA, 23 nt, Human
ugcacuauagccuaggugacaga

SEQ ID NO: 1767704 - RNA, 14 nt, Human
ugcuuuuggucugu

SEQ ID NO: 1767705 - RNA, 17 nt, Human
ugcuuuuggucugugug

SEQ ID NO: 1767706 - RNA, 14 nt, Human
ugcuuuugcuucua

SEQ ID NO: 1767707 - RNA, 13 nt, Human
ugcuuggucuguu

SEQ ID NO: 1767708 - RNA, 15 nt, Human
ugcuuggucuguuug

SEQ ID NO: 1767709 - RNA, 16 nt, Human
ugcuuggucuguuuga

SEQ ID NO: 1767710 - RNA, 13 nt, Human
ugcuugauacagg

SEQ ID NO: 1767711 - RNA, 21 nt, Human
aggacagugcuugauacagga

SEQ ID NO: 1767712 - RNA, 11 nt, Human
aggagcuuccu

SEQ ID NO: 1767713 - RNA, 16 nt, Human
aggagcuuccuguccu

SEQ ID NO: 1767714 - RNA, 19 nt, Human
aggagcuucuuguuuccuu

SEQ ID NO: 1767715 - RNA, 20 nt, Human
aggagcuucuuguuuccuug

SEQ ID NO: 1767716 - RNA, 22 nt, Human
aggagcuucuuguuuccuuguu

SEQ ID NO: 1767717 - RNA, 20 nt, Human
aggagcuuccuguccuccca

SEQ ID NO: 1767718 - RNA, 19 nt, Human
uggaagggauggggugcca

SEQ ID NO: 1767719 - RNA, 16 nt, Human
uggaagcacagcuuca

SEQ ID NO: 1767720 - RNA, 14 nt, Human
uggagcccagggca

SEQ ID NO: 1767721 - RNA, 22 nt, Human
uggagcccagggcaucuugcug

SEQ ID NO: 1767722 - RNA, 20 nt, Human
aggcaccucacaggccccag

SEQ ID NO: 1767723 - RNA, 12 nt, Human
aggcaccucaag

SEQ ID NO: 1767724 - RNA, 18 nt, Human
aggcaccucaagaagaag

SEQ ID NO: 1767725 - RNA, 14 nt, Human
aggcaaugcuggcu

SEQ ID NO: 1767726 - RNA, 20 nt, Human
aggcacccaccaucaugucu

SEQ ID NO: 1767727 - RNA, 21 nt, Human
aggcacccaccaucaugucug

SEQ ID NO: 1767728 - RNA, 22 nt, Human
aggcacccaccaucaugucugg

SEQ ID NO: 1767729 - RNA, 15 nt, Human
aggcaauccuaccuu

SEQ ID NO: 1767730 - RNA, 23 nt, Human
uggacacagcucuucuccaggcu

SEQ ID NO: 1767731 - RNA, 13 nt, Human
uggacacaggccu

SEQ ID NO: 1767732 - RNA, 15 nt, Human
uggacacaggccugc

SEQ ID NO: 1767733 - RNA, 20 nt, Human
uggaccuugaacuggguacu

SEQ ID NO: 1767734 - RNA, 16 nt, Human
uggacccuguugcuaa

SEQ ID NO: 1767735 - RNA, 15 nt, Human
uggacccuguugcua

SEQ ID NO: 1767736 - RNA, 14 nt, Human
uggacccuguugcu

SEQ ID NO: 1767737 - RNA, 13 nt, Human
uggacccuguugc

SEQ ID NO: 1767738 - RNA, 22 nt, Human
uggacacagcucuucuccaggc

SEQ ID NO: 1767739 - RNA, 13 nt, Human
uggacacagcucu

SEQ ID NO: 1767740 - RNA, 14 nt, Human
uggacacagcucuu

SEQ ID NO: 1767741 - RNA, 16 nt, Human
uggacaaucaugaaau

SEQ ID NO: 1767742 - RNA, 22 nt, Human
aggcaaacccaucaacaaaaau

SEQ ID NO: 1767743 - RNA, 16 nt, Human
aggcaaaggguccaga

SEQ ID NO: 1767744 - RNA, 19 nt, Human
aggcaaaggguccagaagg

SEQ ID NO: 1767745 - RNA, 20 nt, Human
aggcaaaggguccagaagga

SEQ ID NO: 1767746 - RNA, 20 nt, Human
uggauuacuucucuauaaaa

SEQ ID NO: 1767747 - RNA, 20 nt, Human
uggauggaagguuggaugga

SEQ ID NO: 1767748 - RNA, 18 nt, Human
uggauggccguggaugcg

SEQ ID NO: 1767749 - RNA, 16 nt, Human
aggcagccccauucug

SEQ ID NO: 1767750 - RNA, 17 nt, Human
aggcagccccauucugc

SEQ ID NO: 1767751 - RNA, 20 nt, Human
aggccagagggagugacaga

SEQ ID NO: 1767752 - RNA, 17 nt, Human
uggcagccuuggcaaac

SEQ ID NO: 1767753 - RNA, 14 nt, Human
aggccagagggagu

SEQ ID NO: 1767754 - RNA, 19 nt, Human
uggcaaugccaucaucucc

SEQ ID NO: 1767755 - RNA, 17 nt, Human
uggccguggaugcgcag

SEQ ID NO: 1767756 - RNA, 14 nt, Human
uggccguggauggc

SEQ ID NO: 1767757 - RNA, 14 nt, Human
uggccucuuugucu

SEQ ID NO: 1767758 - RNA, 22 nt, Human
uggccucuuugucuaaaacaau

SEQ ID NO: 1767759 - RNA, 19 nt, Human
uggccugagagucagcucu

SEQ ID NO: 1767760 - RNA, 18 nt, Human
uggccuuccauuuauaug

SEQ ID NO: 1767761 - RNA, 18 nt, Human
uggccuguuucaacacag

SEQ ID NO: 1767762 - RNA, 21 nt, Human
uggccaaagccaaagcuaggc

SEQ ID NO: 1767763 - RNA, 23 nt, Human
uggccaaagccaaagcuaggccu

SEQ ID NO: 1767764 - RNA, 23 nt, Human
uggccagugugacaaggauugcu

SEQ ID NO: 1767765 - RNA, 12 nt, Human
aggccccugcca

SEQ ID NO: 1767766 - RNA, 16 nt, Human
uggcaugauccaagca

SEQ ID NO: 1767767 - RNA, 16 nt, Human
ugcuguauaaguuauu

SEQ ID NO: 1767768 - RNA, 18 nt, Human
ugcuucauucuuugcagg

SEQ ID NO: 1767769 - RNA, 18 nt, Human
aggacacuaaccacgcug

SEQ ID NO: 1767770 - RNA, 14 nt, Human
aggacacuuccgua

SEQ ID NO: 1767771 - RNA, 19 nt, Human
ugcugggauuacaagcgug

SEQ ID NO: 1767772 - RNA, 19 nt, Human
ugcuggcuguuggcugggg

SEQ ID NO: 1767773 - RNA, 21 nt, Human
ugcuggcuguuggcugggggc

SEQ ID NO: 1767774 - RNA, 21 nt, Human
ugcugggauuacaagcgugag

SEQ ID NO: 1767775 - RNA, 17 nt, Human
ugcugggauuacaggug

SEQ ID NO: 1767776 - RNA, 16 nt, Human
ugcuguauaaaaucag

SEQ ID NO: 1767777 - RNA, 15 nt, Human
ugcuguauaaaauca

SEQ ID NO: 1767778 - RNA, 14 nt, Human
ugcuguauaaaauc

SEQ ID NO: 1767779 - RNA, 13 nt, Human
ugcuguauaaaau

SEQ ID NO: 1767780 - RNA, 18 nt, Human
ugcuguauaaaaucagcc

SEQ ID NO: 1767781 - RNA, 17 nt, Human
ugcuguauaaaaucagc

SEQ ID NO: 1767782 - RNA, 22 nt, Human
aggaauggaggccauauuucca

SEQ ID NO: 1767783 - RNA, 13 nt, Human
ugcuggccaaaua

SEQ ID NO: 1767784 - RNA, 18 nt, Human
ugcuggccaaauagcaaa

SEQ ID NO: 1767785 - RNA, 19 nt, Human
ugcuggccaaauagcaaag

SEQ ID NO: 1767786 - RNA, 20 nt, Human
ugcuggccaaauagcaaaga

SEQ ID NO: 1767787 - RNA, 20 nt, Human
aggaauggacagacagagga

SEQ ID NO: 1767788 - RNA, 12 nt, Human
aggaauggacag

SEQ ID NO: 1767789 - RNA, 15 nt, Human
agcuuucaauuccgu

SEQ ID NO: 1767790 - RNA, 13 nt, Human
ugcuauugacaau

SEQ ID NO: 1767791 - RNA, 16 nt, Human
ugcuauugacaauaaa

SEQ ID NO: 1767792 - RNA, 17 nt, Human
ugcuauugacaauaaaa

SEQ ID NO: 1767793 - RNA, 18 nt, Human
ugcuauugacaauaaaau

SEQ ID NO: 1767794 - RNA, 20 nt, Human
ugcuauugacaauaaaauau

SEQ ID NO: 1767795 - RNA, 21 nt, Human
ugcuauugacaauaaaauauu

SEQ ID NO: 1767796 - RNA, 15 nt, Human
ugcucuggacaggca

SEQ ID NO: 1767797 - RNA, 16 nt, Human
ugcucuggacaggcau

SEQ ID NO: 1767798 - RNA, 14 nt, Human
ugcucuggacaggc

SEQ ID NO: 1767799 - RNA, 15 nt, Human
ugcucccucacaugu

SEQ ID NO: 1767800 - RNA, 18 nt, Human
aggaagccgccaguacuu

SEQ ID NO: 1767801 - RNA, 22 nt, Human
aggaagccgccaguacuuguca

SEQ ID NO: 1767802 - RNA, 21 nt, Human
agcugugcucuggacaggcau

SEQ ID NO: 1767803 - RNA, 23 nt, Human
agcugugcucuggacaggcaugu

SEQ ID NO: 1767804 - RNA, 20 nt, Human
agcugugcucuggacaggca

SEQ ID NO: 1767805 - RNA, 15 nt, Human
agcugggacuacagg

SEQ ID NO: 1767806 - RNA, 23 nt, Human
agcugucccaucuggucauuugg

SEQ ID NO: 1767807 - RNA, 22 nt, Human
agcuggcucuauaaggcagccu

SEQ ID NO: 1767808 - RNA, 21 nt, Human
ugccuguucagcuccagcuca

SEQ ID NO: 1767809 - RNA, 13 nt, Human
ugccuuagcuuca

SEQ ID NO: 1767810 - RNA, 14 nt, Human
ugccuuagcuucag

SEQ ID NO: 1767811 - RNA, 16 nt, Human
ugccuuagcuucagga

SEQ ID NO: 1767812 - RNA, 17 nt, Human
ugccuuagcuucaggaa

SEQ ID NO: 1767813 - RNA, 17 nt, Human
ugccuuaaaccuaccuc

SEQ ID NO: 1767814 - RNA, 18 nt, Human
ugccuuaaaccuaccucc

SEQ ID NO: 1767815 - RNA, 18 nt, Human
ugccuguucagcuccagc

SEQ ID NO: 1767816 - RNA, 20 nt, Human
ugccuguucagcuccagcuc

SEQ ID NO: 1767817 - RNA, 18 nt, Human
ugccugccccaaacaaau

SEQ ID NO: 1767818 - RNA, 20 nt, Human
ugccugccccaaacaaauau

SEQ ID NO: 1767819 - RNA, 14 nt, Human
ugccugcccaggcc

SEQ ID NO: 1767820 - RNA, 15 nt, Human
ugccugcccaggccc

SEQ ID NO: 1767821 - RNA, 16 nt, Human
ugccugcccaggcccc

SEQ ID NO: 1767822 - RNA, 12 nt, Human
ugcccaggcagg

SEQ ID NO: 1767823 - RNA, 13 nt, Human
ugcccaggcaggu

SEQ ID NO: 1767824 - RNA, 14 nt, Human
ugcccaggcagguc

SEQ ID NO: 1767825 - RNA, 13 nt, Human
ugccucugccucu

SEQ ID NO: 1767826 - RNA, 14 nt, Human
ugccucugccucug

SEQ ID NO: 1767827 - RNA, 15 nt, Human
ugccucugccucuga

SEQ ID NO: 1767828 - RNA, 14 nt, Human
agcuggaugagaau

SEQ ID NO: 1767829 - RNA, 20 nt, Human
agcuggaugauggucuucag

SEQ ID NO: 1767830 - RNA, 21 nt, Human
agcugcuuuugucuaugggac

SEQ ID NO: 1767831 - RNA, 21 nt, Human
agcugccuguucagcuccagc

SEQ ID NO: 1767832 - RNA, 22 nt, Human
agcugccuguucagcuccagcu

SEQ ID NO: 1767833 - RNA, 20 nt, Human
agcugccuguucagcuccag

SEQ ID NO: 1767834 - RNA, 14 nt, Human
agcuugaggguugg

SEQ ID NO: 1767835 - RNA, 18 nt, Human
agcuugaggguugggcug

SEQ ID NO: 1767836 - RNA, 22 nt, Human
agcuugaggguugggcuggugu

SEQ ID NO: 1767837 - RNA, 18 nt, Human
agcuuguaaauagcucag

SEQ ID NO: 1767838 - RNA, 20 nt, Human
agcuucuuccaggugcccag

SEQ ID NO: 1767839 - RNA, 22 nt, Human
agcuucuuccaggugcccagcu

SEQ ID NO: 1767840 - RNA, 13 nt, Human
agcuucuuguuuc

SEQ ID NO: 1767841 - RNA, 14 nt, Human
agcuucuuguuucc

SEQ ID NO: 1767842 - RNA, 16 nt, Human
agcuucuuguuuccuu

SEQ ID NO: 1767843 - RNA, 17 nt, Human
agcuucuuguuuccuug

SEQ ID NO: 1767844 - RNA, 18 nt, Human
agcuucuuguuuccuugu

SEQ ID NO: 1767845 - RNA, 19 nt, Human
agcuucuuguuuccuuguu

SEQ ID NO: 1767846 - RNA, 15 nt, Human
agcuuagacuaaggc

SEQ ID NO: 1767847 - RNA, 12 nt, Human
agcuucuuccag

SEQ ID NO: 1767848 - RNA, 22 nt, Human
agcuguugaagucucaggaguc

SEQ ID NO: 1767849 - RNA, 20 nt, Human
ugcuaagccccagcaagcaa

SEQ ID NO: 1767850 - RNA, 16 nt, Human
ugcggcguacaggcug

SEQ ID NO: 1767851 - RNA, 18 nt, Human
ugcggcguacaggcuggc

SEQ ID NO: 1767852 - RNA, 17 nt, Human
ugcgguccacccaggag

SEQ ID NO: 1767853 - RNA, 18 nt, Human
ugcgguccacccaggagc

SEQ ID NO: 1767854 - RNA, 23 nt, Human
ugcggacagccacggccaggcca

SEQ ID NO: 1767855 - RNA, 22 nt, Human
ugcggacagccacggccaggcc

SEQ ID NO: 1767856 - RNA, 16 nt, Human
ugccuuucgaggccug

SEQ ID NO: 1767857 - RNA, 17 nt, Human
ugccuuucgaggccuga

SEQ ID NO: 1767858 - RNA, 12 nt, Human
uggggagaaagu

SEQ ID NO: 1767859 - RNA, 19 nt, Human
uggggacuccggcugugcu

SEQ ID NO: 1767860 - RNA, 22 nt, Human
uggggacuccggcugugcuggg

SEQ ID NO: 1767861 - RNA, 23 nt, Human
uggggacuccggcugugcuggga

SEQ ID NO: 1767862 - RNA, 18 nt, Human
uggggcggugagagggga

SEQ ID NO: 1767863 - RNA, 15 nt, Human
ugggguacccacugc

SEQ ID NO: 1767864 - RNA, 16 nt, Human
ugggguacccacugcu

SEQ ID NO: 1767865 - RNA, 12 nt, Human
uggggguugcug

SEQ ID NO: 1767866 - RNA, 14 nt, Human
ugggguacccacug

SEQ ID NO: 1767867 - RNA, 12 nt, Human
uggggcuguguu

SEQ ID NO: 1767868 - RNA, 16 nt, Human
ugggcugggcccacaa

SEQ ID NO: 1767869 - RNA, 14 nt, Human
ugggcugggcccuc

SEQ ID NO: 1767870 - RNA, 20 nt, Human
ugggcugggcccucucuucu

SEQ ID NO: 1767871 - RNA, 21 nt, Human
ugggcugggcccucucuucuc

SEQ ID NO: 1767872 - RNA, 22 nt, Human
ugggcugggcccucucuucuca

SEQ ID NO: 1767873 - RNA, 11 nt, Human
uggggaagagu

SEQ ID NO: 1767874 - RNA, 11 nt, Human
uggggaaggag

SEQ ID NO: 1767875 - RNA, 15 nt, Human
uggggaaggagccag

SEQ ID NO: 1767876 - RNA, 16 nt, Human
uggggaaggagccagu

SEQ ID NO: 1767877 - RNA, 15 nt, Human
agggccugagccugg

SEQ ID NO: 1767878 - RNA, 18 nt, Human
agggccugagccuggcca

SEQ ID NO: 1767879 - RNA, 17 nt, Human
agggaggugaccccagg

SEQ ID NO: 1767880 - RNA, 17 nt, Human
agggagugacagaggca

SEQ ID NO: 1767881 - RNA, 18 nt, Human
agggagugacagaggcag

SEQ ID NO: 1767882 - RNA, 19 nt, Human
agggagugacagaggcagc

SEQ ID NO: 1767883 - RNA, 19 nt, Human
agggcagagugagacccag

SEQ ID NO: 1767884 - RNA, 18 nt, Human
ugggcccacaaaggcaaa

SEQ ID NO: 1767885 - RNA, 23 nt, Human
agggcccagagaggguggugacc

SEQ ID NO: 1767886 - RNA, 20 nt, Human
agggccgccagggagaccug

SEQ ID NO: 1767887 - RNA, 23 nt, Human
agggccgccagggagaccuggac

SEQ ID NO: 1767888 - RNA, 14 nt, Human
agggcagcagggcu

SEQ ID NO: 1767889 - RNA, 15 nt, Human
agggcagcagggcua

SEQ ID NO: 1767890 - RNA, 12 nt, Human
agggcagggccc

SEQ ID NO: 1767891 - RNA, 17 nt, Human
agggcagggccccaggc

SEQ ID NO: 1767892 - RNA, 15 nt, Human
ugggcacaugcucag

SEQ ID NO: 1767893 - RNA, 16 nt, Human
ugggcacaugcucagg

SEQ ID NO: 1767894 - RNA, 17 nt, Human
ugggcaacccccagccu

SEQ ID NO: 1767895 - RNA, 20 nt, Human
ugggcaacccccagccugcu

SEQ ID NO: 1767896 - RNA, 21 nt, Human
ugggcaacccccagccugcua

SEQ ID NO: 1767897 - RNA, 16 nt, Human
ugggcaacccccagcc

SEQ ID NO: 1767898 - RNA, 16 nt, Human
ugggauugagucugug

SEQ ID NO: 1767899 - RNA, 19 nt, Human
ugggauugagucugugcca

SEQ ID NO: 1767900 - RNA, 14 nt, Human
ugggaguacaaaag

SEQ ID NO: 1767901 - RNA, 21 nt, Human
agggucucacuauguugccca

SEQ ID NO: 1767902 - RNA, 22 nt, Human
agggucucacuauguugcccag

SEQ ID NO: 1767903 - RNA, 23 nt, Human
agggucucacuauguugcccagg

SEQ ID NO: 1767904 - RNA, 22 nt, Human
agggucucacucugucgcccag

SEQ ID NO: 1767905 - RNA, 17 nt, Human
uggucucaaacucuuga

SEQ ID NO: 1767906 - RNA, 23 nt, Human
uggucucaaacucuugaccucag

SEQ ID NO: 1767907 - RNA, 16 nt, Human
uggucucaaacucuug

SEQ ID NO: 1767908 - RNA, 13 nt, Human
uggucccacucag

SEQ ID NO: 1767909 - RNA, 20 nt, Human
ugguacuauaaaagcuuucu

SEQ ID NO: 1767910 - RNA, 15 nt, Human
uggucagcccuaggg

SEQ ID NO: 1767911 - RNA, 19 nt, Human
uggucagcccuagggugga

SEQ ID NO: 1767912 - RNA, 22 nt, Human
uggucagcccuaggguggagag

SEQ ID NO: 1767913 - RNA, 16 nt, Human
uggucugacccacugc

SEQ ID NO: 1767914 - RNA, 17 nt, Human
uggucugacccacugcu

SEQ ID NO: 1767915 - RNA, 15 nt, Human
uggucuucagccucu

SEQ ID NO: 1767916 - RNA, 14 nt, Human
uggucuuccuuuuu

SEQ ID NO: 1767917 - RNA, 17 nt, Human
uggucuuggcagcaccu

SEQ ID NO: 1767918 - RNA, 20 nt, Human
uggucuuggcagcaccuguc

SEQ ID NO: 1767919 - RNA, 15 nt, Human
aggguuaaggccuga

SEQ ID NO: 1767920 - RNA, 16 nt, Human
aggguuaaggccugaa

SEQ ID NO: 1767921 - RNA, 12 nt, Human
aggucagagccu

SEQ ID NO: 1767922 - RNA, 15 nt, Human
agguaggguuuaauc

SEQ ID NO: 1767923 - RNA, 12 nt, Human
agguaggguuua

SEQ ID NO: 1767924 - RNA, 18 nt, Human
aggguuggccccugcccg

SEQ ID NO: 1767925 - RNA, 23 nt, Human
aggguuggccccugcccggcugc

SEQ ID NO: 1767926 - RNA, 13 nt, Human
aggguugggcugg

SEQ ID NO: 1767927 - RNA, 16 nt, Human
uguacuuuuaaggcag

SEQ ID NO: 1767928 - RNA, 16 nt, Human
uguaccagugaauuuu

SEQ ID NO: 1767929 - RNA, 19 nt, Human
uguaccagugaauuuuugc

SEQ ID NO: 1767930 - RNA, 20 nt, Human
uguaccagugaauuuuugca

SEQ ID NO: 1767931 - RNA, 21 nt, Human
uguaccagugaauuuuugcaa

SEQ ID NO: 1767932 - RNA, 22 nt, Human
uguaccagugaauuuuugcaau

SEQ ID NO: 1767933 - RNA, 21 nt, Human
uguaccaugaaacaaagcugc

SEQ ID NO: 1767934 - RNA, 21 nt, Human
agguuuuguuuuuuuucagcc

SEQ ID NO: 1767935 - RNA, 12 nt, Human
aguaagccucau

SEQ ID NO: 1767936 - RNA, 17 nt, Human
aguaagccucaucauca

SEQ ID NO: 1767937 - RNA, 21 nt, Human
aguaagccucaucaucagagc

SEQ ID NO: 1767938 - RNA, 17 nt, Human
aguagaaaggccuuuaa

SEQ ID NO: 1767939 - RNA, 16 nt, Human
aguagaaaggccuuua

SEQ ID NO: 1767940 - RNA, 15 nt, Human
aguagaaaggccuuu

SEQ ID NO: 1767941 - RNA, 14 nt, Human
aguagaaaggccuu

SEQ ID NO: 1767942 - RNA, 14 nt, Human
aguaauuuguaaag

SEQ ID NO: 1767943 - RNA, 12 nt, Human
aguagagacagg

SEQ ID NO: 1767944 - RNA, 19 nt, Human
aguagaaauaauaugcauu

SEQ ID NO: 1767945 - RNA, 18 nt, Human
aguagaaaggccuuuaaa

SEQ ID NO: 1767946 - RNA, 18 nt, Human
aguagaaauaauaugcau

SEQ ID NO: 1767947 - RNA, 12 nt, Human
aggugggcccgg

SEQ ID NO: 1767948 - RNA, 14 nt, Human
aggugcagccagag

SEQ ID NO: 1767949 - RNA, 15 nt, Human
aggugcagccagagg

SEQ ID NO: 1767950 - RNA, 16 nt, Human
aggugcagccagaggc

SEQ ID NO: 1767951 - RNA, 17 nt, Human
aggugcagccagaggca

SEQ ID NO: 1767952 - RNA, 18 nt, Human
aggugcagccagaggcac

SEQ ID NO: 1767953 - RNA, 13 nt, Human
aggugcagccaga

SEQ ID NO: 1767954 - RNA, 23 nt, Human
aggucuugaacuccuggccucaa

SEQ ID NO: 1767955 - RNA, 12 nt, Human
uguaagaauaau

SEQ ID NO: 1767956 - RNA, 16 nt, Human
uguaagaauaauuuau

SEQ ID NO: 1767957 - RNA, 20 nt, Human
agguugagcaauuucccccu

SEQ ID NO: 1767958 - RNA, 14 nt, Human
agguugggauggga

SEQ ID NO: 1767959 - RNA, 12 nt, Human
agucaggaaagg

SEQ ID NO: 1767960 - RNA, 14 nt, Human
agucccugucaccu

SEQ ID NO: 1767961 - RNA, 16 nt, Human
agucccugucaccucu

SEQ ID NO: 1767962 - RNA, 17 nt, Human
agucccugucaccucuu

SEQ ID NO: 1767963 - RNA, 18 nt, Human
agucccugucaccucuuc

SEQ ID NO: 1767964 - RNA, 19 nt, Human
agucccugucaccucuucc

SEQ ID NO: 1767965 - RNA, 16 nt, Human
agucucacuguugccc

SEQ ID NO: 1767966 - RNA, 17 nt, Human
agucucacuguugccca

SEQ ID NO: 1767967 - RNA, 23 nt, Human
aguccgaaagggacuuggaagcu

SEQ ID NO: 1767968 - RNA, 18 nt, Human
agucgugagcucuuguga

SEQ ID NO: 1767969 - RNA, 21 nt, Human
agucgugagcucuugugagga

SEQ ID NO: 1767970 - RNA, 17 nt, Human
uguccggaaugccaccc

SEQ ID NO: 1767971 - RNA, 15 nt, Human
uguccaaaacugccu

SEQ ID NO: 1767972 - RNA, 12 nt, Human
uguccuuuccuu

SEQ ID NO: 1767973 - RNA, 16 nt, Human
uguccuacccacccuc

SEQ ID NO: 1767974 - RNA, 14 nt, Human
ugucgcccagucug

SEQ ID NO: 1767975 - RNA, 15 nt, Human
ugucgcccagucugg

SEQ ID NO: 1767976 - RNA, 13 nt, Human
ugucuaaaacaau

SEQ ID NO: 1767977 - RNA, 15 nt, Human
ugucuaaaacaauaa

SEQ ID NO: 1767978 - RNA, 17 nt, Human
ugucuaaaacaauaaaa

SEQ ID NO: 1767979 - RNA, 19 nt, Human
agucagaauuagcugcuuc

SEQ ID NO: 1767980 - RNA, 13 nt, Human
agucaccaagccc

SEQ ID NO: 1767981 - RNA, 14 nt, Human
agucaccaagccca

SEQ ID NO: 1767982 - RNA, 22 nt, Human
agucaccaaaagacacugcaga

SEQ ID NO: 1767983 - RNA, 20 nt, Human
aguauuucaaauuggagcuu

SEQ ID NO: 1767984 - RNA, 13 nt, Human
ugucagcugaggc

SEQ ID NO: 1767985 - RNA, 14 nt, Human
ugucagcugaggcu

SEQ ID NO: 1767986 - RNA, 19 nt, Human
ugucagcugaggcuggggg

SEQ ID NO: 1767987 - RNA, 24 nt, Human
ugucagcugaggcugggggagagc

SEQ ID NO: 1767988 - RNA, 16 nt, Human
ugucagguggggcagc

SEQ ID NO: 1767989 - RNA, 20 nt, Human
ugucaguaccuucaaacuag

SEQ ID NO: 1767990 - RNA, 13 nt, Human
aguaggagcccag

SEQ ID NO: 1767991 - RNA, 14 nt, Human
ugucaagaaagagc

SEQ ID NO: 1767992 - RNA, 19 nt, Human
ugucaagagggucugagga

SEQ ID NO: 1767993 - RNA, 16 nt, Human
ugugcucuggacaggc

SEQ ID NO: 1767994 - RNA, 18 nt, Human
ugugcucuggacaggcau

SEQ ID NO: 1767995 - RNA, 19 nt, Human
ugugcucuggacaggcaug

SEQ ID NO: 1767996 - RNA, 14 nt, Human
ugugcucugcuuca

SEQ ID NO: 1767997 - RNA, 21 nt, Human
agucucacuguugcccaggcu

SEQ ID NO: 1767998 - RNA, 20 nt, Human
agucucacuguugcccaggc

SEQ ID NO: 1767999 - RNA, 18 nt, Human
agucucacuguugcccag

SEQ ID NO: 1768000 - RNA, 19 nt, Human
agucucacuguugcccagg

SEQ ID NO: 1768001 - RNA, 12 nt, Human
ugugccucggcu

SEQ ID NO: 1768002 - RNA, 21 nt, Human
ugugccucggcuuuucucagc

SEQ ID NO: 1768003 - RNA, 22 nt, Human
ugugcucugaucauccacugug

SEQ ID NO: 1768004 - RNA, 23 nt, Human
ugugcucugaucauccacugugc

SEQ ID NO: 1768005 - RNA, 15 nt, Human
ugugcucuggacagg

SEQ ID NO: 1768006 - RNA, 16 nt, Human
agugcaguccugauca

SEQ ID NO: 1768007 - RNA, 22 nt, Human
agugcaguccugaucagagccg

SEQ ID NO: 1768008 - RNA, 16 nt, Human
agugccaacaauccua

SEQ ID NO: 1768009 - RNA, 21 nt, Human
agugccaacaauccuagugcu

SEQ ID NO: 1768010 - RNA, 14 nt, Human
agugcccacaggau

SEQ ID NO: 1768011 - RNA, 16 nt, Human
agugagucgaggacag

SEQ ID NO: 1768012 - RNA, 22 nt, Human
agugauucuccugccucagccu

SEQ ID NO: 1768013 - RNA, 24 nt, Human
agugauucuccugccucagccucc

SEQ ID NO: 1768014 - RNA, 22 nt, Human
agugcaaugguauaaauuucaa

SEQ ID NO: 1768015 - RNA, 20 nt, Human
agugauuuucaagucugugu

SEQ ID NO: 1768016 - RNA, 14 nt, Human
uguguuaugaagca

SEQ ID NO: 1768017 - RNA, 20 nt, Human
ugugucagguggggcagcuu

SEQ ID NO: 1768018 - RNA, 14 nt, Human
ugugucagcugagg

SEQ ID NO: 1768019 - RNA, 15 nt, Human
ugugucagcugaggc

SEQ ID NO: 1768020 - RNA, 17 nt, Human
ugugucagcugaggcug

SEQ ID NO: 1768021 - RNA, 17 nt, Human
ugugucagguggggcag

SEQ ID NO: 1768022 - RNA, 19 nt, Human
ugugucagguggggcagcu

SEQ ID NO: 1768023 - RNA, 19 nt, Human
agugcuuuccuuuuuuaaa

SEQ ID NO: 1768024 - RNA, 22 nt, Human
agugcuuuccuuuuuuaaaaau

SEQ ID NO: 1768025 - RNA, 19 nt, Human
uguuaaugauagcuacugu

SEQ ID NO: 1768026 - RNA, 22 nt, Human
uguguugggauugagucugugc

SEQ ID NO: 1768027 - RNA, 20 nt, Human
agugcugggauuacaagcgu

SEQ ID NO: 1768028 - RNA, 19 nt, Human
agugcugggauuacaggug

SEQ ID NO: 1768029 - RNA, 14 nt, Human
uguuguguuucugu

SEQ ID NO: 1768030 - RNA, 23 nt, Human
uguugggguggguauaaaagaug

SEQ ID NO: 1768031 - RNA, 22 nt, Human
uguugggguggguauaaaagau

SEQ ID NO: 1768032 - RNA, 16 nt, Human
aguucaauucucauuu

SEQ ID NO: 1768033 - RNA, 20 nt, Human
uguugggguggguauaaaag

SEQ ID NO: 1768034 - RNA, 18 nt, Human
uguugggguggguauaaa

SEQ ID NO: 1768035 - RNA, 17 nt, Human
uguugggguggguauaa

SEQ ID NO: 1768036 - RNA, 19 nt, Human
aguucggugagcuacaaau

SEQ ID NO: 1768037 - RNA, 20 nt, Human
aguucggugagcuacaaaug

SEQ ID NO: 1768038 - RNA, 15 nt, Human
aguguuagggaaggg

SEQ ID NO: 1768039 - RNA, 18 nt, Human
aguguuagggaagggccu

SEQ ID NO: 1768040 - RNA, 19 nt, Human
aguguuagggaagggccug

SEQ ID NO: 1768041 - RNA, 23 nt, Human
aguguuagggaagggccugccac

SEQ ID NO: 1768042 - RNA, 15 nt, Human
aguguuaaaugugau

SEQ ID NO: 1768043 - RNA, 15 nt, Human
aguguuaccugugug

SEQ ID NO: 1768044 - RNA, 17 nt, Human
aguguuaccugugugcu

SEQ ID NO: 1768045 - RNA, 13 nt, Human
uguucuugaauuu

SEQ ID NO: 1768046 - RNA, 23 nt, Human
uguucuugaauuuaauaaucugu

SEQ ID NO: 1768047 - RNA, 13 nt, Human
uguugcccaggcu

SEQ ID NO: 1768048 - RNA, 15 nt, Human
uguugcccaggcugg

SEQ ID NO: 1768049 - RNA, 17 nt, Human
aguuacuccagugccaa

SEQ ID NO: 1768050 - RNA, 13 nt, Human
aguuacuuuagau

SEQ ID NO: 1768051 - RNA, 14 nt, Human
aguuacuuuagaug

SEQ ID NO: 1768052 - RNA, 15 nt, Human
aguuacuuuagaugg

SEQ ID NO: 1768053 - RNA, 21 nt, Human
aguuacuuuagauggcaagca

SEQ ID NO: 1768054 - RNA, 12 nt, Human
aguuagacuguu

SEQ ID NO: 1768055 - RNA, 21 nt, Human
aguuacuccagugccaacaau

SEQ ID NO: 1768056 - RNA, 21 nt, Human
uguucccuauuuuucucuccu

SEQ ID NO: 1768057 - RNA, 22 nt, Human
uguucccuauuuuucucuccug

SEQ ID NO: 1768058 - RNA, 23 nt, Human
uguucccuauuuuucucuccugu

SEQ ID NO: 1768059 - RNA, 17 nt, Human
uguucuaagucuuucca

SEQ ID NO: 1768060 - RNA, 13 nt, Human
uguuauuucucag

SEQ ID NO: 1768061 - RNA, 17 nt, Human
uguuauuucucagacuu

SEQ ID NO: 1768062 - RNA, 14 nt, Human
uguuccccuuccac

SEQ ID NO: 1768063 - RNA, 17 nt, Human
uguuccccuuccacuga

SEQ ID NO: 1768064 - RNA, 23 nt, Human
uguuccccuuccacugagggcag

SEQ ID NO: 1768065 - RNA, 20 nt, Human
uguuccccuuccacugaggg

SEQ ID NO: 1768066 - RNA, 21 nt, Human
uguuccccuuccacugagggc

SEQ ID NO: 1768067 - RNA, 19 nt, Human
aguggaggugggcugggcc

SEQ ID NO: 1768068 - RNA, 23 nt, Human
aguggaggugggcugggcccucu

SEQ ID NO: 1768069 - RNA, 21 nt, Human
uguuauuagagauuaccuccu

SEQ ID NO: 1768070 - RNA, 23 nt, Human
uguuauuagagauuaccuccuga

SEQ ID NO: 1768071 - RNA, 19 nt, Human
uguuaucaccgugggcucc

SEQ ID NO: 1768072 - RNA, 15 nt, Human
auaaaaucagccaau

SEQ ID NO: 1768073 - RNA, 11 nt, Human
auaaaaucagc

SEQ ID NO: 1768074 - RNA, 16 nt, Human
auaaaauauuauugaa

SEQ ID NO: 1768075 - RNA, 18 nt, Human
auaaaauauuauugaacu

SEQ ID NO: 1768076 - RNA, 21 nt, Human
auaaaagauggggucuguaaa

SEQ ID NO: 1768077 - RNA, 19 nt, Human
auaaaagauggggucugua

SEQ ID NO: 1768078 - RNA, 22 nt, Human
auaaaagauggggucuguaaaa

SEQ ID NO: 1768079 - RNA, 19 nt, Human
aguuuuggaugcagugcuc

SEQ ID NO: 1768080 - RNA, 18 nt, Human
aguuuuggaugcagugcu

SEQ ID NO: 1768081 - RNA, 17 nt, Human
aguuuuggaugcagugc

SEQ ID NO: 1768082 - RNA, 15 nt, Human
aguuuuggaugcagu

SEQ ID NO: 1768083 - RNA, 18 nt, Human
aguuuucuuuccuccuuu

SEQ ID NO: 1768084 - RNA, 19 nt, Human
aguuuucuuuccuccuuuc

SEQ ID NO: 1768085 - RNA, 14 nt, Human
uuaaugaaaaggaa

SEQ ID NO: 1768086 - RNA, 16 nt, Human
uuaaugaaaaggaauc

SEQ ID NO: 1768087 - RNA, 19 nt, Human
uuaauauuuuuucuuuucc

SEQ ID NO: 1768088 - RNA, 18 nt, Human
uuaagaaauuuugccuuu

SEQ ID NO: 1768089 - RNA, 23 nt, Human
uuaagaaauuuugccuuuaaguu

SEQ ID NO: 1768090 - RNA, 19 nt, Human
uuaagucccugucaccucu

SEQ ID NO: 1768091 - RNA, 20 nt, Human
uuaagucccugucaccucuu

SEQ ID NO: 1768092 - RNA, 17 nt, Human
aguuggguggaugccug

SEQ ID NO: 1768093 - RNA, 19 nt, Human
aguugggcuuccucauagu

SEQ ID NO: 1768094 - RNA, 21 nt, Human
aguuggcagaaauacagucuu

SEQ ID NO: 1768095 - RNA, 13 nt, Human
aguugggcuuccu

SEQ ID NO: 1768096 - RNA, 12 nt, Human
uuaaaaaaaaga

SEQ ID NO: 1768097 - RNA, 13 nt, Human
uuaaaaaaaagaa

SEQ ID NO: 1768098 - RNA, 12 nt, Human
uuaaaaaucaac

SEQ ID NO: 1768099 - RNA, 15 nt, Human
uuaaaaaucaacuuu

SEQ ID NO: 1768100 - RNA, 23 nt, Human
uuaaaaaucaacuuuuuauugcc

SEQ ID NO: 1768101 - RNA, 14 nt, Human
aguuuaaauuguaa

SEQ ID NO: 1768102 - RNA, 12 nt, Human
aguuuaaagcaa

SEQ ID NO: 1768103 - RNA, 16 nt, Human
aguuuaaaaaucaacu

SEQ ID NO: 1768104 - RNA, 17 nt, Human
aguuuaaaaaucaacuu

SEQ ID NO: 1768105 - RNA, 18 nt, Human
aguuuaaaaaucaacuuu

SEQ ID NO: 1768106 - RNA, 19 nt, Human
aguuuaaaaaucaacuuuu

SEQ ID NO: 1768107 - RNA, 20 nt, Human
aguuuaaaaaucaacuuuuu

SEQ ID NO: 1768108 - RNA, 15 nt, Human
uuaaauaauuuccua

SEQ ID NO: 1768109 - RNA, 13 nt, Human
uuaaauacagucu

SEQ ID NO: 1768110 - RNA, 19 nt, Human
uuaaauagaguauaugcac

SEQ ID NO: 1768111 - RNA, 18 nt, Human
uuaaaauuuuuuuagaaa

SEQ ID NO: 1768112 - RNA, 14 nt, Human
auaaauaaaaauaa

SEQ ID NO: 1768113 - RNA, 13 nt, Human
auaaaguagaaau

SEQ ID NO: 1768114 - RNA, 14 nt, Human
auaaaguagaaaug

SEQ ID NO: 1768115 - RNA, 13 nt, Human
auaaauaaaaaua

SEQ ID NO: 1768116 - RNA, 21 nt, Human
auaacggaucagaaauacaga

SEQ ID NO: 1768117 - RNA, 20 nt, Human
auaacggaucagaaauacag

SEQ ID NO: 1768118 - RNA, 22 nt, Human
auaacgauaaaagacagugaaa

SEQ ID NO: 1768119 - RNA, 15 nt, Human
auaaaucagucaagc

SEQ ID NO: 1768120 - RNA, 14 nt, Human
auaaauucacuuuc

SEQ ID NO: 1768121 - RNA, 15 nt, Human
auaaauucacuuuca

SEQ ID NO: 1768122 - RNA, 23 nt, Human
auaaauucacuuucauuuuugau

SEQ ID NO: 1768123 - RNA, 13 nt, Human
uuacucuuuccua

SEQ ID NO: 1768124 - RNA, 16 nt, Human
uuagaaagcauuugaa

SEQ ID NO: 1768125 - RNA, 15 nt, Human
uuagaaagcauuuga

SEQ ID NO: 1768126 - RNA, 14 nt, Human
uuagaaagcauuug

SEQ ID NO: 1768127 - RNA, 13 nt, Human
uuagaaagcauuu

SEQ ID NO: 1768128 - RNA, 12 nt, Human
uuagaaagcauu

SEQ ID NO: 1768129 - RNA, 23 nt, Human
uuagaaagcauuugaaugcauuu

SEQ ID NO: 1768130 - RNA, 21 nt, Human
uuagaaagcauuugaaugcau

SEQ ID NO: 1768131 - RNA, 19 nt, Human
uuagaaagcauuugaaugc

SEQ ID NO: 1768132 - RNA, 18 nt, Human
uuagaaagcauuugaaug

SEQ ID NO: 1768133 - RNA, 17 nt, Human
uuagaaagcauuugaau

SEQ ID NO: 1768134 - RNA, 13 nt, Human
uuagacagagucu

SEQ ID NO: 1768135 - RNA, 17 nt, Human
uuagaaauuuauuuccu

SEQ ID NO: 1768136 - RNA, 20 nt, Human
uuagacagagucucacuguu

SEQ ID NO: 1768137 - RNA, 13 nt, Human
uuacccucuuugc

SEQ ID NO: 1768138 - RNA, 15 nt, Human
uuacccucuuugcug

SEQ ID NO: 1768139 - RNA, 17 nt, Human
uuacccucuuugcugca

SEQ ID NO: 1768140 - RNA, 11 nt, Human
uuaccuccuga

SEQ ID NO: 1768141 - RNA, 19 nt, Human
uuaccuccugagaaaaaag

SEQ ID NO: 1768142 - RNA, 18 nt, Human
uuacccacucggucccag

SEQ ID NO: 1768143 - RNA, 16 nt, Human
uuacccaggugggucc

SEQ ID NO: 1768144 - RNA, 13 nt, Human
uuagacagccaaa

SEQ ID NO: 1768145 - RNA, 21 nt, Human
auaagacaaugacauacgcuu

SEQ ID NO: 1768146 - RNA, 11 nt, Human
auaaugcagua

SEQ ID NO: 1768147 - RNA, 13 nt, Human
auaaugcaguaug

SEQ ID NO: 1768148 - RNA, 14 nt, Human
auaaugcaguaugg

SEQ ID NO: 1768149 - RNA, 15 nt, Human
auaaugcaguauggu

SEQ ID NO: 1768150 - RNA, 18 nt, Human
auaaugcaguaugguaca

SEQ ID NO: 1768151 - RNA, 19 nt, Human
auaaugcaguaugguacau

SEQ ID NO: 1768152 - RNA, 18 nt, Human
auaauccuaaacauauga

SEQ ID NO: 1768153 - RNA, 17 nt, Human
uuaguaaaaaaucaauu

SEQ ID NO: 1768154 - RNA, 22 nt, Human
uuaguaaaaaaucaauuaacca

SEQ ID NO: 1768155 - RNA, 12 nt, Human
uuaguaacaugu

SEQ ID NO: 1768156 - RNA, 23 nt, Human
uuaguaacauguguuaaguauuu

SEQ ID NO: 1768157 - RNA, 14 nt, Human
uuagggaagggccu

SEQ ID NO: 1768158 - RNA, 14 nt, Human
uuagcggagacgga

SEQ ID NO: 1768159 - RNA, 15 nt, Human
uuuuaagcaaaauau

SEQ ID NO: 1768160 - RNA, 16 nt, Human
uuuuaagaggcagggu

SEQ ID NO: 1768161 - RNA, 20 nt, Human
uuuuaagaaauuuugccuuu

SEQ ID NO: 1768162 - RNA, 15 nt, Human
uuuuaagaggcaggg

SEQ ID NO: 1768163 - RNA, 14 nt, Human
uuuuaacucugucu

SEQ ID NO: 1768164 - RNA, 18 nt, Human
uuuguuugguauuguauu

SEQ ID NO: 1768165 - RNA, 16 nt, Human
uuuguuugguauugua

SEQ ID NO: 1768166 - RNA, 15 nt, Human
uuuguuugguauugu

SEQ ID NO: 1768167 - RNA, 13 nt, Human
uuuuaaaacccag

SEQ ID NO: 1768168 - RNA, 14 nt, Human
uuuuaaaaaugcaa

SEQ ID NO: 1768169 - RNA, 12 nt, Human
uuuguaccagug

SEQ ID NO: 1768170 - RNA, 17 nt, Human
uuuguaccagugaauuu

SEQ ID NO: 1768171 - RNA, 19 nt, Human
uuuguaccagugaauuuuu

SEQ ID NO: 1768172 - RNA, 22 nt, Human
uuuguaccagugaauuuuugca

SEQ ID NO: 1768173 - RNA, 23 nt, Human
uuuguaccagugaauuuuugcaa

SEQ ID NO: 1768174 - RNA, 13 nt, Human
uuuguagagccag

SEQ ID NO: 1768175 - RNA, 11 nt, Human
uuuguacaugu

SEQ ID NO: 1768176 - RNA, 12 nt, Human
augucuuaauga

SEQ ID NO: 1768177 - RNA, 19 nt, Human
augucuuaaugaaguuuga

SEQ ID NO: 1768178 - RNA, 18 nt, Human
augucuuaaugaaguuug

SEQ ID NO: 1768179 - RNA, 16 nt, Human
augucuuaaugaaguu

SEQ ID NO: 1768180 - RNA, 13 nt, Human
augucuuaaugaa

SEQ ID NO: 1768181 - RNA, 15 nt, Human
augucugccauguug

SEQ ID NO: 1768182 - RNA, 19 nt, Human
augucugcagugugccccc

SEQ ID NO: 1768183 - RNA, 20 nt, Human
augucugcagugugcccccc

SEQ ID NO: 1768184 - RNA, 14 nt, Human
uuugucuaaaacaa

SEQ ID NO: 1768185 - RNA, 16 nt, Human
uuugucuaaaacaaua

SEQ ID NO: 1768186 - RNA, 19 nt, Human
uuugucuaaaacaauaaaa

SEQ ID NO: 1768187 - RNA, 17 nt, Human
augucaguaccuucaaa

SEQ ID NO: 1768188 - RNA, 14 nt, Human
auguccccucccag

SEQ ID NO: 1768189 - RNA, 17 nt, Human
auguaucauaauuacca

SEQ ID NO: 1768190 - RNA, 21 nt, Human
auguaucauaauuaccaagug

SEQ ID NO: 1768191 - RNA, 21 nt, Human
auguagucagaauuagcugcu

SEQ ID NO: 1768192 - RNA, 22 nt, Human
uuugccauguuggccaggcugg

SEQ ID NO: 1768193 - RNA, 21 nt, Human
uuugcccaaaauuuauuuuau

SEQ ID NO: 1768194 - RNA, 13 nt, Human
uuugcaauaaugc

SEQ ID NO: 1768195 - RNA, 14 nt, Human
uuugcaauaaugca

SEQ ID NO: 1768196 - RNA, 15 nt, Human
uuugcaauaaugcag

SEQ ID NO: 1768197 - RNA, 16 nt, Human
uuugcaauaaugcagu

SEQ ID NO: 1768198 - RNA, 17 nt, Human
uuugcaauaaugcagua

SEQ ID NO: 1768199 - RNA, 22 nt, Human
uuugcaauaaugcaguauggua

SEQ ID NO: 1768200 - RNA, 12 nt, Human
uuugcccuuuga

SEQ ID NO: 1768201 - RNA, 20 nt, Human
uuuggggauuuucaaaagau

SEQ ID NO: 1768202 - RNA, 17 nt, Human
uuugggaauauuugaau

SEQ ID NO: 1768203 - RNA, 16 nt, Human
uuugggaauauuugaa

SEQ ID NO: 1768204 - RNA, 23 nt, Human
uuugcugucccauagucccugcc

SEQ ID NO: 1768205 - RNA, 23 nt, Human
auuaaaagaugucucugcaaacc

SEQ ID NO: 1768206 - RNA, 19 nt, Human
auguuuuuguucaaagcca

SEQ ID NO: 1768207 - RNA, 21 nt, Human
auguuguguuucuguucaccu

SEQ ID NO: 1768208 - RNA, 12 nt, Human
uuuucucagcug

SEQ ID NO: 1768209 - RNA, 13 nt, Human
auuaaccucucac

SEQ ID NO: 1768210 - RNA, 16 nt, Human
uuuuccauauccuggu

SEQ ID NO: 1768211 - RNA, 19 nt, Human
uuuucauguuuuaacaaaa

SEQ ID NO: 1768212 - RNA, 20 nt, Human
uuuucauguuuuaacaaaaa

SEQ ID NO: 1768213 - RNA, 16 nt, Human
uuuucauguuuuaaca

SEQ ID NO: 1768214 - RNA, 13 nt, Human
uuuuauaagaaaa

SEQ ID NO: 1768215 - RNA, 14 nt, Human
uuuuauaagaaaaa

SEQ ID NO: 1768216 - RNA, 16 nt, Human
uuuuauaagaaaaacu

SEQ ID NO: 1768217 - RNA, 17 nt, Human
uuuuauaagaaaaacuu

SEQ ID NO: 1768218 - RNA, 14 nt, Human
auguuggccaggcu

SEQ ID NO: 1768219 - RNA, 21 nt, Human
auguugcacacccacucagcu

SEQ ID NO: 1768220 - RNA, 22 nt, Human
auguugcacacccacucagcuc

SEQ ID NO: 1768221 - RNA, 16 nt, Human
auguuggccaggcugg

SEQ ID NO: 1768222 - RNA, 13 nt, Human
auguugaggugga

SEQ ID NO: 1768223 - RNA, 21 nt, Human
uuuuagcaauuuauacaauau

SEQ ID NO: 1768224 - RNA, 14 nt, Human
auguuauagaacuu

SEQ ID NO: 1768225 - RNA, 15 nt, Human
auguuauagaacuuc

SEQ ID NO: 1768226 - RNA, 20 nt, Human
auuccccagauugcaacagg

SEQ ID NO: 1768227 - RNA, 14 nt, Human
auuccgcaucccua

SEQ ID NO: 1768228 - RNA, 16 nt, Human
auuccguagccagcug

SEQ ID NO: 1768229 - RNA, 23 nt, Human
auuccguagccagcugcucccca

SEQ ID NO: 1768230 - RNA, 14 nt, Human
auuauuuuccaaaa

SEQ ID NO: 1768231 - RNA, 13 nt, Human
auuauuuuccaaa

SEQ ID NO: 1768232 - RNA, 15 nt, Human
auuauugaaauauua

SEQ ID NO: 1768233 - RNA, 17 nt, Human
auuauauuuacaaaugg

SEQ ID NO: 1768234 - RNA, 17 nt, Human
auuauccagguaaucca

SEQ ID NO: 1768235 - RNA, 21 nt, Human
auuauccuuuccucauuaaau

SEQ ID NO: 1768236 - RNA, 16 nt, Human
auuauauuuacaaaug

SEQ ID NO: 1768237 - RNA, 19 nt, Human
auuauaggaauaucaauau

SEQ ID NO: 1768238 - RNA, 21 nt, Human
auuauaggaauaucaauauaa

SEQ ID NO: 1768239 - RNA, 20 nt, Human
auuagagauuaccuccugag

SEQ ID NO: 1768240 - RNA, 12 nt, Human
auuaccuccuga

SEQ ID NO: 1768241 - RNA, 13 nt, Human
auuaccuccugag

SEQ ID NO: 1768242 - RNA, 17 nt, Human
auuaccuccugagaaaa

SEQ ID NO: 1768243 - RNA, 16 nt, Human
auuaaugacacuuguc

SEQ ID NO: 1768244 - RNA, 20 nt, Human
auuaaugacacuugucccca

SEQ ID NO: 1768245 - RNA, 14 nt, Human
uuuuuguuggagug

SEQ ID NO: 1768246 - RNA, 19 nt, Human
uuuuuguuggaguguuucu

SEQ ID NO: 1768247 - RNA, 16 nt, Human
auuaauaguaauuugu

SEQ ID NO: 1768248 - RNA, 18 nt, Human
auuaauaguaauuuguaa

SEQ ID NO: 1768249 - RNA, 20 nt, Human
auuaauaguaauuuguaaag

SEQ ID NO: 1768250 - RNA, 21 nt, Human
auuaauaguaauuuguaaagu

SEQ ID NO: 1768251 - RNA, 14 nt, Human
auuuuacaguuaag

SEQ ID NO: 1768252 - RNA, 22 nt, Human
auuuuacaguuaaggaauauaa

SEQ ID NO: 1768253 - RNA, 21 nt, Human
auuuuacuuuaaaaggagcca

SEQ ID NO: 1768254 - RNA, 14 nt, Human
auuuccugugucuu

SEQ ID NO: 1768255 - RNA, 12 nt, Human
auuuauuaaaua

SEQ ID NO: 1768256 - RNA, 13 nt, Human
auuuagcccucac

SEQ ID NO: 1768257 - RNA, 16 nt, Human
auuuagcccucacauu

SEQ ID NO: 1768258 - RNA, 21 nt, Human
auuugggcuuggaccagaucu

SEQ ID NO: 1768259 - RNA, 13 nt, Human
auuuguaaaguug

SEQ ID NO: 1768260 - RNA, 22 nt, Human
auuuguaaaguugguuggauaa

SEQ ID NO: 1768261 - RNA, 14 nt, Human
auuugaaugcauuu

SEQ ID NO: 1768262 - RNA, 12 nt, Human
auuugaaugcau

SEQ ID NO: 1768263 - RNA, 18 nt, Human
auuugaaugcauuuuguu

SEQ ID NO: 1768264 - RNA, 16 nt, Human
auuugaaugcauuuug

SEQ ID NO: 1768265 - RNA, 15 nt, Human
auuugaaugcauuuu

SEQ ID NO: 1768266 - RNA, 17 nt, Human
auuugagcagggcucag

SEQ ID NO: 1768267 - RNA, 14 nt, Human
auuugagugcucug

SEQ ID NO: 1768268 - RNA, 16 nt, Human
auuugagugcucugau

SEQ ID NO: 1768269 - RNA, 13 nt, Human
auuugagucucuu

SEQ ID NO: 1768270 - RNA, 21 nt, Human
auuugagucucuuaauagcca

SEQ ID NO: 1768271 - RNA, 21 nt, Human
auuggcuuuauccucuuuaga

SEQ ID NO: 1768272 - RNA, 17 nt, Human
auuggcuuuauccucuu

SEQ ID NO: 1768273 - RNA, 14 nt, Human
auuggcuuuauccu

SEQ ID NO: 1768274 - RNA, 14 nt, Human
auugcuaauguugc

SEQ ID NO: 1768275 - RNA, 15 nt, Human
auugcuaauguugcu

SEQ ID NO: 1768276 - RNA, 16 nt, Human
auugcuaauguugcug

SEQ ID NO: 1768277 - RNA, 18 nt, Human
auugcuaauguugcugga

SEQ ID NO: 1768278 - RNA, 14 nt, Human
auuguauauucacu

SEQ ID NO: 1768279 - RNA, 13 nt, Human
auuguauauucac

SEQ ID NO: 1768280 - RNA, 15 nt, Human
auuguauauucacuu

SEQ ID NO: 1768281 - RNA, 15 nt, Human
auuguaucgauguua

SEQ ID NO: 1768282 - RNA, 15 nt, Human
auuguauuacaaauc

SEQ ID NO: 1768283 - RNA, 14 nt, Human
auuguauuacaaau

SEQ ID NO: 1768284 - RNA, 17 nt, Human
auugugaaccaaugcaa

SEQ ID NO: 1768285 - RNA, 15 nt, Human
auugugcuucuuucu

SEQ ID NO: 1768286 - RNA, 14 nt, Human
auuguggaauguug

SEQ ID NO: 1768287 - RNA, 15 nt, Human
auuguggaauguugg

SEQ ID NO: 1768288 - RNA, 17 nt, Human
auuguggaauguuggau

SEQ ID NO: 1768289 - RNA, 20 nt, Human
auuguggaauguuggauaag

SEQ ID NO: 1768290 - RNA, 22 nt, Human
auuguuucaauugcaucuccca

SEQ ID NO: 1768291 - RNA, 13 nt, Human
auuguuucaauug

SEQ ID NO: 1768292 - RNA, 19 nt, Human
auuuaauuuuuuugagaca

SEQ ID NO: 1768293 - RNA, 23 nt, Human
auuuaauuuuuuugagacagagu

SEQ ID NO: 1768294 - RNA, 16 nt, Human
auuuacaaaugggaaa

SEQ ID NO: 1768295 - RNA, 19 nt, Human
auuuacccaacucuguaca

SEQ ID NO: 1768296 - RNA, 19 nt, Human
auuuaaacaauaaaugugc

SEQ ID NO: 1768297 - RNA, 14 nt, Human
auugcuacuguccu

SEQ ID NO: 1768298 - RNA, 20 nt, Human
auucuagaugcaagucucuu

SEQ ID NO: 1768299 - RNA, 16 nt, Human
auugcggacagccacg

SEQ ID NO: 1768300 - RNA, 18 nt, Human
auugcggacagccacggc

SEQ ID NO: 1768301 - RNA, 19 nt, Human
auugcggacagccacggcc

SEQ ID NO: 1768302 - RNA, 17 nt, Human
auugcccacgcuggagu

SEQ ID NO: 1768303 - RNA, 21 nt, Human
auugcccacgcuggagugcag

SEQ ID NO: 1768304 - RNA, 22 nt, Human
auugccauauugcacaugucuu

SEQ ID NO: 1768305 - RNA, 19 nt, Human
auugccauauugcacaugu

SEQ ID NO: 1768306 - RNA, 18 nt, Human
auugccauauugcacaug

SEQ ID NO: 1768307 - RNA, 17 nt, Human
auugccauauugcacau

SEQ ID NO: 1768308 - RNA, 16 nt, Human
auugccauauugcaca

SEQ ID NO: 1768309 - RNA, 15 nt, Human
auugccauauugcac

SEQ ID NO: 1768310 - RNA, 12 nt, Human
auugccauauug

SEQ ID NO: 1768311 - RNA, 14 nt, Human
auugccaagggcuu

SEQ ID NO: 1768312 - RNA, 16 nt, Human
auugcaacaggcuggg

SEQ ID NO: 1768313 - RNA, 21 nt, Human
auugcaacaggcugggcuuca

SEQ ID NO: 1768314 - RNA, 20 nt, Human
auugcacaugucuuaaugaa

SEQ ID NO: 1768315 - RNA, 18 nt, Human
auugcacaugucuuaaug

SEQ ID NO: 1768316 - RNA, 16 nt, Human
auugcacaugucuuaa

SEQ ID NO: 1768317 - RNA, 21 nt, Human
auugcacaugucuuaaugaag

SEQ ID NO: 1768318 - RNA, 15 nt, Human
auugcaacaggcugg

SEQ ID NO: 1768319 - RNA, 13 nt, Human
auauaugugugcc

SEQ ID NO: 1768320 - RNA, 17 nt, Human
auauguaacaagccacc

SEQ ID NO: 1768321 - RNA, 16 nt, Human
auauguaacaagccac

SEQ ID NO: 1768322 - RNA, 20 nt, Human
auaugauagcgggaaaagga

SEQ ID NO: 1768323 - RNA, 22 nt, Human
auaugauagcgggaaaaggaga

SEQ ID NO: 1768324 - RNA, 19 nt, Human
auaugugccaaucaauagc

SEQ ID NO: 1768325 - RNA, 9 nt, Human
uucauucag

SEQ ID NO: 1768326 - RNA, 18 nt, Human
uuccagcuggaugagaau

SEQ ID NO: 1768327 - RNA, 23 nt, Human
uuccaagcuuccauagcugcugc

SEQ ID NO: 1768328 - RNA, 18 nt, Human
uucccaagcucugcuccu

SEQ ID NO: 1768329 - RNA, 18 nt, Human
uucccacaggacauuucu

SEQ ID NO: 1768330 - RNA, 14 nt, Human
uucccaauucacau

SEQ ID NO: 1768331 - RNA, 13 nt, Human
uucccaagcucug

SEQ ID NO: 1768332 - RNA, 14 nt, Human
uucccaagcucugc

SEQ ID NO: 1768333 - RNA, 15 nt, Human
uucccaagcucugcu

SEQ ID NO: 1768334 - RNA, 16 nt, Human
uucccaagcucugcuc

SEQ ID NO: 1768335 - RNA, 21 nt, Human
uuccagguacccuucucgcuu

SEQ ID NO: 1768336 - RNA, 16 nt, Human
uuccauagcugcugcc

SEQ ID NO: 1768337 - RNA, 17 nt, Human
uuccauagcugcugccc

SEQ ID NO: 1768338 - RNA, 14 nt, Human
auaguuaauauagu

SEQ ID NO: 1768339 - RNA, 20 nt, Human
auaguuacuccagugccaac

SEQ ID NO: 1768340 - RNA, 22 nt, Human
auaguuggcuaggaccccucca

SEQ ID NO: 1768341 - RNA, 20 nt, Human
auagugauguaaucuugaau

SEQ ID NO: 1768342 - RNA, 21 nt, Human
auaggcgaucacaacgugcau

SEQ ID NO: 1768343 - RNA, 17 nt, Human
auaguggcuuaaaacaa

SEQ ID NO: 1768344 - RNA, 22 nt, Human
uucacuuaugaaugauuugcau

SEQ ID NO: 1768345 - RNA, 17 nt, Human
auaggcguaacuaauuu

SEQ ID NO: 1768346 - RNA, 21 nt, Human
auaggaaaguauuuuuuuaag

SEQ ID NO: 1768347 - RNA, 20 nt, Human
uucacaucuaaccucaucuu

SEQ ID NO: 1768348 - RNA, 18 nt, Human
uucacaucuaaccucauc

SEQ ID NO: 1768349 - RNA, 19 nt, Human
uucacaucuaaccucaucu

SEQ ID NO: 1768350 - RNA, 14 nt, Human
uucacacagauaga

SEQ ID NO: 1768351 - RNA, 15 nt, Human
uucaaaagauaauau

SEQ ID NO: 1768352 - RNA, 21 nt, Human
uucaagcgauucuucugcuuc

SEQ ID NO: 1768353 - RNA, 14 nt, Human
uucaagccauucca

SEQ ID NO: 1768354 - RNA, 18 nt, Human
uuauuuuuagacagaguc

SEQ ID NO: 1768355 - RNA, 17 nt, Human
uuauuuuuagacagagu

SEQ ID NO: 1768356 - RNA, 17 nt, Human
uucaaaaccuuuugaaa

SEQ ID NO: 1768357 - RNA, 14 nt, Human
uuauuuuuguacau

SEQ ID NO: 1768358 - RNA, 16 nt, Human
uuauuuuuguacaugu

SEQ ID NO: 1768359 - RNA, 17 nt, Human
uuauuuuuguacauguu

SEQ ID NO: 1768360 - RNA, 14 nt, Human
uuauuuuuuacauu

SEQ ID NO: 1768361 - RNA, 18 nt, Human
uuauuuuuuacauuauua

SEQ ID NO: 1768362 - RNA, 15 nt, Human
uucuguagaaauggu

SEQ ID NO: 1768363 - RNA, 14 nt, Human
uucuguagaaaugg

SEQ ID NO: 1768364 - RNA, 13 nt, Human
uucuguagaaaug

SEQ ID NO: 1768365 - RNA, 22 nt, Human
uucuguagaaaugguuguauua

SEQ ID NO: 1768366 - RNA, 21 nt, Human
uucuguagaaaugguuguauu

SEQ ID NO: 1768367 - RNA, 20 nt, Human
uucuguagaaaugguuguau

SEQ ID NO: 1768368 - RNA, 18 nt, Human
uucuguagaaaugguugu

SEQ ID NO: 1768369 - RNA, 13 nt, Human
aucauuuaauaau

SEQ ID NO: 1768370 - RNA, 12 nt, Human
aucauuuaauaa

SEQ ID NO: 1768371 - RNA, 19 nt, Human
uucucuaagagaacaaugu

SEQ ID NO: 1768372 - RNA, 15 nt, Human
aucauuucuauuucu

SEQ ID NO: 1768373 - RNA, 22 nt, Human
aucauuuauuuuuuacauuauu

SEQ ID NO: 1768374 - RNA, 21 nt, Human
aucauuuaauaauauacuugu

SEQ ID NO: 1768375 - RNA, 19 nt, Human
aucauuuauuuuuuacauu

SEQ ID NO: 1768376 - RNA, 19 nt, Human
aucauuuaauaauauacuu

SEQ ID NO: 1768377 - RNA, 18 nt, Human
aucauuuaauaauauacu

SEQ ID NO: 1768378 - RNA, 17 nt, Human
aucauuuaauaauauac

SEQ ID NO: 1768379 - RNA, 14 nt, Human
aucauuuaauaaua

SEQ ID NO: 1768380 - RNA, 16 nt, Human
uucucuuuucaaaaca

SEQ ID NO: 1768381 - RNA, 22 nt, Human
uucugaauuugcaaaguacugu

SEQ ID NO: 1768382 - RNA, 20 nt, Human
uucucuuuuccccuuuccug

SEQ ID NO: 1768383 - RNA, 21 nt, Human
uucucuuuuccccuuuccugu

SEQ ID NO: 1768384 - RNA, 22 nt, Human
uucucuuuuccccuuuccuguc

SEQ ID NO: 1768385 - RNA, 24 nt, Human
uucucuaagagaacaaugugcuau

SEQ ID NO: 1768386 - RNA, 20 nt, Human
auccuagguaggguuuaauc

SEQ ID NO: 1768387 - RNA, 21 nt, Human
uucuguuggccagugugacaa

SEQ ID NO: 1768388 - RNA, 15 nt, Human
uucuuucuuagaaau

SEQ ID NO: 1768389 - RNA, 14 nt, Human
uucuuucuuagaaa

SEQ ID NO: 1768390 - RNA, 13 nt, Human
uucuuucuuagaa

SEQ ID NO: 1768391 - RNA, 16 nt, Human
uucuuucuuugggaau

SEQ ID NO: 1768392 - RNA, 20 nt, Human
uucuuucuuagaaauuuauu

SEQ ID NO: 1768393 - RNA, 21 nt, Human
uucuugaauuuaauaaucugu

SEQ ID NO: 1768394 - RNA, 14 nt, Human
uucuucgaaaaucu

SEQ ID NO: 1768395 - RNA, 17 nt, Human
uucuucgaaaaucuaga

SEQ ID NO: 1768396 - RNA, 13 nt, Human
uucgcuccugugu

SEQ ID NO: 1768397 - RNA, 13 nt, Human
uucgccuuuccuc

SEQ ID NO: 1768398 - RNA, 16 nt, Human
uucgccuuuccucucu

SEQ ID NO: 1768399 - RNA, 14 nt, Human
uucuaaccuggagg

SEQ ID NO: 1768400 - RNA, 13 nt, Human
uucuaaggaagac

SEQ ID NO: 1768401 - RNA, 20 nt, Human
uucgcagagcuuuucagauu

SEQ ID NO: 1768402 - RNA, 11 nt, Human
uucgaggccug

SEQ ID NO: 1768403 - RNA, 12 nt, Human
uucgaggccuga

SEQ ID NO: 1768404 - RNA, 13 nt, Human
uucgaggccugaa

SEQ ID NO: 1768405 - RNA, 15 nt, Human
uucgaggccugaagc

SEQ ID NO: 1768406 - RNA, 20 nt, Human
uucgaggccugaagccagcu

SEQ ID NO: 1768407 - RNA, 13 nt, Human
aucagaauuugug

SEQ ID NO: 1768408 - RNA, 14 nt, Human
aucagaauuugugu

SEQ ID NO: 1768409 - RNA, 16 nt, Human
aucaggacccagagga

SEQ ID NO: 1768410 - RNA, 18 nt, Human
aucaggacccagaggaag

SEQ ID NO: 1768411 - RNA, 20 nt, Human
aucaggacccagaggaaggg

SEQ ID NO: 1768412 - RNA, 14 nt, Human
uucuauaauuuaaa

SEQ ID NO: 1768413 - RNA, 13 nt, Human
uucuauaauuuaa

SEQ ID NO: 1768414 - RNA, 16 nt, Human
uucuagauacaauaaa

SEQ ID NO: 1768415 - RNA, 18 nt, Human
uucuagauacaauaaauu

SEQ ID NO: 1768416 - RNA, 19 nt, Human
uucuagauacaauaaauug

SEQ ID NO: 1768417 - RNA, 20 nt, Human
uucuagauacaauaaauugc

SEQ ID NO: 1768418 - RNA, 11 nt, Human
uuccuguccca

SEQ ID NO: 1768419 - RNA, 23 nt, Human
uuccugucccaccauacgagcac

SEQ ID NO: 1768420 - RNA, 14 nt, Human
uuccugucccugcg

SEQ ID NO: 1768421 - RNA, 15 nt, Human
uuccugucccugcgc

SEQ ID NO: 1768422 - RNA, 21 nt, Human
uuccugucccugcgccuuucc

SEQ ID NO: 1768423 - RNA, 23 nt, Human
uuccugucccugcgccuuuccuu

SEQ ID NO: 1768424 - RNA, 22 nt, Human
uuccugucccugcgccuuuccu

SEQ ID NO: 1768425 - RNA, 19 nt, Human
aucaaccccuucgcuccug

SEQ ID NO: 1768426 - RNA, 20 nt, Human
aucaaccccuucgcuccugu

SEQ ID NO: 1768427 - RNA, 22 nt, Human
aucaaccccuucgcuccugugu

SEQ ID NO: 1768428 - RNA, 21 nt, Human
auauuuugucauaucaaauaa

SEQ ID NO: 1768429 - RNA, 14 nt, Human
auauuuuacauaca

SEQ ID NO: 1768430 - RNA, 22 nt, Human
uuccccucagaaaaaaauucau

SEQ ID NO: 1768431 - RNA, 21 nt, Human
uucccagcacuaugcuuuccu

SEQ ID NO: 1768432 - RNA, 22 nt, Human
uucccagcacuaugcuuuccuu

SEQ ID NO: 1768433 - RNA, 23 nt, Human
uucccagcacuaugcuuuccuuc

SEQ ID NO: 1768434 - RNA, 15 nt, Human
uuccuacccugccuc

SEQ ID NO: 1768435 - RNA, 16 nt, Human
uuccuacccugccucc

SEQ ID NO: 1768436 - RNA, 22 nt, Human
uucccuagaaacuuccaaaucc

SEQ ID NO: 1768437 - RNA, 21 nt, Human
uuccccuuccacugagggcag

SEQ ID NO: 1768438 - RNA, 14 nt, Human
uuccccuuccacug

SEQ ID NO: 1768439 - RNA, 15 nt, Human
uuccccuuccacuga

SEQ ID NO: 1768440 - RNA, 11 nt, Human
uuccccugugu

SEQ ID NO: 1768441 - RNA, 12 nt, Human
uuccccuguguc

SEQ ID NO: 1768442 - RNA, 13 nt, Human
uuccccuguguca

SEQ ID NO: 1768443 - RNA, 15 nt, Human
uuccccugugucauc

SEQ ID NO: 1768444 - RNA, 21 nt, Human
uuguucucugggagaaaauca

SEQ ID NO: 1768445 - RNA, 20 nt, Human
uugugugugugucagcugag

SEQ ID NO: 1768446 - RNA, 13 nt, Human
augcaccagcccu

SEQ ID NO: 1768447 - RNA, 11 nt, Human
augcaaauccu

SEQ ID NO: 1768448 - RNA, 18 nt, Human
augcaaauccuaugugau

SEQ ID NO: 1768449 - RNA, 19 nt, Human
augcaaauccuaugugauu

SEQ ID NO: 1768450 - RNA, 14 nt, Human
augcaccagcccuu

SEQ ID NO: 1768451 - RNA, 19 nt, Human
augcacuuauaauuuuccu

SEQ ID NO: 1768452 - RNA, 12 nt, Human
augauucaagcc

SEQ ID NO: 1768453 - RNA, 13 nt, Human
augauucaagcca

SEQ ID NO: 1768454 - RNA, 14 nt, Human
augauucaagccau

SEQ ID NO: 1768455 - RNA, 15 nt, Human
augauucaagccauu

SEQ ID NO: 1768456 - RNA, 16 nt, Human
augauucaagccauuc

SEQ ID NO: 1768457 - RNA, 16 nt, Human
augauucaguguuaaa

SEQ ID NO: 1768458 - RNA, 15 nt, Human
augcaguucugagca

SEQ ID NO: 1768459 - RNA, 11 nt, Human
augcaguuuga

SEQ ID NO: 1768460 - RNA, 13 nt, Human
augcaguuugaaa

SEQ ID NO: 1768461 - RNA, 14 nt, Human
augcaguuugaaau

SEQ ID NO: 1768462 - RNA, 15 nt, Human
augcaguuugaaauu

SEQ ID NO: 1768463 - RNA, 16 nt, Human
augcaguuugaaauuc

SEQ ID NO: 1768464 - RNA, 17 nt, Human
augcaguuugaaauucu

SEQ ID NO: 1768465 - RNA, 18 nt, Human
augcaguuugaaauucug

SEQ ID NO: 1768466 - RNA, 19 nt, Human
augcaguuugaaauucuga

SEQ ID NO: 1768467 - RNA, 21 nt, Human
augcaguuugaaauucugaau

SEQ ID NO: 1768468 - RNA, 22 nt, Human
augcaguuugaaauucugaauu

SEQ ID NO: 1768469 - RNA, 23 nt, Human
augcaguuugaaauucugaauuu

SEQ ID NO: 1768470 - RNA, 17 nt, Human
augcaggugaaacccag

SEQ ID NO: 1768471 - RNA, 19 nt, Human
augcagucuguccaggcuc

SEQ ID NO: 1768472 - RNA, 20 nt, Human
augcagucuguccaggcucg

SEQ ID NO: 1768473 - RNA, 18 nt, Human
augcaggugaaacccagu

SEQ ID NO: 1768474 - RNA, 15 nt, Human
augcaguaugguaca

SEQ ID NO: 1768475 - RNA, 22 nt, Human
augcaguaugguacauuuuuca

SEQ ID NO: 1768476 - RNA, 23 nt, Human
augcaguaugguacauuuuucaa

SEQ ID NO: 1768477 - RNA, 18 nt, Human
augcagucuguccaggcu

SEQ ID NO: 1768478 - RNA, 24 nt, Human
augcagugcucgcuguugcugaau

SEQ ID NO: 1768479 - RNA, 23 nt, Human
augcagugcucgcuguugcugaa

SEQ ID NO: 1768480 - RNA, 21 nt, Human
augcagugcucgcuguugcug

SEQ ID NO: 1768481 - RNA, 20 nt, Human
augcagugcucgcuguugcu

SEQ ID NO: 1768482 - RNA, 19 nt, Human
augcagugcucgcuguugc

SEQ ID NO: 1768483 - RNA, 17 nt, Human
augcagugcucgcuguu

SEQ ID NO: 1768484 - RNA, 13 nt, Human
augcagugcucgc

SEQ ID NO: 1768485 - RNA, 13 nt, Human
auggcagaaggca

SEQ ID NO: 1768486 - RNA, 14 nt, Human
auggccaaacccaa

SEQ ID NO: 1768487 - RNA, 15 nt, Human
auggcagaaggcaaa

SEQ ID NO: 1768488 - RNA, 20 nt, Human
auggcagaaggcaaacccau

SEQ ID NO: 1768489 - RNA, 21 nt, Human
auggcagaaggcaaacccauc

SEQ ID NO: 1768490 - RNA, 14 nt, Human
auggccguggaugc

SEQ ID NO: 1768491 - RNA, 16 nt, Human
auggccguggauggcc

SEQ ID NO: 1768492 - RNA, 20 nt, Human
auggccguggauggccgugg

SEQ ID NO: 1768493 - RNA, 15 nt, Human
auggccuaaauuuau

SEQ ID NO: 1768494 - RNA, 14 nt, Human
auggacagauuaau

SEQ ID NO: 1768495 - RNA, 16 nt, Human
auggacagauuaauau

SEQ ID NO: 1768496 - RNA, 23 nt, Human
uuucauguugcacacccacucag

SEQ ID NO: 1768497 - RNA, 16 nt, Human
uuucauguuuuaacaa

SEQ ID NO: 1768498 - RNA, 17 nt, Human
uuucauguuuuaacaaa

SEQ ID NO: 1768499 - RNA, 19 nt, Human
uuucauguuuuaacaaaaa

SEQ ID NO: 1768500 - RNA, 14 nt, Human
auggaacuuagcca

SEQ ID NO: 1768501 - RNA, 16 nt, Human
auggaacuuagccauu

SEQ ID NO: 1768502 - RNA, 15 nt, Human
augcuccuugggccc

SEQ ID NO: 1768503 - RNA, 16 nt, Human
augcuccuugggcccu

SEQ ID NO: 1768504 - RNA, 13 nt, Human
uuuauaguaauga

SEQ ID NO: 1768505 - RNA, 17 nt, Human
aucuugacuacagucag

SEQ ID NO: 1768506 - RNA, 19 nt, Human
aucuugcucugcugacaga

SEQ ID NO: 1768507 - RNA, 15 nt, Human
aucugugucuuguuu

SEQ ID NO: 1768508 - RNA, 14 nt, Human
aucuguuagggccu

SEQ ID NO: 1768509 - RNA, 15 nt, Human
aucuguuagggccuu

SEQ ID NO: 1768510 - RNA, 16 nt, Human
aucuguuagggccuug

SEQ ID NO: 1768511 - RNA, 17 nt, Human
aucuguuagggccuugg

SEQ ID NO: 1768512 - RNA, 16 nt, Human
aucuguuccuuggcag

SEQ ID NO: 1768513 - RNA, 19 nt, Human
aucuguugcaagccccucu

SEQ ID NO: 1768514 - RNA, 17 nt, Human
aucuggguucacugcaa

SEQ ID NO: 1768515 - RNA, 19 nt, Human
aucuggguucacugcaacc

SEQ ID NO: 1768516 - RNA, 14 nt, Human
aucuggucauuugg

SEQ ID NO: 1768517 - RNA, 22 nt, Human
aucugauuguugucaggccaua

SEQ ID NO: 1768518 - RNA, 18 nt, Human
aucugcaauuucuacuac

SEQ ID NO: 1768519 - RNA, 11 nt, Human
aucucuuccuu

SEQ ID NO: 1768520 - RNA, 12 nt, Human
aucucuuccuug

SEQ ID NO: 1768521 - RNA, 20 nt, Human
uugcaucucccagauaaugu

SEQ ID NO: 1768522 - RNA, 22 nt, Human
uugcacaugucuuaaugaaguu

SEQ ID NO: 1768523 - RNA, 21 nt, Human
uugcacaugucuuaaugaagu

SEQ ID NO: 1768524 - RNA, 17 nt, Human
uugcacaugucuuaaug

SEQ ID NO: 1768525 - RNA, 15 nt, Human
uugcaugugacucug

SEQ ID NO: 1768526 - RNA, 16 nt, Human
uugcaugugacucuga

SEQ ID NO: 1768527 - RNA, 17 nt, Human
uugcaugugacucugaa

SEQ ID NO: 1768528 - RNA, 19 nt, Human
uugcacacccacucagcuc

SEQ ID NO: 1768529 - RNA, 21 nt, Human
uugcacacccacucagcuccg

SEQ ID NO: 1768530 - RNA, 16 nt, Human
uugcacaugucuuaau

SEQ ID NO: 1768531 - RNA, 15 nt, Human
uugcacaugucuuaa

SEQ ID NO: 1768532 - RNA, 13 nt, Human
uugcacaugucuu

SEQ ID NO: 1768533 - RNA, 13 nt, Human
uugcacagggauu

SEQ ID NO: 1768534 - RNA, 19 nt, Human
uugcacagggauucucaca

SEQ ID NO: 1768535 - RNA, 19 nt, Human
aucucccagauaaugugaa

SEQ ID NO: 1768536 - RNA, 20 nt, Human
aucucccagauaaugugaaa

SEQ ID NO: 1768537 - RNA, 18 nt, Human
aucucaugaggggagagg

SEQ ID NO: 1768538 - RNA, 13 nt, Human
auccuagugcuuu

SEQ ID NO: 1768539 - RNA, 19 nt, Human
auccuaucaacaacaaggu

SEQ ID NO: 1768540 - RNA, 12 nt, Human
aucucacucugc

SEQ ID NO: 1768541 - RNA, 14 nt, Human
aucucacucugccc

SEQ ID NO: 1768542 - RNA, 16 nt, Human
aucucacucugccccc

SEQ ID NO: 1768543 - RNA, 19 nt, Human
aucucaggacacuuccgua

SEQ ID NO: 1768544 - RNA, 13 nt, Human
augaauuguacag

SEQ ID NO: 1768545 - RNA, 14 nt, Human
augaauuguacaga

SEQ ID NO: 1768546 - RNA, 22 nt, Human
augaauuguacagaauauuucu

SEQ ID NO: 1768547 - RNA, 21 nt, Human
augagaagaaaauggaaccag

SEQ ID NO: 1768548 - RNA, 21 nt, Human
augagaaagguugaagcacca

SEQ ID NO: 1768549 - RNA, 22 nt, Human
augagaaagguugaagcaccaa

SEQ ID NO: 1768550 - RNA, 23 nt, Human
augagaagaaaauggaaccaggc

SEQ ID NO: 1768551 - RNA, 21 nt, Human
augagaauuugagugcucuga

SEQ ID NO: 1768552 - RNA, 18 nt, Human
augacauuuauuuuucau

SEQ ID NO: 1768553 - RNA, 20 nt, Human
augacauuggauagaacaug

SEQ ID NO: 1768554 - RNA, 13 nt, Human
uuggcugcaggga

SEQ ID NO: 1768555 - RNA, 16 nt, Human
aucuuuuguuuccuuu

SEQ ID NO: 1768556 - RNA, 22 nt, Human
aucuuuuguuuccuuuuuuccc

SEQ ID NO: 1768557 - RNA, 23 nt, Human
aucuuuuguuuccuuuuuuccca

SEQ ID NO: 1768558 - RNA, 12 nt, Human
augaaaggagag

SEQ ID NO: 1768559 - RNA, 15 nt, Human
augaaaggagagcau

SEQ ID NO: 1768560 - RNA, 12 nt, Human
aucuugcuggcu

SEQ ID NO: 1768561 - RNA, 13 nt, Human
uuggauccaagga

SEQ ID NO: 1768562 - RNA, 24 nt, Human
uuggaugcagugcucgcuguugcu

SEQ ID NO: 1768563 - RNA, 23 nt, Human
uuggaugcagugcucgcuguugc

SEQ ID NO: 1768564 - RNA, 19 nt, Human
uuggaguguuccccuucca

SEQ ID NO: 1768565 - RNA, 22 nt, Human
uuggaguguuccccuuccacug

SEQ ID NO: 1768566 - RNA, 14 nt, Human
uuggaguguuucua

SEQ ID NO: 1768567 - RNA, 15 nt, Human
uuggggauuuucaaa

SEQ ID NO: 1768568 - RNA, 15 nt, Human
augaaagggcccaga

SEQ ID NO: 1768569 - RNA, 22 nt, Human
augaaugucuuuuuucaaacuu

SEQ ID NO: 1768570 - RNA, 17 nt, Human
augaaugauuugcauau

SEQ ID NO: 1768571 - RNA, 15 nt, Human
augaaugauuugcau

SEQ ID NO: 1768572 - RNA, 15 nt, Human
auguuugccucugcc

SEQ ID NO: 1768573 - RNA, 17 nt, Human
auguuugccucugccuc

SEQ ID NO: 1768574 - RNA, 14 nt, Human
auguuugccucugc

SEQ ID NO: 1768575 - RNA, 15 nt, Human
auguucugggacaca

SEQ ID NO: 1768576 - RNA, 21 nt, Human
auguucugugccuguaaacau

SEQ ID NO: 1768577 - RNA, 17 nt, Human
auguucucugaggacac

SEQ ID NO: 1768578 - RNA, 14 nt, Human
auguucugggacac

SEQ ID NO: 1768579 - RNA, 13 nt, Human
auguucucugagg

SEQ ID NO: 1768580 - RNA, 17 nt, Human
auguuccagacauucuc

SEQ ID NO: 1768581 - RNA, 12 nt, Human
augguacauuuu

SEQ ID NO: 1768582 - RNA, 16 nt, Human
augguacauuuuucaa

SEQ ID NO: 1768583 - RNA, 19 nt, Human
augguacauuuuucaacuu

SEQ ID NO: 1768584 - RNA, 13 nt, Human
augguccaggaga

SEQ ID NO: 1768585 - RNA, 16 nt, Human
augguccaggagaagg

SEQ ID NO: 1768586 - RNA, 18 nt, Human
augguccaggagaaggcc

SEQ ID NO: 1768587 - RNA, 19 nt, Human
augguccaggagaaggcca

SEQ ID NO: 1768588 - RNA, 21 nt, Human
augugaaaaugguccaggaga

SEQ ID NO: 1768589 - RNA, 19 nt, Human
augucuuuugaugaauaga

SEQ ID NO: 1768590 - RNA, 21 nt, Human
augucuuuuuucaaacuuuau

SEQ ID NO: 1768591 - RNA, 19 nt, Human
augucacaggcagguccag

SEQ ID NO: 1768592 - RNA, 22 nt, Human
augugaaaaugguccaggagaa

SEQ ID NO: 1768593 - RNA, 17 nt, Human
auguauuuaccaaaaau

SEQ ID NO: 1768594 - RNA, 21 nt, Human
auguauuuaccaaaaauuuug

SEQ ID NO: 1768595 - RNA, 22 nt, Human
auguauuuaccaaaaauuuugu

SEQ ID NO: 1768596 - RNA, 13 nt, Human
augucacaggcag

SEQ ID NO: 1768597 - RNA, 21 nt, Human
auggagucauuugagucucuu

SEQ ID NO: 1768598 - RNA, 18 nt, Human
augcuuuagaaagguuuu

SEQ ID NO: 1768599 - RNA, 13 nt, Human
auggauacauaaa

SEQ ID NO: 1768600 - RNA, 14 nt, Human
auggauacauaaag

SEQ ID NO: 1768601 - RNA, 14 nt, Human
auggaucagaucug

SEQ ID NO: 1768602 - RNA, 19 nt, Human
augccugccccaaacaaau

SEQ ID NO: 1768603 - RNA, 15 nt, Human
augcauugcucugga

SEQ ID NO: 1768604 - RNA, 21 nt, Human
augcauugcucuggaucuguu

SEQ ID NO: 1768605 - RNA, 18 nt, Human
augaucuuugcagacagg

SEQ ID NO: 1768606 - RNA, 19 nt, Human
augaucuuugcagacaggc

SEQ ID NO: 1768607 - RNA, 21 nt, Human
augaucuuugcagacaggcaa

SEQ ID NO: 1768608 - RNA, 17 nt, Human
augaucuuugcagacag

SEQ ID NO: 1768609 - RNA, 23 nt, Human
augaugaaaugaggucagagccu

SEQ ID NO: 1768610 - RNA, 18 nt, Human
augaugaaaugaggucag

SEQ ID NO: 1768611 - RNA, 11 nt, Human
augaggggaga

SEQ ID NO: 1768612 - RNA, 12 nt, Human
augaggggagag

SEQ ID NO: 1768613 - RNA, 14 nt, Human
augaggggagagga

SEQ ID NO: 1768614 - RNA, 15 nt, Human
augaaaaugucuugu

SEQ ID NO: 1768615 - RNA, 13 nt, Human
augaaaaugucuu

SEQ ID NO: 1768616 - RNA, 14 nt, Human
augaaaaugucuug

SEQ ID NO: 1768617 - RNA, 22 nt, Human
aucuggggcagcacccuauaaa

SEQ ID NO: 1768618 - RNA, 23 nt, Human
aucuggggcagcacccuauaaau

SEQ ID NO: 1768619 - RNA, 18 nt, Human
aucuucgggaccaggauu

SEQ ID NO: 1768620 - RNA, 12 nt, Human
aucuuccugugu

SEQ ID NO: 1768621 - RNA, 13 nt, Human
aucuuccuguguc

SEQ ID NO: 1768622 - RNA, 14 nt, Human
aucuuccugugucc

SEQ ID NO: 1768623 - RNA, 15 nt, Human
aucuuccuguguccu

SEQ ID NO: 1768624 - RNA, 15 nt, Human
aucuucgggaccagg

SEQ ID NO: 1768625 - RNA, 14 nt, Human
aucuccggcuccca

SEQ ID NO: 1768626 - RNA, 16 nt, Human
aucuccggcucccagc

SEQ ID NO: 1768627 - RNA, 18 nt, Human
aucuccggcucccagccu

SEQ ID NO: 1768628 - RNA, 19 nt, Human
aucuccggcucccagccuc

SEQ ID NO: 1768629 - RNA, 21 nt, Human
aucuccggcucccagccucag

SEQ ID NO: 1768630 - RNA, 16 nt, Human
aucuccugccuuccuc

SEQ ID NO: 1768631 - RNA, 17 nt, Human
aucuccugccuuccucc

SEQ ID NO: 1768632 - RNA, 22 nt, Human
aucuccggcucccagccucagc

SEQ ID NO: 1768633 - RNA, 20 nt, Human
aucuccugccuuccuccugg

SEQ ID NO: 1768634 - RNA, 18 nt, Human
aucaaacauggguuuagu

SEQ ID NO: 1768635 - RNA, 11 nt, Human
aucacacacac

SEQ ID NO: 1768636 - RNA, 14 nt, Human
aucacaccugcccu

SEQ ID NO: 1768637 - RNA, 19 nt, Human
aucaccgugggcucccuga

SEQ ID NO: 1768638 - RNA, 20 nt, Human
aucaccgugggcucccugac

SEQ ID NO: 1768639 - RNA, 22 nt, Human
aucaccgugggcucccugacug

SEQ ID NO: 1768640 - RNA, 14 nt, Human
aucaugucuggcua

SEQ ID NO: 1768641 - RNA, 18 nt, Human
aucaugaaauaugcaucu

SEQ ID NO: 1768642 - RNA, 15 nt, Human
aucaugaaauaugca

SEQ ID NO: 1768643 - RNA, 16 nt, Human
aucaugaaauaugcau

SEQ ID NO: 1768644 - RNA, 21 nt, Human
aucagcuucuauccuugacuu

SEQ ID NO: 1768645 - RNA, 14 nt, Human
aucaugaaauaugc

SEQ ID NO: 1768646 - RNA, 19 nt, Human
auccagacccggcugcgug

SEQ ID NO: 1768647 - RNA, 19 nt, Human
aucccaugagccucagcau

SEQ ID NO: 1768648 - RNA, 17 nt, Human
auccagagauucauuuu

SEQ ID NO: 1768649 - RNA, 19 nt, Human
auccagagauucauuuucu

SEQ ID NO: 1768650 - RNA, 22 nt, Human
auccagagauucauuuucuaga

SEQ ID NO: 1768651 - RNA, 23 nt, Human
auccagagauucauuuucuagau

SEQ ID NO: 1768652 - RNA, 19 nt, Human
auccccacugggaccaacc

SEQ ID NO: 1768653 - RNA, 14 nt, Human
aucccggggguggg

SEQ ID NO: 1768654 - RNA, 19 nt, Human
auccucaguuuuugugaaa

SEQ ID NO: 1768655 - RNA, 17 nt, Human
aucccuaccgacccagg

SEQ ID NO: 1768656 - RNA, 19 nt, Human
aucccuaccgacccagggu

SEQ ID NO: 1768657 - RNA, 12 nt, Human
auccucaaucca

SEQ ID NO: 1768658 - RNA, 15 nt, Human
auccucaauccagcu

SEQ ID NO: 1768659 - RNA, 17 nt, Human
auccuugggggcuccca

SEQ ID NO: 1768660 - RNA, 18 nt, Human
auccuugggggcucccag

SEQ ID NO: 1768661 - RNA, 22 nt, Human
auccuugggggcucccagggca

SEQ ID NO: 1768662 - RNA, 12 nt, Human
aucgccuuuccc

SEQ ID NO: 1768663 - RNA, 19 nt, Human
auccuuuaggguucugccu

SEQ ID NO: 1768664 - RNA, 21 nt, Human
auccuuuaggguucugccucu

SEQ ID NO: 1768665 - RNA, 19 nt, Human
auccuuuccucauuaaauu

SEQ ID NO: 1768666 - RNA, 15 nt, Human
auaugcugcaacaaa

SEQ ID NO: 1768667 - RNA, 13 nt, Human
auaugcacuuaua

SEQ ID NO: 1768668 - RNA, 14 nt, Human
auaugcacuuauaa

SEQ ID NO: 1768669 - RNA, 17 nt, Human
auaguaaugaguuuaaa

SEQ ID NO: 1768670 - RNA, 23 nt, Human
auaguaaugaguuuaaaaaucaa

SEQ ID NO: 1768671 - RNA, 15 nt, Human
auagccuaggugaca

SEQ ID NO: 1768672 - RNA, 17 nt, Human
auagccuaggugacaga

SEQ ID NO: 1768673 - RNA, 19 nt, Human
auagccgauaucagaauuu

SEQ ID NO: 1768674 - RNA, 13 nt, Human
auaguaauuugua

SEQ ID NO: 1768675 - RNA, 14 nt, Human
auaguaauuuguaa

SEQ ID NO: 1768676 - RNA, 16 nt, Human
auaguaauuuguaaag

SEQ ID NO: 1768677 - RNA, 17 nt, Human
auaguaauuuguaaagu

SEQ ID NO: 1768678 - RNA, 19 nt, Human
auaguaauuuguaaaguug

SEQ ID NO: 1768679 - RNA, 17 nt, Human
auauaaucuuucaaacc

SEQ ID NO: 1768680 - RNA, 18 nt, Human
auagcaccccuacucaca

SEQ ID NO: 1768681 - RNA, 21 nt, Human
auacuuguggacuaaaagaua

SEQ ID NO: 1768682 - RNA, 20 nt, Human
auacuuguggacuaaaagau

SEQ ID NO: 1768683 - RNA, 14 nt, Human
auacuuguggacua

SEQ ID NO: 1768684 - RNA, 13 nt, Human
auacuuguggacu

SEQ ID NO: 1768685 - RNA, 12 nt, Human
auacuuuacaug

SEQ ID NO: 1768686 - RNA, 23 nt, Human
auacuuuagaaguagaauugaca

SEQ ID NO: 1768687 - RNA, 12 nt, Human
aguuugaaauuc

SEQ ID NO: 1768688 - RNA, 13 nt, Human
aguuugaaauucu

SEQ ID NO: 1768689 - RNA, 14 nt, Human
aguuugaaauucug

SEQ ID NO: 1768690 - RNA, 15 nt, Human
aguuugaaauucuga

SEQ ID NO: 1768691 - RNA, 17 nt, Human
aguuugaaauucugaau

SEQ ID NO: 1768692 - RNA, 18 nt, Human
aguuugaaauucugaauu

SEQ ID NO: 1768693 - RNA, 19 nt, Human
aguuugaaauucugaauuu

SEQ ID NO: 1768694 - RNA, 20 nt, Human
aguuugaaauucugaauuug

SEQ ID NO: 1768695 - RNA, 22 nt, Human
aguuugaaauucugaauuugca

SEQ ID NO: 1768696 - RNA, 23 nt, Human
aguuugaaauucugaauuugcaa

SEQ ID NO: 1768697 - RNA, 15 nt, Human
aguuugaauguuaaa

SEQ ID NO: 1768698 - RNA, 14 nt, Human
aguuugaauguuaa

SEQ ID NO: 1768699 - RNA, 12 nt, Human
aguuugaauguu

SEQ ID NO: 1768700 - RNA, 21 nt, Human
aguuugaauguuaaauaaauu

SEQ ID NO: 1768701 - RNA, 16 nt, Human
aguuugaauguuaaau

SEQ ID NO: 1768702 - RNA, 14 nt, Human
aguuugauuauuca

SEQ ID NO: 1768703 - RNA, 17 nt, Human
aguuugauuauucagug

SEQ ID NO: 1768704 - RNA, 18 nt, Human
aguuugauuauucagugu

SEQ ID NO: 1768705 - RNA, 23 nt, Human
aguuugauuauucagugucacug

SEQ ID NO: 1768706 - RNA, 14 nt, Human
auaacaauuccucu

SEQ ID NO: 1768707 - RNA, 15 nt, Human
auaacaauuccucua

SEQ ID NO: 1768708 - RNA, 11 nt, Human
auaacacacau

SEQ ID NO: 1768709 - RNA, 14 nt, Human
auaacaaugaaagu

SEQ ID NO: 1768710 - RNA, 19 nt, Human
auaaauuguauauucacuu

SEQ ID NO: 1768711 - RNA, 18 nt, Human
auaaauuguauauucacu

SEQ ID NO: 1768712 - RNA, 17 nt, Human
auaaauuguauauucac

SEQ ID NO: 1768713 - RNA, 16 nt, Human
auaaauuguauauuca

SEQ ID NO: 1768714 - RNA, 15 nt, Human
auacaauaucaucca

SEQ ID NO: 1768715 - RNA, 21 nt, Human
auaaggggucaaaauuugcug

SEQ ID NO: 1768716 - RNA, 18 nt, Human
aguucagguaacaggcag

SEQ ID NO: 1768717 - RNA, 11 nt, Human
aguucagaucu

SEQ ID NO: 1768718 - RNA, 13 nt, Human
aguucagaucuua

SEQ ID NO: 1768719 - RNA, 16 nt, Human
aguucagaucuuaaua

SEQ ID NO: 1768720 - RNA, 22 nt, Human
aguucagaucuuaauauaaauu

SEQ ID NO: 1768721 - RNA, 20 nt, Human
agugcucgcuguugcugaau

SEQ ID NO: 1768722 - RNA, 19 nt, Human
agugcucgcuguugcugaa

SEQ ID NO: 1768723 - RNA, 18 nt, Human
agugcucgcuguugcuga

SEQ ID NO: 1768724 - RNA, 17 nt, Human
agugcucgcuguugcug

SEQ ID NO: 1768725 - RNA, 16 nt, Human
agugcucgcuguugcu

SEQ ID NO: 1768726 - RNA, 15 nt, Human
agugcucgcuguugc

SEQ ID NO: 1768727 - RNA, 22 nt, Human
agugcuaagugugaacuggacc

SEQ ID NO: 1768728 - RNA, 19 nt, Human
agugcuaagugugaacugg

SEQ ID NO: 1768729 - RNA, 23 nt, Human
agugcucgcuguugcugaauagg

SEQ ID NO: 1768730 - RNA, 22 nt, Human
agugcucgcuguugcugaauag

SEQ ID NO: 1768731 - RNA, 11 nt, Human
agugcucugau

SEQ ID NO: 1768732 - RNA, 16 nt, Human
agugcucugaucccuc

SEQ ID NO: 1768733 - RNA, 17 nt, Human
agugcucugaucccucu

SEQ ID NO: 1768734 - RNA, 21 nt, Human
agugcucugaucccucuacag

SEQ ID NO: 1768735 - RNA, 18 nt, Human
agugcuaagugugaacug

SEQ ID NO: 1768736 - RNA, 17 nt, Human
agugcuaagugugaacu

SEQ ID NO: 1768737 - RNA, 16 nt, Human
agugcuaagugugaac

SEQ ID NO: 1768738 - RNA, 15 nt, Human
agugcuaagugugaa

SEQ ID NO: 1768739 - RNA, 14 nt, Human
agugcuaaguguga

SEQ ID NO: 1768740 - RNA, 14 nt, Human
agugauucuccugc

SEQ ID NO: 1768741 - RNA, 15 nt, Human
agugauucuccugcc

SEQ ID NO: 1768742 - RNA, 17 nt, Human
agugauucuccugccuc

SEQ ID NO: 1768743 - RNA, 14 nt, Human
agugauccucccac

SEQ ID NO: 1768744 - RNA, 15 nt, Human
agugauccucccacc

SEQ ID NO: 1768745 - RNA, 18 nt, Human
agugauccucccaccuca

SEQ ID NO: 1768746 - RNA, 19 nt, Human
agugauccucccaccucag

SEQ ID NO: 1768747 - RNA, 24 nt, Human
agugauccucccaccucagccucc

SEQ ID NO: 1768748 - RNA, 14 nt, Human
aguggccucuuugu

SEQ ID NO: 1768749 - RNA, 15 nt, Human
aguggccucuuuguc

SEQ ID NO: 1768750 - RNA, 21 nt, Human
aguggccucuuugucuaaaac

SEQ ID NO: 1768751 - RNA, 23 nt, Human
aguggccucuuugucuaaaacaa

SEQ ID NO: 1768752 - RNA, 15 nt, Human
agugggaugaaccag

SEQ ID NO: 1768753 - RNA, 13 nt, Human
agucaugugcauu

SEQ ID NO: 1768754 - RNA, 22 nt, Human
aguccucuuuucugagaggacu

SEQ ID NO: 1768755 - RNA, 20 nt, Human
aguccugaucagagccgugg

SEQ ID NO: 1768756 - RNA, 19 nt, Human
aguccucuuuucugagagg

SEQ ID NO: 1768757 - RNA, 21 nt, Human
agucuguguucaaaaauauau

SEQ ID NO: 1768758 - RNA, 20 nt, Human
agucugugccacguguuugu

SEQ ID NO: 1768759 - RNA, 23 nt, Human
aguccuuauguuaagcccuggca

SEQ ID NO: 1768760 - RNA, 18 nt, Human
aguaacccccacuggacu

SEQ ID NO: 1768761 - RNA, 20 nt, Human
aguaacccccacuggacuga

SEQ ID NO: 1768762 - RNA, 14 nt, Human
aguacuagaaacug

SEQ ID NO: 1768763 - RNA, 17 nt, Human
aguacuucuccacccug

SEQ ID NO: 1768764 - RNA, 12 nt, Human
aguacuucuuuu

SEQ ID NO: 1768765 - RNA, 23 nt, Human
aguacuguaagaauaauuuauag

SEQ ID NO: 1768766 - RNA, 13 nt, Human
aguacugugggca

SEQ ID NO: 1768767 - RNA, 17 nt, Human
aguacugugggcaauuu

SEQ ID NO: 1768768 - RNA, 18 nt, Human
aguacugugggcaauuua

SEQ ID NO: 1768769 - RNA, 19 nt, Human
aguacugugggcaauuuag

SEQ ID NO: 1768770 - RNA, 20 nt, Human
aguacugugggcaauuuaga

SEQ ID NO: 1768771 - RNA, 21 nt, Human
aguacugugggcaauuuagaa

SEQ ID NO: 1768772 - RNA, 22 nt, Human
aguacugugggcaauuuagaaa

SEQ ID NO: 1768773 - RNA, 23 nt, Human
aguacugugggcaauuuagaaaa

SEQ ID NO: 1768774 - RNA, 22 nt, Human
agucacacaguauuacuucugc

SEQ ID NO: 1768775 - RNA, 18 nt, Human
aguauuuuuccuuuuuaa

SEQ ID NO: 1768776 - RNA, 14 nt, Human
aguauuuuugcugc

SEQ ID NO: 1768777 - RNA, 16 nt, Human
aguauuuuugcugcuu

SEQ ID NO: 1768778 - RNA, 19 nt, Human
aguauuuuugcugcuucug

SEQ ID NO: 1768779 - RNA, 14 nt, Human
aguacuugucauau

SEQ ID NO: 1768780 - RNA, 15 nt, Human
aguacuugucauaug

SEQ ID NO: 1768781 - RNA, 17 nt, Human
aguacuugucauaugua

SEQ ID NO: 1768782 - RNA, 16 nt, Human
agagccguggucccug

SEQ ID NO: 1768783 - RNA, 21 nt, Human
agagccguggucccugaggau

SEQ ID NO: 1768784 - RNA, 13 nt, Human
agagcccaccuug

SEQ ID NO: 1768785 - RNA, 13 nt, Human
agagccagggucu

SEQ ID NO: 1768786 - RNA, 15 nt, Human
agagagaggcaaugg

SEQ ID NO: 1768787 - RNA, 16 nt, Human
agagaggccuuguccc

SEQ ID NO: 1768788 - RNA, 16 nt, Human
agagagaccacuuuuc

SEQ ID NO: 1768789 - RNA, 18 nt, Human
agacucugucucaaaaaa

SEQ ID NO: 1768790 - RNA, 15 nt, Human
agacugaggggucga

SEQ ID NO: 1768791 - RNA, 21 nt, Human
agaggacuuuucuuuguggcu

SEQ ID NO: 1768792 - RNA, 22 nt, Human
agaggacuuuucuuuguggcuu

SEQ ID NO: 1768793 - RNA, 23 nt, Human
agaggacuuuucuuuguggcuuc

SEQ ID NO: 1768794 - RNA, 12 nt, Human
agagggggccug

SEQ ID NO: 1768795 - RNA, 19 nt, Human
agagggggccugggacuuc

SEQ ID NO: 1768796 - RNA, 22 nt, Human
agagggggccugggacuuccau

SEQ ID NO: 1768797 - RNA, 23 nt, Human
agaggaaggggccagaggcucgu

SEQ ID NO: 1768798 - RNA, 15 nt, Human
agaggaaguucagau

SEQ ID NO: 1768799 - RNA, 16 nt, Human
agaggaaguucagauc

SEQ ID NO: 1768800 - RNA, 18 nt, Human
agaggaaguucagaucuu

SEQ ID NO: 1768801 - RNA, 16 nt, Human
agaggaaggggccaga

SEQ ID NO: 1768802 - RNA, 18 nt, Human
agaggaaggggccagagg

SEQ ID NO: 1768803 - RNA, 20 nt, Human
agaggaaggggccagaggcu

SEQ ID NO: 1768804 - RNA, 13 nt, Human
agaagacacugau

SEQ ID NO: 1768805 - RNA, 21 nt, Human
agaagacacugaugggcaacc

SEQ ID NO: 1768806 - RNA, 18 nt, Human
acuuuccucuuccugccu

SEQ ID NO: 1768807 - RNA, 18 nt, Human
agaagagacucuuugcau

SEQ ID NO: 1768808 - RNA, 18 nt, Human
agaaugaaagggcccaga

SEQ ID NO: 1768809 - RNA, 11 nt, Human
agacagagucu

SEQ ID NO: 1768810 - RNA, 19 nt, Human
agacagagucucacuguug

SEQ ID NO: 1768811 - RNA, 20 nt, Human
agacagagucucacuguugc

SEQ ID NO: 1768812 - RNA, 18 nt, Human
agacagccaaaggcuggc

SEQ ID NO: 1768813 - RNA, 19 nt, Human
agacagccaaaggcuggcg

SEQ ID NO: 1768814 - RNA, 23 nt, Human
agacagagucucacuguugccca

SEQ ID NO: 1768815 - RNA, 21 nt, Human
agacagagucucacuguugcc

SEQ ID NO: 1768816 - RNA, 13 nt, Human
agacgccugagga

SEQ ID NO: 1768817 - RNA, 15 nt, Human
agacgccugaggaac

SEQ ID NO: 1768818 - RNA, 18 nt, Human
agacccagcccucauccc

SEQ ID NO: 1768819 - RNA, 19 nt, Human
agacccagcccucaucccg

SEQ ID NO: 1768820 - RNA, 17 nt, Human
agacccagcccucaucc

SEQ ID NO: 1768821 - RNA, 17 nt, Human
agccccauucugccugc

SEQ ID NO: 1768822 - RNA, 18 nt, Human
agccccauucugccugcc

SEQ ID NO: 1768823 - RNA, 19 nt, Human
agccccauucugccugccc

SEQ ID NO: 1768824 - RNA, 20 nt, Human
agccccauucugccugccca

SEQ ID NO: 1768825 - RNA, 13 nt, Human
agcauccuggcac

SEQ ID NO: 1768826 - RNA, 23 nt, Human
agcaggaaaugaaaaugucuugu

SEQ ID NO: 1768827 - RNA, 15 nt, Human
agcaggaaaugaaaa

SEQ ID NO: 1768828 - RNA, 21 nt, Human
agcaggaaaugaaaaugucuu

SEQ ID NO: 1768829 - RNA, 16 nt, Human
agcccaccuuggcuca

SEQ ID NO: 1768830 - RNA, 14 nt, Human
agcccaccuuggcu

SEQ ID NO: 1768831 - RNA, 15 nt, Human
agcccacucugcucg

SEQ ID NO: 1768832 - RNA, 13 nt, Human
agcccacucugcu

SEQ ID NO: 1768833 - RNA, 14 nt, Human
agcccacucugcuc

SEQ ID NO: 1768834 - RNA, 16 nt, Human
agccagcagcagccca

SEQ ID NO: 1768835 - RNA, 18 nt, Human
agccagcagcagcccaag

SEQ ID NO: 1768836 - RNA, 21 nt, Human
agccagcagcagcccaagcuu

SEQ ID NO: 1768837 - RNA, 17 nt, Human
agccaaggauagaagcu

SEQ ID NO: 1768838 - RNA, 22 nt, Human
agccaaggauagaagcugcagu

SEQ ID NO: 1768839 - RNA, 16 nt, Human
agccaaagcuaggccu

SEQ ID NO: 1768840 - RNA, 18 nt, Human
agccaaagcuaggccugg

SEQ ID NO: 1768841 - RNA, 14 nt, Human
agcauccuggcacc

SEQ ID NO: 1768842 - RNA, 17 nt, Human
agcauccuggcacccgg

SEQ ID NO: 1768843 - RNA, 18 nt, Human
agcauccuggcacccggc

SEQ ID NO: 1768844 - RNA, 23 nt, Human
agauugcaacaggcugggcuuca

SEQ ID NO: 1768845 - RNA, 20 nt, Human
agauugcaacaggcugggcu

SEQ ID NO: 1768846 - RNA, 21 nt, Human
agauugcaacaggcugggcuu

SEQ ID NO: 1768847 - RNA, 13 nt, Human
agcaaacccagac

SEQ ID NO: 1768848 - RNA, 15 nt, Human
agcaaacccagacgg

SEQ ID NO: 1768849 - RNA, 19 nt, Human
agauggucacgcaccuggg

SEQ ID NO: 1768850 - RNA, 21 nt, Human
agauggucacgcaccugggug

SEQ ID NO: 1768851 - RNA, 21 nt, Human
agaugguguggguguccugcc

SEQ ID NO: 1768852 - RNA, 22 nt, Human
agaugguguggguguccugccu

SEQ ID NO: 1768853 - RNA, 12 nt, Human
aggcuacagggc

SEQ ID NO: 1768854 - RNA, 14 nt, Human
aggcuacagggcca

SEQ ID NO: 1768855 - RNA, 23 nt, Human
aggcuaccaacuuguauccaggc

SEQ ID NO: 1768856 - RNA, 20 nt, Human
aggcuguaucccaugagccu

SEQ ID NO: 1768857 - RNA, 21 nt, Human
aggcuguaucccaugagccuc

SEQ ID NO: 1768858 - RNA, 22 nt, Human
aggcuguaucccaugagccuca

SEQ ID NO: 1768859 - RNA, 19 nt, Human
aggcggugcacucacuccu

SEQ ID NO: 1768860 - RNA, 18 nt, Human
aggcgggacagugcugca

SEQ ID NO: 1768861 - RNA, 20 nt, Human
aggccggcgagcccugugga

SEQ ID NO: 1768862 - RNA, 23 nt, Human
aggcacugagauaccagcgagga

SEQ ID NO: 1768863 - RNA, 19 nt, Human
aggcagcagugugaggcca

SEQ ID NO: 1768864 - RNA, 20 nt, Human
aggcagcagugugaggccag

SEQ ID NO: 1768865 - RNA, 22 nt, Human
aggcagcagugugaggccaggg

SEQ ID NO: 1768866 - RNA, 23 nt, Human
aggcagcagugugaggccagggc

SEQ ID NO: 1768867 - RNA, 17 nt, Human
aggcauguucucugagg

SEQ ID NO: 1768868 - RNA, 18 nt, Human
aggcauguucucugagga

SEQ ID NO: 1768869 - RNA, 19 nt, Human
aggcauguucucugaggac

SEQ ID NO: 1768870 - RNA, 15 nt, Human
aggccauauuuccau

SEQ ID NO: 1768871 - RNA, 14 nt, Human
aggccagugagcca

SEQ ID NO: 1768872 - RNA, 13 nt, Human
aggccggcagccc

SEQ ID NO: 1768873 - RNA, 15 nt, Human
aggccggcagcccca

SEQ ID NO: 1768874 - RNA, 16 nt, Human
aggccggcagccccag

SEQ ID NO: 1768875 - RNA, 19 nt, Human
aggccggcagccccagccu

SEQ ID NO: 1768876 - RNA, 20 nt, Human
aggccggcagccccagccug

SEQ ID NO: 1768877 - RNA, 21 nt, Human
aggccggcagccccagccugc

SEQ ID NO: 1768878 - RNA, 22 nt, Human
aggccggcagccccagccugcu

SEQ ID NO: 1768879 - RNA, 23 nt, Human
aggccggcagccccagccugcua

SEQ ID NO: 1768880 - RNA, 19 nt, Human
aggccggcgagcccugugg

SEQ ID NO: 1768881 - RNA, 16 nt, Human
aggcccugcugaguca

SEQ ID NO: 1768882 - RNA, 13 nt, Human
agggccugcugga

SEQ ID NO: 1768883 - RNA, 14 nt, Human
agggccugcuggag

SEQ ID NO: 1768884 - RNA, 15 nt, Human
agggccugcuggagg

SEQ ID NO: 1768885 - RNA, 16 nt, Human
agggccugcuggaggc

SEQ ID NO: 1768886 - RNA, 17 nt, Human
agggccugcuggaggcc

SEQ ID NO: 1768887 - RNA, 18 nt, Human
agggccugcuggaggccu

SEQ ID NO: 1768888 - RNA, 19 nt, Human
agggccugcuggaggccuc

SEQ ID NO: 1768889 - RNA, 21 nt, Human
agggccugcuggaggccucag

SEQ ID NO: 1768890 - RNA, 22 nt, Human
agggccugcuggaggccucagg

SEQ ID NO: 1768891 - RNA, 23 nt, Human
agggccugcuggaggccucaggu

SEQ ID NO: 1768892 - RNA, 16 nt, Human
aggggccccccugccc

SEQ ID NO: 1768893 - RNA, 12 nt, Human
agggccugcugg

SEQ ID NO: 1768894 - RNA, 18 nt, Human
aggggccccccugcccug

SEQ ID NO: 1768895 - RNA, 20 nt, Human
aggggccccccugcccugug

SEQ ID NO: 1768896 - RNA, 21 nt, Human
aggggccccccugcccugugg

SEQ ID NO: 1768897 - RNA, 22 nt, Human
aggggccccccugcccuguggg

SEQ ID NO: 1768898 - RNA, 15 nt, Human
agggucagaaacagg

SEQ ID NO: 1768899 - RNA, 19 nt, Human
agggucagacgccugagga

SEQ ID NO: 1768900 - RNA, 19 nt, Human
agggucagaaacaggaccg

SEQ ID NO: 1768901 - RNA, 23 nt, Human
agggccugcaggaccugccugua

SEQ ID NO: 1768902 - RNA, 20 nt, Human
agggccugcaggaccugccu

SEQ ID NO: 1768903 - RNA, 22 nt, Human
agggccugcaggaccugccugu

SEQ ID NO: 1768904 - RNA, 22 nt, Human
agggccugagccuggccagccu

SEQ ID NO: 1768905 - RNA, 17 nt, Human
agggcaagcuccgcagg

SEQ ID NO: 1768906 - RNA, 19 nt, Human
agggcaagcuccgcaggac

SEQ ID NO: 1768907 - RNA, 20 nt, Human
agggcaagcuccgcaggacu

SEQ ID NO: 1768908 - RNA, 21 nt, Human
agggcaagcuccgcaggacuu

SEQ ID NO: 1768909 - RNA, 20 nt, Human
agggccugagccuggccagc

SEQ ID NO: 1768910 - RNA, 21 nt, Human
agggauguuauuauccuuggg

SEQ ID NO: 1768911 - RNA, 15 nt, Human
agggaucccucaucu

SEQ ID NO: 1768912 - RNA, 16 nt, Human
agggaucccucaucug

SEQ ID NO: 1768913 - RNA, 19 nt, Human
agggaucccucaucugucc

SEQ ID NO: 1768914 - RNA, 22 nt, Human
agggaucccucaucugucccuc

SEQ ID NO: 1768915 - RNA, 20 nt, Human
agggucucacuauguugccc

SEQ ID NO: 1768916 - RNA, 22 nt, Human
aggguuuugccauguuggccag

SEQ ID NO: 1768917 - RNA, 23 nt, Human
aggguuuugccauguuggccagg

SEQ ID NO: 1768918 - RNA, 16 nt, Human
agguaacaggcagaua

SEQ ID NO: 1768919 - RNA, 13 nt, Human
agguaacaggcag

SEQ ID NO: 1768920 - RNA, 14 nt, Human
agguaacaggcaga

SEQ ID NO: 1768921 - RNA, 17 nt, Human
agguccuccccucucuu

SEQ ID NO: 1768922 - RNA, 18 nt, Human
agguccuccccucucuug

SEQ ID NO: 1768923 - RNA, 20 nt, Human
aggucucauagguugagcaa

SEQ ID NO: 1768924 - RNA, 22 nt, Human
agcugguuuuuagcggagacgg

SEQ ID NO: 1768925 - RNA, 18 nt, Human
agcuggucccacucaguc

SEQ ID NO: 1768926 - RNA, 19 nt, Human
agcuggucccacucagucc

SEQ ID NO: 1768927 - RNA, 13 nt, Human
agcugcugacagu

SEQ ID NO: 1768928 - RNA, 14 nt, Human
agcugcugacagug

SEQ ID NO: 1768929 - RNA, 16 nt, Human
agcuggucccacucag

SEQ ID NO: 1768930 - RNA, 17 nt, Human
agcuggucccacucagu

SEQ ID NO: 1768931 - RNA, 21 nt, Human
agcugcgguccacccaggagc

SEQ ID NO: 1768932 - RNA, 12 nt, Human
agcugcugacag

SEQ ID NO: 1768933 - RNA, 19 nt, Human
agcugcgguccacccagga

SEQ ID NO: 1768934 - RNA, 20 nt, Human
agcugcgguccacccaggag

SEQ ID NO: 1768935 - RNA, 13 nt, Human
agcugcgguccac

SEQ ID NO: 1768936 - RNA, 16 nt, Human
agcugcgguccaccca

SEQ ID NO: 1768937 - RNA, 17 nt, Human
agcugcgguccacccag

SEQ ID NO: 1768938 - RNA, 18 nt, Human
agcugcgguccacccagg

SEQ ID NO: 1768939 - RNA, 15 nt, Human
agcugaggcagcagu

SEQ ID NO: 1768940 - RNA, 16 nt, Human
agcugaggcagcagug

SEQ ID NO: 1768941 - RNA, 17 nt, Human
agcugaggcagcagugu

SEQ ID NO: 1768942 - RNA, 13 nt, Human
agcuaauuuacug

SEQ ID NO: 1768943 - RNA, 13 nt, Human
agcgagcccuggu

SEQ ID NO: 1768944 - RNA, 19 nt, Human
agcgagcccugguggcagu

SEQ ID NO: 1768945 - RNA, 12 nt, Human
agcgacuaaacu

SEQ ID NO: 1768946 - RNA, 20 nt, Human
agcgaggagaugcuccuugg

SEQ ID NO: 1768947 - RNA, 15 nt, Human
agcgaggaggcucca

SEQ ID NO: 1768948 - RNA, 19 nt, Human
agcgaggaggcuccagagg

SEQ ID NO: 1768949 - RNA, 19 nt, Human
agcucaccagccccagugc

SEQ ID NO: 1768950 - RNA, 20 nt, Human
agcucaccagccccagugcc

SEQ ID NO: 1768951 - RNA, 18 nt, Human
agcguuuuguugagcaug

SEQ ID NO: 1768952 - RNA, 17 nt, Human
agcuaaaccaaggacug

SEQ ID NO: 1768953 - RNA, 18 nt, Human
agcuaaaccaaggacuga

SEQ ID NO: 1768954 - RNA, 19 nt, Human
agcuaaaccaaggacugag

SEQ ID NO: 1768955 - RNA, 16 nt, Human
agcucaccagccccag

SEQ ID NO: 1768956 - RNA, 19 nt, Human
agcucaaggaaaggccuga

SEQ ID NO: 1768957 - RNA, 23 nt, Human
agcucaacuagugggguuuccug

SEQ ID NO: 1768958 - RNA, 20 nt, Human
aggaaccgugguaugucugc

SEQ ID NO: 1768959 - RNA, 22 nt, Human
aggaaccgugguaugucugcca

SEQ ID NO: 1768960 - RNA, 23 nt, Human
aggaaccgugguaugucugccau

SEQ ID NO: 1768961 - RNA, 19 nt, Human
aggaacccuuacaguagga

SEQ ID NO: 1768962 - RNA, 16 nt, Human
aggaaccucgaguacu

SEQ ID NO: 1768963 - RNA, 17 nt, Human
aggaaccucgaguacug

SEQ ID NO: 1768964 - RNA, 18 nt, Human
aggaaccucgaguacugu

SEQ ID NO: 1768965 - RNA, 20 nt, Human
aggaaccucgaguacugugg

SEQ ID NO: 1768966 - RNA, 14 nt, Human
aggaaguucagauc

SEQ ID NO: 1768967 - RNA, 16 nt, Human
aggaaggggccagagg

SEQ ID NO: 1768968 - RNA, 18 nt, Human
aggaaggggccagaggcu

SEQ ID NO: 1768969 - RNA, 20 nt, Human
aggaaggggccagaggcucg

SEQ ID NO: 1768970 - RNA, 14 nt, Human
aggaaguaggaagu

SEQ ID NO: 1768971 - RNA, 15 nt, Human
aggaaguaggaagua

SEQ ID NO: 1768972 - RNA, 18 nt, Human
aggaagucaaagcaagga

SEQ ID NO: 1768973 - RNA, 19 nt, Human
agcuucauuuccugugucu

SEQ ID NO: 1768974 - RNA, 18 nt, Human
agcuucauuuccuguguc

SEQ ID NO: 1768975 - RNA, 19 nt, Human
agcuucauggcagaaggca

SEQ ID NO: 1768976 - RNA, 16 nt, Human
agcuucauguggcuuc

SEQ ID NO: 1768977 - RNA, 20 nt, Human
agcuucauguggcuucccuu

SEQ ID NO: 1768978 - RNA, 18 nt, Human
agcuucacuguaaaauaa

SEQ ID NO: 1768979 - RNA, 13 nt, Human
aggaccugccugu

SEQ ID NO: 1768980 - RNA, 14 nt, Human
aggaccugccugua

SEQ ID NO: 1768981 - RNA, 19 nt, Human
aggaccagucaaccugggc

SEQ ID NO: 1768982 - RNA, 20 nt, Human
aggaccagucaaccugggca

SEQ ID NO: 1768983 - RNA, 12 nt, Human
aggacccaagca

SEQ ID NO: 1768984 - RNA, 17 nt, Human
aggaauauaugugugcc

SEQ ID NO: 1768985 - RNA, 22 nt, Human
aggaauaucaauauaauguuuu

SEQ ID NO: 1768986 - RNA, 19 nt, Human
aggaaucacguuagaggaa

SEQ ID NO: 1768987 - RNA, 17 nt, Human
aaacagcuaaugggaca

SEQ ID NO: 1768988 - RNA, 11 nt, Human
aaacagcugcc

SEQ ID NO: 1768989 - RNA, 12 nt, Human
aaacagcugccu

SEQ ID NO: 1768990 - RNA, 13 nt, Human
aaacagcugccuu

SEQ ID NO: 1768991 - RNA, 14 nt, Human
aaacagcugccuua

SEQ ID NO: 1768992 - RNA, 15 nt, Human
aaacagcugccuuag

SEQ ID NO: 1768993 - RNA, 17 nt, Human
aaacagcugccuuagcu

SEQ ID NO: 1768994 - RNA, 18 nt, Human
aaacagcugccuuagcuu

SEQ ID NO: 1768995 - RNA, 19 nt, Human
aaacagcugccuuagcuuc

SEQ ID NO: 1768996 - RNA, 21 nt, Human
aaacagcugccuuagcuucag

SEQ ID NO: 1768997 - RNA, 22 nt, Human
aaacagcugccuuagcuucagg

SEQ ID NO: 1768998 - RNA, 13 nt, Human
aaaauucugaauu

SEQ ID NO: 1768999 - RNA, 15 nt, Human
aaaauucugaauuuu

SEQ ID NO: 1769000 - RNA, 21 nt, Human
aaaauucugaauuuuggggau

SEQ ID NO: 1769001 - RNA, 15 nt, Human
aaaauucuaaaugua

SEQ ID NO: 1769002 - RNA, 21 nt, Human
aaaaucagccaauuauguuaa

SEQ ID NO: 1769003 - RNA, 20 nt, Human
aaaaucagccaauuauguua

SEQ ID NO: 1769004 - RNA, 19 nt, Human
aaaaucagccaauuauguu

SEQ ID NO: 1769005 - RNA, 18 nt, Human
aaaaucagccaauuaugu

SEQ ID NO: 1769006 - RNA, 17 nt, Human
aaaaucagccaauuaug

SEQ ID NO: 1769007 - RNA, 14 nt, Human
aaaaucagccaauu

SEQ ID NO: 1769008 - RNA, 15 nt, Human
aaaaucaauuaacca

SEQ ID NO: 1769009 - RNA, 12 nt, Human
aaaaucaacuuu

SEQ ID NO: 1769010 - RNA, 13 nt, Human
aaaaucaacuuuu

SEQ ID NO: 1769011 - RNA, 20 nt, Human
aaaaucaacuuuuuauugcc

SEQ ID NO: 1769012 - RNA, 21 nt, Human
aaaaucaacuuuuuauugccu

SEQ ID NO: 1769013 - RNA, 22 nt, Human
aaaaucaacuuuuuauugccuu

SEQ ID NO: 1769014 - RNA, 23 nt, Human
aaaaucaacuuuuuauugccuuc

SEQ ID NO: 1769015 - RNA, 23 nt, Human
aaaauuauaggaauaucaauaua

SEQ ID NO: 1769016 - RNA, 13 nt, Human
aaaauuauuugca

SEQ ID NO: 1769017 - RNA, 14 nt, Human
aaaauuauuugcau

SEQ ID NO: 1769018 - RNA, 21 nt, Human
aaagauacagaacucuuucaa

SEQ ID NO: 1769019 - RNA, 21 nt, Human
aaagauaauauuuuacauaca

SEQ ID NO: 1769020 - RNA, 13 nt, Human
aaagaaaauuccu

SEQ ID NO: 1769021 - RNA, 16 nt, Human
aaagaaaauuccuaua

SEQ ID NO: 1769022 - RNA, 17 nt, Human
aaacucuugaccucagg

SEQ ID NO: 1769023 - RNA, 23 nt, Human
aaagcauuugaaugcauuuuguu

SEQ ID NO: 1769024 - RNA, 22 nt, Human
aaagcauuugaaugcauuuugu

SEQ ID NO: 1769025 - RNA, 20 nt, Human
aaagcauuugaaugcauuuu

SEQ ID NO: 1769026 - RNA, 19 nt, Human
aaagcauuugaaugcauuu

SEQ ID NO: 1769027 - RNA, 17 nt, Human
aaagcauuugaaugcau

SEQ ID NO: 1769028 - RNA, 15 nt, Human
aaagccaaagcuagg

SEQ ID NO: 1769029 - RNA, 15 nt, Human
aaagcauuugaaugc

SEQ ID NO: 1769030 - RNA, 14 nt, Human
aaagcauuugaaug

SEQ ID NO: 1769031 - RNA, 13 nt, Human
aaagcauuugaau

SEQ ID NO: 1769032 - RNA, 17 nt, Human
aaaggccaaaccucugu

SEQ ID NO: 1769033 - RNA, 14 nt, Human
aaaggccaaaccuc

SEQ ID NO: 1769034 - RNA, 15 nt, Human
aaaggccaaaccucu

SEQ ID NO: 1769035 - RNA, 16 nt, Human
aaaggcaguauuuugu

SEQ ID NO: 1769036 - RNA, 18 nt, Human
aaaggcaguauuuugugu

SEQ ID NO: 1769037 - RNA, 19 nt, Human
aaaggcaguauuuuguguc

SEQ ID NO: 1769038 - RNA, 16 nt, Human
aaauaaacacuacaga

SEQ ID NO: 1769039 - RNA, 13 nt, Human
aaauaaauuguau

SEQ ID NO: 1769040 - RNA, 19 nt, Human
aaauaaauuguauauucac

SEQ ID NO: 1769041 - RNA, 18 nt, Human
aaauaaauuguauauuca

SEQ ID NO: 1769042 - RNA, 15 nt, Human
aaauaaauuguauau

SEQ ID NO: 1769043 - RNA, 14 nt, Human
aaauaaauuguaua

SEQ ID NO: 1769044 - RNA, 22 nt, Human
aaauaaauuguauauucacuuu

SEQ ID NO: 1769045 - RNA, 21 nt, Human
aaauaaauuguauauucacuu

SEQ ID NO: 1769046 - RNA, 20 nt, Human
aaauaaauuguauauucacu

SEQ ID NO: 1769047 - RNA, 23 nt, Human
aaagugcagcuccguuuggcagu

SEQ ID NO: 1769048 - RNA, 14 nt, Human
aacgcuccuuugug

SEQ ID NO: 1769049 - RNA, 21 nt, Human
aacugaaggcuaaaaagcaac

SEQ ID NO: 1769050 - RNA, 15 nt, Human
aacgaaccuuggccu

SEQ ID NO: 1769051 - RNA, 18 nt, Human
aacgaaccuuggccuggg

SEQ ID NO: 1769052 - RNA, 21 nt, Human
aacgaaccuuggccugggccg

SEQ ID NO: 1769053 - RNA, 22 nt, Human
aacauccuaucaacaacaaggu

SEQ ID NO: 1769054 - RNA, 22 nt, Human
aacaggaaaggcucgaaauaca

SEQ ID NO: 1769055 - RNA, 12 nt, Human
aacaggaccggg

SEQ ID NO: 1769056 - RNA, 17 nt, Human
aacaggaccggguggaa

SEQ ID NO: 1769057 - RNA, 16 nt, Human
aacagcuaaugggaca

SEQ ID NO: 1769058 - RNA, 16 nt, Human
aacccuucaucuuccu

SEQ ID NO: 1769059 - RNA, 19 nt, Human
aacccuucaucuuccugug

SEQ ID NO: 1769060 - RNA, 22 nt, Human
aacccuucaucuuccugugucc

SEQ ID NO: 1769061 - RNA, 12 nt, Human
aacaaauaugca

SEQ ID NO: 1769062 - RNA, 13 nt, Human
aacaaauaugcaa

SEQ ID NO: 1769063 - RNA, 11 nt, Human
aaaucugccug

SEQ ID NO: 1769064 - RNA, 13 nt, Human
aaaucugccuggg

SEQ ID NO: 1769065 - RNA, 15 nt, Human
aaaucugccuggguu

SEQ ID NO: 1769066 - RNA, 18 nt, Human
aauaaaauuuuuuuucau

SEQ ID NO: 1769067 - RNA, 19 nt, Human
aauaaaauuuuuuuucaug

SEQ ID NO: 1769068 - RNA, 22 nt, Human
aauaaaauuuuuuuucauguuu

SEQ ID NO: 1769069 - RNA, 18 nt, Human
aauaaagccuucaaacuc

SEQ ID NO: 1769070 - RNA, 19 nt, Human
aaguucuguacucaaaugu

SEQ ID NO: 1769071 - RNA, 13 nt, Human
aaguaggaaguaa

SEQ ID NO: 1769072 - RNA, 17 nt, Human
aauaauaugcauuguca

SEQ ID NO: 1769073 - RNA, 11 nt, Human
aauaauaugca

SEQ ID NO: 1769074 - RNA, 12 nt, Human
aauaauaugcau

SEQ ID NO: 1769075 - RNA, 13 nt, Human
aauaauaugcauu

SEQ ID NO: 1769076 - RNA, 15 nt, Human
aauaauaugcauugu

SEQ ID NO: 1769077 - RNA, 16 nt, Human
aauaauauacuugugg

SEQ ID NO: 1769078 - RNA, 13 nt, Human
aauaauauacuug

SEQ ID NO: 1769079 - RNA, 12 nt, Human
aauaauauacuu

SEQ ID NO: 1769080 - RNA, 23 nt, Human
aauauacuuguggacuaaaagau

SEQ ID NO: 1769081 - RNA, 22 nt, Human
aauauacuuguggacuaaaaga

SEQ ID NO: 1769082 - RNA, 17 nt, Human
aauauacuuguggacua

SEQ ID NO: 1769083 - RNA, 17 nt, Human
aauauaaauucacuuuc

SEQ ID NO: 1769084 - RNA, 17 nt, Human
aauaugcugcaacaaaa

SEQ ID NO: 1769085 - RNA, 18 nt, Human
aauaugcugcaacaaaau

SEQ ID NO: 1769086 - RNA, 21 nt, Human
aauaugcugcaacaaaaugua

SEQ ID NO: 1769087 - RNA, 13 nt, Human
aauacuugaacuu

SEQ ID NO: 1769088 - RNA, 14 nt, Human
aauacuugaacuug

SEQ ID NO: 1769089 - RNA, 18 nt, Human
aauacuugaacuugccuc

SEQ ID NO: 1769090 - RNA, 19 nt, Human
aauacuugaacuugccucu

SEQ ID NO: 1769091 - RNA, 20 nt, Human
aauacuugaacuugccucuu

SEQ ID NO: 1769092 - RNA, 15 nt, Human
aauacuugaacuugu

SEQ ID NO: 1769093 - RNA, 16 nt, Human
aaugcccuuaaaucau

SEQ ID NO: 1769094 - RNA, 18 nt, Human
aaugccgcgaugggucag

SEQ ID NO: 1769095 - RNA, 23 nt, Human
aaugccgcgaugggucagguagg

SEQ ID NO: 1769096 - RNA, 14 nt, Human
aaugguccaggaga

SEQ ID NO: 1769097 - RNA, 19 nt, Human
aaugguccaggagaaggcc

SEQ ID NO: 1769098 - RNA, 13 nt, Human
aaugggacacuaa

SEQ ID NO: 1769099 - RNA, 16 nt, Human
aaugcucauaacggau

SEQ ID NO: 1769100 - RNA, 15 nt, Human
aaugauagcuacugu

SEQ ID NO: 1769101 - RNA, 22 nt, Human
aauccaagauauuuuaaaaucu

SEQ ID NO: 1769102 - RNA, 15 nt, Human
aagcgauucuucugc

SEQ ID NO: 1769103 - RNA, 14 nt, Human
aagcgauucuucug

SEQ ID NO: 1769104 - RNA, 16 nt, Human
aagcgauucuucugcu

SEQ ID NO: 1769105 - RNA, 17 nt, Human
aagcgauucuucugcuu

SEQ ID NO: 1769106 - RNA, 16 nt, Human
aagcugcugacagugu

SEQ ID NO: 1769107 - RNA, 21 nt, Human
aagcugcuuuaaaaaaauaca

SEQ ID NO: 1769108 - RNA, 19 nt, Human
aaggaaucacguuagagga

SEQ ID NO: 1769109 - RNA, 18 nt, Human
aaggaauuauagaccucu

SEQ ID NO: 1769110 - RNA, 21 nt, Human
aagcgugagccacugcaccgg

SEQ ID NO: 1769111 - RNA, 17 nt, Human
aagcgugagccacugca

SEQ ID NO: 1769112 - RNA, 20 nt, Human
aagcgugagccacugcaccg

SEQ ID NO: 1769113 - RNA, 14 nt, Human
aagcugcugacagu

SEQ ID NO: 1769114 - RNA, 15 nt, Human
aaggcaaacccauca

SEQ ID NO: 1769115 - RNA, 20 nt, Human
aaggcaaacccaucaacaaa

SEQ ID NO: 1769116 - RNA, 21 nt, Human
aaggcaaaggguccagaagga

SEQ ID NO: 1769117 - RNA, 14 nt, Human
aaguagccucuccu

SEQ ID NO: 1769118 - RNA, 22 nt, Human
aagguguucauucacuugcauu

SEQ ID NO: 1769119 - RNA, 17 nt, Human
aagguucacuaaagcag

SEQ ID NO: 1769120 - RNA, 23 nt, Human
aagguuccgcuuggagcagaggg

SEQ ID NO: 1769121 - RNA, 22 nt, Human
aagguuccaaucagaucuuuau

SEQ ID NO: 1769122 - RNA, 20 nt, Human
aagggacuuggaagcuccgc

SEQ ID NO: 1769123 - RNA, 13 nt, Human
aagggcagaauga

SEQ ID NO: 1769124 - RNA, 22 nt, Human
aagggauguuauuauccuuggg

SEQ ID NO: 1769125 - RNA, 20 nt, Human
aagagaaugaugcucaaaau

SEQ ID NO: 1769126 - RNA, 17 nt, Human
aagagagaacaggacua

SEQ ID NO: 1769127 - RNA, 16 nt, Human
aacuguuucaaagcca

SEQ ID NO: 1769128 - RNA, 23 nt, Human
aagacagugaaagaaaauaacaa

SEQ ID NO: 1769129 - RNA, 12 nt, Human
aagauuccaaaa

SEQ ID NO: 1769130 - RNA, 17 nt, Human
aagauuccaaaaagcac

SEQ ID NO: 1769131 - RNA, 20 nt, Human
aagauuccaaaaagcacaua

SEQ ID NO: 1769132 - RNA, 16 nt, Human
aagauucuuucccaau

SEQ ID NO: 1769133 - RNA, 13 nt, Human
aagauucuuuccc

SEQ ID NO: 1769134 - RNA, 14 nt, Human
accaugaaacaaag

SEQ ID NO: 1769135 - RNA, 15 nt, Human
accaugaaacaaagc

SEQ ID NO: 1769136 - RNA, 15 nt, Human
acccaucaacaaaaa

SEQ ID NO: 1769137 - RNA, 15 nt, Human
acccacccuccuuuc

SEQ ID NO: 1769138 - RNA, 14 nt, Human
acccauacaccccc

SEQ ID NO: 1769139 - RNA, 14 nt, Human
acauuuauucugcu

SEQ ID NO: 1769140 - RNA, 16 nt, Human
accagccccagugccc

SEQ ID NO: 1769141 - RNA, 17 nt, Human
accagccccagugccca

SEQ ID NO: 1769142 - RNA, 18 nt, Human
accagccccagugcccac

SEQ ID NO: 1769143 - RNA, 19 nt, Human
accagccccagugcccaca

SEQ ID NO: 1769144 - RNA, 20 nt, Human
accagccccagugcccacag

SEQ ID NO: 1769145 - RNA, 15 nt, Human
accaaggacugagca

SEQ ID NO: 1769146 - RNA, 23 nt, Human
acauuucucuaagagaacaaugu

SEQ ID NO: 1769147 - RNA, 14 nt, Human
accaagaaagcagg

SEQ ID NO: 1769148 - RNA, 20 nt, Human
acaggcaagcaccuccugcc

SEQ ID NO: 1769149 - RNA, 23 nt, Human
acaggcaagcaccuccugccucg

SEQ ID NO: 1769150 - RNA, 16 nt, Human
acagcucuguccuggg

SEQ ID NO: 1769151 - RNA, 17 nt, Human
acagcucuguccuggga

SEQ ID NO: 1769152 - RNA, 16 nt, Human
acagcuccuucugucc

SEQ ID NO: 1769153 - RNA, 18 nt, Human
acagcuccuucuguccua

SEQ ID NO: 1769154 - RNA, 23 nt, Human
acagcuccuucuguccuacucug

SEQ ID NO: 1769155 - RNA, 14 nt, Human
acagcucuguccug

SEQ ID NO: 1769156 - RNA, 22 nt, Human
acagugagucgaggacagggag

SEQ ID NO: 1769157 - RNA, 19 nt, Human
acaggugugaaccaccaca

SEQ ID NO: 1769158 - RNA, 22 nt, Human
acaggugugagucaccaagccc

SEQ ID NO: 1769159 - RNA, 23 nt, Human
acaggugugagucaccaagccca

SEQ ID NO: 1769160 - RNA, 14 nt, Human
acaggcaaugcugg

SEQ ID NO: 1769161 - RNA, 20 nt, Human
acagggcccuguugaauuuu

SEQ ID NO: 1769162 - RNA, 15 nt, Human
acaguggggaagagu

SEQ ID NO: 1769163 - RNA, 23 nt, Human
acagugagucgaggacagggagg

SEQ ID NO: 1769164 - RNA, 21 nt, Human
acauccuccacguucugcuca

SEQ ID NO: 1769165 - RNA, 14 nt, Human
acacugggaggcca

SEQ ID NO: 1769166 - RNA, 15 nt, Human
acacugggaggccag

SEQ ID NO: 1769167 - RNA, 20 nt, Human
acacugggaggccagugagc

SEQ ID NO: 1769168 - RNA, 16 nt, Human
acagaaccuuguuauu

SEQ ID NO: 1769169 - RNA, 18 nt, Human
acagaacucuuucaaaac

SEQ ID NO: 1769170 - RNA, 20 nt, Human
acagaacucuuucaaaaccu

SEQ ID NO: 1769171 - RNA, 23 nt, Human
acagaaccuuguuauuucucaga

SEQ ID NO: 1769172 - RNA, 17 nt, Human
acagaaccuuguuauuu

SEQ ID NO: 1769173 - RNA, 19 nt, Human
acagaaccuuguuauuucu

SEQ ID NO: 1769174 - RNA, 22 nt, Human
acagaaccuuguuauuucucag

SEQ ID NO: 1769175 - RNA, 13 nt, Human
acagaggcagccc

SEQ ID NO: 1769176 - RNA, 16 nt, Human
acagaggaugagcucu

SEQ ID NO: 1769177 - RNA, 17 nt, Human
acagaggccaugggccu

SEQ ID NO: 1769178 - RNA, 20 nt, Human
acagaggaugagcucuaccc

SEQ ID NO: 1769179 - RNA, 21 nt, Human
acagaggccaugggccuccug

SEQ ID NO: 1769180 - RNA, 23 nt, Human
acagaggccaugggccuccugug

SEQ ID NO: 1769181 - RNA, 12 nt, Human
acagacacacac

SEQ ID NO: 1769182 - RNA, 13 nt, Human
acagacacacaca

SEQ ID NO: 1769183 - RNA, 14 nt, Human
acagacacacacac

SEQ ID NO: 1769184 - RNA, 22 nt, Human
acagaagcucuuacucuuuccu

SEQ ID NO: 1769185 - RNA, 19 nt, Human
acacaaaaguuucucuuuu

SEQ ID NO: 1769186 - RNA, 22 nt, Human
acacagcucuucuccaggcugu

SEQ ID NO: 1769187 - RNA, 20 nt, Human
acacagcucuucuccaggcu

SEQ ID NO: 1769188 - RNA, 21 nt, Human
acacagcucuucuccaggcug

SEQ ID NO: 1769189 - RNA, 16 nt, Human
acaaggauugcuacug

SEQ ID NO: 1769190 - RNA, 12 nt, Human
acaaagaaaauu

SEQ ID NO: 1769191 - RNA, 12 nt, Human
acaauuguuugu

SEQ ID NO: 1769192 - RNA, 15 nt, Human
acaauucuacauugu

SEQ ID NO: 1769193 - RNA, 23 nt, Human
acaauuccucuacuaacaaucag

SEQ ID NO: 1769194 - RNA, 22 nt, Human
acaauuccucuacuaacaauca

SEQ ID NO: 1769195 - RNA, 12 nt, Human
aauuguauauuc

SEQ ID NO: 1769196 - RNA, 14 nt, Human
aauuguaacuguuc

SEQ ID NO: 1769197 - RNA, 16 nt, Human
aauuguaacuguucuu

SEQ ID NO: 1769198 - RNA, 17 nt, Human
aauuguauauucacuuu

SEQ ID NO: 1769199 - RNA, 16 nt, Human
aauuguauauucacuu

SEQ ID NO: 1769200 - RNA, 14 nt, Human
aauuguauauucac

SEQ ID NO: 1769201 - RNA, 13 nt, Human
aauuguauauuca

SEQ ID NO: 1769202 - RNA, 16 nt, Human
aaugucacaggcaggu

SEQ ID NO: 1769203 - RNA, 19 nt, Human
aaugucacaggcaggucca

SEQ ID NO: 1769204 - RNA, 18 nt, Human
aauugggucauagaaauu

SEQ ID NO: 1769205 - RNA, 16 nt, Human
aauuuauuuccuaguu

SEQ ID NO: 1769206 - RNA, 22 nt, Human
aauuuauuuccuaguucuguag

SEQ ID NO: 1769207 - RNA, 19 nt, Human
aauuuauuuccuaguucug

SEQ ID NO: 1769208 - RNA, 16 nt, Human
aauuuauuuuauaaga

SEQ ID NO: 1769209 - RNA, 17 nt, Human
aauuuauuuuauaagaa

SEQ ID NO: 1769210 - RNA, 18 nt, Human
aauuuauuuuauaagaaa

SEQ ID NO: 1769211 - RNA, 21 nt, Human
aauuuauuuuauaagaaaaac

SEQ ID NO: 1769212 - RNA, 22 nt, Human
aauuuauuuuauaagaaaaacu

SEQ ID NO: 1769213 - RNA, 23 nt, Human
aauuuauuuuauaagaaaaacuu

SEQ ID NO: 1769214 - RNA, 20 nt, Human
aauugugccgagaaaagcau

SEQ ID NO: 1769215 - RNA, 11 nt, Human
aauugucccuu

SEQ ID NO: 1769216 - RNA, 16 nt, Human
aauugucccuuaaaca

SEQ ID NO: 1769217 - RNA, 18 nt, Human
aauugucccuuaaacaaa

SEQ ID NO: 1769218 - RNA, 18 nt, Human
aauuuuggggauuuucaa

SEQ ID NO: 1769219 - RNA, 22 nt, Human
aauuuuggggauuuucaaaaga

SEQ ID NO: 1769220 - RNA, 16 nt, Human
acugcuuuuggucugu

SEQ ID NO: 1769221 - RNA, 20 nt, Human
acugcuuuuggucuguguga

SEQ ID NO: 1769222 - RNA, 15 nt, Human
acugcuuuuggucug

SEQ ID NO: 1769223 - RNA, 19 nt, Human
acucugucucaaaaaaaca

SEQ ID NO: 1769224 - RNA, 21 nt, Human
acucugugucagguggggcag

SEQ ID NO: 1769225 - RNA, 19 nt, Human
acucugugucagguggggc

SEQ ID NO: 1769226 - RNA, 23 nt, Human
acugacauuguuggccaaagcca

SEQ ID NO: 1769227 - RNA, 12 nt, Human
acugaugggcaa

SEQ ID NO: 1769228 - RNA, 22 nt, Human
acugaugggcaacccccagccu

SEQ ID NO: 1769229 - RNA, 20 nt, Human
acuucugccauauucuguug

SEQ ID NO: 1769230 - RNA, 22 nt, Human
acugcccggcacagaugcucca

SEQ ID NO: 1769231 - RNA, 14 nt, Human
acuggacaaagaau

SEQ ID NO: 1769232 - RNA, 15 nt, Human
acuggacccuguugc

SEQ ID NO: 1769233 - RNA, 13 nt, Human
acuggaccccagc

SEQ ID NO: 1769234 - RNA, 17 nt, Human
accugcccuaaacccug

SEQ ID NO: 1769235 - RNA, 15 nt, Human
accucaucuucuuca

SEQ ID NO: 1769236 - RNA, 12 nt, Human
accucagggcac

SEQ ID NO: 1769237 - RNA, 20 nt, Human
accgggcacucagaagacac

SEQ ID NO: 1769238 - RNA, 20 nt, Human
accgggccacagagaaagua

SEQ ID NO: 1769239 - RNA, 15 nt, Human
accgggccacagaga

SEQ ID NO: 1769240 - RNA, 19 nt, Human
accgggccacagagaaagu

SEQ ID NO: 1769241 - RNA, 16 nt, Human
accccaagaggaaguu

SEQ ID NO: 1769242 - RNA, 19 nt, Human
accccaagauuucagauau

SEQ ID NO: 1769243 - RNA, 17 nt, Human
acccuguuaccauuuug

SEQ ID NO: 1769244 - RNA, 12 nt, Human
acccuguugcua

SEQ ID NO: 1769245 - RNA, 15 nt, Human
acccuguuccuggag

SEQ ID NO: 1769246 - RNA, 18 nt, Human
acccuguuccuggagguc

SEQ ID NO: 1769247 - RNA, 15 nt, Human
acccuguugcuaagc

SEQ ID NO: 1769248 - RNA, 14 nt, Human
acccuguugcuaag

SEQ ID NO: 1769249 - RNA, 13 nt, Human
acccuuacaguag

SEQ ID NO: 1769250 - RNA, 19 nt, Human
acccuuacaguaggagccc

SEQ ID NO: 1769251 - RNA, 16 nt, Human
acuagggaucccucau

SEQ ID NO: 1769252 - RNA, 11 nt, Human
accugugugcu

SEQ ID NO: 1769253 - RNA, 13 nt, Human
accugugugcuug

SEQ ID NO: 1769254 - RNA, 19 nt, Human
acgcuggagugcagugagc

SEQ ID NO: 1769255 - RNA, 21 nt, Human
acgcagcaggaggccaggccg

SEQ ID NO: 1769256 - RNA, 14 nt, Human
acgcagcaggaggc

SEQ ID NO: 1769257 - RNA, 15 nt, Human
acggaauaguuggcu

SEQ ID NO: 1769258 - RNA, 23 nt, Human
acgucugacaggcaaugcuggcu

SEQ ID NO: 1769259 - RNA, 18 nt, Human
acggagccacuccucuga

SEQ ID NO: 1769260 - RNA, 19 nt, Human
acggagccacuccucugac

SEQ ID NO: 1769261 - RNA, 20 nt, Human
acggagccacuccucugacu

SEQ ID NO: 1769262 - RNA, 17 nt, Human
cacaguucaauucucau

SEQ ID NO: 1769263 - RNA, 23 nt, Human
cacaguucaaaauucuaaaugua

SEQ ID NO: 1769264 - RNA, 19 nt, Human
caagaggaaguucagaucu

SEQ ID NO: 1769265 - RNA, 20 nt, Human
caagaggaaguucagaucuu

SEQ ID NO: 1769266 - RNA, 18 nt, Human
caacgugcauugugcuuc

SEQ ID NO: 1769267 - RNA, 18 nt, Human
caacuuguauccaggccu

SEQ ID NO: 1769268 - RNA, 20 nt, Human
caacuuguauccaggccugg

SEQ ID NO: 1769269 - RNA, 23 nt, Human
caaagugcugggauuacaagcgu

SEQ ID NO: 1769270 - RNA, 17 nt, Human
caaaguguuuuguacca

SEQ ID NO: 1769271 - RNA, 19 nt, Human
caaaguguuuuguaccagu

SEQ ID NO: 1769272 - RNA, 23 nt, Human
caaaguguuuuguaccagugaau

SEQ ID NO: 1769273 - RNA, 14 nt, Human
caaaguucaacuug

SEQ ID NO: 1769274 - RNA, 13 nt, Human
caaagugcuggga

SEQ ID NO: 1769275 - RNA, 19 nt, Human
caaagugcugggauuacaa

SEQ ID NO: 1769276 - RNA, 23 nt, Human
caaauaaagagagaacaggacua

SEQ ID NO: 1769277 - RNA, 21 nt, Human
caacaggccauugugaaccaa

SEQ ID NO: 1769278 - RNA, 12 nt, Human
caacaggcuggg

SEQ ID NO: 1769279 - RNA, 13 nt, Human
caacaggcugggc

SEQ ID NO: 1769280 - RNA, 17 nt, Human
caaacucuugaccucag

SEQ ID NO: 1769281 - RNA, 19 nt, Human
caaacucuugaccucaggu

SEQ ID NO: 1769282 - RNA, 20 nt, Human
caaacucuugaccucaggug

SEQ ID NO: 1769283 - RNA, 23 nt, Human
caaaccucuguucaguguaaaua

SEQ ID NO: 1769284 - RNA, 15 nt, Human
caaaccuuaucucca

SEQ ID NO: 1769285 - RNA, 17 nt, Human
caaaccuuaucuccaca

SEQ ID NO: 1769286 - RNA, 21 nt, Human
caaaccuuaucuccacaaccu

SEQ ID NO: 1769287 - RNA, 21 nt, Human
caaacucuugaccucagguga

SEQ ID NO: 1769288 - RNA, 22 nt, Human
caaaauuugcugccaaaugcgu

SEQ ID NO: 1769289 - RNA, 21 nt, Human
caaaauuuauuuuauaagaaa

SEQ ID NO: 1769290 - RNA, 22 nt, Human
caaaauuuauuuuauaagaaaa

SEQ ID NO: 1769291 - RNA, 23 nt, Human
caaaauuuauuuuauaagaaaaa

SEQ ID NO: 1769292 - RNA, 14 nt, Human
caaacaaauaugca

SEQ ID NO: 1769293 - RNA, 15 nt, Human
caaacaaauaugcaa

SEQ ID NO: 1769294 - RNA, 17 nt, Human
caaacaaauaugcaaaa

SEQ ID NO: 1769295 - RNA, 16 nt, Human
caaaacuccugucuuu

SEQ ID NO: 1769296 - RNA, 14 nt, Human
caaaaguuucucuu

SEQ ID NO: 1769297 - RNA, 16 nt, Human
caaaaucauuuuaaug

SEQ ID NO: 1769298 - RNA, 20 nt, Human
cacagccgauucaccugagc

SEQ ID NO: 1769299 - RNA, 21 nt, Human
cacagccgauucaccugagca

SEQ ID NO: 1769300 - RNA, 19 nt, Human
cacagauguucccccaucu

SEQ ID NO: 1769301 - RNA, 13 nt, Human
cacagaugcucca

SEQ ID NO: 1769302 - RNA, 15 nt, Human
cacagaugcuccagg

SEQ ID NO: 1769303 - RNA, 16 nt, Human
cacagaugcuccaggg

SEQ ID NO: 1769304 - RNA, 18 nt, Human
cacagauagaccuuuuuu

SEQ ID NO: 1769305 - RNA, 19 nt, Human
cacagagaaaguacuucuc

SEQ ID NO: 1769306 - RNA, 20 nt, Human
cacagagaaaguacuucucc

SEQ ID NO: 1769307 - RNA, 21 nt, Human
cacagagaaaguacuucucca

SEQ ID NO: 1769308 - RNA, 14 nt, Human
cacacucccaaggu

SEQ ID NO: 1769309 - RNA, 21 nt, Human
cacacucccaagguuggagcc

SEQ ID NO: 1769310 - RNA, 23 nt, Human
cacacucccaagguuggagccca

SEQ ID NO: 1769311 - RNA, 17 nt, Human
cacacacgcgugcacac

SEQ ID NO: 1769312 - RNA, 20 nt, Human
cacaaaggcaaaggguccag

SEQ ID NO: 1769313 - RNA, 20 nt, Human
cacaauagccgauaucagaa

SEQ ID NO: 1769314 - RNA, 18 nt, Human
cacaaugcaguucugagc

SEQ ID NO: 1769315 - RNA, 15 nt, Human
cacacacacacacaa

SEQ ID NO: 1769316 - RNA, 22 nt, Human
cacaaaauaaccaauccuggac

SEQ ID NO: 1769317 - RNA, 21 nt, Human
caauuccguagccagcugcuc

SEQ ID NO: 1769318 - RNA, 20 nt, Human
caauuccguagccagcugcu

SEQ ID NO: 1769319 - RNA, 21 nt, Human
caagcuggucccacucagucc

SEQ ID NO: 1769320 - RNA, 15 nt, Human
caagcugcucugagc

SEQ ID NO: 1769321 - RNA, 16 nt, Human
caagcugcucugagcc

SEQ ID NO: 1769322 - RNA, 18 nt, Human
caagcugcucugagccac

SEQ ID NO: 1769323 - RNA, 21 nt, Human
caagcugcucugagccacagu

SEQ ID NO: 1769324 - RNA, 22 nt, Human
caagcugcucugagccacagug

SEQ ID NO: 1769325 - RNA, 15 nt, Human
caagcgauucuucug

SEQ ID NO: 1769326 - RNA, 17 nt, Human
caagcgauucuucugcu

SEQ ID NO: 1769327 - RNA, 18 nt, Human
caagcgauucuucugcuu

SEQ ID NO: 1769328 - RNA, 20 nt, Human
caaggaaaaaauaacaauga

SEQ ID NO: 1769329 - RNA, 22 nt, Human
caagcuggucccacucagucca

SEQ ID NO: 1769330 - RNA, 23 nt, Human
caagcuggucccacucaguccau

SEQ ID NO: 1769331 - RNA, 18 nt, Human
caaggaaaaaauaacaau

SEQ ID NO: 1769332 - RNA, 15 nt, Human
caagggaaaagucuc

SEQ ID NO: 1769333 - RNA, 16 nt, Human
caagggaaaagucucu

SEQ ID NO: 1769334 - RNA, 17 nt, Human
caauaaaguauuuaauu

SEQ ID NO: 1769335 - RNA, 16 nt, Human
caauaaaguauuuaau

SEQ ID NO: 1769336 - RNA, 16 nt, Human
caaggguuaaggccug

SEQ ID NO: 1769337 - RNA, 17 nt, Human
caaggguuaaggccuga

SEQ ID NO: 1769338 - RNA, 18 nt, Human
caaggguuaaggccugaa

SEQ ID NO: 1769339 - RNA, 22 nt, Human
caauaaaguauuuaauuagugc

SEQ ID NO: 1769340 - RNA, 20 nt, Human
caauaaaguauuuaauuagu

SEQ ID NO: 1769341 - RNA, 13 nt, Human
caauaaauugcua

SEQ ID NO: 1769342 - RNA, 15 nt, Human
caauaaauugcuaau

SEQ ID NO: 1769343 - RNA, 20 nt, Human
caauaaauugcuaauguugc

SEQ ID NO: 1769344 - RNA, 22 nt, Human
caauaaauugcuaauguugcug

SEQ ID NO: 1769345 - RNA, 14 nt, Human
caauagcaccccua

SEQ ID NO: 1769346 - RNA, 20 nt, Human
caauagcaccccuacucaca

SEQ ID NO: 1769347 - RNA, 18 nt, Human
cauaugcaguguucuaca

SEQ ID NO: 1769348 - RNA, 12 nt, Human
caucacacacac

SEQ ID NO: 1769349 - RNA, 11 nt, Human
caucacacaca

SEQ ID NO: 1769350 - RNA, 15 nt, Human
caucacaccugcccu

SEQ ID NO: 1769351 - RNA, 17 nt, Human
caucacaccugcccuaa

SEQ ID NO: 1769352 - RNA, 22 nt, Human
caucaagucuuucacauuuaaa

SEQ ID NO: 1769353 - RNA, 12 nt, Human
caucaagccacu

SEQ ID NO: 1769354 - RNA, 18 nt, Human
cauauuuucaccauuuga

SEQ ID NO: 1769355 - RNA, 22 nt, Human
cauaugacucacaugaugcaua

SEQ ID NO: 1769356 - RNA, 20 nt, Human
cauaugacucacaugaugca

SEQ ID NO: 1769357 - RNA, 23 nt, Human
cauauauauguuuuaagaggcag

SEQ ID NO: 1769358 - RNA, 22 nt, Human
cauauauauguuuuaagaggca

SEQ ID NO: 1769359 - RNA, 18 nt, Human
cauaguaugguggcuggg

SEQ ID NO: 1769360 - RNA, 19 nt, Human
cauaguaugguggcugggu

SEQ ID NO: 1769361 - RNA, 20 nt, Human
cauaguaugguggcuggguu

SEQ ID NO: 1769362 - RNA, 22 nt, Human
cauaguggcuuaaaacaacacu

SEQ ID NO: 1769363 - RNA, 22 nt, Human
cauaguuggggucauagauguu

SEQ ID NO: 1769364 - RNA, 20 nt, Human
cauauaaacaucacacacac

SEQ ID NO: 1769365 - RNA, 16 nt, Human
cauaguuuuucagucu

SEQ ID NO: 1769366 - RNA, 19 nt, Human
cauauaaacaucacacaca

SEQ ID NO: 1769367 - RNA, 23 nt, Human
caucccuaccgacccaggguucc

SEQ ID NO: 1769368 - RNA, 21 nt, Human
caucauucucugucucaucca

SEQ ID NO: 1769369 - RNA, 22 nt, Human
caucauucucugucucauccau

SEQ ID NO: 1769370 - RNA, 20 nt, Human
caucauuuuccauauccugg

SEQ ID NO: 1769371 - RNA, 22 nt, Human
caucauuuuccauauccuggug

SEQ ID NO: 1769372 - RNA, 24 nt, Human
caucauucucugucucauccauca

SEQ ID NO: 1769373 - RNA, 15 nt, Human
cauccagguucagcu

SEQ ID NO: 1769374 - RNA, 17 nt, Human
cauccagguucagcuug

SEQ ID NO: 1769375 - RNA, 19 nt, Human
caucccuaccgacccaggg

SEQ ID NO: 1769376 - RNA, 17 nt, Human
cauccacaugggagccg

SEQ ID NO: 1769377 - RNA, 17 nt, Human
caucucccagauaaugu

SEQ ID NO: 1769378 - RNA, 18 nt, Human
caucucccagauaaugug

SEQ ID NO: 1769379 - RNA, 22 nt, Human
caucucccagauaaugugaaaa

SEQ ID NO: 1769380 - RNA, 13 nt, Human
caucuccccucag

SEQ ID NO: 1769381 - RNA, 14 nt, Human
caucuccccucagc

SEQ ID NO: 1769382 - RNA, 13 nt, Human
caucuugcucugc

SEQ ID NO: 1769383 - RNA, 15 nt, Human
caucuugcucugcug

SEQ ID NO: 1769384 - RNA, 14 nt, Human
caucuugcucugcu

SEQ ID NO: 1769385 - RNA, 20 nt, Human
caucuugcucugcugacaga

SEQ ID NO: 1769386 - RNA, 13 nt, Human
caucuugcuggcu

SEQ ID NO: 1769387 - RNA, 14 nt, Human
caucuugcuggcua

SEQ ID NO: 1769388 - RNA, 15 nt, Human
caucuucgggaccag

SEQ ID NO: 1769389 - RNA, 18 nt, Human
caucuucgggaccaggau

SEQ ID NO: 1769390 - RNA, 12 nt, Human
caucuuccugug

SEQ ID NO: 1769391 - RNA, 13 nt, Human
caucuuccugugu

SEQ ID NO: 1769392 - RNA, 14 nt, Human
caucuuccuguguc

SEQ ID NO: 1769393 - RNA, 15 nt, Human
caucuuccugugucc

SEQ ID NO: 1769394 - RNA, 16 nt, Human
caucuuccuguguccu

SEQ ID NO: 1769395 - RNA, 17 nt, Human
caucuuccuguguccug

SEQ ID NO: 1769396 - RNA, 14 nt, Human
caucuucgggacca

SEQ ID NO: 1769397 - RNA, 18 nt, Human
cauccuccacguucugcu

SEQ ID NO: 1769398 - RNA, 20 nt, Human
cauccuccacguucugcuca

SEQ ID NO: 1769399 - RNA, 21 nt, Human
cauccuccacguucugcucau

SEQ ID NO: 1769400 - RNA, 14 nt, Human
caucuacuucaggc

SEQ ID NO: 1769401 - RNA, 19 nt, Human
caucucacuggaugcaaag

SEQ ID NO: 1769402 - RNA, 20 nt, Human
caucucaggacacuuccgua

SEQ ID NO: 1769403 - RNA, 18 nt, Human
caucucaugaggggagag

SEQ ID NO: 1769404 - RNA, 19 nt, Human
caucucaugaggggagagg

SEQ ID NO: 1769405 - RNA, 23 nt, Human
caucucaugaggggagaggagac

SEQ ID NO: 1769406 - RNA, 22 nt, Human
cauacgcuuuuaaugaaaagga

SEQ ID NO: 1769407 - RNA, 16 nt, Human
cauaaccuagccuuag

SEQ ID NO: 1769408 - RNA, 21 nt, Human
cauaacggaucagaaauacag

SEQ ID NO: 1769409 - RNA, 17 nt, Human
cauaacggaucagaaau

SEQ ID NO: 1769410 - RNA, 17 nt, Human
cauaacaauuccucuac

SEQ ID NO: 1769411 - RNA, 14 nt, Human
cauaacaauuccuc

SEQ ID NO: 1769412 - RNA, 15 nt, Human
cauaacaauuccucu

SEQ ID NO: 1769413 - RNA, 16 nt, Human
cauaacaauuccucua

SEQ ID NO: 1769414 - RNA, 22 nt, Human
cauaacggaucagaaauacaga

SEQ ID NO: 1769415 - RNA, 11 nt, Human
cauaagguuuu

SEQ ID NO: 1769416 - RNA, 16 nt, Human
cauaagguuuuuaugc

SEQ ID NO: 1769417 - RNA, 17 nt, Human
cauaagguuuuuaugca

SEQ ID NO: 1769418 - RNA, 15 nt, Human
cauaaguauuucaaa

SEQ ID NO: 1769419 - RNA, 18 nt, Human
cauacccaaaccaggugg

SEQ ID NO: 1769420 - RNA, 14 nt, Human
cauaccaaugaaaa

SEQ ID NO: 1769421 - RNA, 18 nt, Human
caguuggguggaugccug

SEQ ID NO: 1769422 - RNA, 19 nt, Human
caguuggguggaugccugg

SEQ ID NO: 1769423 - RNA, 16 nt, Human
caguuggguggaugcc

SEQ ID NO: 1769424 - RNA, 16 nt, Human
caguugcucuaugcuu

SEQ ID NO: 1769425 - RNA, 12 nt, Human
caguggcagcug

SEQ ID NO: 1769426 - RNA, 20 nt, Human
caguggacucagaaagccaa

SEQ ID NO: 1769427 - RNA, 22 nt, Human
caguggacucagaaagccaaca

SEQ ID NO: 1769428 - RNA, 13 nt, Human
caguggcagcugc

SEQ ID NO: 1769429 - RNA, 14 nt, Human
caguggcagcugcu

SEQ ID NO: 1769430 - RNA, 15 nt, Human
caguggcagcugcuu

SEQ ID NO: 1769431 - RNA, 16 nt, Human
caguggcagcugcuuu

SEQ ID NO: 1769432 - RNA, 16 nt, Human
caguggauugcauuuc

SEQ ID NO: 1769433 - RNA, 14 nt, Human
cagugugacaagga

SEQ ID NO: 1769434 - RNA, 16 nt, Human
cagugugaggccaggg

SEQ ID NO: 1769435 - RNA, 17 nt, Human
cagugugaggccagggc

SEQ ID NO: 1769436 - RNA, 18 nt, Human
cagugugaggccagggca

SEQ ID NO: 1769437 - RNA, 19 nt, Human
cagugugaggccagggcag

SEQ ID NO: 1769438 - RNA, 17 nt, Human
caguguaaauaguuacu

SEQ ID NO: 1769439 - RNA, 19 nt, Human
caguguaaauaguuacucc

SEQ ID NO: 1769440 - RNA, 21 nt, Human
caguuacccacucggucccag

SEQ ID NO: 1769441 - RNA, 17 nt, Human
caguuaaggaauauaau

SEQ ID NO: 1769442 - RNA, 14 nt, Human
caguguuaccugug

SEQ ID NO: 1769443 - RNA, 17 nt, Human
caguguuaccugugugc

SEQ ID NO: 1769444 - RNA, 18 nt, Human
caguguuaccugugugcu

SEQ ID NO: 1769445 - RNA, 19 nt, Human
caguguuaccugugugcuu

SEQ ID NO: 1769446 - RNA, 14 nt, Human
caguguuaaaugug

SEQ ID NO: 1769447 - RNA, 19 nt, Human
caguguuaaaugugaugaa

SEQ ID NO: 1769448 - RNA, 19 nt, Human
caguguuagggaagggccu

SEQ ID NO: 1769449 - RNA, 15 nt, Human
caguuaaaaaaaauu

SEQ ID NO: 1769450 - RNA, 16 nt, Human
caguuaaaaaaaauuu

SEQ ID NO: 1769451 - RNA, 19 nt, Human
caguuaaaaaaaauuuuaa

SEQ ID NO: 1769452 - RNA, 22 nt, Human
caguucggugagcuacaaaugc

SEQ ID NO: 1769453 - RNA, 21 nt, Human
caguucuggauggugugccuu

SEQ ID NO: 1769454 - RNA, 22 nt, Human
caguucuggauggugugccuuc

SEQ ID NO: 1769455 - RNA, 23 nt, Human
caguucuggauggugugccuucc

SEQ ID NO: 1769456 - RNA, 10 nt, Human
caugcaguuu

SEQ ID NO: 1769457 - RNA, 12 nt, Human
caugcaguuuga

SEQ ID NO: 1769458 - RNA, 13 nt, Human
caugcaguuugaa

SEQ ID NO: 1769459 - RNA, 14 nt, Human
caugcaguuugaaa

SEQ ID NO: 1769460 - RNA, 16 nt, Human
caugcaguuugaaauu

SEQ ID NO: 1769461 - RNA, 17 nt, Human
caugcaguuugaaauuc

SEQ ID NO: 1769462 - RNA, 20 nt, Human
caugcaguuugaaauucuga

SEQ ID NO: 1769463 - RNA, 21 nt, Human
caugcaguuugaaauucugaa

SEQ ID NO: 1769464 - RNA, 22 nt, Human
caugcaguuugaaauucugaau

SEQ ID NO: 1769465 - RNA, 16 nt, Human
caugcccucucaggcc

SEQ ID NO: 1769466 - RNA, 21 nt, Human
caugcccucucaggccggcag

SEQ ID NO: 1769467 - RNA, 13 nt, Human
caugcccucucag

SEQ ID NO: 1769468 - RNA, 14 nt, Human
caugcccucucagg

SEQ ID NO: 1769469 - RNA, 15 nt, Human
caugcccucucaggc

SEQ ID NO: 1769470 - RNA, 13 nt, Human
cauggcagaaggc

SEQ ID NO: 1769471 - RNA, 19 nt, Human
cauggauuacuucucuaua

SEQ ID NO: 1769472 - RNA, 16 nt, Human
caugggccuccugugu

SEQ ID NO: 1769473 - RNA, 17 nt, Human
caugggccuccugugug

SEQ ID NO: 1769474 - RNA, 15 nt, Human
caugggccuccugug

SEQ ID NO: 1769475 - RNA, 16 nt, Human
cauggucagcccuagg

SEQ ID NO: 1769476 - RNA, 19 nt, Human
cauggucagcccuagggug

SEQ ID NO: 1769477 - RNA, 20 nt, Human
caugccugccccaaacaaau

SEQ ID NO: 1769478 - RNA, 22 nt, Human
caugcgacacugggaggccagu

SEQ ID NO: 1769479 - RNA, 19 nt, Human
caugccuuaaaccuaccuc

SEQ ID NO: 1769480 - RNA, 20 nt, Human
caugccuuaaaccuaccucc

SEQ ID NO: 1769481 - RNA, 20 nt, Human
cauggaagaggcuacagggc

SEQ ID NO: 1769482 - RNA, 18 nt, Human
cauggugugaucgucuga

SEQ ID NO: 1769483 - RNA, 19 nt, Human
caugguuaagguaaaguaa

SEQ ID NO: 1769484 - RNA, 15 nt, Human
caugugcacaugcac

SEQ ID NO: 1769485 - RNA, 21 nt, Human
caugugccagguuuuuggucu

SEQ ID NO: 1769486 - RNA, 12 nt, Human
caugugacucug

SEQ ID NO: 1769487 - RNA, 22 nt, Human
caugugccagguuuuuggucug

SEQ ID NO: 1769488 - RNA, 19 nt, Human
cauguggcuccucccagcc

SEQ ID NO: 1769489 - RNA, 17 nt, Human
cauguggagacuucauc

SEQ ID NO: 1769490 - RNA, 12 nt, Human
cauguuuuaaca

SEQ ID NO: 1769491 - RNA, 13 nt, Human
cauguuuuaacaa

SEQ ID NO: 1769492 - RNA, 14 nt, Human
cauguuuuaacaaa

SEQ ID NO: 1769493 - RNA, 15 nt, Human
cauguuuuaacaaaa

SEQ ID NO: 1769494 - RNA, 16 nt, Human
cauguuuuaacaaaaa

SEQ ID NO: 1769495 - RNA, 17 nt, Human
cauguuuuaacaaaaac

SEQ ID NO: 1769496 - RNA, 20 nt, Human
cauguuuuaacaaaaaccaa

SEQ ID NO: 1769497 - RNA, 23 nt, Human
cauguguguccacgacugucucc

SEQ ID NO: 1769498 - RNA, 12 nt, Human
caugugugucca

SEQ ID NO: 1769499 - RNA, 21 nt, Human
cauguguguccacgacugucu

SEQ ID NO: 1769500 - RNA, 22 nt, Human
cauguguguccacgacugucuc

SEQ ID NO: 1769501 - RNA, 13 nt, Human
cauuaaauuaccu

SEQ ID NO: 1769502 - RNA, 12 nt, Human
cauuauuuguca

SEQ ID NO: 1769503 - RNA, 13 nt, Human
cauuauuugucaa

SEQ ID NO: 1769504 - RNA, 14 nt, Human
cauuauuugucaaa

SEQ ID NO: 1769505 - RNA, 15 nt, Human
cauuauuugucaaau

SEQ ID NO: 1769506 - RNA, 16 nt, Human
cauuugagcagggcuc

SEQ ID NO: 1769507 - RNA, 14 nt, Human
cauuugagcagggc

SEQ ID NO: 1769508 - RNA, 23 nt, Human
cauuugaaugcauuuuguuuggu

SEQ ID NO: 1769509 - RNA, 18 nt, Human
cauuugaaugcauuuugu

SEQ ID NO: 1769510 - RNA, 15 nt, Human
cauuugaaugcauuu

SEQ ID NO: 1769511 - RNA, 14 nt, Human
cauuugaaugcauu

SEQ ID NO: 1769512 - RNA, 13 nt, Human
cauuugaaugcau

SEQ ID NO: 1769513 - RNA, 20 nt, Human
cauuuuuaguagagacaggg

SEQ ID NO: 1769514 - RNA, 11 nt, Human
ccaaaccucug

SEQ ID NO: 1769515 - RNA, 12 nt, Human
ccaaaccucugu

SEQ ID NO: 1769516 - RNA, 13 nt, Human
ccaaaccucuguu

SEQ ID NO: 1769517 - RNA, 14 nt, Human
ccaaaccucuguuc

SEQ ID NO: 1769518 - RNA, 17 nt, Human
ccaaaccucuguucagu

SEQ ID NO: 1769519 - RNA, 20 nt, Human
ccaaaccucuguucagugua

SEQ ID NO: 1769520 - RNA, 15 nt, Human
ccaaacgcugagcca

SEQ ID NO: 1769521 - RNA, 20 nt, Human
ccaaacgcugagccaccugc

SEQ ID NO: 1769522 - RNA, 21 nt, Human
ccaaaccucuguucaguguaa

SEQ ID NO: 1769523 - RNA, 23 nt, Human
cauuuugggguacccacugcucu

SEQ ID NO: 1769524 - RNA, 23 nt, Human
cauuuuguuugguauuguauuua

SEQ ID NO: 1769525 - RNA, 13 nt, Human
cauuuuuaaaugu

SEQ ID NO: 1769526 - RNA, 14 nt, Human
cauuuuuaaaugug

SEQ ID NO: 1769527 - RNA, 17 nt, Human
cauuuuuaaauguguuu

SEQ ID NO: 1769528 - RNA, 18 nt, Human
cauuuuuaaauguguuuu

SEQ ID NO: 1769529 - RNA, 22 nt, Human
cauuuuguuugguauuguauuu

SEQ ID NO: 1769530 - RNA, 21 nt, Human
cauuuuguuugguauuguauu

SEQ ID NO: 1769531 - RNA, 20 nt, Human
cauuuuguuugguauuguau

SEQ ID NO: 1769532 - RNA, 19 nt, Human
cauuuuguuugguauugua

SEQ ID NO: 1769533 - RNA, 19 nt, Human
cauuuuuaguagagacagg

SEQ ID NO: 1769534 - RNA, 18 nt, Human
cauuuuuaguagagacag

SEQ ID NO: 1769535 - RNA, 20 nt, Human
cauuuugggguacccacugc

SEQ ID NO: 1769536 - RNA, 21 nt, Human
cauuuugggguacccacugcu

SEQ ID NO: 1769537 - RNA, 22 nt, Human
cauuuugggguacccacugcuc

SEQ ID NO: 1769538 - RNA, 19 nt, Human
cauuucuauuucuccucca

SEQ ID NO: 1769539 - RNA, 15 nt, Human
cauuucucuaagaga

SEQ ID NO: 1769540 - RNA, 21 nt, Human
cauuuccauguccccucccag

SEQ ID NO: 1769541 - RNA, 17 nt, Human
cauuuacuuuguguuca

SEQ ID NO: 1769542 - RNA, 21 nt, Human
cauuuacuuuguguucaccuu

SEQ ID NO: 1769543 - RNA, 16 nt, Human
ccacaaugcaguucug

SEQ ID NO: 1769544 - RNA, 20 nt, Human
ccaagguuggagcccagggc

SEQ ID NO: 1769545 - RNA, 22 nt, Human
ccaagguuggagcccagggcau

SEQ ID NO: 1769546 - RNA, 23 nt, Human
ccacaaaauaaccaauccuggac

SEQ ID NO: 1769547 - RNA, 15 nt, Human
ccacaaccucuuccc

SEQ ID NO: 1769548 - RNA, 13 nt, Human
ccacaaccucuuc

SEQ ID NO: 1769549 - RNA, 20 nt, Human
ccacaaaggcaaagggucca

SEQ ID NO: 1769550 - RNA, 16 nt, Human
ccacaaaggcaaaggg

SEQ ID NO: 1769551 - RNA, 18 nt, Human
ccaagcaggacagugcuu

SEQ ID NO: 1769552 - RNA, 19 nt, Human
ccaagcaggacagugcuug

SEQ ID NO: 1769553 - RNA, 18 nt, Human
ccaagcaggaaaugaaaa

SEQ ID NO: 1769554 - RNA, 19 nt, Human
ccaagaggaaguucagauc

SEQ ID NO: 1769555 - RNA, 21 nt, Human
ccaagaggaaguucagaucuu

SEQ ID NO: 1769556 - RNA, 16 nt, Human
ccaacccuggggaagg

SEQ ID NO: 1769557 - RNA, 17 nt, Human
ccaacccuggggaagga

SEQ ID NO: 1769558 - RNA, 18 nt, Human
ccaacccuggggaaggag

SEQ ID NO: 1769559 - RNA, 20 nt, Human
ccaacccuggggaaggagcc

SEQ ID NO: 1769560 - RNA, 15 nt, Human
ccaacauguggcucc

SEQ ID NO: 1769561 - RNA, 14 nt, Human
ccaaccuauuuuga

SEQ ID NO: 1769562 - RNA, 21 nt, Human
ccaaccuauuuugaaguacca

SEQ ID NO: 1769563 - RNA, 23 nt, Human
ccaaccuuagauguucuaagucu

SEQ ID NO: 1769564 - RNA, 17 nt, Human
ccaagaccucagggcac

SEQ ID NO: 1769565 - RNA, 15 nt, Human
ccagcugucaagggc

SEQ ID NO: 1769566 - RNA, 23 nt, Human
ccaggaccagucaaccugggcaa

SEQ ID NO: 1769567 - RNA, 22 nt, Human
ccagcugugcucuggacaggca

SEQ ID NO: 1769568 - RNA, 23 nt, Human
ccagcugugcucuggacaggcau

SEQ ID NO: 1769569 - RNA, 14 nt, Human
ccaggccagaggga

SEQ ID NO: 1769570 - RNA, 21 nt, Human
ccaggccagagggagugacag

SEQ ID NO: 1769571 - RNA, 21 nt, Human
ccaggccccugccacccuggg

SEQ ID NO: 1769572 - RNA, 23 nt, Human
ccaggccccugccacccugggga

SEQ ID NO: 1769573 - RNA, 15 nt, Human
ccaggccccuggagg

SEQ ID NO: 1769574 - RNA, 21 nt, Human
ccaggccccuggaggcugccu

SEQ ID NO: 1769575 - RNA, 23 nt, Human
ccaggccccuggaggcugccucc

SEQ ID NO: 1769576 - RNA, 18 nt, Human
ccagcugugcucuggaca

SEQ ID NO: 1769577 - RNA, 20 nt, Human
ccagcugugcucuggacagg

SEQ ID NO: 1769578 - RNA, 21 nt, Human
ccagcugugcucuggacaggc

SEQ ID NO: 1769579 - RNA, 18 nt, Human
ccagccugaacagaagcu

SEQ ID NO: 1769580 - RNA, 19 nt, Human
ccagccugaacagaagcuc

SEQ ID NO: 1769581 - RNA, 15 nt, Human
ccagcucugaaacca

SEQ ID NO: 1769582 - RNA, 20 nt, Human
ccagcucugaaaccaguguu

SEQ ID NO: 1769583 - RNA, 21 nt, Human
ccagcucugaaaccaguguua

SEQ ID NO: 1769584 - RNA, 14 nt, Human
ccagcucuguauca

SEQ ID NO: 1769585 - RNA, 18 nt, Human
ccagcucuguaucaggac

SEQ ID NO: 1769586 - RNA, 21 nt, Human
ccagcucuguaucaggaccca

SEQ ID NO: 1769587 - RNA, 13 nt, Human
ccagcugcaaagu

SEQ ID NO: 1769588 - RNA, 14 nt, Human
ccagcugcaaagug

SEQ ID NO: 1769589 - RNA, 15 nt, Human
ccagcugcaaagugu

SEQ ID NO: 1769590 - RNA, 16 nt, Human
ccagcugcaaaguguu

SEQ ID NO: 1769591 - RNA, 17 nt, Human
ccagcugcaaaguguuu

SEQ ID NO: 1769592 - RNA, 16 nt, Human
ccagggagaccuggac

SEQ ID NO: 1769593 - RNA, 17 nt, Human
ccagggagaccuggaca

SEQ ID NO: 1769594 - RNA, 18 nt, Human
ccaucaacaaaaauuguc

SEQ ID NO: 1769595 - RNA, 17 nt, Human
ccaucaacaaaaauugu

SEQ ID NO: 1769596 - RNA, 13 nt, Human
ccaguggucucac

SEQ ID NO: 1769597 - RNA, 17 nt, Human
ccaguggucucacaugg

SEQ ID NO: 1769598 - RNA, 18 nt, Human
ccauagauacucucuucu

SEQ ID NO: 1769599 - RNA, 15 nt, Human
ccauauucuguuggc

SEQ ID NO: 1769600 - RNA, 18 nt, Human
ccauauucuguuggccag

SEQ ID NO: 1769601 - RNA, 19 nt, Human
ccauauucuguuggccagu

SEQ ID NO: 1769602 - RNA, 20 nt, Human
ccaucucaugaggggagagg

SEQ ID NO: 1769603 - RNA, 14 nt, Human
ccaucaugucuggc

SEQ ID NO: 1769604 - RNA, 16 nt, Human
ccaucaugucuggcua

SEQ ID NO: 1769605 - RNA, 18 nt, Human
ccagggagaccuggacac

SEQ ID NO: 1769606 - RNA, 22 nt, Human
cccaugagccucagcauccugg

SEQ ID NO: 1769607 - RNA, 13 nt, Human
cccagguuucuau

SEQ ID NO: 1769608 - RNA, 17 nt, Human
cccaguaaaauugccau

SEQ ID NO: 1769609 - RNA, 16 nt, Human
cccaguaaaauugcca

SEQ ID NO: 1769610 - RNA, 13 nt, Human
cccaguaaaauug

SEQ ID NO: 1769611 - RNA, 12 nt, Human
cccaguaaaauu

SEQ ID NO: 1769612 - RNA, 18 nt, Human
cccaguaaaauugccaua

SEQ ID NO: 1769613 - RNA, 14 nt, Human
cccaggguucccgc

SEQ ID NO: 1769614 - RNA, 23 nt, Human
cccaggcaggucuugaacuccug

SEQ ID NO: 1769615 - RNA, 21 nt, Human
cccagugcccacaggaucagu

SEQ ID NO: 1769616 - RNA, 10 nt, Human
cccagucugg

SEQ ID NO: 1769617 - RNA, 18 nt, Human
cccagucuggaaugcagu

SEQ ID NO: 1769618 - RNA, 19 nt, Human
cccagucuggaaugcagug

SEQ ID NO: 1769619 - RNA, 13 nt, Human
cccaucucaggac

SEQ ID NO: 1769620 - RNA, 15 nt, Human
cccaucuucgggacc

SEQ ID NO: 1769621 - RNA, 17 nt, Human
cccaucuucgggaccag

SEQ ID NO: 1769622 - RNA, 18 nt, Human
cccaucuucgggaccagg

SEQ ID NO: 1769623 - RNA, 21 nt, Human
cccaucuucgggaccaggauu

SEQ ID NO: 1769624 - RNA, 15 nt, Human
cccaugagccucagc

SEQ ID NO: 1769625 - RNA, 16 nt, Human
cccaugagccucagca

SEQ ID NO: 1769626 - RNA, 20 nt, Human
cccaugagccucagcauccu

SEQ ID NO: 1769627 - RNA, 19 nt, Human
ccccaaauccgaaccuccu

SEQ ID NO: 1769628 - RNA, 23 nt, Human
ccccaaauccgaaccuccucugu

SEQ ID NO: 1769629 - RNA, 11 nt, Human
ccccaaauccg

SEQ ID NO: 1769630 - RNA, 16 nt, Human
cccagaggauugcugc

SEQ ID NO: 1769631 - RNA, 21 nt, Human
cccagaggaaggggccagagg

SEQ ID NO: 1769632 - RNA, 22 nt, Human
cccagaggaaggggccagaggc

SEQ ID NO: 1769633 - RNA, 23 nt, Human
cccagaggaaggggccagaggcu

SEQ ID NO: 1769634 - RNA, 24 nt, Human
cccagaggaaggggccagaggcuc

SEQ ID NO: 1769635 - RNA, 19 nt, Human
cccagagcugguggaccca

SEQ ID NO: 1769636 - RNA, 20 nt, Human
cccagagcugguggacccag

SEQ ID NO: 1769637 - RNA, 23 nt, Human
cccagagcugguggacccaggga

SEQ ID NO: 1769638 - RNA, 16 nt, Human
cccagaggcugcccca

SEQ ID NO: 1769639 - RNA, 13 nt, Human
cccagccucagcg

SEQ ID NO: 1769640 - RNA, 14 nt, Human
cccagccucagcgc

SEQ ID NO: 1769641 - RNA, 15 nt, Human
cccagccucagcgcg

SEQ ID NO: 1769642 - RNA, 20 nt, Human
cccagccucagcgcggcccu

SEQ ID NO: 1769643 - RNA, 22 nt, Human
cccagccucagcgcggcccucc

SEQ ID NO: 1769644 - RNA, 15 nt, Human
cccagcccucauccc

SEQ ID NO: 1769645 - RNA, 16 nt, Human
cccagcccucaucccg

SEQ ID NO: 1769646 - RNA, 14 nt, Human
cccagcccucaucc

SEQ ID NO: 1769647 - RNA, 19 nt, Human
cccagcccucaucccgagc

SEQ ID NO: 1769648 - RNA, 13 nt, Human
cccaggagccccg

SEQ ID NO: 1769649 - RNA, 14 nt, Human
cccaggagccccga

SEQ ID NO: 1769650 - RNA, 18 nt, Human
cccaggagccccgaggcc

SEQ ID NO: 1769651 - RNA, 15 nt, Human
cccaggacucugacc

SEQ ID NO: 1769652 - RNA, 19 nt, Human
cccaggacucugaccccag

SEQ ID NO: 1769653 - RNA, 23 nt, Human
cccaggacucugaccccagcauu

SEQ ID NO: 1769654 - RNA, 14 nt, Human
cccagcgagcccug

SEQ ID NO: 1769655 - RNA, 20 nt, Human
cccagcuauaccugugccuc

SEQ ID NO: 1769656 - RNA, 12 nt, Human
cccagcucugaa

SEQ ID NO: 1769657 - RNA, 17 nt, Human
cccagcuauaccugugc

SEQ ID NO: 1769658 - RNA, 14 nt, Human
cccagcucugaaac

SEQ ID NO: 1769659 - RNA, 22 nt, Human
cccagcucugaaaccaguguua

SEQ ID NO: 1769660 - RNA, 18 nt, Human
ccauguuggccaggcugg

SEQ ID NO: 1769661 - RNA, 15 nt, Human
ccauguuggccaggc

SEQ ID NO: 1769662 - RNA, 19 nt, Human
ccauguuggccaggcuggu

SEQ ID NO: 1769663 - RNA, 21 nt, Human
ccauguuggccaggcuggucu

SEQ ID NO: 1769664 - RNA, 22 nt, Human
ccauuccugggaaauauucccu

SEQ ID NO: 1769665 - RNA, 17 nt, Human
cccaccuuggcugcagg

SEQ ID NO: 1769666 - RNA, 19 nt, Human
cccaccuuggcugcaggga

SEQ ID NO: 1769667 - RNA, 20 nt, Human
cccaccuuggcugcagggag

SEQ ID NO: 1769668 - RNA, 21 nt, Human
cccagacggcuccacuaggac

SEQ ID NO: 1769669 - RNA, 21 nt, Human
ccaucucaggacacuuccgua

SEQ ID NO: 1769670 - RNA, 15 nt, Human
ccaugaaccaagacc

SEQ ID NO: 1769671 - RNA, 13 nt, Human
ccaugaaacaaag

SEQ ID NO: 1769672 - RNA, 21 nt, Human
ccaugcgacacugggaggcca

SEQ ID NO: 1769673 - RNA, 22 nt, Human
ccaugcgacacugggaggccag

SEQ ID NO: 1769674 - RNA, 16 nt, Human
ccaugccuuaaaccua

SEQ ID NO: 1769675 - RNA, 16 nt, Human
ccaugcgacacuggga

SEQ ID NO: 1769676 - RNA, 13 nt, Human
ccauguuggccag

SEQ ID NO: 1769677 - RNA, 14 nt, Human
ccauguuggccagg

SEQ ID NO: 1769678 - RNA, 17 nt, Human
ccauguggagacuucau

SEQ ID NO: 1769679 - RNA, 13 nt, Human
ccaugugccaggu

SEQ ID NO: 1769680 - RNA, 15 nt, Human
ccauggcccucauua

SEQ ID NO: 1769681 - RNA, 17 nt, Human
ccauggaacuguuuccu

SEQ ID NO: 1769682 - RNA, 19 nt, Human
ccauggaacuguuuccuuc

SEQ ID NO: 1769683 - RNA, 21 nt, Human
ccauggaagaggcuacagggc

SEQ ID NO: 1769684 - RNA, 23 nt, Human
ccauggaagaggcuacagggcca

SEQ ID NO: 1769685 - RNA, 13 nt, Human
cccugcugguuca

SEQ ID NO: 1769686 - RNA, 19 nt, Human
cccugcugguucaggguug

SEQ ID NO: 1769687 - RNA, 20 nt, Human
cccugcugguucaggguugg

SEQ ID NO: 1769688 - RNA, 15 nt, Human
cccuggaagagccca

SEQ ID NO: 1769689 - RNA, 16 nt, Human
cccuggaagagcccag

SEQ ID NO: 1769690 - RNA, 17 nt, Human
cccuggaagagcccagu

SEQ ID NO: 1769691 - RNA, 18 nt, Human
cccuggaagagcccaguc

SEQ ID NO: 1769692 - RNA, 15 nt, Human
cccuggaggcugccu

SEQ ID NO: 1769693 - RNA, 16 nt, Human
cccuggaggcugccuc

SEQ ID NO: 1769694 - RNA, 17 nt, Human
cccuggaggcugccucc

SEQ ID NO: 1769695 - RNA, 18 nt, Human
cccuggaggcugccuccc

SEQ ID NO: 1769696 - RNA, 19 nt, Human
cccuggaggcugccuccca

SEQ ID NO: 1769697 - RNA, 22 nt, Human
cccugguggcagugggagcugc

SEQ ID NO: 1769698 - RNA, 14 nt, Human
cccugccagggcag

SEQ ID NO: 1769699 - RNA, 12 nt, Human
cccugccagggc

SEQ ID NO: 1769700 - RNA, 17 nt, Human
cccugccacccugggga

SEQ ID NO: 1769701 - RNA, 18 nt, Human
cccugccacccuggggag

SEQ ID NO: 1769702 - RNA, 12 nt, Human
cccugccacccu

SEQ ID NO: 1769703 - RNA, 14 nt, Human
cccugccacccugg

SEQ ID NO: 1769704 - RNA, 15 nt, Human
cccugccacccuggg

SEQ ID NO: 1769705 - RNA, 18 nt, Human
cccugcaaaaggacucuc

SEQ ID NO: 1769706 - RNA, 20 nt, Human
cccugcaaaaggacucucag

SEQ ID NO: 1769707 - RNA, 15 nt, Human
cccucuacagagcuu

SEQ ID NO: 1769708 - RNA, 18 nt, Human
cccucuacagagcuuccc

SEQ ID NO: 1769709 - RNA, 21 nt, Human
cccucuacagagcuucccuga

SEQ ID NO: 1769710 - RNA, 14 nt, Human
cccuacugcuguga

SEQ ID NO: 1769711 - RNA, 17 nt, Human
cccuacugcugugaacc

SEQ ID NO: 1769712 - RNA, 17 nt, Human
cccuagaaacuuccaaa

SEQ ID NO: 1769713 - RNA, 22 nt, Human
cccggcacagaugcuccaggga

SEQ ID NO: 1769714 - RNA, 13 nt, Human
cccucaucugucc

SEQ ID NO: 1769715 - RNA, 14 nt, Human
cccucaucuguccc

SEQ ID NO: 1769716 - RNA, 12 nt, Human
cccucauuaaug

SEQ ID NO: 1769717 - RNA, 17 nt, Human
cccucaucccgagcacc

SEQ ID NO: 1769718 - RNA, 17 nt, Human
cccuccaugugggcuag

SEQ ID NO: 1769719 - RNA, 13 nt, Human
ccccagccugcua

SEQ ID NO: 1769720 - RNA, 18 nt, Human
ccccagccugcgccugcu

SEQ ID NO: 1769721 - RNA, 19 nt, Human
ccccagccugcgccugcug

SEQ ID NO: 1769722 - RNA, 12 nt, Human
ccccagccugcu

SEQ ID NO: 1769723 - RNA, 20 nt, Human
ccccagccugcuagcuagcu

SEQ ID NO: 1769724 - RNA, 13 nt, Human
ccccacaguugcu

SEQ ID NO: 1769725 - RNA, 10 nt, Human
ccccagccug

SEQ ID NO: 1769726 - RNA, 11 nt, Human
ccccagccugc

SEQ ID NO: 1769727 - RNA, 12 nt, Human
ccccagccugcg

SEQ ID NO: 1769728 - RNA, 23 nt, Human
ccccagccccgguggcugggcag

SEQ ID NO: 1769729 - RNA, 14 nt, Human
ccccagggccugag

SEQ ID NO: 1769730 - RNA, 15 nt, Human
ccccagggccugagc

SEQ ID NO: 1769731 - RNA, 16 nt, Human
ccccagggccugagcc

SEQ ID NO: 1769732 - RNA, 19 nt, Human
ccccagggccugagccugg

SEQ ID NO: 1769733 - RNA, 21 nt, Human
ccccagggccugagccuggcc

SEQ ID NO: 1769734 - RNA, 20 nt, Human
cccgaggccuucucugaagg

SEQ ID NO: 1769735 - RNA, 15 nt, Human
cccgaggccuucucu

SEQ ID NO: 1769736 - RNA, 22 nt, Human
cccgcggggcugucggcgcugc

SEQ ID NO: 1769737 - RNA, 17 nt, Human
cccgcgccacaggaccc

SEQ ID NO: 1769738 - RNA, 21 nt, Human
ccuccccuccggacuggugcc

SEQ ID NO: 1769739 - RNA, 18 nt, Human
ccucuacagagcuucccu

SEQ ID NO: 1769740 - RNA, 19 nt, Human
ccuccuuuaguaaaacucc

SEQ ID NO: 1769741 - RNA, 15 nt, Human
ccuccuuuccuccuc

SEQ ID NO: 1769742 - RNA, 20 nt, Human
ccucuccccagcaagugaga

SEQ ID NO: 1769743 - RNA, 15 nt, Human
ccucuccccagcaag

SEQ ID NO: 1769744 - RNA, 17 nt, Human
ccucuccaggcauuuag

SEQ ID NO: 1769745 - RNA, 20 nt, Human
ccucuacagagcuucccuga

SEQ ID NO: 1769746 - RNA, 21 nt, Human
ccucuacagagcuucccugac

SEQ ID NO: 1769747 - RNA, 24 nt, Human
ccucuacagagcuucccugacuca

SEQ ID NO: 1769748 - RNA, 21 nt, Human
ccucugacacacagcucuguc

SEQ ID NO: 1769749 - RNA, 17 nt, Human
ccucugacucagggcuc

SEQ ID NO: 1769750 - RNA, 19 nt, Human
ccucugacucagggcuccu

SEQ ID NO: 1769751 - RNA, 21 nt, Human
ccucugacucagggcuccugg

SEQ ID NO: 1769752 - RNA, 22 nt, Human
ccucugacucagggcuccuggg

SEQ ID NO: 1769753 - RNA, 12 nt, Human
ccucugacucag

SEQ ID NO: 1769754 - RNA, 16 nt, Human
ccucugacucagggcu

SEQ ID NO: 1769755 - RNA, 13 nt, Human
ccucugacacaca

SEQ ID NO: 1769756 - RNA, 16 nt, Human
ccucugaaacccugga

SEQ ID NO: 1769757 - RNA, 19 nt, Human
ccucugaaacccuggacca

SEQ ID NO: 1769758 - RNA, 15 nt, Human
ccucugacacacagc

SEQ ID NO: 1769759 - RNA, 14 nt, Human
ccucugacacacag

SEQ ID NO: 1769760 - RNA, 19 nt, Human
ccucugacacacagcucug

SEQ ID NO: 1769761 - RNA, 20 nt, Human
ccucugacacacagcucugu

SEQ ID NO: 1769762 - RNA, 21 nt, Human
ccucccgaauagcugggacua

SEQ ID NO: 1769763 - RNA, 19 nt, Human
ccucccgaguagcugggac

SEQ ID NO: 1769764 - RNA, 17 nt, Human
ccucccgaguagcuggg

SEQ ID NO: 1769765 - RNA, 18 nt, Human
ccucccgaguagcuggga

SEQ ID NO: 1769766 - RNA, 19 nt, Human
ccucccgaauagcugggac

SEQ ID NO: 1769767 - RNA, 20 nt, Human
ccucccgaauagcugggacu

SEQ ID NO: 1769768 - RNA, 18 nt, Human
ccucccgaauagcuggga

SEQ ID NO: 1769769 - RNA, 12 nt, Human
ccuccccugcca

SEQ ID NO: 1769770 - RNA, 13 nt, Human
ccuccccugccag

SEQ ID NO: 1769771 - RNA, 16 nt, Human
ccuccccugccagggc

SEQ ID NO: 1769772 - RNA, 18 nt, Human
ccuccccugccagggcag

SEQ ID NO: 1769773 - RNA, 12 nt, Human
ccuccaggagcu

SEQ ID NO: 1769774 - RNA, 18 nt, Human
ccuccaggagcuucuugu

SEQ ID NO: 1769775 - RNA, 19 nt, Human
ccuccaggagcuucuuguu

SEQ ID NO: 1769776 - RNA, 23 nt, Human
ccuccaggagcuucuuguuuccu

SEQ ID NO: 1769777 - RNA, 16 nt, Human
ccuccagccugaacag

SEQ ID NO: 1769778 - RNA, 12 nt, Human
ccuccauguggg

SEQ ID NO: 1769779 - RNA, 15 nt, Human
ccuccaugugggcua

SEQ ID NO: 1769780 - RNA, 17 nt, Human
ccucccaaagugcuggg

SEQ ID NO: 1769781 - RNA, 11 nt, Human
ccuccauggga

SEQ ID NO: 1769782 - RNA, 17 nt, Human
ccuauuccaagcuucca

SEQ ID NO: 1769783 - RNA, 23 nt, Human
ccuaugugauuuuaacucugucu

SEQ ID NO: 1769784 - RNA, 22 nt, Human
ccuauguuuuuguucaaagcca

SEQ ID NO: 1769785 - RNA, 15 nt, Human
ccuauucuuucgaaa

SEQ ID NO: 1769786 - RNA, 15 nt, Human
ccuaggugacagagu

SEQ ID NO: 1769787 - RNA, 18 nt, Human
ccuagugaaggcuucucu

SEQ ID NO: 1769788 - RNA, 19 nt, Human
ccuagugaaggcuucucuc

SEQ ID NO: 1769789 - RNA, 21 nt, Human
ccuagugaaggcuucucucug

SEQ ID NO: 1769790 - RNA, 22 nt, Human
ccuagugaaggcuucucucugu

SEQ ID NO: 1769791 - RNA, 23 nt, Human
ccuagugaaggcuucucucugug

SEQ ID NO: 1769792 - RNA, 14 nt, Human
cccuucaucuuccu

SEQ ID NO: 1769793 - RNA, 15 nt, Human
cccuucaucuuccug

SEQ ID NO: 1769794 - RNA, 16 nt, Human
cccuucaucuuccugu

SEQ ID NO: 1769795 - RNA, 17 nt, Human
cccuucaucuuccugug

SEQ ID NO: 1769796 - RNA, 20 nt, Human
cccuucaucuuccugugucc

SEQ ID NO: 1769797 - RNA, 14 nt, Human
cccuucccacagga

SEQ ID NO: 1769798 - RNA, 23 nt, Human
cccuucccacaggacauuucucu

SEQ ID NO: 1769799 - RNA, 13 nt, Human
cccuuuacccucu

SEQ ID NO: 1769800 - RNA, 17 nt, Human
ccgggaaccuccccagc

SEQ ID NO: 1769801 - RNA, 18 nt, Human
ccgggaaccuccccagcc

SEQ ID NO: 1769802 - RNA, 19 nt, Human
ccgggaaccuccccagccu

SEQ ID NO: 1769803 - RNA, 20 nt, Human
ccgggaaccuccccagccug

SEQ ID NO: 1769804 - RNA, 21 nt, Human
ccgggaaccuccccagccugc

SEQ ID NO: 1769805 - RNA, 12 nt, Human
ccggacuggugc

SEQ ID NO: 1769806 - RNA, 13 nt, Human
ccggacuggugcc

SEQ ID NO: 1769807 - RNA, 16 nt, Human
ccggacuggugcccuc

SEQ ID NO: 1769808 - RNA, 17 nt, Human
ccggacuggugcccucc

SEQ ID NO: 1769809 - RNA, 18 nt, Human
ccggacuggugcccuccu

SEQ ID NO: 1769810 - RNA, 22 nt, Human
ccgggaaccuccccagccugcg

SEQ ID NO: 1769811 - RNA, 14 nt, Human
ccgguggcugggca

SEQ ID NO: 1769812 - RNA, 16 nt, Human
ccgguggcugggcaga

SEQ ID NO: 1769813 - RNA, 11 nt, Human
ccguggaugcg

SEQ ID NO: 1769814 - RNA, 21 nt, Human
ccguggauggccguggaugcg

SEQ ID NO: 1769815 - RNA, 13 nt, Human
ccuaggugacaga

SEQ ID NO: 1769816 - RNA, 21 nt, Human
ccuagacucggggugcuuccu

SEQ ID NO: 1769817 - RNA, 23 nt, Human
ccuagacucggggugcuuccuug

SEQ ID NO: 1769818 - RNA, 22 nt, Human
ccuacuuacccagguggguccc

SEQ ID NO: 1769819 - RNA, 11 nt, Human
ccuacugcugu

SEQ ID NO: 1769820 - RNA, 12 nt, Human
ccuacugcugug

SEQ ID NO: 1769821 - RNA, 18 nt, Human
ccuacccacccuccuuuc

SEQ ID NO: 1769822 - RNA, 18 nt, Human
ccuacaggagugagcacu

SEQ ID NO: 1769823 - RNA, 13 nt, Human
ccuacccacccuc

SEQ ID NO: 1769824 - RNA, 14 nt, Human
ccuacauguuauuc

SEQ ID NO: 1769825 - RNA, 14 nt, Human
ccuaaauuuauuaa

SEQ ID NO: 1769826 - RNA, 13 nt, Human
ccuaaacauauga

SEQ ID NO: 1769827 - RNA, 16 nt, Human
ccuaaaauucagugga

SEQ ID NO: 1769828 - RNA, 21 nt, Human
ccguguugcagguucauggau

SEQ ID NO: 1769829 - RNA, 22 nt, Human
cuagcaccauuuuaagucccug

SEQ ID NO: 1769830 - RNA, 13 nt, Human
cuagauuuucacu

SEQ ID NO: 1769831 - RNA, 19 nt, Human
cuagauuuucacuuaugaa

SEQ ID NO: 1769832 - RNA, 17 nt, Human
cuagaugcaagucucuu

SEQ ID NO: 1769833 - RNA, 16 nt, Human
cuagagccuucagccu

SEQ ID NO: 1769834 - RNA, 17 nt, Human
cuagagccuucagccuu

SEQ ID NO: 1769835 - RNA, 15 nt, Human
cuagaggaaaagaaa

SEQ ID NO: 1769836 - RNA, 17 nt, Human
cuagaggaaaagaaaga

SEQ ID NO: 1769837 - RNA, 16 nt, Human
cuacucugugucaggu

SEQ ID NO: 1769838 - RNA, 21 nt, Human
cuacucugugucagguggggc

SEQ ID NO: 1769839 - RNA, 15 nt, Human
cuaaggugugcucug

SEQ ID NO: 1769840 - RNA, 19 nt, Human
cuaagccccagcaagcaau

SEQ ID NO: 1769841 - RNA, 17 nt, Human
cuaagccccagcaagca

SEQ ID NO: 1769842 - RNA, 16 nt, Human
cuaagccccagcaagc

SEQ ID NO: 1769843 - RNA, 15 nt, Human
cuaagccccagcaag

SEQ ID NO: 1769844 - RNA, 17 nt, Human
cuaaccacgcuggaccu

SEQ ID NO: 1769845 - RNA, 17 nt, Human
cuacagaggccaugggc

SEQ ID NO: 1769846 - RNA, 20 nt, Human
cuacagagcuucccugacuc

SEQ ID NO: 1769847 - RNA, 14 nt, Human
cuaccacuccugcc

SEQ ID NO: 1769848 - RNA, 17 nt, Human
cuaccacuccugccaag

SEQ ID NO: 1769849 - RNA, 18 nt, Human
cuaccagauaacugagga

SEQ ID NO: 1769850 - RNA, 17 nt, Human
cuacccacccuccuuuc

SEQ ID NO: 1769851 - RNA, 22 nt, Human
cuacccacccuccuuucaccac

SEQ ID NO: 1769852 - RNA, 20 nt, Human
cuacccagcgagcccuggug

SEQ ID NO: 1769853 - RNA, 19 nt, Human
cuacccagcgagcccuggu

SEQ ID NO: 1769854 - RNA, 11 nt, Human
cuacccagggc

SEQ ID NO: 1769855 - RNA, 14 nt, Human
cuacccagggccug

SEQ ID NO: 1769856 - RNA, 15 nt, Human
cuacccagggccugc

SEQ ID NO: 1769857 - RNA, 16 nt, Human
cuacccagggccugca

SEQ ID NO: 1769858 - RNA, 19 nt, Human
cuacccagggccugcagga

SEQ ID NO: 1769859 - RNA, 15 nt, Human
cuacagaggccaugg

SEQ ID NO: 1769860 - RNA, 16 nt, Human
cuacagagcuucccug

SEQ ID NO: 1769861 - RNA, 17 nt, Human
cuacagagcuucccuga

SEQ ID NO: 1769862 - RNA, 18 nt, Human
cuacagagcuucccugac

SEQ ID NO: 1769863 - RNA, 16 nt, Human
cuaaggugugcucuga

SEQ ID NO: 1769864 - RNA, 18 nt, Human
cuaauguugcuggaucag

SEQ ID NO: 1769865 - RNA, 18 nt, Human
cuaucuuuuguuuccuuu

SEQ ID NO: 1769866 - RNA, 19 nt, Human
cuaucuuuuguuuccuuuu

SEQ ID NO: 1769867 - RNA, 14 nt, Human
cuauauuuugucau

SEQ ID NO: 1769868 - RNA, 15 nt, Human
cuauauuuugucaua

SEQ ID NO: 1769869 - RNA, 16 nt, Human
cuauauuuugucauau

SEQ ID NO: 1769870 - RNA, 21 nt, Human
cuauauuuugucauaucaaau

SEQ ID NO: 1769871 - RNA, 18 nt, Human
cuaguuacugugguaugg

SEQ ID NO: 1769872 - RNA, 22 nt, Human
cuaggaccccuccaugugggcu

SEQ ID NO: 1769873 - RNA, 23 nt, Human
cuaggaagaucucugcagggccg

SEQ ID NO: 1769874 - RNA, 17 nt, Human
cuaggacuucaaauugg

SEQ ID NO: 1769875 - RNA, 15 nt, Human
cuagugggguuuccu

SEQ ID NO: 1769876 - RNA, 17 nt, Human
cuagugggguuuccugg

SEQ ID NO: 1769877 - RNA, 18 nt, Human
cuagugggguuuccuggc

SEQ ID NO: 1769878 - RNA, 19 nt, Human
cuagugggguuuccuggca

SEQ ID NO: 1769879 - RNA, 12 nt, Human
cuauuuugaagu

SEQ ID NO: 1769880 - RNA, 17 nt, Human
cucaaggaaaggccuga

SEQ ID NO: 1769881 - RNA, 21 nt, Human
cucacccccuucuccauccac

SEQ ID NO: 1769882 - RNA, 15 nt, Human
cucacccccuucucc

SEQ ID NO: 1769883 - RNA, 15 nt, Human
cucacccccuccuuc

SEQ ID NO: 1769884 - RNA, 16 nt, Human
cucacccccuucucca

SEQ ID NO: 1769885 - RNA, 17 nt, Human
cucacccccuucuccau

SEQ ID NO: 1769886 - RNA, 19 nt, Human
cucacccccuucuccaucc

SEQ ID NO: 1769887 - RNA, 20 nt, Human
cucacccccuucuccaucca

SEQ ID NO: 1769888 - RNA, 17 nt, Human
cucacuauaccaguaua

SEQ ID NO: 1769889 - RNA, 16 nt, Human
cucacuauguugccca

SEQ ID NO: 1769890 - RNA, 17 nt, Human
cucacuauguugcccag

SEQ ID NO: 1769891 - RNA, 18 nt, Human
cucaagugauucuccugc

SEQ ID NO: 1769892 - RNA, 19 nt, Human
cucaagugauucuccugcc

SEQ ID NO: 1769893 - RNA, 20 nt, Human
cucaagugauucuccugccu

SEQ ID NO: 1769894 - RNA, 20 nt, Human
cucaccagccccagugccca

SEQ ID NO: 1769895 - RNA, 21 nt, Human
cucaccagccccagugcccac

SEQ ID NO: 1769896 - RNA, 16 nt, Human
cucacauuagaucuag

SEQ ID NO: 1769897 - RNA, 22 nt, Human
cucacaugucaguaccuucaaa

SEQ ID NO: 1769898 - RNA, 23 nt, Human
cucacauggugcuacgccugcau

SEQ ID NO: 1769899 - RNA, 11 nt, Human
cucaccagcug

SEQ ID NO: 1769900 - RNA, 12 nt, Human
cucaccagcugc

SEQ ID NO: 1769901 - RNA, 13 nt, Human
cucaccagcugca

SEQ ID NO: 1769902 - RNA, 14 nt, Human
cucaccagcugcaa

SEQ ID NO: 1769903 - RNA, 15 nt, Human
cucaccagcugcaaa

SEQ ID NO: 1769904 - RNA, 16 nt, Human
cucaccagcugcaaag

SEQ ID NO: 1769905 - RNA, 17 nt, Human
cucaccagcugcaaagu

SEQ ID NO: 1769906 - RNA, 18 nt, Human
cucaccagcugcaaagug

SEQ ID NO: 1769907 - RNA, 20 nt, Human
cucaccagcugcaaaguguu

SEQ ID NO: 1769908 - RNA, 21 nt, Human
cucacauggugcuacgccugc

SEQ ID NO: 1769909 - RNA, 19 nt, Human
cucaccagccccagugccc

SEQ ID NO: 1769910 - RNA, 13 nt, Human
cucacauuuauau

SEQ ID NO: 1769911 - RNA, 18 nt, Human
cguccugcuuuggcagug

SEQ ID NO: 1769912 - RNA, 12 nt, Human
cguccuccucug

SEQ ID NO: 1769913 - RNA, 13 nt, Human
cguccuccucugu

SEQ ID NO: 1769914 - RNA, 14 nt, Human
cguccuccucugug

SEQ ID NO: 1769915 - RNA, 15 nt, Human
cguccuccucuguga

SEQ ID NO: 1769916 - RNA, 16 nt, Human
cgugcacacaccagag

SEQ ID NO: 1769917 - RNA, 20 nt, Human
cgucugacaggcaaugcugg

SEQ ID NO: 1769918 - RNA, 21 nt, Human
cgucugacaggcaaugcuggc

SEQ ID NO: 1769919 - RNA, 22 nt, Human
cgucugacaggcaaugcuggcu

SEQ ID NO: 1769920 - RNA, 15 nt, Human
cgugcauugugcuuc

SEQ ID NO: 1769921 - RNA, 12 nt, Human
cgugcauugugc

SEQ ID NO: 1769922 - RNA, 21 nt, Human
cgugcauugugcuucuuucuu

SEQ ID NO: 1769923 - RNA, 21 nt, Human
cgugcaguggugcgaucuggg

SEQ ID NO: 1769924 - RNA, 22 nt, Human
cgugcaguggugcgaucugggu

SEQ ID NO: 1769925 - RNA, 18 nt, Human
cgugcacacaccagagcc

SEQ ID NO: 1769926 - RNA, 19 nt, Human
cgugcacacaccagagccc

SEQ ID NO: 1769927 - RNA, 18 nt, Human
cguggaugcgcagugccu

SEQ ID NO: 1769928 - RNA, 13 nt, Human
cgugggcucccug

SEQ ID NO: 1769929 - RNA, 17 nt, Human
cgugggcucccugacug

SEQ ID NO: 1769930 - RNA, 22 nt, Human
cgugggcugggcccacaaaggc

SEQ ID NO: 1769931 - RNA, 16 nt, Human
cuaaauuuauuaaaua

SEQ ID NO: 1769932 - RNA, 17 nt, Human
cuaaauuuauuaaauaa

SEQ ID NO: 1769933 - RNA, 22 nt, Human
cuaacaaucagcuccuuccugg

SEQ ID NO: 1769934 - RNA, 17 nt, Human
cuaaaacaauaaaauuu

SEQ ID NO: 1769935 - RNA, 12 nt, Human
cuaaaacaauaa

SEQ ID NO: 1769936 - RNA, 14 nt, Human
cguuuacuaugccu

SEQ ID NO: 1769937 - RNA, 17 nt, Human
cguuuacuaugccugug

SEQ ID NO: 1769938 - RNA, 16 nt, Human
cuaaaccaaggacuga

SEQ ID NO: 1769939 - RNA, 17 nt, Human
cuaaaccaaggacugag

SEQ ID NO: 1769940 - RNA, 19 nt, Human
cuaaaccaaggacugagca

SEQ ID NO: 1769941 - RNA, 20 nt, Human
cuaaaccaaggacugagcac

SEQ ID NO: 1769942 - RNA, 23 nt, Human
cuaaaccaaggacugagcacccu

SEQ ID NO: 1769943 - RNA, 16 nt, Human
cuaaaagauauaagug

SEQ ID NO: 1769944 - RNA, 20 nt, Human
cguuuacuaugccugugucu

SEQ ID NO: 1769945 - RNA, 14 nt, Human
cgcgccacaggacc

SEQ ID NO: 1769946 - RNA, 16 nt, Human
cgcgccacaggacccu

SEQ ID NO: 1769947 - RNA, 17 nt, Human
cgcgccacaggacccuc

SEQ ID NO: 1769948 - RNA, 21 nt, Human
cgcgccacaggacccucgccg

SEQ ID NO: 1769949 - RNA, 16 nt, Human
ccucugacuuggggac

SEQ ID NO: 1769950 - RNA, 21 nt, Human
cgccccuagccgguuccuguc

SEQ ID NO: 1769951 - RNA, 12 nt, Human
cgcccagucugg

SEQ ID NO: 1769952 - RNA, 22 nt, Human
cgcccagagacccaagcugccu

SEQ ID NO: 1769953 - RNA, 14 nt, Human
cgccaguacuuguc

SEQ ID NO: 1769954 - RNA, 15 nt, Human
cgccaguacuuguca

SEQ ID NO: 1769955 - RNA, 14 nt, Human
cgcuuggagcagag

SEQ ID NO: 1769956 - RNA, 12 nt, Human
cgcuugcucugu

SEQ ID NO: 1769957 - RNA, 11 nt, Human
cgcuuuuccuu

SEQ ID NO: 1769958 - RNA, 14 nt, Human
cgcuuuuccuuggc

SEQ ID NO: 1769959 - RNA, 16 nt, Human
cgcuuuuccuuggcau

SEQ ID NO: 1769960 - RNA, 17 nt, Human
cgcuuuuccuuggcauu

SEQ ID NO: 1769961 - RNA, 13 nt, Human
cgcgccccuagcc

SEQ ID NO: 1769962 - RNA, 22 nt, Human
cgcuuuuccuuggcauuccgca

SEQ ID NO: 1769963 - RNA, 23 nt, Human
cgcuuuugccauuagccaaggau

SEQ ID NO: 1769964 - RNA, 14 nt, Human
cggaauaguuggcu

SEQ ID NO: 1769965 - RNA, 15 nt, Human
cggcagcauggagcu

SEQ ID NO: 1769966 - RNA, 15 nt, Human
cggcagccccagccu

SEQ ID NO: 1769967 - RNA, 16 nt, Human
cggcagccccagccug

SEQ ID NO: 1769968 - RNA, 17 nt, Human
cggcagccccagccugc

SEQ ID NO: 1769969 - RNA, 18 nt, Human
cggcagccccagccugcu

SEQ ID NO: 1769970 - RNA, 22 nt, Human
cggcagccccagccugcuagcu

SEQ ID NO: 1769971 - RNA, 13 nt, Human
cggccccugcugg

SEQ ID NO: 1769972 - RNA, 18 nt, Human
cggccccugcugguucag

SEQ ID NO: 1769973 - RNA, 19 nt, Human
cggccccugcugguucagg

SEQ ID NO: 1769974 - RNA, 24 nt, Human
cggccaggccagagggagugacag

SEQ ID NO: 1769975 - RNA, 20 nt, Human
cggccuagggcccccacagu

SEQ ID NO: 1769976 - RNA, 16 nt, Human
cggcccgcgccacagg

SEQ ID NO: 1769977 - RNA, 17 nt, Human
cggcccgcgccacagga

SEQ ID NO: 1769978 - RNA, 23 nt, Human
cggggacagcuccuucuguccua

SEQ ID NO: 1769979 - RNA, 21 nt, Human
cggggccuuaucgggcuccag

SEQ ID NO: 1769980 - RNA, 22 nt, Human
cggggccuuaucgggcuccagc

SEQ ID NO: 1769981 - RNA, 14 nt, Human
cggggcugucggcg

SEQ ID NO: 1769982 - RNA, 19 nt, Human
cggggcugucggcgcugcc

SEQ ID NO: 1769983 - RNA, 21 nt, Human
cggggcugucggcgcugcccc

SEQ ID NO: 1769984 - RNA, 15 nt, Human
cggggugcuuccuug

SEQ ID NO: 1769985 - RNA, 16 nt, Human
cgggggcaggugcugg

SEQ ID NO: 1769986 - RNA, 16 nt, Human
cgggacucaggcggga

SEQ ID NO: 1769987 - RNA, 22 nt, Human
cgggacucaggcgggacagugc

SEQ ID NO: 1769988 - RNA, 22 nt, Human
cggggacagcuccuucuguccu

SEQ ID NO: 1769989 - RNA, 14 nt, Human
cgggcacucagaag

SEQ ID NO: 1769990 - RNA, 22 nt, Human
cgggcacucagaagacacugau

SEQ ID NO: 1769991 - RNA, 13 nt, Human
cgggucugccucu

SEQ ID NO: 1769992 - RNA, 18 nt, Human
cgggucgggggcaggugc

SEQ ID NO: 1769993 - RNA, 17 nt, Human
cggguuagacagccaaa

SEQ ID NO: 1769994 - RNA, 14 nt, Human
cgguccacccagga

SEQ ID NO: 1769995 - RNA, 15 nt, Human
cgguccacccaggag

SEQ ID NO: 1769996 - RNA, 16 nt, Human
cgguccacccaggagc

SEQ ID NO: 1769997 - RNA, 20 nt, Human
cgguccacccaggagccccg

SEQ ID NO: 1769998 - RNA, 20 nt, Human
cggugagaggggaacagacu

SEQ ID NO: 1769999 - RNA, 21 nt, Human
cggugagaggggaacagacug

SEQ ID NO: 1770000 - RNA, 17 nt, Human
cggugagcuacaaaugc

SEQ ID NO: 1770001 - RNA, 14 nt, Human
cggugccaugucug

SEQ ID NO: 1770002 - RNA, 19 nt, Human
cggugccaugucugcagug

SEQ ID NO: 1770003 - RNA, 21 nt, Human
cggucccaguuuuguugcccc

SEQ ID NO: 1770004 - RNA, 16 nt, Human
cucuauaaggcagccu

SEQ ID NO: 1770005 - RNA, 15 nt, Human
cucuauaaaaaauau

SEQ ID NO: 1770006 - RNA, 16 nt, Human
cucuccuguccucccu

SEQ ID NO: 1770007 - RNA, 14 nt, Human
cucuccuuccugug

SEQ ID NO: 1770008 - RNA, 14 nt, Human
cucuccccagcaag

SEQ ID NO: 1770009 - RNA, 22 nt, Human
cucuccccagcaagugagagcu

SEQ ID NO: 1770010 - RNA, 24 nt, Human
cucuccccagcaagugagagcugg

SEQ ID NO: 1770011 - RNA, 18 nt, Human
cucggcuuuucucagcug

SEQ ID NO: 1770012 - RNA, 17 nt, Human
cucggcuuuucucagcu

SEQ ID NO: 1770013 - RNA, 14 nt, Human
cucuaaccucgccc

SEQ ID NO: 1770014 - RNA, 17 nt, Human
cucuaaccucgcccucu

SEQ ID NO: 1770015 - RNA, 19 nt, Human
cucuaaccucgcccucucc

SEQ ID NO: 1770016 - RNA, 20 nt, Human
cucuaaccucgcccucuccu

SEQ ID NO: 1770017 - RNA, 13 nt, Human
cucuacagaggcc

SEQ ID NO: 1770018 - RNA, 17 nt, Human
cucuacagagcuucccu

SEQ ID NO: 1770019 - RNA, 18 nt, Human
cucuacagagcuucccug

SEQ ID NO: 1770020 - RNA, 20 nt, Human
cucuacagagcuucccugac

SEQ ID NO: 1770021 - RNA, 22 nt, Human
cucuacagagcuucccugacuc

SEQ ID NO: 1770022 - RNA, 23 nt, Human
cucuacagagcuucccugacuca

SEQ ID NO: 1770023 - RNA, 19 nt, Human
cucuacagaggccaugggc

SEQ ID NO: 1770024 - RNA, 14 nt, Human
cucuacagaggcca

SEQ ID NO: 1770025 - RNA, 16 nt, Human
cucuacagaggccaug

SEQ ID NO: 1770026 - RNA, 13 nt, Human
cucggcucagcuc

SEQ ID NO: 1770027 - RNA, 16 nt, Human
cucgcuguugcugaau

SEQ ID NO: 1770028 - RNA, 15 nt, Human
cucgcuguugcugaa

SEQ ID NO: 1770029 - RNA, 13 nt, Human
cucgcuguugcug

SEQ ID NO: 1770030 - RNA, 13 nt, Human
cucgcugccagcu

SEQ ID NO: 1770031 - RNA, 16 nt, Human
cucgcugccagcucug

SEQ ID NO: 1770032 - RNA, 12 nt, Human
cucgcuguugcu

SEQ ID NO: 1770033 - RNA, 19 nt, Human
cucgcuggacucucagucu

SEQ ID NO: 1770034 - RNA, 19 nt, Human
cucgcugccagcucuguau

SEQ ID NO: 1770035 - RNA, 15 nt, Human
cucgcuggacucuca

SEQ ID NO: 1770036 - RNA, 16 nt, Human
cucgcuggacucucag

SEQ ID NO: 1770037 - RNA, 20 nt, Human
cuccugugugugcgccuaca

SEQ ID NO: 1770038 - RNA, 21 nt, Human
cucuacuaacaaucagcuccu

SEQ ID NO: 1770039 - RNA, 20 nt, Human
cucuaccagauaacugagga

SEQ ID NO: 1770040 - RNA, 23 nt, Human
cucuaccagauaacugaggaggg

SEQ ID NO: 1770041 - RNA, 21 nt, Human
cucuaccagauaacugaggag

SEQ ID NO: 1770042 - RNA, 13 nt, Human
cucuacccagggc

SEQ ID NO: 1770043 - RNA, 14 nt, Human
cucuacccagggcc

SEQ ID NO: 1770044 - RNA, 17 nt, Human
cucuacccagggccugc

SEQ ID NO: 1770045 - RNA, 18 nt, Human
cucuacccagggccugca

SEQ ID NO: 1770046 - RNA, 12 nt, Human
cucuaccugaca

SEQ ID NO: 1770047 - RNA, 22 nt, Human
cucuaccugacacucccuuggg

SEQ ID NO: 1770048 - RNA, 15 nt, Human
cucuagagccuucag

SEQ ID NO: 1770049 - RNA, 22 nt, Human
cucuagagccuucagccuuaau

SEQ ID NO: 1770050 - RNA, 16 nt, Human
cuccugccucagccuc

SEQ ID NO: 1770051 - RNA, 15 nt, Human
cuccugccucagccu

SEQ ID NO: 1770052 - RNA, 16 nt, Human
cuccugccuuccuccu

SEQ ID NO: 1770053 - RNA, 18 nt, Human
cuccugccuuccuccugg

SEQ ID NO: 1770054 - RNA, 19 nt, Human
cuccugccuuccuccuggg

SEQ ID NO: 1770055 - RNA, 20 nt, Human
cuccugccuuccuccugggc

SEQ ID NO: 1770056 - RNA, 16 nt, Human
cuccugugugugcgcc

SEQ ID NO: 1770057 - RNA, 19 nt, Human
cuccugugugugcgccuac

SEQ ID NO: 1770058 - RNA, 13 nt, Human
cuccugccucagc

SEQ ID NO: 1770059 - RNA, 14 nt, Human
cuccugccucagcc

SEQ ID NO: 1770060 - RNA, 21 nt, Human
cuccuccccccuccucugaaa

SEQ ID NO: 1770061 - RNA, 22 nt, Human
cuccuccccccuccucugaaac

SEQ ID NO: 1770062 - RNA, 11 nt, Human
cuccucccaua

SEQ ID NO: 1770063 - RNA, 22 nt, Human
cuccucuccccagcaagugaga

SEQ ID NO: 1770064 - RNA, 15 nt, Human
cuccuccaugggaga

SEQ ID NO: 1770065 - RNA, 18 nt, Human
cuccuccaugggagaaaa

SEQ ID NO: 1770066 - RNA, 15 nt, Human
cuccgaccagacacc

SEQ ID NO: 1770067 - RNA, 18 nt, Human
cucccaaagugcugggau

SEQ ID NO: 1770068 - RNA, 23 nt, Human
cucccaggugcagccagaggcac

SEQ ID NO: 1770069 - RNA, 18 nt, Human
cucccaggugcagccaga

SEQ ID NO: 1770070 - RNA, 17 nt, Human
cucccaggugcagccag

SEQ ID NO: 1770071 - RNA, 17 nt, Human
cucccaaagugcuggga

SEQ ID NO: 1770072 - RNA, 13 nt, Human
cuccaugugggcu

SEQ ID NO: 1770073 - RNA, 18 nt, Human
cucacuauguugcccagg

SEQ ID NO: 1770074 - RNA, 12 nt, Human
cuccccagcaag

SEQ ID NO: 1770075 - RNA, 20 nt, Human
cuccccagcaagugagagcu

SEQ ID NO: 1770076 - RNA, 21 nt, Human
cuccccagcaagugagagcug

SEQ ID NO: 1770077 - RNA, 12 nt, Human
cuccccagccug

SEQ ID NO: 1770078 - RNA, 13 nt, Human
cuccccagccugc

SEQ ID NO: 1770079 - RNA, 14 nt, Human
cuccccagccugcg

SEQ ID NO: 1770080 - RNA, 16 nt, Human
cuccccagccugcgcc

SEQ ID NO: 1770081 - RNA, 21 nt, Human
cuccccagccugcgccugcug

SEQ ID NO: 1770082 - RNA, 17 nt, Human
cucccgaauagcuggga

SEQ ID NO: 1770083 - RNA, 16 nt, Human
cucccgaauagcuggg

SEQ ID NO: 1770084 - RNA, 15 nt, Human
cucccgaguagcugg

SEQ ID NO: 1770085 - RNA, 18 nt, Human
cucccgaauagcugggac

SEQ ID NO: 1770086 - RNA, 16 nt, Human
cucccgaguagcuggg

SEQ ID NO: 1770087 - RNA, 17 nt, Human
cucccgaguagcuggga

SEQ ID NO: 1770088 - RNA, 19 nt, Human
cucccgaauagcugggacu

SEQ ID NO: 1770089 - RNA, 18 nt, Human
cucccgaguagcugggac

SEQ ID NO: 1770090 - RNA, 11 nt, Human
cucccgcggug

SEQ ID NO: 1770091 - RNA, 18 nt, Human
cucccgggccccacagac

SEQ ID NO: 1770092 - RNA, 12 nt, Human
cugacuugggga

SEQ ID NO: 1770093 - RNA, 19 nt, Human
cugacuuggggaccuuuug

SEQ ID NO: 1770094 - RNA, 12 nt, Human
cugacucagggc

SEQ ID NO: 1770095 - RNA, 14 nt, Human
cugacucagggcuc

SEQ ID NO: 1770096 - RNA, 13 nt, Human
cugacccacugcu

SEQ ID NO: 1770097 - RNA, 14 nt, Human
cugacccacugcuu

SEQ ID NO: 1770098 - RNA, 22 nt, Human
cugacauuguuggccaaagcca

SEQ ID NO: 1770099 - RNA, 18 nt, Human
cugacauuuggaguguuc

SEQ ID NO: 1770100 - RNA, 21 nt, Human
cugacauuuggaguguucccc

SEQ ID NO: 1770101 - RNA, 19 nt, Human
cugaagacucauucuucug

SEQ ID NO: 1770102 - RNA, 21 nt, Human
cugacaggcaaugcuggcugu

SEQ ID NO: 1770103 - RNA, 12 nt, Human
cugagcugaggc

SEQ ID NO: 1770104 - RNA, 13 nt, Human
cugagcugaggca

SEQ ID NO: 1770105 - RNA, 15 nt, Human
cugagcugaggcagc

SEQ ID NO: 1770106 - RNA, 18 nt, Human
cugaggaugggucagagc

SEQ ID NO: 1770107 - RNA, 19 nt, Human
cugaggaugggucagagcu

SEQ ID NO: 1770108 - RNA, 20 nt, Human
cugaggaugggucagagcua

SEQ ID NO: 1770109 - RNA, 15 nt, Human
cugaggcagcagugu

SEQ ID NO: 1770110 - RNA, 17 nt, Human
cugaggcagcaguguga

SEQ ID NO: 1770111 - RNA, 22 nt, Human
cugaggcagcagugugaggcca

SEQ ID NO: 1770112 - RNA, 23 nt, Human
cugaggcagcagugugaggccag

SEQ ID NO: 1770113 - RNA, 24 nt, Human
cugaggcagcagugugaggccagg

SEQ ID NO: 1770114 - RNA, 13 nt, Human
cugagccuggcca

SEQ ID NO: 1770115 - RNA, 14 nt, Human
cugagccuggccag

SEQ ID NO: 1770116 - RNA, 15 nt, Human
cugagccuggccagc

SEQ ID NO: 1770117 - RNA, 17 nt, Human
cugagccuggccagccu

SEQ ID NO: 1770118 - RNA, 20 nt, Human
cugagcgaggagaugcuccu

SEQ ID NO: 1770119 - RNA, 21 nt, Human
cucugccugaagucacacagu

SEQ ID NO: 1770120 - RNA, 22 nt, Human
cucugccugaagucacacagug

SEQ ID NO: 1770121 - RNA, 15 nt, Human
cucuggacaggcaug

SEQ ID NO: 1770122 - RNA, 16 nt, Human
cucuggacaggcaugu

SEQ ID NO: 1770123 - RNA, 22 nt, Human
cucuggacaggcauguucucug

SEQ ID NO: 1770124 - RNA, 22 nt, Human
cucuggaucuguuccuuggcag

SEQ ID NO: 1770125 - RNA, 19 nt, Human
cucugugucagguggggca

SEQ ID NO: 1770126 - RNA, 14 nt, Human
cucuguucagugua

SEQ ID NO: 1770127 - RNA, 15 nt, Human
cucuguucaguguaa

SEQ ID NO: 1770128 - RNA, 17 nt, Human
cucuguucaguguaaau

SEQ ID NO: 1770129 - RNA, 15 nt, Human
cucugugucaggugg

SEQ ID NO: 1770130 - RNA, 17 nt, Human
cucugugggugaugggg

SEQ ID NO: 1770131 - RNA, 22 nt, Human
cucugugggugauggggagggg

SEQ ID NO: 1770132 - RNA, 18 nt, Human
cucuguucaguguaaaua

SEQ ID NO: 1770133 - RNA, 14 nt, Human
cucuuacucuuucc

SEQ ID NO: 1770134 - RNA, 15 nt, Human
cucuuacucuuuccu

SEQ ID NO: 1770135 - RNA, 16 nt, Human
cucuuacucuuuccua

SEQ ID NO: 1770136 - RNA, 18 nt, Human
cucuuacucuuuccuauu

SEQ ID NO: 1770137 - RNA, 20 nt, Human
cucuuacucuuuccuauuuc

SEQ ID NO: 1770138 - RNA, 14 nt, Human
cucuucaucuaaua

SEQ ID NO: 1770139 - RNA, 22 nt, Human
cucugucugaguaagaaacaga

SEQ ID NO: 1770140 - RNA, 14 nt, Human
cucugucucaucca

SEQ ID NO: 1770141 - RNA, 15 nt, Human
cucugucucauccau

SEQ ID NO: 1770142 - RNA, 17 nt, Human
cucugucuucaccugau

SEQ ID NO: 1770143 - RNA, 18 nt, Human
cugaaagcugguggcaga

SEQ ID NO: 1770144 - RNA, 21 nt, Human
cugaaauaucccggggguggg

SEQ ID NO: 1770145 - RNA, 22 nt, Human
cugaaauaucccgggggugggg

SEQ ID NO: 1770146 - RNA, 19 nt, Human
cucuuucugucccuucugu

SEQ ID NO: 1770147 - RNA, 19 nt, Human
cucuuuccuauuucagugu

SEQ ID NO: 1770148 - RNA, 20 nt, Human
cucuuuccuauuucaguguu

SEQ ID NO: 1770149 - RNA, 12 nt, Human
cucuuugcugca

SEQ ID NO: 1770150 - RNA, 13 nt, Human
cucuuugcugcag

SEQ ID NO: 1770151 - RNA, 17 nt, Human
cucuuugcugcagagaa

SEQ ID NO: 1770152 - RNA, 10 nt, Human
cucuuugaga

SEQ ID NO: 1770153 - RNA, 13 nt, Human
cugaacagaagcu

SEQ ID NO: 1770154 - RNA, 18 nt, Human
cucuuuaaugucacaggc

SEQ ID NO: 1770155 - RNA, 21 nt, Human
cucuuuagaguuagacuguug

SEQ ID NO: 1770156 - RNA, 19 nt, Human
cucuuuagaguuagacugu

SEQ ID NO: 1770157 - RNA, 18 nt, Human
cucuuuagaguuagacug

SEQ ID NO: 1770158 - RNA, 17 nt, Human
cucuuuagaguuagacu

SEQ ID NO: 1770159 - RNA, 15 nt, Human
cucuuuagaguuaga

SEQ ID NO: 1770160 - RNA, 20 nt, Human
cucuuuaaugucacaggcag

SEQ ID NO: 1770161 - RNA, 21 nt, Human
cucuuuaaugucacaggcagg

SEQ ID NO: 1770162 - RNA, 22 nt, Human
cucuuuaaugucacaggcaggu

SEQ ID NO: 1770163 - RNA, 23 nt, Human
cucuuuaaugucacaggcagguc

SEQ ID NO: 1770164 - RNA, 21 nt, Human
cucuuggguucaagcgauucu

SEQ ID NO: 1770165 - RNA, 19 nt, Human
cucuuggguucaagcgauu

SEQ ID NO: 1770166 - RNA, 16 nt, Human
cucuucuucccagcac

SEQ ID NO: 1770167 - RNA, 13 nt, Human
cucuucugucccu

SEQ ID NO: 1770168 - RNA, 16 nt, Human
cucuuccgacucuuuc

SEQ ID NO: 1770169 - RNA, 18 nt, Human
cucuuccgacucuuucug

SEQ ID NO: 1770170 - RNA, 17 nt, Human
cucuuccuacccugccu

SEQ ID NO: 1770171 - RNA, 18 nt, Human
cucuuccuacccugccuc

SEQ ID NO: 1770172 - RNA, 19 nt, Human
cucuuccuacccugccucc

SEQ ID NO: 1770173 - RNA, 16 nt, Human
cuggcacccggccccu

SEQ ID NO: 1770174 - RNA, 17 nt, Human
cuggcacccggccccug

SEQ ID NO: 1770175 - RNA, 18 nt, Human
cuggcacccggccccugc

SEQ ID NO: 1770176 - RNA, 17 nt, Human
cuggcaugauccaagca

SEQ ID NO: 1770177 - RNA, 18 nt, Human
cuggcaugauccaagcaa

SEQ ID NO: 1770178 - RNA, 23 nt, Human
cuggccucaagugauucuccugc

SEQ ID NO: 1770179 - RNA, 17 nt, Human
cuggccccauggucagc

SEQ ID NO: 1770180 - RNA, 19 nt, Human
cugggaggaauggacagac

SEQ ID NO: 1770181 - RNA, 22 nt, Human
cugggaggaauggacagacaga

SEQ ID NO: 1770182 - RNA, 17 nt, Human
cugggaggaauggacag

SEQ ID NO: 1770183 - RNA, 24 nt, Human
cugggccguaucuccggcucccag

SEQ ID NO: 1770184 - RNA, 18 nt, Human
cugggccguaucuccggc

SEQ ID NO: 1770185 - RNA, 21 nt, Human
cugggccguaucuccggcucc

SEQ ID NO: 1770186 - RNA, 12 nt, Human
cugggagugagc

SEQ ID NO: 1770187 - RNA, 20 nt, Human
cugggauuacaggugugaac

SEQ ID NO: 1770188 - RNA, 17 nt, Human
cugggauuacaggugug

SEQ ID NO: 1770189 - RNA, 18 nt, Human
cuggcuguuggcuggggg

SEQ ID NO: 1770190 - RNA, 16 nt, Human
cuggcuguuggcuggg

SEQ ID NO: 1770191 - RNA, 17 nt, Human
cuggcuguuggcugggg

SEQ ID NO: 1770192 - RNA, 22 nt, Human
cuggcgacacguagcagcuuag

SEQ ID NO: 1770193 - RNA, 23 nt, Human
cuggcgagagucuggcccuagac

SEQ ID NO: 1770194 - RNA, 19 nt, Human
cuggcgagagucuggcccu

SEQ ID NO: 1770195 - RNA, 23 nt, Human
cuggcgcagaacgaaccuuggcc

SEQ ID NO: 1770196 - RNA, 24 nt, Human
cuggcgcagaacgaaccuuggccu

SEQ ID NO: 1770197 - RNA, 20 nt, Human
cugguucaggguuggccccu

SEQ ID NO: 1770198 - RNA, 12 nt, Human
cugguggcagcu

SEQ ID NO: 1770199 - RNA, 16 nt, Human
cugguggcagaguccu

SEQ ID NO: 1770200 - RNA, 11 nt, Human
cuguacagggg

SEQ ID NO: 1770201 - RNA, 15 nt, Human
cuggguuggagggug

SEQ ID NO: 1770202 - RNA, 19 nt, Human
cuggguacuuguggacaca

SEQ ID NO: 1770203 - RNA, 18 nt, Human
cuggguacuuguggacac

SEQ ID NO: 1770204 - RNA, 16 nt, Human
cuggguacuuguggac

SEQ ID NO: 1770205 - RNA, 14 nt, Human
cuggguacuugugg

SEQ ID NO: 1770206 - RNA, 17 nt, Human
cugguagccugcagaag

SEQ ID NO: 1770207 - RNA, 23 nt, Human
cuggucucaaacucuugaccuca

SEQ ID NO: 1770208 - RNA, 14 nt, Human
cuggucccacucag

SEQ ID NO: 1770209 - RNA, 13 nt, Human
cuggucccacuca

SEQ ID NO: 1770210 - RNA, 13 nt, Human
cugguccacaggg

SEQ ID NO: 1770211 - RNA, 16 nt, Human
cugguccacagggcac

SEQ ID NO: 1770212 - RNA, 22 nt, Human
cugguccacagggcaccugcca

SEQ ID NO: 1770213 - RNA, 12 nt, Human
cugucccucaca

SEQ ID NO: 1770214 - RNA, 13 nt, Human
cugucccucacag

SEQ ID NO: 1770215 - RNA, 16 nt, Human
cugucccucacagcac

SEQ ID NO: 1770216 - RNA, 12 nt, Human
cugucccuccgg

SEQ ID NO: 1770217 - RNA, 16 nt, Human
cuguccuacucugugu

SEQ ID NO: 1770218 - RNA, 17 nt, Human
cuguccuacucuguguc

SEQ ID NO: 1770219 - RNA, 18 nt, Human
cuguccuacucuguguca

SEQ ID NO: 1770220 - RNA, 20 nt, Human
cuguccuacucugugucagg

SEQ ID NO: 1770221 - RNA, 17 nt, Human
cugucccuucugucccu

SEQ ID NO: 1770222 - RNA, 18 nt, Human
cugucccuucugucccuc

SEQ ID NO: 1770223 - RNA, 19 nt, Human
cugucccuucugucccuca

SEQ ID NO: 1770224 - RNA, 12 nt, Human
cugucucaucca

SEQ ID NO: 1770225 - RNA, 15 nt, Human
cugucucauccauca

SEQ ID NO: 1770226 - RNA, 16 nt, Human
cugucucauccaucau

SEQ ID NO: 1770227 - RNA, 17 nt, Human
cugucucauccaucauc

SEQ ID NO: 1770228 - RNA, 20 nt, Human
cugucucauccaucaucaug

SEQ ID NO: 1770229 - RNA, 21 nt, Human
cugucucauccaucaucaugu

SEQ ID NO: 1770230 - RNA, 21 nt, Human
cuguccuacucugugucaggu

SEQ ID NO: 1770231 - RNA, 22 nt, Human
cugucuccuuucaccccagggc

SEQ ID NO: 1770232 - RNA, 23 nt, Human
cugucuccuuucaccccagggcc

SEQ ID NO: 1770233 - RNA, 18 nt, Human
cugucccauagucccugc

SEQ ID NO: 1770234 - RNA, 19 nt, Human
cugucccauagucccugcc

SEQ ID NO: 1770235 - RNA, 21 nt, Human
cugucccaucuggucauuugg

SEQ ID NO: 1770236 - RNA, 14 nt, Human
cuguaucccaugag

SEQ ID NO: 1770237 - RNA, 15 nt, Human
cuguaucccaugagc

SEQ ID NO: 1770238 - RNA, 19 nt, Human
cuguaucccaugagccuca

SEQ ID NO: 1770239 - RNA, 18 nt, Human
cuguaucccaugagccuc

SEQ ID NO: 1770240 - RNA, 18 nt, Human
cuguauguuauagaacuu

SEQ ID NO: 1770241 - RNA, 19 nt, Human
cuguauguuauagaacuuc

SEQ ID NO: 1770242 - RNA, 15 nt, Human
cuguauuaagccacu

SEQ ID NO: 1770243 - RNA, 12 nt, Human
cugcucugguua

SEQ ID NO: 1770244 - RNA, 20 nt, Human
cugcucugcgugucaccugu

SEQ ID NO: 1770245 - RNA, 21 nt, Human
cugcucugcgugucaccugug

SEQ ID NO: 1770246 - RNA, 22 nt, Human
cugcucugcgugucaccugugc

SEQ ID NO: 1770247 - RNA, 20 nt, Human
cugcuccccagcagcggaac

SEQ ID NO: 1770248 - RNA, 23 nt, Human
cugcuccucuccccagcaaguga

SEQ ID NO: 1770249 - RNA, 19 nt, Human
cugcuccucuccccagcaa

SEQ ID NO: 1770250 - RNA, 20 nt, Human
cugcuccucuccccagcaag

SEQ ID NO: 1770251 - RNA, 15 nt, Human
cugcucuccgaccag

SEQ ID NO: 1770252 - RNA, 19 nt, Human
cugcucuccgaccagacac

SEQ ID NO: 1770253 - RNA, 13 nt, Human
cugccuuccuccu

SEQ ID NO: 1770254 - RNA, 14 nt, Human
cugccuuccuccug

SEQ ID NO: 1770255 - RNA, 15 nt, Human
cugccuuccuccugg

SEQ ID NO: 1770256 - RNA, 16 nt, Human
cugccuuccuccuggg

SEQ ID NO: 1770257 - RNA, 18 nt, Human
cugccuuccuccugggcc

SEQ ID NO: 1770258 - RNA, 21 nt, Human
cugccuuccuccugggcccuc

SEQ ID NO: 1770259 - RNA, 16 nt, Human
cugcgccaguccugcu

SEQ ID NO: 1770260 - RNA, 20 nt, Human
cugcgccaguccugcuaccu

SEQ ID NO: 1770261 - RNA, 21 nt, Human
cugcgccuuuccuuuucgccu

SEQ ID NO: 1770262 - RNA, 12 nt, Human
cugcgccugcug

SEQ ID NO: 1770263 - RNA, 13 nt, Human
cugcgccugcugc

SEQ ID NO: 1770264 - RNA, 20 nt, Human
cugcgccugcugcaugcccu

SEQ ID NO: 1770265 - RNA, 23 nt, Human
cugcgccugcugcaugcccucuc

SEQ ID NO: 1770266 - RNA, 13 nt, Human
cugcgccuuuccu

SEQ ID NO: 1770267 - RNA, 23 nt, Human
cugcgguccacccaggagccccg

SEQ ID NO: 1770268 - RNA, 23 nt, Human
cugccugaagucacacagugagu

SEQ ID NO: 1770269 - RNA, 19 nt, Human
cugccugaagucacacagu

SEQ ID NO: 1770270 - RNA, 12 nt, Human
cugccugcccac

SEQ ID NO: 1770271 - RNA, 13 nt, Human
cugccugcccaca

SEQ ID NO: 1770272 - RNA, 23 nt, Human
cugccugccgguaaacacgccug

SEQ ID NO: 1770273 - RNA, 18 nt, Human
cugccugaagucacacag

SEQ ID NO: 1770274 - RNA, 16 nt, Human
cugccugaagucacac

SEQ ID NO: 1770275 - RNA, 19 nt, Human
cugcuuuugucuaugggac

SEQ ID NO: 1770276 - RNA, 17 nt, Human
cugcuuuuggucugugu

SEQ ID NO: 1770277 - RNA, 12 nt, Human
cuggaagcccag

SEQ ID NO: 1770278 - RNA, 14 nt, Human
cuggaagcccagcc

SEQ ID NO: 1770279 - RNA, 17 nt, Human
cuggaagcccagccccu

SEQ ID NO: 1770280 - RNA, 21 nt, Human
cuggaagcccagccccuacug

SEQ ID NO: 1770281 - RNA, 22 nt, Human
cuggaagcccagccccuacugc

SEQ ID NO: 1770282 - RNA, 14 nt, Human
cugcuuuggcagug

SEQ ID NO: 1770283 - RNA, 15 nt, Human
cugcuuuggcagugc

SEQ ID NO: 1770284 - RNA, 16 nt, Human
cugcuuuggcagugcc

SEQ ID NO: 1770285 - RNA, 15 nt, Human
cugcuuuuggucugu

SEQ ID NO: 1770286 - RNA, 12 nt, Human
cugcuugaggaa

SEQ ID NO: 1770287 - RNA, 13 nt, Human
cugcuugaggaaa

SEQ ID NO: 1770288 - RNA, 14 nt, Human
cugcuugaggaaaa

SEQ ID NO: 1770289 - RNA, 16 nt, Human
cugcuugaggaaaaca

SEQ ID NO: 1770290 - RNA, 22 nt, Human
cugcuucuccaaaaaucugccu

SEQ ID NO: 1770291 - RNA, 23 nt, Human
cugcuucuccaaaaaucugccug

SEQ ID NO: 1770292 - RNA, 12 nt, Human
cugcccucuaga

SEQ ID NO: 1770293 - RNA, 14 nt, Human
cugcccucuagagc

SEQ ID NO: 1770294 - RNA, 20 nt, Human
cugcccucuagagccuucag

SEQ ID NO: 1770295 - RNA, 18 nt, Human
cugcccguaaacacgccu

SEQ ID NO: 1770296 - RNA, 19 nt, Human
cugcccguaaacacgccug

SEQ ID NO: 1770297 - RNA, 21 nt, Human
cugcccguaaacacgccugca

SEQ ID NO: 1770298 - RNA, 14 nt, Human
cugccccagcccag

SEQ ID NO: 1770299 - RNA, 15 nt, Human
cugccccagcccaga

SEQ ID NO: 1770300 - RNA, 16 nt, Human
cugccccagcccagau

SEQ ID NO: 1770301 - RNA, 14 nt, Human
cugcccaggccccu

SEQ ID NO: 1770302 - RNA, 15 nt, Human
cugcccaggccccug

SEQ ID NO: 1770303 - RNA, 23 nt, Human
cugccccaccccuccccauuagc

SEQ ID NO: 1770304 - RNA, 16 nt, Human
cugcccaggccccugc

SEQ ID NO: 1770305 - RNA, 18 nt, Human
cugcccaggccccugcca

SEQ ID NO: 1770306 - RNA, 19 nt, Human
cugcccaggccccugccac

SEQ ID NO: 1770307 - RNA, 20 nt, Human
cugcccaggccccugccacc

SEQ ID NO: 1770308 - RNA, 21 nt, Human
cugccauccagguucagcuug

SEQ ID NO: 1770309 - RNA, 16 nt, Human
cugccauguugccccu

SEQ ID NO: 1770310 - RNA, 22 nt, Human
cugccauguugccccuuucucu

SEQ ID NO: 1770311 - RNA, 17 nt, Human
cugccagcucuguauca

SEQ ID NO: 1770312 - RNA, 21 nt, Human
cugccacccuggggagaaagu

SEQ ID NO: 1770313 - RNA, 23 nt, Human
cugccacccugggccuggcagcu

SEQ ID NO: 1770314 - RNA, 12 nt, Human
cugccacccugg

SEQ ID NO: 1770315 - RNA, 14 nt, Human
cugccacccugggg

SEQ ID NO: 1770316 - RNA, 16 nt, Human
cugccacccugggccu

SEQ ID NO: 1770317 - RNA, 17 nt, Human
cugccacccugggccug

SEQ ID NO: 1770318 - RNA, 12 nt, Human
cugccaccccua

SEQ ID NO: 1770319 - RNA, 14 nt, Human
cugcagugugcccc

SEQ ID NO: 1770320 - RNA, 15 nt, Human
cugcagugugccccc

SEQ ID NO: 1770321 - RNA, 18 nt, Human
cugcaccgggccacagag

SEQ ID NO: 1770322 - RNA, 20 nt, Human
cugcaccgggccacagagaa

SEQ ID NO: 1770323 - RNA, 14 nt, Human
cugcaccgggccac

SEQ ID NO: 1770324 - RNA, 15 nt, Human
cugcaccgggccaca

SEQ ID NO: 1770325 - RNA, 17 nt, Human
cuuucuuagaaauuuau

SEQ ID NO: 1770326 - RNA, 14 nt, Human
cuuucuuagaaauu

SEQ ID NO: 1770327 - RNA, 13 nt, Human
cuuucuuagaaau

SEQ ID NO: 1770328 - RNA, 11 nt, Human
cuuucuuagaa

SEQ ID NO: 1770329 - RNA, 15 nt, Human
cuuucuuucuuagaa

SEQ ID NO: 1770330 - RNA, 17 nt, Human
cuuucuuucuuagaaau

SEQ ID NO: 1770331 - RNA, 16 nt, Human
cuuucuuucuuagaaa

SEQ ID NO: 1770332 - RNA, 22 nt, Human
cuuucuuugggaauauuugaau

SEQ ID NO: 1770333 - RNA, 21 nt, Human
cuuucuuugggaauauuugaa

SEQ ID NO: 1770334 - RNA, 20 nt, Human
cuuucuuugggaauauuuga

SEQ ID NO: 1770335 - RNA, 18 nt, Human
cuuucuuugggaauauuu

SEQ ID NO: 1770336 - RNA, 23 nt, Human
cuuucuuugggaauauuugaauc

SEQ ID NO: 1770337 - RNA, 16 nt, Human
cuuugcagacaggcaa

SEQ ID NO: 1770338 - RNA, 14 nt, Human
cuuugcagacaggc

SEQ ID NO: 1770339 - RNA, 15 nt, Human
cuuugcagacaggca

SEQ ID NO: 1770340 - RNA, 17 nt, Human
cuuugaauaaagaauac

SEQ ID NO: 1770341 - RNA, 18 nt, Human
cuuugaauaaagaauacu

SEQ ID NO: 1770342 - RNA, 21 nt, Human
cuuugaauaaagaauacuuga

SEQ ID NO: 1770343 - RNA, 22 nt, Human
cuuugaauaaagaauacuugaa

SEQ ID NO: 1770344 - RNA, 16 nt, Human
cuuugaagucauacca

SEQ ID NO: 1770345 - RNA, 21 nt, Human
cuuguggacacagcucuucuc

SEQ ID NO: 1770346 - RNA, 19 nt, Human
cuuucaaaaccuuuugaaa

SEQ ID NO: 1770347 - RNA, 15 nt, Human
cuuucaaaccagcuu

SEQ ID NO: 1770348 - RNA, 16 nt, Human
cuuucaaaccagcuuc

SEQ ID NO: 1770349 - RNA, 18 nt, Human
cuuucaaaccagcuucau

SEQ ID NO: 1770350 - RNA, 17 nt, Human
cuuucauguaaacugug

SEQ ID NO: 1770351 - RNA, 19 nt, Human
cuuucauguaaacugugca

SEQ ID NO: 1770352 - RNA, 20 nt, Human
cuuucauguaaacugugcac

SEQ ID NO: 1770353 - RNA, 21 nt, Human
cuuucauguaaacugugcacc

SEQ ID NO: 1770354 - RNA, 21 nt, Human
cuuuccacggagccacuccuc

SEQ ID NO: 1770355 - RNA, 22 nt, Human
cuuuccacggagccacuccucu

SEQ ID NO: 1770356 - RNA, 11 nt, Human
cuuuuucuacc

SEQ ID NO: 1770357 - RNA, 14 nt, Human
cuuuucgccuuucc

SEQ ID NO: 1770358 - RNA, 15 nt, Human
cuuuucgccuuuccu

SEQ ID NO: 1770359 - RNA, 18 nt, Human
cuuuguuuuuuguuggag

SEQ ID NO: 1770360 - RNA, 13 nt, Human
cuuuuaaugaaaa

SEQ ID NO: 1770361 - RNA, 16 nt, Human
cuuuuaaugaaaagga

SEQ ID NO: 1770362 - RNA, 13 nt, Human
cuuuuccuuggca

SEQ ID NO: 1770363 - RNA, 15 nt, Human
cuuuuccuuggcauu

SEQ ID NO: 1770364 - RNA, 16 nt, Human
cuuuuccauuaugcug

SEQ ID NO: 1770365 - RNA, 21 nt, Human
cuucuuucuuugggaauauuu

SEQ ID NO: 1770366 - RNA, 19 nt, Human
cuugaacuccuggccucaa

SEQ ID NO: 1770367 - RNA, 16 nt, Human
cuugaacuggguacuu

SEQ ID NO: 1770368 - RNA, 14 nt, Human
cuugaacuugccuc

SEQ ID NO: 1770369 - RNA, 15 nt, Human
cuugaacuugccucu

SEQ ID NO: 1770370 - RNA, 18 nt, Human
cuugaacuugccucuuuu

SEQ ID NO: 1770371 - RNA, 18 nt, Human
cuugaacuggguacuugu

SEQ ID NO: 1770372 - RNA, 20 nt, Human
cuugaacuggguacuugugg

SEQ ID NO: 1770373 - RNA, 14 nt, Human
cuugaacuccuggc

SEQ ID NO: 1770374 - RNA, 15 nt, Human
cuugaacuccuggcc

SEQ ID NO: 1770375 - RNA, 17 nt, Human
cuugaacuccuggccuc

SEQ ID NO: 1770376 - RNA, 18 nt, Human
cuugaacuccuggccuca

SEQ ID NO: 1770377 - RNA, 14 nt, Human
cuugcaauggcagc

SEQ ID NO: 1770378 - RNA, 20 nt, Human
cuugcagacucuacagaggc

SEQ ID NO: 1770379 - RNA, 18 nt, Human
cuugcagacucuacagag

SEQ ID NO: 1770380 - RNA, 15 nt, Human
cuuguauccaggccu

SEQ ID NO: 1770381 - RNA, 17 nt, Human
cuuguauccaggccugg

SEQ ID NO: 1770382 - RNA, 17 nt, Human
cuuguggacacagcucu

SEQ ID NO: 1770383 - RNA, 18 nt, Human
cuuguggacacagcucuu

SEQ ID NO: 1770384 - RNA, 20 nt, Human
cuugucauauguagccuuca

SEQ ID NO: 1770385 - RNA, 14 nt, Human
cuuggcugcaggga

SEQ ID NO: 1770386 - RNA, 14 nt, Human
cuuggcuugcccac

SEQ ID NO: 1770387 - RNA, 17 nt, Human
cuuguaaacagaagcaa

SEQ ID NO: 1770388 - RNA, 18 nt, Human
cuuguaaaggaauuuaaa

SEQ ID NO: 1770389 - RNA, 23 nt, Human
cuuggcucaaguccucuuuucug

SEQ ID NO: 1770390 - RNA, 12 nt, Human
cuuggcugcagg

SEQ ID NO: 1770391 - RNA, 13 nt, Human
cuuggcugcaggg

SEQ ID NO: 1770392 - RNA, 14 nt, Human
cuuggauucucuaa

SEQ ID NO: 1770393 - RNA, 15 nt, Human
cuuggauucucuaac

SEQ ID NO: 1770394 - RNA, 18 nt, Human
cuuggauguaccugcccc

SEQ ID NO: 1770395 - RNA, 16 nt, Human
cuuggaccagaucuaa

SEQ ID NO: 1770396 - RNA, 21 nt, Human
cuugcuggcuacgccucuucu

SEQ ID NO: 1770397 - RNA, 22 nt, Human
cuugcuggcuacgccucuucug

SEQ ID NO: 1770398 - RNA, 17 nt, Human
cuugccaaauauaaaua

SEQ ID NO: 1770399 - RNA, 12 nt, Human
cuugcugcuguc

SEQ ID NO: 1770400 - RNA, 13 nt, Human
cuugcugcugucu

SEQ ID NO: 1770401 - RNA, 16 nt, Human
gaacugugccacaaug

SEQ ID NO: 1770402 - RNA, 20 nt, Human
gaaccacaucuugcucugcu

SEQ ID NO: 1770403 - RNA, 18 nt, Human
gaaccacaucuugcucug

SEQ ID NO: 1770404 - RNA, 15 nt, Human
gaagaaaguggaaaa

SEQ ID NO: 1770405 - RNA, 22 nt, Human
gaacuuguaaaggaauuuaaaa

SEQ ID NO: 1770406 - RNA, 15 nt, Human
gaacuugucucuuca

SEQ ID NO: 1770407 - RNA, 14 nt, Human
gaagauucuuuccc

SEQ ID NO: 1770408 - RNA, 21 nt, Human
gaagaucucacucugcccccc

SEQ ID NO: 1770409 - RNA, 19 nt, Human
gaagaucucugcagggccg

SEQ ID NO: 1770410 - RNA, 22 nt, Human
gaagaucucugcagggccgcca

SEQ ID NO: 1770411 - RNA, 21 nt, Human
gaaggaacuugucucuucauc

SEQ ID NO: 1770412 - RNA, 23 nt, Human
gaaggaacuugucucuucaucua

SEQ ID NO: 1770413 - RNA, 19 nt, Human
gaaggacauugcggacagc

SEQ ID NO: 1770414 - RNA, 20 nt, Human
gaaggacauugcggacagcc

SEQ ID NO: 1770415 - RNA, 21 nt, Human
gaaggacauugcggacagcca

SEQ ID NO: 1770416 - RNA, 20 nt, Human
gaagccgccaguacuuguca

SEQ ID NO: 1770417 - RNA, 21 nt, Human
gaagccucugggucagugguc

SEQ ID NO: 1770418 - RNA, 16 nt, Human
gaaguaagccucauca

SEQ ID NO: 1770419 - RNA, 15 nt, Human
gaagucaaagcaagg

SEQ ID NO: 1770420 - RNA, 16 nt, Human
gaagucaaagcaagga

SEQ ID NO: 1770421 - RNA, 13 nt, Human
gaagucacacagu

SEQ ID NO: 1770422 - RNA, 14 nt, Human
gaaggggccagagg

SEQ ID NO: 1770423 - RNA, 16 nt, Human
gaaggggccagaggcu

SEQ ID NO: 1770424 - RNA, 17 nt, Human
gaaggggccagaggcuc

SEQ ID NO: 1770425 - RNA, 18 nt, Human
gaaaugaggucagagccu

SEQ ID NO: 1770426 - RNA, 22 nt, Human
gaaaugcauugcucuggaucug

SEQ ID NO: 1770427 - RNA, 12 nt, Human
gaaauaucauuu

SEQ ID NO: 1770428 - RNA, 13 nt, Human
gaaauaucauuua

SEQ ID NO: 1770429 - RNA, 14 nt, Human
gaaauaucauuuau

SEQ ID NO: 1770430 - RNA, 18 nt, Human
gaaauaucccgggggugg

SEQ ID NO: 1770431 - RNA, 20 nt, Human
gaaauaucccgggggugggg

SEQ ID NO: 1770432 - RNA, 22 nt, Human
gaacagacuggaagcacagcuu

SEQ ID NO: 1770433 - RNA, 11 nt, Human
gaacaggacua

SEQ ID NO: 1770434 - RNA, 12 nt, Human
gaacaugcaguu

SEQ ID NO: 1770435 - RNA, 13 nt, Human
gaacaugcaguuu

SEQ ID NO: 1770436 - RNA, 15 nt, Human
gaacaugcaguuuga

SEQ ID NO: 1770437 - RNA, 16 nt, Human
gaacaugcaguuugaa

SEQ ID NO: 1770438 - RNA, 18 nt, Human
gaacaugcaguuugaaau

SEQ ID NO: 1770439 - RNA, 19 nt, Human
gaacaugcaguuugaaauu

SEQ ID NO: 1770440 - RNA, 20 nt, Human
gaacaugcaguuugaaauuc

SEQ ID NO: 1770441 - RNA, 22 nt, Human
gaacaugcaguuugaaauucug

SEQ ID NO: 1770442 - RNA, 23 nt, Human
gaacaugcaguuugaaauucuga

SEQ ID NO: 1770443 - RNA, 20 nt, Human
gaacagacuggaagcacagc

SEQ ID NO: 1770444 - RNA, 17 nt, Human
gaaagacugaagaaagu

SEQ ID NO: 1770445 - RNA, 19 nt, Human
gaaagacugaagaaagugu

SEQ ID NO: 1770446 - RNA, 15 nt, Human
gaaacugcagggaaa

SEQ ID NO: 1770447 - RNA, 20 nt, Human
gaaaaaugcccuuaaaucau

SEQ ID NO: 1770448 - RNA, 19 nt, Human
gaaaaagaacaugcaguuu

SEQ ID NO: 1770449 - RNA, 21 nt, Human
gaaaaagaacaugcaguuuga

SEQ ID NO: 1770450 - RNA, 23 nt, Human
gaaaaagaacaugcaguuugaaa

SEQ ID NO: 1770451 - RNA, 19 nt, Human
gaaacuauauuuugucaua

SEQ ID NO: 1770452 - RNA, 21 nt, Human
gaaagcauuugaaugcauuuu

SEQ ID NO: 1770453 - RNA, 20 nt, Human
gaaagcauuugaaugcauuu

SEQ ID NO: 1770454 - RNA, 18 nt, Human
gaaagcauuugaaugcau

SEQ ID NO: 1770455 - RNA, 17 nt, Human
gaaagcauuugaaugca

SEQ ID NO: 1770456 - RNA, 16 nt, Human
gaaagcauuugaaugc

SEQ ID NO: 1770457 - RNA, 15 nt, Human
gaaagcauuugaaug

SEQ ID NO: 1770458 - RNA, 14 nt, Human
gaaagcauuugaau

SEQ ID NO: 1770459 - RNA, 12 nt, Human
gaaagcauuuga

SEQ ID NO: 1770460 - RNA, 17 nt, Human
gaaagucauuggcuuua

SEQ ID NO: 1770461 - RNA, 14 nt, Human
gaaagucauuggcu

SEQ ID NO: 1770462 - RNA, 21 nt, Human
gaaagucauuggcuuuauccu

SEQ ID NO: 1770463 - RNA, 18 nt, Human
gaaagucauuggcuuuau

SEQ ID NO: 1770464 - RNA, 13 nt, Human
gagcccaccuugg

SEQ ID NO: 1770465 - RNA, 15 nt, Human
gagcccaccuuggcu

SEQ ID NO: 1770466 - RNA, 17 nt, Human
gagcccaccuuggcuca

SEQ ID NO: 1770467 - RNA, 18 nt, Human
gagccacugcaccgggcc

SEQ ID NO: 1770468 - RNA, 19 nt, Human
gagccacugcaccgggcca

SEQ ID NO: 1770469 - RNA, 20 nt, Human
gagccacugcaccgggccac

SEQ ID NO: 1770470 - RNA, 15 nt, Human
gagcagaggggcuga

SEQ ID NO: 1770471 - RNA, 14 nt, Human
gagaguuuuggaug

SEQ ID NO: 1770472 - RNA, 12 nt, Human
gagccugcaguu

SEQ ID NO: 1770473 - RNA, 10 nt, Human
gagccugagg

SEQ ID NO: 1770474 - RNA, 12 nt, Human
gagccugaggga

SEQ ID NO: 1770475 - RNA, 15 nt, Human
gagccugagggaucu

SEQ ID NO: 1770476 - RNA, 13 nt, Human
gagccucagcauc

SEQ ID NO: 1770477 - RNA, 13 nt, Human
gagccgugguccu

SEQ ID NO: 1770478 - RNA, 17 nt, Human
gagccgugguccuuugg

SEQ ID NO: 1770479 - RNA, 16 nt, Human
gagccguggucccuga

SEQ ID NO: 1770480 - RNA, 19 nt, Human
gagccguggucccugagga

SEQ ID NO: 1770481 - RNA, 20 nt, Human
gagccguggucccugaggau

SEQ ID NO: 1770482 - RNA, 17 nt, Human
gagccucagcauccugg

SEQ ID NO: 1770483 - RNA, 14 nt, Human
gagccucagcaucc

SEQ ID NO: 1770484 - RNA, 15 nt, Human
gagccucagcauccu

SEQ ID NO: 1770485 - RNA, 21 nt, Human
gagccgagaucacgccacugc

SEQ ID NO: 1770486 - RNA, 22 nt, Human
gagccgagaucacgccacugca

SEQ ID NO: 1770487 - RNA, 17 nt, Human
gagccgggucugccucu

SEQ ID NO: 1770488 - RNA, 20 nt, Human
gagccgggucugccucuucu

SEQ ID NO: 1770489 - RNA, 21 nt, Human
gagccgggucugccucuucug

SEQ ID NO: 1770490 - RNA, 22 nt, Human
gagccgggucugccucuucugg

SEQ ID NO: 1770491 - RNA, 19 nt, Human
gagccgagaucacgccacu

SEQ ID NO: 1770492 - RNA, 20 nt, Human
gagccgagaucacgccacug

SEQ ID NO: 1770493 - RNA, 15 nt, Human
gagccugcaguuauu

SEQ ID NO: 1770494 - RNA, 12 nt, Human
gagcuagccaga

SEQ ID NO: 1770495 - RNA, 13 nt, Human
gagcuagccagag

SEQ ID NO: 1770496 - RNA, 14 nt, Human
gagcuagccagagg

SEQ ID NO: 1770497 - RNA, 15 nt, Human
gagcuagccagagga

SEQ ID NO: 1770498 - RNA, 18 nt, Human
gagcuagccagaggacug

SEQ ID NO: 1770499 - RNA, 16 nt, Human
gagcugaggcagcagu

SEQ ID NO: 1770500 - RNA, 21 nt, Human
gagcucuugugaggaaaguca

SEQ ID NO: 1770501 - RNA, 21 nt, Human
gagcugaaagcugguggcaga

SEQ ID NO: 1770502 - RNA, 17 nt, Human
gagcucuugugaggaaa

SEQ ID NO: 1770503 - RNA, 21 nt, Human
gagcucuacccagggccugca

SEQ ID NO: 1770504 - RNA, 23 nt, Human
gagcucuacccagggccugcagg

SEQ ID NO: 1770505 - RNA, 14 nt, Human
gagcucuacccagg

SEQ ID NO: 1770506 - RNA, 15 nt, Human
gagcucuacccaggg

SEQ ID NO: 1770507 - RNA, 20 nt, Human
gagcucuacccagggccugc

SEQ ID NO: 1770508 - RNA, 21 nt, Human
gagcucccaggugcagccaga

SEQ ID NO: 1770509 - RNA, 22 nt, Human
gagcucccaggugcagccagag

SEQ ID NO: 1770510 - RNA, 16 nt, Human
gagcucccaggugcag

SEQ ID NO: 1770511 - RNA, 20 nt, Human
gagcucccaggugcagccag

SEQ ID NO: 1770512 - RNA, 18 nt, Human
gaggaaacuacugccuuu

SEQ ID NO: 1770513 - RNA, 22 nt, Human
gaggaaacuacugccuuuagaa

SEQ ID NO: 1770514 - RNA, 20 nt, Human
gaggaaagucauuggcuuua

SEQ ID NO: 1770515 - RNA, 18 nt, Human
gaggaaagucauuggcuu

SEQ ID NO: 1770516 - RNA, 12 nt, Human
gaggaaagucau

SEQ ID NO: 1770517 - RNA, 21 nt, Human
gaggaaagggaggaguggagg

SEQ ID NO: 1770518 - RNA, 19 nt, Human
gagacagaguuuucacucu

SEQ ID NO: 1770519 - RNA, 22 nt, Human
gagaacacagccgauucaccug

SEQ ID NO: 1770520 - RNA, 18 nt, Human
gagaaacuuaagcaaagg

SEQ ID NO: 1770521 - RNA, 12 nt, Human
gagaacaggacu

SEQ ID NO: 1770522 - RNA, 13 nt, Human
gagaacaggacua

SEQ ID NO: 1770523 - RNA, 23 nt, Human
gagaaaguacuucuccacccugc

SEQ ID NO: 1770524 - RNA, 14 nt, Human
gacuuggaagcucc

SEQ ID NO: 1770525 - RNA, 18 nt, Human
gacucggggugcuuccuu

SEQ ID NO: 1770526 - RNA, 19 nt, Human
gacucggggugcuuccuug

SEQ ID NO: 1770527 - RNA, 15 nt, Human
gacuuggaagcuccg

SEQ ID NO: 1770528 - RNA, 16 nt, Human
gacuuggaagcuccgc

SEQ ID NO: 1770529 - RNA, 11 nt, Human
gagaaaaucau

SEQ ID NO: 1770530 - RNA, 15 nt, Human
gagaaaaucaucaag

SEQ ID NO: 1770531 - RNA, 16 nt, Human
gagaaaaucaucaaga

SEQ ID NO: 1770532 - RNA, 18 nt, Human
gagaaaaucaucaagaag

SEQ ID NO: 1770533 - RNA, 23 nt, Human
gagaaaaucaucaagaagggcug

SEQ ID NO: 1770534 - RNA, 14 nt, Human
gagacucugucuca

SEQ ID NO: 1770535 - RNA, 15 nt, Human
gagacugcccagcua

SEQ ID NO: 1770536 - RNA, 18 nt, Human
gagagaggcaauggcucc

SEQ ID NO: 1770537 - RNA, 15 nt, Human
gagagcaucggccua

SEQ ID NO: 1770538 - RNA, 18 nt, Human
gagagcaucggccuaggg

SEQ ID NO: 1770539 - RNA, 16 nt, Human
gagagccaccaagagg

SEQ ID NO: 1770540 - RNA, 13 nt, Human
gagaggggaacag

SEQ ID NO: 1770541 - RNA, 18 nt, Human
gagaggggaacagacugg

SEQ ID NO: 1770542 - RNA, 17 nt, Human
gagauacagaauuuuau

SEQ ID NO: 1770543 - RNA, 18 nt, Human
gacacaggcccggcucca

SEQ ID NO: 1770544 - RNA, 12 nt, Human
gacacaggccug

SEQ ID NO: 1770545 - RNA, 18 nt, Human
gacaccuugacagggcac

SEQ ID NO: 1770546 - RNA, 20 nt, Human
gacaccuugacagggcacac

SEQ ID NO: 1770547 - RNA, 15 nt, Human
gacaccuugacaggg

SEQ ID NO: 1770548 - RNA, 17 nt, Human
gacaccuugacagggca

SEQ ID NO: 1770549 - RNA, 15 nt, Human
gacacuaaccacgcu

SEQ ID NO: 1770550 - RNA, 16 nt, Human
gacacuaaccacgcug

SEQ ID NO: 1770551 - RNA, 17 nt, Human
gacacuaaccacgcugg

SEQ ID NO: 1770552 - RNA, 18 nt, Human
gacacuaaccacgcugga

SEQ ID NO: 1770553 - RNA, 12 nt, Human
gacacacacaca

SEQ ID NO: 1770554 - RNA, 13 nt, Human
gacacacagcucu

SEQ ID NO: 1770555 - RNA, 15 nt, Human
gacacaggcccggcu

SEQ ID NO: 1770556 - RNA, 17 nt, Human
gacacaggcccggcucc

SEQ ID NO: 1770557 - RNA, 21 nt, Human
gacaaucaugaaauaugcauc

SEQ ID NO: 1770558 - RNA, 19 nt, Human
gacaaucaugaaauaugca

SEQ ID NO: 1770559 - RNA, 20 nt, Human
gacaaucaugaaauaugcau

SEQ ID NO: 1770560 - RNA, 21 nt, Human
gacaauaugugccaaucaaua

SEQ ID NO: 1770561 - RNA, 15 nt, Human
gacaauaaaauauua

SEQ ID NO: 1770562 - RNA, 22 nt, Human
gacaaggauugcuacuguccua

SEQ ID NO: 1770563 - RNA, 14 nt, Human
gaaguccuuauguu

SEQ ID NO: 1770564 - RNA, 14 nt, Human
gacaggcaaugcug

SEQ ID NO: 1770565 - RNA, 16 nt, Human
gacaggcaaugcuggc

SEQ ID NO: 1770566 - RNA, 17 nt, Human
gacaggcaaugcuggcu

SEQ ID NO: 1770567 - RNA, 18 nt, Human
gacaggcauguucucuga

SEQ ID NO: 1770568 - RNA, 19 nt, Human
gacaggcauguucucugag

SEQ ID NO: 1770569 - RNA, 18 nt, Human
gacagccaaaggcuggcg

SEQ ID NO: 1770570 - RNA, 16 nt, Human
gacagccaaaggcugg

SEQ ID NO: 1770571 - RNA, 17 nt, Human
gacagccaaaggcuggc

SEQ ID NO: 1770572 - RNA, 13 nt, Human
gacagccacggcc

SEQ ID NO: 1770573 - RNA, 14 nt, Human
gacagacacaggcc

SEQ ID NO: 1770574 - RNA, 20 nt, Human
gacacuaaccacgcuggacc

SEQ ID NO: 1770575 - RNA, 21 nt, Human
gacacuaaccacgcuggaccu

SEQ ID NO: 1770576 - RNA, 15 nt, Human
gacagacacaggccc

SEQ ID NO: 1770577 - RNA, 16 nt, Human
gacagacacaggcccg

SEQ ID NO: 1770578 - RNA, 14 nt, Human
gacaggcagagcug

SEQ ID NO: 1770579 - RNA, 20 nt, Human
gacaugaagauucuuuccca

SEQ ID NO: 1770580 - RNA, 21 nt, Human
gacaucuguuucuaaauguuu

SEQ ID NO: 1770581 - RNA, 16 nt, Human
gacauacgcuuuuaau

SEQ ID NO: 1770582 - RNA, 21 nt, Human
gacauacgcuuuuaaugaaaa

SEQ ID NO: 1770583 - RNA, 13 nt, Human
gaccccuccaugu

SEQ ID NO: 1770584 - RNA, 11 nt, Human
gacccacugcu

SEQ ID NO: 1770585 - RNA, 12 nt, Human
gacccacugcuu

SEQ ID NO: 1770586 - RNA, 20 nt, Human
gacccacgaaacugcccugg

SEQ ID NO: 1770587 - RNA, 22 nt, Human
gacccacgaaacugcccuggcu

SEQ ID NO: 1770588 - RNA, 20 nt, Human
gaccaacccuggggaaggag

SEQ ID NO: 1770589 - RNA, 15 nt, Human
gacccagggaacagc

SEQ ID NO: 1770590 - RNA, 17 nt, Human
gacccagggaacagcca

SEQ ID NO: 1770591 - RNA, 19 nt, Human
gacccagggaacagccacu

SEQ ID NO: 1770592 - RNA, 20 nt, Human
gacccagggaacagccacuc

SEQ ID NO: 1770593 - RNA, 22 nt, Human
gacccagggaacagccacuccc

SEQ ID NO: 1770594 - RNA, 16 nt, Human
gacccaggguucccgc

SEQ ID NO: 1770595 - RNA, 16 nt, Human
gacccuguugcuaagc

SEQ ID NO: 1770596 - RNA, 15 nt, Human
gacccuguugcuaag

SEQ ID NO: 1770597 - RNA, 21 nt, Human
gacccuguugcuaagccccag

SEQ ID NO: 1770598 - RNA, 16 nt, Human
gaccugcauuguaaau

SEQ ID NO: 1770599 - RNA, 23 nt, Human
gaccugauuucugagcauuuaau

SEQ ID NO: 1770600 - RNA, 12 nt, Human
gacuacaggcac

SEQ ID NO: 1770601 - RNA, 12 nt, Human
gacucagggcuc

SEQ ID NO: 1770602 - RNA, 13 nt, Human
gacucagggcucc

SEQ ID NO: 1770603 - RNA, 14 nt, Human
gacucagggcuccu

SEQ ID NO: 1770604 - RNA, 16 nt, Human
gacucagggcuccugg

SEQ ID NO: 1770605 - RNA, 17 nt, Human
gacucagggcuccuggg

SEQ ID NO: 1770606 - RNA, 19 nt, Human
gacucagggcuccuggguu

SEQ ID NO: 1770607 - RNA, 13 nt, Human
gacucaugaggag

SEQ ID NO: 1770608 - RNA, 15 nt, Human
gacucaugaggaggg

SEQ ID NO: 1770609 - RNA, 18 nt, Human
gacucaugaggaggggcc

SEQ ID NO: 1770610 - RNA, 22 nt, Human
gacucaugaggaggggcccccc

SEQ ID NO: 1770611 - RNA, 13 nt, Human
gacucauucugaa

SEQ ID NO: 1770612 - RNA, 16 nt, Human
gacucauucugaagga

SEQ ID NO: 1770613 - RNA, 17 nt, Human
gacucauucugaaggag

SEQ ID NO: 1770614 - RNA, 23 nt, Human
gacgggacucaggcgggacagug

SEQ ID NO: 1770615 - RNA, 23 nt, Human
gacggagucccaccuuggcugca

SEQ ID NO: 1770616 - RNA, 19 nt, Human
gacgcagcaggaggccagg

SEQ ID NO: 1770617 - RNA, 21 nt, Human
gacggagucccaccuuggcug

SEQ ID NO: 1770618 - RNA, 14 nt, Human
gacggagucccacc

SEQ ID NO: 1770619 - RNA, 18 nt, Human
gacggagucccaccuugg

SEQ ID NO: 1770620 - RNA, 12 nt, Human
gaccugccugua

SEQ ID NO: 1770621 - RNA, 23 nt, Human
gaccuugaacuggguacuugugg

SEQ ID NO: 1770622 - RNA, 18 nt, Human
gaccuggacacaggccug

SEQ ID NO: 1770623 - RNA, 18 nt, Human
gaccuuuuuuuuuuuucc

SEQ ID NO: 1770624 - RNA, 21 nt, Human
gacgaacuuccauggcccuca

SEQ ID NO: 1770625 - RNA, 17 nt, Human
gaccuuuugggggaggg

SEQ ID NO: 1770626 - RNA, 18 nt, Human
gaccuuuugggggagggc

SEQ ID NO: 1770627 - RNA, 14 nt, Human
gacgaacuuccaug

SEQ ID NO: 1770628 - RNA, 22 nt, Human
gcagauacaggaaaagcugcug

SEQ ID NO: 1770629 - RNA, 17 nt, Human
gcagccccauucugccu

SEQ ID NO: 1770630 - RNA, 18 nt, Human
gcagccccauucugccug

SEQ ID NO: 1770631 - RNA, 19 nt, Human
gcagccccauucugccugc

SEQ ID NO: 1770632 - RNA, 21 nt, Human
gcagccccauucugccugccc

SEQ ID NO: 1770633 - RNA, 24 nt, Human
gcagccccauucugccugcccagg

SEQ ID NO: 1770634 - RNA, 15 nt, Human
gcagccuuggcaaac

SEQ ID NO: 1770635 - RNA, 14 nt, Human
gcaggaggccaggc

SEQ ID NO: 1770636 - RNA, 15 nt, Human
gcaggaggccaggcc

SEQ ID NO: 1770637 - RNA, 16 nt, Human
gcaggaggccaggccg

SEQ ID NO: 1770638 - RNA, 17 nt, Human
gcaggaggccaggccgg

SEQ ID NO: 1770639 - RNA, 19 nt, Human
gcaggaauauaugugugcc

SEQ ID NO: 1770640 - RNA, 21 nt, Human
gcaggaauauaugugugccua

SEQ ID NO: 1770641 - RNA, 22 nt, Human
gcaggaccagccagcagcagcc

SEQ ID NO: 1770642 - RNA, 21 nt, Human
gcaggaaaugaaaaugucuug

SEQ ID NO: 1770643 - RNA, 23 nt, Human
gcaggaaaugaaaaugucuugug

SEQ ID NO: 1770644 - RNA, 22 nt, Human
gcacccaccaucaugucuggcu

SEQ ID NO: 1770645 - RNA, 19 nt, Human
gcaccauuuuaagucccug

SEQ ID NO: 1770646 - RNA, 17 nt, Human
gcacccaagaccucagg

SEQ ID NO: 1770647 - RNA, 21 nt, Human
gcacccaagaccucagggcac

SEQ ID NO: 1770648 - RNA, 19 nt, Human
gcacccggccccugcuggu

SEQ ID NO: 1770649 - RNA, 12 nt, Human
gcaauggcagcc

SEQ ID NO: 1770650 - RNA, 13 nt, Human
gcaauggcagccu

SEQ ID NO: 1770651 - RNA, 14 nt, Human
gcaauggcagccuu

SEQ ID NO: 1770652 - RNA, 13 nt, Human
gcacccuauaaau

SEQ ID NO: 1770653 - RNA, 14 nt, Human
gcacccuauaaauc

SEQ ID NO: 1770654 - RNA, 21 nt, Human
gcacggaccaugcgacacugg

SEQ ID NO: 1770655 - RNA, 23 nt, Human
gcagacaggcaagcaccuccugc

SEQ ID NO: 1770656 - RNA, 19 nt, Human
gcagacaggcaagcaccuc

SEQ ID NO: 1770657 - RNA, 16 nt, Human
gcagaaugaaucuaug

SEQ ID NO: 1770658 - RNA, 14 nt, Human
gcaguggacucaga

SEQ ID NO: 1770659 - RNA, 22 nt, Human
gcaguggacucagaaagccaac

SEQ ID NO: 1770660 - RNA, 22 nt, Human
gcagguccaggguuugaguuca

SEQ ID NO: 1770661 - RNA, 16 nt, Human
gcagguagccugcugg

SEQ ID NO: 1770662 - RNA, 17 nt, Human
gcagguagccugcuggu

SEQ ID NO: 1770663 - RNA, 19 nt, Human
gcaggucuugaacuccugg

SEQ ID NO: 1770664 - RNA, 20 nt, Human
gcaggucuugaacuccuggc

SEQ ID NO: 1770665 - RNA, 16 nt, Human
gcaggugaaacccagu

SEQ ID NO: 1770666 - RNA, 17 nt, Human
gcaggugaaacccaguc

SEQ ID NO: 1770667 - RNA, 20 nt, Human
gcaggugaaacccagucacu

SEQ ID NO: 1770668 - RNA, 22 nt, Human
gcagggcucagcggggacagcu

SEQ ID NO: 1770669 - RNA, 17 nt, Human
gcagggucucacucugu

SEQ ID NO: 1770670 - RNA, 18 nt, Human
gcagggucucacucuguc

SEQ ID NO: 1770671 - RNA, 19 nt, Human
gcagggcucagcggggaca

SEQ ID NO: 1770672 - RNA, 21 nt, Human
gcagggcucagcggggacagc

SEQ ID NO: 1770673 - RNA, 21 nt, Human
gcagggccccaggcauugcca

SEQ ID NO: 1770674 - RNA, 15 nt, Human
gcagggccgccaggg

SEQ ID NO: 1770675 - RNA, 23 nt, Human
gcagggccgccagggagaccugg

SEQ ID NO: 1770676 - RNA, 17 nt, Human
gcauagguuuaauaauu

SEQ ID NO: 1770677 - RNA, 22 nt, Human
gcauaucugccuuuauuguguu

SEQ ID NO: 1770678 - RNA, 16 nt, Human
gcauaugaaaggagag

SEQ ID NO: 1770679 - RNA, 20 nt, Human
gcauaugaaaggagagcauc

SEQ ID NO: 1770680 - RNA, 21 nt, Human
gcauaucugccuuuauugugu

SEQ ID NO: 1770681 - RNA, 18 nt, Human
gcauaucugccuuuauug

SEQ ID NO: 1770682 - RNA, 16 nt, Human
gcauaucugccuuuau

SEQ ID NO: 1770683 - RNA, 15 nt, Human
gcauaucugccuuua

SEQ ID NO: 1770684 - RNA, 14 nt, Human
gcauaucugccuuu

SEQ ID NO: 1770685 - RNA, 12 nt, Human
gcauaucugccu

SEQ ID NO: 1770686 - RNA, 15 nt, Human
gcagugugaggccag

SEQ ID NO: 1770687 - RNA, 13 nt, Human
gcagugggagcug

SEQ ID NO: 1770688 - RNA, 14 nt, Human
gcagugggagcugc

SEQ ID NO: 1770689 - RNA, 15 nt, Human
gcagugggagcugcc

SEQ ID NO: 1770690 - RNA, 13 nt, Human
gcauagaaguaaa

SEQ ID NO: 1770691 - RNA, 17 nt, Human
gcaguuauuaacacuaa

SEQ ID NO: 1770692 - RNA, 18 nt, Human
gcaucuuuuuuucauuuu

SEQ ID NO: 1770693 - RNA, 15 nt, Human
gcaucuugcuggcua

SEQ ID NO: 1770694 - RNA, 18 nt, Human
gcaugauccaagcaagac

SEQ ID NO: 1770695 - RNA, 19 nt, Human
gcaugauccaagcaagacu

SEQ ID NO: 1770696 - RNA, 22 nt, Human
gcaugauccaagcaagacugag

SEQ ID NO: 1770697 - RNA, 23 nt, Human
gcaugauccaagcaagacugagg

SEQ ID NO: 1770698 - RNA, 13 nt, Human
gcaugauguuugc

SEQ ID NO: 1770699 - RNA, 18 nt, Human
gcaugauguuugcccaaa

SEQ ID NO: 1770700 - RNA, 22 nt, Human
gcaugauguuugcccaaaauuu

SEQ ID NO: 1770701 - RNA, 15 nt, Human
gcauguucucugagg

SEQ ID NO: 1770702 - RNA, 21 nt, Human
gcauguucucugaggacacua

SEQ ID NO: 1770703 - RNA, 22 nt, Human
gcauguucucugaggacacuaa

SEQ ID NO: 1770704 - RNA, 18 nt, Human
gcauuuuguuugguauug

SEQ ID NO: 1770705 - RNA, 23 nt, Human
gcauuuuguuugguauuguauuu

SEQ ID NO: 1770706 - RNA, 21 nt, Human
gcauuuuguuugguauuguau

SEQ ID NO: 1770707 - RNA, 13 nt, Human
gccaaaccucugu

SEQ ID NO: 1770708 - RNA, 13 nt, Human
gccaaagccaaag

SEQ ID NO: 1770709 - RNA, 20 nt, Human
gccaaagccaaagcuaggcc

SEQ ID NO: 1770710 - RNA, 16 nt, Human
gccaaagcuaggccug

SEQ ID NO: 1770711 - RNA, 22 nt, Human
gccaaagcuaggccuggccaga

SEQ ID NO: 1770712 - RNA, 14 nt, Human
gccaaaccucuguu

SEQ ID NO: 1770713 - RNA, 15 nt, Human
gccaaaccucuguuc

SEQ ID NO: 1770714 - RNA, 16 nt, Human
gccaaaccucuguuca

SEQ ID NO: 1770715 - RNA, 17 nt, Human
gccaaaccucuguucag

SEQ ID NO: 1770716 - RNA, 19 nt, Human
gccaaaccucuguucagug

SEQ ID NO: 1770717 - RNA, 22 nt, Human
gccaaaccucuguucaguguaa

SEQ ID NO: 1770718 - RNA, 17 nt, Human
gcauuugaucuguugca

SEQ ID NO: 1770719 - RNA, 21 nt, Human
gcauuugaucuguugcaagcc

SEQ ID NO: 1770720 - RNA, 15 nt, Human
gcauuauauaccauu

SEQ ID NO: 1770721 - RNA, 19 nt, Human
gcauuauauaccauuuauc

SEQ ID NO: 1770722 - RNA, 14 nt, Human
gcauuauugcauua

SEQ ID NO: 1770723 - RNA, 15 nt, Human
gcauuauugcauuau

SEQ ID NO: 1770724 - RNA, 18 nt, Human
gaucuuugcagacaggca

SEQ ID NO: 1770725 - RNA, 15 nt, Human
gaucucacucugccc

SEQ ID NO: 1770726 - RNA, 13 nt, Human
gaucucacucugc

SEQ ID NO: 1770727 - RNA, 18 nt, Human
gaucgucugacugguguu

SEQ ID NO: 1770728 - RNA, 18 nt, Human
gauggccguggauggccg

SEQ ID NO: 1770729 - RNA, 20 nt, Human
gaugccugguggcagcugcg

SEQ ID NO: 1770730 - RNA, 18 nt, Human
gaugccugguggcagcug

SEQ ID NO: 1770731 - RNA, 19 nt, Human
gaugccugguggcagcugc

SEQ ID NO: 1770732 - RNA, 13 nt, Human
gaugcaccagccc

SEQ ID NO: 1770733 - RNA, 17 nt, Human
gaucauccacugugcca

SEQ ID NO: 1770734 - RNA, 19 nt, Human
gaucauccacugugccaug

SEQ ID NO: 1770735 - RNA, 21 nt, Human
gaucauccacugugccaugug

SEQ ID NO: 1770736 - RNA, 12 nt, Human
gaucacggcuca

SEQ ID NO: 1770737 - RNA, 23 nt, Human
gaucagauugcaugugacucuga

SEQ ID NO: 1770738 - RNA, 15 nt, Human
gaucagauugcaugu

SEQ ID NO: 1770739 - RNA, 22 nt, Human
gaucagucugauucccaagcuc

SEQ ID NO: 1770740 - RNA, 16 nt, Human
gaucacgccacugcac

SEQ ID NO: 1770741 - RNA, 18 nt, Human
gaucacgccacugcacua

SEQ ID NO: 1770742 - RNA, 22 nt, Human
gauaagaguagaaacugcaggg

SEQ ID NO: 1770743 - RNA, 17 nt, Human
gauaaggaauuauagac

SEQ ID NO: 1770744 - RNA, 16 nt, Human
gauaaauacaaggccc

SEQ ID NO: 1770745 - RNA, 18 nt, Human
gauacaggaaaagcugcu

SEQ ID NO: 1770746 - RNA, 19 nt, Human
gauacaggaaaagcugcug

SEQ ID NO: 1770747 - RNA, 23 nt, Human
gauagauaggucagugcaaauac

SEQ ID NO: 1770748 - RNA, 22 nt, Human
gauuccauuuggcagagcuucu

SEQ ID NO: 1770749 - RNA, 16 nt, Human
gaugggggcagggcug

SEQ ID NO: 1770750 - RNA, 17 nt, Human
gaugggggcagggcugu

SEQ ID NO: 1770751 - RNA, 20 nt, Human
gaugggggcagggcugugcu

SEQ ID NO: 1770752 - RNA, 16 nt, Human
gauggggucuguaaaa

SEQ ID NO: 1770753 - RNA, 11 nt, Human
gauggggaggg

SEQ ID NO: 1770754 - RNA, 12 nt, Human
gauggggagggg

SEQ ID NO: 1770755 - RNA, 21 nt, Human
gauucccaagcucugcuccuc

SEQ ID NO: 1770756 - RNA, 19 nt, Human
gauucccaagcucugcucc

SEQ ID NO: 1770757 - RNA, 20 nt, Human
gauucccaagcucugcuccu

SEQ ID NO: 1770758 - RNA, 21 nt, Human
gauugcaacaggcugggcuuc

SEQ ID NO: 1770759 - RNA, 20 nt, Human
gauugcaacaggcugggcuu

SEQ ID NO: 1770760 - RNA, 21 nt, Human
gauuuccccccuccgccucca

SEQ ID NO: 1770761 - RNA, 17 nt, Human
gauuucuguaaacucug

SEQ ID NO: 1770762 - RNA, 19 nt, Human
gauuuguuaaugauagcua

SEQ ID NO: 1770763 - RNA, 17 nt, Human
gauuuucaaaagauaau

SEQ ID NO: 1770764 - RNA, 15 nt, Human
gcaaugccaucaucu

SEQ ID NO: 1770765 - RNA, 18 nt, Human
gcaaugccaucaucuccu

SEQ ID NO: 1770766 - RNA, 19 nt, Human
gcaaugccaucaucuccug

SEQ ID NO: 1770767 - RNA, 13 nt, Human
gcaaugcuggcug

SEQ ID NO: 1770768 - RNA, 14 nt, Human
gcaaugcuggcugu

SEQ ID NO: 1770769 - RNA, 22 nt, Human
gcaaugcuggcuguuggcuggg

SEQ ID NO: 1770770 - RNA, 23 nt, Human
gcaaugcuggcuguuggcugggg

SEQ ID NO: 1770771 - RNA, 18 nt, Human
gcaaggguuaaggccuga

SEQ ID NO: 1770772 - RNA, 15 nt, Human
gcaagcuccgcagga

SEQ ID NO: 1770773 - RNA, 18 nt, Human
gcaagcuccgcaggacuu

SEQ ID NO: 1770774 - RNA, 16 nt, Human
gcaagccccucuuucu

SEQ ID NO: 1770775 - RNA, 14 nt, Human
gcaagacgcccucu

SEQ ID NO: 1770776 - RNA, 18 nt, Human
gcaaaggguccagaagga

SEQ ID NO: 1770777 - RNA, 22 nt, Human
gcaaaggguccagaaggagaca

SEQ ID NO: 1770778 - RNA, 13 nt, Human
gcaaaggggacag

SEQ ID NO: 1770779 - RNA, 14 nt, Human
gcaaaggggacagc

SEQ ID NO: 1770780 - RNA, 19 nt, Human
gcaaaggggacagcugugu

SEQ ID NO: 1770781 - RNA, 11 nt, Human
gcaaaguacug

SEQ ID NO: 1770782 - RNA, 12 nt, Human
gcaaaguacugu

SEQ ID NO: 1770783 - RNA, 13 nt, Human
gcaaaguacugua

SEQ ID NO: 1770784 - RNA, 14 nt, Human
gcaaaguacuguaa

SEQ ID NO: 1770785 - RNA, 22 nt, Human
gcaaaguacuguaagaauaauu

SEQ ID NO: 1770786 - RNA, 15 nt, Human
gcaaauccuauguga

SEQ ID NO: 1770787 - RNA, 23 nt, Human
gcaaauccuaugugauuuuaacu

SEQ ID NO: 1770788 - RNA, 17 nt, Human
gcaaauccuaugugauu

SEQ ID NO: 1770789 - RNA, 19 nt, Human
gcaaauccuaugugauuuu

SEQ ID NO: 1770790 - RNA, 17 nt, Human
gccucugacacacagcu

SEQ ID NO: 1770791 - RNA, 18 nt, Human
gccucugacacacagcuc

SEQ ID NO: 1770792 - RNA, 19 nt, Human
gccucugacacacagcucu

SEQ ID NO: 1770793 - RNA, 20 nt, Human
gccucugacacacagcucug

SEQ ID NO: 1770794 - RNA, 21 nt, Human
gccucugacacacagcucugu

SEQ ID NO: 1770795 - RNA, 18 nt, Human
gccucugccucugacaca

SEQ ID NO: 1770796 - RNA, 13 nt, Human
gccugacugcuca

SEQ ID NO: 1770797 - RNA, 14 nt, Human
gccugacugcucag

SEQ ID NO: 1770798 - RNA, 15 nt, Human
gccugacugcucaga

SEQ ID NO: 1770799 - RNA, 12 nt, Human
gccucugccucu

SEQ ID NO: 1770800 - RNA, 13 nt, Human
gccucugccucug

SEQ ID NO: 1770801 - RNA, 16 nt, Human
gccugaguagaaaggc

SEQ ID NO: 1770802 - RNA, 21 nt, Human
gccugaguagaaaggccuuua

SEQ ID NO: 1770803 - RNA, 13 nt, Human
gccugagucaccu

SEQ ID NO: 1770804 - RNA, 21 nt, Human
gccugcaaacgcugccugccc

SEQ ID NO: 1770805 - RNA, 19 nt, Human
gccugcaaacgcugccugc

SEQ ID NO: 1770806 - RNA, 20 nt, Human
gccugcaaacgcugccugcc

SEQ ID NO: 1770807 - RNA, 15 nt, Human
gccucagcauccugg

SEQ ID NO: 1770808 - RNA, 16 nt, Human
gccucagcauccuggc

SEQ ID NO: 1770809 - RNA, 17 nt, Human
gccucagcauccuggca

SEQ ID NO: 1770810 - RNA, 17 nt, Human
gccucagaugauuuccc

SEQ ID NO: 1770811 - RNA, 18 nt, Human
gccucccaaagugcuggg

SEQ ID NO: 1770812 - RNA, 19 nt, Human
gccucccaaagugcuggga

SEQ ID NO: 1770813 - RNA, 23 nt, Human
gccucccaacaguggggaagagu

SEQ ID NO: 1770814 - RNA, 20 nt, Human
gccucccgaguagcugggac

SEQ ID NO: 1770815 - RNA, 18 nt, Human
gccucccgaguagcuggg

SEQ ID NO: 1770816 - RNA, 19 nt, Human
gccucccgaguagcuggga

SEQ ID NO: 1770817 - RNA, 13 nt, Human
gccucccuugacu

SEQ ID NO: 1770818 - RNA, 13 nt, Human
gccguccuugucu

SEQ ID NO: 1770819 - RNA, 17 nt, Human
gccguccuugucucugg

SEQ ID NO: 1770820 - RNA, 21 nt, Human
gccguaucuccggcucccagc

SEQ ID NO: 1770821 - RNA, 23 nt, Human
gccguaucuccggcucccagccu

SEQ ID NO: 1770822 - RNA, 20 nt, Human
gccguaucuccggcucccag

SEQ ID NO: 1770823 - RNA, 12 nt, Human
gccgguuccugu

SEQ ID NO: 1770824 - RNA, 17 nt, Human
gccgguuccugucccug

SEQ ID NO: 1770825 - RNA, 22 nt, Human
gccgguuccugucccugcgccu

SEQ ID NO: 1770826 - RNA, 12 nt, Human
gccguggaugcg

SEQ ID NO: 1770827 - RNA, 13 nt, Human
gccguggauggcc

SEQ ID NO: 1770828 - RNA, 18 nt, Human
gccguggauggccgugga

SEQ ID NO: 1770829 - RNA, 18 nt, Human
gccucaaccuccugggcu

SEQ ID NO: 1770830 - RNA, 19 nt, Human
gccucaaccuccugggcua

SEQ ID NO: 1770831 - RNA, 15 nt, Human
gccucaacuccuccc

SEQ ID NO: 1770832 - RNA, 17 nt, Human
gccucaacuccucccau

SEQ ID NO: 1770833 - RNA, 18 nt, Human
gccucaacuccucccaua

SEQ ID NO: 1770834 - RNA, 16 nt, Human
gccgugguccuuuggg

SEQ ID NO: 1770835 - RNA, 14 nt, Human
gccguggucccuga

SEQ ID NO: 1770836 - RNA, 15 nt, Human
gccguggucccugag

SEQ ID NO: 1770837 - RNA, 17 nt, Human
gccuaaauuuauuaaau

SEQ ID NO: 1770838 - RNA, 18 nt, Human
gccuaaauuuauuaaaua

SEQ ID NO: 1770839 - RNA, 22 nt, Human
gccgagaucacgccacugcacu

SEQ ID NO: 1770840 - RNA, 20 nt, Human
gccgagaucacgccacugca

SEQ ID NO: 1770841 - RNA, 21 nt, Human
gccgagaucacgccacugcac

SEQ ID NO: 1770842 - RNA, 18 nt, Human
gccggcgagcccugugga

SEQ ID NO: 1770843 - RNA, 15 nt, Human
gccggcgagcccugu

SEQ ID NO: 1770844 - RNA, 17 nt, Human
gccggcgagcccugugg

SEQ ID NO: 1770845 - RNA, 13 nt, Human
gccgggcugaggg

SEQ ID NO: 1770846 - RNA, 18 nt, Human
gccgggcugagggccugc

SEQ ID NO: 1770847 - RNA, 17 nt, Human
gcccuuuuuucugccuc

SEQ ID NO: 1770848 - RNA, 19 nt, Human
gcccuuuuuucugccuccu

SEQ ID NO: 1770849 - RNA, 20 nt, Human
gcccuuuuuucugccuccuu

SEQ ID NO: 1770850 - RNA, 22 nt, Human
gcccuuuuuucugccuccuuua

SEQ ID NO: 1770851 - RNA, 18 nt, Human
gcggggcugucggcgcug

SEQ ID NO: 1770852 - RNA, 22 nt, Human
gcggggcugucggcgcugcccc

SEQ ID NO: 1770853 - RNA, 16 nt, Human
gcggacagccacggcc

SEQ ID NO: 1770854 - RNA, 15 nt, Human
gcggacagccacggc

SEQ ID NO: 1770855 - RNA, 14 nt, Human
gcguacaggcuggc

SEQ ID NO: 1770856 - RNA, 11 nt, Human
gcggacagcca

SEQ ID NO: 1770857 - RNA, 13 nt, Human
gcggacagccacg

SEQ ID NO: 1770858 - RNA, 14 nt, Human
gcgcgccccuagcc

SEQ ID NO: 1770859 - RNA, 15 nt, Human
gcgcgccccuagccg

SEQ ID NO: 1770860 - RNA, 18 nt, Human
gcgccuacaggagugagc

SEQ ID NO: 1770861 - RNA, 15 nt, Human
gcgccuacaggagug

SEQ ID NO: 1770862 - RNA, 18 nt, Human
gcgacacugggaggccag

SEQ ID NO: 1770863 - RNA, 17 nt, Human
gcuaaagcaauaugcau

SEQ ID NO: 1770864 - RNA, 19 nt, Human
gcuaaagcaauaugcauuu

SEQ ID NO: 1770865 - RNA, 17 nt, Human
gcuaaacuccuuccugg

SEQ ID NO: 1770866 - RNA, 22 nt, Human
gcuaaacuccuuccuggccuga

SEQ ID NO: 1770867 - RNA, 23 nt, Human
gcuaaacuccuuccuggccugag

SEQ ID NO: 1770868 - RNA, 19 nt, Human
gccuuagaagucacacagu

SEQ ID NO: 1770869 - RNA, 17 nt, Human
gccuuagaagucacaca

SEQ ID NO: 1770870 - RNA, 18 nt, Human
gccuuagaagucacacag

SEQ ID NO: 1770871 - RNA, 19 nt, Human
gccuuaucgggcuccagcc

SEQ ID NO: 1770872 - RNA, 23 nt, Human
gccuuaucgggcuccagccaucu

SEQ ID NO: 1770873 - RNA, 13 nt, Human
gccugguggcagc

SEQ ID NO: 1770874 - RNA, 14 nt, Human
gccugguggcagcu

SEQ ID NO: 1770875 - RNA, 18 nt, Human
gccugguggcagcugcgg

SEQ ID NO: 1770876 - RNA, 19 nt, Human
gccugguggcagcugcggu

SEQ ID NO: 1770877 - RNA, 21 nt, Human
gccugguggcagcugcggucc

SEQ ID NO: 1770878 - RNA, 16 nt, Human
gccugggggugccagg

SEQ ID NO: 1770879 - RNA, 17 nt, Human
gccugggggugccagga

SEQ ID NO: 1770880 - RNA, 21 nt, Human
gccugggggugccaggaccag

SEQ ID NO: 1770881 - RNA, 12 nt, Human
gccuuccagauc

SEQ ID NO: 1770882 - RNA, 16 nt, Human
gccuuccagauccucu

SEQ ID NO: 1770883 - RNA, 20 nt, Human
gccuuccagauccucucugg

SEQ ID NO: 1770884 - RNA, 21 nt, Human
gccuuccagauccucucuggg

SEQ ID NO: 1770885 - RNA, 22 nt, Human
gccuuccagauccucucugggg

SEQ ID NO: 1770886 - RNA, 23 nt, Human
gccuuccagauccucucuggggc

SEQ ID NO: 1770887 - RNA, 22 nt, Human
gcccgagggaggggaagcuucu

SEQ ID NO: 1770888 - RNA, 23 nt, Human
gcccgagggaggggaagcuucug

SEQ ID NO: 1770889 - RNA, 14 nt, Human
gccccucaccuacu

SEQ ID NO: 1770890 - RNA, 15 nt, Human
gccccgaggccuucu

SEQ ID NO: 1770891 - RNA, 18 nt, Human
gccccgaggccuucucug

SEQ ID NO: 1770892 - RNA, 22 nt, Human
gccccgaggccuucucugaagg

SEQ ID NO: 1770893 - RNA, 22 nt, Human
gcccgcagagcgcgccccuagc

SEQ ID NO: 1770894 - RNA, 23 nt, Human
gcccgcagagcgcgccccuagcc

SEQ ID NO: 1770895 - RNA, 15 nt, Human
gccccauucugccug

SEQ ID NO: 1770896 - RNA, 14 nt, Human
gccccauucugccu

SEQ ID NO: 1770897 - RNA, 12 nt, Human
gccccauuccug

SEQ ID NO: 1770898 - RNA, 15 nt, Human
gccccauuccuggga

SEQ ID NO: 1770899 - RNA, 18 nt, Human
gcccccacaguugcucua

SEQ ID NO: 1770900 - RNA, 15 nt, Human
gccccagugcccaca

SEQ ID NO: 1770901 - RNA, 13 nt, Human
gccccagugccca

SEQ ID NO: 1770902 - RNA, 14 nt, Human
gccccagugcccac

SEQ ID NO: 1770903 - RNA, 14 nt, Human
gccccaucagugcu

SEQ ID NO: 1770904 - RNA, 12 nt, Human
gccccagugccc

SEQ ID NO: 1770905 - RNA, 21 nt, Human
gcccagagaggguggugaccu

SEQ ID NO: 1770906 - RNA, 23 nt, Human
gcccaggccccugccacccuggg

SEQ ID NO: 1770907 - RNA, 12 nt, Human
gcccaggcuggc

SEQ ID NO: 1770908 - RNA, 16 nt, Human
gcccagggcaagcucc

SEQ ID NO: 1770909 - RNA, 18 nt, Human
gcccagggcaagcuccgc

SEQ ID NO: 1770910 - RNA, 19 nt, Human
gcccagggcaagcuccgca

SEQ ID NO: 1770911 - RNA, 23 nt, Human
gcccagggcaagcuccgcaggac

SEQ ID NO: 1770912 - RNA, 18 nt, Human
gcccagggcaucuugcug

SEQ ID NO: 1770913 - RNA, 20 nt, Human
gcccagggcaucuugcuggc

SEQ ID NO: 1770914 - RNA, 21 nt, Human
gcccagggcaucuugcuggcu

SEQ ID NO: 1770915 - RNA, 23 nt, Human
gcccagggcaucuugcuggcuac

SEQ ID NO: 1770916 - RNA, 16 nt, Human
gcccauacugguuggc

SEQ ID NO: 1770917 - RNA, 22 nt, Human
gccaggaccagucaaccugggc

SEQ ID NO: 1770918 - RNA, 15 nt, Human
gccagcugcccuaug

SEQ ID NO: 1770919 - RNA, 20 nt, Human
gccagcugcccuaugggccu

SEQ ID NO: 1770920 - RNA, 21 nt, Human
gccagcugcccuaugggccug

SEQ ID NO: 1770921 - RNA, 22 nt, Human
gccagcugcccuaugggccugc

SEQ ID NO: 1770922 - RNA, 23 nt, Human
gccagcucuguaucaggacccag

SEQ ID NO: 1770923 - RNA, 15 nt, Human
gccagcucuguauca

SEQ ID NO: 1770924 - RNA, 14 nt, Human
gccagaugcaccag

SEQ ID NO: 1770925 - RNA, 17 nt, Human
gccagagggagugacag

SEQ ID NO: 1770926 - RNA, 13 nt, Human
gccagaggcaccu

SEQ ID NO: 1770927 - RNA, 22 nt, Human
gccagaggcucguugacuggcu

SEQ ID NO: 1770928 - RNA, 15 nt, Human
gccagaugcaccagc

SEQ ID NO: 1770929 - RNA, 16 nt, Human
gccacuccccuccacu

SEQ ID NO: 1770930 - RNA, 13 nt, Human
gccacuccucuga

SEQ ID NO: 1770931 - RNA, 14 nt, Human
gccacuccucugac

SEQ ID NO: 1770932 - RNA, 15 nt, Human
gccacuccucugacu

SEQ ID NO: 1770933 - RNA, 17 nt, Human
gccacuccucugacuca

SEQ ID NO: 1770934 - RNA, 20 nt, Human
gccacugcaccgggccacag

SEQ ID NO: 1770935 - RNA, 21 nt, Human
gccacugcaccgggccacaga

SEQ ID NO: 1770936 - RNA, 21 nt, Human
gccacuccucugacucagggc

SEQ ID NO: 1770937 - RNA, 22 nt, Human
gccacugcaccgggccacagag

SEQ ID NO: 1770938 - RNA, 14 nt, Human
gcccacuucugcca

SEQ ID NO: 1770939 - RNA, 13 nt, Human
gcccaccuuggcu

SEQ ID NO: 1770940 - RNA, 15 nt, Human
gcccaccuuggcuca

SEQ ID NO: 1770941 - RNA, 16 nt, Human
gcccaccuuggcucaa

SEQ ID NO: 1770942 - RNA, 17 nt, Human
gcccaccuuggcucaag

SEQ ID NO: 1770943 - RNA, 14 nt, Human
gcccaagcuucccu

SEQ ID NO: 1770944 - RNA, 15 nt, Human
gcccaagcuucccuc

SEQ ID NO: 1770945 - RNA, 18 nt, Human
gcccaagcuucccuccau

SEQ ID NO: 1770946 - RNA, 20 nt, Human
gcccaagcuucccuccaucc

SEQ ID NO: 1770947 - RNA, 15 nt, Human
gccaugggccuccug

SEQ ID NO: 1770948 - RNA, 16 nt, Human
gccaugggccuccugu

SEQ ID NO: 1770949 - RNA, 14 nt, Human
gccauccagguuca

SEQ ID NO: 1770950 - RNA, 23 nt, Human
gccaucugguuaggauggcagga

SEQ ID NO: 1770951 - RNA, 13 nt, Human
gccaggcuggucu

SEQ ID NO: 1770952 - RNA, 15 nt, Human
gccaggcuggucuca

SEQ ID NO: 1770953 - RNA, 16 nt, Human
gccaguacuugucaua

SEQ ID NO: 1770954 - RNA, 23 nt, Human
gccaucaucuccugccuuccucc

SEQ ID NO: 1770955 - RNA, 17 nt, Human
uuuuguauucucugagc

SEQ ID NO: 1770956 - RNA, 11 nt, Human
uuuuguacaug

SEQ ID NO: 1770957 - RNA, 20 nt, Human
uuuuuaaaaaugcaaauccu

SEQ ID NO: 1770958 - RNA, 19 nt, Human
uuuuguagagccagggucu

SEQ ID NO: 1770959 - RNA, 11 nt, Human
uuuuguaccag

SEQ ID NO: 1770960 - RNA, 13 nt, Human
uuuuguaccagug

SEQ ID NO: 1770961 - RNA, 14 nt, Human
uuuuguaccaguga

SEQ ID NO: 1770962 - RNA, 14 nt, Human
uuuucuuuccuccu

SEQ ID NO: 1770963 - RNA, 17 nt, Human
uuuucuuuccuccuuuc

SEQ ID NO: 1770964 - RNA, 22 nt, Human
uuuuggggauuuucaaaagaua

SEQ ID NO: 1770965 - RNA, 23 nt, Human
uuuuggggauuuucaaaagauaa

SEQ ID NO: 1770966 - RNA, 15 nt, Human
uuuuggucuguguga

SEQ ID NO: 1770967 - RNA, 15 nt, Human
uuuucuuuuccauua

SEQ ID NO: 1770968 - RNA, 16 nt, Human
uuuuggaugcagugcu

SEQ ID NO: 1770969 - RNA, 12 nt, Human
uuuuucucuccu

SEQ ID NO: 1770970 - RNA, 17 nt, Human
uuuuuccuaugcuauug

SEQ ID NO: 1770971 - RNA, 15 nt, Human
uuuuaaugaaaagga

SEQ ID NO: 1770972 - RNA, 19 nt, Human
uuuuaaugaaaaggaauca

SEQ ID NO: 1770973 - RNA, 22 nt, Human
uuuuaaugaaaaggaaucacgu

SEQ ID NO: 1770974 - RNA, 13 nt, Human
uuuguucucuggg

SEQ ID NO: 1770975 - RNA, 21 nt, Human
uuuguucucugggagaaaauc

SEQ ID NO: 1770976 - RNA, 13 nt, Human
uuuguucccggcu

SEQ ID NO: 1770977 - RNA, 18 nt, Human
uuugaauguuaaauaaau

SEQ ID NO: 1770978 - RNA, 16 nt, Human
uuugaauguuaaauaa

SEQ ID NO: 1770979 - RNA, 13 nt, Human
uuugaauguuaaa

SEQ ID NO: 1770980 - RNA, 22 nt, Human
uuugaauguuaaauaaauugua

SEQ ID NO: 1770981 - RNA, 21 nt, Human
uuugaauguuaaauaaauugu

SEQ ID NO: 1770982 - RNA, 16 nt, Human
uuugaaugcauuuugu

SEQ ID NO: 1770983 - RNA, 14 nt, Human
uuugaaugcauuuu

SEQ ID NO: 1770984 - RNA, 21 nt, Human
uuugaaucuugucucaaugcu

SEQ ID NO: 1770985 - RNA, 13 nt, Human
uuugaaugcauuu

SEQ ID NO: 1770986 - RNA, 20 nt, Human
uuuggagagggggccuggga

SEQ ID NO: 1770987 - RNA, 18 nt, Human
uuugaaucaucaagucuu

SEQ ID NO: 1770988 - RNA, 12 nt, Human
uuugaaucuugu

SEQ ID NO: 1770989 - RNA, 18 nt, Human
uuugaaucuugucucaau

SEQ ID NO: 1770990 - RNA, 16 nt, Human
uuugaaucuugucuca

SEQ ID NO: 1770991 - RNA, 18 nt, Human
uuucuacuuugaagucau

SEQ ID NO: 1770992 - RNA, 22 nt, Human
uuucuacuuugaagucauacca

SEQ ID NO: 1770993 - RNA, 12 nt, Human
uuaccaaaaauu

SEQ ID NO: 1770994 - RNA, 16 nt, Human
uuaccaaaaauuuugu

SEQ ID NO: 1770995 - RNA, 23 nt, Human
guagggcgggaggauguucuggg

SEQ ID NO: 1770996 - RNA, 21 nt, Human
guagggcgggaggauguucug

SEQ ID NO: 1770997 - RNA, 22 nt, Human
guagggcgggaggauguucugg

SEQ ID NO: 1770998 - RNA, 16 nt, Human
guagggcgggaggaug

SEQ ID NO: 1770999 - RNA, 20 nt, Human
guagcccacucugcucgccu

SEQ ID NO: 1771000 - RNA, 16 nt, Human
guagcccacucugcuc

SEQ ID NO: 1771001 - RNA, 14 nt, Human
guagauuaaaaauu

SEQ ID NO: 1771002 - RNA, 21 nt, Human
guagucagaauuagcugcuuc

SEQ ID NO: 1771003 - RNA, 22 nt, Human
guagucagaauuagcugcuucu

SEQ ID NO: 1771004 - RNA, 22 nt, Human
guaggguaauuaguaacaugug

SEQ ID NO: 1771005 - RNA, 23 nt, Human
guaggguuuaauccccaguaaaa

SEQ ID NO: 1771006 - RNA, 13 nt, Human
guauguuauagaa

SEQ ID NO: 1771007 - RNA, 21 nt, Human
guaugaucacggcucacugca

SEQ ID NO: 1771008 - RNA, 22 nt, Human
guaugaucacggcucacugcag

SEQ ID NO: 1771009 - RNA, 20 nt, Human
guaugaucacggcucacugc

SEQ ID NO: 1771010 - RNA, 12 nt, Human
guaugaauuuga

SEQ ID NO: 1771011 - RNA, 14 nt, Human
guaugaauuugagc

SEQ ID NO: 1771012 - RNA, 19 nt, Human
guauacuuccuuaugcuuc

SEQ ID NO: 1771013 - RNA, 13 nt, Human
guauacuuccuua

SEQ ID NO: 1771014 - RNA, 15 nt, Human
guaucgauguuaugu

SEQ ID NO: 1771015 - RNA, 20 nt, Human
guaucuccggcucccagccu

SEQ ID NO: 1771016 - RNA, 21 nt, Human
guaucuccggcucccagccuc

SEQ ID NO: 1771017 - RNA, 22 nt, Human
guaucuccggcucccagccuca

SEQ ID NO: 1771018 - RNA, 16 nt, Human
guaucuccggcuccca

SEQ ID NO: 1771019 - RNA, 18 nt, Human
guaucuccggcucccagc

SEQ ID NO: 1771020 - RNA, 23 nt, Human
gucccuccgggaccuggugcugc

SEQ ID NO: 1771021 - RNA, 16 nt, Human
gucccugcacuugcag

SEQ ID NO: 1771022 - RNA, 12 nt, Human
gucccugaggau

SEQ ID NO: 1771023 - RNA, 22 nt, Human
gucccugaggaugggucagagc

SEQ ID NO: 1771024 - RNA, 19 nt, Human
gucccugcacuugcagacu

SEQ ID NO: 1771025 - RNA, 21 nt, Human
gucccugcacuugcagacucu

SEQ ID NO: 1771026 - RNA, 22 nt, Human
guccccaaauccgaaccuccuc

SEQ ID NO: 1771027 - RNA, 17 nt, Human
gucccauagucccugcc

SEQ ID NO: 1771028 - RNA, 18 nt, Human
gucccauagucccugcca

SEQ ID NO: 1771029 - RNA, 23 nt, Human
gucccaccuuggcugcagggagu

SEQ ID NO: 1771030 - RNA, 13 nt, Human
guccacccaggag

SEQ ID NO: 1771031 - RNA, 13 nt, Human
guccacagggcac

SEQ ID NO: 1771032 - RNA, 12 nt, Human
guccacccagga

SEQ ID NO: 1771033 - RNA, 23 nt, Human
guccacccaggagccccgaggcc

SEQ ID NO: 1771034 - RNA, 15 nt, Human
guccacgacugucuc

SEQ ID NO: 1771035 - RNA, 16 nt, Human
guccacgacugucucc

SEQ ID NO: 1771036 - RNA, 18 nt, Human
guccacgacugucuccau

SEQ ID NO: 1771037 - RNA, 21 nt, Human
gucccaccuuggcugcaggga

SEQ ID NO: 1771038 - RNA, 18 nt, Human
guccagcauugcuggacu

SEQ ID NO: 1771039 - RNA, 19 nt, Human
guccagcauugcuggacuc

SEQ ID NO: 1771040 - RNA, 21 nt, Human
guccagcauugcuggacucug

SEQ ID NO: 1771041 - RNA, 17 nt, Human
gucauuggcuuuauccu

SEQ ID NO: 1771042 - RNA, 14 nt, Human
gucauuggcuuuau

SEQ ID NO: 1771043 - RNA, 21 nt, Human
gucauuagccugaguagaaag

SEQ ID NO: 1771044 - RNA, 19 nt, Human
gucauuagccugaguagaa

SEQ ID NO: 1771045 - RNA, 13 nt, Human
gucauuagccuga

SEQ ID NO: 1771046 - RNA, 13 nt, Human
gucagcucucugc

SEQ ID NO: 1771047 - RNA, 14 nt, Human
gucagcucucugcc

SEQ ID NO: 1771048 - RNA, 15 nt, Human
gucagcucucugccc

SEQ ID NO: 1771049 - RNA, 16 nt, Human
gucagcucucugcccu

SEQ ID NO: 1771050 - RNA, 17 nt, Human
gucagcucucugcccug

SEQ ID NO: 1771051 - RNA, 18 nt, Human
gucagcucucugcccugu

SEQ ID NO: 1771052 - RNA, 21 nt, Human
gucagcucucugcccugugua

SEQ ID NO: 1771053 - RNA, 12 nt, Human
gucagcugaggc

SEQ ID NO: 1771054 - RNA, 23 nt, Human
gucagcugaggcugggggagagc

SEQ ID NO: 1771055 - RNA, 18 nt, Human
guauuuuguauuguuuca

SEQ ID NO: 1771056 - RNA, 15 nt, Human
guauuuuguguccuc

SEQ ID NO: 1771057 - RNA, 24 nt, Human
guauuuuguguccuccaggagcuu

SEQ ID NO: 1771058 - RNA, 13 nt, Human
guauuuugaaaau

SEQ ID NO: 1771059 - RNA, 18 nt, Human
guauuaauuuugauauaa

SEQ ID NO: 1771060 - RNA, 16 nt, Human
gucagacgccugagga

SEQ ID NO: 1771061 - RNA, 17 nt, Human
gucagacgccugaggaa

SEQ ID NO: 1771062 - RNA, 18 nt, Human
gucagacgccugaggaac

SEQ ID NO: 1771063 - RNA, 15 nt, Human
gucagagccugcagu

SEQ ID NO: 1771064 - RNA, 16 nt, Human
gucagagccugcaguu

SEQ ID NO: 1771065 - RNA, 14 nt, Human
gucagagccugcag

SEQ ID NO: 1771066 - RNA, 21 nt, Human
gucagaugcccgagggagggg

SEQ ID NO: 1771067 - RNA, 16 nt, Human
gucucugguagccugc

SEQ ID NO: 1771068 - RNA, 17 nt, Human
gucucugguagccugca

SEQ ID NO: 1771069 - RNA, 13 nt, Human
gucucugggccac

SEQ ID NO: 1771070 - RNA, 19 nt, Human
gucucugggccacuuggag

SEQ ID NO: 1771071 - RNA, 20 nt, Human
gucucugggccacuuggagu

SEQ ID NO: 1771072 - RNA, 12 nt, Human
gucucugcaaac

SEQ ID NO: 1771073 - RNA, 16 nt, Human
gucucaggagucucug

SEQ ID NO: 1771074 - RNA, 17 nt, Human
gucucaggagucucugg

SEQ ID NO: 1771075 - RNA, 15 nt, Human
gucucacucugucgc

SEQ ID NO: 1771076 - RNA, 16 nt, Human
gucucacucugucgcc

SEQ ID NO: 1771077 - RNA, 18 nt, Human
gucucacucugucgccca

SEQ ID NO: 1771078 - RNA, 19 nt, Human
gucucacucugucgcccag

SEQ ID NO: 1771079 - RNA, 22 nt, Human
gucucacucugucgcccagucu

SEQ ID NO: 1771080 - RNA, 22 nt, Human
gucccugccacgaauuucugug

SEQ ID NO: 1771081 - RNA, 18 nt, Human
gucucacuauguugccca

SEQ ID NO: 1771082 - RNA, 11 nt, Human
gucucacucug

SEQ ID NO: 1771083 - RNA, 19 nt, Human
gucucacuauguugcccag

SEQ ID NO: 1771084 - RNA, 18 nt, Human
gucgucaaagcugaaaug

SEQ ID NO: 1771085 - RNA, 17 nt, Human
gucgugagcucuuguga

SEQ ID NO: 1771086 - RNA, 21 nt, Human
gucuugaacuccuggccucaa

SEQ ID NO: 1771087 - RNA, 18 nt, Human
gucuugaacuccuggccu

SEQ ID NO: 1771088 - RNA, 20 nt, Human
gucuugaacuccuggccuca

SEQ ID NO: 1771089 - RNA, 16 nt, Human
gucuugcaauggcagc

SEQ ID NO: 1771090 - RNA, 17 nt, Human
gucuugcaauggcagcc

SEQ ID NO: 1771091 - RNA, 18 nt, Human
gucuugcaauggcagccu

SEQ ID NO: 1771092 - RNA, 19 nt, Human
gucuugcaauggcagccuu

SEQ ID NO: 1771093 - RNA, 20 nt, Human
gucuucucacaagccagcca

SEQ ID NO: 1771094 - RNA, 17 nt, Human
gucuucuccaccacgcu

SEQ ID NO: 1771095 - RNA, 20 nt, Human
gucuucuccaccacgcuggg

SEQ ID NO: 1771096 - RNA, 16 nt, Human
gucuugaacuccuggc

SEQ ID NO: 1771097 - RNA, 17 nt, Human
gucuugaacuccuggcc

SEQ ID NO: 1771098 - RNA, 16 nt, Human
gucuuuuuucacuaca

SEQ ID NO: 1771099 - RNA, 20 nt, Human
gucuuggcagcaccugucuc

SEQ ID NO: 1771100 - RNA, 22 nt, Human
gucuuggcagcaccugucuccu

SEQ ID NO: 1771101 - RNA, 23 nt, Human
gucuugcaauggcagccuuggca

SEQ ID NO: 1771102 - RNA, 20 nt, Human
gucuugcaauggcagccuug

SEQ ID NO: 1771103 - RNA, 21 nt, Human
gucuugcaauggcagccuugg

SEQ ID NO: 1771104 - RNA, 16 nt, Human
gucugccauguugccc

SEQ ID NO: 1771105 - RNA, 21 nt, Human
gucugccauguugccccuuuc

SEQ ID NO: 1771106 - RNA, 12 nt, Human
gucugccccagc

SEQ ID NO: 1771107 - RNA, 11 nt, Human
gucugccucuu

SEQ ID NO: 1771108 - RNA, 11 nt, Human
gucuguugagu

SEQ ID NO: 1771109 - RNA, 12 nt, Human
gugacagaggca

SEQ ID NO: 1771110 - RNA, 13 nt, Human
gugacagaggcag

SEQ ID NO: 1771111 - RNA, 14 nt, Human
gugacagaggcagc

SEQ ID NO: 1771112 - RNA, 12 nt, Human
gugaccucugcc

SEQ ID NO: 1771113 - RNA, 15 nt, Human
gugacagaggcagcc

SEQ ID NO: 1771114 - RNA, 13 nt, Human
gugaccucugccu

SEQ ID NO: 1771115 - RNA, 14 nt, Human
gugaccucugccug

SEQ ID NO: 1771116 - RNA, 15 nt, Human
gugaccucugccuga

SEQ ID NO: 1771117 - RNA, 20 nt, Human
gugacaaggauugcuacugu

SEQ ID NO: 1771118 - RNA, 19 nt, Human
gugaacaagcaaacccaga

SEQ ID NO: 1771119 - RNA, 17 nt, Human
gugauaaaucagucaag

SEQ ID NO: 1771120 - RNA, 15 nt, Human
gugagccacugcacc

SEQ ID NO: 1771121 - RNA, 20 nt, Human
gugagccacugcaccgggcc

SEQ ID NO: 1771122 - RNA, 19 nt, Human
gugagccgagaucacgcca

SEQ ID NO: 1771123 - RNA, 12 nt, Human
gugccaugucug

SEQ ID NO: 1771124 - RNA, 11 nt, Human
gugccauggaa

SEQ ID NO: 1771125 - RNA, 22 nt, Human
gugccauguaaauccccacugg

SEQ ID NO: 1771126 - RNA, 14 nt, Human
gugccaugugccag

SEQ ID NO: 1771127 - RNA, 16 nt, Human
gugccaugugccaggu

SEQ ID NO: 1771128 - RNA, 22 nt, Human
gugccuuccagauccucucugg

SEQ ID NO: 1771129 - RNA, 23 nt, Human
gugccuuccagauccucucuggg

SEQ ID NO: 1771130 - RNA, 21 nt, Human
gugcgaucuggguucacugca

SEQ ID NO: 1771131 - RNA, 14 nt, Human
gugccuucuguggg

SEQ ID NO: 1771132 - RNA, 17 nt, Human
gugccuucuguggggac

SEQ ID NO: 1771133 - RNA, 15 nt, Human
gugcguccacgagcu

SEQ ID NO: 1771134 - RNA, 14 nt, Human
gugcgccuacagga

SEQ ID NO: 1771135 - RNA, 16 nt, Human
gugcuaagugugaacu

SEQ ID NO: 1771136 - RNA, 14 nt, Human
gugcuaagugugaa

SEQ ID NO: 1771137 - RNA, 13 nt, Human
gugcuaaguguga

SEQ ID NO: 1771138 - RNA, 18 nt, Human
gugcuaagugugaacugg

SEQ ID NO: 1771139 - RNA, 17 nt, Human
gugcuaagugugaacug

SEQ ID NO: 1771140 - RNA, 20 nt, Human
gugcuaagugugaacuggac

SEQ ID NO: 1771141 - RNA, 20 nt, Human
gugcaguggugcgaucuggg

SEQ ID NO: 1771142 - RNA, 23 nt, Human
gugcaguggugcgaucuggguuc

SEQ ID NO: 1771143 - RNA, 17 nt, Human
gugcagccgcugagcga

SEQ ID NO: 1771144 - RNA, 18 nt, Human
gugcagccgcugagcgag

SEQ ID NO: 1771145 - RNA, 22 nt, Human
gugcagcucaaggaaaggccug

SEQ ID NO: 1771146 - RNA, 23 nt, Human
gugcagcucaaggaaaggccuga

SEQ ID NO: 1771147 - RNA, 12 nt, Human
gugcagccagag

SEQ ID NO: 1771148 - RNA, 13 nt, Human
gugcagccagagg

SEQ ID NO: 1771149 - RNA, 14 nt, Human
gugcagccagaggc

SEQ ID NO: 1771150 - RNA, 13 nt, Human
gugccaggaccag

SEQ ID NO: 1771151 - RNA, 16 nt, Human
gugccaggaccaguca

SEQ ID NO: 1771152 - RNA, 23 nt, Human
gugauccacccaccucagccucc

SEQ ID NO: 1771153 - RNA, 24 nt, Human
gugauccacccaccucagccuccc

SEQ ID NO: 1771154 - RNA, 14 nt, Human
gugauuuuaacucu

SEQ ID NO: 1771155 - RNA, 16 nt, Human
gugauuuuaacucugu

SEQ ID NO: 1771156 - RNA, 17 nt, Human
gugauuuuaacucuguc

SEQ ID NO: 1771157 - RNA, 18 nt, Human
gugauuuuaacucugucu

SEQ ID NO: 1771158 - RNA, 19 nt, Human
gugauuuuaacucugucuu

SEQ ID NO: 1771159 - RNA, 12 nt, Human
gugugcucugau

SEQ ID NO: 1771160 - RNA, 12 nt, Human
gugugccuucca

SEQ ID NO: 1771161 - RNA, 23 nt, Human
gugugccuuccagauccucucug

SEQ ID NO: 1771162 - RNA, 15 nt, Human
gugugcucugaucau

SEQ ID NO: 1771163 - RNA, 22 nt, Human
gugugcucugaucauccacugu

SEQ ID NO: 1771164 - RNA, 15 nt, Human
gugugcucugcuuca

SEQ ID NO: 1771165 - RNA, 20 nt, Human
gugugagucaccaagcccag

SEQ ID NO: 1771166 - RNA, 18 nt, Human
gugugauaaaucagucaa

SEQ ID NO: 1771167 - RNA, 14 nt, Human
gugugaucgucuga

SEQ ID NO: 1771168 - RNA, 16 nt, Human
gugugcaccaggguug

SEQ ID NO: 1771169 - RNA, 13 nt, Human
guguccugccugu

SEQ ID NO: 1771170 - RNA, 16 nt, Human
guguccugccugucug

SEQ ID NO: 1771171 - RNA, 17 nt, Human
guguccugccugucugc

SEQ ID NO: 1771172 - RNA, 20 nt, Human
guguccugccugucugcccc

SEQ ID NO: 1771173 - RNA, 16 nt, Human
guguccuccaggagcu

SEQ ID NO: 1771174 - RNA, 20 nt, Human
guguccugaaacgcuccuuu

SEQ ID NO: 1771175 - RNA, 21 nt, Human
guguccugaaacgcuccuuug

SEQ ID NO: 1771176 - RNA, 23 nt, Human
gugucccugcacuugcagacucu

SEQ ID NO: 1771177 - RNA, 14 nt, Human
guguuuuguaccag

SEQ ID NO: 1771178 - RNA, 16 nt, Human
guguuuuguuuauuaa

SEQ ID NO: 1771179 - RNA, 18 nt, Human
guguuccccuuccacuga

SEQ ID NO: 1771180 - RNA, 19 nt, Human
guguuccccuuccacugag

SEQ ID NO: 1771181 - RNA, 22 nt, Human
guguuccccuuccacugagggc

SEQ ID NO: 1771182 - RNA, 23 nt, Human
guguuccccuuccacugagggca

SEQ ID NO: 1771183 - RNA, 21 nt, Human
guguuaaaugugaugaauacu

SEQ ID NO: 1771184 - RNA, 23 nt, Human
guguuagggaagggccugccaca

SEQ ID NO: 1771185 - RNA, 16 nt, Human
guguuagggaagggcc

SEQ ID NO: 1771186 - RNA, 22 nt, Human
guguuagggaagggccugccac

SEQ ID NO: 1771187 - RNA, 16 nt, Human
guguuaccugaaaaca

SEQ ID NO: 1771188 - RNA, 15 nt, Human
guguuaccugugugc

SEQ ID NO: 1771189 - RNA, 16 nt, Human
guguuaccugugugcu

SEQ ID NO: 1771190 - RNA, 22 nt, Human
guuaacccuucaucuuccugug

SEQ ID NO: 1771191 - RNA, 19 nt, Human
guuaaauaaauuguauauu

SEQ ID NO: 1771192 - RNA, 18 nt, Human
guuaaauaaauuguauau

SEQ ID NO: 1771193 - RNA, 17 nt, Human
guuaaauaaauuguaua

SEQ ID NO: 1771194 - RNA, 13 nt, Human
guuaaauaaauug

SEQ ID NO: 1771195 - RNA, 21 nt, Human
guuaaauaaauuguauauuca

SEQ ID NO: 1771196 - RNA, 20 nt, Human
guuaaauaaauuguauauuc

SEQ ID NO: 1771197 - RNA, 22 nt, Human
guuaaauaaauuguauauucac

SEQ ID NO: 1771198 - RNA, 21 nt, Human
guuaaauagaguauaugcacu

SEQ ID NO: 1771199 - RNA, 19 nt, Human
guuaaauagaguauaugca

SEQ ID NO: 1771200 - RNA, 20 nt, Human
guuaaauagaguauaugcac

SEQ ID NO: 1771201 - RNA, 23 nt, Human
guuaaacuagcauaucugccuuu

SEQ ID NO: 1771202 - RNA, 15 nt, Human
guuaaacuagcauau

SEQ ID NO: 1771203 - RNA, 22 nt, Human
guuaaacuagcauaucugccuu

SEQ ID NO: 1771204 - RNA, 21 nt, Human
guuaaacuagcauaucugccu

SEQ ID NO: 1771205 - RNA, 20 nt, Human
guuaaacuagcauaucugcc

SEQ ID NO: 1771206 - RNA, 19 nt, Human
guuaaacuagcauaucugc

SEQ ID NO: 1771207 - RNA, 19 nt, Human
guggugcgaucuggguuca

SEQ ID NO: 1771208 - RNA, 14 nt, Human
guggugaccucugc

SEQ ID NO: 1771209 - RNA, 17 nt, Human
guggugaccucugccug

SEQ ID NO: 1771210 - RNA, 19 nt, Human
gugguaugaucacggcuca

SEQ ID NO: 1771211 - RNA, 22 nt, Human
gugguaugacauuggauagaac

SEQ ID NO: 1771212 - RNA, 18 nt, Human
gugguauuaauuuugaua

SEQ ID NO: 1771213 - RNA, 14 nt, Human
gugguaugucugcc

SEQ ID NO: 1771214 - RNA, 15 nt, Human
gugguaugucugcca

SEQ ID NO: 1771215 - RNA, 19 nt, Human
guguacuucccgggccagg

SEQ ID NO: 1771216 - RNA, 23 nt, Human
guguacuucccgggccagggcug

SEQ ID NO: 1771217 - RNA, 17 nt, Human
guguacaguuggcaugg

SEQ ID NO: 1771218 - RNA, 13 nt, Human
gugucccugcacu

SEQ ID NO: 1771219 - RNA, 18 nt, Human
gugucccccucuguccag

SEQ ID NO: 1771220 - RNA, 14 nt, Human
gugucccccucugu

SEQ ID NO: 1771221 - RNA, 16 nt, Human
gugucccugcacuugc

SEQ ID NO: 1771222 - RNA, 18 nt, Human
gugucccugcacuugcag

SEQ ID NO: 1771223 - RNA, 22 nt, Human
guguauagaagcgauuuaaguu

SEQ ID NO: 1771224 - RNA, 19 nt, Human
guggcuggguuggagggug

SEQ ID NO: 1771225 - RNA, 11 nt, Human
guggcugggca

SEQ ID NO: 1771226 - RNA, 12 nt, Human
guggcugggcag

SEQ ID NO: 1771227 - RNA, 15 nt, Human
gugggcaauuuagaa

SEQ ID NO: 1771228 - RNA, 22 nt, Human
guggcuuaaaacaacacucaca

SEQ ID NO: 1771229 - RNA, 15 nt, Human
guggcuccucccagc

SEQ ID NO: 1771230 - RNA, 15 nt, Human
gugggcuaguugggc

SEQ ID NO: 1771231 - RNA, 13 nt, Human
gugggcucccuga

SEQ ID NO: 1771232 - RNA, 14 nt, Human
gugggcucccugac

SEQ ID NO: 1771233 - RNA, 15 nt, Human
gugggcucccugacu

SEQ ID NO: 1771234 - RNA, 17 nt, Human
guggggagacugggcug

SEQ ID NO: 1771235 - RNA, 15 nt, Human
gugggcugggcccuc

SEQ ID NO: 1771236 - RNA, 20 nt, Human
gugggcugggcccucucuuc

SEQ ID NO: 1771237 - RNA, 13 nt, Human
guggggcagcuug

SEQ ID NO: 1771238 - RNA, 17 nt, Human
guggggcagcuugaggg

SEQ ID NO: 1771239 - RNA, 18 nt, Human
guggguguccugccuguc

SEQ ID NO: 1771240 - RNA, 22 nt, Human
guggguguccugccugucugcc

SEQ ID NO: 1771241 - RNA, 18 nt, Human
guuaugaacacuuaaauu

SEQ ID NO: 1771242 - RNA, 20 nt, Human
guuaucaccgugggcucccu

SEQ ID NO: 1771243 - RNA, 22 nt, Human
guuaucaccgugggcucccuga

SEQ ID NO: 1771244 - RNA, 19 nt, Human
guuauauugaaaaaauaga

SEQ ID NO: 1771245 - RNA, 14 nt, Human
guuauaugaauaua

SEQ ID NO: 1771246 - RNA, 19 nt, Human
guuauagaacuucauggau

SEQ ID NO: 1771247 - RNA, 23 nt, Human
guucaauucucauuugucacaca

SEQ ID NO: 1771248 - RNA, 16 nt, Human
guucaauucucauuug

SEQ ID NO: 1771249 - RNA, 20 nt, Human
guucaagcgauucuucugcu

SEQ ID NO: 1771250 - RNA, 23 nt, Human
guucaauaaagcacugagcaagu

SEQ ID NO: 1771251 - RNA, 21 nt, Human
guuauguaaaaggccaaaccu

SEQ ID NO: 1771252 - RNA, 19 nt, Human
guucaagcgauucuucugc

SEQ ID NO: 1771253 - RNA, 17 nt, Human
guuauuauauuuacaaa

SEQ ID NO: 1771254 - RNA, 22 nt, Human
guuauuagagauuaccuccuga

SEQ ID NO: 1771255 - RNA, 23 nt, Human
guuaccauuuugggguacccacu

SEQ ID NO: 1771256 - RNA, 22 nt, Human
guuaccugaaaacacugugcac

SEQ ID NO: 1771257 - RNA, 13 nt, Human
guuaccugugugc

SEQ ID NO: 1771258 - RNA, 14 nt, Human
guuaccugugugcu

SEQ ID NO: 1771259 - RNA, 14 nt, Human
guuauaaagauaca

SEQ ID NO: 1771260 - RNA, 15 nt, Human
guuauaaagauacag

SEQ ID NO: 1771261 - RNA, 16 nt, Human
guuacuccagugccaa

SEQ ID NO: 1771262 - RNA, 22 nt, Human
guuacuccagugccaacaaucc

SEQ ID NO: 1771263 - RNA, 15 nt, Human
guucacuaaagcagu

SEQ ID NO: 1771264 - RNA, 19 nt, Human
guucacgugcagcucaagg

SEQ ID NO: 1771265 - RNA, 19 nt, Human
guucacugcaaccuccgcc

SEQ ID NO: 1771266 - RNA, 16 nt, Human
guucacuuuugacaaa

SEQ ID NO: 1771267 - RNA, 20 nt, Human
guucacuuuugacaaaggca

SEQ ID NO: 1771268 - RNA, 20 nt, Human
guucauccuauucuuucgaa

SEQ ID NO: 1771269 - RNA, 18 nt, Human
guucauggauuacuucuc

SEQ ID NO: 1771270 - RNA, 20 nt, Human
guucagaucuuaauauaaau

SEQ ID NO: 1771271 - RNA, 23 nt, Human
guucagaucuuaauauaaauuca

SEQ ID NO: 1771272 - RNA, 14 nt, Human
guuccagacauucu

SEQ ID NO: 1771273 - RNA, 13 nt, Human
guuccugucccug

SEQ ID NO: 1771274 - RNA, 14 nt, Human
guuccugucccugc

SEQ ID NO: 1771275 - RNA, 15 nt, Human
guuccugucccugcg

SEQ ID NO: 1771276 - RNA, 16 nt, Human
guuccugucccugcgc

SEQ ID NO: 1771277 - RNA, 17 nt, Human
guuccugucccugcgcc

SEQ ID NO: 1771278 - RNA, 15 nt, Human
guucugcucaucauu

SEQ ID NO: 1771279 - RNA, 18 nt, Human
guucugcucaucauucuc

SEQ ID NO: 1771280 - RNA, 23 nt, Human
guucugcucaucauucucugucu

SEQ ID NO: 1771281 - RNA, 11 nt, Human
guucugggaca

SEQ ID NO: 1771282 - RNA, 20 nt, Human
guucuggaggaaagggagga

SEQ ID NO: 1771283 - RNA, 17 nt, Human
guucuggauggugugcc

SEQ ID NO: 1771284 - RNA, 12 nt, Human
guucugggacac

SEQ ID NO: 1771285 - RNA, 14 nt, Human
guucugggacacag

SEQ ID NO: 1771286 - RNA, 15 nt, Human
guucugggacacagu

SEQ ID NO: 1771287 - RNA, 16 nt, Human
guucugggacacaguu

SEQ ID NO: 1771288 - RNA, 23 nt, Human
guucugggacacaguucaauucu

SEQ ID NO: 1771289 - RNA, 16 nt, Human
guucuaagucuuucca

SEQ ID NO: 1771290 - RNA, 13 nt, Human
guucgcagagcuu

SEQ ID NO: 1771291 - RNA, 11 nt, Human
guucugccucu

SEQ ID NO: 1771292 - RNA, 13 nt, Human
guucugccucucc

SEQ ID NO: 1771293 - RNA, 17 nt, Human
guucuaagucuuuccau

SEQ ID NO: 1771294 - RNA, 19 nt, Human
guucuaagucuuuccauug

SEQ ID NO: 1771295 - RNA, 21 nt, Human
guucucugggagaaaaucauc

SEQ ID NO: 1771296 - RNA, 12 nt, Human
guugcccaggca

SEQ ID NO: 1771297 - RNA, 15 nt, Human
guugcccaggcaggu

SEQ ID NO: 1771298 - RNA, 14 nt, Human
guugcccaggcagg

SEQ ID NO: 1771299 - RNA, 13 nt, Human
guuggccaggcug

SEQ ID NO: 1771300 - RNA, 15 nt, Human
guuggccaggcuggu

SEQ ID NO: 1771301 - RNA, 14 nt, Human
guuggccaggcugg

SEQ ID NO: 1771302 - RNA, 17 nt, Human
guuggccaggcuggucu

SEQ ID NO: 1771303 - RNA, 19 nt, Human
guuggccaggcuggucuca

SEQ ID NO: 1771304 - RNA, 14 nt, Human
guuggccaguguga

SEQ ID NO: 1771305 - RNA, 23 nt, Human
guuggccaaagccaaagcuaggc

SEQ ID NO: 1771306 - RNA, 20 nt, Human
guuggcagaaauacagucuu

SEQ ID NO: 1771307 - RNA, 22 nt, Human
guuggauggauggguggauggc

SEQ ID NO: 1771308 - RNA, 23 nt, Human
guuggauggauggguggauggcc

SEQ ID NO: 1771309 - RNA, 14 nt, Human
guugcaagccccuc

SEQ ID NO: 1771310 - RNA, 20 nt, Human
guugcacacccacucagcuc

SEQ ID NO: 1771311 - RNA, 19 nt, Human
guuuagagaaugagaaaug

SEQ ID NO: 1771312 - RNA, 22 nt, Human
guuuacuagggaucccucaucu

SEQ ID NO: 1771313 - RNA, 16 nt, Human
guuuacuaugccugug

SEQ ID NO: 1771314 - RNA, 17 nt, Human
guuuacuaugccugugu

SEQ ID NO: 1771315 - RNA, 20 nt, Human
guuuacuaugccugugucuu

SEQ ID NO: 1771316 - RNA, 14 nt, Human
guuguccaacuauu

SEQ ID NO: 1771317 - RNA, 17 nt, Human
guugcagguucauggau

SEQ ID NO: 1771318 - RNA, 23 nt, Human
guuggcugggggccucagugcca

SEQ ID NO: 1771319 - RNA, 19 nt, Human
guuggcugggggccucagu

SEQ ID NO: 1771320 - RNA, 20 nt, Human
guuggccccugcccggcugc

SEQ ID NO: 1771321 - RNA, 13 nt, Human
guuggccccugcc

SEQ ID NO: 1771322 - RNA, 14 nt, Human
guuggccccugccc

SEQ ID NO: 1771323 - RNA, 12 nt, Human
guuggcuggggg

SEQ ID NO: 1771324 - RNA, 16 nt, Human
guuugaauguuaaaua

SEQ ID NO: 1771325 - RNA, 11 nt, Human
guuugaaauuc

SEQ ID NO: 1771326 - RNA, 14 nt, Human
guuugaaauucuga

SEQ ID NO: 1771327 - RNA, 15 nt, Human
guuugaaauucugaa

SEQ ID NO: 1771328 - RNA, 16 nt, Human
guuugaaauucugaau

SEQ ID NO: 1771329 - RNA, 17 nt, Human
guuugaauguuaaauaa

SEQ ID NO: 1771330 - RNA, 18 nt, Human
guuugguauuguauuuau

SEQ ID NO: 1771331 - RNA, 17 nt, Human
guuugguauuguauuua

SEQ ID NO: 1771332 - RNA, 15 nt, Human
guuugguauuguauu

SEQ ID NO: 1771333 - RNA, 23 nt, Human
guuuguggggugacgggacucag

SEQ ID NO: 1771334 - RNA, 21 nt, Human
guuugucauuagccugaguag

SEQ ID NO: 1771335 - RNA, 15 nt, Human
guuugucauuagccu

SEQ ID NO: 1771336 - RNA, 13 nt, Human
guuugucauuagc

SEQ ID NO: 1771337 - RNA, 12 nt, Human
guuuuguugagc

SEQ ID NO: 1771338 - RNA, 14 nt, Human
guuuuguaccagug

SEQ ID NO: 1771339 - RNA, 15 nt, Human
guuuuguaccaguga

SEQ ID NO: 1771340 - RNA, 17 nt, Human
guuuuguaccagugaau

SEQ ID NO: 1771341 - RNA, 19 nt, Human
guuuuguaccagugaauuu

SEQ ID NO: 1771342 - RNA, 11 nt, Human
guuuucacucu

SEQ ID NO: 1771343 - RNA, 12 nt, Human
guuuucacucuu

SEQ ID NO: 1771344 - RNA, 12 nt, Human
uaaaaggagcca

SEQ ID NO: 1771345 - RNA, 15 nt, Human
uaaaaggccaaaccu

SEQ ID NO: 1771346 - RNA, 18 nt, Human
uaaaaggccaaaccucug

SEQ ID NO: 1771347 - RNA, 20 nt, Human
uaaaaggccaaaccucuguu

SEQ ID NO: 1771348 - RNA, 16 nt, Human
uaaaagauauaagugc

SEQ ID NO: 1771349 - RNA, 13 nt, Human
uaaaagauauaag

SEQ ID NO: 1771350 - RNA, 12 nt, Human
uaaaagauauaa

SEQ ID NO: 1771351 - RNA, 21 nt, Human
uaaaagauauaagugcuguau

SEQ ID NO: 1771352 - RNA, 20 nt, Human
uaaaagaugucucugcaaac

SEQ ID NO: 1771353 - RNA, 20 nt, Human
uaaaagauauaagugcugua

SEQ ID NO: 1771354 - RNA, 19 nt, Human
uaaaagauauaagugcugu

SEQ ID NO: 1771355 - RNA, 18 nt, Human
uaaaagauauaagugcug

SEQ ID NO: 1771356 - RNA, 18 nt, Human
guuuuuaauauaaagccu

SEQ ID NO: 1771357 - RNA, 16 nt, Human
guuuuguuuauuaaau

SEQ ID NO: 1771358 - RNA, 17 nt, Human
guuuuguuuauuaaaua

SEQ ID NO: 1771359 - RNA, 11 nt, Human
uaaaaagcaac

SEQ ID NO: 1771360 - RNA, 23 nt, Human
uaaaacaauaaaauuuuuuuuca

SEQ ID NO: 1771361 - RNA, 22 nt, Human
uaaaacaagcacuaaacaaaga

SEQ ID NO: 1771362 - RNA, 15 nt, Human
uaaaacaacacucac

SEQ ID NO: 1771363 - RNA, 12 nt, Human
uaaagaaaacug

SEQ ID NO: 1771364 - RNA, 15 nt, Human
uaaagcaauaugcau

SEQ ID NO: 1771365 - RNA, 17 nt, Human
uaaagcaauaugcauuu

SEQ ID NO: 1771366 - RNA, 14 nt, Human
uaaagcacugagca

SEQ ID NO: 1771367 - RNA, 14 nt, Human
uaaaguguuugaaa

SEQ ID NO: 1771368 - RNA, 15 nt, Human
uaaaccaaggacuga

SEQ ID NO: 1771369 - RNA, 17 nt, Human
uaaaccaaggacugagc

SEQ ID NO: 1771370 - RNA, 12 nt, Human
uaaacugugcac

SEQ ID NO: 1771371 - RNA, 14 nt, Human
uaaacugugcacca

SEQ ID NO: 1771372 - RNA, 13 nt, Human
uaaaaucugucac

SEQ ID NO: 1771373 - RNA, 14 nt, Human
uaaaaucugucacg

SEQ ID NO: 1771374 - RNA, 18 nt, Human
uaaacacgccugcaaacg

SEQ ID NO: 1771375 - RNA, 11 nt, Human
uaaacacuaca

SEQ ID NO: 1771376 - RNA, 15 nt, Human
uaaacaucacacaca

SEQ ID NO: 1771377 - RNA, 16 nt, Human
uaaacaucacacacac

SEQ ID NO: 1771378 - RNA, 16 nt, Human
uaaaguugguuggaua

SEQ ID NO: 1771379 - RNA, 17 nt, Human
uaaaguugguuggauaa

SEQ ID NO: 1771380 - RNA, 18 nt, Human
uaaaguugguuggauaag

SEQ ID NO: 1771381 - RNA, 23 nt, Human
uaaaguucuguacucaaauguag

SEQ ID NO: 1771382 - RNA, 22 nt, Human
uaaaugucucuuuaaugucaca

SEQ ID NO: 1771383 - RNA, 18 nt, Human
uaacaccugauuaacuga

SEQ ID NO: 1771384 - RNA, 19 nt, Human
uaacaccugauuaacugag

SEQ ID NO: 1771385 - RNA, 12 nt, Human
uaaauuuauuaa

SEQ ID NO: 1771386 - RNA, 16 nt, Human
uaaauuuauuaaauaa

SEQ ID NO: 1771387 - RNA, 16 nt, Human
uaaauucacuuucauu

SEQ ID NO: 1771388 - RNA, 18 nt, Human
uaaauucacuuucauuuu

SEQ ID NO: 1771389 - RNA, 19 nt, Human
uaaaugugaugaauacugu

SEQ ID NO: 1771390 - RNA, 18 nt, Human
uaagaaaugguggaacug

SEQ ID NO: 1771391 - RNA, 20 nt, Human
uaagaaacaacucuuugaga

SEQ ID NO: 1771392 - RNA, 21 nt, Human
uaagaaacaacucuuugagaa

SEQ ID NO: 1771393 - RNA, 17 nt, Human
uaagaaauuuugccuuu

SEQ ID NO: 1771394 - RNA, 13 nt, Human
uaagaaccccucu

SEQ ID NO: 1771395 - RNA, 17 nt, Human
uaagaaccccucugcuu

SEQ ID NO: 1771396 - RNA, 20 nt, Human
uaagaaaaaauaacacacau

SEQ ID NO: 1771397 - RNA, 10 nt, Human
uaagaaaaac

SEQ ID NO: 1771398 - RNA, 11 nt, Human
uaagaaaaacu

SEQ ID NO: 1771399 - RNA, 13 nt, Human
uaagaaaaacuuu

SEQ ID NO: 1771400 - RNA, 15 nt, Human
uaagaaaaacuuuuu

SEQ ID NO: 1771401 - RNA, 19 nt, Human
uaagaaaaacuuuuuuggu

SEQ ID NO: 1771402 - RNA, 20 nt, Human
uaagaaaaacuuuuuugguu

SEQ ID NO: 1771403 - RNA, 13 nt, Human
uaacacuguuuau

SEQ ID NO: 1771404 - RNA, 18 nt, Human
uaacccccacuggacuga

SEQ ID NO: 1771405 - RNA, 15 nt, Human
uaacucugucuucac

SEQ ID NO: 1771406 - RNA, 11 nt, Human
uaacucugucu

SEQ ID NO: 1771407 - RNA, 14 nt, Human
uaacucugucuuca

SEQ ID NO: 1771408 - RNA, 13 nt, Human
uaagucccuguca

SEQ ID NO: 1771409 - RNA, 15 nt, Human
uaagucccugucacc

SEQ ID NO: 1771410 - RNA, 16 nt, Human
uaagucccugucaccu

SEQ ID NO: 1771411 - RNA, 19 nt, Human
uaagucccugucaccucuu

SEQ ID NO: 1771412 - RNA, 12 nt, Human
uaagugcuguau

SEQ ID NO: 1771413 - RNA, 14 nt, Human
uaagugcuguauaa

SEQ ID NO: 1771414 - RNA, 15 nt, Human
uaagugugaacugga

SEQ ID NO: 1771415 - RNA, 14 nt, Human
uaagugugaacugg

SEQ ID NO: 1771416 - RNA, 12 nt, Human
uaagugugaacu

SEQ ID NO: 1771417 - RNA, 22 nt, Human
uaagugugaacuggacccuguu

SEQ ID NO: 1771418 - RNA, 22 nt, Human
uaagccccagcaagcaauccua

SEQ ID NO: 1771419 - RNA, 17 nt, Human
uaagccccagcaagcaa

SEQ ID NO: 1771420 - RNA, 16 nt, Human
uaagccccagcaagca

SEQ ID NO: 1771421 - RNA, 12 nt, Human
uaagaggcaggg

SEQ ID NO: 1771422 - RNA, 15 nt, Human
uaagaggcagggucu

SEQ ID NO: 1771423 - RNA, 13 nt, Human
uaagcccuggcag

SEQ ID NO: 1771424 - RNA, 19 nt, Human
uaagcuauccguguugcag

SEQ ID NO: 1771425 - RNA, 15 nt, Human
uaaggugugcucuga

SEQ ID NO: 1771426 - RNA, 15 nt, Human
uaagucaaccugccu

SEQ ID NO: 1771427 - RNA, 17 nt, Human
uaagucaaccugccuga

SEQ ID NO: 1771428 - RNA, 19 nt, Human
uaauccgaaucucuuuuug

SEQ ID NO: 1771429 - RNA, 21 nt, Human
uaauccgaaucucuuuuugcu

SEQ ID NO: 1771430 - RNA, 21 nt, Human
uaauccccaguaaaauugcca

SEQ ID NO: 1771431 - RNA, 10 nt, Human
uaauaugcau

SEQ ID NO: 1771432 - RNA, 21 nt, Human
uaauaugcugcaacaaaaugu

SEQ ID NO: 1771433 - RNA, 22 nt, Human
uaauaugcugcaacaaaaugua

SEQ ID NO: 1771434 - RNA, 15 nt, Human
uaauggggcggugag

SEQ ID NO: 1771435 - RNA, 17 nt, Human
uaauggacagauuaaua

SEQ ID NO: 1771436 - RNA, 17 nt, Human
uaauggagcaucaagcc

SEQ ID NO: 1771437 - RNA, 22 nt, Human
uaauguugcuggaucaggaagc

SEQ ID NO: 1771438 - RNA, 13 nt, Human
uauagaagcgauu

SEQ ID NO: 1771439 - RNA, 13 nt, Human
uauagaacuucau

SEQ ID NO: 1771440 - RNA, 17 nt, Human
uauagaacuucauggau

SEQ ID NO: 1771441 - RNA, 22 nt, Human
uauagaacuucauggaucagau

SEQ ID NO: 1771442 - RNA, 14 nt, Human
uauaaaguagaaau

SEQ ID NO: 1771443 - RNA, 15 nt, Human
uauaguaaugaguuu

SEQ ID NO: 1771444 - RNA, 13 nt, Human
uauagugauguaa

SEQ ID NO: 1771445 - RNA, 18 nt, Human
uauagugauguaaucuug

SEQ ID NO: 1771446 - RNA, 20 nt, Human
uaucaggugcugccauccag

SEQ ID NO: 1771447 - RNA, 13 nt, Human
uaucauaauuacc

SEQ ID NO: 1771448 - RNA, 19 nt, Human
uaucaggugcugccaucca

SEQ ID NO: 1771449 - RNA, 16 nt, Human
uaucauggugaaaagc

SEQ ID NO: 1771450 - RNA, 13 nt, Human
uauauuuugucau

SEQ ID NO: 1771451 - RNA, 14 nt, Human
uauauuuugucaua

SEQ ID NO: 1771452 - RNA, 14 nt, Human
uauaaacaucacac

SEQ ID NO: 1771453 - RNA, 17 nt, Human
uauaaacaucacacaca

SEQ ID NO: 1771454 - RNA, 18 nt, Human
uauaaacaucacacacac

SEQ ID NO: 1771455 - RNA, 16 nt, Human
uaguaugguggcuggg

SEQ ID NO: 1771456 - RNA, 20 nt, Human
uaguggcuuaaaacaacacu

SEQ ID NO: 1771457 - RNA, 21 nt, Human
uagcugucccaucuggucauu

SEQ ID NO: 1771458 - RNA, 11 nt, Human
uaggugacaga

SEQ ID NO: 1771459 - RNA, 16 nt, Human
uaggugacagagugag

SEQ ID NO: 1771460 - RNA, 15 nt, Human
uagguuccccuguca

SEQ ID NO: 1771461 - RNA, 12 nt, Human
uagguucuucuu

SEQ ID NO: 1771462 - RNA, 14 nt, Human
uaguagauuaaaaa

SEQ ID NO: 1771463 - RNA, 11 nt, Human
uagcagggaaa

SEQ ID NO: 1771464 - RNA, 23 nt, Human
uagcauaucugccuuuauugugu

SEQ ID NO: 1771465 - RNA, 22 nt, Human
uagcauaucugccuuuauugug

SEQ ID NO: 1771466 - RNA, 21 nt, Human
uagcauaucugccuuuauugu

SEQ ID NO: 1771467 - RNA, 18 nt, Human
uagcauaucugccuuuau

SEQ ID NO: 1771468 - RNA, 17 nt, Human
uagcauaucugccuuua

SEQ ID NO: 1771469 - RNA, 16 nt, Human
uagcauaucugccuuu

SEQ ID NO: 1771470 - RNA, 14 nt, Human
uagcauaucugccu

SEQ ID NO: 1771471 - RNA, 16 nt, Human
uagaguuagacuguug

SEQ ID NO: 1771472 - RNA, 15 nt, Human
uagaguuagacuguu

SEQ ID NO: 1771473 - RNA, 17 nt, Human
uagaguuagacuguugg

SEQ ID NO: 1771474 - RNA, 16 nt, Human
uagauacucucuucuu

SEQ ID NO: 1771475 - RNA, 16 nt, Human
uagccuaggugacaga

SEQ ID NO: 1771476 - RNA, 16 nt, Human
uagccgguuccugucc

SEQ ID NO: 1771477 - RNA, 21 nt, Human
uagccgguuccugucccugcg

SEQ ID NO: 1771478 - RNA, 21 nt, Human
uagccgauaucagaauuugug

SEQ ID NO: 1771479 - RNA, 22 nt, Human
uagccgauaucagaauuugugu

SEQ ID NO: 1771480 - RNA, 14 nt, Human
uagccagcugcucc

SEQ ID NO: 1771481 - RNA, 15 nt, Human
uagccagcugcuccc

SEQ ID NO: 1771482 - RNA, 18 nt, Human
uagccagcugcuccccag

SEQ ID NO: 1771483 - RNA, 13 nt, Human
uagccagcuguca

SEQ ID NO: 1771484 - RNA, 18 nt, Human
uagccagcugucaagggc

SEQ ID NO: 1771485 - RNA, 12 nt, Human
uagccugcuggu

SEQ ID NO: 1771486 - RNA, 20 nt, Human
uagcucaggugucccugcac

SEQ ID NO: 1771487 - RNA, 21 nt, Human
uagcucaggugucccugcacu

SEQ ID NO: 1771488 - RNA, 15 nt, Human
uagcugggacuacag

SEQ ID NO: 1771489 - RNA, 17 nt, Human
uagcugggacuacaggc

SEQ ID NO: 1771490 - RNA, 19 nt, Human
uagcugggacuacaggcac

SEQ ID NO: 1771491 - RNA, 15 nt, Human
uagagaaugagaaau

SEQ ID NO: 1771492 - RNA, 11 nt, Human
uagagacaggg

SEQ ID NO: 1771493 - RNA, 12 nt, Human
uagagaauguuc

SEQ ID NO: 1771494 - RNA, 16 nt, Human
uagagaauguuccaga

SEQ ID NO: 1771495 - RNA, 17 nt, Human
uagagaauguuccagac

SEQ ID NO: 1771496 - RNA, 22 nt, Human
uagagaauguuccagacauucu

SEQ ID NO: 1771497 - RNA, 15 nt, Human
uagagugucuuucca

SEQ ID NO: 1771498 - RNA, 14 nt, Human
uagaguuagacugu

SEQ ID NO: 1771499 - RNA, 13 nt, Human
uagaguuagacug

SEQ ID NO: 1771500 - RNA, 20 nt, Human
uagaccuuuuuuuuuuuucc

SEQ ID NO: 1771501 - RNA, 21 nt, Human
uagaccuuuuuuuuuuuucca

SEQ ID NO: 1771502 - RNA, 22 nt, Human
uagaccuuuuuuuuuuuuccaa

SEQ ID NO: 1771503 - RNA, 23 nt, Human
uagacuaaggccauuauuguacu

SEQ ID NO: 1771504 - RNA, 20 nt, Human
uagacucggggugcuuccuu

SEQ ID NO: 1771505 - RNA, 21 nt, Human
uagacucggggugcuuccuug

SEQ ID NO: 1771506 - RNA, 23 nt, Human
uagacuguugggguggguauaaa

SEQ ID NO: 1771507 - RNA, 14 nt, Human
uacuuguggacaca

SEQ ID NO: 1771508 - RNA, 19 nt, Human
uacuuguggacuaaaagau

SEQ ID NO: 1771509 - RNA, 16 nt, Human
uacuuguggacuaaaa

SEQ ID NO: 1771510 - RNA, 15 nt, Human
uacuuguggacuaaa

SEQ ID NO: 1771511 - RNA, 23 nt, Human
uacuuguggacuaaaagauauaa

SEQ ID NO: 1771512 - RNA, 22 nt, Human
uacuuguggacuaaaagauaua

SEQ ID NO: 1771513 - RNA, 20 nt, Human
uacuuguggacuaaaagaua

SEQ ID NO: 1771514 - RNA, 15 nt, Human
uagaaguuuuaaauu

SEQ ID NO: 1771515 - RNA, 14 nt, Human
uagaauauucagac

SEQ ID NO: 1771516 - RNA, 15 nt, Human
uagaauauucagaca

SEQ ID NO: 1771517 - RNA, 17 nt, Human
uagaauauucagacaaa

SEQ ID NO: 1771518 - RNA, 22 nt, Human
uagaauauucagacaaaaugga

SEQ ID NO: 1771519 - RNA, 16 nt, Human
uacauuuuucaacuuu

SEQ ID NO: 1771520 - RNA, 17 nt, Human
uacauuuuucaacuuug

SEQ ID NO: 1771521 - RNA, 19 nt, Human
uacauuuuucaacuuugaa

SEQ ID NO: 1771522 - RNA, 20 nt, Human
uacauuuuucaacuuugaau

SEQ ID NO: 1771523 - RNA, 21 nt, Human
uacauuuuucaacuuugaaua

SEQ ID NO: 1771524 - RNA, 15 nt, Human
uacccacugcucugg

SEQ ID NO: 1771525 - RNA, 14 nt, Human
uaccgacccagggu

SEQ ID NO: 1771526 - RNA, 16 nt, Human
uacccagcgagcccug

SEQ ID NO: 1771527 - RNA, 14 nt, Human
uaccucccacacuc

SEQ ID NO: 1771528 - RNA, 15 nt, Human
uaccucccacacucc

SEQ ID NO: 1771529 - RNA, 17 nt, Human
uaccucccacacuccca

SEQ ID NO: 1771530 - RNA, 20 nt, Human
uaccucccacacucccaagg

SEQ ID NO: 1771531 - RNA, 15 nt, Human
uaccucccuugccuu

SEQ ID NO: 1771532 - RNA, 23 nt, Human
uacuaacaaucagcuccuuccug

SEQ ID NO: 1771533 - RNA, 21 nt, Human
uaccuccugucuuuacaaaua

SEQ ID NO: 1771534 - RNA, 13 nt, Human
uaccuccugagaa

SEQ ID NO: 1771535 - RNA, 19 nt, Human
uaccuccuccccccuccuc

SEQ ID NO: 1771536 - RNA, 11 nt, Human
uaccuccuccu

SEQ ID NO: 1771537 - RNA, 14 nt, Human
uaccuccugagaaa

SEQ ID NO: 1771538 - RNA, 16 nt, Human
uacuguccuacccacc

SEQ ID NO: 1771539 - RNA, 15 nt, Human
uacugccuuuagaaa

SEQ ID NO: 1771540 - RNA, 18 nt, Human
uacugccuuuagaaaaua

SEQ ID NO: 1771541 - RNA, 19 nt, Human
uacugccuuuagaaaauau

SEQ ID NO: 1771542 - RNA, 13 nt, Human
uacuuguggacac

SEQ ID NO: 1771543 - RNA, 13 nt, Human
uacuuaacuguuu

SEQ ID NO: 1771544 - RNA, 11 nt, Human
uacuugaacuu

SEQ ID NO: 1771545 - RNA, 17 nt, Human
uacuugaacuugccucu

SEQ ID NO: 1771546 - RNA, 21 nt, Human
uacuugaacuugccucuuuua

SEQ ID NO: 1771547 - RNA, 13 nt, Human
uacuugaacuugu

SEQ ID NO: 1771548 - RNA, 21 nt, Human
uacuccagugccaacaauccu

SEQ ID NO: 1771549 - RNA, 12 nt, Human
uacugccuuaau

SEQ ID NO: 1771550 - RNA, 22 nt, Human
uacugccuuaauaaaaaaugaa

SEQ ID NO: 1771551 - RNA, 11 nt, Human
uacugccaaag

SEQ ID NO: 1771552 - RNA, 11 nt, Human
uacacacacac

SEQ ID NO: 1771553 - RNA, 17 nt, Human
uacaacucauuccagau

SEQ ID NO: 1771554 - RNA, 18 nt, Human
uacaacucauuccagauc

SEQ ID NO: 1771555 - RNA, 20 nt, Human
uacaacucauuccagauccc

SEQ ID NO: 1771556 - RNA, 20 nt, Human
uaauuagugcuaagugugaa

SEQ ID NO: 1771557 - RNA, 16 nt, Human
uaauuagugcuaagug

SEQ ID NO: 1771558 - RNA, 15 nt, Human
uaauuagugcuaagu

SEQ ID NO: 1771559 - RNA, 14 nt, Human
uaauuagugcuaag

SEQ ID NO: 1771560 - RNA, 12 nt, Human
uaauuagugcua

SEQ ID NO: 1771561 - RNA, 16 nt, Human
uaauguuuuuaauauu

SEQ ID NO: 1771562 - RNA, 16 nt, Human
uacaaacugguauucu

SEQ ID NO: 1771563 - RNA, 14 nt, Human
uacauaaagacuaa

SEQ ID NO: 1771564 - RNA, 15 nt, Human
uacaggagugagcac

SEQ ID NO: 1771565 - RNA, 23 nt, Human
uacaguucggugagcuacaaaug

SEQ ID NO: 1771566 - RNA, 14 nt, Human
ugacacacagcucu

SEQ ID NO: 1771567 - RNA, 15 nt, Human
ugacacacagcucug

SEQ ID NO: 1771568 - RNA, 14 nt, Human
ugacagacacaggc

SEQ ID NO: 1771569 - RNA, 16 nt, Human
ugacagacacaggccc

SEQ ID NO: 1771570 - RNA, 13 nt, Human
ugacagacacagg

SEQ ID NO: 1771571 - RNA, 23 nt, Human
ugacaaggauugcuacuguccua

SEQ ID NO: 1771572 - RNA, 16 nt, Human
ugacaaggucaaauuu

SEQ ID NO: 1771573 - RNA, 19 nt, Human
ugaauuguaacuguucuug

SEQ ID NO: 1771574 - RNA, 12 nt, Human
ugaauuguacag

SEQ ID NO: 1771575 - RNA, 13 nt, Human
ugaauuguacaga

SEQ ID NO: 1771576 - RNA, 17 nt, Human
ugacagacacaggcccg

SEQ ID NO: 1771577 - RNA, 18 nt, Human
ugacagacacaggcccgg

SEQ ID NO: 1771578 - RNA, 21 nt, Human
ugaaguuugaauguuaaauaa

SEQ ID NO: 1771579 - RNA, 20 nt, Human
ugaaguuugaauguuaaaua

SEQ ID NO: 1771580 - RNA, 18 nt, Human
ugaaguuugaauguuaaa

SEQ ID NO: 1771581 - RNA, 17 nt, Human
ugaaguuugaauguuaa

SEQ ID NO: 1771582 - RNA, 16 nt, Human
ugaaguuugaauguua

SEQ ID NO: 1771583 - RNA, 13 nt, Human
ugaaucaugagcc

SEQ ID NO: 1771584 - RNA, 14 nt, Human
ugaaucaugagccu

SEQ ID NO: 1771585 - RNA, 15 nt, Human
ugaaucaugagccug

SEQ ID NO: 1771586 - RNA, 18 nt, Human
ugaaucaugagccugcug

SEQ ID NO: 1771587 - RNA, 19 nt, Human
ugaaggcuucucucugugg

SEQ ID NO: 1771588 - RNA, 13 nt, Human
ugaaggcuucucu

SEQ ID NO: 1771589 - RNA, 15 nt, Human
ugaaggcuucucucu

SEQ ID NO: 1771590 - RNA, 16 nt, Human
ugaaggcuucucucug

SEQ ID NO: 1771591 - RNA, 13 nt, Human
ugaaguuugaaug

SEQ ID NO: 1771592 - RNA, 12 nt, Human
ugaaguuugaau

SEQ ID NO: 1771593 - RNA, 15 nt, Human
ugaaguuugaauguu

SEQ ID NO: 1771594 - RNA, 14 nt, Human
ugaaguuugaaugu

SEQ ID NO: 1771595 - RNA, 13 nt, Human
ugaaucuugucuc

SEQ ID NO: 1771596 - RNA, 20 nt, Human
ugaaucuugucucaaugcuc

SEQ ID NO: 1771597 - RNA, 19 nt, Human
ugaaucuugucucaaugcu

SEQ ID NO: 1771598 - RNA, 16 nt, Human
ugaaucuugucucaau

SEQ ID NO: 1771599 - RNA, 15 nt, Human
ugaaucuugucucaa

SEQ ID NO: 1771600 - RNA, 23 nt, Human
ugaaucuugucucaaugcucaua

SEQ ID NO: 1771601 - RNA, 21 nt, Human
ugaaucuugucucaaugcuca

SEQ ID NO: 1771602 - RNA, 24 nt, Human
ugaaucuugucucaaugcucauaa

SEQ ID NO: 1771603 - RNA, 23 nt, Human
ugaaugcagucuguccaggcucg

SEQ ID NO: 1771604 - RNA, 22 nt, Human
ugaaugcagucuguccaggcuc

SEQ ID NO: 1771605 - RNA, 14 nt, Human
ugaaugauuugcau

SEQ ID NO: 1771606 - RNA, 16 nt, Human
ugaaugauucaguguu

SEQ ID NO: 1771607 - RNA, 14 nt, Human
ugaaggcccugcug

SEQ ID NO: 1771608 - RNA, 15 nt, Human
ugaaggcccugcuga

SEQ ID NO: 1771609 - RNA, 23 nt, Human
ugaagaguaagucaaccugccug

SEQ ID NO: 1771610 - RNA, 9 nt, Human
ugaaacagc

SEQ ID NO: 1771611 - RNA, 10 nt, Human
ugaaacagcu

SEQ ID NO: 1771612 - RNA, 11 nt, Human
ugaaacagcug

SEQ ID NO: 1771613 - RNA, 13 nt, Human
ugaaacagcugcc

SEQ ID NO: 1771614 - RNA, 14 nt, Human
ugaaacagcugccu

SEQ ID NO: 1771615 - RNA, 15 nt, Human
ugaaacagcugccuu

SEQ ID NO: 1771616 - RNA, 16 nt, Human
ugaaacagcugccuua

SEQ ID NO: 1771617 - RNA, 17 nt, Human
ugaaacagcugccuuag

SEQ ID NO: 1771618 - RNA, 19 nt, Human
ugaaacagcugccuuagcu

SEQ ID NO: 1771619 - RNA, 22 nt, Human
ugaaacagcugccuuagcuuca

SEQ ID NO: 1771620 - RNA, 23 nt, Human
ugaaacagcugccuuagcuucag

SEQ ID NO: 1771621 - RNA, 15 nt, Human
ugaacuggucuuccu

SEQ ID NO: 1771622 - RNA, 16 nt, Human
ugaacuggucuuccuu

SEQ ID NO: 1771623 - RNA, 17 nt, Human
ugaacuggucuuccuuu

SEQ ID NO: 1771624 - RNA, 18 nt, Human
ugaacuggucuuccuuuu

SEQ ID NO: 1771625 - RNA, 20 nt, Human
ugaacuuacuguagccucag

SEQ ID NO: 1771626 - RNA, 19 nt, Human
ugaagacucauucuucugu

SEQ ID NO: 1771627 - RNA, 20 nt, Human
ugaagacucauucuucugua

SEQ ID NO: 1771628 - RNA, 21 nt, Human
ugaggcagcagugugaggcca

SEQ ID NO: 1771629 - RNA, 19 nt, Human
ugaggcugggggagagccg

SEQ ID NO: 1771630 - RNA, 18 nt, Human
ugaggucagagccugcag

SEQ ID NO: 1771631 - RNA, 19 nt, Human
ugaggucagagccugcagu

SEQ ID NO: 1771632 - RNA, 22 nt, Human
ugaggaggggccccccugcccu

SEQ ID NO: 1771633 - RNA, 18 nt, Human
ugaggaugggucagagcu

SEQ ID NO: 1771634 - RNA, 23 nt, Human
ugagccgagaucacgccacugca

SEQ ID NO: 1771635 - RNA, 20 nt, Human
ugagcagggcucagcgggga

SEQ ID NO: 1771636 - RNA, 22 nt, Human
ugagcagggcucagcggggaca

SEQ ID NO: 1771637 - RNA, 23 nt, Human
ugagcagggcucagcggggacag

SEQ ID NO: 1771638 - RNA, 22 nt, Human
ugagccgagaucacgccacugc

SEQ ID NO: 1771639 - RNA, 14 nt, Human
ugagcugaggcagc

SEQ ID NO: 1771640 - RNA, 21 nt, Human
ugacugcccggcacagaugcu

SEQ ID NO: 1771641 - RNA, 22 nt, Human
ugacugcccggcacagaugcuc

SEQ ID NO: 1771642 - RNA, 16 nt, Human
ugacugcucagaacuu

SEQ ID NO: 1771643 - RNA, 20 nt, Human
ugacugcucagaacuugcug

SEQ ID NO: 1771644 - RNA, 22 nt, Human
ugacugcucagaacuugcugcu

SEQ ID NO: 1771645 - RNA, 18 nt, Human
ugacuacagucaggaaag

SEQ ID NO: 1771646 - RNA, 16 nt, Human
ugacuacagucaggaa

SEQ ID NO: 1771647 - RNA, 17 nt, Human
ugacuacagucaggaaa

SEQ ID NO: 1771648 - RNA, 19 nt, Human
ugagaggggaacagacugg

SEQ ID NO: 1771649 - RNA, 18 nt, Human
ugagaggggaacagacug

SEQ ID NO: 1771650 - RNA, 14 nt, Human
ugagaggggaacag

SEQ ID NO: 1771651 - RNA, 20 nt, Human
ugagauaccagcgaggaggc

SEQ ID NO: 1771652 - RNA, 21 nt, Human
ugagauaccagcgaggaggcu

SEQ ID NO: 1771653 - RNA, 22 nt, Human
ugagaguuuuggaugcagugcu

SEQ ID NO: 1771654 - RNA, 14 nt, Human
ugacuuuucugugg

SEQ ID NO: 1771655 - RNA, 20 nt, Human
ugagaaacaacaauuucuac

SEQ ID NO: 1771656 - RNA, 15 nt, Human
ucuugcucugcugac

SEQ ID NO: 1771657 - RNA, 23 nt, Human
ucuugcucugcugacagacacag

SEQ ID NO: 1771658 - RNA, 17 nt, Human
ucuugucucaaugcuca

SEQ ID NO: 1771659 - RNA, 15 nt, Human
ucuugucucaaugcu

SEQ ID NO: 1771660 - RNA, 14 nt, Human
ucuugucucaaugc

SEQ ID NO: 1771661 - RNA, 14 nt, Human
ucuugcucugcuga

SEQ ID NO: 1771662 - RNA, 19 nt, Human
ucuugccaaauauaaauaa

SEQ ID NO: 1771663 - RNA, 17 nt, Human
ucuucuuguucugagau

SEQ ID NO: 1771664 - RNA, 14 nt, Human
ucuucgggaccagg

SEQ ID NO: 1771665 - RNA, 17 nt, Human
ucuucgggaccaggauu

SEQ ID NO: 1771666 - RNA, 22 nt, Human
ucugugucagguggggcagcuu

SEQ ID NO: 1771667 - RNA, 17 nt, Human
ucugugucagguggggc

SEQ ID NO: 1771668 - RNA, 20 nt, Human
ucugugucagguggggcagc

SEQ ID NO: 1771669 - RNA, 14 nt, Human
ucuuauaauuuaaa

SEQ ID NO: 1771670 - RNA, 13 nt, Human
ucuuauaauuuaa

SEQ ID NO: 1771671 - RNA, 14 nt, Human
ucuucagaggcccu

SEQ ID NO: 1771672 - RNA, 15 nt, Human
ucuucagaggcccuc

SEQ ID NO: 1771673 - RNA, 14 nt, Human
ucuuugcagacagg

SEQ ID NO: 1771674 - RNA, 17 nt, Human
ucuuugcagacaggcaa

SEQ ID NO: 1771675 - RNA, 13 nt, Human
ucuuugcagacag

SEQ ID NO: 1771676 - RNA, 12 nt, Human
ucuuugcugcag

SEQ ID NO: 1771677 - RNA, 13 nt, Human
ucuuugcugcaga

SEQ ID NO: 1771678 - RNA, 17 nt, Human
ucuuuccaaauaaaaug

SEQ ID NO: 1771679 - RNA, 22 nt, Human
ucuuguggaagugcaucuacuu

SEQ ID NO: 1771680 - RNA, 23 nt, Human
ucuuguggaagugcaucuacuug

SEQ ID NO: 1771681 - RNA, 20 nt, Human
ucuugucucaaugcucauaa

SEQ ID NO: 1771682 - RNA, 18 nt, Human
ucuugucucaaugcucau

SEQ ID NO: 1771683 - RNA, 21 nt, Human
ucuugucucaaugcucauaac

SEQ ID NO: 1771684 - RNA, 23 nt, Human
ucuugugaggaaagucauuggcu

SEQ ID NO: 1771685 - RNA, 13 nt, Human
ucuugugaggaaa

SEQ ID NO: 1771686 - RNA, 16 nt, Human
ugaaaacacugugcac

SEQ ID NO: 1771687 - RNA, 18 nt, Human
ugaaaacacugugcacau

SEQ ID NO: 1771688 - RNA, 14 nt, Human
ucuuuuguuuccuu

SEQ ID NO: 1771689 - RNA, 17 nt, Human
ucuuuuccccuuuccug

SEQ ID NO: 1771690 - RNA, 18 nt, Human
ucuuuuccccuuuccugu

SEQ ID NO: 1771691 - RNA, 19 nt, Human
ucuuuuccccuuuccuguc

SEQ ID NO: 1771692 - RNA, 22 nt, Human
ucuuugcaggaggcccaaccuc

SEQ ID NO: 1771693 - RNA, 19 nt, Human
ucuggacugccccagaaaa

SEQ ID NO: 1771694 - RNA, 18 nt, Human
ucugcucuauuauauaaa

SEQ ID NO: 1771695 - RNA, 16 nt, Human
ucugcucugcguguca

SEQ ID NO: 1771696 - RNA, 21 nt, Human
ucugcucugcgugucaccugu

SEQ ID NO: 1771697 - RNA, 17 nt, Human
ucugccugcccaggccc

SEQ ID NO: 1771698 - RNA, 18 nt, Human
ucugccugcccaggcccc

SEQ ID NO: 1771699 - RNA, 20 nt, Human
ucugccugcccaggccccug

SEQ ID NO: 1771700 - RNA, 16 nt, Human
ucugcucgccuuagca

SEQ ID NO: 1771701 - RNA, 23 nt, Human
ucuguaaaaucuuucuuucuuag

SEQ ID NO: 1771702 - RNA, 22 nt, Human
ucuguaaaaucuuucuuucuua

SEQ ID NO: 1771703 - RNA, 12 nt, Human
ucuguccuggga

SEQ ID NO: 1771704 - RNA, 17 nt, Human
ucugucgcccagucugg

SEQ ID NO: 1771705 - RNA, 13 nt, Human
ucugucucaucca

SEQ ID NO: 1771706 - RNA, 21 nt, Human
ucugucucauccaucaucaug

SEQ ID NO: 1771707 - RNA, 17 nt, Human
ucugucucauccaucau

SEQ ID NO: 1771708 - RNA, 15 nt, Human
ucugucuccagcuuc

SEQ ID NO: 1771709 - RNA, 17 nt, Human
ucugucuccagcuuccc

SEQ ID NO: 1771710 - RNA, 18 nt, Human
ucugagaggacuuuucuu

SEQ ID NO: 1771711 - RNA, 15 nt, Human
ucugagccacagugg

SEQ ID NO: 1771712 - RNA, 17 nt, Human
ucugagccacaguggga

SEQ ID NO: 1771713 - RNA, 20 nt, Human
ucucauagguugagcaauuu

SEQ ID NO: 1771714 - RNA, 13 nt, Human
ucucauccaucau

SEQ ID NO: 1771715 - RNA, 14 nt, Human
ucucauccaucauc

SEQ ID NO: 1771716 - RNA, 22 nt, Human
ucugaggaauccagacccggcu

SEQ ID NO: 1771717 - RNA, 18 nt, Human
ucugaggaauccagaccc

SEQ ID NO: 1771718 - RNA, 21 nt, Human
ucugaggaauccagacccggc

SEQ ID NO: 1771719 - RNA, 19 nt, Human
ucugccauguugccccuuu

SEQ ID NO: 1771720 - RNA, 22 nt, Human
ucugccauauucuguuggccag

SEQ ID NO: 1771721 - RNA, 23 nt, Human
ucugccauauucuguuggccagu

SEQ ID NO: 1771722 - RNA, 16 nt, Human
ucugcagugugccccc

SEQ ID NO: 1771723 - RNA, 23 nt, Human
ucugccucugacacacagcucug

SEQ ID NO: 1771724 - RNA, 14 nt, Human
ucugccucuucugg

SEQ ID NO: 1771725 - RNA, 21 nt, Human
ucugccucugacacacagcuc

SEQ ID NO: 1771726 - RNA, 22 nt, Human
ucugccucugacacacagcucu

SEQ ID NO: 1771727 - RNA, 19 nt, Human
ucugccugaagucacacag

SEQ ID NO: 1771728 - RNA, 15 nt, Human
ucugccucuucuggg

SEQ ID NO: 1771729 - RNA, 17 nt, Human
ucugccucuucugggag

SEQ ID NO: 1771730 - RNA, 18 nt, Human
ucugccucuucugggagg

SEQ ID NO: 1771731 - RNA, 19 nt, Human
ucugccucuucugggaggg

SEQ ID NO: 1771732 - RNA, 20 nt, Human
ucugccugaagucacacagu

SEQ ID NO: 1771733 - RNA, 15 nt, Human
ucugccucugacaca

SEQ ID NO: 1771734 - RNA, 18 nt, Human
ucugccucugacacacag

SEQ ID NO: 1771735 - RNA, 13 nt, Human
ucugccuccuuua

SEQ ID NO: 1771736 - RNA, 13 nt, Human
ucugccucuccag

SEQ ID NO: 1771737 - RNA, 18 nt, Human
ucugccucuccaggcauu

SEQ ID NO: 1771738 - RNA, 16 nt, Human
ucaguuacccacucgg

SEQ ID NO: 1771739 - RNA, 18 nt, Human
ucaguuacccacucgguc

SEQ ID NO: 1771740 - RNA, 15 nt, Human
ucaguguuaaaugug

SEQ ID NO: 1771741 - RNA, 17 nt, Human
ucaguguuaaaugugau

SEQ ID NO: 1771742 - RNA, 21 nt, Human
ucaguguuaaaugugaugaau

SEQ ID NO: 1771743 - RNA, 15 nt, Human
ucaguguuaccugug

SEQ ID NO: 1771744 - RNA, 16 nt, Human
ucaguguuaccugugu

SEQ ID NO: 1771745 - RNA, 17 nt, Human
ucaguguuaccugugug

SEQ ID NO: 1771746 - RNA, 18 nt, Human
ucaguguuaccugugugc

SEQ ID NO: 1771747 - RNA, 19 nt, Human
ucaguguuaccugugugcu

SEQ ID NO: 1771748 - RNA, 17 nt, Human
ucagucugauucccaag

SEQ ID NO: 1771749 - RNA, 19 nt, Human
ucagucugauucccaagcu

SEQ ID NO: 1771750 - RNA, 13 nt, Human
ucagucucugagc

SEQ ID NO: 1771751 - RNA, 15 nt, Human
ucagucucugagcag

SEQ ID NO: 1771752 - RNA, 17 nt, Human
ucagucucugagcagug

SEQ ID NO: 1771753 - RNA, 20 nt, Human
ucagucucugagcagugaau

SEQ ID NO: 1771754 - RNA, 14 nt, Human
ucagguggggcagc

SEQ ID NO: 1771755 - RNA, 13 nt, Human
ucaggugcugucc

SEQ ID NO: 1771756 - RNA, 16 nt, Human
ucaggugcuguccaug

SEQ ID NO: 1771757 - RNA, 18 nt, Human
ucaggugcugccauccag

SEQ ID NO: 1771758 - RNA, 20 nt, Human
ucaggugcugccauccaggu

SEQ ID NO: 1771759 - RNA, 15 nt, Human
ucagguggggcagcu

SEQ ID NO: 1771760 - RNA, 16 nt, Human
ucagguggggcagcuu

SEQ ID NO: 1771761 - RNA, 21 nt, Human
ucagguggggcagcuugaggg

SEQ ID NO: 1771762 - RNA, 17 nt, Human
ucagguggggcagcuug

SEQ ID NO: 1771763 - RNA, 22 nt, Human
ucaggagucucugguagccugc

SEQ ID NO: 1771764 - RNA, 15 nt, Human
ucaguccauagcaga

SEQ ID NO: 1771765 - RNA, 13 nt, Human
ucauggauuacuu

SEQ ID NO: 1771766 - RNA, 22 nt, Human
ucauggauuacuucucuauaaa

SEQ ID NO: 1771767 - RNA, 22 nt, Human
ucauggcagaaggcaaacccau

SEQ ID NO: 1771768 - RNA, 20 nt, Human
ucaucauucucugucucauc

SEQ ID NO: 1771769 - RNA, 22 nt, Human
ucaucauucucugucucaucca

SEQ ID NO: 1771770 - RNA, 14 nt, Human
ucaucaucagagcc

SEQ ID NO: 1771771 - RNA, 11 nt, Human
ucaucaagaag

SEQ ID NO: 1771772 - RNA, 13 nt, Human
ucaucaagaaggg

SEQ ID NO: 1771773 - RNA, 16 nt, Human
ucaucaagaagggcug

SEQ ID NO: 1771774 - RNA, 18 nt, Human
ucaucaagaagggcugca

SEQ ID NO: 1771775 - RNA, 21 nt, Human
ucaucaagaagggcugcauga

SEQ ID NO: 1771776 - RNA, 22 nt, Human
ucagccucccaaagugcuggga

SEQ ID NO: 1771777 - RNA, 12 nt, Human
ucagccucccga

SEQ ID NO: 1771778 - RNA, 20 nt, Human
ucagccucccgaauagcugg

SEQ ID NO: 1771779 - RNA, 18 nt, Human
ucagcuccagcucaccag

SEQ ID NO: 1771780 - RNA, 21 nt, Human
ucagcuccagcucaccagccc

SEQ ID NO: 1771781 - RNA, 22 nt, Human
ucagcuccagcucaccagcccc

SEQ ID NO: 1771782 - RNA, 14 nt, Human
ucagcuccuuccug

SEQ ID NO: 1771783 - RNA, 15 nt, Human
ucagcuccuuccugg

SEQ ID NO: 1771784 - RNA, 16 nt, Human
ucagcuccuuccugga

SEQ ID NO: 1771785 - RNA, 17 nt, Human
ucagcuccuuccuggag

SEQ ID NO: 1771786 - RNA, 18 nt, Human
ucagcucggcucagcucg

SEQ ID NO: 1771787 - RNA, 13 nt, Human
ucagcucggcuca

SEQ ID NO: 1771788 - RNA, 20 nt, Human
ucaggaccaaagcuuucaug

SEQ ID NO: 1771789 - RNA, 15 nt, Human
ucaggacccagagga

SEQ ID NO: 1771790 - RNA, 16 nt, Human
ucaggacccagaggaa

SEQ ID NO: 1771791 - RNA, 19 nt, Human
ucaggacccagaggaaggg

SEQ ID NO: 1771792 - RNA, 18 nt, Human
ucaggaccuccaagccac

SEQ ID NO: 1771793 - RNA, 20 nt, Human
ucaggaccuccaagccacug

SEQ ID NO: 1771794 - RNA, 14 nt, Human
ucaggacucagaag

SEQ ID NO: 1771795 - RNA, 21 nt, Human
ucaggacucagaagccucugg

SEQ ID NO: 1771796 - RNA, 17 nt, Human
ucaggaggcaggaccuu

SEQ ID NO: 1771797 - RNA, 12 nt, Human
ucagccucccaa

SEQ ID NO: 1771798 - RNA, 13 nt, Human
ucagccucccaaa

SEQ ID NO: 1771799 - RNA, 15 nt, Human
ucagcauccuggcac

SEQ ID NO: 1771800 - RNA, 16 nt, Human
ucagcauccuggcacc

SEQ ID NO: 1771801 - RNA, 17 nt, Human
ucagcauccuggcaccc

SEQ ID NO: 1771802 - RNA, 18 nt, Human
ucagcauccuggcacccg

SEQ ID NO: 1771803 - RNA, 16 nt, Human
uaucauuuaauaauau

SEQ ID NO: 1771804 - RNA, 15 nt, Human
ucagauauucugcuc

SEQ ID NO: 1771805 - RNA, 18 nt, Human
ucagauauucugcucuau

SEQ ID NO: 1771806 - RNA, 14 nt, Human
uaucauuuaauaau

SEQ ID NO: 1771807 - RNA, 15 nt, Human
ucccaugagccucag

SEQ ID NO: 1771808 - RNA, 16 nt, Human
ucccaugagccucagc

SEQ ID NO: 1771809 - RNA, 16 nt, Human
ucccaccucagccucc

SEQ ID NO: 1771810 - RNA, 18 nt, Human
ucccaccucagccucccg

SEQ ID NO: 1771811 - RNA, 19 nt, Human
ucccaccuuggcugcaggg

SEQ ID NO: 1771812 - RNA, 21 nt, Human
ucccaccuuggcugcagggag

SEQ ID NO: 1771813 - RNA, 14 nt, Human
ucccacucagucca

SEQ ID NO: 1771814 - RNA, 15 nt, Human
uccauagcugcugcc

SEQ ID NO: 1771815 - RNA, 17 nt, Human
uccauagcugcugcccu

SEQ ID NO: 1771816 - RNA, 20 nt, Human
uccauaucagaacugugcca

SEQ ID NO: 1771817 - RNA, 13 nt, Human
uccauauccuggu

SEQ ID NO: 1771818 - RNA, 14 nt, Human
uccauauccuggug

SEQ ID NO: 1771819 - RNA, 21 nt, Human
uccaugccuuaaaccuaccuc

SEQ ID NO: 1771820 - RNA, 18 nt, Human
uccauguccccucccaga

SEQ ID NO: 1771821 - RNA, 17 nt, Human
uccauguccccucccag

SEQ ID NO: 1771822 - RNA, 16 nt, Human
uccauguccccuccca

SEQ ID NO: 1771823 - RNA, 16 nt, Human
uccagagauucauuuu

SEQ ID NO: 1771824 - RNA, 18 nt, Human
uccagagauucauuuucu

SEQ ID NO: 1771825 - RNA, 19 nt, Human
uccagagauucauuuucua

SEQ ID NO: 1771826 - RNA, 20 nt, Human
uccagagauucauuuucuag

SEQ ID NO: 1771827 - RNA, 21 nt, Human
uccagagauucauuuucuaga

SEQ ID NO: 1771828 - RNA, 23 nt, Human
uccagagauucauuuucuagaua

SEQ ID NO: 1771829 - RNA, 12 nt, Human
uccagagggcac

SEQ ID NO: 1771830 - RNA, 17 nt, Human
uccagagggcacucugc

SEQ ID NO: 1771831 - RNA, 22 nt, Human
uccacugugccaugugccaggu

SEQ ID NO: 1771832 - RNA, 21 nt, Human
uccacccugcucuccgaccag

SEQ ID NO: 1771833 - RNA, 12 nt, Human
uccacagggcac

SEQ ID NO: 1771834 - RNA, 13 nt, Human
uccacccugcucu

SEQ ID NO: 1771835 - RNA, 14 nt, Human
uccacccugcucuc

SEQ ID NO: 1771836 - RNA, 21 nt, Human
uccaggaagaaagaauguuac

SEQ ID NO: 1771837 - RNA, 16 nt, Human
uccaggagaaggccaa

SEQ ID NO: 1771838 - RNA, 20 nt, Human
uccaggagaaggccaauucc

SEQ ID NO: 1771839 - RNA, 23 nt, Human
uccaggagaaggccaauuccuau

SEQ ID NO: 1771840 - RNA, 17 nt, Human
uccaagccacugagcaa

SEQ ID NO: 1771841 - RNA, 16 nt, Human
ucuaauuuuuaagcaa

SEQ ID NO: 1771842 - RNA, 20 nt, Human
ucuaauggguauuuaaacaa

SEQ ID NO: 1771843 - RNA, 20 nt, Human
ucuaggccuccuggcccagg

SEQ ID NO: 1771844 - RNA, 17 nt, Human
ucucacuguugcccagg

SEQ ID NO: 1771845 - RNA, 21 nt, Human
ucucagacuuuggaaaaugca

SEQ ID NO: 1771846 - RNA, 22 nt, Human
ucucagacuuuggaaaaugcau

SEQ ID NO: 1771847 - RNA, 14 nt, Human
ucucacuguugccc

SEQ ID NO: 1771848 - RNA, 15 nt, Human
ucucacuguugccca

SEQ ID NO: 1771849 - RNA, 17 nt, Human
ucucacuggaugcaaag

SEQ ID NO: 1771850 - RNA, 18 nt, Human
ucuaucuuuuguuuccuu

SEQ ID NO: 1771851 - RNA, 14 nt, Human
ucucacaagccagc

SEQ ID NO: 1771852 - RNA, 23 nt, Human
ucucacucugucgcccagucugg

SEQ ID NO: 1771853 - RNA, 14 nt, Human
ucgcccagucugga

SEQ ID NO: 1771854 - RNA, 19 nt, Human
ucgcccagucuggaaugca

SEQ ID NO: 1771855 - RNA, 23 nt, Human
ucgcccagucuggaaugcagugg

SEQ ID NO: 1771856 - RNA, 15 nt, Human
ucggccuagggcccc

SEQ ID NO: 1771857 - RNA, 22 nt, Human
ucggccuagggcccccacaguu

SEQ ID NO: 1771858 - RNA, 16 nt, Human
ucgauguuauguaaaa

SEQ ID NO: 1771859 - RNA, 17 nt, Human
uccuuuguguguguguc

SEQ ID NO: 1771860 - RNA, 18 nt, Human
uccuuuguguguguguca

SEQ ID NO: 1771861 - RNA, 22 nt, Human
uccuuugugugugugucagcug

SEQ ID NO: 1771862 - RNA, 10 nt, Human
uccuguccca

SEQ ID NO: 1771863 - RNA, 14 nt, Human
uccugucccugcgc

SEQ ID NO: 1771864 - RNA, 22 nt, Human
uccugucccugcgccuuuccuu

SEQ ID NO: 1771865 - RNA, 18 nt, Human
uccuugggggcucccagg

SEQ ID NO: 1771866 - RNA, 15 nt, Human
uccuucuuugggaua

SEQ ID NO: 1771867 - RNA, 21 nt, Human
uccuucuuugggauagagaau

SEQ ID NO: 1771868 - RNA, 14 nt, Human
uccuccugggcccu

SEQ ID NO: 1771869 - RNA, 15 nt, Human
uccuccugggcccuc

SEQ ID NO: 1771870 - RNA, 16 nt, Human
uccuccugggcccucu

SEQ ID NO: 1771871 - RNA, 22 nt, Human
uccuccguccauaucagaacug

SEQ ID NO: 1771872 - RNA, 17 nt, Human
uccucaaaacuggaguc

SEQ ID NO: 1771873 - RNA, 12 nt, Human
uccggacuggug

SEQ ID NO: 1771874 - RNA, 14 nt, Human
uccggacuggugcc

SEQ ID NO: 1771875 - RNA, 16 nt, Human
uccggacuggugcccu

SEQ ID NO: 1771876 - RNA, 16 nt, Human
uccggaaugccaccca

SEQ ID NO: 1771877 - RNA, 17 nt, Human
uccggaaugccacccac

SEQ ID NO: 1771878 - RNA, 18 nt, Human
uccggaaugccacccaca

SEQ ID NO: 1771879 - RNA, 20 nt, Human
uccuaugcuauugacaauaa

SEQ ID NO: 1771880 - RNA, 21 nt, Human
uccuaugcuauugacaauaaa

SEQ ID NO: 1771881 - RNA, 22 nt, Human
uccuaugcuauugacaauaaaa

SEQ ID NO: 1771882 - RNA, 21 nt, Human
uccuaugugauuuuaacucug

SEQ ID NO: 1771883 - RNA, 22 nt, Human
uccgaaagggacuuggaagcuc

SEQ ID NO: 1771884 - RNA, 17 nt, Human
uccgaaccuccucugug

SEQ ID NO: 1771885 - RNA, 16 nt, Human
uccgaaccuccucugu

SEQ ID NO: 1771886 - RNA, 15 nt, Human
uccgaaccuccucug

SEQ ID NO: 1771887 - RNA, 19 nt, Human
uccgacucuuucugagugc

SEQ ID NO: 1771888 - RNA, 23 nt, Human
uccgacucuuucugagugccuuc

SEQ ID NO: 1771889 - RNA, 17 nt, Human
ucccuucugucccucac

SEQ ID NO: 1771890 - RNA, 22 nt, Human
ucccuucugucccucacagcac

SEQ ID NO: 1771891 - RNA, 21 nt, Human
uccgaaagggacuuggaagcu

SEQ ID NO: 1771892 - RNA, 20 nt, Human
ucccuugacuuugcuccuca

SEQ ID NO: 1771893 - RNA, 21 nt, Human
uccgcuuucuacccagcgagc

SEQ ID NO: 1771894 - RNA, 16 nt, Human
ucccuucugucccuca

SEQ ID NO: 1771895 - RNA, 12 nt, Human
ucccuggcuucu

SEQ ID NO: 1771896 - RNA, 14 nt, Human
ucccuggcuucugu

SEQ ID NO: 1771897 - RNA, 15 nt, Human
ucccuggcuucugug

SEQ ID NO: 1771898 - RNA, 17 nt, Human
ucccuggcuucuguggg

SEQ ID NO: 1771899 - RNA, 20 nt, Human
ucccugcacuugcagacucu

SEQ ID NO: 1771900 - RNA, 14 nt, Human
ucccuccgggaccu

SEQ ID NO: 1771901 - RNA, 15 nt, Human
ucccuccgggaccug

SEQ ID NO: 1771902 - RNA, 19 nt, Human
ucccuagaaacuuccaaau

SEQ ID NO: 1771903 - RNA, 18 nt, Human
ucccuagaaacuuccaaa

SEQ ID NO: 1771904 - RNA, 17 nt, Human
ucccaugagccucagca

SEQ ID NO: 1771905 - RNA, 22 nt, Human
ucccaugagccucagcauccug

SEQ ID NO: 1771906 - RNA, 15 nt, Human
ucccuaccgacccag

SEQ ID NO: 1771907 - RNA, 18 nt, Human
ucccuaccgacccagggu

SEQ ID NO: 1771908 - RNA, 22 nt, Human
uggacagacagaggaugagcuc

SEQ ID NO: 1771909 - RNA, 16 nt, Human
uggacagacagaggau

SEQ ID NO: 1771910 - RNA, 18 nt, Human
uggacaugaagauucuuu

SEQ ID NO: 1771911 - RNA, 16 nt, Human
uggacagauuaauauu

SEQ ID NO: 1771912 - RNA, 21 nt, Human
uggacaugaagauucuuuccc

SEQ ID NO: 1771913 - RNA, 22 nt, Human
uggacaugaagauucuuuccca

SEQ ID NO: 1771914 - RNA, 13 nt, Human
uggaaccaggcuu

SEQ ID NO: 1771915 - RNA, 15 nt, Human
uggaaccaggcuugg

SEQ ID NO: 1771916 - RNA, 22 nt, Human
uggaauaauccuaaacauauga

SEQ ID NO: 1771917 - RNA, 16 nt, Human
ugcuggagcacugggc

SEQ ID NO: 1771918 - RNA, 18 nt, Human
ugcuggagcacugggcuc

SEQ ID NO: 1771919 - RNA, 20 nt, Human
ugcuggagcacugggcuccc

SEQ ID NO: 1771920 - RNA, 18 nt, Human
uggaaacauucaggagcu

SEQ ID NO: 1771921 - RNA, 17 nt, Human
uggaaaacaaggaaguc

SEQ ID NO: 1771922 - RNA, 13 nt, Human
uggcagugggagc

SEQ ID NO: 1771923 - RNA, 15 nt, Human
uggcagguccucccc

SEQ ID NO: 1771924 - RNA, 17 nt, Human
uggcagguccuccccuc

SEQ ID NO: 1771925 - RNA, 20 nt, Human
uggcaggacgugggcugggc

SEQ ID NO: 1771926 - RNA, 13 nt, Human
uggcagcugcuuu

SEQ ID NO: 1771927 - RNA, 21 nt, Human
uggcacccggccccugcuggu

SEQ ID NO: 1771928 - RNA, 23 nt, Human
uggcaguggacucagaaagccaa

SEQ ID NO: 1771929 - RNA, 20 nt, Human
uggccagaugcaccagcccu

SEQ ID NO: 1771930 - RNA, 21 nt, Human
uggccagaugcaccagcccuu

SEQ ID NO: 1771931 - RNA, 15 nt, Human
uggacucucagucuc

SEQ ID NO: 1771932 - RNA, 20 nt, Human
uggacucucagucucugagc

SEQ ID NO: 1771933 - RNA, 22 nt, Human
uggacucucagucucugagcag

SEQ ID NO: 1771934 - RNA, 21 nt, Human
uggacucugaaauaucccggg

SEQ ID NO: 1771935 - RNA, 12 nt, Human
uggacucagaaa

SEQ ID NO: 1771936 - RNA, 16 nt, Human
uggaggaaagggagga

SEQ ID NO: 1771937 - RNA, 14 nt, Human
uggauuucuuuugu

SEQ ID NO: 1771938 - RNA, 18 nt, Human
uggaucucauuggacccu

SEQ ID NO: 1771939 - RNA, 16 nt, Human
uggauuucuuuuguaa

SEQ ID NO: 1771940 - RNA, 14 nt, Human
ugggggugccagga

SEQ ID NO: 1771941 - RNA, 13 nt, Human
ugggguuuccugg

SEQ ID NO: 1771942 - RNA, 14 nt, Human
ugggguuuccuggc

SEQ ID NO: 1771943 - RNA, 17 nt, Human
ugggguuuccuggcacu

SEQ ID NO: 1771944 - RNA, 15 nt, Human
ugggguuuccuggca

SEQ ID NO: 1771945 - RNA, 18 nt, Human
ugguauuguauuuauuca

SEQ ID NO: 1771946 - RNA, 14 nt, Human
ugguauuguauuua

SEQ ID NO: 1771947 - RNA, 13 nt, Human
ugguauuguauuu

SEQ ID NO: 1771948 - RNA, 12 nt, Human
ugguauuguauu

SEQ ID NO: 1771949 - RNA, 19 nt, Human
ugguauucaggauuacaug

SEQ ID NO: 1771950 - RNA, 18 nt, Human
ugguaugaucacggcuca

SEQ ID NO: 1771951 - RNA, 22 nt, Human
ugggcuaagugauccucccacc

SEQ ID NO: 1771952 - RNA, 16 nt, Human
ugggcuaguugggcuu

SEQ ID NO: 1771953 - RNA, 17 nt, Human
ugggcuggugucaccug

SEQ ID NO: 1771954 - RNA, 15 nt, Human
ugggcuucaguggca

SEQ ID NO: 1771955 - RNA, 17 nt, Human
ugggcuucaguggcagc

SEQ ID NO: 1771956 - RNA, 21 nt, Human
uggcuugaguuuaaauuguaa

SEQ ID NO: 1771957 - RNA, 20 nt, Human
uggcuuuauccucuuuagag

SEQ ID NO: 1771958 - RNA, 16 nt, Human
uggcuuuauccucuuu

SEQ ID NO: 1771959 - RNA, 16 nt, Human
uggcuuuaugcacauu

SEQ ID NO: 1771960 - RNA, 21 nt, Human
uggcuuuauccucuuuagagu

SEQ ID NO: 1771961 - RNA, 14 nt, Human
uggcuucugugggg

SEQ ID NO: 1771962 - RNA, 20 nt, Human
uggcuucuguggggccccuc

SEQ ID NO: 1771963 - RNA, 21 nt, Human
uggcugggggccucagugcca

SEQ ID NO: 1771964 - RNA, 15 nt, Human
ugggagugagcuggu

SEQ ID NO: 1771965 - RNA, 17 nt, Human
ugggagcugccuguuca

SEQ ID NO: 1771966 - RNA, 21 nt, Human
ugggagcugccuguucagcuc

SEQ ID NO: 1771967 - RNA, 22 nt, Human
ugggagcugccuguucagcucc

SEQ ID NO: 1771968 - RNA, 16 nt, Human
ugggauuacaggugug

SEQ ID NO: 1771969 - RNA, 12 nt, Human
ugggagcugccu

SEQ ID NO: 1771970 - RNA, 13 nt, Human
ugggagcugccug

SEQ ID NO: 1771971 - RNA, 14 nt, Human
ugggagcugccugu

SEQ ID NO: 1771972 - RNA, 17 nt, Human
ugcaccgggccacagag

SEQ ID NO: 1771973 - RNA, 22 nt, Human
ugcaccgggccacagagaaagu

SEQ ID NO: 1771974 - RNA, 14 nt, Human
ugcaccgggccaca

SEQ ID NO: 1771975 - RNA, 15 nt, Human
ugcaccgggccacag

SEQ ID NO: 1771976 - RNA, 23 nt, Human
ugcagcaggaauauaugugugcc

SEQ ID NO: 1771977 - RNA, 20 nt, Human
ugcagugcucgcuguugcug

SEQ ID NO: 1771978 - RNA, 19 nt, Human
ugcagugcucgcuguugcu

SEQ ID NO: 1771979 - RNA, 17 nt, Human
ugcagugcucgcuguug

SEQ ID NO: 1771980 - RNA, 22 nt, Human
ugcagugguaugaucacggcuc

SEQ ID NO: 1771981 - RNA, 20 nt, Human
ugcaguggugcgaucugggu

SEQ ID NO: 1771982 - RNA, 23 nt, Human
ugcagugcucgcuguugcugaau

SEQ ID NO: 1771983 - RNA, 22 nt, Human
ugcagugcucgcuguugcugaa

SEQ ID NO: 1771984 - RNA, 21 nt, Human
ugcagugcucgcuguugcuga

SEQ ID NO: 1771985 - RNA, 19 nt, Human
ugcagugguauuaauuuug

SEQ ID NO: 1771986 - RNA, 14 nt, Human
ugcaguucugagca

SEQ ID NO: 1771987 - RNA, 16 nt, Human
ugccccaucagugcuc

SEQ ID NO: 1771988 - RNA, 18 nt, Human
ugccccaucagugcuccc

SEQ ID NO: 1771989 - RNA, 20 nt, Human
ugccccaucagugcucccuc

SEQ ID NO: 1771990 - RNA, 21 nt, Human
ugccccaucagugcucccuca

SEQ ID NO: 1771991 - RNA, 11 nt, Human
ugcccaggcug

SEQ ID NO: 1771992 - RNA, 13 nt, Human
ugcccaggcuggc

SEQ ID NO: 1771993 - RNA, 21 nt, Human
ugccauccagguucagcuugu

SEQ ID NO: 1771994 - RNA, 18 nt, Human
ugccagguuuuuggucug

SEQ ID NO: 1771995 - RNA, 19 nt, Human
ugccagguuuuuggucuga

SEQ ID NO: 1771996 - RNA, 22 nt, Human
ugccagguuuuuggucugaccc

SEQ ID NO: 1771997 - RNA, 19 nt, Human
ugccacccuggggagaaag

SEQ ID NO: 1771998 - RNA, 22 nt, Human
ugccacuacggaauaguuggcu

SEQ ID NO: 1771999 - RNA, 20 nt, Human
ugccacccuggggagaaagu

SEQ ID NO: 1772000 - RNA, 18 nt, Human
ugccaaauauaaauaaaa

SEQ ID NO: 1772001 - RNA, 17 nt, Human
ugccaaauauaaauaaa

SEQ ID NO: 1772002 - RNA, 22 nt, Human
ugccaaauauaaauaaaaauaa

SEQ ID NO: 1772003 - RNA, 19 nt, Human
ugccaaauauaaauaaaaa

SEQ ID NO: 1772004 - RNA, 14 nt, Human
ugcgccuacaggag

SEQ ID NO: 1772005 - RNA, 16 nt, Human
ugcgccuacaggagug

SEQ ID NO: 1772006 - RNA, 22 nt, Human
ugcgccuacaggagugagcacu

SEQ ID NO: 1772007 - RNA, 11 nt, Human
ugcgccugcug

SEQ ID NO: 1772008 - RNA, 14 nt, Human
ugcgaucuggguuc

SEQ ID NO: 1772009 - RNA, 15 nt, Human
ugcgaucuggguuca

SEQ ID NO: 1772010 - RNA, 19 nt, Human
ugcgaucuggguucacugc

SEQ ID NO: 1772011 - RNA, 20 nt, Human
ugcgaucuggguucacugca

SEQ ID NO: 1772012 - RNA, 21 nt, Human
ugcgaucuggguucacugcaa

SEQ ID NO: 1772013 - RNA, 15 nt, Human
ugccucuucugggag

SEQ ID NO: 1772014 - RNA, 13 nt, Human
ugccucuccaggc

SEQ ID NO: 1772015 - RNA, 14 nt, Human
ugccucuccaggca

SEQ ID NO: 1772016 - RNA, 18 nt, Human
ugccucuuuuaccugcug

SEQ ID NO: 1772017 - RNA, 19 nt, Human
ugccucuuuuaccugcugc

SEQ ID NO: 1772018 - RNA, 20 nt, Human
ugccucuuuuaccugcugcu

SEQ ID NO: 1772019 - RNA, 21 nt, Human
ugccucuuuuaccugcugcuu

SEQ ID NO: 1772020 - RNA, 22 nt, Human
ugccucuuuuaccugcugcuuc

SEQ ID NO: 1772021 - RNA, 16 nt, Human
ugccucuucugggagg

SEQ ID NO: 1772022 - RNA, 19 nt, Human
ugccucuucugggagggca

SEQ ID NO: 1772023 - RNA, 20 nt, Human
ugccucuucugggagggcag

SEQ ID NO: 1772024 - RNA, 21 nt, Human
ugccucuucugggagggcagc

SEQ ID NO: 1772025 - RNA, 20 nt, Human
ugccucgaacuggcugcaaa

SEQ ID NO: 1772026 - RNA, 18 nt, Human
ugccucgaacuggcugca

SEQ ID NO: 1772027 - RNA, 19 nt, Human
ugccucgaacuggcugcaa

SEQ ID NO: 1772028 - RNA, 18 nt, Human
ugccugacauuuggagug

SEQ ID NO: 1772029 - RNA, 13 nt, Human
ugccugucugccc

SEQ ID NO: 1772030 - RNA, 14 nt, Human
ugccugucugcccc

SEQ ID NO: 1772031 - RNA, 15 nt, Human
ugccugucugcccca

SEQ ID NO: 1772032 - RNA, 16 nt, Human
ugccugucugccccag

SEQ ID NO: 1772033 - RNA, 15 nt, Human
ugccuguaaacauag

SEQ ID NO: 1772034 - RNA, 18 nt, Human
ugccuguagcccacucug

SEQ ID NO: 1772035 - RNA, 20 nt, Human
ugccuguagcccacucugcu

SEQ ID NO: 1772036 - RNA, 23 nt, Human
ugccuguagcccacucugcucgc

SEQ ID NO: 1772037 - RNA, 14 nt, Human
ugccugguggcagc

SEQ ID NO: 1772038 - RNA, 15 nt, Human
ugccugguggcagcu

SEQ ID NO: 1772039 - RNA, 16 nt, Human
ugccugguggcagcug

SEQ ID NO: 1772040 - RNA, 19 nt, Human
ugcugcuauccugccaaaa

SEQ ID NO: 1772041 - RNA, 11 nt, Human
ugcugcuggcc

SEQ ID NO: 1772042 - RNA, 12 nt, Human
ugcugcuggcca

SEQ ID NO: 1772043 - RNA, 13 nt, Human
ugcugcuggccaa

SEQ ID NO: 1772044 - RNA, 14 nt, Human
ugcugcuggccaaa

SEQ ID NO: 1772045 - RNA, 21 nt, Human
ugcugcuggccaaauagcaaa

SEQ ID NO: 1772046 - RNA, 14 nt, Human
ugcuggaagcccag

SEQ ID NO: 1772047 - RNA, 15 nt, Human
ugcuggaagcccagc

SEQ ID NO: 1772048 - RNA, 12 nt, Human
ugcugcugucuu

SEQ ID NO: 1772049 - RNA, 18 nt, Human
ugcugcaugcccucucag

SEQ ID NO: 1772050 - RNA, 19 nt, Human
ugcugcaugcccucucagg

SEQ ID NO: 1772051 - RNA, 15 nt, Human
ugcugcaugcccucu

SEQ ID NO: 1772052 - RNA, 16 nt, Human
ugcugcaugcccucuc

SEQ ID NO: 1772053 - RNA, 17 nt, Human
ugcugcaacaaaaugua

SEQ ID NO: 1772054 - RNA, 22 nt, Human
ugcugacagacacaggcccggc

SEQ ID NO: 1772055 - RNA, 23 nt, Human
ugcugacagacacaggcccggcu

SEQ ID NO: 1772056 - RNA, 14 nt, Human
ugcuccucucccca

SEQ ID NO: 1772057 - RNA, 15 nt, Human
ugcucacauaucugu

SEQ ID NO: 1772058 - RNA, 16 nt, Human
ugcucacauaucuguc

SEQ ID NO: 1772059 - RNA, 15 nt, Human
ugcuaagccccagca

SEQ ID NO: 1772060 - RNA, 18 nt, Human
ugcuaagccccagcaagc

SEQ ID NO: 1772061 - RNA, 17 nt, Human
ugcuccucuccccagca

SEQ ID NO: 1772062 - RNA, 18 nt, Human
ugcuccucuccccagcaa

SEQ ID NO: 1772063 - RNA, 16 nt, Human
ugcucuaugcuuucca

SEQ ID NO: 1772064 - RNA, 18 nt, Human
ugcucuaugcuuuccaaa

SEQ ID NO: 1772065 - RNA, 12 nt, Human
ugcucuaugcuu

SEQ ID NO: 1772066 - RNA, 21 nt, Human
ugcucuaugcuuuccaaaccu

SEQ ID NO: 1772067 - RNA, 18 nt, Human
ugcucgcuguugcugaau

SEQ ID NO: 1772068 - RNA, 17 nt, Human
ugcucgcuguugcugaa

SEQ ID NO: 1772069 - RNA, 15 nt, Human
ugcucgcuguugcug

SEQ ID NO: 1772070 - RNA, 14 nt, Human
ugcucgcuguugcu

SEQ ID NO: 1772071 - RNA, 13 nt, Human
ugcucgcuguugc

SEQ ID NO: 1772072 - RNA, 18 nt, Human
ugugaaaaugguccagga

SEQ ID NO: 1772073 - RNA, 22 nt, Human
ugugaaaaugguccaggagaag

SEQ ID NO: 1772074 - RNA, 22 nt, Human
uguccugaaacgcuccuuugug

SEQ ID NO: 1772075 - RNA, 16 nt, Human
ugugaguuuaaagcaa

SEQ ID NO: 1772076 - RNA, 14 nt, Human
ugugauauuaacag

SEQ ID NO: 1772077 - RNA, 17 nt, Human
ugugcacaucugugucu

SEQ ID NO: 1772078 - RNA, 20 nt, Human
ugugcacaucugugucuugu

SEQ ID NO: 1772079 - RNA, 15 nt, Human
ugugagucaccaagc

SEQ ID NO: 1772080 - RNA, 17 nt, Human
ugugagucaccaagccc

SEQ ID NO: 1772081 - RNA, 14 nt, Human
ugugaggccagggc

SEQ ID NO: 1772082 - RNA, 15 nt, Human
ugugaggccagggca

SEQ ID NO: 1772083 - RNA, 16 nt, Human
ugugaggccagggcag

SEQ ID NO: 1772084 - RNA, 17 nt, Human
ugugaggccagggcaga

SEQ ID NO: 1772085 - RNA, 22 nt, Human
ugugaggccagggcagagugag

SEQ ID NO: 1772086 - RNA, 19 nt, Human
ugugagucaccaagcccag

SEQ ID NO: 1772087 - RNA, 21 nt, Human
ugugagucaccaagcccaguu

SEQ ID NO: 1772088 - RNA, 15 nt, Human
ugugaccaaugucuu

SEQ ID NO: 1772089 - RNA, 16 nt, Human
ugugaccaaugucuug

SEQ ID NO: 1772090 - RNA, 13 nt, Human
ugugaggccaggg

SEQ ID NO: 1772091 - RNA, 22 nt, Human
ugugacauuuggagagggggcc

SEQ ID NO: 1772092 - RNA, 11 nt, Human
ugugacauucc

SEQ ID NO: 1772093 - RNA, 13 nt, Human
ugugacauuccuu

SEQ ID NO: 1772094 - RNA, 14 nt, Human
ugugacauuccuuc

SEQ ID NO: 1772095 - RNA, 18 nt, Human
uguggacacagcucuucu

SEQ ID NO: 1772096 - RNA, 17 nt, Human
uguggaauguuggauaa

SEQ ID NO: 1772097 - RNA, 19 nt, Human
uguggacacagcucuucuc

SEQ ID NO: 1772098 - RNA, 16 nt, Human
uguggacuaaaagaua

SEQ ID NO: 1772099 - RNA, 15 nt, Human
uguggacuaaaagau

SEQ ID NO: 1772100 - RNA, 19 nt, Human
uguggacuaaaagauauaa

SEQ ID NO: 1772101 - RNA, 20 nt, Human
uguggccuuccauuuauaug

SEQ ID NO: 1772102 - RNA, 22 nt, Human
ugugggcuaguugggcuuccuc

SEQ ID NO: 1772103 - RNA, 16 nt, Human
uguguagggcgggagg

SEQ ID NO: 1772104 - RNA, 12 nt, Human
uguguagggcgg

SEQ ID NO: 1772105 - RNA, 16 nt, Human
ugugcacaugcacgug

SEQ ID NO: 1772106 - RNA, 14 nt, Human
ugugcacguacaca

SEQ ID NO: 1772107 - RNA, 21 nt, Human
ugugcacaucugugucuuguu

SEQ ID NO: 1772108 - RNA, 15 nt, Human
ugugcuuggucuguu

SEQ ID NO: 1772109 - RNA, 18 nt, Human
ugugcuuggucuguuuga

SEQ ID NO: 1772110 - RNA, 17 nt, Human
ugugcuugaaggcccug

SEQ ID NO: 1772111 - RNA, 21 nt, Human
ugugcuugaaggcccugcuga

SEQ ID NO: 1772112 - RNA, 22 nt, Human
ugugcuugaaggcccugcugag

SEQ ID NO: 1772113 - RNA, 14 nt, Human
ugugcgccuacagg

SEQ ID NO: 1772114 - RNA, 19 nt, Human
ugugcgccuacaggaguga

SEQ ID NO: 1772115 - RNA, 18 nt, Human
ugugcucaggacucagaa

SEQ ID NO: 1772116 - RNA, 15 nt, Human
uguacgucugacagg

SEQ ID NO: 1772117 - RNA, 15 nt, Human
uguagccucagauga

SEQ ID NO: 1772118 - RNA, 15 nt, Human
uguagccuucacaca

SEQ ID NO: 1772119 - RNA, 22 nt, Human
uguagcccacucugcucgccuu

SEQ ID NO: 1772120 - RNA, 16 nt, Human
uguagcccacucugcu

SEQ ID NO: 1772121 - RNA, 17 nt, Human
uguagcccacucugcuc

SEQ ID NO: 1772122 - RNA, 22 nt, Human
ugguauuguauuuauucaauaa

SEQ ID NO: 1772123 - RNA, 21 nt, Human
ugguauucuguucuggaggaa

SEQ ID NO: 1772124 - RNA, 19 nt, Human
ugguauuguauuuauucaa

SEQ ID NO: 1772125 - RNA, 16 nt, Human
uguaauccgaaucucu

SEQ ID NO: 1772126 - RNA, 15 nt, Human
uguaaucuugaauug

SEQ ID NO: 1772127 - RNA, 21 nt, Human
uguaaucuugaauuguaacug

SEQ ID NO: 1772128 - RNA, 19 nt, Human
uguauuuauucaauaaagu

SEQ ID NO: 1772129 - RNA, 17 nt, Human
uguauuuauucaauaaa

SEQ ID NO: 1772130 - RNA, 14 nt, Human
uguauuuauucaau

SEQ ID NO: 1772131 - RNA, 13 nt, Human
uguauuuauucaa

SEQ ID NO: 1772132 - RNA, 22 nt, Human
uguauuuauucaauaaaguauu

SEQ ID NO: 1772133 - RNA, 13 nt, Human
ugucacaggcagg

SEQ ID NO: 1772134 - RNA, 12 nt, Human
ugucacaggcag

SEQ ID NO: 1772135 - RNA, 14 nt, Human
uguauuuuguauug

SEQ ID NO: 1772136 - RNA, 17 nt, Human
ugucacacacuuuggcu

SEQ ID NO: 1772137 - RNA, 13 nt, Human
uguauucucugag

SEQ ID NO: 1772138 - RNA, 14 nt, Human
uguauucucugagc

SEQ ID NO: 1772139 - RNA, 19 nt, Human
uguauucucugagcugugc

SEQ ID NO: 1772140 - RNA, 20 nt, Human
uguauucucugagcugugca

SEQ ID NO: 1772141 - RNA, 21 nt, Human
uguauucucugagcugugcag

SEQ ID NO: 1772142 - RNA, 12 nt, Human
uguccuacucug

SEQ ID NO: 1772143 - RNA, 17 nt, Human
uguccuacucuguguca

SEQ ID NO: 1772144 - RNA, 18 nt, Human
ugucccccucuguccagg

SEQ ID NO: 1772145 - RNA, 20 nt, Human
uguccuacccacccuccuuu

SEQ ID NO: 1772146 - RNA, 18 nt, Human
ugucccaccauacgagca

SEQ ID NO: 1772147 - RNA, 23 nt, Human
ugucccaccauacgagcaccucc

SEQ ID NO: 1772148 - RNA, 13 nt, Human
ugucaccugaaga

SEQ ID NO: 1772149 - RNA, 14 nt, Human
ugucaccugugcuu

SEQ ID NO: 1772150 - RNA, 16 nt, Human
ugucaccucuuccgac

SEQ ID NO: 1772151 - RNA, 23 nt, Human
ugucaccucuuccgacucuuucu

SEQ ID NO: 1772152 - RNA, 19 nt, Human
ugucauuugagcagggcuc

SEQ ID NO: 1772153 - RNA, 16 nt, Human
ugucauuugagcaggg

SEQ ID NO: 1772154 - RNA, 19 nt, Human
uuaaacuagcauaucugcc

SEQ ID NO: 1772155 - RNA, 17 nt, Human
uuaaacuagcauaucug

SEQ ID NO: 1772156 - RNA, 23 nt, Human
uuaaacuagcauaucugccuuua

SEQ ID NO: 1772157 - RNA, 22 nt, Human
uuaaacuagcauaucugccuuu

SEQ ID NO: 1772158 - RNA, 21 nt, Human
uuaaacuagcauaucugccuu

SEQ ID NO: 1772159 - RNA, 17 nt, Human
uguuuuaagaggcaggg

SEQ ID NO: 1772160 - RNA, 13 nt, Human
uguuuuaacaaaa

SEQ ID NO: 1772161 - RNA, 14 nt, Human
uguuuuaacaaaaa

SEQ ID NO: 1772162 - RNA, 11 nt, Human
uguuuuaacaa

SEQ ID NO: 1772163 - RNA, 16 nt, Human
uguuuuaagaggcagg

SEQ ID NO: 1772164 - RNA, 14 nt, Human
uguuuguucuguuu

SEQ ID NO: 1772165 - RNA, 15 nt, Human
uguuugugcuguggu

SEQ ID NO: 1772166 - RNA, 13 nt, Human
uguuuacuaggga

SEQ ID NO: 1772167 - RNA, 19 nt, Human
uguuuacuagggaucccuc

SEQ ID NO: 1772168 - RNA, 11 nt, Human
uuaaauguguu

SEQ ID NO: 1772169 - RNA, 21 nt, Human
uuaauaauauacuuguggacu

SEQ ID NO: 1772170 - RNA, 18 nt, Human
uuaauaauauacuugugg

SEQ ID NO: 1772171 - RNA, 16 nt, Human
uuaauaauauacuugu

SEQ ID NO: 1772172 - RNA, 14 nt, Human
uuaauaauauacuu

SEQ ID NO: 1772173 - RNA, 21 nt, Human
uuaagccacuuaaaauguuca

SEQ ID NO: 1772174 - RNA, 16 nt, Human
uuaagcaaaggggaca

SEQ ID NO: 1772175 - RNA, 23 nt, Human
uuaagcaaaggggacagcugugu

SEQ ID NO: 1772176 - RNA, 18 nt, Human
uuacacagaaaugcugcu

SEQ ID NO: 1772177 - RNA, 19 nt, Human
uuacacagaaaugcugcug

SEQ ID NO: 1772178 - RNA, 20 nt, Human
uuacacagaaaugcugcugg

SEQ ID NO: 1772179 - RNA, 23 nt, Human
uuacacagaaaugcugcuggcca

SEQ ID NO: 1772180 - RNA, 14 nt, Human
uuaauuagugcuaa

SEQ ID NO: 1772181 - RNA, 13 nt, Human
uuaauuagugcua

SEQ ID NO: 1772182 - RNA, 14 nt, Human
uuaaugacacuugu

SEQ ID NO: 1772183 - RNA, 19 nt, Human
uuaaugacacuugucccca

SEQ ID NO: 1772184 - RNA, 23 nt, Human
uuaaugacacuuguccccaaauc

SEQ ID NO: 1772185 - RNA, 23 nt, Human
uuaaugaaguuugaauguuaaau

SEQ ID NO: 1772186 - RNA, 22 nt, Human
uuaaugaaguuugaauguuaaa

SEQ ID NO: 1772187 - RNA, 18 nt, Human
uuaaugaaguuugaaugu

SEQ ID NO: 1772188 - RNA, 17 nt, Human
uuaaugaaguuugaaug

SEQ ID NO: 1772189 - RNA, 16 nt, Human
uuaaugaaguuugaau

SEQ ID NO: 1772190 - RNA, 17 nt, Human
uguuggcugggggccuc

SEQ ID NO: 1772191 - RNA, 19 nt, Human
uguuggcugggggccucag

SEQ ID NO: 1772192 - RNA, 15 nt, Human
uguuggccaaagcca

SEQ ID NO: 1772193 - RNA, 15 nt, Human
uguuggccaggcugg

SEQ ID NO: 1772194 - RNA, 16 nt, Human
uguuggccaggcuggu

SEQ ID NO: 1772195 - RNA, 13 nt, Human
uguucuggaggaa

SEQ ID NO: 1772196 - RNA, 12 nt, Human
uguucugggaca

SEQ ID NO: 1772197 - RNA, 14 nt, Human
uguugaaggaacuu

SEQ ID NO: 1772198 - RNA, 18 nt, Human
uguugaaggaacuugucu

SEQ ID NO: 1772199 - RNA, 23 nt, Human
uguugaaggaacuugucucuuca

SEQ ID NO: 1772200 - RNA, 17 nt, Human
uguugaagucucaggag

SEQ ID NO: 1772201 - RNA, 13 nt, Human
uguucucugagga

SEQ ID NO: 1772202 - RNA, 20 nt, Human
uguucucuaucauuuaauaa

SEQ ID NO: 1772203 - RNA, 18 nt, Human
uguucucuaucauuuaau

SEQ ID NO: 1772204 - RNA, 15 nt, Human
uguucucuaucauuu

SEQ ID NO: 1772205 - RNA, 19 nt, Human
ugugugcacguacacacac

SEQ ID NO: 1772206 - RNA, 12 nt, Human
uguuacugccuu

SEQ ID NO: 1772207 - RNA, 19 nt, Human
uguuacugccuuaauaaaa

SEQ ID NO: 1772208 - RNA, 23 nt, Human
uguuaccugaaaacacugugcac

SEQ ID NO: 1772209 - RNA, 15 nt, Human
uguuaccugaaaaca

SEQ ID NO: 1772210 - RNA, 16 nt, Human
uguuaccugaaaacac

SEQ ID NO: 1772211 - RNA, 22 nt, Human
uguuaccugaaaacacugugca

SEQ ID NO: 1772212 - RNA, 13 nt, Human
uguuaccugugug

SEQ ID NO: 1772213 - RNA, 15 nt, Human
uguuaccugugugcu

SEQ ID NO: 1772214 - RNA, 17 nt, Human
uguuaccugugugcuug

SEQ ID NO: 1772215 - RNA, 20 nt, Human
uguucagcuccagcucacca

SEQ ID NO: 1772216 - RNA, 21 nt, Human
uguucagcuccagcucaccag

SEQ ID NO: 1772217 - RNA, 22 nt, Human
uguucagcuccagcucaccagc

SEQ ID NO: 1772218 - RNA, 17 nt, Human
uguucacuuuugacaaa

SEQ ID NO: 1772219 - RNA, 18 nt, Human
cucgguacccggggccca

SEQ ID NO: 1772220 - RNA, 21 nt, Human
cucgguacccggggcccaggg

SEQ ID NO: 1772221 - RNA, 22 nt, Human
cucgguacccggggcccagggc

SEQ ID NO: 1772222 - RNA, 17 nt, Human
cuccuuuguucccggcu

SEQ ID NO: 1772223 - RNA, 12 nt, Human
cuccuuugugug

SEQ ID NO: 1772224 - RNA, 15 nt, Human
cuccuuugugugugu

SEQ ID NO: 1772225 - RNA, 16 nt, Human
cuccuuuguucccggc

SEQ ID NO: 1772226 - RNA, 16 nt, Human
cuccuuuagcgcccag

SEQ ID NO: 1772227 - RNA, 17 nt, Human
cuccuuuagcgcccagu

SEQ ID NO: 1772228 - RNA, 22 nt, Human
cuccuuuagcgcccaguugggu

SEQ ID NO: 1772229 - RNA, 17 nt, Human
cucugaaauaucccggg

SEQ ID NO: 1772230 - RNA, 17 nt, Human
cucugaaaccaguguua

SEQ ID NO: 1772231 - RNA, 15 nt, Human
cucugaaacccugga

SEQ ID NO: 1772232 - RNA, 12 nt, Human
cucugaaaccag

SEQ ID NO: 1772233 - RNA, 9 nt, Human
cucugaaac

SEQ ID NO: 1772234 - RNA, 11 nt, Human
cucugaaacag

SEQ ID NO: 1772235 - RNA, 12 nt, Human
cucugaaacagc

SEQ ID NO: 1772236 - RNA, 13 nt, Human
cucugaaacagcu

SEQ ID NO: 1772237 - RNA, 15 nt, Human
cucugaaacagcugc

SEQ ID NO: 1772238 - RNA, 16 nt, Human
cucugaaacagcugcc

SEQ ID NO: 1772239 - RNA, 17 nt, Human
cucugaaacagcugccu

SEQ ID NO: 1772240 - RNA, 18 nt, Human
cucugaaacagcugccuu

SEQ ID NO: 1772241 - RNA, 19 nt, Human
cucugaaacagcugccuua

SEQ ID NO: 1772242 - RNA, 20 nt, Human
cucugaaacagcugccuuag

SEQ ID NO: 1772243 - RNA, 23 nt, Human
cucugaaacagcugccuuagcuu

SEQ ID NO: 1772244 - RNA, 21 nt, Human
cucuccgaccagacaccuuga

SEQ ID NO: 1772245 - RNA, 16 nt, Human
cucuccgaccagacac

SEQ ID NO: 1772246 - RNA, 13 nt, Human
cucucuugucaga

SEQ ID NO: 1772247 - RNA, 23 nt, Human
cuccgcuuucuacccagcgagcc

SEQ ID NO: 1772248 - RNA, 22 nt, Human
cuccgcuuucuacccagcgagc

SEQ ID NO: 1772249 - RNA, 15 nt, Human
cuccgggaccuggug

SEQ ID NO: 1772250 - RNA, 19 nt, Human
cuccggcucccagccucag

SEQ ID NO: 1772251 - RNA, 20 nt, Human
cuccggcucccagccucagc

SEQ ID NO: 1772252 - RNA, 13 nt, Human
cuccggcugugcu

SEQ ID NO: 1772253 - RNA, 14 nt, Human
cuccggcugugcug

SEQ ID NO: 1772254 - RNA, 17 nt, Human
cuccggcugugcuggga

SEQ ID NO: 1772255 - RNA, 21 nt, Human
cuccggcugugcugggagaaa

SEQ ID NO: 1772256 - RNA, 21 nt, Human
cuccgcuuucuacccagcgag

SEQ ID NO: 1772257 - RNA, 20 nt, Human
cuccgcuuucuacccagcga

SEQ ID NO: 1772258 - RNA, 13 nt, Human
cucccucccagga

SEQ ID NO: 1772259 - RNA, 14 nt, Human
cucccucccaggac

SEQ ID NO: 1772260 - RNA, 17 nt, Human
cucccucccaggacucu

SEQ ID NO: 1772261 - RNA, 14 nt, Human
cucccagccucagc

SEQ ID NO: 1772262 - RNA, 23 nt, Human
cuccaggcuguaucccaugagcc

SEQ ID NO: 1772263 - RNA, 22 nt, Human
cuccagggaugauucaagccau

SEQ ID NO: 1772264 - RNA, 14 nt, Human
cuccagugccaaca

SEQ ID NO: 1772265 - RNA, 14 nt, Human
cucccaccucagcc

SEQ ID NO: 1772266 - RNA, 16 nt, Human
cucccaccucagccuc

SEQ ID NO: 1772267 - RNA, 17 nt, Human
cucccaccucagccucc

SEQ ID NO: 1772268 - RNA, 11 nt, Human
cucccagccuc

SEQ ID NO: 1772269 - RNA, 17 nt, Human
cugacacucccuugggc

SEQ ID NO: 1772270 - RNA, 13 nt, Human
cugacacacagcu

SEQ ID NO: 1772271 - RNA, 15 nt, Human
cugacacacagcucu

SEQ ID NO: 1772272 - RNA, 14 nt, Human
cugaagccagcugc

SEQ ID NO: 1772273 - RNA, 17 nt, Human
cugaagccagcugcccu

SEQ ID NO: 1772274 - RNA, 16 nt, Human
cugacacacagcucug

SEQ ID NO: 1772275 - RNA, 17 nt, Human
cugacacacagcucugu

SEQ ID NO: 1772276 - RNA, 18 nt, Human
cugacacacagcucuguc

SEQ ID NO: 1772277 - RNA, 19 nt, Human
cugacacacagcucugucc

SEQ ID NO: 1772278 - RNA, 20 nt, Human
cugacacacagcucuguccu

SEQ ID NO: 1772279 - RNA, 21 nt, Human
cugacacacagcucuguccug

SEQ ID NO: 1772280 - RNA, 22 nt, Human
cugacacacagcucuguccugg

SEQ ID NO: 1772281 - RNA, 23 nt, Human
cugacacacagcucuguccuggg

SEQ ID NO: 1772282 - RNA, 18 nt, Human
cugagcugaggcagcagu

SEQ ID NO: 1772283 - RNA, 13 nt, Human
cugagcugugcag

SEQ ID NO: 1772284 - RNA, 15 nt, Human
cugagcugugcaggu

SEQ ID NO: 1772285 - RNA, 14 nt, Human
cugaggaauccaga

SEQ ID NO: 1772286 - RNA, 22 nt, Human
cugaggaacccuuacaguagga

SEQ ID NO: 1772287 - RNA, 23 nt, Human
cugaggaauccagacccggcugc

SEQ ID NO: 1772288 - RNA, 13 nt, Human
cucacaagccagc

SEQ ID NO: 1772289 - RNA, 15 nt, Human
cucacaagccagcca

SEQ ID NO: 1772290 - RNA, 21 nt, Human
cucacaauagccgauaucaga

SEQ ID NO: 1772291 - RNA, 14 nt, Human
cuauuuuucucucc

SEQ ID NO: 1772292 - RNA, 16 nt, Human
cuauuuuucucuccug

SEQ ID NO: 1772293 - RNA, 20 nt, Human
cuauuuuucucuccuguccu

SEQ ID NO: 1772294 - RNA, 14 nt, Human
cuauuuuuaaauaa

SEQ ID NO: 1772295 - RNA, 17 nt, Human
cuauuuuuaaauaauuu

SEQ ID NO: 1772296 - RNA, 23 nt, Human
cuauuuuuaaauaauuuccuaca

SEQ ID NO: 1772297 - RNA, 16 nt, Human
cuauguugcccaggca

SEQ ID NO: 1772298 - RNA, 17 nt, Human
cuauguugcccaggcag

SEQ ID NO: 1772299 - RNA, 22 nt, Human
cuauguguagggcgggaggaug

SEQ ID NO: 1772300 - RNA, 20 nt, Human
cuaugugauuuuaacucugu

SEQ ID NO: 1772301 - RNA, 21 nt, Human
cuaugugauuuuaacucuguc

SEQ ID NO: 1772302 - RNA, 22 nt, Human
cuaugugauuuuaacucugucu

SEQ ID NO: 1772303 - RNA, 15 nt, Human
cuauguugcccaggc

SEQ ID NO: 1772304 - RNA, 11 nt, Human
cuaugugauuu

SEQ ID NO: 1772305 - RNA, 16 nt, Human
cuaugugauuuuaacu

SEQ ID NO: 1772306 - RNA, 18 nt, Human
cuaugugauuuuaacucu

SEQ ID NO: 1772307 - RNA, 19 nt, Human
cuaugugauuuuaacucug

SEQ ID NO: 1772308 - RNA, 21 nt, Human
cucagaagggagcuagccaga

SEQ ID NO: 1772309 - RNA, 22 nt, Human
cucagaagggagcuagccagag

SEQ ID NO: 1772310 - RNA, 17 nt, Human
cucagaaagccaacaug

SEQ ID NO: 1772311 - RNA, 23 nt, Human
cuacuaacaaucagcuccuuccu

SEQ ID NO: 1772312 - RNA, 21 nt, Human
cuaccuugguucccccacuga

SEQ ID NO: 1772313 - RNA, 13 nt, Human
cuaccuugcuuuu

SEQ ID NO: 1772314 - RNA, 17 nt, Human
cuaccuugcuuuugcuu

SEQ ID NO: 1772315 - RNA, 19 nt, Human
cuaccuugcuuuugcuucu

SEQ ID NO: 1772316 - RNA, 19 nt, Human
cuaggccuccuggcccagg

SEQ ID NO: 1772317 - RNA, 14 nt, Human
cuaggccuggccag

SEQ ID NO: 1772318 - RNA, 15 nt, Human
cuaggccuggccaga

SEQ ID NO: 1772319 - RNA, 18 nt, Human
cuaggccuggccagaugc

SEQ ID NO: 1772320 - RNA, 19 nt, Human
cuaggccuggccagaugca

SEQ ID NO: 1772321 - RNA, 13 nt, Human
cuaggccuggcca

SEQ ID NO: 1772322 - RNA, 17 nt, Human
cuaggccuccuggccca

SEQ ID NO: 1772323 - RNA, 18 nt, Human
cuaggccuccuggcccag

SEQ ID NO: 1772324 - RNA, 16 nt, Human
cuaggccucaacuccu

SEQ ID NO: 1772325 - RNA, 20 nt, Human
cuaggccucaacuccuccca

SEQ ID NO: 1772326 - RNA, 21 nt, Human
cuaggccucaacuccucccau

SEQ ID NO: 1772327 - RNA, 15 nt, Human
cuaguucuguagaaa

SEQ ID NO: 1772328 - RNA, 16 nt, Human
cuaguuuucuuuccuc

SEQ ID NO: 1772329 - RNA, 18 nt, Human
cuaguuuucuuuccuccu

SEQ ID NO: 1772330 - RNA, 21 nt, Human
cuaguuuucuuuccuccuuuc

SEQ ID NO: 1772331 - RNA, 15 nt, Human
cuauaaaaaauaugu

SEQ ID NO: 1772332 - RNA, 12 nt, Human
cuauaaaagcuu

SEQ ID NO: 1772333 - RNA, 15 nt, Human
cuauaaaagcuuucu

SEQ ID NO: 1772334 - RNA, 16 nt, Human
cuauaaaagcuuucug

SEQ ID NO: 1772335 - RNA, 19 nt, Human
cuauaaaagcuuucugcca

SEQ ID NO: 1772336 - RNA, 14 nt, Human
cuaguucuguagaa

SEQ ID NO: 1772337 - RNA, 15 nt, Human
cggagacggaguccc

SEQ ID NO: 1772338 - RNA, 15 nt, Human
cggugugcaccaggg

SEQ ID NO: 1772339 - RNA, 16 nt, Human
cggugugcaccagggu

SEQ ID NO: 1772340 - RNA, 16 nt, Human
cgguuccugucccugc

SEQ ID NO: 1772341 - RNA, 16 nt, Human
cgugucaccugugcuu

SEQ ID NO: 1772342 - RNA, 14 nt, Human
cgugucaagcugcu

SEQ ID NO: 1772343 - RNA, 15 nt, Human
cgugucaagcugcuc

SEQ ID NO: 1772344 - RNA, 17 nt, Human
cgugucaagcugcucug

SEQ ID NO: 1772345 - RNA, 20 nt, Human
cgcuggacucucagucucug

SEQ ID NO: 1772346 - RNA, 19 nt, Human
cgcuggaccuugaacuggg

SEQ ID NO: 1772347 - RNA, 23 nt, Human
cgcuggaccuugaacuggguacu

SEQ ID NO: 1772348 - RNA, 22 nt, Human
cgccuuagcacuaccacuccug

SEQ ID NO: 1772349 - RNA, 12 nt, Human
cgaguacugugg

SEQ ID NO: 1772350 - RNA, 13 nt, Human
cgaguacuguggg

SEQ ID NO: 1772351 - RNA, 14 nt, Human
cgaguacugugggc

SEQ ID NO: 1772352 - RNA, 16 nt, Human
cgaguacugugggcaa

SEQ ID NO: 1772353 - RNA, 17 nt, Human
cgaguacugugggcaau

SEQ ID NO: 1772354 - RNA, 22 nt, Human
cgaguacugugggcaauuuaga

SEQ ID NO: 1772355 - RNA, 19 nt, Human
cccacugggaccaacccug

SEQ ID NO: 1772356 - RNA, 22 nt, Human
cccagcaagugguccuagaggc

SEQ ID NO: 1772357 - RNA, 22 nt, Human
cccaucagugcucccucacaug

SEQ ID NO: 1772358 - RNA, 23 nt, Human
cccaucagugcucccucacaugu

SEQ ID NO: 1772359 - RNA, 15 nt, Human
ccccagauugcaaca

SEQ ID NO: 1772360 - RNA, 20 nt, Human
ccccagauugcaacaggcug

SEQ ID NO: 1772361 - RNA, 12 nt, Human
ccccagcccaga

SEQ ID NO: 1772362 - RNA, 19 nt, Human
ccccauggucagcccuagg

SEQ ID NO: 1772363 - RNA, 23 nt, Human
ccccauuagcuuucaauuccgua

SEQ ID NO: 1772364 - RNA, 17 nt, Human
ccccauuagcuuucaau

SEQ ID NO: 1772365 - RNA, 19 nt, Human
cccauucugccugcccagg

SEQ ID NO: 1772366 - RNA, 14 nt, Human
cccauucugccugc

SEQ ID NO: 1772367 - RNA, 15 nt, Human
cccauucugccugcc

SEQ ID NO: 1772368 - RNA, 13 nt, Human
cccuccucugaaa

SEQ ID NO: 1772369 - RNA, 14 nt, Human
cccuccucugaaac

SEQ ID NO: 1772370 - RNA, 15 nt, Human
cccuccucugaaaca

SEQ ID NO: 1772371 - RNA, 19 nt, Human
cccuccucugaaacagcug

SEQ ID NO: 1772372 - RNA, 20 nt, Human
cccuccucugaaacagcugc

SEQ ID NO: 1772373 - RNA, 21 nt, Human
cccuccucugaaacagcugcc

SEQ ID NO: 1772374 - RNA, 12 nt, Human
cccuccugaccc

SEQ ID NO: 1772375 - RNA, 21 nt, Human
cccuccucacucccaccugca

SEQ ID NO: 1772376 - RNA, 21 nt, Human
cccucaccuacuuacccaggu

SEQ ID NO: 1772377 - RNA, 16 nt, Human
cccucagcucggcuca

SEQ ID NO: 1772378 - RNA, 19 nt, Human
cccucagcucggcucagcu

SEQ ID NO: 1772379 - RNA, 16 nt, Human
cccgaauagcugggac

SEQ ID NO: 1772380 - RNA, 17 nt, Human
cccgaauagcugggacu

SEQ ID NO: 1772381 - RNA, 18 nt, Human
cccgaauagcugggacua

SEQ ID NO: 1772382 - RNA, 22 nt, Human
cccgaauagcugggacuacagg

SEQ ID NO: 1772383 - RNA, 11 nt, Human
cccggcuccag

SEQ ID NO: 1772384 - RNA, 15 nt, Human
cccggccccugcugg

SEQ ID NO: 1772385 - RNA, 16 nt, Human
cccggccccugcuggu

SEQ ID NO: 1772386 - RNA, 14 nt, Human
ccccugccacccug

SEQ ID NO: 1772387 - RNA, 16 nt, Human
ccccugccacccuggg

SEQ ID NO: 1772388 - RNA, 14 nt, Human
ccccugccagggca

SEQ ID NO: 1772389 - RNA, 15 nt, Human
ccccugccagggcag

SEQ ID NO: 1772390 - RNA, 19 nt, Human
ccccugccagggcagggcc

SEQ ID NO: 1772391 - RNA, 23 nt, Human
ccccugccagggcagggccccag

SEQ ID NO: 1772392 - RNA, 12 nt, Human
ccccucugcuuu

SEQ ID NO: 1772393 - RNA, 13 nt, Human
ccagucccugucc

SEQ ID NO: 1772394 - RNA, 18 nt, Human
ccagucccuguccggaau

SEQ ID NO: 1772395 - RNA, 23 nt, Human
ccaggggggacaauaugugccaa

SEQ ID NO: 1772396 - RNA, 23 nt, Human
ccaggcaggucuugaacuccugg

SEQ ID NO: 1772397 - RNA, 12 nt, Human
ccaggcaggucu

SEQ ID NO: 1772398 - RNA, 14 nt, Human
ccaggcaggucuug

SEQ ID NO: 1772399 - RNA, 12 nt, Human
ccaggcuggcgu

SEQ ID NO: 1772400 - RNA, 16 nt, Human
ccaggcuggcgugcag

SEQ ID NO: 1772401 - RNA, 21 nt, Human
ccaggaucagauugcauguga

SEQ ID NO: 1772402 - RNA, 19 nt, Human
ccaggaucagauugcaugu

SEQ ID NO: 1772403 - RNA, 14 nt, Human
ccaggaucagauug

SEQ ID NO: 1772404 - RNA, 18 nt, Human
ccaggaucagauugcaug

SEQ ID NO: 1772405 - RNA, 14 nt, Human
ccagcuauaccugu

SEQ ID NO: 1772406 - RNA, 15 nt, Human
ccagcuauaccugug

SEQ ID NO: 1772407 - RNA, 16 nt, Human
ccagcuauaccugugc

SEQ ID NO: 1772408 - RNA, 18 nt, Human
ccagcuauaccugugccu

SEQ ID NO: 1772409 - RNA, 22 nt, Human
ccagcuauguuauauugaaaaa

SEQ ID NO: 1772410 - RNA, 19 nt, Human
ccagcuauaccugugccuc

SEQ ID NO: 1772411 - RNA, 18 nt, Human
ccagccccgguggcuggg

SEQ ID NO: 1772412 - RNA, 20 nt, Human
ccagccccgguggcugggca

SEQ ID NO: 1772413 - RNA, 14 nt, Human
ccagccccuacugc

SEQ ID NO: 1772414 - RNA, 15 nt, Human
ccagccccuacugcu

SEQ ID NO: 1772415 - RNA, 17 nt, Human
ccagccccagugcccac

SEQ ID NO: 1772416 - RNA, 22 nt, Human
ccauuuccauguccccucccag

SEQ ID NO: 1772417 - RNA, 15 nt, Human
ccauuggaucucauu

SEQ ID NO: 1772418 - RNA, 15 nt, Human
cccaccccuggaaga

SEQ ID NO: 1772419 - RNA, 23 nt, Human
cccacugcuuuuggucuguguga

SEQ ID NO: 1772420 - RNA, 13 nt, Human
cccaagcucugcu

SEQ ID NO: 1772421 - RNA, 14 nt, Human
cccaagcucugcuc

SEQ ID NO: 1772422 - RNA, 12 nt, Human
cccaagcucugc

SEQ ID NO: 1772423 - RNA, 15 nt, Human
cccaagcucugcucc

SEQ ID NO: 1772424 - RNA, 18 nt, Human
cccaagaccucagggcac

SEQ ID NO: 1772425 - RNA, 13 nt, Human
ccauguccccucc

SEQ ID NO: 1772426 - RNA, 15 nt, Human
ccauguccccuccca

SEQ ID NO: 1772427 - RNA, 16 nt, Human
ccauguccccucccag

SEQ ID NO: 1772428 - RNA, 15 nt, Human
ccauguagaaaauuu

SEQ ID NO: 1772429 - RNA, 16 nt, Human
ccauguagaaaauuug

SEQ ID NO: 1772430 - RNA, 18 nt, Human
ccauccagguucagcuug

SEQ ID NO: 1772431 - RNA, 19 nt, Human
ccauccagguucagcuugu

SEQ ID NO: 1772432 - RNA, 23 nt, Human
ccaguuggguggaugccuggugg

SEQ ID NO: 1772433 - RNA, 12 nt, Human
ccuagccagcug

SEQ ID NO: 1772434 - RNA, 19 nt, Human
ccggcacagaugcuccagg

SEQ ID NO: 1772435 - RNA, 22 nt, Human
ccuagccuuagaagucacacag

SEQ ID NO: 1772436 - RNA, 19 nt, Human
ccuagccuuagaagucaca

SEQ ID NO: 1772437 - RNA, 18 nt, Human
ccguccauaucagaacug

SEQ ID NO: 1772438 - RNA, 21 nt, Human
ccguccauaucagaacugugc

SEQ ID NO: 1772439 - RNA, 23 nt, Human
ccguccauaucagaacugugcca

SEQ ID NO: 1772440 - RNA, 17 nt, Human
ccgguuccugucccugc

SEQ ID NO: 1772441 - RNA, 19 nt, Human
ccgguuccugucccugcgc

SEQ ID NO: 1772442 - RNA, 21 nt, Human
ccguaaacacgccugcaaacg

SEQ ID NO: 1772443 - RNA, 15 nt, Human
ccggcagccccagcc

SEQ ID NO: 1772444 - RNA, 16 nt, Human
ccggcagccccagccu

SEQ ID NO: 1772445 - RNA, 17 nt, Human
ccggcagccccagccug

SEQ ID NO: 1772446 - RNA, 18 nt, Human
ccggcagccccagccugc

SEQ ID NO: 1772447 - RNA, 19 nt, Human
ccggcagccccagccugcu

SEQ ID NO: 1772448 - RNA, 20 nt, Human
ccggcagccccagccugcua

SEQ ID NO: 1772449 - RNA, 21 nt, Human
ccggcagccccagccugcuag

SEQ ID NO: 1772450 - RNA, 21 nt, Human
ccgcagagcgcgccccuagcc

SEQ ID NO: 1772451 - RNA, 22 nt, Human
ccgcagagcgcgccccuagccg

SEQ ID NO: 1772452 - RNA, 22 nt, Human
cccuguggaugagcccucagaa

SEQ ID NO: 1772453 - RNA, 23 nt, Human
cccuguggaugagcccucagaac

SEQ ID NO: 1772454 - RNA, 20 nt, Human
cccuguggaugagcccucag

SEQ ID NO: 1772455 - RNA, 21 nt, Human
cccuguggaugagcccucaga

SEQ ID NO: 1772456 - RNA, 23 nt, Human
cccuucuccauccacaugggagc

SEQ ID NO: 1772457 - RNA, 14 nt, Human
cccuccuuucacca

SEQ ID NO: 1772458 - RNA, 18 nt, Human
ccgaagccgccuguggac

SEQ ID NO: 1772459 - RNA, 13 nt, Human
ccgaaccuccucu

SEQ ID NO: 1772460 - RNA, 15 nt, Human
ccgaaccuccucugu

SEQ ID NO: 1772461 - RNA, 16 nt, Human
ccgaaccuccucugug

SEQ ID NO: 1772462 - RNA, 15 nt, Human
ccucaaccuccuggg

SEQ ID NO: 1772463 - RNA, 23 nt, Human
ccucaagugauucuccugccuca

SEQ ID NO: 1772464 - RNA, 17 nt, Human
ccucagcucggcucagc

SEQ ID NO: 1772465 - RNA, 18 nt, Human
ccucagcucggcucagcu

SEQ ID NO: 1772466 - RNA, 19 nt, Human
ccucagcucggcucagcuc

SEQ ID NO: 1772467 - RNA, 14 nt, Human
ccucagcgcggccc

SEQ ID NO: 1772468 - RNA, 13 nt, Human
ccucagcucggcu

SEQ ID NO: 1772469 - RNA, 15 nt, Human
ccucagcucggcuca

SEQ ID NO: 1772470 - RNA, 16 nt, Human
ccucaaccuccugggc

SEQ ID NO: 1772471 - RNA, 20 nt, Human
ccucaagugauucuccugcc

SEQ ID NO: 1772472 - RNA, 20 nt, Human
ccucccauagauacucucuu

SEQ ID NO: 1772473 - RNA, 21 nt, Human
ccucccauagauacucucuuc

SEQ ID NO: 1772474 - RNA, 13 nt, Human
ccucgaguacugu

SEQ ID NO: 1772475 - RNA, 17 nt, Human
ccucgaguacugugggc

SEQ ID NO: 1772476 - RNA, 18 nt, Human
ccucgaguacugugggca

SEQ ID NO: 1772477 - RNA, 19 nt, Human
ccucgaguacugugggcaa

SEQ ID NO: 1772478 - RNA, 21 nt, Human
ccucgaguacugugggcaauu

SEQ ID NO: 1772479 - RNA, 18 nt, Human
ccucgcuggacucucagu

SEQ ID NO: 1772480 - RNA, 14 nt, Human
ccucgcccucuccu

SEQ ID NO: 1772481 - RNA, 18 nt, Human
ccucgcccucuccuuugu

SEQ ID NO: 1772482 - RNA, 17 nt, Human
ccucgcuggacucucag

SEQ ID NO: 1772483 - RNA, 13 nt, Human
ccuccgccucuug

SEQ ID NO: 1772484 - RNA, 14 nt, Human
ccuccgccucuugg

SEQ ID NO: 1772485 - RNA, 13 nt, Human
ccuccggacuggu

SEQ ID NO: 1772486 - RNA, 15 nt, Human
ccuccggacuggugc

SEQ ID NO: 1772487 - RNA, 16 nt, Human
ccuccggacuggugcc

SEQ ID NO: 1772488 - RNA, 13 nt, Human
ccucccuugccuu

SEQ ID NO: 1772489 - RNA, 22 nt, Human
ccugcccacacagguucacgug

SEQ ID NO: 1772490 - RNA, 16 nt, Human
ccugccucagccuccc

SEQ ID NO: 1772491 - RNA, 15 nt, Human
ccugccucagccucc

SEQ ID NO: 1772492 - RNA, 21 nt, Human
ccugcccaggccccugccacc

SEQ ID NO: 1772493 - RNA, 22 nt, Human
ccugcccaggccccugccaccc

SEQ ID NO: 1772494 - RNA, 19 nt, Human
ccugcccaggccccugcca

SEQ ID NO: 1772495 - RNA, 14 nt, Human
ccugcccacacagg

SEQ ID NO: 1772496 - RNA, 20 nt, Human
ccugccauggaacuguuucc

SEQ ID NO: 1772497 - RNA, 22 nt, Human
ccugccauggaacuguuuccuu

SEQ ID NO: 1772498 - RNA, 20 nt, Human
ccugacccauugcuguuguc

SEQ ID NO: 1772499 - RNA, 13 nt, Human
ccugagggagcuc

SEQ ID NO: 1772500 - RNA, 15 nt, Human
ccugagggagcucca

SEQ ID NO: 1772501 - RNA, 19 nt, Human
ccugcaggaccugccugua

SEQ ID NO: 1772502 - RNA, 20 nt, Human
ccugcaggaccugccuguag

SEQ ID NO: 1772503 - RNA, 23 nt, Human
ccugucuccuuucaccccagggc

SEQ ID NO: 1772504 - RNA, 16 nt, Human
ccuguaaccucuucag

SEQ ID NO: 1772505 - RNA, 21 nt, Human
ccuguaaccucuucagaggcc

SEQ ID NO: 1772506 - RNA, 20 nt, Human
ccugguggcagugggagcug

SEQ ID NO: 1772507 - RNA, 18 nt, Human
ccugguggcagugggagc

SEQ ID NO: 1772508 - RNA, 19 nt, Human
ccugguggcagugggagcu

SEQ ID NO: 1772509 - RNA, 15 nt, Human
ccuggggagaaagua

SEQ ID NO: 1772510 - RNA, 12 nt, Human
ccuggggaagga

SEQ ID NO: 1772511 - RNA, 13 nt, Human
ccuggggaaggag

SEQ ID NO: 1772512 - RNA, 17 nt, Human
ccuggggaaggagccag

SEQ ID NO: 1772513 - RNA, 18 nt, Human
ccuggggaaggagccagu

SEQ ID NO: 1772514 - RNA, 18 nt, Human
ccaccaucaugucuggcu

SEQ ID NO: 1772515 - RNA, 19 nt, Human
ccaccaucaugucuggcua

SEQ ID NO: 1772516 - RNA, 12 nt, Human
ccaccuuggcug

SEQ ID NO: 1772517 - RNA, 14 nt, Human
ccaccuuggcugca

SEQ ID NO: 1772518 - RNA, 15 nt, Human
ccaccuuggcugcag

SEQ ID NO: 1772519 - RNA, 16 nt, Human
ccaccuuggcugcagg

SEQ ID NO: 1772520 - RNA, 13 nt, Human
ccacgcuggagug

SEQ ID NO: 1772521 - RNA, 18 nt, Human
ccacgcuggaccuugaac

SEQ ID NO: 1772522 - RNA, 18 nt, Human
ccaccuuggcugcaggga

SEQ ID NO: 1772523 - RNA, 19 nt, Human
ccaccuuggcugcagggag

SEQ ID NO: 1772524 - RNA, 22 nt, Human
ccacagagaaaguacuucucca

SEQ ID NO: 1772525 - RNA, 23 nt, Human
ccacagacaaaagcgcuuuuccu

SEQ ID NO: 1772526 - RNA, 14 nt, Human
ccacuccucugacu

SEQ ID NO: 1772527 - RNA, 13 nt, Human
ccacuccucugac

SEQ ID NO: 1772528 - RNA, 20 nt, Human
ccacuccucugacucagggc

SEQ ID NO: 1772529 - RNA, 20 nt, Human
ccaagcuggucccacucagu

SEQ ID NO: 1772530 - RNA, 12 nt, Human
ccaagcuggucc

SEQ ID NO: 1772531 - RNA, 19 nt, Human
ccaagcuggucccacucag

SEQ ID NO: 1772532 - RNA, 13 nt, Human
ccaagaaagcagg

SEQ ID NO: 1772533 - RNA, 16 nt, Human
ccaaaguucaacuugg

SEQ ID NO: 1772534 - RNA, 13 nt, Human
ccaauccuauguu

SEQ ID NO: 1772535 - RNA, 14 nt, Human
ccaauccuauguuu

SEQ ID NO: 1772536 - RNA, 16 nt, Human
ccaaucgguguguagu

SEQ ID NO: 1772537 - RNA, 19 nt, Human
ccaaucugcaauuucuacu

SEQ ID NO: 1772538 - RNA, 23 nt, Human
ccaaugaaaaaauguauaugcac

SEQ ID NO: 1772539 - RNA, 15 nt, Human
ccaaugaaaaaaugu

SEQ ID NO: 1772540 - RNA, 23 nt, Human
cauuuaguuugauuauucagugu

SEQ ID NO: 1772541 - RNA, 14 nt, Human
cauuuauucugcuc

SEQ ID NO: 1772542 - RNA, 15 nt, Human
cauuuauucugcuca

SEQ ID NO: 1772543 - RNA, 17 nt, Human
cauuugucacacacuuu

SEQ ID NO: 1772544 - RNA, 23 nt, Human
cauuuggaguguuccccuuccac

SEQ ID NO: 1772545 - RNA, 20 nt, Human
cauuuggcaaugccaucauc

SEQ ID NO: 1772546 - RNA, 15 nt, Human
cauuuggaggcaauc

SEQ ID NO: 1772547 - RNA, 21 nt, Human
caucuggggcccauacugguu

SEQ ID NO: 1772548 - RNA, 13 nt, Human
cauagcugcugcc

SEQ ID NO: 1772549 - RNA, 19 nt, Human
cauagcagagaaugaaagg

SEQ ID NO: 1772550 - RNA, 22 nt, Human
cauagcagagaaugaaagggcc

SEQ ID NO: 1772551 - RNA, 15 nt, Human
cagugggagcugccu

SEQ ID NO: 1772552 - RNA, 23 nt, Human
cauacacccccucuucugagcac

SEQ ID NO: 1772553 - RNA, 21 nt, Human
cauacacuguauguuauagaa

SEQ ID NO: 1772554 - RNA, 21 nt, Human
cauacacccccucuucugagc

SEQ ID NO: 1772555 - RNA, 22 nt, Human
cauacacccccucuucugagca

SEQ ID NO: 1772556 - RNA, 13 nt, Human
caugacagccugc

SEQ ID NO: 1772557 - RNA, 14 nt, Human
caugacagccugca

SEQ ID NO: 1772558 - RNA, 18 nt, Human
caugacagccugcagcag

SEQ ID NO: 1772559 - RNA, 20 nt, Human
caugacagccugcagcagga

SEQ ID NO: 1772560 - RNA, 16 nt, Human
caugcacgugugugca

SEQ ID NO: 1772561 - RNA, 12 nt, Human
cauguuggccag

SEQ ID NO: 1772562 - RNA, 13 nt, Human
cauguuggccagg

SEQ ID NO: 1772563 - RNA, 18 nt, Human
cauguugcacacccacuc

SEQ ID NO: 1772564 - RNA, 22 nt, Human
cauguugcacacccacucagcu

SEQ ID NO: 1772565 - RNA, 23 nt, Human
cauguugcacacccacucagcuc

SEQ ID NO: 1772566 - RNA, 17 nt, Human
cauguugccccuuucuc

SEQ ID NO: 1772567 - RNA, 22 nt, Human
cauguugccccuuucucuuuuc

SEQ ID NO: 1772568 - RNA, 11 nt, Human
cauuccuucuc

SEQ ID NO: 1772569 - RNA, 15 nt, Human
cauguaucauaauua

SEQ ID NO: 1772570 - RNA, 18 nt, Human
cauguaucauaauuacca

SEQ ID NO: 1772571 - RNA, 19 nt, Human
cauguaucauaauuaccaa

SEQ ID NO: 1772572 - RNA, 20 nt, Human
cagaguauuugaaaaaugua

SEQ ID NO: 1772573 - RNA, 23 nt, Human
cagagcuucccugacucauucug

SEQ ID NO: 1772574 - RNA, 17 nt, Human
cagagcugguggaccca

SEQ ID NO: 1772575 - RNA, 18 nt, Human
cagagcugguggacccag

SEQ ID NO: 1772576 - RNA, 20 nt, Human
cagagcugguggacccaggg

SEQ ID NO: 1772577 - RNA, 13 nt, Human
cagagcuucccug

SEQ ID NO: 1772578 - RNA, 14 nt, Human
cagagcuucccuga

SEQ ID NO: 1772579 - RNA, 18 nt, Human
cagagcuucccugacuca

SEQ ID NO: 1772580 - RNA, 21 nt, Human
cagagcugguggacccaggga

SEQ ID NO: 1772581 - RNA, 16 nt, Human
cagcacccuauaaauc

SEQ ID NO: 1772582 - RNA, 17 nt, Human
cagcacccuauaaauca

SEQ ID NO: 1772583 - RNA, 16 nt, Human
cagcagguagccugcu

SEQ ID NO: 1772584 - RNA, 18 nt, Human
cagcagguagccugcugg

SEQ ID NO: 1772585 - RNA, 19 nt, Human
cagcagguagccugcuggu

SEQ ID NO: 1772586 - RNA, 13 nt, Human
cagcuccagcuca

SEQ ID NO: 1772587 - RNA, 14 nt, Human
cagcuccagcucac

SEQ ID NO: 1772588 - RNA, 15 nt, Human
cagcuccagcucacc

SEQ ID NO: 1772589 - RNA, 22 nt, Human
cagcuccagcucaccagcccca

SEQ ID NO: 1772590 - RNA, 16 nt, Human
cagcuccagcucacca

SEQ ID NO: 1772591 - RNA, 17 nt, Human
cagcuccagcucaccag

SEQ ID NO: 1772592 - RNA, 18 nt, Human
cagcuccagcucaccagc

SEQ ID NO: 1772593 - RNA, 20 nt, Human
cagcuccagcucaccagccc

SEQ ID NO: 1772594 - RNA, 19 nt, Human
cagcugugcucuggacagg

SEQ ID NO: 1772595 - RNA, 18 nt, Human
cagcugugcucuggacag

SEQ ID NO: 1772596 - RNA, 15 nt, Human
cagcuucauuuccug

SEQ ID NO: 1772597 - RNA, 18 nt, Human
cagcuucauuuccugugu

SEQ ID NO: 1772598 - RNA, 19 nt, Human
cagcuucauuuccuguguc

SEQ ID NO: 1772599 - RNA, 15 nt, Human
caggaaaggaaucau

SEQ ID NO: 1772600 - RNA, 18 nt, Human
caggaaaggcccagccac

SEQ ID NO: 1772601 - RNA, 19 nt, Human
caggaaaggaaucauuucu

SEQ ID NO: 1772602 - RNA, 13 nt, Human
caggaaaugaaaa

SEQ ID NO: 1772603 - RNA, 22 nt, Human
caggaacaacauuuacaacuca

SEQ ID NO: 1772604 - RNA, 20 nt, Human
caggaaaugaaaaugucuug

SEQ ID NO: 1772605 - RNA, 21 nt, Human
caggaaaugaaaaugucuugu

SEQ ID NO: 1772606 - RNA, 11 nt, Human
cagcugcaaag

SEQ ID NO: 1772607 - RNA, 12 nt, Human
cagcugcaaagu

SEQ ID NO: 1772608 - RNA, 13 nt, Human
cagcugcaaagug

SEQ ID NO: 1772609 - RNA, 15 nt, Human
cagcugcaaaguguu

SEQ ID NO: 1772610 - RNA, 16 nt, Human
cagcugcaaaguguuu

SEQ ID NO: 1772611 - RNA, 16 nt, Human
cagcugcaagggaguu

SEQ ID NO: 1772612 - RNA, 15 nt, Human
cagcugcccuauggg

SEQ ID NO: 1772613 - RNA, 18 nt, Human
cagcugcccuaugggccu

SEQ ID NO: 1772614 - RNA, 19 nt, Human
cagcugcccuaugggccug

SEQ ID NO: 1772615 - RNA, 20 nt, Human
cagcugcccuaugggccugc

SEQ ID NO: 1772616 - RNA, 15 nt, Human
cagcggggacagcuc

SEQ ID NO: 1772617 - RNA, 16 nt, Human
cagcggggacagcucc

SEQ ID NO: 1772618 - RNA, 17 nt, Human
cagcggggacagcuccu

SEQ ID NO: 1772619 - RNA, 17 nt, Human
cagccucuuucuguccc

SEQ ID NO: 1772620 - RNA, 17 nt, Human
cagccugaacagaagcu

SEQ ID NO: 1772621 - RNA, 18 nt, Human
cagccugaacagaagcuc

SEQ ID NO: 1772622 - RNA, 15 nt, Human
cagcgugcuuuaaaa

SEQ ID NO: 1772623 - RNA, 21 nt, Human
cagcgggggaggcccgcagag

SEQ ID NO: 1772624 - RNA, 15 nt, Human
cagcguccuccucug

SEQ ID NO: 1772625 - RNA, 16 nt, Human
cagcguccuccucugu

SEQ ID NO: 1772626 - RNA, 18 nt, Human
cagcguccuccucuguga

SEQ ID NO: 1772627 - RNA, 16 nt, Human
cagcccuuagcaggga

SEQ ID NO: 1772628 - RNA, 21 nt, Human
cagcccuuagcagggaaacag

SEQ ID NO: 1772629 - RNA, 18 nt, Human
cagccgauucaccugagc

SEQ ID NO: 1772630 - RNA, 18 nt, Human
cagccucuuggccccaga

SEQ ID NO: 1772631 - RNA, 16 nt, Human
cagccucuuucugucc

SEQ ID NO: 1772632 - RNA, 19 nt, Human
cagccgauucaccugagca

SEQ ID NO: 1772633 - RNA, 23 nt, Human
caggccagagggagugacagagg

SEQ ID NO: 1772634 - RNA, 19 nt, Human
caggccagagggagugaca

SEQ ID NO: 1772635 - RNA, 21 nt, Human
caggccagagggagugacaga

SEQ ID NO: 1772636 - RNA, 23 nt, Human
caggagcuuccuguccucccagc

SEQ ID NO: 1772637 - RNA, 12 nt, Human
caggagcuuccu

SEQ ID NO: 1772638 - RNA, 16 nt, Human
caggacccucgccgga

SEQ ID NO: 1772639 - RNA, 12 nt, Human
caggacccucgc

SEQ ID NO: 1772640 - RNA, 13 nt, Human
caggacccucgcc

SEQ ID NO: 1772641 - RNA, 18 nt, Human
caggcacccaccaucaug

SEQ ID NO: 1772642 - RNA, 22 nt, Human
caggcacccaccaucaugucug

SEQ ID NO: 1772643 - RNA, 23 nt, Human
caggcacccaccaucaugucugg

SEQ ID NO: 1772644 - RNA, 16 nt, Human
caggaggggaaacauc

SEQ ID NO: 1772645 - RNA, 22 nt, Human
cagggaguccgaaagggacuug

SEQ ID NO: 1772646 - RNA, 18 nt, Human
cagggaggugaccccagg

SEQ ID NO: 1772647 - RNA, 17 nt, Human
caggcgggacagugcug

SEQ ID NO: 1772648 - RNA, 19 nt, Human
caggcgggacagugcugca

SEQ ID NO: 1772649 - RNA, 15 nt, Human
caggcuggcgugcag

SEQ ID NO: 1772650 - RNA, 16 nt, Human
caggcugggcuucagu

SEQ ID NO: 1772651 - RNA, 17 nt, Human
caggcugggcuucagug

SEQ ID NO: 1772652 - RNA, 19 nt, Human
caggcugggcuucaguggc

SEQ ID NO: 1772653 - RNA, 21 nt, Human
caggugcuacacccuuuucca

SEQ ID NO: 1772654 - RNA, 20 nt, Human
caggugauccacccaccuca

SEQ ID NO: 1772655 - RNA, 22 nt, Human
caggugaguccuagagcuacag

SEQ ID NO: 1772656 - RNA, 23 nt, Human
caggugaguccuagagcuacagg

SEQ ID NO: 1772657 - RNA, 17 nt, Human
caggugcagccagaggc

SEQ ID NO: 1772658 - RNA, 19 nt, Human
caggugcagccagaggcac

SEQ ID NO: 1772659 - RNA, 14 nt, Human
caggugcagccaga

SEQ ID NO: 1772660 - RNA, 15 nt, Human
caggugcagccagag

SEQ ID NO: 1772661 - RNA, 16 nt, Human
caggugcagccagagg

SEQ ID NO: 1772662 - RNA, 14 nt, Human
caggguuggccccu

SEQ ID NO: 1772663 - RNA, 20 nt, Human
caggugaguccuagagcuac

SEQ ID NO: 1772664 - RNA, 12 nt, Human
caggguuggccc

SEQ ID NO: 1772665 - RNA, 16 nt, Human
caggugauccacccac

SEQ ID NO: 1772666 - RNA, 17 nt, Human
caggugauccacccacc

SEQ ID NO: 1772667 - RNA, 22 nt, Human
cagggucucacucugucgccca

SEQ ID NO: 1772668 - RNA, 21 nt, Human
cagggucucacucugucgccc

SEQ ID NO: 1772669 - RNA, 18 nt, Human
cagggucucacucugucg

SEQ ID NO: 1772670 - RNA, 19 nt, Human
caggguugaccccagagga

SEQ ID NO: 1772671 - RNA, 20 nt, Human
caggguugaccccagaggau

SEQ ID NO: 1772672 - RNA, 19 nt, Human
caggguucccgcggggcug

SEQ ID NO: 1772673 - RNA, 21 nt, Human
caggguucccgcggggcuguc

SEQ ID NO: 1772674 - RNA, 15 nt, Human
cagguugggauggga

SEQ ID NO: 1772675 - RNA, 14 nt, Human
caguauuuuguguc

SEQ ID NO: 1772676 - RNA, 16 nt, Human
caguauuuuguguccu

SEQ ID NO: 1772677 - RNA, 17 nt, Human
caguauuuuguguccuc

SEQ ID NO: 1772678 - RNA, 18 nt, Human
caguauuuuguguccucc

SEQ ID NO: 1772679 - RNA, 14 nt, Human
caguauuuuugcug

SEQ ID NO: 1772680 - RNA, 19 nt, Human
caguauuuuugcugcuucu

SEQ ID NO: 1772681 - RNA, 20 nt, Human
caguauuuuugcugcuucug

SEQ ID NO: 1772682 - RNA, 14 nt, Human
cagucaaccugggc

SEQ ID NO: 1772683 - RNA, 15 nt, Human
cagucaaccugggca

SEQ ID NO: 1772684 - RNA, 16 nt, Human
cagucaaccugggcaa

SEQ ID NO: 1772685 - RNA, 22 nt, Human
cagucaaccugggcaaagccua

SEQ ID NO: 1772686 - RNA, 21 nt, Human
cagucaaccugggcaaagccu

SEQ ID NO: 1772687 - RNA, 16 nt, Human
cagucaagcuguugaa

SEQ ID NO: 1772688 - RNA, 20 nt, Human
cagucaagcuguugaagucu

SEQ ID NO: 1772689 - RNA, 22 nt, Human
cagucaagcuguugaagucuca

SEQ ID NO: 1772690 - RNA, 15 nt, Human
cagucgauagagcug

SEQ ID NO: 1772691 - RNA, 16 nt, Human
cagucgauagagcugu

SEQ ID NO: 1772692 - RNA, 19 nt, Human
cagucugauucccaagcuc

SEQ ID NO: 1772693 - RNA, 20 nt, Human
cagucugauucccaagcucu

SEQ ID NO: 1772694 - RNA, 22 nt, Human
cagugcaaugguauaaauuuca

SEQ ID NO: 1772695 - RNA, 11 nt, Human
cagugggagcu

SEQ ID NO: 1772696 - RNA, 12 nt, Human
cagugcccacag

SEQ ID NO: 1772697 - RNA, 20 nt, Human
cagugccauguaaaucccca

SEQ ID NO: 1772698 - RNA, 13 nt, Human
auuuaugaauaua

SEQ ID NO: 1772699 - RNA, 14 nt, Human
auuuaugaauauaa

SEQ ID NO: 1772700 - RNA, 15 nt, Human
auuuaauaauauacu

SEQ ID NO: 1772701 - RNA, 13 nt, Human
auuuaauaauaua

SEQ ID NO: 1772702 - RNA, 18 nt, Human
auuuaauaauauacuugu

SEQ ID NO: 1772703 - RNA, 16 nt, Human
auuuaauaauauacuu

SEQ ID NO: 1772704 - RNA, 19 nt, Human
auuuaauaauauacuugug

SEQ ID NO: 1772705 - RNA, 15 nt, Human
auuuaauaaucugua

SEQ ID NO: 1772706 - RNA, 19 nt, Human
auuucaguguuaccugugu

SEQ ID NO: 1772707 - RNA, 21 nt, Human
auuucaguguuaccugugugc

SEQ ID NO: 1772708 - RNA, 15 nt, Human
auuucuauuucuccu

SEQ ID NO: 1772709 - RNA, 18 nt, Human
auuucuauuucuccucca

SEQ ID NO: 1772710 - RNA, 20 nt, Human
auuucuauuucuccuccaug

SEQ ID NO: 1772711 - RNA, 11 nt, Human
auuucuguaaa

SEQ ID NO: 1772712 - RNA, 11 nt, Human
auuucugugcc

SEQ ID NO: 1772713 - RNA, 16 nt, Human
auuucugugcccuccu

SEQ ID NO: 1772714 - RNA, 15 nt, Human
auugcuguuguccaa

SEQ ID NO: 1772715 - RNA, 19 nt, Human
auugcuguuguccaacuau

SEQ ID NO: 1772716 - RNA, 21 nt, Human
auugcuguuguccaacuauuu

SEQ ID NO: 1772717 - RNA, 13 nt, Human
auuguguuuguca

SEQ ID NO: 1772718 - RNA, 19 nt, Human
auuguguuugucauuagcc

SEQ ID NO: 1772719 - RNA, 18 nt, Human
auuguguuugucauuagc

SEQ ID NO: 1772720 - RNA, 16 nt, Human
auuguguuugucauua

SEQ ID NO: 1772721 - RNA, 15 nt, Human
auuguguuugucauu

SEQ ID NO: 1772722 - RNA, 22 nt, Human
auuguguuugucauuagccuga

SEQ ID NO: 1772723 - RNA, 20 nt, Human
auugugugugcucugcuuca

SEQ ID NO: 1772724 - RNA, 13 nt, Human
auuguaacuguuc

SEQ ID NO: 1772725 - RNA, 15 nt, Human
auuguaacuguucuu

SEQ ID NO: 1772726 - RNA, 19 nt, Human
auuguaacuguucuugaau

SEQ ID NO: 1772727 - RNA, 21 nt, Human
auuccuucucccaucucuucc

SEQ ID NO: 1772728 - RNA, 23 nt, Human
auuccuucucccaucucuuccuu

SEQ ID NO: 1772729 - RNA, 17 nt, Human
auuccugggaaauauuc

SEQ ID NO: 1772730 - RNA, 22 nt, Human
auuccugggaaauauucccuag

SEQ ID NO: 1772731 - RNA, 13 nt, Human
auucucugagcug

SEQ ID NO: 1772732 - RNA, 17 nt, Human
auucucugagcugugca

SEQ ID NO: 1772733 - RNA, 18 nt, Human
auucucugagcugugcag

SEQ ID NO: 1772734 - RNA, 17 nt, Human
auucucgcuucccugaa

SEQ ID NO: 1772735 - RNA, 12 nt, Human
auucucugucuc

SEQ ID NO: 1772736 - RNA, 13 nt, Human
auucucugucuca

SEQ ID NO: 1772737 - RNA, 14 nt, Human
auucucugucucau

SEQ ID NO: 1772738 - RNA, 16 nt, Human
auucucugucucaucc

SEQ ID NO: 1772739 - RNA, 17 nt, Human
auucucugucucaucca

SEQ ID NO: 1772740 - RNA, 19 nt, Human
auucuucugcuucagccuc

SEQ ID NO: 1772741 - RNA, 18 nt, Human
auucucugucucauccau

SEQ ID NO: 1772742 - RNA, 19 nt, Human
auucucugucucauccauc

SEQ ID NO: 1772743 - RNA, 20 nt, Human
auucuucugcuucagccucc

SEQ ID NO: 1772744 - RNA, 22 nt, Human
auucuucuguacgucugacagg

SEQ ID NO: 1772745 - RNA, 19 nt, Human
auucuugauuuauuugcuu

SEQ ID NO: 1772746 - RNA, 21 nt, Human
auucuugauuuauuugcuucu

SEQ ID NO: 1772747 - RNA, 22 nt, Human
auucuugauuuauuugcuucuu

SEQ ID NO: 1772748 - RNA, 12 nt, Human
auuaaauuaccu

SEQ ID NO: 1772749 - RNA, 16 nt, Human
auuaguaacauguguu

SEQ ID NO: 1772750 - RNA, 17 nt, Human
auuaguaacauguguua

SEQ ID NO: 1772751 - RNA, 13 nt, Human
auuaguaacaugu

SEQ ID NO: 1772752 - RNA, 16 nt, Human
auuaguaaaugcuuau

SEQ ID NO: 1772753 - RNA, 20 nt, Human
auucaauaaaguauuuaauu

SEQ ID NO: 1772754 - RNA, 18 nt, Human
auucaauaaaguauuuaa

SEQ ID NO: 1772755 - RNA, 22 nt, Human
auucaauaaaguauuuaauuag

SEQ ID NO: 1772756 - RNA, 21 nt, Human
auucaauaaaguauuuaauua

SEQ ID NO: 1772757 - RNA, 13 nt, Human
auucaauauugaa

SEQ ID NO: 1772758 - RNA, 14 nt, Human
auucaauauugaau

SEQ ID NO: 1772759 - RNA, 21 nt, Human
auucaauauugaauuuuuccu

SEQ ID NO: 1772760 - RNA, 14 nt, Human
auuuuuagacagag

SEQ ID NO: 1772761 - RNA, 14 nt, Human
caaaagacacugca

SEQ ID NO: 1772762 - RNA, 16 nt, Human
auuuuuuugagacaga

SEQ ID NO: 1772763 - RNA, 21 nt, Human
caaaaggauaaugaauacuuu

SEQ ID NO: 1772764 - RNA, 12 nt, Human
caacucauucca

SEQ ID NO: 1772765 - RNA, 14 nt, Human
caacucauuccaga

SEQ ID NO: 1772766 - RNA, 15 nt, Human
caacucauuccagau

SEQ ID NO: 1772767 - RNA, 16 nt, Human
caacucauuccagauc

SEQ ID NO: 1772768 - RNA, 12 nt, Human
caacuccuccca

SEQ ID NO: 1772769 - RNA, 13 nt, Human
caacuccucccau

SEQ ID NO: 1772770 - RNA, 23 nt, Human
caagaccccaagaggaaguucag

SEQ ID NO: 1772771 - RNA, 18 nt, Human
caagaugggggcagggcu

SEQ ID NO: 1772772 - RNA, 19 nt, Human
caagaugggggcagggcug

SEQ ID NO: 1772773 - RNA, 20 nt, Human
caagaugggggcagggcugu

SEQ ID NO: 1772774 - RNA, 17 nt, Human
caaaggguccagaagga

SEQ ID NO: 1772775 - RNA, 21 nt, Human
caaaggguccagaaggagaca

SEQ ID NO: 1772776 - RNA, 22 nt, Human
caaaugaccagcagauucaaau

SEQ ID NO: 1772777 - RNA, 12 nt, Human
caccucagccuc

SEQ ID NO: 1772778 - RNA, 12 nt, Human
caccuagccagc

SEQ ID NO: 1772779 - RNA, 15 nt, Human
caccuagccagcugu

SEQ ID NO: 1772780 - RNA, 18 nt, Human
caccuuggcugcagggag

SEQ ID NO: 1772781 - RNA, 15 nt, Human
caccuuggcugcagg

SEQ ID NO: 1772782 - RNA, 16 nt, Human
caccuuggcugcaggg

SEQ ID NO: 1772783 - RNA, 16 nt, Human
cacgaaacugcccugg

SEQ ID NO: 1772784 - RNA, 20 nt, Human
caccuuuguuuuuuguugga

SEQ ID NO: 1772785 - RNA, 15 nt, Human
cacggcucacugcag

SEQ ID NO: 1772786 - RNA, 14 nt, Human
cacggcucacugca

SEQ ID NO: 1772787 - RNA, 12 nt, Human
cacggccaggcc

SEQ ID NO: 1772788 - RNA, 13 nt, Human
cacggccaggcca

SEQ ID NO: 1772789 - RNA, 21 nt, Human
cacuacauuauaaaugucucu

SEQ ID NO: 1772790 - RNA, 20 nt, Human
cacucuuauugcccacgcug

SEQ ID NO: 1772791 - RNA, 21 nt, Human
cacucuuauugcccacgcugg

SEQ ID NO: 1772792 - RNA, 22 nt, Human
cacucuuauugcccacgcugga

SEQ ID NO: 1772793 - RNA, 20 nt, Human
cagaaauacagauuuugaua

SEQ ID NO: 1772794 - RNA, 15 nt, Human
cagaaauacagauuu

SEQ ID NO: 1772795 - RNA, 23 nt, Human
cagaaauacagauuuugauagca

SEQ ID NO: 1772796 - RNA, 21 nt, Human
cagaaauacagucuuccacaa

SEQ ID NO: 1772797 - RNA, 14 nt, Human
cagaaaugcugcug

SEQ ID NO: 1772798 - RNA, 15 nt, Human
cagaaaugcugcugg

SEQ ID NO: 1772799 - RNA, 16 nt, Human
cagaaaugcugcuggc

SEQ ID NO: 1772800 - RNA, 17 nt, Human
cagaaaugcugcuggcc

SEQ ID NO: 1772801 - RNA, 18 nt, Human
cagaaaugcugcuggcca

SEQ ID NO: 1772802 - RNA, 19 nt, Human
cagaaaugcugcuggccaa

SEQ ID NO: 1772803 - RNA, 14 nt, Human
cagaacaguaugaa

SEQ ID NO: 1772804 - RNA, 18 nt, Human
cagaacaguaugaauuug

SEQ ID NO: 1772805 - RNA, 16 nt, Human
cacuuaaauuaugaua

SEQ ID NO: 1772806 - RNA, 22 nt, Human
cacuuguggguuuuuguuuugu

SEQ ID NO: 1772807 - RNA, 18 nt, Human
cacuuguguuaugaagca

SEQ ID NO: 1772808 - RNA, 20 nt, Human
cacugcagccucaaccuccu

SEQ ID NO: 1772809 - RNA, 21 nt, Human
cacugcagccucaaccuccug

SEQ ID NO: 1772810 - RNA, 22 nt, Human
cacugcagccucaaccuccugg

SEQ ID NO: 1772811 - RNA, 23 nt, Human
cacugcagccucaaccuccuggg

SEQ ID NO: 1772812 - RNA, 19 nt, Human
cacugcagccucaaccucc

SEQ ID NO: 1772813 - RNA, 14 nt, Human
cacugcagccucaa

SEQ ID NO: 1772814 - RNA, 14 nt, Human
cacugggaggccag

SEQ ID NO: 1772815 - RNA, 21 nt, Human
cacugggaggccagugagcca

SEQ ID NO: 1772816 - RNA, 15 nt, Human
cacugggcucccggg

SEQ ID NO: 1772817 - RNA, 16 nt, Human
cacugggcucccgggc

SEQ ID NO: 1772818 - RNA, 18 nt, Human
cacuguugcccaggcugg

SEQ ID NO: 1772819 - RNA, 19 nt, Human
cacuguugcccaggcuggc

SEQ ID NO: 1772820 - RNA, 23 nt, Human
cacuguugcccaggcuggcgugc

SEQ ID NO: 1772821 - RNA, 16 nt, Human
cacaucugugucuugu

SEQ ID NO: 1772822 - RNA, 17 nt, Human
cacaucugugucuuguu

SEQ ID NO: 1772823 - RNA, 18 nt, Human
cacaucugugucuuguuu

SEQ ID NO: 1772824 - RNA, 23 nt, Human
cacaucugugucuuguuuggaau

SEQ ID NO: 1772825 - RNA, 12 nt, Human
cacaucuguguc

SEQ ID NO: 1772826 - RNA, 17 nt, Human
cacccaccucagccucc

SEQ ID NO: 1772827 - RNA, 13 nt, Human
caccagccccagu

SEQ ID NO: 1772828 - RNA, 16 nt, Human
caccagccccagugcc

SEQ ID NO: 1772829 - RNA, 18 nt, Human
cacccaccucagccuccc

SEQ ID NO: 1772830 - RNA, 13 nt, Human
cacccacucagcu

SEQ ID NO: 1772831 - RNA, 14 nt, Human
cacccacucagcuc

SEQ ID NO: 1772832 - RNA, 15 nt, Human
cacccacucagcucc

SEQ ID NO: 1772833 - RNA, 16 nt, Human
cacccaggagccccga

SEQ ID NO: 1772834 - RNA, 13 nt, Human
cacagaaaugcug

SEQ ID NO: 1772835 - RNA, 14 nt, Human
cacagaaaugcugc

SEQ ID NO: 1772836 - RNA, 16 nt, Human
cacagaaaugcugcug

SEQ ID NO: 1772837 - RNA, 17 nt, Human
cacagaaaugcugcugg

SEQ ID NO: 1772838 - RNA, 18 nt, Human
cacagaaaugcugcuggc

SEQ ID NO: 1772839 - RNA, 19 nt, Human
cacagaaaugcugcuggcc

SEQ ID NO: 1772840 - RNA, 20 nt, Human
cacagaaaugcugcuggcca

SEQ ID NO: 1772841 - RNA, 21 nt, Human
cacagaaaugcugcuggccaa

SEQ ID NO: 1772842 - RNA, 22 nt, Human
cacagaaaugcugcuggccaaa

SEQ ID NO: 1772843 - RNA, 17 nt, Human
cacacuuuuuaagaaau

SEQ ID NO: 1772844 - RNA, 17 nt, Human
cacagcucuucuccagg

SEQ ID NO: 1772845 - RNA, 14 nt, Human
cacagcucuucucc

SEQ ID NO: 1772846 - RNA, 15 nt, Human
cacagcucuucucca

SEQ ID NO: 1772847 - RNA, 15 nt, Human
cacagcucuguccug

SEQ ID NO: 1772848 - RNA, 16 nt, Human
cacagcucuguccugg

SEQ ID NO: 1772849 - RNA, 18 nt, Human
cacagcucuguccuggga

SEQ ID NO: 1772850 - RNA, 19 nt, Human
cacagcucuguccugggag

SEQ ID NO: 1772851 - RNA, 11 nt, Human
cacagcucugu

SEQ ID NO: 1772852 - RNA, 14 nt, Human
cacagcucuguccu

SEQ ID NO: 1772853 - RNA, 16 nt, Human
cacagaagcacaugca

SEQ ID NO: 1772854 - RNA, 14 nt, Human
caauugcaucuccc

SEQ ID NO: 1772855 - RNA, 15 nt, Human
caauugcaucuccca

SEQ ID NO: 1772856 - RNA, 17 nt, Human
caauugcaucucccaga

SEQ ID NO: 1772857 - RNA, 12 nt, Human
caauuucccccu

SEQ ID NO: 1772858 - RNA, 16 nt, Human
caauuucuacuuugaa

SEQ ID NO: 1772859 - RNA, 20 nt, Human
caauuucuacuuugaaguca

SEQ ID NO: 1772860 - RNA, 21 nt, Human
caauuucuacuuugaagucau

SEQ ID NO: 1772861 - RNA, 17 nt, Human
caaucaugaaauaugca

SEQ ID NO: 1772862 - RNA, 13 nt, Human
caaugcuggcugu

SEQ ID NO: 1772863 - RNA, 20 nt, Human
caaugcuggcuguuggcugg

SEQ ID NO: 1772864 - RNA, 21 nt, Human
caaugcuggcuguuggcuggg

SEQ ID NO: 1772865 - RNA, 13 nt, Human
caagucaugugca

SEQ ID NO: 1772866 - RNA, 16 nt, Human
caagucaugugcauuu

SEQ ID NO: 1772867 - RNA, 17 nt, Human
caagucaugugcauuuc

SEQ ID NO: 1772868 - RNA, 14 nt, Human
caauaaaauauuau

SEQ ID NO: 1772869 - RNA, 17 nt, Human
caauaaaauauuauuga

SEQ ID NO: 1772870 - RNA, 21 nt, Human
caauaaaauauuauugaacua

SEQ ID NO: 1772871 - RNA, 18 nt, Human
ggcucagcggggacagcu

SEQ ID NO: 1772872 - RNA, 19 nt, Human
ggcucagcggggacagcuc

SEQ ID NO: 1772873 - RNA, 20 nt, Human
ggcucagcggggacagcucc

SEQ ID NO: 1772874 - RNA, 19 nt, Human
ggcugcggcguacaggcug

SEQ ID NO: 1772875 - RNA, 21 nt, Human
ggcugcggcguacaggcuggc

SEQ ID NO: 1772876 - RNA, 22 nt, Human
ggcugcggcguacaggcuggcg

SEQ ID NO: 1772877 - RNA, 19 nt, Human
ggcucugugggugaugggg

SEQ ID NO: 1772878 - RNA, 22 nt, Human
ggcucugugggugauggggagg

SEQ ID NO: 1772879 - RNA, 18 nt, Human
ggcucuauaaggcagccu

SEQ ID NO: 1772880 - RNA, 12 nt, Human
ggcugccuccca

SEQ ID NO: 1772881 - RNA, 13 nt, Human
ggcugccucccaa

SEQ ID NO: 1772882 - RNA, 19 nt, Human
ggcugcgacgcuugcucug

SEQ ID NO: 1772883 - RNA, 22 nt, Human
ggcugcggaaugaaccacaucu

SEQ ID NO: 1772884 - RNA, 16 nt, Human
ggcugaauagcagaag

SEQ ID NO: 1772885 - RNA, 21 nt, Human
aaaagccucaacuagucauuu

SEQ ID NO: 1772886 - RNA, 14 nt, Human
gggagaaaaucauc

SEQ ID NO: 1772887 - RNA, 20 nt, Human
gggagaaaaucaucaagaag

SEQ ID NO: 1772888 - RNA, 12 nt, Human
gggagaaauacu

SEQ ID NO: 1772889 - RNA, 19 nt, Human
gggagaaauacuugaacuu

SEQ ID NO: 1772890 - RNA, 15 nt, Human
gggacuuggaagcuc

SEQ ID NO: 1772891 - RNA, 17 nt, Human
gggacuuggaagcuccg

SEQ ID NO: 1772892 - RNA, 18 nt, Human
gggacuuggaagcuccgc

SEQ ID NO: 1772893 - RNA, 23 nt, Human
gggacuuggaagcuccgcuuucu

SEQ ID NO: 1772894 - RNA, 16 nt, Human
aaaaauguauaugcac

SEQ ID NO: 1772895 - RNA, 14 nt, Human
aaaaccuuuugaaa

SEQ ID NO: 1772896 - RNA, 14 nt, Human
ggcuucucucugug

SEQ ID NO: 1772897 - RNA, 12 nt, Human
ggcuucuguggg

SEQ ID NO: 1772898 - RNA, 13 nt, Human
ggcuucugugggg

SEQ ID NO: 1772899 - RNA, 19 nt, Human
ggcuucuguggggccccuc

SEQ ID NO: 1772900 - RNA, 22 nt, Human
gggaacagccacuccccuccac

SEQ ID NO: 1772901 - RNA, 16 nt, Human
gggaaccuccccagcc

SEQ ID NO: 1772902 - RNA, 18 nt, Human
gggaaccuccccagccug

SEQ ID NO: 1772903 - RNA, 19 nt, Human
gggaaccuccccagccugc

SEQ ID NO: 1772904 - RNA, 20 nt, Human
gggaaccuccccagccugcg

SEQ ID NO: 1772905 - RNA, 12 nt, Human
gggacagcuccu

SEQ ID NO: 1772906 - RNA, 13 nt, Human
gggacagcuccuu

SEQ ID NO: 1772907 - RNA, 15 nt, Human
gggacagcuccuucu

SEQ ID NO: 1772908 - RNA, 16 nt, Human
gggacagcuccuucug

SEQ ID NO: 1772909 - RNA, 17 nt, Human
gggacagugcugcagcu

SEQ ID NO: 1772910 - RNA, 16 nt, Human
ggcuuccucauaguau

SEQ ID NO: 1772911 - RNA, 18 nt, Human
ggcuucaguggcagcugc

SEQ ID NO: 1772912 - RNA, 17 nt, Human
ggcuucaguggcagcug

SEQ ID NO: 1772913 - RNA, 19 nt, Human
ggcuucaguggcagcugcu

SEQ ID NO: 1772914 - RNA, 20 nt, Human
ggcuucaguggcagcugcuu

SEQ ID NO: 1772915 - RNA, 18 nt, Human
ggcuguaucccaugagcc

SEQ ID NO: 1772916 - RNA, 15 nt, Human
ggcugggggccucag

SEQ ID NO: 1772917 - RNA, 16 nt, Human
ggcugggggccucagu

SEQ ID NO: 1772918 - RNA, 17 nt, Human
ggcugggggccucagug

SEQ ID NO: 1772919 - RNA, 19 nt, Human
ggcugggggccucagugcc

SEQ ID NO: 1772920 - RNA, 14 nt, Human
aaaaauaacaauga

SEQ ID NO: 1772921 - RNA, 23 nt, Human
ggcacucagaagacacugauggg

SEQ ID NO: 1772922 - RNA, 21 nt, Human
ggcagcagggcuacccugagc

SEQ ID NO: 1772923 - RNA, 13 nt, Human
ggcagcaguguga

SEQ ID NO: 1772924 - RNA, 14 nt, Human
ggcagcagugugag

SEQ ID NO: 1772925 - RNA, 19 nt, Human
ggcagcagugugaggccag

SEQ ID NO: 1772926 - RNA, 20 nt, Human
ggcagcagugugaggccagg

SEQ ID NO: 1772927 - RNA, 13 nt, Human
ggcagcagggcua

SEQ ID NO: 1772928 - RNA, 18 nt, Human
ggcagcagggcuacccug

SEQ ID NO: 1772929 - RNA, 15 nt, Human
ggagacugcccagcu

SEQ ID NO: 1772930 - RNA, 11 nt, Human
ggcagggcugu

SEQ ID NO: 1772931 - RNA, 16 nt, Human
ggcagggcugugcuug

SEQ ID NO: 1772932 - RNA, 20 nt, Human
ggccagugugacaaggauug

SEQ ID NO: 1772933 - RNA, 13 nt, Human
ggcccuuugcugu

SEQ ID NO: 1772934 - RNA, 14 nt, Human
ggcccuuugcuguc

SEQ ID NO: 1772935 - RNA, 23 nt, Human
ggccccugcugguucaggguugg

SEQ ID NO: 1772936 - RNA, 13 nt, Human
ggcccggcuccag

SEQ ID NO: 1772937 - RNA, 13 nt, Human
ggccccugcuggu

SEQ ID NO: 1772938 - RNA, 14 nt, Human
ggccccugcugguu

SEQ ID NO: 1772939 - RNA, 15 nt, Human
ggcccggcuccaggc

SEQ ID NO: 1772940 - RNA, 15 nt, Human
ggcccucgcugccag

SEQ ID NO: 1772941 - RNA, 16 nt, Human
ggcccucgcugccagc

SEQ ID NO: 1772942 - RNA, 19 nt, Human
ggcccucgcugccagcucu

SEQ ID NO: 1772943 - RNA, 21 nt, Human
ggcccucgcugccagcucugu

SEQ ID NO: 1772944 - RNA, 22 nt, Human
ggcccucgcugccagcucugua

SEQ ID NO: 1772945 - RNA, 23 nt, Human
ggcccucgcugccagcucuguau

SEQ ID NO: 1772946 - RNA, 19 nt, Human
gguggaacauauggucucc

SEQ ID NO: 1772947 - RNA, 13 nt, Human
gguggaugccugg

SEQ ID NO: 1772948 - RNA, 13 nt, Human
gguggagggccac

SEQ ID NO: 1772949 - RNA, 23 nt, Human
gguggagggccacaugggaggcu

SEQ ID NO: 1772950 - RNA, 13 nt, Human
ggugcagccagag

SEQ ID NO: 1772951 - RNA, 17 nt, Human
ggugcagccagaggcac

SEQ ID NO: 1772952 - RNA, 18 nt, Human
ggugauccacccaccuca

SEQ ID NO: 1772953 - RNA, 23 nt, Human
ggugauccacccaccucagccuc

SEQ ID NO: 1772954 - RNA, 24 nt, Human
ggugauccacccaccucagccucc

SEQ ID NO: 1772955 - RNA, 17 nt, Human
ggucgacuucgggcugg

SEQ ID NO: 1772956 - RNA, 15 nt, Human
gguccuuugggguga

SEQ ID NO: 1772957 - RNA, 13 nt, Human
aaagcugcugaca

SEQ ID NO: 1772958 - RNA, 20 nt, Human
aaagcugguggcagaguccu

SEQ ID NO: 1772959 - RNA, 12 nt, Human
aaagcuuucugc

SEQ ID NO: 1772960 - RNA, 19 nt, Human
aaaggagcccuuaucugug

SEQ ID NO: 1772961 - RNA, 23 nt, Human
aaaggagcccuuaucugugcuca

SEQ ID NO: 1772962 - RNA, 22 nt, Human
aaagggacuuggaagcuccgcu

SEQ ID NO: 1772963 - RNA, 18 nt, Human
aaagauggggucuguaaa

SEQ ID NO: 1772964 - RNA, 17 nt, Human
aaagauggggucuguaa

SEQ ID NO: 1772965 - RNA, 22 nt, Human
aaagauggggucuguaaaaucu

SEQ ID NO: 1772966 - RNA, 21 nt, Human
aaagauggggucuguaaaauc

SEQ ID NO: 1772967 - RNA, 19 nt, Human
aaagauggggucuguaaaa

SEQ ID NO: 1772968 - RNA, 14 nt, Human
aaagcaaggaaacu

SEQ ID NO: 1772969 - RNA, 20 nt, Human
aaagcaaggaaacuauguaa

SEQ ID NO: 1772970 - RNA, 14 nt, Human
aaagcaauaugcau

SEQ ID NO: 1772971 - RNA, 11 nt, Human
gguccuuccug

SEQ ID NO: 1772972 - RNA, 15 nt, Human
aaacuuggauucucu

SEQ ID NO: 1772973 - RNA, 18 nt, Human
aaacuuggauucucuaac

SEQ ID NO: 1772974 - RNA, 12 nt, Human
aaacuugggcac

SEQ ID NO: 1772975 - RNA, 15 nt, Human
aaacuuugauucuuu

SEQ ID NO: 1772976 - RNA, 20 nt, Human
aaacuuuccucuuccugccu

SEQ ID NO: 1772977 - RNA, 14 nt, Human
aaagacacugcaga

SEQ ID NO: 1772978 - RNA, 13 nt, Human
aaagacagugaaa

SEQ ID NO: 1772979 - RNA, 17 nt, Human
gggucgacuucgggcug

SEQ ID NO: 1772980 - RNA, 12 nt, Human
ggguccaugggc

SEQ ID NO: 1772981 - RNA, 13 nt, Human
ggguccuuccuga

SEQ ID NO: 1772982 - RNA, 18 nt, Human
gggucccggcucuguggg

SEQ ID NO: 1772983 - RNA, 12 nt, Human
ggguccuuccug

SEQ ID NO: 1772984 - RNA, 14 nt, Human
aaaccaaggacuga

SEQ ID NO: 1772985 - RNA, 13 nt, Human
aaaccuuuugaaa

SEQ ID NO: 1772986 - RNA, 20 nt, Human
aaaccuuuuggaaaaucugc

SEQ ID NO: 1772987 - RNA, 11 nt, Human
aaaccucuguu

SEQ ID NO: 1772988 - RNA, 14 nt, Human
aaaccucuguucag

SEQ ID NO: 1772989 - RNA, 16 nt, Human
aaaccucuguucagug

SEQ ID NO: 1772990 - RNA, 17 nt, Human
aaaccucuguucagugu

SEQ ID NO: 1772991 - RNA, 21 nt, Human
aaaccucuguucaguguaaau

SEQ ID NO: 1772992 - RNA, 18 nt, Human
aaacuagggccaagccca

SEQ ID NO: 1772993 - RNA, 17 nt, Human
aaacuauauuuugucau

SEQ ID NO: 1772994 - RNA, 18 nt, Human
aaacuauauuuugucaua

SEQ ID NO: 1772995 - RNA, 19 nt, Human
aaacuguuaauaguucagg

SEQ ID NO: 1772996 - RNA, 15 nt, Human
aaacugcccuggcuc

SEQ ID NO: 1772997 - RNA, 12 nt, Human
aaacugugcacc

SEQ ID NO: 1772998 - RNA, 15 nt, Human
ggggccucagugcca

SEQ ID NO: 1772999 - RNA, 12 nt, Human
gggggccucagu

SEQ ID NO: 1773000 - RNA, 15 nt, Human
gggggccucagugcc

SEQ ID NO: 1773001 - RNA, 17 nt, Human
gggggccucagugccac

SEQ ID NO: 1773002 - RNA, 18 nt, Human
gggggccucagugccacu

SEQ ID NO: 1773003 - RNA, 11 nt, Human
ggggagaaagu

SEQ ID NO: 1773004 - RNA, 20 nt, Human
ggggaccuuuugggggaggg

SEQ ID NO: 1773005 - RNA, 18 nt, Human
ggggacuccggcugugcu

SEQ ID NO: 1773006 - RNA, 22 nt, Human
ggggacuccggcugugcuggga

SEQ ID NO: 1773007 - RNA, 16 nt, Human
aaacauggguuuaguu

SEQ ID NO: 1773008 - RNA, 17 nt, Human
aaacauguuagaagcaa

SEQ ID NO: 1773009 - RNA, 16 nt, Human
aaacauguuagaagca

SEQ ID NO: 1773010 - RNA, 18 nt, Human
aaacagguugggauggga

SEQ ID NO: 1773011 - RNA, 13 nt, Human
ggggaaggagcca

SEQ ID NO: 1773012 - RNA, 15 nt, Human
ggggaaggagccagu

SEQ ID NO: 1773013 - RNA, 21 nt, Human
ggggaaggagccaguuugccg

SEQ ID NO: 1773014 - RNA, 18 nt, Human
ggggaauguuugccucug

SEQ ID NO: 1773015 - RNA, 22 nt, Human
ggggaauguuugccucugccuc

SEQ ID NO: 1773016 - RNA, 16 nt, Human
aaacaaugaaugucuu

SEQ ID NO: 1773017 - RNA, 16 nt, Human
aaacaacaauuucuac

SEQ ID NO: 1773018 - RNA, 22 nt, Human
aaacaacaauuucuacuuugaa

SEQ ID NO: 1773019 - RNA, 16 nt, Human
aaacaauaaaugugca

SEQ ID NO: 1773020 - RNA, 12 nt, Human
aaacaaauaugc

SEQ ID NO: 1773021 - RNA, 13 nt, Human
aaacaaauaugca

SEQ ID NO: 1773022 - RNA, 14 nt, Human
aaacaaauaugcaa

SEQ ID NO: 1773023 - RNA, 17 nt, Human
aaacaaauaugcaaaag

SEQ ID NO: 1773024 - RNA, 16 nt, Human
aaaauuuugugacauu

SEQ ID NO: 1773025 - RNA, 19 nt, Human
aaaauuuugugacauuccu

SEQ ID NO: 1773026 - RNA, 20 nt, Human
aaaauuuugugacauuccuu

SEQ ID NO: 1773027 - RNA, 21 nt, Human
aaaauuuugugacauuccuuc

SEQ ID NO: 1773028 - RNA, 18 nt, Human
aaaauuuauuuuauaaga

SEQ ID NO: 1773029 - RNA, 20 nt, Human
aaaauuuauuuuauaagaaa

SEQ ID NO: 1773030 - RNA, 21 nt, Human
aaaauuuuauaaaauuaagca

SEQ ID NO: 1773031 - RNA, 13 nt, Human
gggaugagaaagg

SEQ ID NO: 1773032 - RNA, 15 nt, Human
gggaugagaguuuug

SEQ ID NO: 1773033 - RNA, 16 nt, Human
gggaugauucaagcca

SEQ ID NO: 1773034 - RNA, 19 nt, Human
aaaguacuucuccacccug

SEQ ID NO: 1773035 - RNA, 23 nt, Human
aaaguacuucuccacccugcucu

SEQ ID NO: 1773036 - RNA, 11 nt, Human
aaaguacugua

SEQ ID NO: 1773037 - RNA, 12 nt, Human
aaaguacuguaa

SEQ ID NO: 1773038 - RNA, 20 nt, Human
aaaguacuucuccacccugc

SEQ ID NO: 1773039 - RNA, 21 nt, Human
aaaguacuucuccacccugcu

SEQ ID NO: 1773040 - RNA, 23 nt, Human
aaaguauuuaauuagugcuaagu

SEQ ID NO: 1773041 - RNA, 21 nt, Human
aaaguauuuaauuagugcuaa

SEQ ID NO: 1773042 - RNA, 20 nt, Human
aaaguauuuaauuagugcua

SEQ ID NO: 1773043 - RNA, 19 nt, Human
aaaguauuuaauuagugcu

SEQ ID NO: 1773044 - RNA, 18 nt, Human
aaaguauuuaauuagugc

SEQ ID NO: 1773045 - RNA, 17 nt, Human
aaaguauuuaauuagug

SEQ ID NO: 1773046 - RNA, 15 nt, Human
aaaguauuauuuucc

SEQ ID NO: 1773047 - RNA, 16 nt, Human
aaaguauuauuuucca

SEQ ID NO: 1773048 - RNA, 17 nt, Human
aaaguauuauuuuccaa

SEQ ID NO: 1773049 - RNA, 14 nt, Human
aaaguucuguacuc

SEQ ID NO: 1773050 - RNA, 21 nt, Human
aaaguucuguacucaaaugua

SEQ ID NO: 1773051 - RNA, 13 nt, Human
aaauaauuuccua

SEQ ID NO: 1773052 - RNA, 14 nt, Human
aaauaauaugcauu

SEQ ID NO: 1773053 - RNA, 12 nt, Human
aaauaauaugca

SEQ ID NO: 1773054 - RNA, 13 nt, Human
aaauaauaugcau

SEQ ID NO: 1773055 - RNA, 24 nt, Human
aaauaagaaacaacucuuugagaa

SEQ ID NO: 1773056 - RNA, 16 nt, Human
aaauaacuucaagcaa

SEQ ID NO: 1773057 - RNA, 16 nt, Human
aaaguugguuggauaa

SEQ ID NO: 1773058 - RNA, 13 nt, Human
aaauaacacacau

SEQ ID NO: 1773059 - RNA, 19 nt, Human
aaauaaccaauccuggaca

SEQ ID NO: 1773060 - RNA, 21 nt, Human
aaauaacacacauauaaacau

SEQ ID NO: 1773061 - RNA, 15 nt, Human
aaauaacuucaagca

SEQ ID NO: 1773062 - RNA, 18 nt, Human
aaauaacuucaagcaaac

SEQ ID NO: 1773063 - RNA, 15 nt, Human
aaauacagauuuuga

SEQ ID NO: 1773064 - RNA, 23 nt, Human
aaauacagauuuugauagcaaag

SEQ ID NO: 1773065 - RNA, 17 nt, Human
aaauacagauuuugaua

SEQ ID NO: 1773066 - RNA, 22 nt, Human
aaauacagucuuccauuugcaa

SEQ ID NO: 1773067 - RNA, 23 nt, Human
aaauacagucuuccauuugcaag

SEQ ID NO: 1773068 - RNA, 13 nt, Human
aaauacaugacau

SEQ ID NO: 1773069 - RNA, 14 nt, Human
aaauacaugcaucu

SEQ ID NO: 1773070 - RNA, 20 nt, Human
guaauaggcguaacuaauuu

SEQ ID NO: 1773071 - RNA, 13 nt, Human
guaauuuguaaag

SEQ ID NO: 1773072 - RNA, 14 nt, Human
guaauuuguaaagu

SEQ ID NO: 1773073 - RNA, 17 nt, Human
aaaucagccaauuaugu

SEQ ID NO: 1773074 - RNA, 23 nt, Human
aaaucagccaauuauguuaaacu

SEQ ID NO: 1773075 - RNA, 21 nt, Human
aaaucagccaauuauguuaaa

SEQ ID NO: 1773076 - RNA, 20 nt, Human
aaaucagccaauuauguuaa

SEQ ID NO: 1773077 - RNA, 18 nt, Human
aaaucagccaauuauguu

SEQ ID NO: 1773078 - RNA, 18 nt, Human
aaauauucccuagaaacu

SEQ ID NO: 1773079 - RNA, 19 nt, Human
aaauauucccuagaaacuu

SEQ ID NO: 1773080 - RNA, 13 nt, Human
aaauauuauugaa

SEQ ID NO: 1773081 - RNA, 20 nt, Human
aaauauuauuuuaugaaagg

SEQ ID NO: 1773082 - RNA, 14 nt, Human
aaaucagucaagcu

SEQ ID NO: 1773083 - RNA, 22 nt, Human
aaaucauaggaaaguauuuuuu

SEQ ID NO: 1773084 - RNA, 18 nt, Human
guacauguucgggugugg

SEQ ID NO: 1773085 - RNA, 21 nt, Human
guacauguucggguguggguu

SEQ ID NO: 1773086 - RNA, 20 nt, Human
guaccaugaaacaaagcugc

SEQ ID NO: 1773087 - RNA, 12 nt, Human
guacccacugcu

SEQ ID NO: 1773088 - RNA, 15 nt, Human
guaccagugaauuuu

SEQ ID NO: 1773089 - RNA, 16 nt, Human
guaccagugaauuuuu

SEQ ID NO: 1773090 - RNA, 19 nt, Human
guaccagugaauuuuugca

SEQ ID NO: 1773091 - RNA, 21 nt, Human
guaccagugaauuuuugcaau

SEQ ID NO: 1773092 - RNA, 22 nt, Human
guaccagugaauuuuugcaaua

SEQ ID NO: 1773093 - RNA, 15 nt, Human
guaccaccaaaaaag

SEQ ID NO: 1773094 - RNA, 16 nt, Human
guacauuuuucaacuu

SEQ ID NO: 1773095 - RNA, 19 nt, Human
guacauuuuucaacuuuga

SEQ ID NO: 1773096 - RNA, 20 nt, Human
guacauuuuucaacuuugaa

SEQ ID NO: 1773097 - RNA, 21 nt, Human
guacauuuuucaacuuugaau

SEQ ID NO: 1773098 - RNA, 22 nt, Human
guacauuuuucaacuuugaaua

SEQ ID NO: 1773099 - RNA, 23 nt, Human
guacauuuuucaacuuugaauaa

SEQ ID NO: 1773100 - RNA, 11 nt, Human
guagagacagg

SEQ ID NO: 1773101 - RNA, 12 nt, Human
guagagacaggg

SEQ ID NO: 1773102 - RNA, 15 nt, Human
guagagccagggucu

SEQ ID NO: 1773103 - RNA, 18 nt, Human
guagagccagggucucac

SEQ ID NO: 1773104 - RNA, 13 nt, Human
guagagacagggu

SEQ ID NO: 1773105 - RNA, 10 nt, Human
guagagccag

SEQ ID NO: 1773106 - RNA, 11 nt, Human
guagagccagg

SEQ ID NO: 1773107 - RNA, 11 nt, Human
guagaauauuc

SEQ ID NO: 1773108 - RNA, 21 nt, Human
guagaaaggccuuuaaaauuu

SEQ ID NO: 1773109 - RNA, 16 nt, Human
guagaaauaauaugca

SEQ ID NO: 1773110 - RNA, 22 nt, Human
guagaaaugguuguauuagaug

SEQ ID NO: 1773111 - RNA, 20 nt, Human
guagaaaugguuguauuaga

SEQ ID NO: 1773112 - RNA, 18 nt, Human
guagaaaugguuguauua

SEQ ID NO: 1773113 - RNA, 17 nt, Human
guagaaaugguuguauu

SEQ ID NO: 1773114 - RNA, 17 nt, Human
guagaaauaauaugcau

SEQ ID NO: 1773115 - RNA, 15 nt, Human
guacucaaauguagc

SEQ ID NO: 1773116 - RNA, 13 nt, Human
guacccacugcuc

SEQ ID NO: 1773117 - RNA, 14 nt, Human
guacccacugcucu

SEQ ID NO: 1773118 - RNA, 16 nt, Human
guacuguaagaauaau

SEQ ID NO: 1773119 - RNA, 16 nt, Human
guacugugggcaauuu

SEQ ID NO: 1773120 - RNA, 17 nt, Human
guacugugggcaauuua

SEQ ID NO: 1773121 - RNA, 20 nt, Human
guacugugggcaauuuagaa

SEQ ID NO: 1773122 - RNA, 21 nt, Human
guacugugggcaauuuagaaa

SEQ ID NO: 1773123 - RNA, 22 nt, Human
guacugugggcaauuuagaaaa

SEQ ID NO: 1773124 - RNA, 13 nt, Human
gcuucaggaaccu

SEQ ID NO: 1773125 - RNA, 14 nt, Human
gcuucaggaaccuc

SEQ ID NO: 1773126 - RNA, 22 nt, Human
gcuucaggaaccucgaguacug

SEQ ID NO: 1773127 - RNA, 23 nt, Human
gcuucaggaaccucgaguacugu

SEQ ID NO: 1773128 - RNA, 12 nt, Human
gcuucagccucc

SEQ ID NO: 1773129 - RNA, 22 nt, Human
gcuuccucauaguaugguggcu

SEQ ID NO: 1773130 - RNA, 16 nt, Human
gcuucuagcugacuug

SEQ ID NO: 1773131 - RNA, 15 nt, Human
gcuucuuccaggugc

SEQ ID NO: 1773132 - RNA, 16 nt, Human
gcuucuuccaggugcc

SEQ ID NO: 1773133 - RNA, 19 nt, Human
gcuucuuccaggugcccag

SEQ ID NO: 1773134 - RNA, 20 nt, Human
gcuuguaaauagcucaggug

SEQ ID NO: 1773135 - RNA, 15 nt, Human
gcuggcuguuggcug

SEQ ID NO: 1773136 - RNA, 16 nt, Human
gcuggcuguuggcugg

SEQ ID NO: 1773137 - RNA, 17 nt, Human
gcuggcuguuggcuggg

SEQ ID NO: 1773138 - RNA, 15 nt, Human
gcuggcuacgccucu

SEQ ID NO: 1773139 - RNA, 21 nt, Human
gcuggcucuauaaggcagccu

SEQ ID NO: 1773140 - RNA, 15 nt, Human
gcugggcccucucuu

SEQ ID NO: 1773141 - RNA, 17 nt, Human
gcugggcccucucuucu

SEQ ID NO: 1773142 - RNA, 18 nt, Human
gcugggcccucucuucuc

SEQ ID NO: 1773143 - RNA, 12 nt, Human
gcuggaggccuc

SEQ ID NO: 1773144 - RNA, 14 nt, Human
gcuggaggccucag

SEQ ID NO: 1773145 - RNA, 19 nt, Human
gcuggaggccucaggugcu

SEQ ID NO: 1773146 - RNA, 20 nt, Human
gcuggcgugcaguggugcga

SEQ ID NO: 1773147 - RNA, 15 nt, Human
gcuggcgagagucug

SEQ ID NO: 1773148 - RNA, 17 nt, Human
gcuggcgagagucuggc

SEQ ID NO: 1773149 - RNA, 20 nt, Human
gcuggcgagagucuggcccu

SEQ ID NO: 1773150 - RNA, 18 nt, Human
gcuggagugcagugagcc

SEQ ID NO: 1773151 - RNA, 17 nt, Human
gcuggagugcagugagc

SEQ ID NO: 1773152 - RNA, 22 nt, Human
gcuggagugcagugagccgaga

SEQ ID NO: 1773153 - RNA, 11 nt, Human
gcugcuggcca

SEQ ID NO: 1773154 - RNA, 21 nt, Human
gcugcuggccaaauagcaaag

SEQ ID NO: 1773155 - RNA, 22 nt, Human
gcugcuggccaaauagcaaaga

SEQ ID NO: 1773156 - RNA, 17 nt, Human
ggacccuguugcuaagc

SEQ ID NO: 1773157 - RNA, 13 nt, Human
ggacccuguugcu

SEQ ID NO: 1773158 - RNA, 16 nt, Human
ggacggguuagacagc

SEQ ID NO: 1773159 - RNA, 15 nt, Human
ggacucaaugcacug

SEQ ID NO: 1773160 - RNA, 14 nt, Human
ggacuacaggugug

SEQ ID NO: 1773161 - RNA, 13 nt, Human
ggacgugggcugg

SEQ ID NO: 1773162 - RNA, 19 nt, Human
ggacuaaaagauauaagug

SEQ ID NO: 1773163 - RNA, 14 nt, Human
ggacuaaaagauau

SEQ ID NO: 1773164 - RNA, 12 nt, Human
ggacuaaaagau

SEQ ID NO: 1773165 - RNA, 16 nt, Human
ggacucaaugcacuga

SEQ ID NO: 1773166 - RNA, 18 nt, Human
ggacucaaugcacugaca

SEQ ID NO: 1773167 - RNA, 16 nt, Human
ggacucaggcgggaca

SEQ ID NO: 1773168 - RNA, 22 nt, Human
ggacucaggcgggacagugcug

SEQ ID NO: 1773169 - RNA, 14 nt, Human
ggacucaugaggag

SEQ ID NO: 1773170 - RNA, 22 nt, Human
ggagaaauacuugaacuugccu

SEQ ID NO: 1773171 - RNA, 14 nt, Human
ggacuuggaagcuc

SEQ ID NO: 1773172 - RNA, 16 nt, Human
ggacuccggcugugcu

SEQ ID NO: 1773173 - RNA, 17 nt, Human
ggacuccggcugugcug

SEQ ID NO: 1773174 - RNA, 23 nt, Human
ggacaggcauguucucugaggac

SEQ ID NO: 1773175 - RNA, 13 nt, Human
ggaacagaaauug

SEQ ID NO: 1773176 - RNA, 16 nt, Human
ggaacuguccuuuccu

SEQ ID NO: 1773177 - RNA, 15 nt, Human
ggaacuguuuccuuc

SEQ ID NO: 1773178 - RNA, 11 nt, Human
ggaagcuccgc

SEQ ID NO: 1773179 - RNA, 13 nt, Human
ggaagcuucuguc

SEQ ID NO: 1773180 - RNA, 13 nt, Human
ggaagcucuucuu

SEQ ID NO: 1773181 - RNA, 16 nt, Human
ggaauccagacccggc

SEQ ID NO: 1773182 - RNA, 24 nt, Human
ggaaucauuucuauuucuccucca

SEQ ID NO: 1773183 - RNA, 13 nt, Human
ggaaucagcuucu

SEQ ID NO: 1773184 - RNA, 14 nt, Human
ggaaucagcuucua

SEQ ID NO: 1773185 - RNA, 15 nt, Human
ggacaauaugugcca

SEQ ID NO: 1773186 - RNA, 19 nt, Human
ggacaaucaugaaauaugc

SEQ ID NO: 1773187 - RNA, 21 nt, Human
ggacaaucaugaaauaugcau

SEQ ID NO: 1773188 - RNA, 21 nt, Human
ggacacagcucuucuccaggc

SEQ ID NO: 1773189 - RNA, 15 nt, Human
ggacacagcucuucu

SEQ ID NO: 1773190 - RNA, 18 nt, Human
ggacacagcucuucucca

SEQ ID NO: 1773191 - RNA, 17 nt, Human
ggacacuaaccacgcug

SEQ ID NO: 1773192 - RNA, 22 nt, Human
ggacacuaaccacgcuggaccu

SEQ ID NO: 1773193 - RNA, 19 nt, Human
ggacagcuccuucuguccu

SEQ ID NO: 1773194 - RNA, 20 nt, Human
ggacagcuccuucuguccua

SEQ ID NO: 1773195 - RNA, 12 nt, Human
ggacagcugugu

SEQ ID NO: 1773196 - RNA, 20 nt, Human
gccuaggugacagagugaga

SEQ ID NO: 1773197 - RNA, 17 nt, Human
gccuagggcccccacag

SEQ ID NO: 1773198 - RNA, 19 nt, Human
gccuagugaaggcuucucu

SEQ ID NO: 1773199 - RNA, 22 nt, Human
gccuagugaaggcuucucucug

SEQ ID NO: 1773200 - RNA, 23 nt, Human
gccuagugaaggcuucucucugu

SEQ ID NO: 1773201 - RNA, 13 nt, Human
gccuaggugacag

SEQ ID NO: 1773202 - RNA, 14 nt, Human
gccuaggugacaga

SEQ ID NO: 1773203 - RNA, 15 nt, Human
gccuaggugacagag

SEQ ID NO: 1773204 - RNA, 22 nt, Human
gcccuuagcagggaaacagcua

SEQ ID NO: 1773205 - RNA, 15 nt, Human
gcccuuaucugugcu

SEQ ID NO: 1773206 - RNA, 16 nt, Human
gcccuuaucugugcuc

SEQ ID NO: 1773207 - RNA, 18 nt, Human
gcccuuaucugugcucag

SEQ ID NO: 1773208 - RNA, 20 nt, Human
gcccuuagcagggaaacagc

SEQ ID NO: 1773209 - RNA, 17 nt, Human
gccccugccacccuggg

SEQ ID NO: 1773210 - RNA, 16 nt, Human
gccccugccacccugg

SEQ ID NO: 1773211 - RNA, 19 nt, Human
gccccccaccccuggaaga

SEQ ID NO: 1773212 - RNA, 21 nt, Human
gccccccaccccuggaagagc

SEQ ID NO: 1773213 - RNA, 19 nt, Human
gccccccagccccgguggc

SEQ ID NO: 1773214 - RNA, 17 nt, Human
gcccguaaacacgccug

SEQ ID NO: 1773215 - RNA, 22 nt, Human
gcgaucuggguucacugcaacc

SEQ ID NO: 1773216 - RNA, 12 nt, Human
gcgaugggucag

SEQ ID NO: 1773217 - RNA, 22 nt, Human
gcgaugggucagguagggggga

SEQ ID NO: 1773218 - RNA, 17 nt, Human
gcgagcccugguggcag

SEQ ID NO: 1773219 - RNA, 15 nt, Human
gcgagcccugguggc

SEQ ID NO: 1773220 - RNA, 19 nt, Human
gcgaggagaugcuccuugg

SEQ ID NO: 1773221 - RNA, 20 nt, Human
gcgaggagaugcuccuuggg

SEQ ID NO: 1773222 - RNA, 15 nt, Human
gcgaggaggcuccag

SEQ ID NO: 1773223 - RNA, 16 nt, Human
gcgaggaggcuccaga

SEQ ID NO: 1773224 - RNA, 17 nt, Human
gcgaggaggcuccagag

SEQ ID NO: 1773225 - RNA, 18 nt, Human
gcgaggaggcuccagagg

SEQ ID NO: 1773226 - RNA, 15 nt, Human
gccuccaucagcuaa

SEQ ID NO: 1773227 - RNA, 17 nt, Human
gccucgaacuggcugca

SEQ ID NO: 1773228 - RNA, 19 nt, Human
gccuccugugugugcgccu

SEQ ID NO: 1773229 - RNA, 23 nt, Human
gccuccugugugugcgccuacag

SEQ ID NO: 1773230 - RNA, 16 nt, Human
gccucccaaagugcug

SEQ ID NO: 1773231 - RNA, 17 nt, Human
gccucccaaagugcugg

SEQ ID NO: 1773232 - RNA, 14 nt, Human
gccucuuggguuca

SEQ ID NO: 1773233 - RNA, 13 nt, Human
gccugcccaggcc

SEQ ID NO: 1773234 - RNA, 14 nt, Human
gccugcccaggccc

SEQ ID NO: 1773235 - RNA, 17 nt, Human
gccucuuucugucccuu

SEQ ID NO: 1773236 - RNA, 16 nt, Human
gccucuuuuaccugcu

SEQ ID NO: 1773237 - RNA, 17 nt, Human
gccucuuuuaccugcug

SEQ ID NO: 1773238 - RNA, 18 nt, Human
gccucuuuuaccugcugc

SEQ ID NO: 1773239 - RNA, 19 nt, Human
gccucuuuuaccugcugcu

SEQ ID NO: 1773240 - RNA, 20 nt, Human
gccucuuuuaccugcugcuu

SEQ ID NO: 1773241 - RNA, 22 nt, Human
gccucuuuuaccugcugcuucu

SEQ ID NO: 1773242 - RNA, 20 nt, Human
gccucgaacuggcugcaaag

SEQ ID NO: 1773243 - RNA, 22 nt, Human
gccucgaacuggcugcaaaggg

SEQ ID NO: 1773244 - RNA, 17 nt, Human
gccugccccaaacaaau

SEQ ID NO: 1773245 - RNA, 23 nt, Human
gccugccccaaacaaauaugcaa

SEQ ID NO: 1773246 - RNA, 22 nt, Human
gccugcccaggccccugccacc

SEQ ID NO: 1773247 - RNA, 19 nt, Human
gccucuuugucuaaaacaa

SEQ ID NO: 1773248 - RNA, 23 nt, Human
gccucuuugucuaaaacaauaaa

SEQ ID NO: 1773249 - RNA, 15 nt, Human
gccugcccaggcccc

SEQ ID NO: 1773250 - RNA, 17 nt, Human
gccugcccaggccccug

SEQ ID NO: 1773251 - RNA, 16 nt, Human
gcuaggccuggccaga

SEQ ID NO: 1773252 - RNA, 17 nt, Human
gcuaggccuggccagau

SEQ ID NO: 1773253 - RNA, 23 nt, Human
gcuaggccuggccagaugcacca

SEQ ID NO: 1773254 - RNA, 14 nt, Human
gcucaggugucccu

SEQ ID NO: 1773255 - RNA, 16 nt, Human
gcucaggugucccugc

SEQ ID NO: 1773256 - RNA, 17 nt, Human
gcucaggugucccugca

SEQ ID NO: 1773257 - RNA, 16 nt, Human
gcucaggacucagaag

SEQ ID NO: 1773258 - RNA, 22 nt, Human
gcucaggcuacuauagguccag

SEQ ID NO: 1773259 - RNA, 17 nt, Human
gcucacugcagccucaa

SEQ ID NO: 1773260 - RNA, 15 nt, Human
gcucacugcagccuc

SEQ ID NO: 1773261 - RNA, 16 nt, Human
gcucacugcagccuca

SEQ ID NO: 1773262 - RNA, 11 nt, Human
gcucacugcag

SEQ ID NO: 1773263 - RNA, 12 nt, Human
gcucacugcagc

SEQ ID NO: 1773264 - RNA, 13 nt, Human
gcucacugcagcc

SEQ ID NO: 1773265 - RNA, 14 nt, Human
gcucacugcagccu

SEQ ID NO: 1773266 - RNA, 14 nt, Human
gcuauugacaauaa

SEQ ID NO: 1773267 - RNA, 15 nt, Human
gcuauugacaauaaa

SEQ ID NO: 1773268 - RNA, 12 nt, Human
gcucaaaaucuu

SEQ ID NO: 1773269 - RNA, 15 nt, Human
gcucaaaaucuuucc

SEQ ID NO: 1773270 - RNA, 20 nt, Human
gcgggaggauguucugggac

SEQ ID NO: 1773271 - RNA, 21 nt, Human
gcgggaggauguucugggaca

SEQ ID NO: 1773272 - RNA, 22 nt, Human
gcgggaggauguucugggacac

SEQ ID NO: 1773273 - RNA, 20 nt, Human
gcgugcacacaccagagccc

SEQ ID NO: 1773274 - RNA, 13 nt, Human
gcuaaaaagcaac

SEQ ID NO: 1773275 - RNA, 14 nt, Human
gcuaaaaagcaaca

SEQ ID NO: 1773276 - RNA, 23 nt, Human
gcgugcacacaccagagcccacc

SEQ ID NO: 1773277 - RNA, 17 nt, Human
gcgugucaccugugcuu

SEQ ID NO: 1773278 - RNA, 23 nt, Human
gcuaagugauccucccaccucag

SEQ ID NO: 1773279 - RNA, 13 nt, Human
gcuaagugugaac

SEQ ID NO: 1773280 - RNA, 15 nt, Human
gcuaaugggacacua

SEQ ID NO: 1773281 - RNA, 22 nt, Human
gcuaauguugcuggaucaggaa

SEQ ID NO: 1773282 - RNA, 13 nt, Human
gcuaaugggacac

SEQ ID NO: 1773283 - RNA, 19 nt, Human
gcuccaccaagaaagcagg

SEQ ID NO: 1773284 - RNA, 17 nt, Human
gcuccugagggagcucc

SEQ ID NO: 1773285 - RNA, 19 nt, Human
gcuccugagggagcuccaa

SEQ ID NO: 1773286 - RNA, 20 nt, Human
gcuccccucugcacggacca

SEQ ID NO: 1773287 - RNA, 13 nt, Human
gcucccagccuca

SEQ ID NO: 1773288 - RNA, 14 nt, Human
gcucccagccucag

SEQ ID NO: 1773289 - RNA, 15 nt, Human
gcucccagccucagc

SEQ ID NO: 1773290 - RNA, 17 nt, Human
gcucccagccucagcgc

SEQ ID NO: 1773291 - RNA, 12 nt, Human
gcucccagccuc

SEQ ID NO: 1773292 - RNA, 20 nt, Human
gcuccagcucaccagcccca

SEQ ID NO: 1773293 - RNA, 21 nt, Human
gcuccagcucaccagccccag

SEQ ID NO: 1773294 - RNA, 18 nt, Human
gcuccagcucaccagccc

SEQ ID NO: 1773295 - RNA, 17 nt, Human
gcucgguacccggggcc

SEQ ID NO: 1773296 - RNA, 23 nt, Human
gcucgguacccggggcccagggc

SEQ ID NO: 1773297 - RNA, 24 nt, Human
gcucgguacccggggcccagggca

SEQ ID NO: 1773298 - RNA, 13 nt, Human
gcucugaucccuc

SEQ ID NO: 1773299 - RNA, 22 nt, Human
gcucugaucccucuacagagcu

SEQ ID NO: 1773300 - RNA, 23 nt, Human
gcucugaucccucuacagagcuu

SEQ ID NO: 1773301 - RNA, 23 nt, Human
gcucugaucauccacugugccau

SEQ ID NO: 1773302 - RNA, 17 nt, Human
gcucugaucauccacug

SEQ ID NO: 1773303 - RNA, 22 nt, Human
gcagcugcgguccacccaggag

SEQ ID NO: 1773304 - RNA, 23 nt, Human
gcagcugcgguccacccaggagc

SEQ ID NO: 1773305 - RNA, 13 nt, Human
gcagcugcuuuug

SEQ ID NO: 1773306 - RNA, 20 nt, Human
gcagcugcuuuugucuaugg

SEQ ID NO: 1773307 - RNA, 16 nt, Human
gcagcuugaggguugg

SEQ ID NO: 1773308 - RNA, 22 nt, Human
gcagggaaacagcuaaugggac

SEQ ID NO: 1773309 - RNA, 19 nt, Human
gcagcuugaggguugggcu

SEQ ID NO: 1773310 - RNA, 21 nt, Human
gcagcuugaggguugggcugg

SEQ ID NO: 1773311 - RNA, 16 nt, Human
gcauaacaauuccucu

SEQ ID NO: 1773312 - RNA, 17 nt, Human
gcauaacaauuccucua

SEQ ID NO: 1773313 - RNA, 14 nt, Human
gcagguucauggau

SEQ ID NO: 1773314 - RNA, 17 nt, Human
gcauccuggcacccggc

SEQ ID NO: 1773315 - RNA, 21 nt, Human
gcauccuggcacccggccccu

SEQ ID NO: 1773316 - RNA, 23 nt, Human
gcauccuuuaggguucugccucu

SEQ ID NO: 1773317 - RNA, 22 nt, Human
gcauccuggcacccggccccug

SEQ ID NO: 1773318 - RNA, 23 nt, Human
gcauccuggcacccggccccugc

SEQ ID NO: 1773319 - RNA, 14 nt, Human
gcaucggccuaggg

SEQ ID NO: 1773320 - RNA, 15 nt, Human
gcaucggccuagggc

SEQ ID NO: 1773321 - RNA, 15 nt, Human
gcaugugacucugaa

SEQ ID NO: 1773322 - RNA, 21 nt, Human
gcaugugacucugaagcugac

SEQ ID NO: 1773323 - RNA, 11 nt, Human
gcauuguaaau

SEQ ID NO: 1773324 - RNA, 12 nt, Human
gcauuguaaaua

SEQ ID NO: 1773325 - RNA, 15 nt, Human
gcauuguaucgaugu

SEQ ID NO: 1773326 - RNA, 19 nt, Human
gcauuguaucgauguuaug

SEQ ID NO: 1773327 - RNA, 20 nt, Human
gcaugugacucugaagcuga

SEQ ID NO: 1773328 - RNA, 16 nt, Human
gccaaccuauuuugaa

SEQ ID NO: 1773329 - RNA, 13 nt, Human
gcauuugaaugca

SEQ ID NO: 1773330 - RNA, 12 nt, Human
gcauuugaaugc

SEQ ID NO: 1773331 - RNA, 10 nt, Human
gcauuugaau

SEQ ID NO: 1773332 - RNA, 16 nt, Human
gcauuugaaugcauuu

SEQ ID NO: 1773333 - RNA, 15 nt, Human
gcauuugaaugcauu

SEQ ID NO: 1773334 - RNA, 15 nt, Human
gccaaccuauuuuga

SEQ ID NO: 1773335 - RNA, 17 nt, Human
gcacuaugcuuuccuuc

SEQ ID NO: 1773336 - RNA, 22 nt, Human
gcacuauagccuaggugacaga

SEQ ID NO: 1773337 - RNA, 12 nt, Human
gcaccuccugcc

SEQ ID NO: 1773338 - RNA, 18 nt, Human
gcaccuccacauccucca

SEQ ID NO: 1773339 - RNA, 15 nt, Human
gcaccuccagccuga

SEQ ID NO: 1773340 - RNA, 20 nt, Human
gcacacaccagagcccaccu

SEQ ID NO: 1773341 - RNA, 18 nt, Human
gcacacagaggggaguca

SEQ ID NO: 1773342 - RNA, 12 nt, Human
gcaauaaugcag

SEQ ID NO: 1773343 - RNA, 13 nt, Human
gcaauaaugcagu

SEQ ID NO: 1773344 - RNA, 14 nt, Human
gcaauaaugcagua

SEQ ID NO: 1773345 - RNA, 19 nt, Human
gcaauaaugcaguauggua

SEQ ID NO: 1773346 - RNA, 12 nt, Human
gcacacaccaga

SEQ ID NO: 1773347 - RNA, 14 nt, Human
gcacacaccagagc

SEQ ID NO: 1773348 - RNA, 15 nt, Human
gcacacaccagagcc

SEQ ID NO: 1773349 - RNA, 16 nt, Human
gcacacaccagagccc

SEQ ID NO: 1773350 - RNA, 17 nt, Human
gcacacaccagagccca

SEQ ID NO: 1773351 - RNA, 18 nt, Human
gcacacaccagagcccac

SEQ ID NO: 1773352 - RNA, 19 nt, Human
gcacacaccagagcccacc

SEQ ID NO: 1773353 - RNA, 18 nt, Human
gcaaccuccgccucuugg

SEQ ID NO: 1773354 - RNA, 12 nt, Human
gcaaaaccagaa

SEQ ID NO: 1773355 - RNA, 18 nt, Human
gcaacccccagccugcua

SEQ ID NO: 1773356 - RNA, 21 nt, Human
gauucuucugcuucagccucc

SEQ ID NO: 1773357 - RNA, 19 nt, Human
gauucuccugccucagccu

SEQ ID NO: 1773358 - RNA, 20 nt, Human
gauucuccugccucagccuc

SEQ ID NO: 1773359 - RNA, 21 nt, Human
gauucuccugccucagccucc

SEQ ID NO: 1773360 - RNA, 20 nt, Human
gauucuuucccaauucacau

SEQ ID NO: 1773361 - RNA, 17 nt, Human
gauuuaaguuacaaugu

SEQ ID NO: 1773362 - RNA, 20 nt, Human
gauuuaaguuacaauguuuu

SEQ ID NO: 1773363 - RNA, 20 nt, Human
gaucuggguucacugcaacc

SEQ ID NO: 1773364 - RNA, 18 nt, Human
gaucuggguucacugcaa

SEQ ID NO: 1773365 - RNA, 19 nt, Human
gaugagcucuacccagggc

SEQ ID NO: 1773366 - RNA, 20 nt, Human
gaugagcucuacccagggcc

SEQ ID NO: 1773367 - RNA, 11 nt, Human
gaugagcucua

SEQ ID NO: 1773368 - RNA, 16 nt, Human
gaugagcucuacccag

SEQ ID NO: 1773369 - RNA, 21 nt, Human
gaugauggucuucagccucuu

SEQ ID NO: 1773370 - RNA, 13 nt, Human
gaugauucaagcc

SEQ ID NO: 1773371 - RNA, 16 nt, Human
gaugauucaagccauu

SEQ ID NO: 1773372 - RNA, 19 nt, Human
gauguaccaugaaacaaag

SEQ ID NO: 1773373 - RNA, 21 nt, Human
gagaagcucucgggcuaggaa

SEQ ID NO: 1773374 - RNA, 21 nt, Human
gagcagugaaugauucagugu

SEQ ID NO: 1773375 - RNA, 18 nt, Human
gagcugugcaggugggga

SEQ ID NO: 1773376 - RNA, 20 nt, Human
gagcugccuguucagcucca

SEQ ID NO: 1773377 - RNA, 16 nt, Human
gagcugguggacccag

SEQ ID NO: 1773378 - RNA, 23 nt, Human
gagcugguggacccagggaacag

SEQ ID NO: 1773379 - RNA, 18 nt, Human
gagcuguauuaagccacu

SEQ ID NO: 1773380 - RNA, 17 nt, Human
gagcgcgccccuagccg

SEQ ID NO: 1773381 - RNA, 15 nt, Human
gagcugccuguucag

SEQ ID NO: 1773382 - RNA, 16 nt, Human
gagcugccuguucagc

SEQ ID NO: 1773383 - RNA, 19 nt, Human
gagcugccuguucagcucc

SEQ ID NO: 1773384 - RNA, 16 nt, Human
gagcgcgccccuagcc

SEQ ID NO: 1773385 - RNA, 18 nt, Human
gagcgaggagaugcuccu

SEQ ID NO: 1773386 - RNA, 21 nt, Human
gagcgaggagaugcuccuugg

SEQ ID NO: 1773387 - RNA, 13 nt, Human
gagccuucagccu

SEQ ID NO: 1773388 - RNA, 17 nt, Human
gagccuucagccuuaau

SEQ ID NO: 1773389 - RNA, 13 nt, Human
gagcccucagaac

SEQ ID NO: 1773390 - RNA, 22 nt, Human
gagucaucuguuagggccuugg

SEQ ID NO: 1773391 - RNA, 13 nt, Human
gagucauuugagu

SEQ ID NO: 1773392 - RNA, 18 nt, Human
gagucauuugagucucuu

SEQ ID NO: 1773393 - RNA, 22 nt, Human
gagugagacccagcccucaucc

SEQ ID NO: 1773394 - RNA, 23 nt, Human
gagugagacccagcccucauccc

SEQ ID NO: 1773395 - RNA, 14 nt, Human
gagugagacucugu

SEQ ID NO: 1773396 - RNA, 18 nt, Human
gagugagacucugucuca

SEQ ID NO: 1773397 - RNA, 18 nt, Human
gagugcagugagccgaga

SEQ ID NO: 1773398 - RNA, 14 nt, Human
gaggcuccagaggg

SEQ ID NO: 1773399 - RNA, 17 nt, Human
gaggcuccagagggcac

SEQ ID NO: 1773400 - RNA, 12 nt, Human
gaggggaacaga

SEQ ID NO: 1773401 - RNA, 16 nt, Human
gaggggaagcuucugu

SEQ ID NO: 1773402 - RNA, 14 nt, Human
gaggcugccuccca

SEQ ID NO: 1773403 - RNA, 15 nt, Human
gaggcugccucccaa

SEQ ID NO: 1773404 - RNA, 23 nt, Human
gaggcugccccaccccuccccau

SEQ ID NO: 1773405 - RNA, 16 nt, Human
gacagcuccuucuguc

SEQ ID NO: 1773406 - RNA, 18 nt, Human
gacagccugcagcaggaa

SEQ ID NO: 1773407 - RNA, 13 nt, Human
gacagcuccuucu

SEQ ID NO: 1773408 - RNA, 14 nt, Human
gacagcuccuucug

SEQ ID NO: 1773409 - RNA, 15 nt, Human
gacagcuccuucugu

SEQ ID NO: 1773410 - RNA, 20 nt, Human
gacacucuauaagauuccaa

SEQ ID NO: 1773411 - RNA, 21 nt, Human
gacacucuauaagauuccaaa

SEQ ID NO: 1773412 - RNA, 15 nt, Human
gacacucccuugggc

SEQ ID NO: 1773413 - RNA, 21 nt, Human
gacacucccuugggcucccug

SEQ ID NO: 1773414 - RNA, 14 nt, Human
gaccaguggucuca

SEQ ID NO: 1773415 - RNA, 17 nt, Human
gaccagucaaccugggc

SEQ ID NO: 1773416 - RNA, 18 nt, Human
gaccagucaaccugggca

SEQ ID NO: 1773417 - RNA, 16 nt, Human
gacccuaaaucuugac

SEQ ID NO: 1773418 - RNA, 12 nt, Human
gacccggcugcg

SEQ ID NO: 1773419 - RNA, 13 nt, Human
gacccggcugcgu

SEQ ID NO: 1773420 - RNA, 14 nt, Human
gacuuugcuccuca

SEQ ID NO: 1773421 - RNA, 14 nt, Human
gacucaaugcacug

SEQ ID NO: 1773422 - RNA, 17 nt, Human
gacucaaugcacugaca

SEQ ID NO: 1773423 - RNA, 22 nt, Human
gacugguguuaucaccgugggc

SEQ ID NO: 1773424 - RNA, 18 nt, Human
gacugucuccauggcccu

SEQ ID NO: 1773425 - RNA, 14 nt, Human
gacccucuaaccuc

SEQ ID NO: 1773426 - RNA, 18 nt, Human
gacccucuaaccucgccc

SEQ ID NO: 1773427 - RNA, 18 nt, Human
gaaccaccacacccagcc

SEQ ID NO: 1773428 - RNA, 20 nt, Human
gaaccaccacacccagccca

SEQ ID NO: 1773429 - RNA, 21 nt, Human
gaaccaccacacccagcccac

SEQ ID NO: 1773430 - RNA, 22 nt, Human
gaaccaccacacccagcccacu

SEQ ID NO: 1773431 - RNA, 15 nt, Human
gaaccaggcuuggaa

SEQ ID NO: 1773432 - RNA, 23 nt, Human
gaaccaccacacccagcccacuu

SEQ ID NO: 1773433 - RNA, 17 nt, Human
gaaccagccggggccuu

SEQ ID NO: 1773434 - RNA, 18 nt, Human
gaaccagccggggccuua

SEQ ID NO: 1773435 - RNA, 15 nt, Human
gaacuccuggccuca

SEQ ID NO: 1773436 - RNA, 14 nt, Human
gaacuccuggccuc

SEQ ID NO: 1773437 - RNA, 13 nt, Human
gaacuccuggccu

SEQ ID NO: 1773438 - RNA, 21 nt, Human
gaagacacugaugggcaaccc

SEQ ID NO: 1773439 - RNA, 16 nt, Human
gaagacacugaugggc

SEQ ID NO: 1773440 - RNA, 22 nt, Human
gaagaccauguggagacuucau

SEQ ID NO: 1773441 - RNA, 23 nt, Human
gaagcagcuaaaccaaggacuga

SEQ ID NO: 1773442 - RNA, 20 nt, Human
gaagcacaugcaccuaccca

SEQ ID NO: 1773443 - RNA, 13 nt, Human
gaagcacagcuuc

SEQ ID NO: 1773444 - RNA, 14 nt, Human
gaagcacagcuuca

SEQ ID NO: 1773445 - RNA, 17 nt, Human
gaagacucauucuucug

SEQ ID NO: 1773446 - RNA, 18 nt, Human
gaagacucauucuucugu

SEQ ID NO: 1773447 - RNA, 16 nt, Human
gaagacucauucuucu

SEQ ID NO: 1773448 - RNA, 21 nt, Human
gaacaaugugcuaugugaaga

SEQ ID NO: 1773449 - RNA, 15 nt, Human
gaaagggcccagaga

SEQ ID NO: 1773450 - RNA, 16 nt, Human
gaaagggcccagagag

SEQ ID NO: 1773451 - RNA, 13 nt, Human
gaaagggcccaga

SEQ ID NO: 1773452 - RNA, 17 nt, Human
gaaacaacucuuugaga

SEQ ID NO: 1773453 - RNA, 20 nt, Human
gaaacaacucuuugagaaac

SEQ ID NO: 1773454 - RNA, 16 nt, Human
gaaaauuauuugcaua

SEQ ID NO: 1773455 - RNA, 17 nt, Human
gaaaaaauaacacacau

SEQ ID NO: 1773456 - RNA, 15 nt, Human
gaaaagaaagaaguu

SEQ ID NO: 1773457 - RNA, 21 nt, Human
gaaaagaaagaaguuauuuuc

SEQ ID NO: 1773458 - RNA, 14 nt, Human
gaaaaugucuugug

SEQ ID NO: 1773459 - RNA, 15 nt, Human
gaaaauuauuugcau

SEQ ID NO: 1773460 - RNA, 15 nt, Human
cuugaaggcccugcu

SEQ ID NO: 1773461 - RNA, 17 nt, Human
cuugaaggcccugcuga

SEQ ID NO: 1773462 - RNA, 18 nt, Human
cuugaaggcccugcugag

SEQ ID NO: 1773463 - RNA, 21 nt, Human
cuugaaggcccugcugaguca

SEQ ID NO: 1773464 - RNA, 21 nt, Human
cuugaauuguaacuguucuug

SEQ ID NO: 1773465 - RNA, 22 nt, Human
cuugaauuguaacuguucuuga

SEQ ID NO: 1773466 - RNA, 17 nt, Human
cuugaauuguaacuguu

SEQ ID NO: 1773467 - RNA, 20 nt, Human
cuugaauuguaacuguucuu

SEQ ID NO: 1773468 - RNA, 12 nt, Human
cuuggccugggc

SEQ ID NO: 1773469 - RNA, 13 nt, Human
cuuggccugggcc

SEQ ID NO: 1773470 - RNA, 14 nt, Human
cuuggccugggccg

SEQ ID NO: 1773471 - RNA, 13 nt, Human
cuucuucaccauu

SEQ ID NO: 1773472 - RNA, 17 nt, Human
cuuccugaaacuauauu

SEQ ID NO: 1773473 - RNA, 20 nt, Human
cuucucacauuuauauuuuu

SEQ ID NO: 1773474 - RNA, 13 nt, Human
cuucucacauuua

SEQ ID NO: 1773475 - RNA, 18 nt, Human
cuuccugaaacuauauuu

SEQ ID NO: 1773476 - RNA, 19 nt, Human
cuuccugaaacuauauuuu

SEQ ID NO: 1773477 - RNA, 23 nt, Human
cuugucucaaugcucauaacgga

SEQ ID NO: 1773478 - RNA, 19 nt, Human
cuugucucaaugcucauaa

SEQ ID NO: 1773479 - RNA, 18 nt, Human
cuugucucaaugcucaua

SEQ ID NO: 1773480 - RNA, 17 nt, Human
cuugucucaaugcucau

SEQ ID NO: 1773481 - RNA, 16 nt, Human
cuugucucaaugcuca

SEQ ID NO: 1773482 - RNA, 14 nt, Human
cuugucucaaugcu

SEQ ID NO: 1773483 - RNA, 17 nt, Human
cuuucagcagacugauc

SEQ ID NO: 1773484 - RNA, 23 nt, Human
cuuuaaugucacaggcaggucca

SEQ ID NO: 1773485 - RNA, 14 nt, Human
cuuuacccucuuug

SEQ ID NO: 1773486 - RNA, 17 nt, Human
cuuuacccucuuugcug

SEQ ID NO: 1773487 - RNA, 19 nt, Human
cuuuacccucuuugcugca

SEQ ID NO: 1773488 - RNA, 22 nt, Human
cuuucaccccagggccugagcc

SEQ ID NO: 1773489 - RNA, 23 nt, Human
cuuucaccccagggccugagccu

SEQ ID NO: 1773490 - RNA, 15 nt, Human
cuuucuacccagcga

SEQ ID NO: 1773491 - RNA, 16 nt, Human
cuuucuacccagcgag

SEQ ID NO: 1773492 - RNA, 13 nt, Human
cuguagaaauggu

SEQ ID NO: 1773493 - RNA, 19 nt, Human
cuguagaaaugguuguauu

SEQ ID NO: 1773494 - RNA, 17 nt, Human
cuguagaaaugguugua

SEQ ID NO: 1773495 - RNA, 20 nt, Human
cuguagaaaugguuguauua

SEQ ID NO: 1773496 - RNA, 24 nt, Human
cuguaggguaauuaguaacaugug

SEQ ID NO: 1773497 - RNA, 15 nt, Human
cuguaaccucuucag

SEQ ID NO: 1773498 - RNA, 19 nt, Human
cuguaaccucuucagaggc

SEQ ID NO: 1773499 - RNA, 20 nt, Human
cuguaaccucuucagaggcc

SEQ ID NO: 1773500 - RNA, 22 nt, Human
cuguaaccucuucagaggcccu

SEQ ID NO: 1773501 - RNA, 23 nt, Human
cuguaaccucuucagaggcccuc

SEQ ID NO: 1773502 - RNA, 15 nt, Human
cugucgcccagucug

SEQ ID NO: 1773503 - RNA, 16 nt, Human
cugucgcccagucugg

SEQ ID NO: 1773504 - RNA, 14 nt, Human
cuguuagggccuug

SEQ ID NO: 1773505 - RNA, 15 nt, Human
cuguuagggccuugg

SEQ ID NO: 1773506 - RNA, 23 nt, Human
cuguguccugaaacgcuccuuug

SEQ ID NO: 1773507 - RNA, 11 nt, Human
cuuagcuucag

SEQ ID NO: 1773508 - RNA, 13 nt, Human
cuuagcuucagga

SEQ ID NO: 1773509 - RNA, 14 nt, Human
cuuagcuucaggaa

SEQ ID NO: 1773510 - RNA, 15 nt, Human
cuuagcuucaggaac

SEQ ID NO: 1773511 - RNA, 16 nt, Human
cuuagcuucaggaacc

SEQ ID NO: 1773512 - RNA, 18 nt, Human
cuuagcuucaggaaccuc

SEQ ID NO: 1773513 - RNA, 21 nt, Human
cuuacccaggugggucccggc

SEQ ID NO: 1773514 - RNA, 22 nt, Human
cuuagccauuuuucaaagcaau

SEQ ID NO: 1773515 - RNA, 17 nt, Human
cuguucaauguuuaaug

SEQ ID NO: 1773516 - RNA, 14 nt, Human
cuguuggcuggggg

SEQ ID NO: 1773517 - RNA, 19 nt, Human
cuguuggcugggggccuca

SEQ ID NO: 1773518 - RNA, 22 nt, Human
cuguuggcugggggccucagug

SEQ ID NO: 1773519 - RNA, 23 nt, Human
cuguugggguggguauaaaagau

SEQ ID NO: 1773520 - RNA, 22 nt, Human
cuguugggguggguauaaaaga

SEQ ID NO: 1773521 - RNA, 14 nt, Human
cuuacaaaaacacu

SEQ ID NO: 1773522 - RNA, 15 nt, Human
cuuacaaaaacacuu

SEQ ID NO: 1773523 - RNA, 14 nt, Human
cuuaaaacaacacu

SEQ ID NO: 1773524 - RNA, 11 nt, Human
cugggacacag

SEQ ID NO: 1773525 - RNA, 14 nt, Human
cugggacuuccaug

SEQ ID NO: 1773526 - RNA, 17 nt, Human
cugggacuuccaugccu

SEQ ID NO: 1773527 - RNA, 19 nt, Human
cugggacuuccaugccuua

SEQ ID NO: 1773528 - RNA, 15 nt, Human
cuggccguccuuguc

SEQ ID NO: 1773529 - RNA, 22 nt, Human
cuggggcagcacccuauaaauc

SEQ ID NO: 1773530 - RNA, 15 nt, Human
cuggguucacugcaa

SEQ ID NO: 1773531 - RNA, 18 nt, Human
cuggguucacugcaaccu

SEQ ID NO: 1773532 - RNA, 20 nt, Human
cuggguucacugcaaccucc

SEQ ID NO: 1773533 - RNA, 21 nt, Human
cuggacugaccugguccacag

SEQ ID NO: 1773534 - RNA, 14 nt, Human
cuggacugaccugg

SEQ ID NO: 1773535 - RNA, 14 nt, Human
cuggaagcacagcu

SEQ ID NO: 1773536 - RNA, 11 nt, Human
cuggaagagcc

SEQ ID NO: 1773537 - RNA, 14 nt, Human
cuggaagagcccag

SEQ ID NO: 1773538 - RNA, 15 nt, Human
cuggaagagcccagu

SEQ ID NO: 1773539 - RNA, 22 nt, Human
cuggaagagcccagucuguuga

SEQ ID NO: 1773540 - RNA, 21 nt, Human
cugcuuuugucuaugggacuc

SEQ ID NO: 1773541 - RNA, 20 nt, Human
cugcuuuugucuaugggacu

SEQ ID NO: 1773542 - RNA, 14 nt, Human
cugccucccuugac

SEQ ID NO: 1773543 - RNA, 14 nt, Human
cugcuagcuagcuc

SEQ ID NO: 1773544 - RNA, 18 nt, Human
cugcuagcuagcucaacu

SEQ ID NO: 1773545 - RNA, 20 nt, Human
cugcuagcuagcucaacuag

SEQ ID NO: 1773546 - RNA, 21 nt, Human
cugcuagcuagcucaacuagu

SEQ ID NO: 1773547 - RNA, 16 nt, Human
cugcucaucauucucu

SEQ ID NO: 1773548 - RNA, 17 nt, Human
cugcucaucauucucug

SEQ ID NO: 1773549 - RNA, 18 nt, Human
cugcucaucauucucugu

SEQ ID NO: 1773550 - RNA, 22 nt, Human
cugcucaucauucucugucuca

SEQ ID NO: 1773551 - RNA, 20 nt, Human
cugccuccccucuccuuccu

SEQ ID NO: 1773552 - RNA, 17 nt, Human
cugccuguucagcucca

SEQ ID NO: 1773553 - RNA, 18 nt, Human
cugccuguucagcuccag

SEQ ID NO: 1773554 - RNA, 19 nt, Human
cugccuguucagcuccagc

SEQ ID NO: 1773555 - RNA, 15 nt, Human
cugccuguagcccac

SEQ ID NO: 1773556 - RNA, 19 nt, Human
cugccuguagcccacucug

SEQ ID NO: 1773557 - RNA, 20 nt, Human
cugccuguagcccacucugc

SEQ ID NO: 1773558 - RNA, 22 nt, Human
cugccuguagcccacucugcuc

SEQ ID NO: 1773559 - RNA, 23 nt, Human
cugccuguagcccacucugcucg

SEQ ID NO: 1773560 - RNA, 15 nt, Human
gugaccaaugucuug

SEQ ID NO: 1773561 - RNA, 16 nt, Human
gugaccaaugucuuga

SEQ ID NO: 1773562 - RNA, 23 nt, Human
gugacagaggcagccccauucug

SEQ ID NO: 1773563 - RNA, 16 nt, Human
gugacagaggcagccc

SEQ ID NO: 1773564 - RNA, 18 nt, Human
gugacagaggcagcccca

SEQ ID NO: 1773565 - RNA, 19 nt, Human
gugacagaggcagccccau

SEQ ID NO: 1773566 - RNA, 17 nt, Human
gugaaggcuucucucug

SEQ ID NO: 1773567 - RNA, 22 nt, Human
gugaaggcuucucucuguggga

SEQ ID NO: 1773568 - RNA, 14 nt, Human
gugaaggcuucucu

SEQ ID NO: 1773569 - RNA, 14 nt, Human
gugaaggcuggcau

SEQ ID NO: 1773570 - RNA, 12 nt, Human
gugaaggcuggc

SEQ ID NO: 1773571 - RNA, 13 nt, Human
gugaaggcuggca

SEQ ID NO: 1773572 - RNA, 19 nt, Human
gugaagaucucacucugcc

SEQ ID NO: 1773573 - RNA, 16 nt, Human
aacuauauuuugucau

SEQ ID NO: 1773574 - RNA, 17 nt, Human
aacuauauuuugucaua

SEQ ID NO: 1773575 - RNA, 12 nt, Human
gugagagcuggg

SEQ ID NO: 1773576 - RNA, 17 nt, Human
gugagaauaggcagccc

SEQ ID NO: 1773577 - RNA, 12 nt, Human
gugaccccaggu

SEQ ID NO: 1773578 - RNA, 21 nt, Human
gugagcacuaaggugugcucu

SEQ ID NO: 1773579 - RNA, 13 nt, Human
gugagagcugggu

SEQ ID NO: 1773580 - RNA, 16 nt, Human
gugagaggggaacaga

SEQ ID NO: 1773581 - RNA, 15 nt, Human
gugagucgaggacag

SEQ ID NO: 1773582 - RNA, 19 nt, Human
gugaguccuagagcuacag

SEQ ID NO: 1773583 - RNA, 17 nt, Human
aacucugucuucaccug

SEQ ID NO: 1773584 - RNA, 20 nt, Human
aacucugucuucaccugauu

SEQ ID NO: 1773585 - RNA, 16 nt, Human
aacucuguggcauuau

SEQ ID NO: 1773586 - RNA, 23 nt, Human
aacucugucuucaccugauucaa

SEQ ID NO: 1773587 - RNA, 18 nt, Human
gucucuuuaaugucacag

SEQ ID NO: 1773588 - RNA, 19 nt, Human
gucucuuuaaugucacagg

SEQ ID NO: 1773589 - RNA, 20 nt, Human
gucucuuuaaugucacaggc

SEQ ID NO: 1773590 - RNA, 22 nt, Human
gucucuuuaaugucacaggcag

SEQ ID NO: 1773591 - RNA, 23 nt, Human
gucucuuuaaugucacaggcagg

SEQ ID NO: 1773592 - RNA, 13 nt, Human
gucucuuguaauc

SEQ ID NO: 1773593 - RNA, 21 nt, Human
gucugacaggcaaugcuggcu

SEQ ID NO: 1773594 - RNA, 22 nt, Human
gucugacaggcaaugcuggcug

SEQ ID NO: 1773595 - RNA, 23 nt, Human
gucugacaggcaaugcuggcugu

SEQ ID NO: 1773596 - RNA, 20 nt, Human
gucuucaccugauucaacua

SEQ ID NO: 1773597 - RNA, 14 nt, Human
gucuucagccucuu

SEQ ID NO: 1773598 - RNA, 15 nt, Human
gucuuccauuugcaa

SEQ ID NO: 1773599 - RNA, 22 nt, Human
gucuucagccucuuucuguccc

SEQ ID NO: 1773600 - RNA, 23 nt, Human
gucuucagccucuuucugucccu

SEQ ID NO: 1773601 - RNA, 14 nt, Human
gucuuccacaaaga

SEQ ID NO: 1773602 - RNA, 15 nt, Human
gucuuccacaaagaa

SEQ ID NO: 1773603 - RNA, 16 nt, Human
gucuuccacaaagaaa

SEQ ID NO: 1773604 - RNA, 17 nt, Human
gucuuccacaaagaaaa

SEQ ID NO: 1773605 - RNA, 19 nt, Human
gucuuccacaaagaaaauu

SEQ ID NO: 1773606 - RNA, 23 nt, Human
aaccuuagauguucuaagucuuu

SEQ ID NO: 1773607 - RNA, 18 nt, Human
aaccuuguuauuucucag

SEQ ID NO: 1773608 - RNA, 17 nt, Human
aaccuuguuauuucuca

SEQ ID NO: 1773609 - RNA, 23 nt, Human
gucgcccagucuggaaugcagug

SEQ ID NO: 1773610 - RNA, 13 nt, Human
gucgcccagucug

SEQ ID NO: 1773611 - RNA, 14 nt, Human
gucgcccagucugg

SEQ ID NO: 1773612 - RNA, 14 nt, Human
gucgaggacaggga

SEQ ID NO: 1773613 - RNA, 18 nt, Human
gucgacuucgggcuggcc

SEQ ID NO: 1773614 - RNA, 17 nt, Human
guccugaucagagccgu

SEQ ID NO: 1773615 - RNA, 21 nt, Human
guccuugucucugggccacuu

SEQ ID NO: 1773616 - RNA, 13 nt, Human
aaccacaucuugc

SEQ ID NO: 1773617 - RNA, 14 nt, Human
gucuccauggcccu

SEQ ID NO: 1773618 - RNA, 14 nt, Human
gucucaaugcucau

SEQ ID NO: 1773619 - RNA, 12 nt, Human
gucucaaugcuc

SEQ ID NO: 1773620 - RNA, 22 nt, Human
gucucaaacucuugaccucagg

SEQ ID NO: 1773621 - RNA, 14 nt, Human
gucuaugggacuca

SEQ ID NO: 1773622 - RNA, 15 nt, Human
gucuaugggacucaa

SEQ ID NO: 1773623 - RNA, 17 nt, Human
gucucaaugcucauaac

SEQ ID NO: 1773624 - RNA, 21 nt, Human
guagccucuccuguauuuaac

SEQ ID NO: 1773625 - RNA, 12 nt, Human
guagccugcugg

SEQ ID NO: 1773626 - RNA, 19 nt, Human
gucccaccuuggcugcagg

SEQ ID NO: 1773627 - RNA, 20 nt, Human
gucccaccuuggcugcaggg

SEQ ID NO: 1773628 - RNA, 17 nt, Human
gucccaccuuggcugca

SEQ ID NO: 1773629 - RNA, 18 nt, Human
gucccaccuuggcugcag

SEQ ID NO: 1773630 - RNA, 13 nt, Human
guccaugggcaga

SEQ ID NO: 1773631 - RNA, 14 nt, Human
guccaugggcagag

SEQ ID NO: 1773632 - RNA, 16 nt, Human
guccaugggcagagcc

SEQ ID NO: 1773633 - RNA, 18 nt, Human
guccaugggcagagccca

SEQ ID NO: 1773634 - RNA, 23 nt, Human
guccaugggcagagcccaaggga

SEQ ID NO: 1773635 - RNA, 22 nt, Human
guccgaaagggacuuggaagcu

SEQ ID NO: 1773636 - RNA, 14 nt, Human
gucccggcucugug

SEQ ID NO: 1773637 - RNA, 15 nt, Human
gucccggcucugugg

SEQ ID NO: 1773638 - RNA, 16 nt, Human
gucccggcucuguggg

SEQ ID NO: 1773639 - RNA, 17 nt, Human
gucccggcucugugggu

SEQ ID NO: 1773640 - RNA, 21 nt, Human
guccgaaagggacuuggaagc

SEQ ID NO: 1773641 - RNA, 13 nt, Human
gucccccucuguc

SEQ ID NO: 1773642 - RNA, 19 nt, Human
gucccccucuguccaggca

SEQ ID NO: 1773643 - RNA, 21 nt, Human
gucccccucuguccaggcacu

SEQ ID NO: 1773644 - RNA, 22 nt, Human
guccccucccagagcuggugga

SEQ ID NO: 1773645 - RNA, 14 nt, Human
aacauauggucucc

SEQ ID NO: 1773646 - RNA, 13 nt, Human
guccuacccaccc

SEQ ID NO: 1773647 - RNA, 20 nt, Human
aacagacuggaagcacagcu

SEQ ID NO: 1773648 - RNA, 17 nt, Human
aacagucuucaggcaaa

SEQ ID NO: 1773649 - RNA, 13 nt, Human
aacagguugggau

SEQ ID NO: 1773650 - RNA, 17 nt, Human
aacagguugggauggga

SEQ ID NO: 1773651 - RNA, 16 nt, Human
guggguauaaaagaug

SEQ ID NO: 1773652 - RNA, 9 nt, Human
gugggucag

SEQ ID NO: 1773653 - RNA, 14 nt, Human
gugggucagaaccc

SEQ ID NO: 1773654 - RNA, 18 nt, Human
guggguccaugggcagag

SEQ ID NO: 1773655 - RNA, 20 nt, Human
guggguccaugggcagagcc

SEQ ID NO: 1773656 - RNA, 22 nt, Human
guggguccaugggcagagccca

SEQ ID NO: 1773657 - RNA, 15 nt, Human
guggguauaaaagau

SEQ ID NO: 1773658 - RNA, 13 nt, Human
guggguauaaaag

SEQ ID NO: 1773659 - RNA, 12 nt, Human
guggguauaaaa

SEQ ID NO: 1773660 - RNA, 10 nt, Human
gugggggugg

SEQ ID NO: 1773661 - RNA, 23 nt, Human
guggugugucccccucuguccag

SEQ ID NO: 1773662 - RNA, 18 nt, Human
gugggucccggcucugug

SEQ ID NO: 1773663 - RNA, 16 nt, Human
gugggaugaaccagcc

SEQ ID NO: 1773664 - RNA, 17 nt, Human
gugggaugaaccagccg

SEQ ID NO: 1773665 - RNA, 23 nt, Human
guggcuucccuuuucuuuguuca

SEQ ID NO: 1773666 - RNA, 14 nt, Human
aagagcccagucug

SEQ ID NO: 1773667 - RNA, 18 nt, Human
aagagcccagucuguuga

SEQ ID NO: 1773668 - RNA, 23 nt, Human
aagagcccagucuguugaguuag

SEQ ID NO: 1773669 - RNA, 17 nt, Human
aagacucauucuucugu

SEQ ID NO: 1773670 - RNA, 16 nt, Human
aagaccccaagaggaa

SEQ ID NO: 1773671 - RNA, 17 nt, Human
gugugaggccagggcag

SEQ ID NO: 1773672 - RNA, 13 nt, Human
gugugagucacca

SEQ ID NO: 1773673 - RNA, 18 nt, Human
gugugagucaccaagccc

SEQ ID NO: 1773674 - RNA, 21 nt, Human
gugucuugcaauggcagccuu

SEQ ID NO: 1773675 - RNA, 12 nt, Human
gugugaggccag

SEQ ID NO: 1773676 - RNA, 14 nt, Human
gugugaggccaggg

SEQ ID NO: 1773677 - RNA, 15 nt, Human
gugugaggccagggc

SEQ ID NO: 1773678 - RNA, 19 nt, Human
gugucuugcaauggcagcc

SEQ ID NO: 1773679 - RNA, 20 nt, Human
gugucccaaaaagaaaggag

SEQ ID NO: 1773680 - RNA, 18 nt, Human
guguccacgacugucucc

SEQ ID NO: 1773681 - RNA, 15 nt, Human
gugugugugucagcu

SEQ ID NO: 1773682 - RNA, 13 nt, Human
aagcaaacccaga

SEQ ID NO: 1773683 - RNA, 16 nt, Human
aagcaaacccagacgg

SEQ ID NO: 1773684 - RNA, 19 nt, Human
aagcaaacccagacggcuc

SEQ ID NO: 1773685 - RNA, 12 nt, Human
gugcacacacca

SEQ ID NO: 1773686 - RNA, 14 nt, Human
gugcacacaccaga

SEQ ID NO: 1773687 - RNA, 14 nt, Human
aacugcagggaaaa

SEQ ID NO: 1773688 - RNA, 23 nt, Human
aacugcagggaaaauuauuugca

SEQ ID NO: 1773689 - RNA, 18 nt, Human
gugcacguacacacacau

SEQ ID NO: 1773690 - RNA, 17 nt, Human
gugcacacaccagagcc

SEQ ID NO: 1773691 - RNA, 13 nt, Human
aacuuggauucuc

SEQ ID NO: 1773692 - RNA, 14 nt, Human
aacuuggauucucu

SEQ ID NO: 1773693 - RNA, 15 nt, Human
aagaaaauuccuaua

SEQ ID NO: 1773694 - RNA, 23 nt, Human
aagaaaaucagauggagcaugaa

SEQ ID NO: 1773695 - RNA, 14 nt, Human
guggacacagcucu

SEQ ID NO: 1773696 - RNA, 15 nt, Human
guggacacagcucuu

SEQ ID NO: 1773697 - RNA, 17 nt, Human
guggacacagcucuucu

SEQ ID NO: 1773698 - RNA, 24 nt, Human
guggacacagcucuucuccaggcu

SEQ ID NO: 1773699 - RNA, 23 nt, Human
guggacuaaaagauauaagugcu

SEQ ID NO: 1773700 - RNA, 15 nt, Human
guggacuaaaagaua

SEQ ID NO: 1773701 - RNA, 21 nt, Human
gugcuguauaaaaucagccaa

SEQ ID NO: 1773702 - RNA, 17 nt, Human
gugcuguauaaaaucag

SEQ ID NO: 1773703 - RNA, 16 nt, Human
gugcuguauaaaauca

SEQ ID NO: 1773704 - RNA, 11 nt, Human
aagaagggcug

SEQ ID NO: 1773705 - RNA, 16 nt, Human
aagaagggcugcauga

SEQ ID NO: 1773706 - RNA, 20 nt, Human
aagaagggcugcaugauguu

SEQ ID NO: 1773707 - RNA, 21 nt, Human
aagaagggcugcaugauguuu

SEQ ID NO: 1773708 - RNA, 22 nt, Human
aagaagggcugcaugauguuug

SEQ ID NO: 1773709 - RNA, 16 nt, Human
gugcuggagcacuggg

SEQ ID NO: 1773710 - RNA, 17 nt, Human
gugcuggagcacugggc

SEQ ID NO: 1773711 - RNA, 19 nt, Human
gugcuggagcacugggcuc

SEQ ID NO: 1773712 - RNA, 22 nt, Human
gugcuggagcacugggcucccg

SEQ ID NO: 1773713 - RNA, 15 nt, Human
gugcuguauaaaauc

SEQ ID NO: 1773714 - RNA, 13 nt, Human
gugcuguauaaaa

SEQ ID NO: 1773715 - RNA, 14 nt, Human
guggcagcugcggu

SEQ ID NO: 1773716 - RNA, 18 nt, Human
guggacucagaaagccaa

SEQ ID NO: 1773717 - RNA, 19 nt, Human
guggcagcugcgguccacc

SEQ ID NO: 1773718 - RNA, 17 nt, Human
guggcagcugcggucca

SEQ ID NO: 1773719 - RNA, 17 nt, Human
aagaauguuacugccuu

SEQ ID NO: 1773720 - RNA, 18 nt, Human
aagaauguuacugccuua

SEQ ID NO: 1773721 - RNA, 19 nt, Human
aagaauguuacugccuuaa

SEQ ID NO: 1773722 - RNA, 20 nt, Human
aagaauguuacugccuuaau

SEQ ID NO: 1773723 - RNA, 13 nt, Human
aagaauuuuuaaa

SEQ ID NO: 1773724 - RNA, 13 nt, Human
aagaauuccaaag

SEQ ID NO: 1773725 - RNA, 14 nt, Human
aagaauuccaaagc

SEQ ID NO: 1773726 - RNA, 16 nt, Human
aagaauuccaaagcaa

SEQ ID NO: 1773727 - RNA, 17 nt, Human
aauaaaaaaugaaaaga

SEQ ID NO: 1773728 - RNA, 19 nt, Human
aauaaagguaugaaagggu

SEQ ID NO: 1773729 - RNA, 12 nt, Human
aauaaaaauaau

SEQ ID NO: 1773730 - RNA, 15 nt, Human
aauaacaauaaaaga

SEQ ID NO: 1773731 - RNA, 15 nt, Human
uaaauaguuaauaua

SEQ ID NO: 1773732 - RNA, 13 nt, Human
uaacaagccaccc

SEQ ID NO: 1773733 - RNA, 16 nt, Human
uaaauaauuuccuaca

SEQ ID NO: 1773734 - RNA, 22 nt, Human
uaaauaauuuccuacacaaaug

SEQ ID NO: 1773735 - RNA, 22 nt, Human
uaaauagguucuucuuguucug

SEQ ID NO: 1773736 - RNA, 22 nt, Human
uaaauaaauuguauauucacuu

SEQ ID NO: 1773737 - RNA, 21 nt, Human
uaaauaaauuguauauucacu

SEQ ID NO: 1773738 - RNA, 20 nt, Human
uaaauaaauuguauauucac

SEQ ID NO: 1773739 - RNA, 19 nt, Human
uaaauaaauuguauauuca

SEQ ID NO: 1773740 - RNA, 18 nt, Human
uaaauaaauuguauauuc

SEQ ID NO: 1773741 - RNA, 17 nt, Human
uaaauaaauuguauauu

SEQ ID NO: 1773742 - RNA, 16 nt, Human
uaaauaaauuguauau

SEQ ID NO: 1773743 - RNA, 15 nt, Human
uaaauaaauuguaua

SEQ ID NO: 1773744 - RNA, 14 nt, Human
uaaauaaauuguau

SEQ ID NO: 1773745 - RNA, 13 nt, Human
uaaacucugcauc

SEQ ID NO: 1773746 - RNA, 17 nt, Human
uaaacucugcauccaga

SEQ ID NO: 1773747 - RNA, 18 nt, Human
uaaacucugcauccagag

SEQ ID NO: 1773748 - RNA, 15 nt, Human
uaaacuccuuccugg

SEQ ID NO: 1773749 - RNA, 16 nt, Human
uaaacuccuuccuggc

SEQ ID NO: 1773750 - RNA, 20 nt, Human
uaaacuccuuccuggccuga

SEQ ID NO: 1773751 - RNA, 21 nt, Human
uaaacuccuuccuggccugag

SEQ ID NO: 1773752 - RNA, 23 nt, Human
uaaacuagcauaucugccuuuau

SEQ ID NO: 1773753 - RNA, 22 nt, Human
uaaacuagcauaucugccuuua

SEQ ID NO: 1773754 - RNA, 21 nt, Human
uaaacuagcauaucugccuuu

SEQ ID NO: 1773755 - RNA, 19 nt, Human
uaaacuagcauaucugccu

SEQ ID NO: 1773756 - RNA, 17 nt, Human
uaaacuagcauaucugc

SEQ ID NO: 1773757 - RNA, 11 nt, Human
uaaaccuaccu

SEQ ID NO: 1773758 - RNA, 23 nt, Human
uaaagauacagaacucuuucaaa

SEQ ID NO: 1773759 - RNA, 19 nt, Human
uaaagagagaacaggacua

SEQ ID NO: 1773760 - RNA, 15 nt, Human
uaaagacuaaguagc

SEQ ID NO: 1773761 - RNA, 12 nt, Human
uaaagaauacuu

SEQ ID NO: 1773762 - RNA, 13 nt, Human
uaaagaauacuug

SEQ ID NO: 1773763 - RNA, 14 nt, Human
uaaagaauacuuga

SEQ ID NO: 1773764 - RNA, 15 nt, Human
uaaagaauacuugaa

SEQ ID NO: 1773765 - RNA, 16 nt, Human
uaaagaauacuugaac

SEQ ID NO: 1773766 - RNA, 17 nt, Human
uaaagaauacuugaacu

SEQ ID NO: 1773767 - RNA, 18 nt, Human
uaaagaauacuugaacuu

SEQ ID NO: 1773768 - RNA, 19 nt, Human
uaaagaauacuugaacuug

SEQ ID NO: 1773769 - RNA, 20 nt, Human
uaaagaauacuugaacuugu

SEQ ID NO: 1773770 - RNA, 16 nt, Human
guuuuuuuucagccac

SEQ ID NO: 1773771 - RNA, 18 nt, Human
aaguguuuuguaccagug

SEQ ID NO: 1773772 - RNA, 19 nt, Human
uaaaauuuuuuuagaaagc

SEQ ID NO: 1773773 - RNA, 18 nt, Human
uaaaauuuuuuuagaaag

SEQ ID NO: 1773774 - RNA, 17 nt, Human
uaaaauuuuuuuagaaa

SEQ ID NO: 1773775 - RNA, 16 nt, Human
uaaaauuuuuuuagaa

SEQ ID NO: 1773776 - RNA, 21 nt, Human
uaaaauuuuuuuagaaagcau

SEQ ID NO: 1773777 - RNA, 20 nt, Human
uaaaauuuuuuuagaaagca

SEQ ID NO: 1773778 - RNA, 16 nt, Human
uaaaauuuuuuuucau

SEQ ID NO: 1773779 - RNA, 17 nt, Human
uaaaauuuuuuuucaug

SEQ ID NO: 1773780 - RNA, 19 nt, Human
uaaaauuuuuuuucauguu

SEQ ID NO: 1773781 - RNA, 20 nt, Human
uaaaauuuuuuuucauguuu

SEQ ID NO: 1773782 - RNA, 23 nt, Human
uaaaauuuuuuuucauguuuuaa

SEQ ID NO: 1773783 - RNA, 17 nt, Human
uaaaauguucacuuuug

SEQ ID NO: 1773784 - RNA, 22 nt, Human
uaaaauguucacuuuugacaaa

SEQ ID NO: 1773785 - RNA, 19 nt, Human
aaggguaucaggugcugcc

SEQ ID NO: 1773786 - RNA, 22 nt, Human
aaggcuggcgagagucuggccc

SEQ ID NO: 1773787 - RNA, 15 nt, Human
aagggcccagagagg

SEQ ID NO: 1773788 - RNA, 13 nt, Human
aagggcccagaga

SEQ ID NO: 1773789 - RNA, 20 nt, Human
aaggcuggcgagagucuggc

SEQ ID NO: 1773790 - RNA, 14 nt, Human
guugguuggauaag

SEQ ID NO: 1773791 - RNA, 18 nt, Human
guuucuaauaaacuugga

SEQ ID NO: 1773792 - RNA, 15 nt, Human
aaggguuaaggccug

SEQ ID NO: 1773793 - RNA, 16 nt, Human
aaggguuaaggccuga

SEQ ID NO: 1773794 - RNA, 14 nt, Human
guuuuaagaggcag

SEQ ID NO: 1773795 - RNA, 16 nt, Human
guuuuaagaggcaggg

SEQ ID NO: 1773796 - RNA, 17 nt, Human
guuugccucugccucug

SEQ ID NO: 1773797 - RNA, 21 nt, Human
aaguacuucuccacccugcuc

SEQ ID NO: 1773798 - RNA, 22 nt, Human
aaguacuucuccacccugcucu

SEQ ID NO: 1773799 - RNA, 23 nt, Human
aaguacuucuccacccugcucuc

SEQ ID NO: 1773800 - RNA, 15 nt, Human
aaguacuguaagaau

SEQ ID NO: 1773801 - RNA, 17 nt, Human
aaguacuguaagaauaa

SEQ ID NO: 1773802 - RNA, 19 nt, Human
aaguacuguaagaauaauu

SEQ ID NO: 1773803 - RNA, 22 nt, Human
aaguacuguaagaauaauuuau

SEQ ID NO: 1773804 - RNA, 13 nt, Human
aagucacacagug

SEQ ID NO: 1773805 - RNA, 24 nt, Human
aagucacacaguauuacuucugcu

SEQ ID NO: 1773806 - RNA, 16 nt, Human
aagucaaccugccuga

SEQ ID NO: 1773807 - RNA, 15 nt, Human
guuuuuguucaaagc

SEQ ID NO: 1773808 - RNA, 18 nt, Human
guuuuugguuuuuaaaac

SEQ ID NO: 1773809 - RNA, 22 nt, Human
guuuuuuguuggaguguuucua

SEQ ID NO: 1773810 - RNA, 18 nt, Human
aagugagaauaggcagcc

SEQ ID NO: 1773811 - RNA, 22 nt, Human
aagucuuauauauuguagauaa

SEQ ID NO: 1773812 - RNA, 14 nt, Human
guugcccaggcugg

SEQ ID NO: 1773813 - RNA, 13 nt, Human
aaggccugaauca

SEQ ID NO: 1773814 - RNA, 17 nt, Human
aaggccuuuaaaauuuu

SEQ ID NO: 1773815 - RNA, 16 nt, Human
aaggccuuuaaaauuu

SEQ ID NO: 1773816 - RNA, 15 nt, Human
aaggccuuuaaaauu

SEQ ID NO: 1773817 - RNA, 11 nt, Human
aaggccuuuaa

SEQ ID NO: 1773818 - RNA, 23 nt, Human
guugcucuaugcuuuccaaaccu

SEQ ID NO: 1773819 - RNA, 22 nt, Human
guugcuaagccccagcaagcaa

SEQ ID NO: 1773820 - RNA, 17 nt, Human
guugcuaagccccagca

SEQ ID NO: 1773821 - RNA, 13 nt, Human
guugcugaauagg

SEQ ID NO: 1773822 - RNA, 15 nt, Human
guugcccaggcuggc

SEQ ID NO: 1773823 - RNA, 16 nt, Human
aaggcuaaaaagcaac

SEQ ID NO: 1773824 - RNA, 17 nt, Human
aaggcuaaaaagcaaca

SEQ ID NO: 1773825 - RNA, 16 nt, Human
guugcccaggcuggcg

SEQ ID NO: 1773826 - RNA, 17 nt, Human
guugcccaggcuggcgu

SEQ ID NO: 1773827 - RNA, 17 nt, Human
guugggcuggugucacc

SEQ ID NO: 1773828 - RNA, 23 nt, Human
guugggguggguauaaaagaugg

SEQ ID NO: 1773829 - RNA, 18 nt, Human
guugguuuugacuucaga

SEQ ID NO: 1773830 - RNA, 21 nt, Human
guugggguggguauaaaagau

SEQ ID NO: 1773831 - RNA, 21 nt, Human
aaggaagucaaagcaaggaaa

SEQ ID NO: 1773832 - RNA, 19 nt, Human
aaggagacaggcagagcug

SEQ ID NO: 1773833 - RNA, 14 nt, Human
aaggagacaggcag

SEQ ID NO: 1773834 - RNA, 16 nt, Human
aaggagacaggcagag

SEQ ID NO: 1773835 - RNA, 15 nt, Human
aaggagccaguuugc

SEQ ID NO: 1773836 - RNA, 17 nt, Human
aaggagccccauuccug

SEQ ID NO: 1773837 - RNA, 19 nt, Human
aaggagccccauuccuggg

SEQ ID NO: 1773838 - RNA, 20 nt, Human
aaggagcccuuaucugugcu

SEQ ID NO: 1773839 - RNA, 23 nt, Human
aaggaggauuccauuuggcagag

SEQ ID NO: 1773840 - RNA, 13 nt, Human
aaggauaaugaau

SEQ ID NO: 1773841 - RNA, 13 nt, Human
aagcucugcuccu

SEQ ID NO: 1773842 - RNA, 23 nt, Human
guuccccucagaaaaaaauucau

SEQ ID NO: 1773843 - RNA, 19 nt, Human
aaggaaaaaauaacaauga

SEQ ID NO: 1773844 - RNA, 16 nt, Human
aaggaaaaaauaacaa

SEQ ID NO: 1773845 - RNA, 15 nt, Human
aagcuccgcaggacu

SEQ ID NO: 1773846 - RNA, 16 nt, Human
aagcuccgcaggacuu

SEQ ID NO: 1773847 - RNA, 19 nt, Human
guguuuauuaaaauucuga

SEQ ID NO: 1773848 - RNA, 20 nt, Human
guugauauuucgaaagcugc

SEQ ID NO: 1773849 - RNA, 19 nt, Human
guugagcaugacagccugc

SEQ ID NO: 1773850 - RNA, 21 nt, Human
guugagcaugacagccugcag

SEQ ID NO: 1773851 - RNA, 20 nt, Human
guugaauuuuguucucuggg

SEQ ID NO: 1773852 - RNA, 21 nt, Human
guugaauuuuguucucuggga

SEQ ID NO: 1773853 - RNA, 22 nt, Human
guugaauuuuguucucugggag

SEQ ID NO: 1773854 - RNA, 16 nt, Human
guucucugaggacacu

SEQ ID NO: 1773855 - RNA, 13 nt, Human
guuccccuuccac

SEQ ID NO: 1773856 - RNA, 15 nt, Human
uacccucuuugcugc

SEQ ID NO: 1773857 - RNA, 16 nt, Human
uacccucuuugcugca

SEQ ID NO: 1773858 - RNA, 19 nt, Human
uacccucuuugcugcagag

SEQ ID NO: 1773859 - RNA, 16 nt, Human
uacccugagcugaggc

SEQ ID NO: 1773860 - RNA, 17 nt, Human
uacccugagcugaggca

SEQ ID NO: 1773861 - RNA, 18 nt, Human
uacccugagcugaggcag

SEQ ID NO: 1773862 - RNA, 12 nt, Human
uacccugccucc

SEQ ID NO: 1773863 - RNA, 15 nt, Human
uaccaugaaacaaag

SEQ ID NO: 1773864 - RNA, 15 nt, Human
aaugucacaggcagg

SEQ ID NO: 1773865 - RNA, 13 nt, Human
aauguugcuggau

SEQ ID NO: 1773866 - RNA, 19 nt, Human
uacauguaaaacauuaucu

SEQ ID NO: 1773867 - RNA, 24 nt, Human
aaugguuguauuagauguucucua

SEQ ID NO: 1773868 - RNA, 23 nt, Human
aaugguuguauuagauguucucu

SEQ ID NO: 1773869 - RNA, 21 nt, Human
aaugguuguauuagauguucu

SEQ ID NO: 1773870 - RNA, 19 nt, Human
aaugguuguauuagauguu

SEQ ID NO: 1773871 - RNA, 14 nt, Human
uacaauaaauugcu

SEQ ID NO: 1773872 - RNA, 16 nt, Human
uacaauaaauugcuaa

SEQ ID NO: 1773873 - RNA, 22 nt, Human
uacaauaaauugcuaauguugc

SEQ ID NO: 1773874 - RNA, 23 nt, Human
uacaauaaauugcuaauguugcu

SEQ ID NO: 1773875 - RNA, 23 nt, Human
uacagauuuugauagcaaagcga

SEQ ID NO: 1773876 - RNA, 22 nt, Human
uacagauuuugauagcaaagcg

SEQ ID NO: 1773877 - RNA, 21 nt, Human
uacagauuuugauagcaaagc

SEQ ID NO: 1773878 - RNA, 18 nt, Human
uacagauuuugauagcaa

SEQ ID NO: 1773879 - RNA, 17 nt, Human
uacagauuuugauagca

SEQ ID NO: 1773880 - RNA, 16 nt, Human
uacagauuuugauagc

SEQ ID NO: 1773881 - RNA, 15 nt, Human
uacagauuuugauag

SEQ ID NO: 1773882 - RNA, 14 nt, Human
uacaccuugcuuuu

SEQ ID NO: 1773883 - RNA, 19 nt, Human
uacaccuugcuuuuuuacu

SEQ ID NO: 1773884 - RNA, 14 nt, Human
aaugucacaggcag

SEQ ID NO: 1773885 - RNA, 13 nt, Human
aaugucacaggca

SEQ ID NO: 1773886 - RNA, 13 nt, Human
uacauacacugua

SEQ ID NO: 1773887 - RNA, 19 nt, Human
aauguagaauauucagaca

SEQ ID NO: 1773888 - RNA, 20 nt, Human
aauguagaauauucagacaa

SEQ ID NO: 1773889 - RNA, 20 nt, Human
uacagucuuccauuugcaag

SEQ ID NO: 1773890 - RNA, 22 nt, Human
uacagucuuccauuugcaaggg

SEQ ID NO: 1773891 - RNA, 14 nt, Human
uacagucuuccaca

SEQ ID NO: 1773892 - RNA, 15 nt, Human
uacagucuuccacaa

SEQ ID NO: 1773893 - RNA, 18 nt, Human
uacagucuuccauuugca

SEQ ID NO: 1773894 - RNA, 19 nt, Human
uacagucuuccauuugcaa

SEQ ID NO: 1773895 - RNA, 16 nt, Human
aaugcaaauccuaugu

SEQ ID NO: 1773896 - RNA, 21 nt, Human
uaauuagugcuaagugugaac

SEQ ID NO: 1773897 - RNA, 12 nt, Human
aaugcacaaaca

SEQ ID NO: 1773898 - RNA, 21 nt, Human
uacaagccauucuaaggaaau

SEQ ID NO: 1773899 - RNA, 13 nt, Human
uacaaaaacacuu

SEQ ID NO: 1773900 - RNA, 23 nt, Human
uacaaaaacacuucguucgcaga

SEQ ID NO: 1773901 - RNA, 16 nt, Human
uacaagcgugagccac

SEQ ID NO: 1773902 - RNA, 18 nt, Human
uacaagcgugagccacug

SEQ ID NO: 1773903 - RNA, 19 nt, Human
uacaagcgugagccacugc

SEQ ID NO: 1773904 - RNA, 20 nt, Human
uacaagcgugagccacugca

SEQ ID NO: 1773905 - RNA, 21 nt, Human
uacaagcgugagccacugcac

SEQ ID NO: 1773906 - RNA, 18 nt, Human
uaaugaaguuugaauguu

SEQ ID NO: 1773907 - RNA, 17 nt, Human
uaaugaaguuugaaugu

SEQ ID NO: 1773908 - RNA, 16 nt, Human
uaaugaaguuugaaug

SEQ ID NO: 1773909 - RNA, 15 nt, Human
uaaugaaguuugaau

SEQ ID NO: 1773910 - RNA, 16 nt, Human
uaaugaagaaagugga

SEQ ID NO: 1773911 - RNA, 17 nt, Human
uaaugaagaaaguggaa

SEQ ID NO: 1773912 - RNA, 14 nt, Human
uaaucuuucaaacc

SEQ ID NO: 1773913 - RNA, 16 nt, Human
uaaucuuucaaaccag

SEQ ID NO: 1773914 - RNA, 19 nt, Human
uaaucuuucaaaccagcuu

SEQ ID NO: 1773915 - RNA, 21 nt, Human
uaaucuuucaaaccagcuuca

SEQ ID NO: 1773916 - RNA, 22 nt, Human
uaaugaagaaaguggaaaacaa

SEQ ID NO: 1773917 - RNA, 23 nt, Human
uaaugaagaaaguggaaaacaag

SEQ ID NO: 1773918 - RNA, 14 nt, Human
uaaugaaguuugaa

SEQ ID NO: 1773919 - RNA, 13 nt, Human
uaaugaaguuuga

SEQ ID NO: 1773920 - RNA, 16 nt, Human
uaaugucacaggcagg

SEQ ID NO: 1773921 - RNA, 17 nt, Human
uaaugucacaggcaggu

SEQ ID NO: 1773922 - RNA, 15 nt, Human
uaaugucacaggcag

SEQ ID NO: 1773923 - RNA, 22 nt, Human
aaucuugacuacagucaggaaa

SEQ ID NO: 1773924 - RNA, 21 nt, Human
uaaugugaaaaugguccagga

SEQ ID NO: 1773925 - RNA, 14 nt, Human
aaugaaaaaaugua

SEQ ID NO: 1773926 - RNA, 16 nt, Human
uaaucuugaauuguaa

SEQ ID NO: 1773927 - RNA, 22 nt, Human
uaaucuugaauuguaacuguuc

SEQ ID NO: 1773928 - RNA, 21 nt, Human
aauacagucuuccauuugcaa

SEQ ID NO: 1773929 - RNA, 16 nt, Human
aauacagucuuccaca

SEQ ID NO: 1773930 - RNA, 18 nt, Human
aauacagucuuccacaaa

SEQ ID NO: 1773931 - RNA, 21 nt, Human
aauacagucuuccacaaagaa

SEQ ID NO: 1773932 - RNA, 16 nt, Human
uagaagucacacagua

SEQ ID NO: 1773933 - RNA, 24 nt, Human
uagaagcgauuuaaguuacaaugu

SEQ ID NO: 1773934 - RNA, 16 nt, Human
uagaagcugcaguggu

SEQ ID NO: 1773935 - RNA, 18 nt, Human
uagacagccaaaggcugg

SEQ ID NO: 1773936 - RNA, 20 nt, Human
uagacagccaaaggcuggcg

SEQ ID NO: 1773937 - RNA, 22 nt, Human
uagaacuuggauguaccugccc

SEQ ID NO: 1773938 - RNA, 15 nt, Human
uagaacuucauggau

SEQ ID NO: 1773939 - RNA, 21 nt, Human
uagaacuucauggaucagauc

SEQ ID NO: 1773940 - RNA, 15 nt, Human
uagaagucacacagu

SEQ ID NO: 1773941 - RNA, 22 nt, Human
aauuuguaaaguugguuggaua

SEQ ID NO: 1773942 - RNA, 13 nt, Human
aauuuuuccuaug

SEQ ID NO: 1773943 - RNA, 17 nt, Human
aauuuuuuugagacaga

SEQ ID NO: 1773944 - RNA, 20 nt, Human
uagagcuguauuaagccacu

SEQ ID NO: 1773945 - RNA, 13 nt, Human
uagaggaaaagaa

SEQ ID NO: 1773946 - RNA, 18 nt, Human
uagcaugucgucaaagcu

SEQ ID NO: 1773947 - RNA, 21 nt, Human
uagcaugucgucaaagcugaa

SEQ ID NO: 1773948 - RNA, 12 nt, Human
acaacacucaca

SEQ ID NO: 1773949 - RNA, 12 nt, Human
acaagccagcca

SEQ ID NO: 1773950 - RNA, 12 nt, Human
acaagccacccc

SEQ ID NO: 1773951 - RNA, 20 nt, Human
acaagcgugagccacugcac

SEQ ID NO: 1773952 - RNA, 21 nt, Human
acaagcgugagccacugcacc

SEQ ID NO: 1773953 - RNA, 18 nt, Human
acaagcacuaaacaaaga

SEQ ID NO: 1773954 - RNA, 19 nt, Human
acaagcaaacccagacggc

SEQ ID NO: 1773955 - RNA, 15 nt, Human
uacugguuggcuccc

SEQ ID NO: 1773956 - RNA, 12 nt, Human
uacucuuuccua

SEQ ID NO: 1773957 - RNA, 13 nt, Human
uacucuuuccuau

SEQ ID NO: 1773958 - RNA, 14 nt, Human
uacgucugacaggc

SEQ ID NO: 1773959 - RNA, 18 nt, Human
aauucuugguugaggaaa

SEQ ID NO: 1773960 - RNA, 19 nt, Human
aauucuugguugaggaaac

SEQ ID NO: 1773961 - RNA, 20 nt, Human
aauucuugguugaggaaaca

SEQ ID NO: 1773962 - RNA, 21 nt, Human
aauucuugccaaauauaaaua

SEQ ID NO: 1773963 - RNA, 22 nt, Human
aauuuagaaaaagaacaugcag

SEQ ID NO: 1773964 - RNA, 11 nt, Human
aauuucuacua

SEQ ID NO: 1773965 - RNA, 15 nt, Human
aauuucuacuuugaa

SEQ ID NO: 1773966 - RNA, 16 nt, Human
aauuucuacuuugaag

SEQ ID NO: 1773967 - RNA, 17 nt, Human
aauuucuacuuugaagu

SEQ ID NO: 1773968 - RNA, 12 nt, Human
aauuucugugcc

SEQ ID NO: 1773969 - RNA, 19 nt, Human
aauuucugugcccuccuga

SEQ ID NO: 1773970 - RNA, 20 nt, Human
aauuucugugcccuccugac

SEQ ID NO: 1773971 - RNA, 13 nt, Human
aauuugagugcuc

SEQ ID NO: 1773972 - RNA, 15 nt, Human
aauugcuaauguugc

SEQ ID NO: 1773973 - RNA, 16 nt, Human
aauugcuaauguugcu

SEQ ID NO: 1773974 - RNA, 22 nt, Human
aauuguuuggggaugagaaagg

SEQ ID NO: 1773975 - RNA, 21 nt, Human
aauugugugugcucugcuuca

SEQ ID NO: 1773976 - RNA, 17 nt, Human
uauguuuuaagaggcag

SEQ ID NO: 1773977 - RNA, 19 nt, Human
uauguuuuaagaggcaggg

SEQ ID NO: 1773978 - RNA, 14 nt, Human
uauuaaauaaaaug

SEQ ID NO: 1773979 - RNA, 23 nt, Human
uauuaaauaaaaugcacaaaacu

SEQ ID NO: 1773980 - RNA, 15 nt, Human
uauuagagugucuuu

SEQ ID NO: 1773981 - RNA, 18 nt, Human
uauuagagugucuuucca

SEQ ID NO: 1773982 - RNA, 22 nt, Human
uauuagauguucucuaucauuu

SEQ ID NO: 1773983 - RNA, 21 nt, Human
uauuagauguucucuaucauu

SEQ ID NO: 1773984 - RNA, 17 nt, Human
uauuagauguucucuau

SEQ ID NO: 1773985 - RNA, 15 nt, Human
uauuagauguucucu

SEQ ID NO: 1773986 - RNA, 14 nt, Human
uauuagauguucuc

SEQ ID NO: 1773987 - RNA, 12 nt, Human
uauuagauguuc

SEQ ID NO: 1773988 - RNA, 15 nt, Human
uauucagacaaaaug

SEQ ID NO: 1773989 - RNA, 16 nt, Human
uauucagacaaaaugg

SEQ ID NO: 1773990 - RNA, 17 nt, Human
uauucagacaaaaugga

SEQ ID NO: 1773991 - RNA, 21 nt, Human
uauucagacaaaauggauaca

SEQ ID NO: 1773992 - RNA, 13 nt, Human
uauucaaauuccu

SEQ ID NO: 1773993 - RNA, 15 nt, Human
acaguauuacuucug

SEQ ID NO: 1773994 - RNA, 16 nt, Human
acaguauuacuucugc

SEQ ID NO: 1773995 - RNA, 17 nt, Human
acaguauuacuucugcu

SEQ ID NO: 1773996 - RNA, 19 nt, Human
acaguauuacuucugcuac

SEQ ID NO: 1773997 - RNA, 21 nt, Human
acaggcugggcuucaguggca

SEQ ID NO: 1773998 - RNA, 14 nt, Human
acaggcugggcuuc

SEQ ID NO: 1773999 - RNA, 17 nt, Human
acaggcugggcuucagu

SEQ ID NO: 1774000 - RNA, 22 nt, Human
acagggcacaccgggcacucag

SEQ ID NO: 1774001 - RNA, 15 nt, Human
acagggcaccugcca

SEQ ID NO: 1774002 - RNA, 17 nt, Human
acagggcaccugccacc

SEQ ID NO: 1774003 - RNA, 16 nt, Human
acaguuaaggaauaua

SEQ ID NO: 1774004 - RNA, 14 nt, Human
acagucuuccauuu

SEQ ID NO: 1774005 - RNA, 19 nt, Human
acagucuuccauuugcaag

SEQ ID NO: 1774006 - RNA, 13 nt, Human
acagucuuccaca

SEQ ID NO: 1774007 - RNA, 21 nt, Human
acagucuuccacaaagaaaau

SEQ ID NO: 1774008 - RNA, 20 nt, Human
acagugaaagaaaauaacaa

SEQ ID NO: 1774009 - RNA, 15 nt, Human
uauuguccauugucc

SEQ ID NO: 1774010 - RNA, 17 nt, Human
uauuguccauuguccaa

SEQ ID NO: 1774011 - RNA, 20 nt, Human
uauuguauuuauucaauaaa

SEQ ID NO: 1774012 - RNA, 18 nt, Human
uauuguauuuauucaaua

SEQ ID NO: 1774013 - RNA, 17 nt, Human
uauuguauuuauucaau

SEQ ID NO: 1774014 - RNA, 16 nt, Human
uauuguauuuauucaa

SEQ ID NO: 1774015 - RNA, 15 nt, Human
uauuguauuuauuca

SEQ ID NO: 1774016 - RNA, 10 nt, Human
uauuguauuu

SEQ ID NO: 1774017 - RNA, 18 nt, Human
uauuucaaauuggagcuu

SEQ ID NO: 1774018 - RNA, 14 nt, Human
uauuucaaauugga

SEQ ID NO: 1774019 - RNA, 23 nt, Human
uauuuaauuuuuuugagacagag

SEQ ID NO: 1774020 - RNA, 21 nt, Human
uauuuaauuagugcuaagugu

SEQ ID NO: 1774021 - RNA, 19 nt, Human
uauuuaauuagugcuaagu

SEQ ID NO: 1774022 - RNA, 18 nt, Human
uauuuaauuagugcuaag

SEQ ID NO: 1774023 - RNA, 17 nt, Human
uauuuaauuagugcuaa

SEQ ID NO: 1774024 - RNA, 16 nt, Human
uauuuaauuagugcua

SEQ ID NO: 1774025 - RNA, 14 nt, Human
uauuuaccaaaaau

SEQ ID NO: 1774026 - RNA, 18 nt, Human
uauuuaccaaaaauuuug

SEQ ID NO: 1774027 - RNA, 14 nt, Human
uauugacucugggu

SEQ ID NO: 1774028 - RNA, 15 nt, Human
uauugacucuggguc

SEQ ID NO: 1774029 - RNA, 20 nt, Human
uauugacucuggguccuucc

SEQ ID NO: 1774030 - RNA, 22 nt, Human
uauugacucuggguccuuccug

SEQ ID NO: 1774031 - RNA, 13 nt, Human
uauugacaauaaa

SEQ ID NO: 1774032 - RNA, 19 nt, Human
uauugacaauaaaauauua

SEQ ID NO: 1774033 - RNA, 20 nt, Human
uauugacaauaaaauauuau

SEQ ID NO: 1774034 - RNA, 21 nt, Human
uauugacaauaaaauauuauu

SEQ ID NO: 1774035 - RNA, 13 nt, Human
uauugaauuuuuc

SEQ ID NO: 1774036 - RNA, 15 nt, Human
uauugaauuuuuccu

SEQ ID NO: 1774037 - RNA, 18 nt, Human
uauugaauuuuuccuaug

SEQ ID NO: 1774038 - RNA, 22 nt, Human
uauugaauuuuuccuaugcuau

SEQ ID NO: 1774039 - RNA, 14 nt, Human
uauugaaagaauua

SEQ ID NO: 1774040 - RNA, 18 nt, Human
uauugaaagaauuauccu

SEQ ID NO: 1774041 - RNA, 13 nt, Human
uauugaaauauua

SEQ ID NO: 1774042 - RNA, 21 nt, Human
uauugaaauauuauagagagu

SEQ ID NO: 1774043 - RNA, 22 nt, Human
uauucuuucgaaagaagaaaau

SEQ ID NO: 1774044 - RNA, 20 nt, Human
uauucuugauuuauuugcuu

SEQ ID NO: 1774045 - RNA, 12 nt, Human
uauucucugagc

SEQ ID NO: 1774046 - RNA, 18 nt, Human
uauucucugagcugugca

SEQ ID NO: 1774047 - RNA, 19 nt, Human
uauucucugagcugugcag

SEQ ID NO: 1774048 - RNA, 16 nt, Human
uauucuguuggccagu

SEQ ID NO: 1774049 - RNA, 22 nt, Human
uauucugcucuauuauauaaac

SEQ ID NO: 1774050 - RNA, 20 nt, Human
acaguucaauucucauuugu

SEQ ID NO: 1774051 - RNA, 21 nt, Human
acaguucaaaauucuaaaugu

SEQ ID NO: 1774052 - RNA, 22 nt, Human
acaguucaaaauucuaaaugua

SEQ ID NO: 1774053 - RNA, 22 nt, Human
acaguucggugagcuacaaaug

SEQ ID NO: 1774054 - RNA, 19 nt, Human
acaguucggugagcuacaa

SEQ ID NO: 1774055 - RNA, 23 nt, Human
acaguucggugagcuacaaaugc

SEQ ID NO: 1774056 - RNA, 22 nt, Human
uauaagauuccaaaaagcacau

SEQ ID NO: 1774057 - RNA, 13 nt, Human
acaccuagccagc

SEQ ID NO: 1774058 - RNA, 22 nt, Human
acaccuagccagcugucaaggg

SEQ ID NO: 1774059 - RNA, 23 nt, Human
acaccuagccagcugucaagggc

SEQ ID NO: 1774060 - RNA, 19 nt, Human
uauaccaguauaauugagu

SEQ ID NO: 1774061 - RNA, 20 nt, Human
acacucccaagguuggagcc

SEQ ID NO: 1774062 - RNA, 21 nt, Human
acacucccaagguuggagccc

SEQ ID NO: 1774063 - RNA, 20 nt, Human
uauagccuaggugacagagu

SEQ ID NO: 1774064 - RNA, 17 nt, Human
acacccagcccccacau

SEQ ID NO: 1774065 - RNA, 21 nt, Human
acaccuacucuaucagagaaa

SEQ ID NO: 1774066 - RNA, 12 nt, Human
acacccagcccc

SEQ ID NO: 1774067 - RNA, 19 nt, Human
acacccagcccacuucugc

SEQ ID NO: 1774068 - RNA, 20 nt, Human
acacccagcccacuucugcc

SEQ ID NO: 1774069 - RNA, 21 nt, Human
acacccagcccacuucugcca

SEQ ID NO: 1774070 - RNA, 23 nt, Human
uauaaaagauggggucuguaaaa

SEQ ID NO: 1774071 - RNA, 22 nt, Human
uauaaaagauggggucuguaaa

SEQ ID NO: 1774072 - RNA, 21 nt, Human
uauaaaagauggggucuguaa

SEQ ID NO: 1774073 - RNA, 20 nt, Human
uauaaaagauggggucugua

SEQ ID NO: 1774074 - RNA, 11 nt, Human
uauaaaagaug

SEQ ID NO: 1774075 - RNA, 15 nt, Human
uaguucuguagaaau

SEQ ID NO: 1774076 - RNA, 14 nt, Human
uaguucuguagaaa

SEQ ID NO: 1774077 - RNA, 13 nt, Human
uaguucuguagaa

SEQ ID NO: 1774078 - RNA, 18 nt, Human
uaguucuguagaaauggu

SEQ ID NO: 1774079 - RNA, 16 nt, Human
uaguucuguagaaaug

SEQ ID NO: 1774080 - RNA, 21 nt, Human
acaaggaagucaaagcaagga

SEQ ID NO: 1774081 - RNA, 19 nt, Human
uagucagaauuagcugcuu

SEQ ID NO: 1774082 - RNA, 14 nt, Human
acagacuggaagca

SEQ ID NO: 1774083 - RNA, 16 nt, Human
acagacagacacacac

SEQ ID NO: 1774084 - RNA, 14 nt, Human
acacucccuugggc

SEQ ID NO: 1774085 - RNA, 23 nt, Human
acagacacaggcccggcuccagg

SEQ ID NO: 1774086 - RNA, 19 nt, Human
uaucaauauaauguuuuua

SEQ ID NO: 1774087 - RNA, 14 nt, Human
uauauuuacaaaug

SEQ ID NO: 1774088 - RNA, 15 nt, Human
uauauuuacaaaugg

SEQ ID NO: 1774089 - RNA, 18 nt, Human
uaucuccggcucccagcc

SEQ ID NO: 1774090 - RNA, 19 nt, Human
uaucuccggcucccagccu

SEQ ID NO: 1774091 - RNA, 20 nt, Human
uaucuccggcucccagccuc

SEQ ID NO: 1774092 - RNA, 21 nt, Human
acagagugagacucugucuca

SEQ ID NO: 1774093 - RNA, 16 nt, Human
uaucuccggcucccag

SEQ ID NO: 1774094 - RNA, 14 nt, Human
uaucuccggcuccc

SEQ ID NO: 1774095 - RNA, 20 nt, Human
acagaguuuucacucuuauu

SEQ ID NO: 1774096 - RNA, 18 nt, Human
acagaguuuucacucuua

SEQ ID NO: 1774097 - RNA, 15 nt, Human
acagccuccccugcc

SEQ ID NO: 1774098 - RNA, 17 nt, Human
acagccuccccugccag

SEQ ID NO: 1774099 - RNA, 18 nt, Human
acagccuccccugccagg

SEQ ID NO: 1774100 - RNA, 19 nt, Human
acagccuccccugccaggg

SEQ ID NO: 1774101 - RNA, 21 nt, Human
acagccuccccugccagggca

SEQ ID NO: 1774102 - RNA, 22 nt, Human
acagccuccccugccagggcag

SEQ ID NO: 1774103 - RNA, 21 nt, Human
uaugaucacggcucacugcag

SEQ ID NO: 1774104 - RNA, 23 nt, Human
uaugaucacggcucacugcagcc

SEQ ID NO: 1774105 - RNA, 14 nt, Human
uaugaucacggcuc

SEQ ID NO: 1774106 - RNA, 16 nt, Human
acagccuugucccccu

SEQ ID NO: 1774107 - RNA, 23 nt, Human
uauggccuaaauuuauuaaauaa

SEQ ID NO: 1774108 - RNA, 16 nt, Human
acucuuauugcccacg

SEQ ID NO: 1774109 - RNA, 19 nt, Human
acucuuauugcccacgcug

SEQ ID NO: 1774110 - RNA, 12 nt, Human
uccucaauccag

SEQ ID NO: 1774111 - RNA, 13 nt, Human
uccucaauccagc

SEQ ID NO: 1774112 - RNA, 14 nt, Human
uccucaauccagcu

SEQ ID NO: 1774113 - RNA, 15 nt, Human
uccucacacuuuugg

SEQ ID NO: 1774114 - RNA, 22 nt, Human
uccucacacuuuuggaaccaug

SEQ ID NO: 1774115 - RNA, 14 nt, Human
uccuccccucucuu

SEQ ID NO: 1774116 - RNA, 17 nt, Human
uccuccccucucuuguc

SEQ ID NO: 1774117 - RNA, 12 nt, Human
uccucuccccag

SEQ ID NO: 1774118 - RNA, 17 nt, Human
uccucccugacuuuucu

SEQ ID NO: 1774119 - RNA, 18 nt, Human
uccucccugacuuuucug

SEQ ID NO: 1774120 - RNA, 20 nt, Human
uccucccugacuuuucugug

SEQ ID NO: 1774121 - RNA, 13 nt, Human
acucucuucuucu

SEQ ID NO: 1774122 - RNA, 15 nt, Human
acucucuucuucuca

SEQ ID NO: 1774123 - RNA, 17 nt, Human
acucucuucuucucaua

SEQ ID NO: 1774124 - RNA, 18 nt, Human
acucugaaauaucccggg

SEQ ID NO: 1774125 - RNA, 12 nt, Human
acucugaagcug

SEQ ID NO: 1774126 - RNA, 23 nt, Human
acucugaagcugacgaacuucca

SEQ ID NO: 1774127 - RNA, 13 nt, Human
acucugcuuguua

SEQ ID NO: 1774128 - RNA, 15 nt, Human
acucugcauccagag

SEQ ID NO: 1774129 - RNA, 20 nt, Human
acucugcauccagagauuca

SEQ ID NO: 1774130 - RNA, 17 nt, Human
uccuaggccucaacucc

SEQ ID NO: 1774131 - RNA, 22 nt, Human
uccuaggccucaacuccuccca

SEQ ID NO: 1774132 - RNA, 23 nt, Human
uccuaggccucaacuccucccau

SEQ ID NO: 1774133 - RNA, 18 nt, Human
uccuagguaggguuuaau

SEQ ID NO: 1774134 - RNA, 15 nt, Human
acucuccaggggucc

SEQ ID NO: 1774135 - RNA, 23 nt, Human
acucuccagggguccuaggccuc

SEQ ID NO: 1774136 - RNA, 16 nt, Human
acucggggugcuuccu

SEQ ID NO: 1774137 - RNA, 20 nt, Human
acucggggugcuuccuugua

SEQ ID NO: 1774138 - RNA, 14 nt, Human
ucccuguaaccucu

SEQ ID NO: 1774139 - RNA, 18 nt, Human
ucccuguaaccucuucag

SEQ ID NO: 1774140 - RNA, 19 nt, Human
ucccuguaaccucuucaga

SEQ ID NO: 1774141 - RNA, 22 nt, Human
ucccuguaaccucuucagaggc

SEQ ID NO: 1774142 - RNA, 23 nt, Human
ucccuguaaccucuucagaggcc

SEQ ID NO: 1774143 - RNA, 15 nt, Human
uccuaaaacaaauag

SEQ ID NO: 1774144 - RNA, 14 nt, Human
acucaugaggaggg

SEQ ID NO: 1774145 - RNA, 21 nt, Human
ucccucaucugucccuccggg

SEQ ID NO: 1774146 - RNA, 16 nt, Human
ucccucaucugucccu

SEQ ID NO: 1774147 - RNA, 12 nt, Human
uccccucagcuc

SEQ ID NO: 1774148 - RNA, 16 nt, Human
uccccuccggacuggu

SEQ ID NO: 1774149 - RNA, 17 nt, Human
uccccuccggacuggug

SEQ ID NO: 1774150 - RNA, 18 nt, Human
uccccuccggacuggugc

SEQ ID NO: 1774151 - RNA, 19 nt, Human
uccccuccggacuggugcc

SEQ ID NO: 1774152 - RNA, 20 nt, Human
uccccuccggacuggugccc

SEQ ID NO: 1774153 - RNA, 21 nt, Human
uccccuccggacuggugcccu

SEQ ID NO: 1774154 - RNA, 15 nt, Human
ucccgaauagcuggg

SEQ ID NO: 1774155 - RNA, 16 nt, Human
ucccgaauagcuggga

SEQ ID NO: 1774156 - RNA, 12 nt, Human
ucccgcggugcc

SEQ ID NO: 1774157 - RNA, 18 nt, Human
ucccgaauagcugggacu

SEQ ID NO: 1774158 - RNA, 18 nt, Human
ucccuauuuuucucuccu

SEQ ID NO: 1774159 - RNA, 20 nt, Human
ucccuauuuuucucuccugu

SEQ ID NO: 1774160 - RNA, 21 nt, Human
ucccuauuuuucucuccuguc

SEQ ID NO: 1774161 - RNA, 22 nt, Human
ucccuauuuuucucuccugucc

SEQ ID NO: 1774162 - RNA, 19 nt, Human
acuauguugcccaggcagg

SEQ ID NO: 1774163 - RNA, 20 nt, Human
acuauguugcccaggcaggu

SEQ ID NO: 1774164 - RNA, 23 nt, Human
acuauguugcccaggcaggucuu

SEQ ID NO: 1774165 - RNA, 18 nt, Human
acuauguugcccaggcag

SEQ ID NO: 1774166 - RNA, 16 nt, Human
uccccaggcaccucac

SEQ ID NO: 1774167 - RNA, 17 nt, Human
acuauagccuaggugac

SEQ ID NO: 1774168 - RNA, 18 nt, Human
acuauagccuaggugaca

SEQ ID NO: 1774169 - RNA, 14 nt, Human
uccccaaauccgaa

SEQ ID NO: 1774170 - RNA, 19 nt, Human
uccccaaauccgaaccucc

SEQ ID NO: 1774171 - RNA, 16 nt, Human
ucccauagucccugcc

SEQ ID NO: 1774172 - RNA, 18 nt, Human
ucccauagucccugccac

SEQ ID NO: 1774173 - RNA, 13 nt, Human
ucccaguuuuguu

SEQ ID NO: 1774174 - RNA, 18 nt, Human
ucccauagauacucucuu

SEQ ID NO: 1774175 - RNA, 19 nt, Human
ucccauagauacucucuuc

SEQ ID NO: 1774176 - RNA, 21 nt, Human
ucccauagauacucucuucuu

SEQ ID NO: 1774177 - RNA, 15 nt, Human
acuacagucaggaaa

SEQ ID NO: 1774178 - RNA, 17 nt, Human
ucccaggugcagccaga

SEQ ID NO: 1774179 - RNA, 20 nt, Human
acguuuuuaauauaaagccu

SEQ ID NO: 1774180 - RNA, 11 nt, Human
acuaaaagaua

SEQ ID NO: 1774181 - RNA, 15 nt, Human
uccagcucaccagcc

SEQ ID NO: 1774182 - RNA, 14 nt, Human
uccagcucaccagc

SEQ ID NO: 1774183 - RNA, 13 nt, Human
acuaaccacgcug

SEQ ID NO: 1774184 - RNA, 23 nt, Human
acuacaggugugagucaccaagc

SEQ ID NO: 1774185 - RNA, 23 nt, Human
acuaaaagauauaagugcuguau

SEQ ID NO: 1774186 - RNA, 21 nt, Human
acuaaaagauauaagugcugu

SEQ ID NO: 1774187 - RNA, 20 nt, Human
acuaaaagauauaagugcug

SEQ ID NO: 1774188 - RNA, 19 nt, Human
acuaaaagauauaagugcu

SEQ ID NO: 1774189 - RNA, 16 nt, Human
acuaaaagauauaagu

SEQ ID NO: 1774190 - RNA, 22 nt, Human
acuggcugcaaaggguaucagg

SEQ ID NO: 1774191 - RNA, 19 nt, Human
acuggcgacacguagcagc

SEQ ID NO: 1774192 - RNA, 14 nt, Human
uccuuccugaaacu

SEQ ID NO: 1774193 - RNA, 23 nt, Human
uccuucauaugaaaggugccaug

SEQ ID NO: 1774194 - RNA, 22 nt, Human
uccuucaucaugaguucugcug

SEQ ID NO: 1774195 - RNA, 22 nt, Human
acugcucagaacuugcugcugu

SEQ ID NO: 1774196 - RNA, 13 nt, Human
acugccuuuagaa

SEQ ID NO: 1774197 - RNA, 19 nt, Human
acugccuuuagaaaauaua

SEQ ID NO: 1774198 - RNA, 14 nt, Human
acugcuugaggaaa

SEQ ID NO: 1774199 - RNA, 15 nt, Human
acugcuugaggaaaa

SEQ ID NO: 1774200 - RNA, 18 nt, Human
acugcuugaggaaaacaa

SEQ ID NO: 1774201 - RNA, 14 nt, Human
ucgaggacagggag

SEQ ID NO: 1774202 - RNA, 17 nt, Human
ucgaggacagggaggug

SEQ ID NO: 1774203 - RNA, 10 nt, Human
ucgaggccug

SEQ ID NO: 1774204 - RNA, 11 nt, Human
ucgaggccuga

SEQ ID NO: 1774205 - RNA, 12 nt, Human
ucgaggccugaa

SEQ ID NO: 1774206 - RNA, 15 nt, Human
ucgaggccugaagcc

SEQ ID NO: 1774207 - RNA, 22 nt, Human
ucgccuuagcacuaccacuccu

SEQ ID NO: 1774208 - RNA, 13 nt, Human
ucgcucccuccca

SEQ ID NO: 1774209 - RNA, 14 nt, Human
ucgcucccucccag

SEQ ID NO: 1774210 - RNA, 23 nt, Human
ucgccuuucccaggugcuacacc

SEQ ID NO: 1774211 - RNA, 12 nt, Human
ucgccuuuccuc

SEQ ID NO: 1774212 - RNA, 13 nt, Human
ucgccuuuccucu

SEQ ID NO: 1774213 - RNA, 21 nt, Human
ucgccuuuccucucuauauuu

SEQ ID NO: 1774214 - RNA, 23 nt, Human
uccuuuaguaaaacuccgaguga

SEQ ID NO: 1774215 - RNA, 19 nt, Human
uccuuuaggguucugccuc

SEQ ID NO: 1774216 - RNA, 20 nt, Human
uccuuuaggguucugccucu

SEQ ID NO: 1774217 - RNA, 13 nt, Human
uccuuccuggccu

SEQ ID NO: 1774218 - RNA, 14 nt, Human
uccuuccuggccug

SEQ ID NO: 1774219 - RNA, 15 nt, Human
uccuuccuggccuga

SEQ ID NO: 1774220 - RNA, 17 nt, Human
uccuuccuggccugaga

SEQ ID NO: 1774221 - RNA, 17 nt, Human
uccuuucaccccagggc

SEQ ID NO: 1774222 - RNA, 15 nt, Human
uccuuucaccacaug

SEQ ID NO: 1774223 - RNA, 18 nt, Human
uccuuucaccccagggcc

SEQ ID NO: 1774224 - RNA, 19 nt, Human
uccuuucaccccagggccu

SEQ ID NO: 1774225 - RNA, 21 nt, Human
uccuuucaccccagggccuga

SEQ ID NO: 1774226 - RNA, 14 nt, Human
ucgaacuggcugca

SEQ ID NO: 1774227 - RNA, 13 nt, Human
ucgaacuggcugc

SEQ ID NO: 1774228 - RNA, 15 nt, Human
ucgaacuggcugcaa

SEQ ID NO: 1774229 - RNA, 14 nt, Human
uccuuuccuccucu

SEQ ID NO: 1774230 - RNA, 19 nt, Human
acuguaagaauaauuuaua

SEQ ID NO: 1774231 - RNA, 20 nt, Human
acuguaagaauaauuuauag

SEQ ID NO: 1774232 - RNA, 22 nt, Human
acuguaagaauaauuuauagua

SEQ ID NO: 1774233 - RNA, 23 nt, Human
acuguaagaauaauuuauaguaa

SEQ ID NO: 1774234 - RNA, 20 nt, Human
acuggguacuuguggacaca

SEQ ID NO: 1774235 - RNA, 23 nt, Human
acuggguacuuguggacacagcu

SEQ ID NO: 1774236 - RNA, 19 nt, Human
acuggguacuuguggacac

SEQ ID NO: 1774237 - RNA, 12 nt, Human
ucgcuccugugu

SEQ ID NO: 1774238 - RNA, 15 nt, Human
ucgcucccucccagg

SEQ ID NO: 1774239 - RNA, 17 nt, Human
ucgcucccucccaggac

SEQ ID NO: 1774240 - RNA, 13 nt, Human
ucgcuccuguguc

SEQ ID NO: 1774241 - RNA, 12 nt, Human
acuguacagggg

SEQ ID NO: 1774242 - RNA, 16 nt, Human
acugcaaccuccgccu

SEQ ID NO: 1774243 - RNA, 22 nt, Human
acugcaaccuccgccucuuggg

SEQ ID NO: 1774244 - RNA, 13 nt, Human
acugcaaccuccg

SEQ ID NO: 1774245 - RNA, 14 nt, Human
acugcaaccuccgc

SEQ ID NO: 1774246 - RNA, 23 nt, Human
acugagggcagucgauagagcug

SEQ ID NO: 1774247 - RNA, 15 nt, Human
uccucuccccagcaa

SEQ ID NO: 1774248 - RNA, 12 nt, Human
acugagggcagu

SEQ ID NO: 1774249 - RNA, 19 nt, Human
uccugccucagccucccaa

SEQ ID NO: 1774250 - RNA, 21 nt, Human
uccugccucgaacuggcugca

SEQ ID NO: 1774251 - RNA, 20 nt, Human
uccugccucgaacuggcugc

SEQ ID NO: 1774252 - RNA, 21 nt, Human
uccugcuaccucccuugccuu

SEQ ID NO: 1774253 - RNA, 23 nt, Human
uccugcuaccucccuugccuuuc

SEQ ID NO: 1774254 - RNA, 18 nt, Human
uccugugugugcgccuac

SEQ ID NO: 1774255 - RNA, 13 nt, Human
uccugugugugcg

SEQ ID NO: 1774256 - RNA, 14 nt, Human
uccugugugugcgc

SEQ ID NO: 1774257 - RNA, 23 nt, Human
uccugugucuugcaauggcagcc

SEQ ID NO: 1774258 - RNA, 24 nt, Human
uccugugucuugcaauggcagccu

SEQ ID NO: 1774259 - RNA, 22 nt, Human
uccuguguguccaaaacugccu

SEQ ID NO: 1774260 - RNA, 12 nt, Human
uccuguguccug

SEQ ID NO: 1774261 - RNA, 10 nt, Human
acugcaggga

SEQ ID NO: 1774262 - RNA, 23 nt, Human
acugcagggaaaauuauuugcau

SEQ ID NO: 1774263 - RNA, 23 nt, Human
acugcagccucaaccuccugggc

SEQ ID NO: 1774264 - RNA, 19 nt, Human
acugcagccucaaccuccu

SEQ ID NO: 1774265 - RNA, 19 nt, Human
acugcagaaacccugagca

SEQ ID NO: 1774266 - RNA, 21 nt, Human
acugcagccucaaccuccugg

SEQ ID NO: 1774267 - RNA, 22 nt, Human
acugcagccucaaccuccuggg

SEQ ID NO: 1774268 - RNA, 16 nt, Human
uccugggcccucucug

SEQ ID NO: 1774269 - RNA, 17 nt, Human
uccugggcccucucugc

SEQ ID NO: 1774270 - RNA, 21 nt, Human
uccugggcccucucugcucug

SEQ ID NO: 1774271 - RNA, 23 nt, Human
uccugggcccucucugcucugcg

SEQ ID NO: 1774272 - RNA, 19 nt, Human
uccugugccuccaucagcu

SEQ ID NO: 1774273 - RNA, 23 nt, Human
uccuggguuuuguauucucugag

SEQ ID NO: 1774274 - RNA, 17 nt, Human
uccuggguuuuguauuc

SEQ ID NO: 1774275 - RNA, 20 nt, Human
uccuggguuuuguauucucu

SEQ ID NO: 1774276 - RNA, 21 nt, Human
uccuggguuuuguauucucug

SEQ ID NO: 1774277 - RNA, 22 nt, Human
uccuggguuuuguauucucuga

SEQ ID NO: 1774278 - RNA, 16 nt, Human
uccugucuuuacaaau

SEQ ID NO: 1774279 - RNA, 15 nt, Human
uccaaauaaaauguu

SEQ ID NO: 1774280 - RNA, 11 nt, Human
uccaagcuggu

SEQ ID NO: 1774281 - RNA, 17 nt, Human
uccaccaagaaagcagg

SEQ ID NO: 1774282 - RNA, 21 nt, Human
ucauuugagcagggcucagcg

SEQ ID NO: 1774283 - RNA, 15 nt, Human
ucauuugagucucuu

SEQ ID NO: 1774284 - RNA, 16 nt, Human
ucauuugagucucuua

SEQ ID NO: 1774285 - RNA, 19 nt, Human
ucauuugagcagggcucag

SEQ ID NO: 1774286 - RNA, 15 nt, Human
uccacugagggcagu

SEQ ID NO: 1774287 - RNA, 19 nt, Human
uccacguucugcucaucau

SEQ ID NO: 1774288 - RNA, 20 nt, Human
uccacguucugcucaucauu

SEQ ID NO: 1774289 - RNA, 21 nt, Human
uccacguucugcucaucauuc

SEQ ID NO: 1774290 - RNA, 14 nt, Human
uccagacccggcug

SEQ ID NO: 1774291 - RNA, 15 nt, Human
accugguccacaggg

SEQ ID NO: 1774292 - RNA, 16 nt, Human
accugguccacagggc

SEQ ID NO: 1774293 - RNA, 17 nt, Human
accugguccacagggca

SEQ ID NO: 1774294 - RNA, 18 nt, Human
accugguccacagggcac

SEQ ID NO: 1774295 - RNA, 16 nt, Human
accuggugcugccucu

SEQ ID NO: 1774296 - RNA, 16 nt, Human
accuugacagggcaca

SEQ ID NO: 1774297 - RNA, 15 nt, Human
accuugacagggcac

SEQ ID NO: 1774298 - RNA, 14 nt, Human
accuugacagggca

SEQ ID NO: 1774299 - RNA, 19 nt, Human
accuuccauggcucuuuuu

SEQ ID NO: 1774300 - RNA, 23 nt, Human
accuccuccccccuccucugaaa

SEQ ID NO: 1774301 - RNA, 19 nt, Human
ucauccacugugccaugug

SEQ ID NO: 1774302 - RNA, 21 nt, Human
ucauccacugugccaugugcc

SEQ ID NO: 1774303 - RNA, 23 nt, Human
ucauccacugugccaugugccag

SEQ ID NO: 1774304 - RNA, 13 nt, Human
ucaugagccugcu

SEQ ID NO: 1774305 - RNA, 14 nt, Human
ucaugagccugcug

SEQ ID NO: 1774306 - RNA, 16 nt, Human
ucaugagccugcugga

SEQ ID NO: 1774307 - RNA, 19 nt, Human
ucaugagccugcuggaagc

SEQ ID NO: 1774308 - RNA, 20 nt, Human
ucaugaggaggggccccccu

SEQ ID NO: 1774309 - RNA, 14 nt, Human
ucaugaggggagag

SEQ ID NO: 1774310 - RNA, 15 nt, Human
ucaugaguucugcug

SEQ ID NO: 1774311 - RNA, 16 nt, Human
ucauguuuuaacaaaa

SEQ ID NO: 1774312 - RNA, 18 nt, Human
ucauguuuuaacaaaaac

SEQ ID NO: 1774313 - RNA, 22 nt, Human
ucauguugcacacccacucagc

SEQ ID NO: 1774314 - RNA, 14 nt, Human
ucauuaaauuaccu

SEQ ID NO: 1774315 - RNA, 13 nt, Human
ucaugucuggcua

SEQ ID NO: 1774316 - RNA, 16 nt, Human
ucaugucuucucacaa

SEQ ID NO: 1774317 - RNA, 12 nt, Human
ucaugugugucc

SEQ ID NO: 1774318 - RNA, 16 nt, Human
ucauguguguccacga

SEQ ID NO: 1774319 - RNA, 21 nt, Human
ucauguguguccacgacuguc

SEQ ID NO: 1774320 - RNA, 23 nt, Human
ucauguguguccacgacugucuc

SEQ ID NO: 1774321 - RNA, 18 nt, Human
accucgcuggacucucag

SEQ ID NO: 1774322 - RNA, 13 nt, Human
accucgcccucuc

SEQ ID NO: 1774323 - RNA, 14 nt, Human
accucgcccucucc

SEQ ID NO: 1774324 - RNA, 15 nt, Human
accucgcccucuccu

SEQ ID NO: 1774325 - RNA, 14 nt, Human
accucgaguacugu

SEQ ID NO: 1774326 - RNA, 15 nt, Human
accucgaguacugug

SEQ ID NO: 1774327 - RNA, 16 nt, Human
accucgaguacugugg

SEQ ID NO: 1774328 - RNA, 18 nt, Human
accucgaguacugugggc

SEQ ID NO: 1774329 - RNA, 19 nt, Human
accucgaguacugugggca

SEQ ID NO: 1774330 - RNA, 22 nt, Human
accucgaguacugugggcaauu

SEQ ID NO: 1774331 - RNA, 14 nt, Human
accucgcuggacuc

SEQ ID NO: 1774332 - RNA, 16 nt, Human
accucgcuggacucuc

SEQ ID NO: 1774333 - RNA, 17 nt, Human
accucgcccucuccuuu

SEQ ID NO: 1774334 - RNA, 22 nt, Human
accucgcccucuccuuuguucc

SEQ ID NO: 1774335 - RNA, 17 nt, Human
ucauuggcuuuauccuc

SEQ ID NO: 1774336 - RNA, 16 nt, Human
ucauuggcuuuauccu

SEQ ID NO: 1774337 - RNA, 14 nt, Human
ucauuggcuuuauc

SEQ ID NO: 1774338 - RNA, 11 nt, Human
ucauuggcuuu

SEQ ID NO: 1774339 - RNA, 24 nt, Human
ucauuguaacacuguuuauugaaa

SEQ ID NO: 1774340 - RNA, 20 nt, Human
accucugaaacccuggacca

SEQ ID NO: 1774341 - RNA, 16 nt, Human
accucuaguagcugaa

SEQ ID NO: 1774342 - RNA, 20 nt, Human
ucauauguagccuucacaca

SEQ ID NO: 1774343 - RNA, 22 nt, Human
ucauauguagccuucacacaga

SEQ ID NO: 1774344 - RNA, 12 nt, Human
acccuuuuccag

SEQ ID NO: 1774345 - RNA, 20 nt, Human
accuccgccucuuggguuca

SEQ ID NO: 1774346 - RNA, 13 nt, Human
accuccccagccu

SEQ ID NO: 1774347 - RNA, 14 nt, Human
accuccccagccug

SEQ ID NO: 1774348 - RNA, 15 nt, Human
accuccccagccugc

SEQ ID NO: 1774349 - RNA, 16 nt, Human
accuccccagccugcg

SEQ ID NO: 1774350 - RNA, 17 nt, Human
accuccccagccugcgc

SEQ ID NO: 1774351 - RNA, 22 nt, Human
accuccccagccugcgccugcu

SEQ ID NO: 1774352 - RNA, 13 nt, Human
accuagccuuaga

SEQ ID NO: 1774353 - RNA, 13 nt, Human
accuagccagcug

SEQ ID NO: 1774354 - RNA, 16 nt, Human
accgugguaugucugc

SEQ ID NO: 1774355 - RNA, 17 nt, Human
accgugguaugucugcc

SEQ ID NO: 1774356 - RNA, 20 nt, Human
accgugguaugucugccaug

SEQ ID NO: 1774357 - RNA, 13 nt, Human
accgugucaagcu

SEQ ID NO: 1774358 - RNA, 14 nt, Human
accgugucaagcug

SEQ ID NO: 1774359 - RNA, 17 nt, Human
accgugucaagcugcuc

SEQ ID NO: 1774360 - RNA, 19 nt, Human
accgugucaagcugcucug

SEQ ID NO: 1774361 - RNA, 14 nt, Human
accgugggcucccu

SEQ ID NO: 1774362 - RNA, 16 nt, Human
accgugggcucccuga

SEQ ID NO: 1774363 - RNA, 14 nt, Human
acccccagccugcu

SEQ ID NO: 1774364 - RNA, 15 nt, Human
acccccagccugcua

SEQ ID NO: 1774365 - RNA, 16 nt, Human
acccaguccacaaaau

SEQ ID NO: 1774366 - RNA, 13 nt, Human
acccagguggguc

SEQ ID NO: 1774367 - RNA, 14 nt, Human
acccaggugggucc

SEQ ID NO: 1774368 - RNA, 16 nt, Human
acccaggugggucccg

SEQ ID NO: 1774369 - RNA, 18 nt, Human
acccaggugggucccggc

SEQ ID NO: 1774370 - RNA, 19 nt, Human
ucagaucuuaauauaaauu

SEQ ID NO: 1774371 - RNA, 20 nt, Human
ucagaucuuaauauaaauuc

SEQ ID NO: 1774372 - RNA, 21 nt, Human
ucagaucuuaauauaaauuca

SEQ ID NO: 1774373 - RNA, 24 nt, Human
ucagaucuuaauauaaauucacuu

SEQ ID NO: 1774374 - RNA, 13 nt, Human
ucagaagacacug

SEQ ID NO: 1774375 - RNA, 13 nt, Human
ucagaacuugcug

SEQ ID NO: 1774376 - RNA, 16 nt, Human
ucagaacuugcugcug

SEQ ID NO: 1774377 - RNA, 17 nt, Human
ucagaacuugcugcugu

SEQ ID NO: 1774378 - RNA, 18 nt, Human
ucagaacuugcugcuguc

SEQ ID NO: 1774379 - RNA, 19 nt, Human
ucagaacuugcugcugucu

SEQ ID NO: 1774380 - RNA, 14 nt, Human
ucagaacugugcca

SEQ ID NO: 1774381 - RNA, 15 nt, Human
ucagaacugugccac

SEQ ID NO: 1774382 - RNA, 18 nt, Human
ucagaacccuuggcuugc

SEQ ID NO: 1774383 - RNA, 20 nt, Human
ucagaacccuuggcuugccc

SEQ ID NO: 1774384 - RNA, 24 nt, Human
ucagaacccuuggcuugcccacgu

SEQ ID NO: 1774385 - RNA, 18 nt, Human
ucagaugauuuccccccu

SEQ ID NO: 1774386 - RNA, 21 nt, Human
ucagaugauuuccccccuccg

SEQ ID NO: 1774387 - RNA, 20 nt, Human
accccuucgcuccugugucu

SEQ ID NO: 1774388 - RNA, 15 nt, Human
acccuucaucuuccu

SEQ ID NO: 1774389 - RNA, 17 nt, Human
acccuucaucuuccugu

SEQ ID NO: 1774390 - RNA, 18 nt, Human
acccuucaucuuccugug

SEQ ID NO: 1774391 - RNA, 19 nt, Human
acccuucaucuuccugugu

SEQ ID NO: 1774392 - RNA, 20 nt, Human
acccuucaucuuccuguguc

SEQ ID NO: 1774393 - RNA, 21 nt, Human
acccuucaucuuccugugucc

SEQ ID NO: 1774394 - RNA, 20 nt, Human
acccucuggauucugaaucu

SEQ ID NO: 1774395 - RNA, 15 nt, Human
acccucuuugcugca

SEQ ID NO: 1774396 - RNA, 16 nt, Human
acccucuuugcugcag

SEQ ID NO: 1774397 - RNA, 20 nt, Human
acccucuuugcugcagagaa

SEQ ID NO: 1774398 - RNA, 21 nt, Human
ucaggccauauuaucaauguu

SEQ ID NO: 1774399 - RNA, 13 nt, Human
ucagguaacaggc

SEQ ID NO: 1774400 - RNA, 15 nt, Human
ucagguaacaggcag

SEQ ID NO: 1774401 - RNA, 16 nt, Human
ucagguaacaggcaga

SEQ ID NO: 1774402 - RNA, 19 nt, Human
accccuucgcuccuguguc

SEQ ID NO: 1774403 - RNA, 15 nt, Human
ucagcggggacagcu

SEQ ID NO: 1774404 - RNA, 16 nt, Human
ucagcggggacagcuc

SEQ ID NO: 1774405 - RNA, 17 nt, Human
ucagcggggacagcucc

SEQ ID NO: 1774406 - RNA, 18 nt, Human
ucagcggggacagcuccu

SEQ ID NO: 1774407 - RNA, 19 nt, Human
ucaggaaccucgaguacug

SEQ ID NO: 1774408 - RNA, 20 nt, Human
ucaggaaccucgaguacugu

SEQ ID NO: 1774409 - RNA, 21 nt, Human
ucaggaaccucgaguacugug

SEQ ID NO: 1774410 - RNA, 22 nt, Human
ucaggaaccucgaguacugugg

SEQ ID NO: 1774411 - RNA, 16 nt, Human
acccagcccacuucug

SEQ ID NO: 1774412 - RNA, 17 nt, Human
acccagcccacuucugc

SEQ ID NO: 1774413 - RNA, 18 nt, Human
acccagcccacuucugcc

SEQ ID NO: 1774414 - RNA, 13 nt, Human
ucagaacccugcc

SEQ ID NO: 1774415 - RNA, 16 nt, Human
ucagaacccugccaug

SEQ ID NO: 1774416 - RNA, 17 nt, Human
ucagaacccugccaugg

SEQ ID NO: 1774417 - RNA, 21 nt, Human
ucagaacccugccauggaacu

SEQ ID NO: 1774418 - RNA, 15 nt, Human
ucagaacccuuggcu

SEQ ID NO: 1774419 - RNA, 16 nt, Human
ucagaacccuuggcuu

SEQ ID NO: 1774420 - RNA, 18 nt, Human
acccaagaccucagggca

SEQ ID NO: 1774421 - RNA, 19 nt, Human
acccaagaccucagggcac

SEQ ID NO: 1774422 - RNA, 23 nt, Human
accauuuugggguacccacugcu

SEQ ID NO: 1774423 - RNA, 16 nt, Human
ucacuguugcccaggc

SEQ ID NO: 1774424 - RNA, 13 nt, Human
ucacugcagccuc

SEQ ID NO: 1774425 - RNA, 12 nt, Human
ucacugcagccu

SEQ ID NO: 1774426 - RNA, 19 nt, Human
ucacuguugcccaggcugg

SEQ ID NO: 1774427 - RNA, 17 nt, Human
ucacuguugcccaggcu

SEQ ID NO: 1774428 - RNA, 18 nt, Human
ucacuguugcccaggcug

SEQ ID NO: 1774429 - RNA, 17 nt, Human
accagugaauuuuugca

SEQ ID NO: 1774430 - RNA, 18 nt, Human
accagugaauuuuugcaa

SEQ ID NO: 1774431 - RNA, 19 nt, Human
accagugaauuuuugcaau

SEQ ID NO: 1774432 - RNA, 21 nt, Human
accagugaauuuuugcaauaa

SEQ ID NO: 1774433 - RNA, 22 nt, Human
accagugaauuuuugcaauaau

SEQ ID NO: 1774434 - RNA, 12 nt, Human
accaguggucuc

SEQ ID NO: 1774435 - RNA, 17 nt, Human
accaguggucucacaug

SEQ ID NO: 1774436 - RNA, 23 nt, Human
accagcgaggaggcuccagaggg

SEQ ID NO: 1774437 - RNA, 19 nt, Human
ucaccugaagacucauucu

SEQ ID NO: 1774438 - RNA, 23 nt, Human
ucaccugaagacucauucuucug

SEQ ID NO: 1774439 - RNA, 22 nt, Human
ucaccugagcaggaccucugaa

SEQ ID NO: 1774440 - RNA, 19 nt, Human
accagagcccaccuuggcu

SEQ ID NO: 1774441 - RNA, 22 nt, Human
accagagcccaccuuggcucaa

SEQ ID NO: 1774442 - RNA, 22 nt, Human
accagacaccuugacagggcac

SEQ ID NO: 1774443 - RNA, 23 nt, Human
accagacaccuugacagggcaca

SEQ ID NO: 1774444 - RNA, 17 nt, Human
accagacaccuugacag

SEQ ID NO: 1774445 - RNA, 16 nt, Human
accacaucuugcucug

SEQ ID NO: 1774446 - RNA, 20 nt, Human
accacaucuugcucugcuga

SEQ ID NO: 1774447 - RNA, 21 nt, Human
accacaucuugcucugcugac

SEQ ID NO: 1774448 - RNA, 24 nt, Human
accacaucuugcucugcugacaga

SEQ ID NO: 1774449 - RNA, 14 nt, Human
accacaucuugcuc

SEQ ID NO: 1774450 - RNA, 17 nt, Human
uauuucaguguuaccug

SEQ ID NO: 1774451 - RNA, 18 nt, Human
uauuucaguguuaccugu

SEQ ID NO: 1774452 - RNA, 19 nt, Human
uauuucaguguuaccugug

SEQ ID NO: 1774453 - RNA, 20 nt, Human
uauuucaguguuaccugugu

SEQ ID NO: 1774454 - RNA, 16 nt, Human
ugaggggagaggagac

SEQ ID NO: 1774455 - RNA, 11 nt, Human
ugagggcaguc

SEQ ID NO: 1774456 - RNA, 13 nt, Human
ugagggccugcug

SEQ ID NO: 1774457 - RNA, 15 nt, Human
ugagggccugcugga

SEQ ID NO: 1774458 - RNA, 18 nt, Human
ugagggccugcuggaggc

SEQ ID NO: 1774459 - RNA, 19 nt, Human
ugagggccugcuggaggcc

SEQ ID NO: 1774460 - RNA, 20 nt, Human
ugagggccugcuggaggccu

SEQ ID NO: 1774461 - RNA, 21 nt, Human
ugagggccugcuggaggccuc

SEQ ID NO: 1774462 - RNA, 22 nt, Human
ugagggccugcuggaggccuca

SEQ ID NO: 1774463 - RNA, 23 nt, Human
ugaggggucgacuucgggcuggc

SEQ ID NO: 1774464 - RNA, 17 nt, Human
ugaggucagagccugca

SEQ ID NO: 1774465 - RNA, 14 nt, Human
ugaggucagagccu

SEQ ID NO: 1774466 - RNA, 16 nt, Human
ugaggucagagccugc

SEQ ID NO: 1774467 - RNA, 13 nt, Human
ugaggucagagcc

SEQ ID NO: 1774468 - RNA, 20 nt, Human
ugaggguugggcugguguca

SEQ ID NO: 1774469 - RNA, 14 nt, Human
agcagaggggcuga

SEQ ID NO: 1774470 - RNA, 13 nt, Human
ugaggccagggca

SEQ ID NO: 1774471 - RNA, 14 nt, Human
ugaggccagggcag

SEQ ID NO: 1774472 - RNA, 15 nt, Human
ugaggccagggcaga

SEQ ID NO: 1774473 - RNA, 16 nt, Human
ugaggccagggcagag

SEQ ID NO: 1774474 - RNA, 21 nt, Human
ugaggacacuaaccacgcugg

SEQ ID NO: 1774475 - RNA, 21 nt, Human
ugaggaauccagacccggcug

SEQ ID NO: 1774476 - RNA, 22 nt, Human
ugaggaauccagacccggcugc

SEQ ID NO: 1774477 - RNA, 16 nt, Human
ugagcuacaaaugcau

SEQ ID NO: 1774478 - RNA, 14 nt, Human
ugagcuacaaaugc

SEQ ID NO: 1774479 - RNA, 13 nt, Human
ugagcuacaaaug

SEQ ID NO: 1774480 - RNA, 22 nt, Human
ugagcgaggagaugcuccuugg

SEQ ID NO: 1774481 - RNA, 23 nt, Human
ugagcgaggagaugcuccuuggg

SEQ ID NO: 1774482 - RNA, 22 nt, Human
ugaggaaagucauuggcuuuau

SEQ ID NO: 1774483 - RNA, 21 nt, Human
ugaggaaagucauuggcuuua

SEQ ID NO: 1774484 - RNA, 19 nt, Human
ugaggaaagucauuggcuu

SEQ ID NO: 1774485 - RNA, 18 nt, Human
ugaggaaagucauuggcu

SEQ ID NO: 1774486 - RNA, 17 nt, Human
ugaggaaagucauuggc

SEQ ID NO: 1774487 - RNA, 15 nt, Human
ugaggaaagucauug

SEQ ID NO: 1774488 - RNA, 21 nt, Human
agcagagaaugaaagggccca

SEQ ID NO: 1774489 - RNA, 16 nt, Human
agcagacugaucagga

SEQ ID NO: 1774490 - RNA, 17 nt, Human
agcagacugaucaggac

SEQ ID NO: 1774491 - RNA, 18 nt, Human
agcagacugaucaggacc

SEQ ID NO: 1774492 - RNA, 19 nt, Human
agcagacugaucaggaccu

SEQ ID NO: 1774493 - RNA, 22 nt, Human
agcagagaaugaaagggcccag

SEQ ID NO: 1774494 - RNA, 23 nt, Human
agcagagaaugaaagggcccaga

SEQ ID NO: 1774495 - RNA, 11 nt, Human
ugagccuggcc

SEQ ID NO: 1774496 - RNA, 12 nt, Human
ugagccuggcca

SEQ ID NO: 1774497 - RNA, 16 nt, Human
ugagccuggccagccu

SEQ ID NO: 1774498 - RNA, 22 nt, Human
agcaccugucuccuuucacccc

SEQ ID NO: 1774499 - RNA, 21 nt, Human
agcacuuguggguuuuuguuu

SEQ ID NO: 1774500 - RNA, 22 nt, Human
agcaagugagagcuggguguca

SEQ ID NO: 1774501 - RNA, 13 nt, Human
agcaagugguccu

SEQ ID NO: 1774502 - RNA, 14 nt, Human
agcaagugagagcu

SEQ ID NO: 1774503 - RNA, 13 nt, Human
agcaagugagagc

SEQ ID NO: 1774504 - RNA, 16 nt, Human
agcacagcuucauuuc

SEQ ID NO: 1774505 - RNA, 18 nt, Human
agcacauauuagugcagc

SEQ ID NO: 1774506 - RNA, 20 nt, Human
ugagcacuaaggugugcucu

SEQ ID NO: 1774507 - RNA, 21 nt, Human
ugagcacuaaggugugcucug

SEQ ID NO: 1774508 - RNA, 22 nt, Human
ugagcacuaaggugugcucuga

SEQ ID NO: 1774509 - RNA, 23 nt, Human
ugagcacuaaggugugcucugau

SEQ ID NO: 1774510 - RNA, 15 nt, Human
ugagcacccucugga

SEQ ID NO: 1774511 - RNA, 16 nt, Human
ugagcacccucuggau

SEQ ID NO: 1774512 - RNA, 21 nt, Human
ugagcaccgugucaagcugcu

SEQ ID NO: 1774513 - RNA, 22 nt, Human
ugagcaccgugucaagcugcuc

SEQ ID NO: 1774514 - RNA, 17 nt, Human
ugagcaauguauaaccc

SEQ ID NO: 1774515 - RNA, 18 nt, Human
ugagcaauguauaacccc

SEQ ID NO: 1774516 - RNA, 21 nt, Human
ugagccacugcaccgggccac

SEQ ID NO: 1774517 - RNA, 18 nt, Human
ugagccacugcaccgggc

SEQ ID NO: 1774518 - RNA, 23 nt, Human
ugagccacugcaccgggccacag

SEQ ID NO: 1774519 - RNA, 13 nt, Human
agauuuggaagcu

SEQ ID NO: 1774520 - RNA, 23 nt, Human
agauucaauauugaauuuuuccu

SEQ ID NO: 1774521 - RNA, 13 nt, Human
ugacucagggcuc

SEQ ID NO: 1774522 - RNA, 14 nt, Human
ugacucagggcucc

SEQ ID NO: 1774523 - RNA, 15 nt, Human
ugacucagggcuccu

SEQ ID NO: 1774524 - RNA, 17 nt, Human
ugacucagggcuccugg

SEQ ID NO: 1774525 - RNA, 18 nt, Human
ugacucagggcuccuggg

SEQ ID NO: 1774526 - RNA, 19 nt, Human
ugacucagggcuccugggu

SEQ ID NO: 1774527 - RNA, 20 nt, Human
ugacucauucugaaggagcc

SEQ ID NO: 1774528 - RNA, 18 nt, Human
ugacuuuacgcccaucuc

SEQ ID NO: 1774529 - RNA, 22 nt, Human
ugacuuuacgcccaucucagga

SEQ ID NO: 1774530 - RNA, 14 nt, Human
agauuauugaaaua

SEQ ID NO: 1774531 - RNA, 16 nt, Human
agauuauugaaauauu

SEQ ID NO: 1774532 - RNA, 23 nt, Human
ugacuugcacagggauucucaca

SEQ ID NO: 1774533 - RNA, 15 nt, Human
ugaccaaugucuuga

SEQ ID NO: 1774534 - RNA, 16 nt, Human
agaugauuuccccccu

SEQ ID NO: 1774535 - RNA, 18 nt, Human
agaugauuuccccccucc

SEQ ID NO: 1774536 - RNA, 22 nt, Human
agaugauuuccccccuccgccu

SEQ ID NO: 1774537 - RNA, 19 nt, Human
ugaauuuaauaaucuguag

SEQ ID NO: 1774538 - RNA, 21 nt, Human
agaugugguugcauaagguuu

SEQ ID NO: 1774539 - RNA, 22 nt, Human
agaugugguugcauaagguuuu

SEQ ID NO: 1774540 - RNA, 13 nt, Human
ugaccucugccug

SEQ ID NO: 1774541 - RNA, 14 nt, Human
ugaccucugccuga

SEQ ID NO: 1774542 - RNA, 16 nt, Human
agauggcaaaugacca

SEQ ID NO: 1774543 - RNA, 17 nt, Human
agagcuucccugacuca

SEQ ID NO: 1774544 - RNA, 20 nt, Human
agagcuucccugacucauuc

SEQ ID NO: 1774545 - RNA, 13 nt, Human
agagcuucccuga

SEQ ID NO: 1774546 - RNA, 16 nt, Human
agagcuucccugacuc

SEQ ID NO: 1774547 - RNA, 12 nt, Human
agagcuucccug

SEQ ID NO: 1774548 - RNA, 19 nt, Human
agagcugggugucaagagg

SEQ ID NO: 1774549 - RNA, 18 nt, Human
agaggcaauggcuccuuc

SEQ ID NO: 1774550 - RNA, 15 nt, Human
agaggcuacagggcc

SEQ ID NO: 1774551 - RNA, 16 nt, Human
agaggcuacagggcca

SEQ ID NO: 1774552 - RNA, 21 nt, Human
agagggacgccugggggugcc

SEQ ID NO: 1774553 - RNA, 15 nt, Human
agagggacgccuggg

SEQ ID NO: 1774554 - RNA, 16 nt, Human
ugaagauucuuuccca

SEQ ID NO: 1774555 - RNA, 14 nt, Human
ugaaugcauuuugu

SEQ ID NO: 1774556 - RNA, 13 nt, Human
ugaaugcauuuug

SEQ ID NO: 1774557 - RNA, 12 nt, Human
ugaaugcauuuu

SEQ ID NO: 1774558 - RNA, 21 nt, Human
ugaaugcauuuuguuugguau

SEQ ID NO: 1774559 - RNA, 15 nt, Human
ugaaugcauuuuguu

SEQ ID NO: 1774560 - RNA, 22 nt, Human
ugaaugcauuuuguuugguauu

SEQ ID NO: 1774561 - RNA, 12 nt, Human
ugaauauaauga

SEQ ID NO: 1774562 - RNA, 15 nt, Human
agagugagacucugu

SEQ ID NO: 1774563 - RNA, 16 nt, Human
agagugagacucuguc

SEQ ID NO: 1774564 - RNA, 20 nt, Human
agagucucacuguugcccag

SEQ ID NO: 1774565 - RNA, 22 nt, Human
agagucucacuguugcccaggc

SEQ ID NO: 1774566 - RNA, 21 nt, Human
agaucaaccccuucgcuccug

SEQ ID NO: 1774567 - RNA, 14 nt, Human
agaucaaccccuuc

SEQ ID NO: 1774568 - RNA, 19 nt, Human
agaucaaccccuucgcucc

SEQ ID NO: 1774569 - RNA, 19 nt, Human
agauacaggaaaagcugcu

SEQ ID NO: 1774570 - RNA, 12 nt, Human
agauacaauaaa

SEQ ID NO: 1774571 - RNA, 13 nt, Human
agauacaauaaau

SEQ ID NO: 1774572 - RNA, 18 nt, Human
agauacagaacucuuuca

SEQ ID NO: 1774573 - RNA, 20 nt, Human
agauacagaacucuuucaaa

SEQ ID NO: 1774574 - RNA, 14 nt, Human
agauaccagcgagg

SEQ ID NO: 1774575 - RNA, 19 nt, Human
agauaccagcgaggaggcu

SEQ ID NO: 1774576 - RNA, 21 nt, Human
agauaccagcgaggaggcucc

SEQ ID NO: 1774577 - RNA, 23 nt, Human
agauaccagcgaggaggcuccag

SEQ ID NO: 1774578 - RNA, 12 nt, Human
agauaaugugaa

SEQ ID NO: 1774579 - RNA, 13 nt, Human
agauaaugugaaa

SEQ ID NO: 1774580 - RNA, 18 nt, Human
agauaaugugaaaauggu

SEQ ID NO: 1774581 - RNA, 19 nt, Human
agagugagacucugucuca

SEQ ID NO: 1774582 - RNA, 16 nt, Human
agagugacucuccagg

SEQ ID NO: 1774583 - RNA, 17 nt, Human
agagugauaauacaagu

SEQ ID NO: 1774584 - RNA, 18 nt, Human
ucuuccuacccugccucc

SEQ ID NO: 1774585 - RNA, 21 nt, Human
ucuuccuacccugccucccuu

SEQ ID NO: 1774586 - RNA, 17 nt, Human
ucuugcaauggcagccu

SEQ ID NO: 1774587 - RNA, 13 nt, Human
ucuugcaauggca

SEQ ID NO: 1774588 - RNA, 16 nt, Human
ucuugcaauggcagcc

SEQ ID NO: 1774589 - RNA, 13 nt, Human
ucuugaugcaugc

SEQ ID NO: 1774590 - RNA, 21 nt, Human
ucuugaugcaugcacuguucc

SEQ ID NO: 1774591 - RNA, 17 nt, Human
agacucauucuucugua

SEQ ID NO: 1774592 - RNA, 18 nt, Human
agacucauucuucuguac

SEQ ID NO: 1774593 - RNA, 23 nt, Human
agacuguugggguggguauaaaa

SEQ ID NO: 1774594 - RNA, 11 nt, Human
agacuguuggg

SEQ ID NO: 1774595 - RNA, 14 nt, Human
agacuuuggaaaau

SEQ ID NO: 1774596 - RNA, 21 nt, Human
agacuuuggaaaaugcauugu

SEQ ID NO: 1774597 - RNA, 22 nt, Human
agacuuuggaaaaugcauugua

SEQ ID NO: 1774598 - RNA, 23 nt, Human
agacuuuggaaaaugcauuguau

SEQ ID NO: 1774599 - RNA, 18 nt, Human
agagaaugaaagggccca

SEQ ID NO: 1774600 - RNA, 14 nt, Human
agagaaugagaaau

SEQ ID NO: 1774601 - RNA, 16 nt, Human
agagaaugaugcucaa

SEQ ID NO: 1774602 - RNA, 19 nt, Human
agacucuacagaggccaug

SEQ ID NO: 1774603 - RNA, 22 nt, Human
agacucggggugcuuccuugua

SEQ ID NO: 1774604 - RNA, 14 nt, Human
agacucggggugcu

SEQ ID NO: 1774605 - RNA, 17 nt, Human
agacucggggugcuucc

SEQ ID NO: 1774606 - RNA, 17 nt, Human
agacucuacagaggcca

SEQ ID NO: 1774607 - RNA, 12 nt, Human
ucuuuagaguua

SEQ ID NO: 1774608 - RNA, 18 nt, Human
ucuuuagaguuagacugu

SEQ ID NO: 1774609 - RNA, 17 nt, Human
ucuuuagaguuagacug

SEQ ID NO: 1774610 - RNA, 16 nt, Human
ucuuuagaguuagacu

SEQ ID NO: 1774611 - RNA, 14 nt, Human
ucuuuagaguuaga

SEQ ID NO: 1774612 - RNA, 19 nt, Human
ucuuuagaguuagacuguu

SEQ ID NO: 1774613 - RNA, 14 nt, Human
ucuggguucacugc

SEQ ID NO: 1774614 - RNA, 16 nt, Human
ucuggguucacugcaa

SEQ ID NO: 1774615 - RNA, 23 nt, Human
ucuggggcagcacccuauaaauc

SEQ ID NO: 1774616 - RNA, 20 nt, Human
ucugucauuugagcagggcu

SEQ ID NO: 1774617 - RNA, 23 nt, Human
ucugucauuugagcagggcucag

SEQ ID NO: 1774618 - RNA, 15 nt, Human
ucugucauuugagca

SEQ ID NO: 1774619 - RNA, 20 nt, Human
ucuguaggguaauuaguaac

SEQ ID NO: 1774620 - RNA, 15 nt, Human
ucugugcccuccuga

SEQ ID NO: 1774621 - RNA, 18 nt, Human
ucuguuggccagugugac

SEQ ID NO: 1774622 - RNA, 19 nt, Human
ucuguuggccagugugaca

SEQ ID NO: 1774623 - RNA, 20 nt, Human
ucuguuggccagugugacaa

SEQ ID NO: 1774624 - RNA, 17 nt, Human
ucuguucaguguaaaua

SEQ ID NO: 1774625 - RNA, 13 nt, Human
ucugugcucagga

SEQ ID NO: 1774626 - RNA, 14 nt, Human
agacagacacacac

SEQ ID NO: 1774627 - RNA, 15 nt, Human
agacagacacacaca

SEQ ID NO: 1774628 - RNA, 16 nt, Human
agacagacacacacac

SEQ ID NO: 1774629 - RNA, 18 nt, Human
agaauuugagugcucuga

SEQ ID NO: 1774630 - RNA, 17 nt, Human
agaauuugagugcucug

SEQ ID NO: 1774631 - RNA, 14 nt, Human
ucuuaauauaaauu

SEQ ID NO: 1774632 - RNA, 15 nt, Human
ucuuaauauaaauuc

SEQ ID NO: 1774633 - RNA, 20 nt, Human
ucuuaauauaaauucacuuu

SEQ ID NO: 1774634 - RNA, 21 nt, Human
ucuuaauauaaauucacuuuc

SEQ ID NO: 1774635 - RNA, 21 nt, Human
agacaggguuuugccauguug

SEQ ID NO: 1774636 - RNA, 23 nt, Human
agacaggcaagcaccuccugccu

SEQ ID NO: 1774637 - RNA, 14 nt, Human
ucuuauugcccacg

SEQ ID NO: 1774638 - RNA, 18 nt, Human
ucuuauugcccacgcugg

SEQ ID NO: 1774639 - RNA, 22 nt, Human
ucuuauugcccacgcuggagug

SEQ ID NO: 1774640 - RNA, 12 nt, Human
ucuuagaaauuu

SEQ ID NO: 1774641 - RNA, 15 nt, Human
ucuuagaaauuuauu

SEQ ID NO: 1774642 - RNA, 11 nt, Human
ucuuagaaauu

SEQ ID NO: 1774643 - RNA, 17 nt, Human
ucuucaccauuuggcaa

SEQ ID NO: 1774644 - RNA, 21 nt, Human
ucuucaccugauucaacuaaa

SEQ ID NO: 1774645 - RNA, 23 nt, Human
ucuucaccugauucaacuaaaaa

SEQ ID NO: 1774646 - RNA, 15 nt, Human
ucuuccaggugccca

SEQ ID NO: 1774647 - RNA, 18 nt, Human
ucuuccaggugcccagcu

SEQ ID NO: 1774648 - RNA, 15 nt, Human
ucuuccgacucuuuc

SEQ ID NO: 1774649 - RNA, 21 nt, Human
ucuuccgacucuuucugagug

SEQ ID NO: 1774650 - RNA, 12 nt, Human
acuuuuuauugc

SEQ ID NO: 1774651 - RNA, 13 nt, Human
acuuuuuauugcc

SEQ ID NO: 1774652 - RNA, 14 nt, Human
acuuuuuauugccu

SEQ ID NO: 1774653 - RNA, 15 nt, Human
acuuuuuauugccuu

SEQ ID NO: 1774654 - RNA, 16 nt, Human
acuuuuuauugccuuc

SEQ ID NO: 1774655 - RNA, 17 nt, Human
acuuuuuauugccuucu

SEQ ID NO: 1774656 - RNA, 18 nt, Human
acuuuuuauugccuucuc

SEQ ID NO: 1774657 - RNA, 14 nt, Human
ucuccggcucccag

SEQ ID NO: 1774658 - RNA, 15 nt, Human
ucuccggcucccagc

SEQ ID NO: 1774659 - RNA, 16 nt, Human
ucuccggcucccagcc

SEQ ID NO: 1774660 - RNA, 17 nt, Human
ucuccggcucccagccu

SEQ ID NO: 1774661 - RNA, 18 nt, Human
ucuccggcucccagccuc

SEQ ID NO: 1774662 - RNA, 22 nt, Human
ucuccggcucccagccucagcg

SEQ ID NO: 1774663 - RNA, 21 nt, Human
ucuccggcucccagccucagc

SEQ ID NO: 1774664 - RNA, 13 nt, Human
ucucuccuguccu

SEQ ID NO: 1774665 - RNA, 14 nt, Human
ucucuccuguccuc

SEQ ID NO: 1774666 - RNA, 15 nt, Human
ucucuccuguccucc

SEQ ID NO: 1774667 - RNA, 13 nt, Human
ucuccuuccugug

SEQ ID NO: 1774668 - RNA, 14 nt, Human
ucuccuuccugugu

SEQ ID NO: 1774669 - RNA, 16 nt, Human
ucuccuuccugugugu

SEQ ID NO: 1774670 - RNA, 22 nt, Human
acuuuuuugguacuauaaaagc

SEQ ID NO: 1774671 - RNA, 22 nt, Human
ucucugcucugcgugucaccug

SEQ ID NO: 1774672 - RNA, 18 nt, Human
ucucugcucugcguguca

SEQ ID NO: 1774673 - RNA, 21 nt, Human
ucucugcucugcgugucaccu

SEQ ID NO: 1774674 - RNA, 14 nt, Human
ucucugcccugugu

SEQ ID NO: 1774675 - RNA, 15 nt, Human
agaaacugcagggaa

SEQ ID NO: 1774676 - RNA, 22 nt, Human
ucucuuuaaugucacaggcagg

SEQ ID NO: 1774677 - RNA, 19 nt, Human
ucugauucccaagcucugc

SEQ ID NO: 1774678 - RNA, 20 nt, Human
ucugauucccaagcucugcu

SEQ ID NO: 1774679 - RNA, 21 nt, Human
ucugauucccaagcucugcuc

SEQ ID NO: 1774680 - RNA, 21 nt, Human
agaaagaauguuacugccuua

SEQ ID NO: 1774681 - RNA, 22 nt, Human
agaaagaauguuacugccuuaa

SEQ ID NO: 1774682 - RNA, 14 nt, Human
ucugacuuggggac

SEQ ID NO: 1774683 - RNA, 19 nt, Human
agaagaaaauggaaccagg

SEQ ID NO: 1774684 - RNA, 20 nt, Human
agaagaaaauggaaccaggc

SEQ ID NO: 1774685 - RNA, 14 nt, Human
agaacucuuucaaa

SEQ ID NO: 1774686 - RNA, 17 nt, Human
ucugcucacauaucugu

SEQ ID NO: 1774687 - RNA, 12 nt, Human
ucugcucaucau

SEQ ID NO: 1774688 - RNA, 16 nt, Human
ucugcucacauaucug

SEQ ID NO: 1774689 - RNA, 14 nt, Human
ucugcucaucauuc

SEQ ID NO: 1774690 - RNA, 15 nt, Human
ucugcucaucauucu

SEQ ID NO: 1774691 - RNA, 18 nt, Human
ucugcucaucauucucug

SEQ ID NO: 1774692 - RNA, 22 nt, Human
ucugcucaucauucucugucuc

SEQ ID NO: 1774693 - RNA, 11 nt, Human
ucugccuuuau

SEQ ID NO: 1774694 - RNA, 18 nt, Human
ucugccuuuauuguguuu

SEQ ID NO: 1774695 - RNA, 16 nt, Human
ucugccuuuauugugu

SEQ ID NO: 1774696 - RNA, 20 nt, Human
ucugccuuuauuguguuugu

SEQ ID NO: 1774697 - RNA, 23 nt, Human
ucugccuuuauuguguuugucau

SEQ ID NO: 1774698 - RNA, 22 nt, Human
agaagaaaauggaaccaggcuu

SEQ ID NO: 1774699 - RNA, 23 nt, Human
agaagaaaauggaaccaggcuug

SEQ ID NO: 1774700 - RNA, 18 nt, Human
ucuggauggugugccuuc

SEQ ID NO: 1774701 - RNA, 21 nt, Human
ucuggauggugugccuuccag

SEQ ID NO: 1774702 - RNA, 22 nt, Human
ucuggauggugugccuuccaga

SEQ ID NO: 1774703 - RNA, 18 nt, Human
ucuggcagguccuccccu

SEQ ID NO: 1774704 - RNA, 22 nt, Human
ucuggcagguccuccccucucu

SEQ ID NO: 1774705 - RNA, 13 nt, Human
ucuggcccuagac

SEQ ID NO: 1774706 - RNA, 14 nt, Human
ucuggcccuagacu

SEQ ID NO: 1774707 - RNA, 19 nt, Human
agaagcgauuuaaguuaca

SEQ ID NO: 1774708 - RNA, 17 nt, Human
ugcauaacaauuccucu

SEQ ID NO: 1774709 - RNA, 18 nt, Human
ugcauaacaauuccucua

SEQ ID NO: 1774710 - RNA, 19 nt, Human
ugcagucuguccaggcucg

SEQ ID NO: 1774711 - RNA, 17 nt, Human
agccucaaccuccuggg

SEQ ID NO: 1774712 - RNA, 18 nt, Human
agccucaaccuccugggc

SEQ ID NO: 1774713 - RNA, 13 nt, Human
agccucagcaucc

SEQ ID NO: 1774714 - RNA, 14 nt, Human
agccucagcauccu

SEQ ID NO: 1774715 - RNA, 16 nt, Human
agccucagcauccugg

SEQ ID NO: 1774716 - RNA, 15 nt, Human
agccucagcauccug

SEQ ID NO: 1774717 - RNA, 19 nt, Human
agccucaaccuccugggcu

SEQ ID NO: 1774718 - RNA, 20 nt, Human
ugcagccucaaccuccuggg

SEQ ID NO: 1774719 - RNA, 18 nt, Human
ugcagccucaaccuccug

SEQ ID NO: 1774720 - RNA, 19 nt, Human
ugcagccucaaccuccugg

SEQ ID NO: 1774721 - RNA, 14 nt, Human
ugcagccgcugagc

SEQ ID NO: 1774722 - RNA, 23 nt, Human
agccugcaguuauuaacacuaac

SEQ ID NO: 1774723 - RNA, 14 nt, Human
agccugcagcagga

SEQ ID NO: 1774724 - RNA, 14 nt, Human
ugcaugauguuugc

SEQ ID NO: 1774725 - RNA, 15 nt, Human
ugcaugauguuugcc

SEQ ID NO: 1774726 - RNA, 17 nt, Human
ugcaugauguuugccca

SEQ ID NO: 1774727 - RNA, 18 nt, Human
ugcaugauguuugcccaa

SEQ ID NO: 1774728 - RNA, 13 nt, Human
ugcaucucccaga

SEQ ID NO: 1774729 - RNA, 18 nt, Human
ugcaucucccagauaaug

SEQ ID NO: 1774730 - RNA, 13 nt, Human
ugcaucuggggcc

SEQ ID NO: 1774731 - RNA, 15 nt, Human
ugcacacaccagagc

SEQ ID NO: 1774732 - RNA, 12 nt, Human
ugcacaugucuu

SEQ ID NO: 1774733 - RNA, 22 nt, Human
ugcaccaagcaggaaaugaaaa

SEQ ID NO: 1774734 - RNA, 16 nt, Human
ugcacaugucuuaaug

SEQ ID NO: 1774735 - RNA, 15 nt, Human
ugcacaugucuuaau

SEQ ID NO: 1774736 - RNA, 14 nt, Human
ugcacaugucuuaa

SEQ ID NO: 1774737 - RNA, 14 nt, Human
ugcaccaagcagga

SEQ ID NO: 1774738 - RNA, 22 nt, Human
ugcacuauagccuaggugacag

SEQ ID NO: 1774739 - RNA, 15 nt, Human
agccuaggugacaga

SEQ ID NO: 1774740 - RNA, 17 nt, Human
agccuaggugacagagu

SEQ ID NO: 1774741 - RNA, 14 nt, Human
agccuagugaaggc

SEQ ID NO: 1774742 - RNA, 23 nt, Human
agccuagugaaggcuucucucug

SEQ ID NO: 1774743 - RNA, 20 nt, Human
agccuagugaaggcuucucu

SEQ ID NO: 1774744 - RNA, 15 nt, Human
agccucaaccuccug

SEQ ID NO: 1774745 - RNA, 22 nt, Human
ugcagacucuacagaggccaug

SEQ ID NO: 1774746 - RNA, 19 nt, Human
ugcagagaaacuuaagcaa

SEQ ID NO: 1774747 - RNA, 20 nt, Human
ugcagagaaacuuaagcaaa

SEQ ID NO: 1774748 - RNA, 21 nt, Human
ugcagagaaacuuaagcaaag

SEQ ID NO: 1774749 - RNA, 19 nt, Human
ugcagacucuacagaggcc

SEQ ID NO: 1774750 - RNA, 20 nt, Human
ugcagacucuacagaggcca

SEQ ID NO: 1774751 - RNA, 17 nt, Human
ugccccuaaucucugua

SEQ ID NO: 1774752 - RNA, 18 nt, Human
ugccccuaaucucuguag

SEQ ID NO: 1774753 - RNA, 20 nt, Human
ugccccuaaucucuguagga

SEQ ID NO: 1774754 - RNA, 21 nt, Human
ugccccuaaucucuguaggaa

SEQ ID NO: 1774755 - RNA, 15 nt, Human
ugcccuaugggccug

SEQ ID NO: 1774756 - RNA, 16 nt, Human
ugcccuaugggccugc

SEQ ID NO: 1774757 - RNA, 18 nt, Human
ugcccuaguuuucuuucc

SEQ ID NO: 1774758 - RNA, 22 nt, Human
ugcccuaguuuucuuuccuccu

SEQ ID NO: 1774759 - RNA, 23 nt, Human
ugcccuaguuuucuuuccuccuu

SEQ ID NO: 1774760 - RNA, 17 nt, Human
ugccccccaccccugga

SEQ ID NO: 1774761 - RNA, 12 nt, Human
ugcccaggcccc

SEQ ID NO: 1774762 - RNA, 14 nt, Human
ugcccaggccccug

SEQ ID NO: 1774763 - RNA, 20 nt, Human
ugcccaggccccugccaccc

SEQ ID NO: 1774764 - RNA, 22 nt, Human
ugcccaggccccugccacccug

SEQ ID NO: 1774765 - RNA, 14 nt, Human
ugcccacaggauca

SEQ ID NO: 1774766 - RNA, 15 nt, Human
ugcccaggcaggucu

SEQ ID NO: 1774767 - RNA, 16 nt, Human
ugcccaggcaggucuu

SEQ ID NO: 1774768 - RNA, 17 nt, Human
ugcccaggcaggucuug

SEQ ID NO: 1774769 - RNA, 20 nt, Human
ugcccaggcaggucuugaac

SEQ ID NO: 1774770 - RNA, 11 nt, Human
ugcccaggccc

SEQ ID NO: 1774771 - RNA, 16 nt, Human
ugccauuagccaagga

SEQ ID NO: 1774772 - RNA, 20 nt, Human
ugccauguuggccaggcugg

SEQ ID NO: 1774773 - RNA, 21 nt, Human
ugccauguuggccaggcuggu

SEQ ID NO: 1774774 - RNA, 17 nt, Human
ugccauguuggccaggc

SEQ ID NO: 1774775 - RNA, 18 nt, Human
ugccauguuggccaggcu

SEQ ID NO: 1774776 - RNA, 19 nt, Human
ugccauguuggccaggcug

SEQ ID NO: 1774777 - RNA, 19 nt, Human
agcuauggugucauaggcu

SEQ ID NO: 1774778 - RNA, 17 nt, Human
agcuauaccugugccuc

SEQ ID NO: 1774779 - RNA, 15 nt, Human
agcuauaccugugcc

SEQ ID NO: 1774780 - RNA, 16 nt, Human
agcuauaccugugccu

SEQ ID NO: 1774781 - RNA, 15 nt, Human
ugccauauucuguug

SEQ ID NO: 1774782 - RNA, 16 nt, Human
ugccauauucuguugg

SEQ ID NO: 1774783 - RNA, 17 nt, Human
ugccauauucuguuggc

SEQ ID NO: 1774784 - RNA, 15 nt, Human
agcgugagccacugc

SEQ ID NO: 1774785 - RNA, 20 nt, Human
ugccauauugcacaugucuu

SEQ ID NO: 1774786 - RNA, 16 nt, Human
agcggggacagcuccu

SEQ ID NO: 1774787 - RNA, 17 nt, Human
agcggggacagcuccuu

SEQ ID NO: 1774788 - RNA, 15 nt, Human
agcggggacagcucc

SEQ ID NO: 1774789 - RNA, 19 nt, Human
ugccauauugcacaugucu

SEQ ID NO: 1774790 - RNA, 16 nt, Human
ugccauauugcacaug

SEQ ID NO: 1774791 - RNA, 15 nt, Human
ugccauauugcacau

SEQ ID NO: 1774792 - RNA, 20 nt, Human
ugccauauucuguuggccag

SEQ ID NO: 1774793 - RNA, 21 nt, Human
ugccauauucuguuggccagu

SEQ ID NO: 1774794 - RNA, 17 nt, Human
agcgugcuuuaaaaaau

SEQ ID NO: 1774795 - RNA, 16 nt, Human
agcgugagccacugca

SEQ ID NO: 1774796 - RNA, 17 nt, Human
agcgugagccacugcac

SEQ ID NO: 1774797 - RNA, 17 nt, Human
agccugcuagcuagcuc

SEQ ID NO: 1774798 - RNA, 18 nt, Human
agccugcuagcuagcuca

SEQ ID NO: 1774799 - RNA, 14 nt, Human
agcgcccaguuggg

SEQ ID NO: 1774800 - RNA, 22 nt, Human
agcgcccaguuggguggaugcc

SEQ ID NO: 1774801 - RNA, 21 nt, Human
agccugcgccaccgcccagag

SEQ ID NO: 1774802 - RNA, 14 nt, Human
agccugcgccugcu

SEQ ID NO: 1774803 - RNA, 15 nt, Human
agccugcgccugcug

SEQ ID NO: 1774804 - RNA, 16 nt, Human
agccugcgccugcugc

SEQ ID NO: 1774805 - RNA, 17 nt, Human
agccugcgccugcugca

SEQ ID NO: 1774806 - RNA, 18 nt, Human
agccugcgccugcugcau

SEQ ID NO: 1774807 - RNA, 20 nt, Human
agccugcgccugcugcaugc

SEQ ID NO: 1774808 - RNA, 9 nt, Human
agccugcua

SEQ ID NO: 1774809 - RNA, 12 nt, Human
agccugcuagcu

SEQ ID NO: 1774810 - RNA, 13 nt, Human
agccugcuagcua

SEQ ID NO: 1774811 - RNA, 18 nt, Human
agcgcggcccucccgagu

SEQ ID NO: 1774812 - RNA, 15 nt, Human
agcgcgccccuagcc

SEQ ID NO: 1774813 - RNA, 15 nt, Human
agcgcggcccucccg

SEQ ID NO: 1774814 - RNA, 18 nt, Human
ugccacaaugcaguucug

SEQ ID NO: 1774815 - RNA, 23 nt, Human
ugccacaaugcaguucugagcac

SEQ ID NO: 1774816 - RNA, 20 nt, Human
ugccucugacacacagcucu

SEQ ID NO: 1774817 - RNA, 21 nt, Human
ugccucugacacacagcucug

SEQ ID NO: 1774818 - RNA, 17 nt, Human
ugcccuuuuuucugccu

SEQ ID NO: 1774819 - RNA, 18 nt, Human
ugcccuuuuuucugccuc

SEQ ID NO: 1774820 - RNA, 19 nt, Human
ugcccuuuuuucugccucc

SEQ ID NO: 1774821 - RNA, 20 nt, Human
ugcccuuuuuucugccuccu

SEQ ID NO: 1774822 - RNA, 21 nt, Human
ugcccuuuuuucugccuccuu

SEQ ID NO: 1774823 - RNA, 16 nt, Human
ugccgcgaugggucag

SEQ ID NO: 1774824 - RNA, 16 nt, Human
ugccggauacaaacug

SEQ ID NO: 1774825 - RNA, 18 nt, Human
ugccggauacaaacuggu

SEQ ID NO: 1774826 - RNA, 22 nt, Human
ugccgggcugagggccugcugg

SEQ ID NO: 1774827 - RNA, 23 nt, Human
ugccgggcugagggccugcugga

SEQ ID NO: 1774828 - RNA, 20 nt, Human
agcugcaucauccuugcagg

SEQ ID NO: 1774829 - RNA, 23 nt, Human
agcugcaucauccuugcaggugg

SEQ ID NO: 1774830 - RNA, 18 nt, Human
ugcccuuggcacccaaga

SEQ ID NO: 1774831 - RNA, 22 nt, Human
agcucugcuccucuccccagca

SEQ ID NO: 1774832 - RNA, 12 nt, Human
agcucugcuccu

SEQ ID NO: 1774833 - RNA, 18 nt, Human
agcucuucuccaggcugu

SEQ ID NO: 1774834 - RNA, 16 nt, Human
agcucuucuucccagc

SEQ ID NO: 1774835 - RNA, 12 nt, Human
agcucuguccug

SEQ ID NO: 1774836 - RNA, 14 nt, Human
agcucuguccuggg

SEQ ID NO: 1774837 - RNA, 12 nt, Human
agcucuguauca

SEQ ID NO: 1774838 - RNA, 22 nt, Human
agcucuguaucaggacccagag

SEQ ID NO: 1774839 - RNA, 23 nt, Human
agcucuguaucaggacccagagg

SEQ ID NO: 1774840 - RNA, 17 nt, Human
agcugggacuacaggug

SEQ ID NO: 1774841 - RNA, 19 nt, Human
agcugggacuacaggugug

SEQ ID NO: 1774842 - RNA, 22 nt, Human
ugccucugacacacagcucugu

SEQ ID NO: 1774843 - RNA, 20 nt, Human
agcugccuccccucuccuuc

SEQ ID NO: 1774844 - RNA, 23 nt, Human
agcugccuccccucuccuuccug

SEQ ID NO: 1774845 - RNA, 10 nt, Human
agcugccugu

SEQ ID NO: 1774846 - RNA, 10 nt, Human
agcugugcag

SEQ ID NO: 1774847 - RNA, 12 nt, Human
agcugugcaggu

SEQ ID NO: 1774848 - RNA, 18 nt, Human
agcugugcagguggggag

SEQ ID NO: 1774849 - RNA, 19 nt, Human
agcugugcagguggggaga

SEQ ID NO: 1774850 - RNA, 15 nt, Human
ugccuguucagcucc

SEQ ID NO: 1774851 - RNA, 14 nt, Human
ugccugugucuucu

SEQ ID NO: 1774852 - RNA, 16 nt, Human
ugccuguucagcucca

SEQ ID NO: 1774853 - RNA, 17 nt, Human
ugccuguucagcuccag

SEQ ID NO: 1774854 - RNA, 19 nt, Human
ugcgacacugggaggccag

SEQ ID NO: 1774855 - RNA, 18 nt, Human
ugcggacagccacggcca

SEQ ID NO: 1774856 - RNA, 15 nt, Human
ugcgacgcuugcucu

SEQ ID NO: 1774857 - RNA, 21 nt, Human
ugccuuuauuguguuugucau

SEQ ID NO: 1774858 - RNA, 20 nt, Human
ugccuuuauuguguuuguca

SEQ ID NO: 1774859 - RNA, 14 nt, Human
ugccuuuauugugu

SEQ ID NO: 1774860 - RNA, 11 nt, Human
ugccuuuagaa

SEQ ID NO: 1774861 - RNA, 15 nt, Human
ugccuuuagaaaaua

SEQ ID NO: 1774862 - RNA, 16 nt, Human
ugccuuuagaaaauau

SEQ ID NO: 1774863 - RNA, 23 nt, Human
ugccuuuagaaaauauaaguaaa

SEQ ID NO: 1774864 - RNA, 21 nt, Human
aggaaacuacugccuuuagaa

SEQ ID NO: 1774865 - RNA, 20 nt, Human
ugcggacagccacggccagg

SEQ ID NO: 1774866 - RNA, 21 nt, Human
ugcggacagccacggccaggc

SEQ ID NO: 1774867 - RNA, 15 nt, Human
ugcuaccucccuugc

SEQ ID NO: 1774868 - RNA, 18 nt, Human
ugcuaccucccuugccuu

SEQ ID NO: 1774869 - RNA, 13 nt, Human
ugcuacgccugca

SEQ ID NO: 1774870 - RNA, 16 nt, Human
ugcuacgccugcaugu

SEQ ID NO: 1774871 - RNA, 20 nt, Human
ugcuacgccugcauguaaac

SEQ ID NO: 1774872 - RNA, 19 nt, Human
agcuuguaaauagcucagg

SEQ ID NO: 1774873 - RNA, 20 nt, Human
agcuuguaaauagcucaggu

SEQ ID NO: 1774874 - RNA, 21 nt, Human
agcuuguaaauagcucaggug

SEQ ID NO: 1774875 - RNA, 13 nt, Human
agcuuucugccac

SEQ ID NO: 1774876 - RNA, 11 nt, Human
ugcugccaucc

SEQ ID NO: 1774877 - RNA, 21 nt, Human
ugcugccauccagguucagcu

SEQ ID NO: 1774878 - RNA, 22 nt, Human
ugcugccauccagguucagcuu

SEQ ID NO: 1774879 - RNA, 12 nt, Human
ugcugccaucca

SEQ ID NO: 1774880 - RNA, 13 nt, Human
ugcugccauccag

SEQ ID NO: 1774881 - RNA, 14 nt, Human
ugcugccauccagg

SEQ ID NO: 1774882 - RNA, 15 nt, Human
ugcugccauccaggu

SEQ ID NO: 1774883 - RNA, 23 nt, Human
aggaauccagacccggcugcgug

SEQ ID NO: 1774884 - RNA, 17 nt, Human
ugcugagucaucuguua

SEQ ID NO: 1774885 - RNA, 19 nt, Human
ugcugagucaucuguuagg

SEQ ID NO: 1774886 - RNA, 21 nt, Human
ugcugagucaucuguuagggc

SEQ ID NO: 1774887 - RNA, 22 nt, Human
ugcucugaucauccacugugcc

SEQ ID NO: 1774888 - RNA, 13 nt, Human
ugcucugaucccu

SEQ ID NO: 1774889 - RNA, 14 nt, Human
ugcucugaucccuc

SEQ ID NO: 1774890 - RNA, 16 nt, Human
ugcucugaucccucua

SEQ ID NO: 1774891 - RNA, 19 nt, Human
ugcucugaucccucuacag

SEQ ID NO: 1774892 - RNA, 20 nt, Human
ugcuauccugccaaaaucau

SEQ ID NO: 1774893 - RNA, 17 nt, Human
ugcucuggacaggcaug

SEQ ID NO: 1774894 - RNA, 16 nt, Human
ugcucuguuugugggg

SEQ ID NO: 1774895 - RNA, 18 nt, Human
aggccugaaaggagcccu

SEQ ID NO: 1774896 - RNA, 13 nt, Human
aggccuggccaga

SEQ ID NO: 1774897 - RNA, 12 nt, Human
aggccuggccag

SEQ ID NO: 1774898 - RNA, 13 nt, Human
aggccugaagcca

SEQ ID NO: 1774899 - RNA, 19 nt, Human
aggccugaagccagcugcc

SEQ ID NO: 1774900 - RNA, 21 nt, Human
aggccugaagccagcugcccu

SEQ ID NO: 1774901 - RNA, 19 nt, Human
aggccugaaucaugagccu

SEQ ID NO: 1774902 - RNA, 20 nt, Human
aggccugaaucaugagccug

SEQ ID NO: 1774903 - RNA, 22 nt, Human
aggccugaaucaugagccugcu

SEQ ID NO: 1774904 - RNA, 23 nt, Human
aggccugaaucaugagccugcug

SEQ ID NO: 1774905 - RNA, 17 nt, Human
aggcccggcuccaggcu

SEQ ID NO: 1774906 - RNA, 14 nt, Human
aggcccggcuccag

SEQ ID NO: 1774907 - RNA, 15 nt, Human
aggcccggcuccagg

SEQ ID NO: 1774908 - RNA, 16 nt, Human
aggcccggcuccaggc

SEQ ID NO: 1774909 - RNA, 13 nt, Human
aggccccugccac

SEQ ID NO: 1774910 - RNA, 15 nt, Human
aggccccugccaccc

SEQ ID NO: 1774911 - RNA, 17 nt, Human
aggccccugccacccug

SEQ ID NO: 1774912 - RNA, 18 nt, Human
aggccccugccacccugg

SEQ ID NO: 1774913 - RNA, 21 nt, Human
aggccccugccacccugggga

SEQ ID NO: 1774914 - RNA, 13 nt, Human
aggccccuggagg

SEQ ID NO: 1774915 - RNA, 14 nt, Human
aggccccuggaggc

SEQ ID NO: 1774916 - RNA, 19 nt, Human
aggccccuggaggcugccu

SEQ ID NO: 1774917 - RNA, 20 nt, Human
aggccccuggaggcugccuc

SEQ ID NO: 1774918 - RNA, 21 nt, Human
aggccccuggaggcugccucc

SEQ ID NO: 1774919 - RNA, 22 nt, Human
aggccccuggaggcugccuccc

SEQ ID NO: 1774920 - RNA, 18 nt, Human
uggcagcaccugucuccu

SEQ ID NO: 1774921 - RNA, 13 nt, Human
aggccauuauugu

SEQ ID NO: 1774922 - RNA, 18 nt, Human
aggccaugggccuccugu

SEQ ID NO: 1774923 - RNA, 11 nt, Human
uggccugggcc

SEQ ID NO: 1774924 - RNA, 24 nt, Human
uggccugggccguaucuccggcuc

SEQ ID NO: 1774925 - RNA, 15 nt, Human
uggcccugcaaaagg

SEQ ID NO: 1774926 - RNA, 19 nt, Human
uggcaugguaguauacaaa

SEQ ID NO: 1774927 - RNA, 21 nt, Human
aggcgaucacaacgugcauug

SEQ ID NO: 1774928 - RNA, 20 nt, Human
aggcgaucacaacgugcauu

SEQ ID NO: 1774929 - RNA, 19 nt, Human
aggcgaucacaacgugcau

SEQ ID NO: 1774930 - RNA, 17 nt, Human
aggccuucucugaagga

SEQ ID NO: 1774931 - RNA, 18 nt, Human
aggccuucucugaaggac

SEQ ID NO: 1774932 - RNA, 14 nt, Human
aggccuugucccag

SEQ ID NO: 1774933 - RNA, 15 nt, Human
aggccuuuaaaauuu

SEQ ID NO: 1774934 - RNA, 14 nt, Human
aggccuuuaaaauu

SEQ ID NO: 1774935 - RNA, 13 nt, Human
aggcuccagaggg

SEQ ID NO: 1774936 - RNA, 14 nt, Human
aggcuccagagggc

SEQ ID NO: 1774937 - RNA, 16 nt, Human
aggcucacccccuucu

SEQ ID NO: 1774938 - RNA, 19 nt, Human
aggcucacccccuucucca

SEQ ID NO: 1774939 - RNA, 21 nt, Human
aggcucacccccuucuccauc

SEQ ID NO: 1774940 - RNA, 23 nt, Human
aggcucacccccuucuccaucca

SEQ ID NO: 1774941 - RNA, 21 nt, Human
aggcaggucuugaacuccugg

SEQ ID NO: 1774942 - RNA, 19 nt, Human
aggcaguauuuuguguccu

SEQ ID NO: 1774943 - RNA, 21 nt, Human
aggcaguauuuuguguccucc

SEQ ID NO: 1774944 - RNA, 22 nt, Human
aggcagggucucacucugucgc

SEQ ID NO: 1774945 - RNA, 14 nt, Human
aggcagguccaggg

SEQ ID NO: 1774946 - RNA, 19 nt, Human
aggcagggucucacucugu

SEQ ID NO: 1774947 - RNA, 18 nt, Human
aggcagggucucacucug

SEQ ID NO: 1774948 - RNA, 20 nt, Human
aggcagggucucacucuguc

SEQ ID NO: 1774949 - RNA, 21 nt, Human
aggcagggucucacucugucg

SEQ ID NO: 1774950 - RNA, 21 nt, Human
aggcaggaccuucgggcugug

SEQ ID NO: 1774951 - RNA, 22 nt, Human
aggcaggaccuucgggcugugc

SEQ ID NO: 1774952 - RNA, 23 nt, Human
aggcaggaccuucgggcugugcc

SEQ ID NO: 1774953 - RNA, 15 nt, Human
aggcacccaccauca

SEQ ID NO: 1774954 - RNA, 15 nt, Human
aggcaccagucccug

SEQ ID NO: 1774955 - RNA, 19 nt, Human
aggcagccccauucugccu

SEQ ID NO: 1774956 - RNA, 20 nt, Human
aggcagccccauucugccug

SEQ ID NO: 1774957 - RNA, 21 nt, Human
aggcagccccauucugccugc

SEQ ID NO: 1774958 - RNA, 22 nt, Human
aggcagccccauucugccugcc

SEQ ID NO: 1774959 - RNA, 16 nt, Human
aggcaccagucccugu

SEQ ID NO: 1774960 - RNA, 15 nt, Human
aggcaaugcuggcug

SEQ ID NO: 1774961 - RNA, 16 nt, Human
aggcaaugcuggcugu

SEQ ID NO: 1774962 - RNA, 21 nt, Human
uggagcuucauggcagaaggc

SEQ ID NO: 1774963 - RNA, 13 nt, Human
aggaggccaggcc

SEQ ID NO: 1774964 - RNA, 22 nt, Human
aggaggccaggccggcgagccc

SEQ ID NO: 1774965 - RNA, 17 nt, Human
uggaagugcaucuacuu

SEQ ID NO: 1774966 - RNA, 14 nt, Human
uggaagcucuucuu

SEQ ID NO: 1774967 - RNA, 13 nt, Human
uggaagcuccgcu

SEQ ID NO: 1774968 - RNA, 18 nt, Human
ugcugccccaucagugcu

SEQ ID NO: 1774969 - RNA, 19 nt, Human
ugcugccccaucagugcuc

SEQ ID NO: 1774970 - RNA, 21 nt, Human
ugcugccccaucagugcuccc

SEQ ID NO: 1774971 - RNA, 12 nt, Human
aggaucagucug

SEQ ID NO: 1774972 - RNA, 16 nt, Human
aggaucagauugcaug

SEQ ID NO: 1774973 - RNA, 22 nt, Human
aggauugcuacuguccuaccca

SEQ ID NO: 1774974 - RNA, 23 nt, Human
aggauuugcacagaagcacaugc

SEQ ID NO: 1774975 - RNA, 14 nt, Human
aggcaagcaccucc

SEQ ID NO: 1774976 - RNA, 20 nt, Human
uggacaaagaauuccaaagc

SEQ ID NO: 1774977 - RNA, 23 nt, Human
uggacaaagaauuccaaagcaaa

SEQ ID NO: 1774978 - RNA, 18 nt, Human
aggcugggcuucaguggc

SEQ ID NO: 1774979 - RNA, 19 nt, Human
aggcugggcuucaguggca

SEQ ID NO: 1774980 - RNA, 20 nt, Human
aggcugggcuucaguggcag

SEQ ID NO: 1774981 - RNA, 21 nt, Human
aggcugggcuucaguggcagc

SEQ ID NO: 1774982 - RNA, 22 nt, Human
aggcugggcuucaguggcagcu

SEQ ID NO: 1774983 - RNA, 23 nt, Human
aggcugggcuucaguggcagcug

SEQ ID NO: 1774984 - RNA, 14 nt, Human
aggcugggcuucag

SEQ ID NO: 1774985 - RNA, 16 nt, Human
aggcuucucucugugg

SEQ ID NO: 1774986 - RNA, 17 nt, Human
aggcugggggagagccg

SEQ ID NO: 1774987 - RNA, 19 nt, Human
aggcugggggagagccgug

SEQ ID NO: 1774988 - RNA, 16 nt, Human
agggaaaaggggcucc

SEQ ID NO: 1774989 - RNA, 17 nt, Human
agggaaaaggggcuccu

SEQ ID NO: 1774990 - RNA, 18 nt, Human
agggaaaauuauuugcau

SEQ ID NO: 1774991 - RNA, 15 nt, Human
uggcuacgccucuuc

SEQ ID NO: 1774992 - RNA, 18 nt, Human
uggcuacgccucuucugu

SEQ ID NO: 1774993 - RNA, 19 nt, Human
uggcuacgccucuucuguc

SEQ ID NO: 1774994 - RNA, 22 nt, Human
uggcuacgccucuucugucccu

SEQ ID NO: 1774995 - RNA, 23 nt, Human
uggcuacgccucuucugucccug

SEQ ID NO: 1774996 - RNA, 15 nt, Human
aggcuccagagggca

SEQ ID NO: 1774997 - RNA, 16 nt, Human
aggcuccagagggcac

SEQ ID NO: 1774998 - RNA, 16 nt, Human
uggcuguuggcugggg

SEQ ID NO: 1774999 - RNA, 18 nt, Human
uggcuguuggcugggggc

SEQ ID NO: 1775000 - RNA, 23 nt, Human
uggcuguuggcugggggccucag

SEQ ID NO: 1775001 - RNA, 23 nt, Human
uggcugcaaaggguaucaggugc

SEQ ID NO: 1775002 - RNA, 23 nt, Human
ugggaaaaaugcccuuaaaucau

SEQ ID NO: 1775003 - RNA, 18 nt, Human
ugggaaacaaaaggauaa

SEQ ID NO: 1775004 - RNA, 20 nt, Human
agggaguccgaaagggacuu

SEQ ID NO: 1775005 - RNA, 23 nt, Human
agggaguccgaaagggacuugga

SEQ ID NO: 1775006 - RNA, 20 nt, Human
agggagugacagaggcagcc

SEQ ID NO: 1775007 - RNA, 12 nt, Human
agggcccagaga

SEQ ID NO: 1775008 - RNA, 13 nt, Human
agggcccagagag

SEQ ID NO: 1775009 - RNA, 21 nt, Human
agggccaagcccagcacugcu

SEQ ID NO: 1775010 - RNA, 19 nt, Human
agggccaaacgcugagcca

SEQ ID NO: 1775011 - RNA, 20 nt, Human
agggccaaacgcugagccac

SEQ ID NO: 1775012 - RNA, 22 nt, Human
agggccaaacgcugagccaccu

SEQ ID NO: 1775013 - RNA, 23 nt, Human
agggccaaacgcugagccaccug

SEQ ID NO: 1775014 - RNA, 14 nt, Human
agggcagaaugaau

SEQ ID NO: 1775015 - RNA, 15 nt, Human
agggcagaaugaauc

SEQ ID NO: 1775016 - RNA, 12 nt, Human
agggcagaguga

SEQ ID NO: 1775017 - RNA, 20 nt, Human
agggcagucgauagagcugu

SEQ ID NO: 1775018 - RNA, 13 nt, Human
agggcccccacag

SEQ ID NO: 1775019 - RNA, 18 nt, Human
agggcccccacaguugcu

SEQ ID NO: 1775020 - RNA, 14 nt, Human
agggcccagagagg

SEQ ID NO: 1775021 - RNA, 18 nt, Human
agggcccagagagggugg

SEQ ID NO: 1775022 - RNA, 12 nt, Human
agggcuccuggg

SEQ ID NO: 1775023 - RNA, 21 nt, Human
agggcugcggcguacaggcug

SEQ ID NO: 1775024 - RNA, 23 nt, Human
agggcugcggcguacaggcuggc

SEQ ID NO: 1775025 - RNA, 21 nt, Human
agggcugccccuaaucucugu

SEQ ID NO: 1775026 - RNA, 12 nt, Human
agggcugcauga

SEQ ID NO: 1775027 - RNA, 15 nt, Human
agggcugcaugaugu

SEQ ID NO: 1775028 - RNA, 16 nt, Human
agggcugcaugauguu

SEQ ID NO: 1775029 - RNA, 22 nt, Human
agggcugcaugauguuugccca

SEQ ID NO: 1775030 - RNA, 11 nt, Human
ugggcucccug

SEQ ID NO: 1775031 - RNA, 15 nt, Human
ugggcucccugacug

SEQ ID NO: 1775032 - RNA, 19 nt, Human
ugggcucccugacugggag

SEQ ID NO: 1775033 - RNA, 21 nt, Human
agggcugugcuugaaggcccu

SEQ ID NO: 1775034 - RNA, 22 nt, Human
agggcugugcuugaaggcccug

SEQ ID NO: 1775035 - RNA, 23 nt, Human
agggcugugcuugaaggcccugc

SEQ ID NO: 1775036 - RNA, 13 nt, Human
ugggcaauuuaga

SEQ ID NO: 1775037 - RNA, 15 nt, Human
ugggcaauuuagaaa

SEQ ID NO: 1775038 - RNA, 16 nt, Human
ugggcaauuuagaaaa

SEQ ID NO: 1775039 - RNA, 14 nt, Human
ugggagggcagcag

SEQ ID NO: 1775040 - RNA, 17 nt, Human
ugggagggcagcagggc

SEQ ID NO: 1775041 - RNA, 18 nt, Human
ugggagggcagcagggcu

SEQ ID NO: 1775042 - RNA, 19 nt, Human
ugggagggcagcagggcua

SEQ ID NO: 1775043 - RNA, 15 nt, Human
ugggcaaagccuagu

SEQ ID NO: 1775044 - RNA, 21 nt, Human
ugggcaaagccuagugaaggc

SEQ ID NO: 1775045 - RNA, 15 nt, Human
ugggagaaaaucauc

SEQ ID NO: 1775046 - RNA, 19 nt, Human
ugggagaaauacuugaacu

SEQ ID NO: 1775047 - RNA, 13 nt, Human
ugggaggcucacc

SEQ ID NO: 1775048 - RNA, 20 nt, Human
ugggaggcucacccccuucu

SEQ ID NO: 1775049 - RNA, 22 nt, Human
ugggaggcucacccccuucucc

SEQ ID NO: 1775050 - RNA, 18 nt, Human
ugggacuacaggcaccca

SEQ ID NO: 1775051 - RNA, 15 nt, Human
agggagcuagccaga

SEQ ID NO: 1775052 - RNA, 16 nt, Human
agggagcuagccagag

SEQ ID NO: 1775053 - RNA, 14 nt, Human
agggagccuggccc

SEQ ID NO: 1775054 - RNA, 18 nt, Human
ugggacuuccaugccuua

SEQ ID NO: 1775055 - RNA, 18 nt, Human
ugggacucaaugcacuga

SEQ ID NO: 1775056 - RNA, 16 nt, Human
ugggacuacaggugug

SEQ ID NO: 1775057 - RNA, 22 nt, Human
agggagcuccaacucagaaggg

SEQ ID NO: 1775058 - RNA, 17 nt, Human
agggagcuagccagagg

SEQ ID NO: 1775059 - RNA, 23 nt, Human
agggagcuagccagaggacugug

SEQ ID NO: 1775060 - RNA, 20 nt, Human
agggacuuggaagcuccgcu

SEQ ID NO: 1775061 - RNA, 16 nt, Human
agggagaccuggacac

SEQ ID NO: 1775062 - RNA, 21 nt, Human
agggagaccuggacacaggcc

SEQ ID NO: 1775063 - RNA, 22 nt, Human
agggagaccuggacacaggccu

SEQ ID NO: 1775064 - RNA, 18 nt, Human
agggacuuggaagcuccg

SEQ ID NO: 1775065 - RNA, 19 nt, Human
agggacuuggaagcuccgc

SEQ ID NO: 1775066 - RNA, 15 nt, Human
agggacuuggaagcu

SEQ ID NO: 1775067 - RNA, 13 nt, Human
agggaaauuucag

SEQ ID NO: 1775068 - RNA, 15 nt, Human
agggaaauaucauuu

SEQ ID NO: 1775069 - RNA, 16 nt, Human
uguccaaaacugccuc

SEQ ID NO: 1775070 - RNA, 17 nt, Human
ugucagguggggcagcu

SEQ ID NO: 1775071 - RNA, 18 nt, Human
ugucagguggggcagcuu

SEQ ID NO: 1775072 - RNA, 15 nt, Human
ugucagaugcccgag

SEQ ID NO: 1775073 - RNA, 21 nt, Human
ugucagaugcccgagggaggg

SEQ ID NO: 1775074 - RNA, 20 nt, Human
ugucagguggggcagcuuga

SEQ ID NO: 1775075 - RNA, 20 nt, Human
ugucauuugagcagggcuca

SEQ ID NO: 1775076 - RNA, 21 nt, Human
ugucauuugagcagggcucag

SEQ ID NO: 1775077 - RNA, 22 nt, Human
ugucauuugagcagggcucagc

SEQ ID NO: 1775078 - RNA, 17 nt, Human
uguccagcauugcugga

SEQ ID NO: 1775079 - RNA, 19 nt, Human
uguccagcauugcuggacu

SEQ ID NO: 1775080 - RNA, 14 nt, Human
uguccaauccuaug

SEQ ID NO: 1775081 - RNA, 20 nt, Human
ugucccugcacuugcagacu

SEQ ID NO: 1775082 - RNA, 22 nt, Human
ugucccugcacuugcagacucu

SEQ ID NO: 1775083 - RNA, 23 nt, Human
ugucccugcacuugcagacucua

SEQ ID NO: 1775084 - RNA, 13 nt, Human
uguccccucccag

SEQ ID NO: 1775085 - RNA, 16 nt, Human
uguccccucccagagc

SEQ ID NO: 1775086 - RNA, 15 nt, Human
agucaccaagcccag

SEQ ID NO: 1775087 - RNA, 15 nt, Human
aguauuuuguguccu

SEQ ID NO: 1775088 - RNA, 16 nt, Human
aguauuucaaauugga

SEQ ID NO: 1775089 - RNA, 13 nt, Human
aguauuauuuucc

SEQ ID NO: 1775090 - RNA, 14 nt, Human
aguauuauuuucca

SEQ ID NO: 1775091 - RNA, 15 nt, Human
aguauuauuuuccaa

SEQ ID NO: 1775092 - RNA, 18 nt, Human
aguauuauuuuccaaaag

SEQ ID NO: 1775093 - RNA, 14 nt, Human
uguauauucacuuu

SEQ ID NO: 1775094 - RNA, 12 nt, Human
uguauauucacu

SEQ ID NO: 1775095 - RNA, 18 nt, Human
agucccaccuuggcugca

SEQ ID NO: 1775096 - RNA, 19 nt, Human
agucccaccuuggcugcag

SEQ ID NO: 1775097 - RNA, 20 nt, Human
agucccaccuuggcugcagg

SEQ ID NO: 1775098 - RNA, 15 nt, Human
agucccaccuuggcu

SEQ ID NO: 1775099 - RNA, 16 nt, Human
agucccaccuuggcug

SEQ ID NO: 1775100 - RNA, 14 nt, Human
agucauaccaauga

SEQ ID NO: 1775101 - RNA, 16 nt, Human
agucaguugaaauucu

SEQ ID NO: 1775102 - RNA, 14 nt, Human
agucaguuugcagu

SEQ ID NO: 1775103 - RNA, 17 nt, Human
agucauaccaaugaaaa

SEQ ID NO: 1775104 - RNA, 23 nt, Human
agucauaccaaugaaaaaaugua

SEQ ID NO: 1775105 - RNA, 16 nt, Human
ugucccuuaaacaaaa

SEQ ID NO: 1775106 - RNA, 18 nt, Human
ugucccugcgccuuuccu

SEQ ID NO: 1775107 - RNA, 13 nt, Human
ugucccuguuaga

SEQ ID NO: 1775108 - RNA, 23 nt, Human
agucacugugagcucccaggugc

SEQ ID NO: 1775109 - RNA, 24 nt, Human
agucacugugagcucccaggugca

SEQ ID NO: 1775110 - RNA, 13 nt, Human
agucagcucucug

SEQ ID NO: 1775111 - RNA, 14 nt, Human
agucagcucucugc

SEQ ID NO: 1775112 - RNA, 17 nt, Human
agucagcucucugcccu

SEQ ID NO: 1775113 - RNA, 18 nt, Human
agucagcucucugcccug

SEQ ID NO: 1775114 - RNA, 16 nt, Human
aguccuaguuuuccua

SEQ ID NO: 1775115 - RNA, 23 nt, Human
aguccuaguuuuccuacuuauaa

SEQ ID NO: 1775116 - RNA, 18 nt, Human
aguccuauucaaauuccu

SEQ ID NO: 1775117 - RNA, 19 nt, Human
aguccuauucaaauuccua

SEQ ID NO: 1775118 - RNA, 23 nt, Human
agucucacuguugcccaggcugg

SEQ ID NO: 1775119 - RNA, 11 nt, Human
ugucucaucca

SEQ ID NO: 1775120 - RNA, 16 nt, Human
ugucucauccaucauc

SEQ ID NO: 1775121 - RNA, 17 nt, Human
ugucucauccaucauca

SEQ ID NO: 1775122 - RNA, 21 nt, Human
ugucucauccaucaucaugug

SEQ ID NO: 1775123 - RNA, 12 nt, Human
ugggcugaggga

SEQ ID NO: 1775124 - RNA, 16 nt, Human
ugggcugagggagccu

SEQ ID NO: 1775125 - RNA, 11 nt, Human
ugggcugaggg

SEQ ID NO: 1775126 - RNA, 16 nt, Human
aggugucccugcacuu

SEQ ID NO: 1775127 - RNA, 20 nt, Human
aggugucccugcacuugcag

SEQ ID NO: 1775128 - RNA, 21 nt, Human
aggugugagucaccaagccca

SEQ ID NO: 1775129 - RNA, 22 nt, Human
aggugugagucaccaagcccag

SEQ ID NO: 1775130 - RNA, 18 nt, Human
agguggggagacugggcu

SEQ ID NO: 1775131 - RNA, 14 nt, Human
aggugggcugggcc

SEQ ID NO: 1775132 - RNA, 21 nt, Human
aggugggcugggcccucucuu

SEQ ID NO: 1775133 - RNA, 22 nt, Human
aggugggcugggcccucucuuc

SEQ ID NO: 1775134 - RNA, 12 nt, Human
aggugugcucug

SEQ ID NO: 1775135 - RNA, 19 nt, Human
agguguccagcauugcugg

SEQ ID NO: 1775136 - RNA, 20 nt, Human
agguguccagcauugcugga

SEQ ID NO: 1775137 - RNA, 23 nt, Human
agguguccagcauugcuggacuc

SEQ ID NO: 1775138 - RNA, 14 nt, Human
agguugaagcacca

SEQ ID NO: 1775139 - RNA, 19 nt, Human
agguucuucuuguucugag

SEQ ID NO: 1775140 - RNA, 15 nt, Human
agguuggagcccagg

SEQ ID NO: 1775141 - RNA, 16 nt, Human
agguuggagcccaggg

SEQ ID NO: 1775142 - RNA, 15 nt, Human
agguuggauggaugg

SEQ ID NO: 1775143 - RNA, 17 nt, Human
aguagauuaaaaauuau

SEQ ID NO: 1775144 - RNA, 18 nt, Human
aguagauuaaaaauuaua

SEQ ID NO: 1775145 - RNA, 19 nt, Human
aguagauuaaaaauuauag

SEQ ID NO: 1775146 - RNA, 17 nt, Human
aguaccaccaaaaaagc

SEQ ID NO: 1775147 - RNA, 22 nt, Human
aguaccaccaaaaaagcuguau

SEQ ID NO: 1775148 - RNA, 17 nt, Human
uguauauauauuaagag

SEQ ID NO: 1775149 - RNA, 14 nt, Human
aguaaugaguuuaa

SEQ ID NO: 1775150 - RNA, 17 nt, Human
aguaaugaguuuaaaaa

SEQ ID NO: 1775151 - RNA, 21 nt, Human
aguaaugaguuuaaaaaucaa

SEQ ID NO: 1775152 - RNA, 14 nt, Human
aguggauugcauuu

SEQ ID NO: 1775153 - RNA, 11 nt, Human
aguggcagcug

SEQ ID NO: 1775154 - RNA, 12 nt, Human
aguggggaagag

SEQ ID NO: 1775155 - RNA, 13 nt, Human
aguggggaagagu

SEQ ID NO: 1775156 - RNA, 18 nt, Human
uguuaaguccucccugac

SEQ ID NO: 1775157 - RNA, 22 nt, Human
uguuaaguccucccugacuuuu

SEQ ID NO: 1775158 - RNA, 23 nt, Human
uguguuaccugaaaacacugugc

SEQ ID NO: 1775159 - RNA, 20 nt, Human
ugugucuugcaauggcagcc

SEQ ID NO: 1775160 - RNA, 16 nt, Human
uguguccaaaacugcc

SEQ ID NO: 1775161 - RNA, 17 nt, Human
uguguccacgacugucu

SEQ ID NO: 1775162 - RNA, 18 nt, Human
uguguccacgacugucuc

SEQ ID NO: 1775163 - RNA, 19 nt, Human
uguguccacgacugucucc

SEQ ID NO: 1775164 - RNA, 16 nt, Human
ugugucccccucuguc

SEQ ID NO: 1775165 - RNA, 18 nt, Human
ugugucccccucugucca

SEQ ID NO: 1775166 - RNA, 21 nt, Human
ugugucccccucuguccaggc

SEQ ID NO: 1775167 - RNA, 17 nt, Human
uguguccuccaggagcu

SEQ ID NO: 1775168 - RNA, 18 nt, Human
uguguccuccaggagcuu

SEQ ID NO: 1775169 - RNA, 21 nt, Human
uguguccuccaggagcuucuu

SEQ ID NO: 1775170 - RNA, 20 nt, Human
uguguccugaaacgcuccuu

SEQ ID NO: 1775171 - RNA, 15 nt, Human
agugccauguaaauc

SEQ ID NO: 1775172 - RNA, 21 nt, Human
aguguuccccuuccacugagg

SEQ ID NO: 1775173 - RNA, 16 nt, Human
aguguuccccuuccac

SEQ ID NO: 1775174 - RNA, 13 nt, Human
aguuagacuguug

SEQ ID NO: 1775175 - RNA, 22 nt, Human
aguuagauuauugaaauauuau

SEQ ID NO: 1775176 - RNA, 23 nt, Human
uguugcccaggcuggcgugcagu

SEQ ID NO: 1775177 - RNA, 20 nt, Human
uguugcccaggcuggcgugc

SEQ ID NO: 1775178 - RNA, 11 nt, Human
uguugccccag

SEQ ID NO: 1775179 - RNA, 16 nt, Human
uguugccccuuucucu

SEQ ID NO: 1775180 - RNA, 17 nt, Human
uguugccccuuucucuu

SEQ ID NO: 1775181 - RNA, 20 nt, Human
uguugccccuuucucuuuuc

SEQ ID NO: 1775182 - RNA, 21 nt, Human
uguugccccuuucucuuuucc

SEQ ID NO: 1775183 - RNA, 17 nt, Human
uguugcagguucaugga

SEQ ID NO: 1775184 - RNA, 23 nt, Human
uguuccuggaggucagcauuuga

SEQ ID NO: 1775185 - RNA, 17 nt, Human
uguuccuuggcagugga

SEQ ID NO: 1775186 - RNA, 15 nt, Human
uguucgggugugggu

SEQ ID NO: 1775187 - RNA, 18 nt, Human
agugugaggccagggcag

SEQ ID NO: 1775188 - RNA, 15 nt, Human
agugugaggccaggg

SEQ ID NO: 1775189 - RNA, 17 nt, Human
agugguccacaucccgg

SEQ ID NO: 1775190 - RNA, 13 nt, Human
agugguccuagag

SEQ ID NO: 1775191 - RNA, 17 nt, Human
agugguccuagaggccc

SEQ ID NO: 1775192 - RNA, 12 nt, Human
ugucuccagcuu

SEQ ID NO: 1775193 - RNA, 15 nt, Human
ugucuccagcuuccc

SEQ ID NO: 1775194 - RNA, 15 nt, Human
ugucuccauggcccu

SEQ ID NO: 1775195 - RNA, 23 nt, Human
ugugaggaaagucauuggcuuua

SEQ ID NO: 1775196 - RNA, 22 nt, Human
ugugaggaaagucauuggcuuu

SEQ ID NO: 1775197 - RNA, 16 nt, Human
ugugaggaaagucauu

SEQ ID NO: 1775198 - RNA, 19 nt, Human
ugugagcucccaggugcag

SEQ ID NO: 1775199 - RNA, 23 nt, Human
ugugagcucccaggugcagccag

SEQ ID NO: 1775200 - RNA, 14 nt, Human
agugagcacuaagg

SEQ ID NO: 1775201 - RNA, 22 nt, Human
agugagcacuaaggugugcucu

SEQ ID NO: 1775202 - RNA, 17 nt, Human
agugagaauaggcagcc

SEQ ID NO: 1775203 - RNA, 14 nt, Human
agugacucuccagg

SEQ ID NO: 1775204 - RNA, 15 nt, Human
agugacucuccaggg

SEQ ID NO: 1775205 - RNA, 22 nt, Human
ugugaugaugaaaugaggucag

SEQ ID NO: 1775206 - RNA, 16 nt, Human
ugugaugcccugcccu

SEQ ID NO: 1775207 - RNA, 12 nt, Human
agugagcugguu

SEQ ID NO: 1775208 - RNA, 16 nt, Human
agucuuucacauuuaa

SEQ ID NO: 1775209 - RNA, 18 nt, Human
agucuuucacauuuaaau

SEQ ID NO: 1775210 - RNA, 12 nt, Human
ugugcucugauc

SEQ ID NO: 1775211 - RNA, 23 nt, Human
ugugcccuccugacccauugcug

SEQ ID NO: 1775212 - RNA, 13 nt, Human
ugugcccuccuga

SEQ ID NO: 1775213 - RNA, 17 nt, Human
ugugcccuccugaccca

SEQ ID NO: 1775214 - RNA, 19 nt, Human
uguggaugagcccucagaa

SEQ ID NO: 1775215 - RNA, 23 nt, Human
uguggaugagcccucagaacccu

SEQ ID NO: 1775216 - RNA, 22 nt, Human
uguggaugccgauuucuguaaa

SEQ ID NO: 1775217 - RNA, 23 nt, Human
agugagcugguuuuuagcggaga

SEQ ID NO: 1775218 - RNA, 13 nt, Human
agugcaucuacuu

SEQ ID NO: 1775219 - RNA, 14 nt, Human
agugcaucuacuug

SEQ ID NO: 1775220 - RNA, 17 nt, Human
agugcagugagccgaga

SEQ ID NO: 1775221 - RNA, 23 nt, Human
agugcaguccugaucagagccgu

SEQ ID NO: 1775222 - RNA, 13 nt, Human
agugcagccaagu

SEQ ID NO: 1775223 - RNA, 21 nt, Human
agugcagccaaguagccucuc

SEQ ID NO: 1775224 - RNA, 22 nt, Human
agugcagccaaguagccucucc

SEQ ID NO: 1775225 - RNA, 18 nt, Human
auagauaggucagugcaa

SEQ ID NO: 1775226 - RNA, 13 nt, Human
auagagcuguauu

SEQ ID NO: 1775227 - RNA, 14 nt, Human
auagaguauaugca

SEQ ID NO: 1775228 - RNA, 15 nt, Human
auagaguauaugcac

SEQ ID NO: 1775229 - RNA, 14 nt, Human
auagagagagacca

SEQ ID NO: 1775230 - RNA, 22 nt, Human
auagaccuuuuuuuuuuuucca

SEQ ID NO: 1775231 - RNA, 12 nt, Human
auagagaauguu

SEQ ID NO: 1775232 - RNA, 13 nt, Human
auagagaauguuc

SEQ ID NO: 1775233 - RNA, 14 nt, Human
auagagaauguucc

SEQ ID NO: 1775234 - RNA, 17 nt, Human
auagagaauguuccaga

SEQ ID NO: 1775235 - RNA, 18 nt, Human
auagaccucuaguagcug

SEQ ID NO: 1775236 - RNA, 13 nt, Human
auagagccugagg

SEQ ID NO: 1775237 - RNA, 15 nt, Human
auagagccugaggga

SEQ ID NO: 1775238 - RNA, 14 nt, Human
auagagcuguauua

SEQ ID NO: 1775239 - RNA, 13 nt, Human
auagauguuuccu

SEQ ID NO: 1775240 - RNA, 20 nt, Human
auagauaagaguagaaacug

SEQ ID NO: 1775241 - RNA, 14 nt, Human
auacuguacagggg

SEQ ID NO: 1775242 - RNA, 13 nt, Human
auagaaguaaaaa

SEQ ID NO: 1775243 - RNA, 16 nt, Human
auagaaguuuuaaauu

SEQ ID NO: 1775244 - RNA, 16 nt, Human
auagaacuucauggau

SEQ ID NO: 1775245 - RNA, 23 nt, Human
auagaagcugcagugguauuaau

SEQ ID NO: 1775246 - RNA, 15 nt, Human
uuauuauauuuacaa

SEQ ID NO: 1775247 - RNA, 14 nt, Human
uuauuauauuuaca

SEQ ID NO: 1775248 - RNA, 13 nt, Human
uuauguuaaacua

SEQ ID NO: 1775249 - RNA, 12 nt, Human
uuauguuaaacu

SEQ ID NO: 1775250 - RNA, 11 nt, Human
uuauguuaaac

SEQ ID NO: 1775251 - RNA, 10 nt, Human
uuauguuaaa

SEQ ID NO: 1775252 - RNA, 14 nt, Human
uuauguuaaacuag

SEQ ID NO: 1775253 - RNA, 12 nt, Human
uuauucaauaaa

SEQ ID NO: 1775254 - RNA, 21 nt, Human
uuauucaauaaaguauuuaau

SEQ ID NO: 1775255 - RNA, 20 nt, Human
uuauucaauaaaguauuuaa

SEQ ID NO: 1775256 - RNA, 19 nt, Human
uuauucaauaaaguauuua

SEQ ID NO: 1775257 - RNA, 17 nt, Human
uuauucaauaaaguauu

SEQ ID NO: 1775258 - RNA, 14 nt, Human
uuauucaauaaagu

SEQ ID NO: 1775259 - RNA, 13 nt, Human
uuauucaguguca

SEQ ID NO: 1775260 - RNA, 14 nt, Human
uuauucagugucac

SEQ ID NO: 1775261 - RNA, 12 nt, Human
uuauucauuauu

SEQ ID NO: 1775262 - RNA, 15 nt, Human
uuauucauuauuugu

SEQ ID NO: 1775263 - RNA, 18 nt, Human
uuauucauuauuugucaa

SEQ ID NO: 1775264 - RNA, 19 nt, Human
uuauucauuauuugucaaa

SEQ ID NO: 1775265 - RNA, 14 nt, Human
auacucauuucuua

SEQ ID NO: 1775266 - RNA, 18 nt, Human
uuaucaccgugggcuccc

SEQ ID NO: 1775267 - RNA, 13 nt, Human
uuaugaagagcua

SEQ ID NO: 1775268 - RNA, 18 nt, Human
uuaugaaagguuuacauu

SEQ ID NO: 1775269 - RNA, 19 nt, Human
uuaugaacacuuaaauuau

SEQ ID NO: 1775270 - RNA, 18 nt, Human
uuaugauagugguaugac

SEQ ID NO: 1775271 - RNA, 14 nt, Human
uuaugaaucuuucc

SEQ ID NO: 1775272 - RNA, 14 nt, Human
uuaugaaugaaaaa

SEQ ID NO: 1775273 - RNA, 21 nt, Human
uuaugucuuuugaugaauaga

SEQ ID NO: 1775274 - RNA, 20 nt, Human
uuauguaaaaggccaaaccu

SEQ ID NO: 1775275 - RNA, 22 nt, Human
uuauguaaaaggccaaaccucu

SEQ ID NO: 1775276 - RNA, 22 nt, Human
auacgcuuuuaaugaaaaggaa

SEQ ID NO: 1775277 - RNA, 15 nt, Human
auacaggaacaacau

SEQ ID NO: 1775278 - RNA, 19 nt, Human
auacagucuuccauuugca

SEQ ID NO: 1775279 - RNA, 17 nt, Human
auacagucuuccacaaa

SEQ ID NO: 1775280 - RNA, 18 nt, Human
auacagucuuccacaaag

SEQ ID NO: 1775281 - RNA, 21 nt, Human
auacagucuuccacaaagaaa

SEQ ID NO: 1775282 - RNA, 22 nt, Human
auacagucuuccacaaagaaaa

SEQ ID NO: 1775283 - RNA, 20 nt, Human
auacagucuuccauuugcaa

SEQ ID NO: 1775284 - RNA, 23 nt, Human
auacaggaaaagcugcugacagu

SEQ ID NO: 1775285 - RNA, 14 nt, Human
auacauaaagacua

SEQ ID NO: 1775286 - RNA, 15 nt, Human
uuauaaaguagaaau

SEQ ID NO: 1775287 - RNA, 22 nt, Human
auacaagccauucuaaggaaau

SEQ ID NO: 1775288 - RNA, 23 nt, Human
auacagaacucuuucaaaaccuu

SEQ ID NO: 1775289 - RNA, 18 nt, Human
auacagaacucuuucaaa

SEQ ID NO: 1775290 - RNA, 20 nt, Human
auacagaacucuuucaaaac

SEQ ID NO: 1775291 - RNA, 14 nt, Human
auacagaacucuuu

SEQ ID NO: 1775292 - RNA, 12 nt, Human
auacaauaaauu

SEQ ID NO: 1775293 - RNA, 14 nt, Human
auacaauaaauugc

SEQ ID NO: 1775294 - RNA, 17 nt, Human
auacaauaaauugcuaa

SEQ ID NO: 1775295 - RNA, 15 nt, Human
auacagaacucuuuc

SEQ ID NO: 1775296 - RNA, 16 nt, Human
auacagaacucuuuca

SEQ ID NO: 1775297 - RNA, 14 nt, Human
aguuucucuuuuca

SEQ ID NO: 1775298 - RNA, 12 nt, Human
uuaaaaaugcaa

SEQ ID NO: 1775299 - RNA, 12 nt, Human
uuaaaauccuca

SEQ ID NO: 1775300 - RNA, 15 nt, Human
uuaaaaaugcaaauc

SEQ ID NO: 1775301 - RNA, 13 nt, Human
uuaaaauccucaa

SEQ ID NO: 1775302 - RNA, 20 nt, Human
aguuuaaauuguaauaggcg

SEQ ID NO: 1775303 - RNA, 17 nt, Human
aguuuaaauuguaauag

SEQ ID NO: 1775304 - RNA, 12 nt, Human
aguuuuguugcc

SEQ ID NO: 1775305 - RNA, 14 nt, Human
aguuuuguugcccc

SEQ ID NO: 1775306 - RNA, 20 nt, Human
uuaagaaaaaauaacacaca

SEQ ID NO: 1775307 - RNA, 21 nt, Human
uuaagaaaaaauaacacacau

SEQ ID NO: 1775308 - RNA, 20 nt, Human
uuaaguuuccuuccagccca

SEQ ID NO: 1775309 - RNA, 21 nt, Human
uuaaguuuccuuccagcccag

SEQ ID NO: 1775310 - RNA, 21 nt, Human
uuaauccccaguaaaauugcc

SEQ ID NO: 1775311 - RNA, 18 nt, Human
uuaauccccaguaaaauu

SEQ ID NO: 1775312 - RNA, 17 nt, Human
uuaauccccaguaaaau

SEQ ID NO: 1775313 - RNA, 17 nt, Human
uuacaguaggagcccag

SEQ ID NO: 1775314 - RNA, 17 nt, Human
uuacaguuaaggaauau

SEQ ID NO: 1775315 - RNA, 14 nt, Human
uuacaggugugaac

SEQ ID NO: 1775316 - RNA, 14 nt, Human
auaaauuguauauu

SEQ ID NO: 1775317 - RNA, 13 nt, Human
auaaauuguauau

SEQ ID NO: 1775318 - RNA, 19 nt, Human
auaaauugcuaauguugcu

SEQ ID NO: 1775319 - RNA, 16 nt, Human
uuagaagucacacagu

SEQ ID NO: 1775320 - RNA, 16 nt, Human
uuacuguagccucaga

SEQ ID NO: 1775321 - RNA, 21 nt, Human
uuacuguagccucagaugauu

SEQ ID NO: 1775322 - RNA, 21 nt, Human
uuagaaucagccuugaaacau

SEQ ID NO: 1775323 - RNA, 11 nt, Human
auaagaaaaac

SEQ ID NO: 1775324 - RNA, 12 nt, Human
auaagaaaaacu

SEQ ID NO: 1775325 - RNA, 14 nt, Human
auaagaaaaacuuu

SEQ ID NO: 1775326 - RNA, 15 nt, Human
auaagaaaaacuuuu

SEQ ID NO: 1775327 - RNA, 17 nt, Human
uuacuggacaaagaauu

SEQ ID NO: 1775328 - RNA, 21 nt, Human
uuacugccaaagggaaauauc

SEQ ID NO: 1775329 - RNA, 13 nt, Human
uuagauguucuaa

SEQ ID NO: 1775330 - RNA, 20 nt, Human
uuagauguucuaagucuuuc

SEQ ID NO: 1775331 - RNA, 20 nt, Human
uuagauguucucuaucauuu

SEQ ID NO: 1775332 - RNA, 19 nt, Human
uuagauguucucuaucauu

SEQ ID NO: 1775333 - RNA, 15 nt, Human
uuagauguucucuau

SEQ ID NO: 1775334 - RNA, 22 nt, Human
uuagauguucuaagucuuucca

SEQ ID NO: 1775335 - RNA, 19 nt, Human
auaauauuuuacauacacu

SEQ ID NO: 1775336 - RNA, 12 nt, Human
auaagauuccaa

SEQ ID NO: 1775337 - RNA, 19 nt, Human
auaagauuccaaaaagcac

SEQ ID NO: 1775338 - RNA, 21 nt, Human
auaagauuccaaaaagcacau

SEQ ID NO: 1775339 - RNA, 22 nt, Human
auaagauuccaaaaagcacaua

SEQ ID NO: 1775340 - RNA, 20 nt, Human
auaauauacuuguggacuaa

SEQ ID NO: 1775341 - RNA, 14 nt, Human
auaauauacuugug

SEQ ID NO: 1775342 - RNA, 13 nt, Human
auaauauacuugu

SEQ ID NO: 1775343 - RNA, 16 nt, Human
uuaggguucugccucu

SEQ ID NO: 1775344 - RNA, 23 nt, Human
uuagauguucucuaucauuuaau

SEQ ID NO: 1775345 - RNA, 22 nt, Human
uuagauguucucuaucauuuaa

SEQ ID NO: 1775346 - RNA, 21 nt, Human
uuagauguucucuaucauuua

SEQ ID NO: 1775347 - RNA, 16 nt, Human
uuauaaaauuaagcaa

SEQ ID NO: 1775348 - RNA, 17 nt, Human
uuaguagagacaggguu

SEQ ID NO: 1775349 - RNA, 14 nt, Human
uuaguagagacagg

SEQ ID NO: 1775350 - RNA, 13 nt, Human
uuaguagagacag

SEQ ID NO: 1775351 - RNA, 17 nt, Human
aucugguuaggauggca

SEQ ID NO: 1775352 - RNA, 22 nt, Human
aucugccuuuauuguguuuguc

SEQ ID NO: 1775353 - RNA, 21 nt, Human
aucugccuuuauuguguuugu

SEQ ID NO: 1775354 - RNA, 19 nt, Human
aucugccuuuauuguguuu

SEQ ID NO: 1775355 - RNA, 12 nt, Human
aucugccugggu

SEQ ID NO: 1775356 - RNA, 16 nt, Human
aucugccuuuauugug

SEQ ID NO: 1775357 - RNA, 13 nt, Human
aucuugcucugcu

SEQ ID NO: 1775358 - RNA, 14 nt, Human
aucuuauaauuuaa

SEQ ID NO: 1775359 - RNA, 18 nt, Human
uugcucuaugcuuuccaa

SEQ ID NO: 1775360 - RNA, 19 nt, Human
uugcucuaugcuuuccaaa

SEQ ID NO: 1775361 - RNA, 13 nt, Human
aucuugucucaau

SEQ ID NO: 1775362 - RNA, 20 nt, Human
aucuugucucaaugcucaua

SEQ ID NO: 1775363 - RNA, 16 nt, Human
aucuugucucaaugcu

SEQ ID NO: 1775364 - RNA, 15 nt, Human
aucuugucucaaugc

SEQ ID NO: 1775365 - RNA, 14 nt, Human
aucuugucucaaug

SEQ ID NO: 1775366 - RNA, 23 nt, Human
aucuugucucaaugcucauaacg

SEQ ID NO: 1775367 - RNA, 18 nt, Human
aucuuugcagacaggcaa

SEQ ID NO: 1775368 - RNA, 17 nt, Human
aucuuugcagacaggca

SEQ ID NO: 1775369 - RNA, 18 nt, Human
augaaagggcccagagag

SEQ ID NO: 1775370 - RNA, 21 nt, Human
aucuuucuuucuuagaaauuu

SEQ ID NO: 1775371 - RNA, 20 nt, Human
aucuuucuuucuuagaaauu

SEQ ID NO: 1775372 - RNA, 17 nt, Human
aucuuucuuucuuagaa

SEQ ID NO: 1775373 - RNA, 15 nt, Human
aucuuucuuucuuag

SEQ ID NO: 1775374 - RNA, 16 nt, Human
uuggagggugucccaa

SEQ ID NO: 1775375 - RNA, 18 nt, Human
uuggccccugcccggcug

SEQ ID NO: 1775376 - RNA, 18 nt, Human
augaacuuguaaaggaau

SEQ ID NO: 1775377 - RNA, 19 nt, Human
augaaagggcccagagagg

SEQ ID NO: 1775378 - RNA, 13 nt, Human
augaaaggugcca

SEQ ID NO: 1775379 - RNA, 17 nt, Human
augaaaggugccaugga

SEQ ID NO: 1775380 - RNA, 22 nt, Human
augaaaggugccauggaagagg

SEQ ID NO: 1775381 - RNA, 16 nt, Human
augaaagguuuacauu

SEQ ID NO: 1775382 - RNA, 21 nt, Human
augaaagguuuacauugucaa

SEQ ID NO: 1775383 - RNA, 21 nt, Human
augaaauggagucauuugagu

SEQ ID NO: 1775384 - RNA, 12 nt, Human
uugagacagagu

SEQ ID NO: 1775385 - RNA, 14 nt, Human
uugacuuugcuccu

SEQ ID NO: 1775386 - RNA, 13 nt, Human
uugacuucagauu

SEQ ID NO: 1775387 - RNA, 22 nt, Human
uugacuuuacgcccaucucagg

SEQ ID NO: 1775388 - RNA, 23 nt, Human
uugacuuuacgcccaucucagga

SEQ ID NO: 1775389 - RNA, 14 nt, Human
uugagucugugcca

SEQ ID NO: 1775390 - RNA, 11 nt, Human
uugagucucuu

SEQ ID NO: 1775391 - RNA, 14 nt, Human
uugaguuuucagug

SEQ ID NO: 1775392 - RNA, 19 nt, Human
uugaguuuucaguggggca

SEQ ID NO: 1775393 - RNA, 18 nt, Human
aucuaauauguaacaagc

SEQ ID NO: 1775394 - RNA, 20 nt, Human
aucuaauauguaacaagcca

SEQ ID NO: 1775395 - RNA, 12 nt, Human
auccucucuggg

SEQ ID NO: 1775396 - RNA, 19 nt, Human
auccucucuggggcugugu

SEQ ID NO: 1775397 - RNA, 20 nt, Human
auccucucuggggcuguguu

SEQ ID NO: 1775398 - RNA, 16 nt, Human
uugaauacucugcccu

SEQ ID NO: 1775399 - RNA, 18 nt, Human
uugaauacucugcccucu

SEQ ID NO: 1775400 - RNA, 15 nt, Human
uugaaggcccugcug

SEQ ID NO: 1775401 - RNA, 20 nt, Human
uugaaggcccugcugaguca

SEQ ID NO: 1775402 - RNA, 17 nt, Human
uugaagggaaauuucag

SEQ ID NO: 1775403 - RNA, 12 nt, Human
uugaauaaagaa

SEQ ID NO: 1775404 - RNA, 18 nt, Human
uugaauaaagaauacuug

SEQ ID NO: 1775405 - RNA, 22 nt, Human
uugaauaaagaauacuugaacu

SEQ ID NO: 1775406 - RNA, 15 nt, Human
uugauuauucagugu

SEQ ID NO: 1775407 - RNA, 17 nt, Human
uugauuauucaguguca

SEQ ID NO: 1775408 - RNA, 13 nt, Human
uugcaagggaaaa

SEQ ID NO: 1775409 - RNA, 19 nt, Human
uugcaagggaaaagucucu

SEQ ID NO: 1775410 - RNA, 14 nt, Human
uugcaagccccucu

SEQ ID NO: 1775411 - RNA, 16 nt, Human
uugcaauggcagccuu

SEQ ID NO: 1775412 - RNA, 22 nt, Human
uugcaagggaaaagucucuugu

SEQ ID NO: 1775413 - RNA, 17 nt, Human
uugcaauggcagccuug

SEQ ID NO: 1775414 - RNA, 19 nt, Human
uugcaauggcagccuuggc

SEQ ID NO: 1775415 - RNA, 14 nt, Human
aucucauuggaccc

SEQ ID NO: 1775416 - RNA, 15 nt, Human
aucucauuggacccu

SEQ ID NO: 1775417 - RNA, 19 nt, Human
aucucauuggacccuucca

SEQ ID NO: 1775418 - RNA, 20 nt, Human
aucucauuggacccuuccau

SEQ ID NO: 1775419 - RNA, 18 nt, Human
aucuccacaaccucuucc

SEQ ID NO: 1775420 - RNA, 19 nt, Human
aucuccacaaccucuuccc

SEQ ID NO: 1775421 - RNA, 19 nt, Human
uucuagaugcaagucucuu

SEQ ID NO: 1775422 - RNA, 15 nt, Human
uucgcuccugugucu

SEQ ID NO: 1775423 - RNA, 19 nt, Human
uucgcuccugugucuugca

SEQ ID NO: 1775424 - RNA, 19 nt, Human
uucggaacuguccuuuccu

SEQ ID NO: 1775425 - RNA, 14 nt, Human
uucucaccagcugc

SEQ ID NO: 1775426 - RNA, 15 nt, Human
uucucaccagcugca

SEQ ID NO: 1775427 - RNA, 16 nt, Human
uucucaccagcugcaa

SEQ ID NO: 1775428 - RNA, 17 nt, Human
uucucaccagcugcaaa

SEQ ID NO: 1775429 - RNA, 18 nt, Human
uucucaccagcugcaaag

SEQ ID NO: 1775430 - RNA, 19 nt, Human
uucucaccagcugcaaagu

SEQ ID NO: 1775431 - RNA, 21 nt, Human
uucucaccagcugcaaagugu

SEQ ID NO: 1775432 - RNA, 22 nt, Human
uucucaccagcugcaaaguguu

SEQ ID NO: 1775433 - RNA, 23 nt, Human
uucucaccagcugcaaaguguuu

SEQ ID NO: 1775434 - RNA, 12 nt, Human
uucucaccagcu

SEQ ID NO: 1775435 - RNA, 13 nt, Human
uucucaccagcug

SEQ ID NO: 1775436 - RNA, 14 nt, Human
aucagauugcaugu

SEQ ID NO: 1775437 - RNA, 15 nt, Human
aucagauugcaugug

SEQ ID NO: 1775438 - RNA, 16 nt, Human
aucagauugcauguga

SEQ ID NO: 1775439 - RNA, 18 nt, Human
aucagauugcaugugacu

SEQ ID NO: 1775440 - RNA, 21 nt, Human
aucagauugcaugugacucug

SEQ ID NO: 1775441 - RNA, 21 nt, Human
aucagggcaaucccaacacau

SEQ ID NO: 1775442 - RNA, 18 nt, Human
aucacggcucacugcagc

SEQ ID NO: 1775443 - RNA, 19 nt, Human
aucacggcucacugcagcc

SEQ ID NO: 1775444 - RNA, 13 nt, Human
aucacgccacugc

SEQ ID NO: 1775445 - RNA, 15 nt, Human
aucacgauguaaauu

SEQ ID NO: 1775446 - RNA, 14 nt, Human
aucacgccacugca

SEQ ID NO: 1775447 - RNA, 18 nt, Human
aucacgauguaaauuauu

SEQ ID NO: 1775448 - RNA, 19 nt, Human
aucacgauguaaauuauua

SEQ ID NO: 1775449 - RNA, 15 nt, Human
aucacggcucacugc

SEQ ID NO: 1775450 - RNA, 20 nt, Human
aucaaugagguaucuucuuu

SEQ ID NO: 1775451 - RNA, 14 nt, Human
uuccuguguccuga

SEQ ID NO: 1775452 - RNA, 16 nt, Human
aucaacaaaaauuguc

SEQ ID NO: 1775453 - RNA, 19 nt, Human
aucaacaccuuaauaugcu

SEQ ID NO: 1775454 - RNA, 11 nt, Human
uuccugugucu

SEQ ID NO: 1775455 - RNA, 20 nt, Human
uuccuguccucccagcuccu

SEQ ID NO: 1775456 - RNA, 14 nt, Human
uuccuguccuccca

SEQ ID NO: 1775457 - RNA, 11 nt, Human
uuccugugucc

SEQ ID NO: 1775458 - RNA, 23 nt, Human
uucccuccaucccccuuuacccu

SEQ ID NO: 1775459 - RNA, 22 nt, Human
auagcaaagcgacguuagucgu

SEQ ID NO: 1775460 - RNA, 17 nt, Human
uucccgggccagggcug

SEQ ID NO: 1775461 - RNA, 18 nt, Human
uucccgggccagggcugc

SEQ ID NO: 1775462 - RNA, 16 nt, Human
uuccguagacuguuua

SEQ ID NO: 1775463 - RNA, 18 nt, Human
uuccguagccagcugcuc

SEQ ID NO: 1775464 - RNA, 19 nt, Human
uuccguagguuauuuucag

SEQ ID NO: 1775465 - RNA, 18 nt, Human
uucuuuuuuuucauuaua

SEQ ID NO: 1775466 - RNA, 16 nt, Human
uugaaagaauuauccu

SEQ ID NO: 1775467 - RNA, 22 nt, Human
uucuuugggaauauuugaaucu

SEQ ID NO: 1775468 - RNA, 20 nt, Human
uucuuugggaauauuugaau

SEQ ID NO: 1775469 - RNA, 18 nt, Human
uucuuugggaauauuuga

SEQ ID NO: 1775470 - RNA, 20 nt, Human
uucuucugcuucagccuccc

SEQ ID NO: 1775471 - RNA, 13 nt, Human
uucuucugcuuca

SEQ ID NO: 1775472 - RNA, 15 nt, Human
uucuucugcuucagc

SEQ ID NO: 1775473 - RNA, 17 nt, Human
aucccaucauuuuccau

SEQ ID NO: 1775474 - RNA, 13 nt, Human
aucccaugagccu

SEQ ID NO: 1775475 - RNA, 18 nt, Human
uucuuaagacauguauca

SEQ ID NO: 1775476 - RNA, 15 nt, Human
auccuaccuugcuuu

SEQ ID NO: 1775477 - RNA, 22 nt, Human
auccuaccuugcuuuugcuucu

SEQ ID NO: 1775478 - RNA, 14 nt, Human
auccuaaaacaaau

SEQ ID NO: 1775479 - RNA, 21 nt, Human
auccgucuuuggccuccucca

SEQ ID NO: 1775480 - RNA, 13 nt, Human
auccguguugcag

SEQ ID NO: 1775481 - RNA, 23 nt, Human
auccguguugcagguucauggau

SEQ ID NO: 1775482 - RNA, 17 nt, Human
uugaaauuguauuacaa

SEQ ID NO: 1775483 - RNA, 12 nt, Human
uugaaauucuga

SEQ ID NO: 1775484 - RNA, 13 nt, Human
uugaaauucugaa

SEQ ID NO: 1775485 - RNA, 14 nt, Human
uugaaauucugaau

SEQ ID NO: 1775486 - RNA, 15 nt, Human
uugaaauucugaauu

SEQ ID NO: 1775487 - RNA, 16 nt, Human
uugaaauucugaauuu

SEQ ID NO: 1775488 - RNA, 17 nt, Human
uugaaauucugaauuug

SEQ ID NO: 1775489 - RNA, 20 nt, Human
uugaaauucugaauuugcaa

SEQ ID NO: 1775490 - RNA, 21 nt, Human
uugaaauucugaauuugcaaa

SEQ ID NO: 1775491 - RNA, 22 nt, Human
uugaaauucugaauuugcaaag

SEQ ID NO: 1775492 - RNA, 18 nt, Human
uugaaauuaaccucucac

SEQ ID NO: 1775493 - RNA, 18 nt, Human
uugaaaugcauugcucug

SEQ ID NO: 1775494 - RNA, 20 nt, Human
uugaaaugcauugcucugga

SEQ ID NO: 1775495 - RNA, 15 nt, Human
uucugccauauucug

SEQ ID NO: 1775496 - RNA, 21 nt, Human
uucugccugcccaggccccug

SEQ ID NO: 1775497 - RNA, 17 nt, Human
uucugccugcccaggcc

SEQ ID NO: 1775498 - RNA, 18 nt, Human
uucugccugcccaggccc

SEQ ID NO: 1775499 - RNA, 14 nt, Human
uucugggagggcag

SEQ ID NO: 1775500 - RNA, 21 nt, Human
uucugggagggcagcagggcu

SEQ ID NO: 1775501 - RNA, 14 nt, Human
aucaggugcugcca

SEQ ID NO: 1775502 - RNA, 14 nt, Human
auccaucaucaugu

SEQ ID NO: 1775503 - RNA, 18 nt, Human
auccaagcuggucccacu

SEQ ID NO: 1775504 - RNA, 21 nt, Human
auccaagcuggucccacucag

SEQ ID NO: 1775505 - RNA, 16 nt, Human
auccaagcaagacuga

SEQ ID NO: 1775506 - RNA, 13 nt, Human
auccacccaccuc

SEQ ID NO: 1775507 - RNA, 15 nt, Human
auccacccaccucag

SEQ ID NO: 1775508 - RNA, 16 nt, Human
auccacccaccucagc

SEQ ID NO: 1775509 - RNA, 20 nt, Human
auggcaggacgugggcuggg

SEQ ID NO: 1775510 - RNA, 21 nt, Human
auggcaggacgugggcugggc

SEQ ID NO: 1775511 - RNA, 23 nt, Human
augggaggcucacccccuucucc

SEQ ID NO: 1775512 - RNA, 13 nt, Human
uuuccccuuuccu

SEQ ID NO: 1775513 - RNA, 14 nt, Human
uuuccccuuuccug

SEQ ID NO: 1775514 - RNA, 15 nt, Human
uuuccccuuuccugu

SEQ ID NO: 1775515 - RNA, 16 nt, Human
uuuccccuuuccuguc

SEQ ID NO: 1775516 - RNA, 12 nt, Human
uuucaaagcaau

SEQ ID NO: 1775517 - RNA, 14 nt, Human
uuucaaagcaauug

SEQ ID NO: 1775518 - RNA, 21 nt, Human
uuucaaagcaauugaaaugca

SEQ ID NO: 1775519 - RNA, 22 nt, Human
uuucaaagcaauugaaaugcau

SEQ ID NO: 1775520 - RNA, 21 nt, Human
uuucaaauuggagcuucaugg

SEQ ID NO: 1775521 - RNA, 12 nt, Human
augcugcuggcc

SEQ ID NO: 1775522 - RNA, 13 nt, Human
augcugcuggcca

SEQ ID NO: 1775523 - RNA, 14 nt, Human
augcugcuggccaa

SEQ ID NO: 1775524 - RNA, 22 nt, Human
uuucaaacuuuauugacaagug

SEQ ID NO: 1775525 - RNA, 12 nt, Human
uuuauuuuucau

SEQ ID NO: 1775526 - RNA, 18 nt, Human
uuucaaaaccuuuugaaa

SEQ ID NO: 1775527 - RNA, 17 nt, Human
uuuauuuuucauuuagu

SEQ ID NO: 1775528 - RNA, 14 nt, Human
augcuauugacaau

SEQ ID NO: 1775529 - RNA, 15 nt, Human
augcuauugacaaua

SEQ ID NO: 1775530 - RNA, 17 nt, Human
augcuauugacaauaaa

SEQ ID NO: 1775531 - RNA, 18 nt, Human
augcuauugacaauaaaa

SEQ ID NO: 1775532 - RNA, 21 nt, Human
augcuauugacaauaaaauau

SEQ ID NO: 1775533 - RNA, 23 nt, Human
augcuauugacaauaaaauauua

SEQ ID NO: 1775534 - RNA, 17 nt, Human
augcaagacgcccucua

SEQ ID NO: 1775535 - RNA, 23 nt, Human
augcaagauaguuuaucuaacuu

SEQ ID NO: 1775536 - RNA, 23 nt, Human
augauucuaauuuuuaagcaaaa

SEQ ID NO: 1775537 - RNA, 22 nt, Human
augcaccagcccuuagcaggga

SEQ ID NO: 1775538 - RNA, 20 nt, Human
uuguuuugcacacuuugcca

SEQ ID NO: 1775539 - RNA, 13 nt, Human
uuuaaaaaucaac

SEQ ID NO: 1775540 - RNA, 15 nt, Human
uuuaaaaaucaacuu

SEQ ID NO: 1775541 - RNA, 16 nt, Human
uuuaaaaaucaacuuu

SEQ ID NO: 1775542 - RNA, 23 nt, Human
uuuaaaaaucaacuuuuuauugc

SEQ ID NO: 1775543 - RNA, 12 nt, Human
uuuaaaaaugca

SEQ ID NO: 1775544 - RNA, 18 nt, Human
augauacucauuucuuau

SEQ ID NO: 1775545 - RNA, 20 nt, Human
augauagcgggaaaaggaga

SEQ ID NO: 1775546 - RNA, 15 nt, Human
augauccaagcaaga

SEQ ID NO: 1775547 - RNA, 17 nt, Human
augauccaagcaagacu

SEQ ID NO: 1775548 - RNA, 13 nt, Human
uuguguucaccuu

SEQ ID NO: 1775549 - RNA, 22 nt, Human
uuguugagcaugacagccugca

SEQ ID NO: 1775550 - RNA, 10 nt, Human
augcccucuc

SEQ ID NO: 1775551 - RNA, 13 nt, Human
augcccucucagg

SEQ ID NO: 1775552 - RNA, 15 nt, Human
augcccuuaaaucau

SEQ ID NO: 1775553 - RNA, 23 nt, Human
augcagugguaugaucacggcuc

SEQ ID NO: 1775554 - RNA, 23 nt, Human
augcauuuuguuugguauuguau

SEQ ID NO: 1775555 - RNA, 22 nt, Human
augcauuuuguuugguauugua

SEQ ID NO: 1775556 - RNA, 19 nt, Human
augcauuuuguuugguauu

SEQ ID NO: 1775557 - RNA, 19 nt, Human
augccaccaacuuacaaaa

SEQ ID NO: 1775558 - RNA, 20 nt, Human
augccaccaacuuacaaaaa

SEQ ID NO: 1775559 - RNA, 15 nt, Human
augccacccacaucu

SEQ ID NO: 1775560 - RNA, 19 nt, Human
uuuaauuuuuuugagacag

SEQ ID NO: 1775561 - RNA, 11 nt, Human
uuuacaacuca

SEQ ID NO: 1775562 - RNA, 22 nt, Human
uuuacaacucauuccagauccc

SEQ ID NO: 1775563 - RNA, 22 nt, Human
uuuaauuagugcuaagugugaa

SEQ ID NO: 1775564 - RNA, 21 nt, Human
uuuaauuagugcuaaguguga

SEQ ID NO: 1775565 - RNA, 20 nt, Human
uuuaauuagugcuaagugug

SEQ ID NO: 1775566 - RNA, 19 nt, Human
uuuaauuagugcuaagugu

SEQ ID NO: 1775567 - RNA, 17 nt, Human
uuuaauuagugcuaagu

SEQ ID NO: 1775568 - RNA, 15 nt, Human
uuuaauuagugcuaa

SEQ ID NO: 1775569 - RNA, 14 nt, Human
uuuaauuagugcua

SEQ ID NO: 1775570 - RNA, 18 nt, Human
uuuaaauauaugcuaagu

SEQ ID NO: 1775571 - RNA, 20 nt, Human
uuuaaauacagucuuccauu

SEQ ID NO: 1775572 - RNA, 15 nt, Human
uuuaagucccuguca

SEQ ID NO: 1775573 - RNA, 16 nt, Human
uuuaagucccugucac

SEQ ID NO: 1775574 - RNA, 23 nt, Human
augucucuuuaaugucacaggca

SEQ ID NO: 1775575 - RNA, 14 nt, Human
augucucugcaaac

SEQ ID NO: 1775576 - RNA, 12 nt, Human
augugacucuga

SEQ ID NO: 1775577 - RNA, 13 nt, Human
augugacucugaa

SEQ ID NO: 1775578 - RNA, 23 nt, Human
augugcacaugcacgugugugca

SEQ ID NO: 1775579 - RNA, 14 nt, Human
augugauuuuaacu

SEQ ID NO: 1775580 - RNA, 15 nt, Human
augugauuuuaacuc

SEQ ID NO: 1775581 - RNA, 16 nt, Human
augugauuuuaacucu

SEQ ID NO: 1775582 - RNA, 18 nt, Human
augugauuuuaacucugu

SEQ ID NO: 1775583 - RNA, 19 nt, Human
augugauuuuaacucuguc

SEQ ID NO: 1775584 - RNA, 20 nt, Human
augugauuuuaacucugucu

SEQ ID NO: 1775585 - RNA, 18 nt, Human
augugacucugaagcuga

SEQ ID NO: 1775586 - RNA, 15 nt, Human
uuugugacauuccuu

SEQ ID NO: 1775587 - RNA, 22 nt, Human
uuuggcaggggcagaaaacucu

SEQ ID NO: 1775588 - RNA, 20 nt, Human
uuuggcagagcuucuuccag

SEQ ID NO: 1775589 - RNA, 13 nt, Human
uuugccucugccu

SEQ ID NO: 1775590 - RNA, 13 nt, Human
uuugcugcuucug

SEQ ID NO: 1775591 - RNA, 15 nt, Human
uuugcugccaaaugc

SEQ ID NO: 1775592 - RNA, 19 nt, Human
uuugcugccaaaugcguau

SEQ ID NO: 1775593 - RNA, 17 nt, Human
uuuggcaaugccaucau

SEQ ID NO: 1775594 - RNA, 14 nt, Human
uuugcaaccucgcu

SEQ ID NO: 1775595 - RNA, 20 nt, Human
uuugcaagggaaaagucucu

SEQ ID NO: 1775596 - RNA, 21 nt, Human
uuugcaagggaaaagucucuu

SEQ ID NO: 1775597 - RNA, 18 nt, Human
uuugccggauacaaacug

SEQ ID NO: 1775598 - RNA, 16 nt, Human
auguagccuucacaca

SEQ ID NO: 1775599 - RNA, 22 nt, Human
auguagccuucacacagauaga

SEQ ID NO: 1775600 - RNA, 14 nt, Human
auguaggaaguagg

SEQ ID NO: 1775601 - RNA, 21 nt, Human
auguagcaaaauacaugacau

SEQ ID NO: 1775602 - RNA, 14 nt, Human
auguagaaaauuug

SEQ ID NO: 1775603 - RNA, 17 nt, Human
auguagaauauucagac

SEQ ID NO: 1775604 - RNA, 20 nt, Human
auguagaauauucagacaaa

SEQ ID NO: 1775605 - RNA, 17 nt, Human
auguacuccucuuuaca

SEQ ID NO: 1775606 - RNA, 20 nt, Human
auguacuccucuuuacacug

SEQ ID NO: 1775607 - RNA, 18 nt, Human
auguaccaugaaacaaag

SEQ ID NO: 1775608 - RNA, 16 nt, Human
augguuguauuagaug

SEQ ID NO: 1775609 - RNA, 14 nt, Human
augguuguauuaga

SEQ ID NO: 1775610 - RNA, 13 nt, Human
augguuguauuag

SEQ ID NO: 1775611 - RNA, 12 nt, Human
augguuguauua

SEQ ID NO: 1775612 - RNA, 21 nt, Human
augguuguauuagauguucuc

SEQ ID NO: 1775613 - RNA, 18 nt, Human
augguuguauuagauguu

SEQ ID NO: 1775614 - RNA, 22 nt, Human
auguaaaaggccaaaccucugu

SEQ ID NO: 1775615 - RNA, 23 nt, Human
auguaaaaggccaaaccucuguu

SEQ ID NO: 1775616 - RNA, 15 nt, Human
auguaaaaggccaaa

SEQ ID NO: 1775617 - RNA, 18 nt, Human
auguaaaaggccaaaccu

SEQ ID NO: 1775618 - RNA, 14 nt, Human
auguaaacugugca

SEQ ID NO: 1775619 - RNA, 14 nt, Human
auguaaauccccac

SEQ ID NO: 1775620 - RNA, 12 nt, Human
augguggcuggg

SEQ ID NO: 1775621 - RNA, 14 nt, Human
augguggagggcca

SEQ ID NO: 1775622 - RNA, 13 nt, Human
augguggagggcc

SEQ ID NO: 1775623 - RNA, 20 nt, Human
auggugcuacgccugcaugu

SEQ ID NO: 1775624 - RNA, 13 nt, Human
augguggcugggu

SEQ ID NO: 1775625 - RNA, 15 nt, Human
augguggcuggguug

SEQ ID NO: 1775626 - RNA, 17 nt, Human
augguggcuggguugga

SEQ ID NO: 1775627 - RNA, 18 nt, Human
augguguggguguccugc

SEQ ID NO: 1775628 - RNA, 20 nt, Human
augguguggguguccugccu

SEQ ID NO: 1775629 - RNA, 17 nt, Human
auggugugccuuccaga

SEQ ID NO: 1775630 - RNA, 15 nt, Human
uuucuguaaacucug

SEQ ID NO: 1775631 - RNA, 15 nt, Human
uuucugucccuucug

SEQ ID NO: 1775632 - RNA, 13 nt, Human
uuucugugcccuc

SEQ ID NO: 1775633 - RNA, 17 nt, Human
uuucugugcccuccuga

SEQ ID NO: 1775634 - RNA, 15 nt, Human
uuucuuucuuagaaa

SEQ ID NO: 1775635 - RNA, 13 nt, Human
uuucuuucuuaga

SEQ ID NO: 1775636 - RNA, 18 nt, Human
uuucuuuccuccuuuccu

SEQ ID NO: 1775637 - RNA, 18 nt, Human
augggcaacccccagccu

SEQ ID NO: 1775638 - RNA, 18 nt, Human
augggaugguggagggcc

SEQ ID NO: 1775639 - RNA, 18 nt, Human
auggggucuguaaaaucu

SEQ ID NO: 1775640 - RNA, 17 nt, Human
auggggucuguaaaauc

SEQ ID NO: 1775641 - RNA, 16 nt, Human
auggggucuguaaaau

SEQ ID NO: 1775642 - RNA, 14 nt, Human
augggugaaggcug

SEQ ID NO: 1775643 - RNA, 13 nt, Human
augggucagagcu

SEQ ID NO: 1775644 - RNA, 14 nt, Human
augggucagagcua

SEQ ID NO: 1775645 - RNA, 15 nt, Human
augggugaaggcugg

SEQ ID NO: 1775646 - RNA, 16 nt, Human
augggugaaggcuggc

SEQ ID NO: 1775647 - RNA, 17 nt, Human
augggugaaggcuggca

SEQ ID NO: 1775648 - RNA, 18 nt, Human
augggugaaggcuggcau

SEQ ID NO: 1775649 - RNA, 14 nt, Human
augggggcagggcu

SEQ ID NO: 1775650 - RNA, 15 nt, Human
augggggcagggcug

SEQ ID NO: 1775651 - RNA, 16 nt, Human
augggggcagggcugu

SEQ ID NO: 1775652 - RNA, 18 nt, Human
augggccuccugugugug

SEQ ID NO: 1775653 - RNA, 18 nt, Human
augggccugccgggcuga

SEQ ID NO: 1775654 - RNA, 20 nt, Human
augggccugccgggcugagg

SEQ ID NO: 1775655 - RNA, 22 nt, Human
augggccugccgggcugagggc

SEQ ID NO: 1775656 - RNA, 11 nt, Human
uuugaaauucu

SEQ ID NO: 1775657 - RNA, 13 nt, Human
uuugaaauucuga

SEQ ID NO: 1775658 - RNA, 14 nt, Human
uuugaaauucugaa

SEQ ID NO: 1775659 - RNA, 15 nt, Human
uuugaaauucugaau

SEQ ID NO: 1775660 - RNA, 16 nt, Human
uuugaaauucugaauu

SEQ ID NO: 1775661 - RNA, 17 nt, Human
uuugaaauucugaauuu

SEQ ID NO: 1775662 - RNA, 18 nt, Human
uuugaaauucugaauuug

SEQ ID NO: 1775663 - RNA, 18 nt, Human
uuugaaauuaaccucuca

SEQ ID NO: 1775664 - RNA, 11 nt, Human
auggggagggg

SEQ ID NO: 1775665 - RNA, 12 nt, Human
auggggaggggc

SEQ ID NO: 1775666 - RNA, 23 nt, Human
uuucuuugggaauauuugaaucu

SEQ ID NO: 1775667 - RNA, 21 nt, Human
uuucuuugggaauauuugaau

SEQ ID NO: 1775668 - RNA, 19 nt, Human
uuucuuugggaauauuuga

SEQ ID NO: 1775669 - RNA, 17 nt, Human
uuucuuugggaauauuu

SEQ ID NO: 1775670 - RNA, 19 nt, Human
auugaaaaaauagagccug

SEQ ID NO: 1775671 - RNA, 22 nt, Human
auugaaaaaauagagccugagg

SEQ ID NO: 1775672 - RNA, 14 nt, Human
auugaaaaaauaga

SEQ ID NO: 1775673 - RNA, 18 nt, Human
auugaaaaaauagagccu

SEQ ID NO: 1775674 - RNA, 13 nt, Human
auugacucugggu

SEQ ID NO: 1775675 - RNA, 14 nt, Human
auugacucuggguc

SEQ ID NO: 1775676 - RNA, 15 nt, Human
auugacucugggucc

SEQ ID NO: 1775677 - RNA, 16 nt, Human
auugacucuggguccu

SEQ ID NO: 1775678 - RNA, 20 nt, Human
auugacucuggguccuuccu

SEQ ID NO: 1775679 - RNA, 22 nt, Human
auugacucuggguccuuccuga

SEQ ID NO: 1775680 - RNA, 23 nt, Human
auugacucuggguccuuccugaa

SEQ ID NO: 1775681 - RNA, 13 nt, Human
auugacaauaaaa

SEQ ID NO: 1775682 - RNA, 15 nt, Human
auugacaauaaaaua

SEQ ID NO: 1775683 - RNA, 16 nt, Human
auugacaauaaaauau

SEQ ID NO: 1775684 - RNA, 17 nt, Human
auugacaauaaaauauu

SEQ ID NO: 1775685 - RNA, 18 nt, Human
auugacaauaaaauauua

SEQ ID NO: 1775686 - RNA, 20 nt, Human
auugacaauaaaauauuauu

SEQ ID NO: 1775687 - RNA, 19 nt, Human
auugaacuuacuguagccu

SEQ ID NO: 1775688 - RNA, 22 nt, Human
auugaacuuacuguagccucag

SEQ ID NO: 1775689 - RNA, 11 nt, Human
auucugccugc

SEQ ID NO: 1775690 - RNA, 13 nt, Human
auucugccugccc

SEQ ID NO: 1775691 - RNA, 14 nt, Human
auucugccugccca

SEQ ID NO: 1775692 - RNA, 15 nt, Human
auucugccugcccag

SEQ ID NO: 1775693 - RNA, 16 nt, Human
auucugccugcccagg

SEQ ID NO: 1775694 - RNA, 17 nt, Human
auucugccugcccaggc

SEQ ID NO: 1775695 - RNA, 18 nt, Human
auucugccugcccaggcc

SEQ ID NO: 1775696 - RNA, 19 nt, Human
auucugccugcccaggccc

SEQ ID NO: 1775697 - RNA, 17 nt, Human
auucucauuugucacac

SEQ ID NO: 1775698 - RNA, 20 nt, Human
auucuaggccuccuggccca

SEQ ID NO: 1775699 - RNA, 22 nt, Human
auucuaguacuagaaacugaag

SEQ ID NO: 1775700 - RNA, 18 nt, Human
auucuaggccuccuggcc

SEQ ID NO: 1775701 - RNA, 19 nt, Human
auucuaggccuccuggccc

SEQ ID NO: 1775702 - RNA, 18 nt, Human
auucugcucacauaucug

SEQ ID NO: 1775703 - RNA, 20 nt, Human
auucugccugcccaggcccc

SEQ ID NO: 1775704 - RNA, 21 nt, Human
auucugccugcccaggccccu

SEQ ID NO: 1775705 - RNA, 19 nt, Human
auucugcucacauaucugu

SEQ ID NO: 1775706 - RNA, 20 nt, Human
auucugcucacauaucuguc

SEQ ID NO: 1775707 - RNA, 21 nt, Human
auucugcucacauaucuguca

SEQ ID NO: 1775708 - RNA, 22 nt, Human
auucugcucacauaucugucau

SEQ ID NO: 1775709 - RNA, 19 nt, Human
auucuguuggccaguguga

SEQ ID NO: 1775710 - RNA, 21 nt, Human
auucuguuggccagugugaca

SEQ ID NO: 1775711 - RNA, 14 nt, Human
auucuguuggccag

SEQ ID NO: 1775712 - RNA, 14 nt, Human
auuccagaucccag

SEQ ID NO: 1775713 - RNA, 16 nt, Human
auuccagaucccaggc

SEQ ID NO: 1775714 - RNA, 17 nt, Human
auucccuagaaacuucc

SEQ ID NO: 1775715 - RNA, 20 nt, Human
auucccuagaaacuuccaaa

SEQ ID NO: 1775716 - RNA, 21 nt, Human
auucccuagaaacuuccaaau

SEQ ID NO: 1775717 - RNA, 15 nt, Human
auucuaaccuggagg

SEQ ID NO: 1775718 - RNA, 14 nt, Human
auuccccuguguca

SEQ ID NO: 1775719 - RNA, 13 nt, Human
auucagacaaaau

SEQ ID NO: 1775720 - RNA, 14 nt, Human
auucagacaaaaug

SEQ ID NO: 1775721 - RNA, 15 nt, Human
auucagacaaaaugg

SEQ ID NO: 1775722 - RNA, 17 nt, Human
auucagacaaaauggau

SEQ ID NO: 1775723 - RNA, 23 nt, Human
auucagacaaaauggauacauaa

SEQ ID NO: 1775724 - RNA, 23 nt, Human
auuauguuaaacuagcauaucug

SEQ ID NO: 1775725 - RNA, 22 nt, Human
auuauguuaaacuagcauaucu

SEQ ID NO: 1775726 - RNA, 14 nt, Human
auuauguuaaacua

SEQ ID NO: 1775727 - RNA, 13 nt, Human
auuauguuaaacu

SEQ ID NO: 1775728 - RNA, 12 nt, Human
auuauguuaaac

SEQ ID NO: 1775729 - RNA, 11 nt, Human
auuauuugcau

SEQ ID NO: 1775730 - RNA, 17 nt, Human
auuauuugucaaauugu

SEQ ID NO: 1775731 - RNA, 17 nt, Human
auucacaucuaaccuca

SEQ ID NO: 1775732 - RNA, 20 nt, Human
auucacaucuaaccucaucu

SEQ ID NO: 1775733 - RNA, 22 nt, Human
auuagugcuaagugugaacugg

SEQ ID NO: 1775734 - RNA, 20 nt, Human
auuagugcuaagugugaacu

SEQ ID NO: 1775735 - RNA, 18 nt, Human
auuagugcuaagugugaa

SEQ ID NO: 1775736 - RNA, 17 nt, Human
auuagugcuaaguguga

SEQ ID NO: 1775737 - RNA, 15 nt, Human
auuauauuuacaaau

SEQ ID NO: 1775738 - RNA, 12 nt, Human
auuuuugcaaua

SEQ ID NO: 1775739 - RNA, 17 nt, Human
auuuuugcaauaaugca

SEQ ID NO: 1775740 - RNA, 19 nt, Human
auuuuugcaauaaugcagu

SEQ ID NO: 1775741 - RNA, 20 nt, Human
auuuuugcaauaaugcagua

SEQ ID NO: 1775742 - RNA, 15 nt, Human
auuuuucucuccugu

SEQ ID NO: 1775743 - RNA, 19 nt, Human
auuuuucucuccuguccuc

SEQ ID NO: 1775744 - RNA, 23 nt, Human
auuuuuccuaugcuauugacaau

SEQ ID NO: 1775745 - RNA, 14 nt, Human
auuuuucaaagcaa

SEQ ID NO: 1775746 - RNA, 15 nt, Human
auuuuucaaagcaau

SEQ ID NO: 1775747 - RNA, 23 nt, Human
auuuuucaaagcaauugaaaugc

SEQ ID NO: 1775748 - RNA, 13 nt, Human
auuuuucaacuuu

SEQ ID NO: 1775749 - RNA, 14 nt, Human
auuuuucaacuuug

SEQ ID NO: 1775750 - RNA, 17 nt, Human
auuuuucaacuuugaau

SEQ ID NO: 1775751 - RNA, 18 nt, Human
auuuuucaacuuugaaua

SEQ ID NO: 1775752 - RNA, 22 nt, Human
auuuuucaacuuugaauaaaga

SEQ ID NO: 1775753 - RNA, 23 nt, Human
auuuuucaacuuugaauaaagaa

SEQ ID NO: 1775754 - RNA, 19 nt, Human
auuuuguuugguauuguau

SEQ ID NO: 1775755 - RNA, 18 nt, Human
auuuuguuugguauugua

SEQ ID NO: 1775756 - RNA, 17 nt, Human
auuuuguuugguauugu

SEQ ID NO: 1775757 - RNA, 14 nt, Human
auuuuguuugguau

SEQ ID NO: 1775758 - RNA, 22 nt, Human
auuuuguuugguauuguauuua

SEQ ID NO: 1775759 - RNA, 21 nt, Human
auuuuguuugguauuguauuu

SEQ ID NO: 1775760 - RNA, 20 nt, Human
auuuuguuugguauuguauu

SEQ ID NO: 1775761 - RNA, 19 nt, Human
auuuuuguagagccagggu

SEQ ID NO: 1775762 - RNA, 12 nt, Human
auuuuuguacau

SEQ ID NO: 1775763 - RNA, 13 nt, Human
auuuuuguacaug

SEQ ID NO: 1775764 - RNA, 22 nt, Human
auuuuugugauuuugugauuga

SEQ ID NO: 1775765 - RNA, 19 nt, Human
auuuuguauuguuucaauu

SEQ ID NO: 1775766 - RNA, 12 nt, Human
auuuuguguccu

SEQ ID NO: 1775767 - RNA, 21 nt, Human
auuuuguguccuccaggagcu

SEQ ID NO: 1775768 - RNA, 17 nt, Human
auuuugugacauuccuu

SEQ ID NO: 1775769 - RNA, 19 nt, Human
auuuugucauaucaaauaa

SEQ ID NO: 1775770 - RNA, 14 nt, Human
auuuuguucucugg

SEQ ID NO: 1775771 - RNA, 15 nt, Human
auuuuguucucuggg

SEQ ID NO: 1775772 - RNA, 16 nt, Human
auuuuguucucuggga

SEQ ID NO: 1775773 - RNA, 18 nt, Human
auuuuguucucugggaga

SEQ ID NO: 1775774 - RNA, 21 nt, Human
auuuuguucucugggagaaaa

SEQ ID NO: 1775775 - RNA, 22 nt, Human
auuuuguucucugggagaaaau

SEQ ID NO: 1775776 - RNA, 14 nt, Human
auuuucuagauaca

SEQ ID NO: 1775777 - RNA, 16 nt, Human
auuuucuagauacaau

SEQ ID NO: 1775778 - RNA, 18 nt, Human
auuuucuagauacaauaa

SEQ ID NO: 1775779 - RNA, 19 nt, Human
auuuucuagauacaauaaa

SEQ ID NO: 1775780 - RNA, 19 nt, Human
auuuugauccaagcugguc

SEQ ID NO: 1775781 - RNA, 15 nt, Human
auuuucuauaauuua

SEQ ID NO: 1775782 - RNA, 14 nt, Human
auuuucuauaauuu

SEQ ID NO: 1775783 - RNA, 21 nt, Human
auuguuuggggaugagaaagg

SEQ ID NO: 1775784 - RNA, 19 nt, Human
auuggacaguaaaauccac

SEQ ID NO: 1775785 - RNA, 14 nt, Human
auuggacccuucca

SEQ ID NO: 1775786 - RNA, 14 nt, Human
auuugucaaauugu

SEQ ID NO: 1775787 - RNA, 13 nt, Human
auuuuaacucugu

SEQ ID NO: 1775788 - RNA, 14 nt, Human
auuuuaacucuguc

SEQ ID NO: 1775789 - RNA, 16 nt, Human
auuuuaacucugucuu

SEQ ID NO: 1775790 - RNA, 15 nt, Human
auuuuaacucugucu

SEQ ID NO: 1775791 - RNA, 20 nt, Human
auuugucaauuuaugaauau

SEQ ID NO: 1775792 - RNA, 23 nt, Human
auuuauuuccuaguucuguagaa

SEQ ID NO: 1775793 - RNA, 18 nt, Human
auuuauuuccuaguucug

SEQ ID NO: 1775794 - RNA, 13 nt, Human
auuuauuuccuag

SEQ ID NO: 1775795 - RNA, 13 nt, Human
auuuauuugcuuc

SEQ ID NO: 1775796 - RNA, 15 nt, Human
auuuauuugcuucuu

SEQ ID NO: 1775797 - RNA, 16 nt, Human
auuuauuugcuucuuc

SEQ ID NO: 1775798 - RNA, 20 nt, Human
auuucuugagguaaaagcau

SEQ ID NO: 1775799 - RNA, 16 nt, Human
aaaaaauguauaugca

SEQ ID NO: 1775800 - RNA, 11 nt, Human
aaaaaauaugu

SEQ ID NO: 1775801 - RNA, 16 nt, Human
acucugucuucaccug

SEQ ID NO: 1775802 - RNA, 17 nt, Human
acucugucuucaccuga

SEQ ID NO: 1775803 - RNA, 18 nt, Human
acucugucuucaccugau

SEQ ID NO: 1775804 - RNA, 22 nt, Human
acucugucuucaccugauucaa

SEQ ID NO: 1775805 - RNA, 19 nt, Human
acuggaagcacagcuucau

SEQ ID NO: 1775806 - RNA, 17 nt, Human
acuggaagcacagcuuc

SEQ ID NO: 1775807 - RNA, 22 nt, Human
acugucuccauggcccugcaaa

SEQ ID NO: 1775808 - RNA, 21 nt, Human
acugugagcucccaggugcag

SEQ ID NO: 1775809 - RNA, 16 nt, Human
acugguauucuguucu

SEQ ID NO: 1775810 - RNA, 22 nt, Human
acugguuggcucccgcggugcc

SEQ ID NO: 1775811 - RNA, 14 nt, Human
acuguaagaauaau

SEQ ID NO: 1775812 - RNA, 15 nt, Human
acuguaagaauaauu

SEQ ID NO: 1775813 - RNA, 18 nt, Human
acuuguaaaggaauuuaa

SEQ ID NO: 1775814 - RNA, 20 nt, Human
acuuuucauaaccuagccuu

SEQ ID NO: 1775815 - RNA, 14 nt, Human
acuuuucuuugugg

SEQ ID NO: 1775816 - RNA, 12 nt, Human
acuuuugacaaa

SEQ ID NO: 1775817 - RNA, 15 nt, Human
acuuuugcccuuuga

SEQ ID NO: 1775818 - RNA, 18 nt, Human
acuuuuggaaccaugccu

SEQ ID NO: 1775819 - RNA, 21 nt, Human
acuuuuggaaccaugccuucc

SEQ ID NO: 1775820 - RNA, 11 nt, Human
agaaaauauaa

SEQ ID NO: 1775821 - RNA, 12 nt, Human
agaaaauauaag

SEQ ID NO: 1775822 - RNA, 14 nt, Human
acuuuuaaggcagu

SEQ ID NO: 1775823 - RNA, 17 nt, Human
acuuuauugacaaguga

SEQ ID NO: 1775824 - RNA, 22 nt, Human
acuuuauuuucuauaauuuaaa

SEQ ID NO: 1775825 - RNA, 23 nt, Human
agaaaguacuucuccacccugcu

SEQ ID NO: 1775826 - RNA, 19 nt, Human
agaaagguuuugagcaugg

SEQ ID NO: 1775827 - RNA, 21 nt, Human
agaaagguuuugagcaugggu

SEQ ID NO: 1775828 - RNA, 22 nt, Human
agaaaguacuucuccacccugc

SEQ ID NO: 1775829 - RNA, 19 nt, Human
agaaaguggaaaacaagga

SEQ ID NO: 1775830 - RNA, 20 nt, Human
agaaaguggaaaacaaggaa

SEQ ID NO: 1775831 - RNA, 23 nt, Human
agaaaguggaaaacaaggaaguc

SEQ ID NO: 1775832 - RNA, 19 nt, Human
agaaaggccuuuaaaauuu

SEQ ID NO: 1775833 - RNA, 17 nt, Human
agaaaggccuuuaaaau

SEQ ID NO: 1775834 - RNA, 16 nt, Human
agaaaggccuuuaaaa

SEQ ID NO: 1775835 - RNA, 12 nt, Human
agaaaaucauca

SEQ ID NO: 1775836 - RNA, 13 nt, Human
agaaaaucaucaa

SEQ ID NO: 1775837 - RNA, 17 nt, Human
agaaaaucaucaagaag

SEQ ID NO: 1775838 - RNA, 19 nt, Human
agaaaaucaucaagaaggg

SEQ ID NO: 1775839 - RNA, 19 nt, Human
agaaaauggaaccaggcuu

SEQ ID NO: 1775840 - RNA, 15 nt, Human
agaaaggccuuuaaa

SEQ ID NO: 1775841 - RNA, 14 nt, Human
agaaaggccuuuaa

SEQ ID NO: 1775842 - RNA, 22 nt, Human
agaaaauggaaccaggcuugga

SEQ ID NO: 1775843 - RNA, 20 nt, Human
agaaaauggaaccaggcuug

SEQ ID NO: 1775844 - RNA, 14 nt, Human
agaaauaauaugca

SEQ ID NO: 1775845 - RNA, 15 nt, Human
agaaauaauaugcau

SEQ ID NO: 1775846 - RNA, 16 nt, Human
agaaauaauaugcauu

SEQ ID NO: 1775847 - RNA, 18 nt, Human
accugcccuuuuuucugc

SEQ ID NO: 1775848 - RNA, 20 nt, Human
accugcccuuuuuucugccu

SEQ ID NO: 1775849 - RNA, 21 nt, Human
accugcccuuuuuucugccuc

SEQ ID NO: 1775850 - RNA, 22 nt, Human
accugcccuuuuuucugccucc

SEQ ID NO: 1775851 - RNA, 23 nt, Human
accugcccuuuuuucugccuccu

SEQ ID NO: 1775852 - RNA, 12 nt, Human
accugucuccuu

SEQ ID NO: 1775853 - RNA, 22 nt, Human
accugucuccuuucaccccagg

SEQ ID NO: 1775854 - RNA, 17 nt, Human
accuuggcugcagggag

SEQ ID NO: 1775855 - RNA, 18 nt, Human
accuuggcugcagggagu

SEQ ID NO: 1775856 - RNA, 16 nt, Human
acgucucgccaagcag

SEQ ID NO: 1775857 - RNA, 19 nt, Human
acuaagaaccccucugcuu

SEQ ID NO: 1775858 - RNA, 18 nt, Human
acuaaguagcccauaagg

SEQ ID NO: 1775859 - RNA, 13 nt, Human
acgucugacaggc

SEQ ID NO: 1775860 - RNA, 14 nt, Human
acgucugacaggca

SEQ ID NO: 1775861 - RNA, 15 nt, Human
acgucugacaggcaa

SEQ ID NO: 1775862 - RNA, 20 nt, Human
acgcuuuuaaugaaaaggaa

SEQ ID NO: 1775863 - RNA, 22 nt, Human
acgcuuuuaaugaaaaggaauc

SEQ ID NO: 1775864 - RNA, 19 nt, Human
acucugucgcccagucugg

SEQ ID NO: 1775865 - RNA, 19 nt, Human
acuauuuauugacucuggg

SEQ ID NO: 1775866 - RNA, 20 nt, Human
acuauuuauugacucugggu

SEQ ID NO: 1775867 - RNA, 23 nt, Human
acuagcaccauuuuaagucccug

SEQ ID NO: 1775868 - RNA, 19 nt, Human
acuagcauaucugccuuua

SEQ ID NO: 1775869 - RNA, 17 nt, Human
acuagcauaucugccuu

SEQ ID NO: 1775870 - RNA, 15 nt, Human
acuagcauaucugcc

SEQ ID NO: 1775871 - RNA, 20 nt, Human
acuagugggguuuccuggca

SEQ ID NO: 1775872 - RNA, 19 nt, Human
acucaguccauagcagaga

SEQ ID NO: 1775873 - RNA, 16 nt, Human
acucagggcuccuggg

SEQ ID NO: 1775874 - RNA, 13 nt, Human
acuagcauaucug

SEQ ID NO: 1775875 - RNA, 20 nt, Human
acuagauuuucacuuaugaa

SEQ ID NO: 1775876 - RNA, 18 nt, Human
acaggcaaugcuggcugu

SEQ ID NO: 1775877 - RNA, 12 nt, Human
acaggcaagcac

SEQ ID NO: 1775878 - RNA, 16 nt, Human
acagcucuucuccagg

SEQ ID NO: 1775879 - RNA, 17 nt, Human
acagcucuucuccaggc

SEQ ID NO: 1775880 - RNA, 18 nt, Human
acagcucuucuccaggcu

SEQ ID NO: 1775881 - RNA, 18 nt, Human
acagccacggccaggcca

SEQ ID NO: 1775882 - RNA, 15 nt, Human
acagccacggccagg

SEQ ID NO: 1775883 - RNA, 16 nt, Human
acagccacggccaggc

SEQ ID NO: 1775884 - RNA, 17 nt, Human
acagccacggccaggcc

SEQ ID NO: 1775885 - RNA, 11 nt, Human
acagacacagg

SEQ ID NO: 1775886 - RNA, 15 nt, Human
acagacacaggcccg

SEQ ID NO: 1775887 - RNA, 19 nt, Human
acagaggcagccccauucu

SEQ ID NO: 1775888 - RNA, 23 nt, Human
acagaggcagccccauucugccu

SEQ ID NO: 1775889 - RNA, 13 nt, Human
acagacacaggcc

SEQ ID NO: 1775890 - RNA, 14 nt, Human
acagacacaggccc

SEQ ID NO: 1775891 - RNA, 14 nt, Human
acagaggcagcccc

SEQ ID NO: 1775892 - RNA, 15 nt, Human
acagaggcagcccca

SEQ ID NO: 1775893 - RNA, 15 nt, Human
acagagugagacucu

SEQ ID NO: 1775894 - RNA, 19 nt, Human
acagagugagacucugucu

SEQ ID NO: 1775895 - RNA, 20 nt, Human
acacagcucuguccugggag

SEQ ID NO: 1775896 - RNA, 16 nt, Human
acacagauagaccuuu

SEQ ID NO: 1775897 - RNA, 11 nt, Human
acacagcucuu

SEQ ID NO: 1775898 - RNA, 13 nt, Human
acacagcucuucu

SEQ ID NO: 1775899 - RNA, 15 nt, Human
acacgcgugcacaca

SEQ ID NO: 1775900 - RNA, 17 nt, Human
acacgcgugcacacacc

SEQ ID NO: 1775901 - RNA, 14 nt, Human
aauuuuguucucug

SEQ ID NO: 1775902 - RNA, 15 nt, Human
aauuuuguucucugg

SEQ ID NO: 1775903 - RNA, 16 nt, Human
aauuuuguucucuggg

SEQ ID NO: 1775904 - RNA, 17 nt, Human
aauuuuguucucuggga

SEQ ID NO: 1775905 - RNA, 18 nt, Human
aauuuuguucucugggag

SEQ ID NO: 1775906 - RNA, 19 nt, Human
aauuuuguucucugggaga

SEQ ID NO: 1775907 - RNA, 21 nt, Human
aauuuuguucucugggagaaa

SEQ ID NO: 1775908 - RNA, 23 nt, Human
aauuuuguucucugggagaaaau

SEQ ID NO: 1775909 - RNA, 24 nt, Human
aauuuuguucucugggagaaaauc

SEQ ID NO: 1775910 - RNA, 19 nt, Human
aauuuuccuaauaaaguuc

SEQ ID NO: 1775911 - RNA, 14 nt, Human
acaacgugcauugu

SEQ ID NO: 1775912 - RNA, 13 nt, Human
acaacgugcauug

SEQ ID NO: 1775913 - RNA, 18 nt, Human
acaacgugcauugugcuu

SEQ ID NO: 1775914 - RNA, 17 nt, Human
acaacgugcauugugcu

SEQ ID NO: 1775915 - RNA, 16 nt, Human
acaacgugcauugugc

SEQ ID NO: 1775916 - RNA, 15 nt, Human
acaacgugcauugug

SEQ ID NO: 1775917 - RNA, 17 nt, Human
acaaggauugcuacugu

SEQ ID NO: 1775918 - RNA, 19 nt, Human
accagauaacugaggaggg

SEQ ID NO: 1775919 - RNA, 12 nt, Human
accaagcccagu

SEQ ID NO: 1775920 - RNA, 13 nt, Human
accaagcaggaaa

SEQ ID NO: 1775921 - RNA, 15 nt, Human
acauuuauucugcuc

SEQ ID NO: 1775922 - RNA, 19 nt, Human
acaggcaaugcuggcuguu

SEQ ID NO: 1775923 - RNA, 23 nt, Human
acaggcaaugcuggcuguuggcu

SEQ ID NO: 1775924 - RNA, 19 nt, Human
acaggguuuugccauguug

SEQ ID NO: 1775925 - RNA, 16 nt, Human
acaugugcacaugcac

SEQ ID NO: 1775926 - RNA, 18 nt, Human
acaugugcacaugcacgu

SEQ ID NO: 1775927 - RNA, 10 nt, Human
acaugcaguu

SEQ ID NO: 1775928 - RNA, 11 nt, Human
acaugcaguuu

SEQ ID NO: 1775929 - RNA, 12 nt, Human
acaugcaguuug

SEQ ID NO: 1775930 - RNA, 13 nt, Human
acaugcaguuuga

SEQ ID NO: 1775931 - RNA, 15 nt, Human
acaugcaguuugaaa

SEQ ID NO: 1775932 - RNA, 16 nt, Human
acaugcaguuugaaau

SEQ ID NO: 1775933 - RNA, 17 nt, Human
acaugcaguuugaaauu

SEQ ID NO: 1775934 - RNA, 18 nt, Human
acaugcaguuugaaauuc

SEQ ID NO: 1775935 - RNA, 19 nt, Human
acaugcaguuugaaauucu

SEQ ID NO: 1775936 - RNA, 22 nt, Human
acaugcaguuugaaauucugaa

SEQ ID NO: 1775937 - RNA, 23 nt, Human
acaugcaguuugaaauucugaau

SEQ ID NO: 1775938 - RNA, 16 nt, Human
accccuccaugugggc

SEQ ID NO: 1775939 - RNA, 19 nt, Human
accccuccaugugggcuag

SEQ ID NO: 1775940 - RNA, 18 nt, Human
acccccuucuccauccac

SEQ ID NO: 1775941 - RNA, 19 nt, Human
acccccuucuccauccaca

SEQ ID NO: 1775942 - RNA, 12 nt, Human
accccuccccau

SEQ ID NO: 1775943 - RNA, 12 nt, Human
accauaugaauu

SEQ ID NO: 1775944 - RNA, 13 nt, Human
accauaugaauug

SEQ ID NO: 1775945 - RNA, 13 nt, Human
acccaccucagcc

SEQ ID NO: 1775946 - RNA, 14 nt, Human
acccaccucagccu

SEQ ID NO: 1775947 - RNA, 15 nt, Human
acccaccucagccuc

SEQ ID NO: 1775948 - RNA, 16 nt, Human
acccaccucagccucc

SEQ ID NO: 1775949 - RNA, 22 nt, Human
acccccucuucugagcacagau

SEQ ID NO: 1775950 - RNA, 13 nt, Human
acccauugcuguu

SEQ ID NO: 1775951 - RNA, 17 nt, Human
acccauugcuguugucc

SEQ ID NO: 1775952 - RNA, 15 nt, Human
aaaauaaacacuaca

SEQ ID NO: 1775953 - RNA, 12 nt, Human
aaaaucaucaag

SEQ ID NO: 1775954 - RNA, 20 nt, Human
aaaaucaucaagaagggcug

SEQ ID NO: 1775955 - RNA, 23 nt, Human
aaaaucaucaagaagggcugcau

SEQ ID NO: 1775956 - RNA, 15 nt, Human
aaaaagaaaggaggg

SEQ ID NO: 1775957 - RNA, 20 nt, Human
aaaaagaacaugcaguuuga

SEQ ID NO: 1775958 - RNA, 16 nt, Human
aaaaguggccucuuug

SEQ ID NO: 1775959 - RNA, 17 nt, Human
aaaaguggccucuuugu

SEQ ID NO: 1775960 - RNA, 15 nt, Human
aaaagugcuucauuc

SEQ ID NO: 1775961 - RNA, 18 nt, Human
aaaagugcuucauucuuu

SEQ ID NO: 1775962 - RNA, 13 nt, Human
aaacacugugcac

SEQ ID NO: 1775963 - RNA, 12 nt, Human
aaaauugccaua

SEQ ID NO: 1775964 - RNA, 17 nt, Human
aaacucugcauccagag

SEQ ID NO: 1775965 - RNA, 23 nt, Human
aaacucugcauccagagauucau

SEQ ID NO: 1775966 - RNA, 21 nt, Human
aaacccgggaaccuccccagc

SEQ ID NO: 1775967 - RNA, 13 nt, Human
aaaccauguagaa

SEQ ID NO: 1775968 - RNA, 21 nt, Human
aaagccagcguccuccucugu

SEQ ID NO: 1775969 - RNA, 14 nt, Human
aaaggcaagcacuu

SEQ ID NO: 1775970 - RNA, 13 nt, Human
aaaggcaaggucc

SEQ ID NO: 1775971 - RNA, 17 nt, Human
aaaggccuuuaaaauuu

SEQ ID NO: 1775972 - RNA, 12 nt, Human
aaaggccuuuaa

SEQ ID NO: 1775973 - RNA, 18 nt, Human
aaaggccaaaccucuguu

SEQ ID NO: 1775974 - RNA, 20 nt, Human
aaaggccaaaccucuguuca

SEQ ID NO: 1775975 - RNA, 21 nt, Human
aaagucauuggcuuuauccuc

SEQ ID NO: 1775976 - RNA, 17 nt, Human
aaagucauuggcuuuau

SEQ ID NO: 1775977 - RNA, 15 nt, Human
aaagucauuggcuuu

SEQ ID NO: 1775978 - RNA, 14 nt, Human
aaagucauuggcuu

SEQ ID NO: 1775979 - RNA, 13 nt, Human
aaagucauuggcu

SEQ ID NO: 1775980 - RNA, 19 nt, Human
aaaguggaaaacaaggaag

SEQ ID NO: 1775981 - RNA, 20 nt, Human
aaaguggaaaacaaggaagu

SEQ ID NO: 1775982 - RNA, 22 nt, Human
aaagugcuucauucuuugcagg

SEQ ID NO: 1775983 - RNA, 23 nt, Human
aaagucauuggcuuuauccucuu

SEQ ID NO: 1775984 - RNA, 14 nt, Human
aaaguggccucuuu

SEQ ID NO: 1775985 - RNA, 16 nt, Human
aaaguggccucuuugu

SEQ ID NO: 1775986 - RNA, 18 nt, Human
aaaguggccucuuugucu

SEQ ID NO: 1775987 - RNA, 24 nt, Human
aaauagcucaggugucccugcacu

SEQ ID NO: 1775988 - RNA, 14 nt, Human
aaauaguuaauaua

SEQ ID NO: 1775989 - RNA, 17 nt, Human
aaauaguuaauauaguc

SEQ ID NO: 1775990 - RNA, 12 nt, Human
aacuuacaaaaa

SEQ ID NO: 1775991 - RNA, 18 nt, Human
aacuuacaaaaacacuuc

SEQ ID NO: 1775992 - RNA, 14 nt, Human
aacuuaagcaaagg

SEQ ID NO: 1775993 - RNA, 21 nt, Human
aacuuaagcaaaggggacagc

SEQ ID NO: 1775994 - RNA, 11 nt, Human
aacgcugccug

SEQ ID NO: 1775995 - RNA, 12 nt, Human
aacgcugccugc

SEQ ID NO: 1775996 - RNA, 13 nt, Human
aacgcugccugcc

SEQ ID NO: 1775997 - RNA, 14 nt, Human
aacgcugccugccc

SEQ ID NO: 1775998 - RNA, 15 nt, Human
aacgcugccugccca

SEQ ID NO: 1775999 - RNA, 15 nt, Human
aacgcugccugcccg

SEQ ID NO: 1776000 - RNA, 16 nt, Human
aacgcuccuuugugug

SEQ ID NO: 1776001 - RNA, 17 nt, Human
aacggaucagaaauaca

SEQ ID NO: 1776002 - RNA, 13 nt, Human
aacggaucagaaa

SEQ ID NO: 1776003 - RNA, 17 nt, Human
aacgcugagccaccugc

SEQ ID NO: 1776004 - RNA, 18 nt, Human
aacggaucagaaauacag

SEQ ID NO: 1776005 - RNA, 21 nt, Human
aacuauuuauugacucugggu

SEQ ID NO: 1776006 - RNA, 12 nt, Human
aacucagaaggg

SEQ ID NO: 1776007 - RNA, 18 nt, Human
aaccuaccucccacacuc

SEQ ID NO: 1776008 - RNA, 22 nt, Human
aaccuaccucccacacucccaa

SEQ ID NO: 1776009 - RNA, 13 nt, Human
aaccacgcuggac

SEQ ID NO: 1776010 - RNA, 22 nt, Human
aaccacuggaaaguuuaugguu

SEQ ID NO: 1776011 - RNA, 16 nt, Human
aaccagaacaguauga

SEQ ID NO: 1776012 - RNA, 15 nt, Human
aaauuuuuuuucaug

SEQ ID NO: 1776013 - RNA, 17 nt, Human
aaauuuuuuuucauguu

SEQ ID NO: 1776014 - RNA, 22 nt, Human
aaauuuuuuuucauguuuuaac

SEQ ID NO: 1776015 - RNA, 23 nt, Human
aaauuuuuuuucauguuuuaaca

SEQ ID NO: 1776016 - RNA, 13 nt, Human
aacacgcaggagc

SEQ ID NO: 1776017 - RNA, 14 nt, Human
aacacgcaggagca

SEQ ID NO: 1776018 - RNA, 15 nt, Human
aacacgccugcaaac

SEQ ID NO: 1776019 - RNA, 20 nt, Human
aacacgccugcaaacgcugc

SEQ ID NO: 1776020 - RNA, 17 nt, Human
aaauugcuaauguugcu

SEQ ID NO: 1776021 - RNA, 23 nt, Human
aaauugccauauugcacaugucu

SEQ ID NO: 1776022 - RNA, 21 nt, Human
aaauugccauauugcacaugu

SEQ ID NO: 1776023 - RNA, 19 nt, Human
aaauugccauauugcacau

SEQ ID NO: 1776024 - RNA, 18 nt, Human
aaauugccauauugcaca

SEQ ID NO: 1776025 - RNA, 16 nt, Human
aaauugccauauugca

SEQ ID NO: 1776026 - RNA, 15 nt, Human
aaauugccauauugc

SEQ ID NO: 1776027 - RNA, 17 nt, Human
aaaucuuauaauuuaaa

SEQ ID NO: 1776028 - RNA, 21 nt, Human
aagcgauucuucugcuucagc

SEQ ID NO: 1776029 - RNA, 23 nt, Human
aagcgcuuuuccuuggcauuccg

SEQ ID NO: 1776030 - RNA, 15 nt, Human
aaggauugcuacugu

SEQ ID NO: 1776031 - RNA, 19 nt, Human
aagcugguggcagaguccu

SEQ ID NO: 1776032 - RNA, 14 nt, Human
aagcuguauuuuga

SEQ ID NO: 1776033 - RNA, 18 nt, Human
aagcuggucccacucagu

SEQ ID NO: 1776034 - RNA, 21 nt, Human
aagcuggucccacucagucca

SEQ ID NO: 1776035 - RNA, 19 nt, Human
aagccagcguccuccucug

SEQ ID NO: 1776036 - RNA, 14 nt, Human
aagccagcguccuc

SEQ ID NO: 1776037 - RNA, 17 nt, Human
aagccagcguccuccuc

SEQ ID NO: 1776038 - RNA, 19 nt, Human
aacuuuccucuuccugccu

SEQ ID NO: 1776039 - RNA, 22 nt, Human
aagagugacaguggauugcauu

SEQ ID NO: 1776040 - RNA, 18 nt, Human
aagagugacucuccaggg

SEQ ID NO: 1776041 - RNA, 19 nt, Human
aagagugacucuccagggg

SEQ ID NO: 1776042 - RNA, 22 nt, Human
aagagugacucuccaggggucc

SEQ ID NO: 1776043 - RNA, 14 nt, Human
aaggugccauggaa

SEQ ID NO: 1776044 - RNA, 17 nt, Human
aaggugccauggaagag

SEQ ID NO: 1776045 - RNA, 18 nt, Human
aaggugccauggaagagg

SEQ ID NO: 1776046 - RNA, 17 nt, Human
aagucccugucaccucu

SEQ ID NO: 1776047 - RNA, 18 nt, Human
aaguccucuuuucugaga

SEQ ID NO: 1776048 - RNA, 14 nt, Human
aaguccucccugac

SEQ ID NO: 1776049 - RNA, 21 nt, Human
aaguccucccugacuuuucug

SEQ ID NO: 1776050 - RNA, 23 nt, Human
aaguccucccugacuuuucugug

SEQ ID NO: 1776051 - RNA, 22 nt, Human
aaguccucuuuucugagaggac

SEQ ID NO: 1776052 - RNA, 17 nt, Human
aagggagcuagccagag

SEQ ID NO: 1776053 - RNA, 16 nt, Human
aagggaaauaucauuu

SEQ ID NO: 1776054 - RNA, 13 nt, Human
aagggaaauauca

SEQ ID NO: 1776055 - RNA, 14 nt, Human
aagggaaauaucau

SEQ ID NO: 1776056 - RNA, 15 nt, Human
aagggaaauaucauu

SEQ ID NO: 1776057 - RNA, 16 nt, Human
aagggaaaagucucuu

SEQ ID NO: 1776058 - RNA, 14 nt, Human
aaugcugcuggcca

SEQ ID NO: 1776059 - RNA, 17 nt, Human
aaugcugcuggccaaau

SEQ ID NO: 1776060 - RNA, 13 nt, Human
aaugguuguauua

SEQ ID NO: 1776061 - RNA, 12 nt, Human
aaugguuguauu

SEQ ID NO: 1776062 - RNA, 18 nt, Human
aaugguuguauuagaugu

SEQ ID NO: 1776063 - RNA, 22 nt, Human
aaugucacguuuuguuuugugc

SEQ ID NO: 1776064 - RNA, 16 nt, Human
aaugguuguauuagau

SEQ ID NO: 1776065 - RNA, 15 nt, Human
aaugguuguauuaga

SEQ ID NO: 1776066 - RNA, 23 nt, Human
aaugucacguuuuguuuugugcc

SEQ ID NO: 1776067 - RNA, 15 nt, Human
aauguuugccucugc

SEQ ID NO: 1776068 - RNA, 16 nt, Human
aauguuugccucugcc

SEQ ID NO: 1776069 - RNA, 14 nt, Human
aauguuuaaugcug

SEQ ID NO: 1776070 - RNA, 20 nt, Human
aaugucuuuuuucaaacuuu

SEQ ID NO: 1776071 - RNA, 13 nt, Human
aauacucugcccu

SEQ ID NO: 1776072 - RNA, 17 nt, Human
aauacucugcccucuag

SEQ ID NO: 1776073 - RNA, 23 nt, Human
aauacucugcccucuagagccuu

SEQ ID NO: 1776074 - RNA, 11 nt, Human
aauacuuuugc

SEQ ID NO: 1776075 - RNA, 15 nt, Human
aauacuguacagggg

SEQ ID NO: 1776076 - RNA, 16 nt, Human
aauacuguauuuugua

SEQ ID NO: 1776077 - RNA, 15 nt, Human
aauauacuuguggac

SEQ ID NO: 1776078 - RNA, 13 nt, Human
aauauacuugugg

SEQ ID NO: 1776079 - RNA, 16 nt, Human
aauauacuuguggacu

SEQ ID NO: 1776080 - RNA, 16 nt, Human
aaugaaguuugaaugu

SEQ ID NO: 1776081 - RNA, 15 nt, Human
aaugaaguuugaaug

SEQ ID NO: 1776082 - RNA, 14 nt, Human
aaugaaguuugaau

SEQ ID NO: 1776083 - RNA, 13 nt, Human
aaugaaguuugaa

SEQ ID NO: 1776084 - RNA, 12 nt, Human
aaugaaguuuga

SEQ ID NO: 1776085 - RNA, 14 nt, Human
aaucucuguaggaa

SEQ ID NO: 1776086 - RNA, 20 nt, Human
aaucucuuuuugcuuucgaa

SEQ ID NO: 1776087 - RNA, 19 nt, Human
aauccagacccggcugcgu

SEQ ID NO: 1776088 - RNA, 17 nt, Human
aauccagacccggcugc

SEQ ID NO: 1776089 - RNA, 15 nt, Human
aauccaaugaaauga

SEQ ID NO: 1776090 - RNA, 14 nt, Human
agaggacuuuucuu

SEQ ID NO: 1776091 - RNA, 15 nt, Human
agaggaaggggccag

SEQ ID NO: 1776092 - RNA, 16 nt, Human
agagggcacucugcuu

SEQ ID NO: 1776093 - RNA, 20 nt, Human
agaggguggugaccucugcc

SEQ ID NO: 1776094 - RNA, 22 nt, Human
agaggguggugaccucugccug

SEQ ID NO: 1776095 - RNA, 19 nt, Human
agaggguggugaccucugc

SEQ ID NO: 1776096 - RNA, 23 nt, Human
agaggguggugaccucugccuga

SEQ ID NO: 1776097 - RNA, 14 nt, Human
agagugucuuucca

SEQ ID NO: 1776098 - RNA, 15 nt, Human
agagugucuuuccac

SEQ ID NO: 1776099 - RNA, 17 nt, Human
agaguuagacuguuggg

SEQ ID NO: 1776100 - RNA, 15 nt, Human
agaguuagacuguug

SEQ ID NO: 1776101 - RNA, 14 nt, Human
agaguuagacuguu

SEQ ID NO: 1776102 - RNA, 13 nt, Human
agaguuagacugu

SEQ ID NO: 1776103 - RNA, 12 nt, Human
agaguuagacug

SEQ ID NO: 1776104 - RNA, 18 nt, Human
agacggagucccaccuug

SEQ ID NO: 1776105 - RNA, 16 nt, Human
agacggaggggaguag

SEQ ID NO: 1776106 - RNA, 18 nt, Human
agaccccaagaggaaguu

SEQ ID NO: 1776107 - RNA, 19 nt, Human
agaccccaagaggaaguuc

SEQ ID NO: 1776108 - RNA, 19 nt, Human
agagcccaccuuggcucaa

SEQ ID NO: 1776109 - RNA, 22 nt, Human
agagaggguggugaccucugcc

SEQ ID NO: 1776110 - RNA, 20 nt, Human
agagaggguggugaccucug

SEQ ID NO: 1776111 - RNA, 21 nt, Human
agagaggguggugaccucugc

SEQ ID NO: 1776112 - RNA, 19 nt, Human
agacuggaagcacagcuuc

SEQ ID NO: 1776113 - RNA, 17 nt, Human
agacuggaagcacagcu

SEQ ID NO: 1776114 - RNA, 16 nt, Human
agacuggaagcacagc

SEQ ID NO: 1776115 - RNA, 13 nt, Human
agccccagugccc

SEQ ID NO: 1776116 - RNA, 14 nt, Human
agccccagugccca

SEQ ID NO: 1776117 - RNA, 15 nt, Human
agccccagugcccac

SEQ ID NO: 1776118 - RNA, 13 nt, Human
agccccauuccug

SEQ ID NO: 1776119 - RNA, 13 nt, Human
agccccauucugc

SEQ ID NO: 1776120 - RNA, 16 nt, Human
agccccauucugccug

SEQ ID NO: 1776121 - RNA, 16 nt, Human
agccccauuccuggga

SEQ ID NO: 1776122 - RNA, 15 nt, Human
agccgcugagcgagg

SEQ ID NO: 1776123 - RNA, 19 nt, Human
agccgcugagcgaggagau

SEQ ID NO: 1776124 - RNA, 18 nt, Human
agccgccaguacuuguca

SEQ ID NO: 1776125 - RNA, 14 nt, Human
agcccucagaaccc

SEQ ID NO: 1776126 - RNA, 15 nt, Human
agcccucagaacccu

SEQ ID NO: 1776127 - RNA, 18 nt, Human
agcccucagaacccuugg

SEQ ID NO: 1776128 - RNA, 16 nt, Human
agcccucaucccgagc

SEQ ID NO: 1776129 - RNA, 19 nt, Human
agcccucagaacccuuggc

SEQ ID NO: 1776130 - RNA, 24 nt, Human
agcccucagaacccuuggcuugcc

SEQ ID NO: 1776131 - RNA, 20 nt, Human
agccucccgaguagcuggga

SEQ ID NO: 1776132 - RNA, 18 nt, Human
agccucccgaguagcugg

SEQ ID NO: 1776133 - RNA, 19 nt, Human
agccucccgaguagcuggg

SEQ ID NO: 1776134 - RNA, 21 nt, Human
agccucccaaagugcugggau

SEQ ID NO: 1776135 - RNA, 18 nt, Human
agcacugggcucccgggc

SEQ ID NO: 1776136 - RNA, 21 nt, Human
agcacugggcucccgggcccc

SEQ ID NO: 1776137 - RNA, 18 nt, Human
agcagcuuagacuaaggc

SEQ ID NO: 1776138 - RNA, 16 nt, Human
agaugggggcagggcu

SEQ ID NO: 1776139 - RNA, 17 nt, Human
agaugggggcagggcug

SEQ ID NO: 1776140 - RNA, 16 nt, Human
agccaacauguggcuc

SEQ ID NO: 1776141 - RNA, 20 nt, Human
agccaacauguggcuccucc

SEQ ID NO: 1776142 - RNA, 17 nt, Human
agccaaguagccucucc

SEQ ID NO: 1776143 - RNA, 20 nt, Human
agccaaguagccucuccugu

SEQ ID NO: 1776144 - RNA, 22 nt, Human
agcauccuggcacccggccccu

SEQ ID NO: 1776145 - RNA, 23 nt, Human
agcauccuggcacccggccccug

SEQ ID NO: 1776146 - RNA, 14 nt, Human
agcaugacagccug

SEQ ID NO: 1776147 - RNA, 15 nt, Human
agcaugacagccugc

SEQ ID NO: 1776148 - RNA, 20 nt, Human
agcaugacagccugcagcag

SEQ ID NO: 1776149 - RNA, 15 nt, Human
agcagugugaggcca

SEQ ID NO: 1776150 - RNA, 21 nt, Human
agcagugugaggccagggcag

SEQ ID NO: 1776151 - RNA, 13 nt, Human
agcuucugucucc

SEQ ID NO: 1776152 - RNA, 14 nt, Human
agcuucugucucca

SEQ ID NO: 1776153 - RNA, 17 nt, Human
agcuucugucuccagcu

SEQ ID NO: 1776154 - RNA, 20 nt, Human
aggaauccagacccggcugc

SEQ ID NO: 1776155 - RNA, 17 nt, Human
aggaauccagacccggc

SEQ ID NO: 1776156 - RNA, 13 nt, Human
aggacccagagga

SEQ ID NO: 1776157 - RNA, 15 nt, Human
aggacccagaggaag

SEQ ID NO: 1776158 - RNA, 13 nt, Human
aggacccaagcag

SEQ ID NO: 1776159 - RNA, 15 nt, Human
aggacccaagcagag

SEQ ID NO: 1776160 - RNA, 18 nt, Human
aggacccaagcagagaag

SEQ ID NO: 1776161 - RNA, 17 nt, Human
aggaguuauuuguaaug

SEQ ID NO: 1776162 - RNA, 16 nt, Human
aggauuacaugcaugu

SEQ ID NO: 1776163 - RNA, 18 nt, Human
aggauguucugggacaca

SEQ ID NO: 1776164 - RNA, 15 nt, Human
aggauguucugggac

SEQ ID NO: 1776165 - RNA, 16 nt, Human
aggauguucugggaca

SEQ ID NO: 1776166 - RNA, 12 nt, Human
agcuccuucugu

SEQ ID NO: 1776167 - RNA, 13 nt, Human
agcuccuucuguc

SEQ ID NO: 1776168 - RNA, 13 nt, Human
agcuccuuccugg

SEQ ID NO: 1776169 - RNA, 15 nt, Human
agcuccuuccuggag

SEQ ID NO: 1776170 - RNA, 19 nt, Human
agcuccuuccuggagacug

SEQ ID NO: 1776171 - RNA, 20 nt, Human
agcuccgcuuucuacccagc

SEQ ID NO: 1776172 - RNA, 21 nt, Human
agcuccgcuuucuacccagcg

SEQ ID NO: 1776173 - RNA, 23 nt, Human
agcuccgcuuucuacccagcgag

SEQ ID NO: 1776174 - RNA, 23 nt, Human
agcuccgcaggacuuccccggag

SEQ ID NO: 1776175 - RNA, 14 nt, Human
agcucccuggcuuc

SEQ ID NO: 1776176 - RNA, 16 nt, Human
agcucccuggcuucug

SEQ ID NO: 1776177 - RNA, 18 nt, Human
agcucccuggcuucugug

SEQ ID NO: 1776178 - RNA, 20 nt, Human
agcucccuggcuucuguggg

SEQ ID NO: 1776179 - RNA, 23 nt, Human
agcucccuggcuucuguggggcc

SEQ ID NO: 1776180 - RNA, 15 nt, Human
agcuccgcaggacuu

SEQ ID NO: 1776181 - RNA, 17 nt, Human
agcuuccauagcugcug

SEQ ID NO: 1776182 - RNA, 18 nt, Human
agcuuccauagcugcugc

SEQ ID NO: 1776183 - RNA, 19 nt, Human
agcuuccauagcugcugcc

SEQ ID NO: 1776184 - RNA, 21 nt, Human
agcuuccauagcugcugcccu

SEQ ID NO: 1776185 - RNA, 23 nt, Human
agcuuccauagcugcugcccuag

SEQ ID NO: 1776186 - RNA, 13 nt, Human
agcuucccuccau

SEQ ID NO: 1776187 - RNA, 22 nt, Human
agcuuccccaacacgcaggagc

SEQ ID NO: 1776188 - RNA, 23 nt, Human
agcugcgguccacccaggagccc

SEQ ID NO: 1776189 - RNA, 13 nt, Human
agcugcuccccag

SEQ ID NO: 1776190 - RNA, 18 nt, Human
agggacgccugggggugc

SEQ ID NO: 1776191 - RNA, 22 nt, Human
agggacgccugggggugccagg

SEQ ID NO: 1776192 - RNA, 13 nt, Human
agggacgccuggg

SEQ ID NO: 1776193 - RNA, 15 nt, Human
agggacgccuggggg

SEQ ID NO: 1776194 - RNA, 23 nt, Human
agggacgccugggggugccagga

SEQ ID NO: 1776195 - RNA, 13 nt, Human
aggcuguauccca

SEQ ID NO: 1776196 - RNA, 18 nt, Human
aggcuguaucccaugagc

SEQ ID NO: 1776197 - RNA, 13 nt, Human
aggcccuuugcug

SEQ ID NO: 1776198 - RNA, 14 nt, Human
aggcccuuugcugu

SEQ ID NO: 1776199 - RNA, 15 nt, Human
aggcccuuugcuguc

SEQ ID NO: 1776200 - RNA, 16 nt, Human
aggcccuuugcugucc

SEQ ID NO: 1776201 - RNA, 14 nt, Human
aggcuaaaaagcaa

SEQ ID NO: 1776202 - RNA, 15 nt, Human
aggcuaaaaagcaac

SEQ ID NO: 1776203 - RNA, 19 nt, Human
aggguaucaggugcugcca

SEQ ID NO: 1776204 - RNA, 21 nt, Human
aggguaucaggugcugccauc

SEQ ID NO: 1776205 - RNA, 18 nt, Human
aggguccagaaggagaca

SEQ ID NO: 1776206 - RNA, 21 nt, Human
agggucagacgccugaggaac

SEQ ID NO: 1776207 - RNA, 19 nt, Human
aggguccagaaggagacag

SEQ ID NO: 1776208 - RNA, 21 nt, Human
aggguccagaaggagacaggc

SEQ ID NO: 1776209 - RNA, 20 nt, Human
agguaaaagcaucacaugaa

SEQ ID NO: 1776210 - RNA, 20 nt, Human
aggugcuacacccuuuucca

SEQ ID NO: 1776211 - RNA, 21 nt, Human
aggugcuacacccuuuuccag

SEQ ID NO: 1776212 - RNA, 17 nt, Human
agguguuuauuaaaauu

SEQ ID NO: 1776213 - RNA, 18 nt, Human
agguguuuauuaaaauuc

SEQ ID NO: 1776214 - RNA, 21 nt, Human
agguguuuauuaaaauucuga

SEQ ID NO: 1776215 - RNA, 18 nt, Human
agguuccgcuuggagcag

SEQ ID NO: 1776216 - RNA, 21 nt, Human
agguuccgcuuggagcagagg

SEQ ID NO: 1776217 - RNA, 23 nt, Human
agguuccgcuuggagcagagggg

SEQ ID NO: 1776218 - RNA, 16 nt, Human
agguuauaugaauaua

SEQ ID NO: 1776219 - RNA, 17 nt, Human
agguuauaugaauauau

SEQ ID NO: 1776220 - RNA, 22 nt, Human
auguuugccucugccucugaca

SEQ ID NO: 1776221 - RNA, 19 nt, Human
auguuugccucugccucug

SEQ ID NO: 1776222 - RNA, 13 nt, Human
auguucugggaca

SEQ ID NO: 1776223 - RNA, 21 nt, Human
auguucucuaucauuuaauaa

SEQ ID NO: 1776224 - RNA, 20 nt, Human
auguucucuaucauuuaaua

SEQ ID NO: 1776225 - RNA, 19 nt, Human
auguucucuaucauuuaau

SEQ ID NO: 1776226 - RNA, 18 nt, Human
auguucucuaucauuuaa

SEQ ID NO: 1776227 - RNA, 11 nt, Human
auguucuggga

SEQ ID NO: 1776228 - RNA, 12 nt, Human
auguucugggac

SEQ ID NO: 1776229 - RNA, 18 nt, Human
auguucuaagucuuucca

SEQ ID NO: 1776230 - RNA, 19 nt, Human
auguucuaagucuuuccau

SEQ ID NO: 1776231 - RNA, 16 nt, Human
auguucucuaucauuu

SEQ ID NO: 1776232 - RNA, 15 nt, Human
auguucucuaucauu

SEQ ID NO: 1776233 - RNA, 14 nt, Human
auguucucuaucau

SEQ ID NO: 1776234 - RNA, 15 nt, Human
auguucggguguggg

SEQ ID NO: 1776235 - RNA, 20 nt, Human
augugggcuaguugggcuuc

SEQ ID NO: 1776236 - RNA, 14 nt, Human
augucuucucacaa

SEQ ID NO: 1776237 - RNA, 20 nt, Human
augucuucucacaagccagc

SEQ ID NO: 1776238 - RNA, 22 nt, Human
augucuucucacaagccagcca

SEQ ID NO: 1776239 - RNA, 10 nt, Human
augucuugug

SEQ ID NO: 1776240 - RNA, 11 nt, Human
augucuugugu

SEQ ID NO: 1776241 - RNA, 23 nt, Human
augucuuaaugaaguuugaaugu

SEQ ID NO: 1776242 - RNA, 21 nt, Human
augucuuaaugaaguuugaau

SEQ ID NO: 1776243 - RNA, 20 nt, Human
augucuuaaugaaguuugaa

SEQ ID NO: 1776244 - RNA, 18 nt, Human
auggucagcccuagggug

SEQ ID NO: 1776245 - RNA, 17 nt, Human
auggucacgcaccuggg

SEQ ID NO: 1776246 - RNA, 14 nt, Human
auguauugagauau

SEQ ID NO: 1776247 - RNA, 11 nt, Human
augauguuugc

SEQ ID NO: 1776248 - RNA, 14 nt, Human
augauguuugccca

SEQ ID NO: 1776249 - RNA, 16 nt, Human
augauguuugcccaaa

SEQ ID NO: 1776250 - RNA, 19 nt, Human
augauguuugcccaaaauu

SEQ ID NO: 1776251 - RNA, 21 nt, Human
augauguuugcccaaaauuua

SEQ ID NO: 1776252 - RNA, 22 nt, Human
augaugcucaaaaucuuuccaa

SEQ ID NO: 1776253 - RNA, 15 nt, Human
augcugcaacaaaau

SEQ ID NO: 1776254 - RNA, 16 nt, Human
augcugcaacaaaaug

SEQ ID NO: 1776255 - RNA, 18 nt, Human
augcugcaacaaaaugua

SEQ ID NO: 1776256 - RNA, 20 nt, Human
augcugcaacaaaauguaga

SEQ ID NO: 1776257 - RNA, 15 nt, Human
augagcucuacccag

SEQ ID NO: 1776258 - RNA, 16 nt, Human
augagcucuacccagg

SEQ ID NO: 1776259 - RNA, 18 nt, Human
augagcucuacccagggc

SEQ ID NO: 1776260 - RNA, 19 nt, Human
augagcucuacccagggcc

SEQ ID NO: 1776261 - RNA, 22 nt, Human
augagcucuacccagggccugc

SEQ ID NO: 1776262 - RNA, 21 nt, Human
augaggaggggccccccugcc

SEQ ID NO: 1776263 - RNA, 20 nt, Human
augaaguuugaauguuaaau

SEQ ID NO: 1776264 - RNA, 19 nt, Human
augaaguuugaauguuaaa

SEQ ID NO: 1776265 - RNA, 18 nt, Human
augaaguuugaauguuaa

SEQ ID NO: 1776266 - RNA, 16 nt, Human
augaaguuugaauguu

SEQ ID NO: 1776267 - RNA, 15 nt, Human
augaaguuugaaugu

SEQ ID NO: 1776268 - RNA, 14 nt, Human
augaaguuugaaug

SEQ ID NO: 1776269 - RNA, 13 nt, Human
augaaguuugaau

SEQ ID NO: 1776270 - RNA, 16 nt, Human
augaaaaaauguauau

SEQ ID NO: 1776271 - RNA, 19 nt, Human
aucucgcucccucccagga

SEQ ID NO: 1776272 - RNA, 17 nt, Human
aucucgcucccucccag

SEQ ID NO: 1776273 - RNA, 14 nt, Human
aucuccccucagcu

SEQ ID NO: 1776274 - RNA, 15 nt, Human
aucuccccucagcuc

SEQ ID NO: 1776275 - RNA, 16 nt, Human
aucuccccucagcucg

SEQ ID NO: 1776276 - RNA, 20 nt, Human
aucuccccucagcucggcuc

SEQ ID NO: 1776277 - RNA, 16 nt, Human
aucuugaauuguaacu

SEQ ID NO: 1776278 - RNA, 18 nt, Human
aucuugaauacucugccc

SEQ ID NO: 1776279 - RNA, 19 nt, Human
aucuugaauacucugcccu

SEQ ID NO: 1776280 - RNA, 21 nt, Human
aucuugaauacucugcccucu

SEQ ID NO: 1776281 - RNA, 14 nt, Human
aucuucuucaccau

SEQ ID NO: 1776282 - RNA, 15 nt, Human
auccagacccggcug

SEQ ID NO: 1776283 - RNA, 15 nt, Human
auccagcuauguuau

SEQ ID NO: 1776284 - RNA, 12 nt, Human
auccuaugugau

SEQ ID NO: 1776285 - RNA, 14 nt, Human
auccuaugugauuu

SEQ ID NO: 1776286 - RNA, 12 nt, Human
auccuauguuuu

SEQ ID NO: 1776287 - RNA, 16 nt, Human
auccuaugugauuuua

SEQ ID NO: 1776288 - RNA, 17 nt, Human
auccuaugugauuuuaa

SEQ ID NO: 1776289 - RNA, 20 nt, Human
auccuauguuuuuguucaaa

SEQ ID NO: 1776290 - RNA, 23 nt, Human
auccuaugugauuuuaacucugu

SEQ ID NO: 1776291 - RNA, 13 nt, Human
auccuauucuuuc

SEQ ID NO: 1776292 - RNA, 19 nt, Human
auccuccacguucugcuca

SEQ ID NO: 1776293 - RNA, 15 nt, Human
auccucccaccucag

SEQ ID NO: 1776294 - RNA, 20 nt, Human
auccucccaccucagccucc

SEQ ID NO: 1776295 - RNA, 18 nt, Human
auccucccaccucagccu

SEQ ID NO: 1776296 - RNA, 19 nt, Human
auccucccaccucagccuc

SEQ ID NO: 1776297 - RNA, 12 nt, Human
aucagccaauua

SEQ ID NO: 1776298 - RNA, 14 nt, Human
aucagccaauuaug

SEQ ID NO: 1776299 - RNA, 13 nt, Human
aucagcuccuucc

SEQ ID NO: 1776300 - RNA, 15 nt, Human
aucagcuccuuccug

SEQ ID NO: 1776301 - RNA, 14 nt, Human
aucagcuauuuacu

SEQ ID NO: 1776302 - RNA, 15 nt, Human
aucagcuauuuacug

SEQ ID NO: 1776303 - RNA, 17 nt, Human
aucagcuccuuccugga

SEQ ID NO: 1776304 - RNA, 21 nt, Human
auaucauuuauuuuuuacauu

SEQ ID NO: 1776305 - RNA, 23 nt, Human
auaucauuuauuuuuuacauuau

SEQ ID NO: 1776306 - RNA, 14 nt, Human
auauuauagagagu

SEQ ID NO: 1776307 - RNA, 16 nt, Human
auauuuauucauuauu

SEQ ID NO: 1776308 - RNA, 19 nt, Human
auauuuauucauuauuugu

SEQ ID NO: 1776309 - RNA, 23 nt, Human
auauuuauucauuauuugucaaa

SEQ ID NO: 1776310 - RNA, 23 nt, Human
auagccauguaucauaauuacca

SEQ ID NO: 1776311 - RNA, 18 nt, Human
auagguccagaaguccuu

SEQ ID NO: 1776312 - RNA, 21 nt, Human
auagguccagaaguccuuaug

SEQ ID NO: 1776313 - RNA, 22 nt, Human
auagguguccagcauugcugga

SEQ ID NO: 1776314 - RNA, 17 nt, Human
auaguaugguggcuggg

SEQ ID NO: 1776315 - RNA, 18 nt, Human
auaguaugguggcugggu

SEQ ID NO: 1776316 - RNA, 22 nt, Human
auagguucuucuuguucugaga

SEQ ID NO: 1776317 - RNA, 13 nt, Human
auagguugagcaa

SEQ ID NO: 1776318 - RNA, 16 nt, Human
auagguugagcaauuu

SEQ ID NO: 1776319 - RNA, 22 nt, Human
auagguugagcaauuucccccu

SEQ ID NO: 1776320 - RNA, 15 nt, Human
auagguuuaauaauu

SEQ ID NO: 1776321 - RNA, 15 nt, Human
auauacuuguggacu

SEQ ID NO: 1776322 - RNA, 14 nt, Human
auauacuuguggac

SEQ ID NO: 1776323 - RNA, 21 nt, Human
auauacuuguggacuaaaaga

SEQ ID NO: 1776324 - RNA, 10 nt, Human
auaaggaauu

SEQ ID NO: 1776325 - RNA, 17 nt, Human
auaaggaauuauagacc

SEQ ID NO: 1776326 - RNA, 19 nt, Human
auaauggacagauuaauau

SEQ ID NO: 1776327 - RNA, 20 nt, Human
auaauggacagauuaauauu

SEQ ID NO: 1776328 - RNA, 17 nt, Human
auaauguuuuuaauauu

SEQ ID NO: 1776329 - RNA, 16 nt, Human
auaccugugccucggc

SEQ ID NO: 1776330 - RNA, 20 nt, Human
auaaagccuguuuugucuuu

SEQ ID NO: 1776331 - RNA, 12 nt, Human
auaaagaauacu

SEQ ID NO: 1776332 - RNA, 13 nt, Human
auaaagaauacuu

SEQ ID NO: 1776333 - RNA, 16 nt, Human
auaaagaauacuugaa

SEQ ID NO: 1776334 - RNA, 19 nt, Human
auaaagaauacuugaacuu

SEQ ID NO: 1776335 - RNA, 20 nt, Human
auaaagaauacuugaacuug

SEQ ID NO: 1776336 - RNA, 18 nt, Human
auaaaggauuaaugucaa

SEQ ID NO: 1776337 - RNA, 14 nt, Human
auaacauaugcagu

SEQ ID NO: 1776338 - RNA, 23 nt, Human
aguugaaaaucuuauaauuuaaa

SEQ ID NO: 1776339 - RNA, 16 nt, Human
aguuaaggugggcccg

SEQ ID NO: 1776340 - RNA, 19 nt, Human
aguuaaggugggcccggcc

SEQ ID NO: 1776341 - RNA, 15 nt, Human
aguuaauauugugaa

SEQ ID NO: 1776342 - RNA, 21 nt, Human
aguuaaauagaguauaugcac

SEQ ID NO: 1776343 - RNA, 23 nt, Human
aguguuuuguaccagugaauuuu

SEQ ID NO: 1776344 - RNA, 20 nt, Human
aguucagguaacaggcagau

SEQ ID NO: 1776345 - RNA, 19 nt, Human
aguucagguaacaggcaga

SEQ ID NO: 1776346 - RNA, 22 nt, Human
aguugaaaaucuuauaauuuaa

SEQ ID NO: 1776347 - RNA, 23 nt, Human
aguggcuuaaaacaacacucaca

SEQ ID NO: 1776348 - RNA, 16 nt, Human
agugggagcugccugu

SEQ ID NO: 1776349 - RNA, 15 nt, Human
agugggagcugccug

SEQ ID NO: 1776350 - RNA, 14 nt, Human
agugggagcugccu

SEQ ID NO: 1776351 - RNA, 23 nt, Human
aguaugaauuugagcaggucuca

SEQ ID NO: 1776352 - RNA, 13 nt, Human
aguaugguacauu

SEQ ID NO: 1776353 - RNA, 14 nt, Human
aguaugguacauuu

SEQ ID NO: 1776354 - RNA, 16 nt, Human
aguaugguacauuuuu

SEQ ID NO: 1776355 - RNA, 19 nt, Human
aguaugguacauuuuucaa

SEQ ID NO: 1776356 - RNA, 22 nt, Human
aguaugguacauuuuucaacuu

SEQ ID NO: 1776357 - RNA, 23 nt, Human
aguaugguacauuuuucaacuuu

SEQ ID NO: 1776358 - RNA, 14 nt, Human
aguaugguggcugg

SEQ ID NO: 1776359 - RNA, 19 nt, Human
agugacaguggauugcauu

SEQ ID NO: 1776360 - RNA, 20 nt, Human
agugacaguggauugcauuu

SEQ ID NO: 1776361 - RNA, 15 nt, Human
agugaaggcuucucu

SEQ ID NO: 1776362 - RNA, 21 nt, Human
agugaaggcuucucucugugg

SEQ ID NO: 1776363 - RNA, 20 nt, Human
agucugauucccaagcucug

SEQ ID NO: 1776364 - RNA, 16 nt, Human
agucugauucccaagc

SEQ ID NO: 1776365 - RNA, 18 nt, Human
agucugauucccaagcuc

SEQ ID NO: 1776366 - RNA, 17 nt, Human
agucuggaaugcagugg

SEQ ID NO: 1776367 - RNA, 18 nt, Human
agucuggaaugcaguggu

SEQ ID NO: 1776368 - RNA, 12 nt, Human
aguccuguaaug

SEQ ID NO: 1776369 - RNA, 17 nt, Human
caccccuaaacuccagg

SEQ ID NO: 1776370 - RNA, 18 nt, Human
cacccccuucuccaucca

SEQ ID NO: 1776371 - RNA, 15 nt, Human
caccccagggccuga

SEQ ID NO: 1776372 - RNA, 22 nt, Human
caccccagggccugagccuggc

SEQ ID NO: 1776373 - RNA, 16 nt, Human
caccccagggccugag

SEQ ID NO: 1776374 - RNA, 17 nt, Human
caccccagggccugagc

SEQ ID NO: 1776375 - RNA, 12 nt, Human
cacccaccucag

SEQ ID NO: 1776376 - RNA, 13 nt, Human
cacccaccucagc

SEQ ID NO: 1776377 - RNA, 14 nt, Human
cacccaccucagcc

SEQ ID NO: 1776378 - RNA, 16 nt, Human
cacccaccucagccuc

SEQ ID NO: 1776379 - RNA, 20 nt, Human
cacccaccaucaugucuggc

SEQ ID NO: 1776380 - RNA, 22 nt, Human
cacccaccaucaugucuggcua

SEQ ID NO: 1776381 - RNA, 17 nt, Human
cacaugugcacaugcac

SEQ ID NO: 1776382 - RNA, 14 nt, Human
cacaugugcacaug

SEQ ID NO: 1776383 - RNA, 15 nt, Human
cacaugugcacaugc

SEQ ID NO: 1776384 - RNA, 23 nt, Human
cacaugucuuaaugaaguuugaa

SEQ ID NO: 1776385 - RNA, 22 nt, Human
cacaugucuuaaugaaguuuga

SEQ ID NO: 1776386 - RNA, 18 nt, Human
cacaugucuuaaugaagu

SEQ ID NO: 1776387 - RNA, 17 nt, Human
cacaugucuuaaugaag

SEQ ID NO: 1776388 - RNA, 16 nt, Human
cacaugucuuaaugaa

SEQ ID NO: 1776389 - RNA, 15 nt, Human
cacaugucuuaauga

SEQ ID NO: 1776390 - RNA, 14 nt, Human
cacaugucuuaaug

SEQ ID NO: 1776391 - RNA, 13 nt, Human
cacaugucuuaau

SEQ ID NO: 1776392 - RNA, 12 nt, Human
cacaugucuuaa

SEQ ID NO: 1776393 - RNA, 22 nt, Human
cacauggugcuacgccugcaug

SEQ ID NO: 1776394 - RNA, 20 nt, Human
cacauggugcuacgccugca

SEQ ID NO: 1776395 - RNA, 12 nt, Human
cacauaucuguc

SEQ ID NO: 1776396 - RNA, 14 nt, Human
cacauaucugucau

SEQ ID NO: 1776397 - RNA, 19 nt, Human
caccacaugugcacaugca

SEQ ID NO: 1776398 - RNA, 15 nt, Human
caccacaugugcaca

SEQ ID NO: 1776399 - RNA, 18 nt, Human
caccacaugugcacaugc

SEQ ID NO: 1776400 - RNA, 15 nt, Human
caccacgucacuuca

SEQ ID NO: 1776401 - RNA, 13 nt, Human
caccacacccagc

SEQ ID NO: 1776402 - RNA, 15 nt, Human
caccacacccagccc

SEQ ID NO: 1776403 - RNA, 17 nt, Human
caccacacccagcccac

SEQ ID NO: 1776404 - RNA, 15 nt, Human
caccaagcccaguua

SEQ ID NO: 1776405 - RNA, 21 nt, Human
cacagugagucgaggacaggg

SEQ ID NO: 1776406 - RNA, 19 nt, Human
cacagugagucgaggacag

SEQ ID NO: 1776407 - RNA, 20 nt, Human
cacagugagucgaggacagg

SEQ ID NO: 1776408 - RNA, 18 nt, Human
cacaguugcucuaugcuu

SEQ ID NO: 1776409 - RNA, 18 nt, Human
cacagugagucgaggaca

SEQ ID NO: 1776410 - RNA, 20 nt, Human
cacaggcccggcuccaggcu

SEQ ID NO: 1776411 - RNA, 23 nt, Human
cacaggcccggcuccaggcuccu

SEQ ID NO: 1776412 - RNA, 17 nt, Human
cacauacacacacacgc

SEQ ID NO: 1776413 - RNA, 16 nt, Human
cacauaguuuuucagu

SEQ ID NO: 1776414 - RNA, 20 nt, Human
cacauaguuuuucagucuau

SEQ ID NO: 1776415 - RNA, 21 nt, Human
cacauauaaacaucacacaca

SEQ ID NO: 1776416 - RNA, 10 nt, Human
cacaggcagg

SEQ ID NO: 1776417 - RNA, 16 nt, Human
cacaggcccggcucca

SEQ ID NO: 1776418 - RNA, 17 nt, Human
cacaggcccggcuccag

SEQ ID NO: 1776419 - RNA, 18 nt, Human
cacaggcccggcuccagg

SEQ ID NO: 1776420 - RNA, 19 nt, Human
cacaggcccggcuccaggc

SEQ ID NO: 1776421 - RNA, 12 nt, Human
cacaggaucagu

SEQ ID NO: 1776422 - RNA, 15 nt, Human
cacaggaucagucug

SEQ ID NO: 1776423 - RNA, 16 nt, Human
cacaggaucagucuga

SEQ ID NO: 1776424 - RNA, 20 nt, Human
cacagccuccccugccaggg

SEQ ID NO: 1776425 - RNA, 21 nt, Human
cacagccuccccugccagggc

SEQ ID NO: 1776426 - RNA, 23 nt, Human
cacagccuccccugccagggcag

SEQ ID NO: 1776427 - RNA, 14 nt, Human
cacagccuccccug

SEQ ID NO: 1776428 - RNA, 17 nt, Human
cacagccuccccugcca

SEQ ID NO: 1776429 - RNA, 19 nt, Human
cacagccuccccugccagg

SEQ ID NO: 1776430 - RNA, 11 nt, Human
caauccuggac

SEQ ID NO: 1776431 - RNA, 17 nt, Human
caauccuagguaggguu

SEQ ID NO: 1776432 - RNA, 15 nt, Human
caauccuagugcuuu

SEQ ID NO: 1776433 - RNA, 14 nt, Human
caauccuauguuuu

SEQ ID NO: 1776434 - RNA, 20 nt, Human
caauccuauguuuuuguuca

SEQ ID NO: 1776435 - RNA, 12 nt, Human
caauaugugcca

SEQ ID NO: 1776436 - RNA, 19 nt, Human
caauaugugccaaucaaua

SEQ ID NO: 1776437 - RNA, 16 nt, Human
cacaaaaguuucucuu

SEQ ID NO: 1776438 - RNA, 18 nt, Human
cacaaaaguuucucuuuu

SEQ ID NO: 1776439 - RNA, 22 nt, Human
cacaaagaugggugaaggcugg

SEQ ID NO: 1776440 - RNA, 19 nt, Human
cacaaagaaaauuccuaua

SEQ ID NO: 1776441 - RNA, 20 nt, Human
cacaaagaaaauuccuauaa

SEQ ID NO: 1776442 - RNA, 20 nt, Human
caauucacaucuaaccucau

SEQ ID NO: 1776443 - RNA, 11 nt, Human
caaugucuuga

SEQ ID NO: 1776444 - RNA, 21 nt, Human
caaugucuugaugcaugcacu

SEQ ID NO: 1776445 - RNA, 23 nt, Human
caaugucuugaugcaugcacugu

SEQ ID NO: 1776446 - RNA, 12 nt, Human
cacagagaaagu

SEQ ID NO: 1776447 - RNA, 12 nt, Human
cacacagcucug

SEQ ID NO: 1776448 - RNA, 14 nt, Human
cacacaccagagcc

SEQ ID NO: 1776449 - RNA, 19 nt, Human
cacaacgugcauugugcuu

SEQ ID NO: 1776450 - RNA, 17 nt, Human
cacaacgugcauugugc

SEQ ID NO: 1776451 - RNA, 14 nt, Human
cacaacgugcauug

SEQ ID NO: 1776452 - RNA, 13 nt, Human
cacacccagccca

SEQ ID NO: 1776453 - RNA, 16 nt, Human
cacacccacucagcuc

SEQ ID NO: 1776454 - RNA, 14 nt, Human
cacacccacucagc

SEQ ID NO: 1776455 - RNA, 15 nt, Human
cacacccacucagcu

SEQ ID NO: 1776456 - RNA, 15 nt, Human
cacaccagagcccac

SEQ ID NO: 1776457 - RNA, 12 nt, Human
cacaccagagcc

SEQ ID NO: 1776458 - RNA, 13 nt, Human
cacaccagagccc

SEQ ID NO: 1776459 - RNA, 17 nt, Human
cacaccgggcacucaga

SEQ ID NO: 1776460 - RNA, 15 nt, Human
cacaccugcccuaaa

SEQ ID NO: 1776461 - RNA, 13 nt, Human
caaauagcaaaga

SEQ ID NO: 1776462 - RNA, 20 nt, Human
caaauaguuuauaaauguga

SEQ ID NO: 1776463 - RNA, 15 nt, Human
caaaggcaagcacuu

SEQ ID NO: 1776464 - RNA, 20 nt, Human
caaauuccuauuuuuaaaua

SEQ ID NO: 1776465 - RNA, 20 nt, Human
caaagccaaagcuaggccug

SEQ ID NO: 1776466 - RNA, 21 nt, Human
caaagccaaagcuaggccugg

SEQ ID NO: 1776467 - RNA, 22 nt, Human
caaagccaaagcuaggccuggc

SEQ ID NO: 1776468 - RNA, 16 nt, Human
caaagcuaggccuggc

SEQ ID NO: 1776469 - RNA, 17 nt, Human
caaagcuaggccuggcc

SEQ ID NO: 1776470 - RNA, 18 nt, Human
caaagcuaggccuggcca

SEQ ID NO: 1776471 - RNA, 23 nt, Human
auuuuuuuagaaagcauuugaau

SEQ ID NO: 1776472 - RNA, 17 nt, Human
auuuuuuuagaaagcau

SEQ ID NO: 1776473 - RNA, 22 nt, Human
caaacuuuauugacaagugauu

SEQ ID NO: 1776474 - RNA, 13 nt, Human
caaagaaaauucc

SEQ ID NO: 1776475 - RNA, 17 nt, Human
caaagaaaauuccuaua

SEQ ID NO: 1776476 - RNA, 19 nt, Human
caaagaaaauuccuauaag

SEQ ID NO: 1776477 - RNA, 20 nt, Human
caacccuggggaaggagcca

SEQ ID NO: 1776478 - RNA, 21 nt, Human
caacccuggggaaggagccag

SEQ ID NO: 1776479 - RNA, 22 nt, Human
caacccuggggaaggagccagu

SEQ ID NO: 1776480 - RNA, 23 nt, Human
caacccuggggaaggagccaguu

SEQ ID NO: 1776481 - RNA, 12 nt, Human
caacuuugaaua

SEQ ID NO: 1776482 - RNA, 14 nt, Human
caacuuugaauaaa

SEQ ID NO: 1776483 - RNA, 16 nt, Human
caacuuugaauaaaga

SEQ ID NO: 1776484 - RNA, 17 nt, Human
caacuuugaauaaagaa

SEQ ID NO: 1776485 - RNA, 22 nt, Human
caacuuugaauaaagaauacuu

SEQ ID NO: 1776486 - RNA, 23 nt, Human
caacuuugaauaaagaauacuug

SEQ ID NO: 1776487 - RNA, 14 nt, Human
caacuuacaaaaac

SEQ ID NO: 1776488 - RNA, 18 nt, Human
caacuuacaaaaacacuu

SEQ ID NO: 1776489 - RNA, 18 nt, Human
caacauuuacaacucauu

SEQ ID NO: 1776490 - RNA, 18 nt, Human
caaccaagucaugugcau

SEQ ID NO: 1776491 - RNA, 20 nt, Human
caaccaagucaugugcauuu

SEQ ID NO: 1776492 - RNA, 21 nt, Human
caaccccuucgcuccuguguc

SEQ ID NO: 1776493 - RNA, 18 nt, Human
caaccccuucgcuccugu

SEQ ID NO: 1776494 - RNA, 19 nt, Human
caaccccuucgcuccugug

SEQ ID NO: 1776495 - RNA, 23 nt, Human
caacaugccugccccaaacaaau

SEQ ID NO: 1776496 - RNA, 17 nt, Human
caacauguggcuccucc

SEQ ID NO: 1776497 - RNA, 18 nt, Human
caacauguggcuccuccc

SEQ ID NO: 1776498 - RNA, 21 nt, Human
caacauguggcuccucccagc

SEQ ID NO: 1776499 - RNA, 23 nt, Human
caacaggcugggcuucaguggca

SEQ ID NO: 1776500 - RNA, 24 nt, Human
caacaggcugggcuucaguggcag

SEQ ID NO: 1776501 - RNA, 23 nt, Human
caaauugugugugcucugcuuca

SEQ ID NO: 1776502 - RNA, 17 nt, Human
caagcgugagccacugc

SEQ ID NO: 1776503 - RNA, 18 nt, Human
caagcgugagccacugca

SEQ ID NO: 1776504 - RNA, 14 nt, Human
caaggaaaggccug

SEQ ID NO: 1776505 - RNA, 17 nt, Human
caagccccucuuucugu

SEQ ID NO: 1776506 - RNA, 16 nt, Human
caagcgugagccacug

SEQ ID NO: 1776507 - RNA, 18 nt, Human
caagcaccuccugccucg

SEQ ID NO: 1776508 - RNA, 17 nt, Human
caagcacuaaacaaaga

SEQ ID NO: 1776509 - RNA, 15 nt, Human
caaggauugcuacug

SEQ ID NO: 1776510 - RNA, 19 nt, Human
caaggauugcuacuguccu

SEQ ID NO: 1776511 - RNA, 20 nt, Human
caagggcuuuguuuugcaca

SEQ ID NO: 1776512 - RNA, 22 nt, Human
caagugauucuccugccucagc

SEQ ID NO: 1776513 - RNA, 16 nt, Human
caagugauucuccugc

SEQ ID NO: 1776514 - RNA, 17 nt, Human
caagugauucuccugcc

SEQ ID NO: 1776515 - RNA, 13 nt, Human
caagucuguguuc

SEQ ID NO: 1776516 - RNA, 14 nt, Human
cccacgcuggagug

SEQ ID NO: 1776517 - RNA, 16 nt, Human
cccaccuuggcugcag

SEQ ID NO: 1776518 - RNA, 15 nt, Human
cccaccuuggcucaa

SEQ ID NO: 1776519 - RNA, 22 nt, Human
cccaccuuggcucaaguccucu

SEQ ID NO: 1776520 - RNA, 14 nt, Human
cccaccuuggcugc

SEQ ID NO: 1776521 - RNA, 15 nt, Human
cccaccuuggcugca

SEQ ID NO: 1776522 - RNA, 12 nt, Human
cccaccucagcc

SEQ ID NO: 1776523 - RNA, 14 nt, Human
cccaccucagccuc

SEQ ID NO: 1776524 - RNA, 15 nt, Human
cccaccucagccucc

SEQ ID NO: 1776525 - RNA, 17 nt, Human
cccaccucagccucccg

SEQ ID NO: 1776526 - RNA, 12 nt, Human
cccaccuuggcu

SEQ ID NO: 1776527 - RNA, 21 nt, Human
cccaccucagccucccaaagu

SEQ ID NO: 1776528 - RNA, 15 nt, Human
ccauuuuucaaagca

SEQ ID NO: 1776529 - RNA, 16 nt, Human
ccauuuuucaaagcaa

SEQ ID NO: 1776530 - RNA, 17 nt, Human
ccauuuuucaaagcaau

SEQ ID NO: 1776531 - RNA, 18 nt, Human
ccauuuuucaaagcaauu

SEQ ID NO: 1776532 - RNA, 15 nt, Human
cccaagguuggagcc

SEQ ID NO: 1776533 - RNA, 19 nt, Human
cccaagguuggagcccagg

SEQ ID NO: 1776534 - RNA, 23 nt, Human
cccacacucccaagguuggagcc

SEQ ID NO: 1776535 - RNA, 23 nt, Human
cccacagacaaaagcgcuuuucc

SEQ ID NO: 1776536 - RNA, 15 nt, Human
cccacaguugcucua

SEQ ID NO: 1776537 - RNA, 17 nt, Human
cccacaggaucagucug

SEQ ID NO: 1776538 - RNA, 13 nt, Human
cccacaggaucag

SEQ ID NO: 1776539 - RNA, 19 nt, Human
ccauuagcuuucaauuccg

SEQ ID NO: 1776540 - RNA, 14 nt, Human
ccauuuuaaguccc

SEQ ID NO: 1776541 - RNA, 15 nt, Human
ccauuuuaagucccu

SEQ ID NO: 1776542 - RNA, 16 nt, Human
ccauuuuaagucccug

SEQ ID NO: 1776543 - RNA, 20 nt, Human
ccauuuuaagucccugucac

SEQ ID NO: 1776544 - RNA, 23 nt, Human
ccauuuuaagucccugucaccuc

SEQ ID NO: 1776545 - RNA, 16 nt, Human
ccauucugccugccca

SEQ ID NO: 1776546 - RNA, 15 nt, Human
ccauucugccugccc

SEQ ID NO: 1776547 - RNA, 13 nt, Human
ccauguugccccu

SEQ ID NO: 1776548 - RNA, 20 nt, Human
ccauguuaaguccucccuga

SEQ ID NO: 1776549 - RNA, 21 nt, Human
ccauguuaaguccucccugac

SEQ ID NO: 1776550 - RNA, 14 nt, Human
ccaucucuuccuug

SEQ ID NO: 1776551 - RNA, 15 nt, Human
ccaucucuuccuuga

SEQ ID NO: 1776552 - RNA, 18 nt, Human
ccaucuucgggaccagga

SEQ ID NO: 1776553 - RNA, 20 nt, Human
ccaucuucgggaccaggauu

SEQ ID NO: 1776554 - RNA, 14 nt, Human
ccaggcuggucuca

SEQ ID NO: 1776555 - RNA, 19 nt, Human
ccaggccccugccacccug

SEQ ID NO: 1776556 - RNA, 12 nt, Human
ccaggccagagg

SEQ ID NO: 1776557 - RNA, 14 nt, Human
ccaggccccugcca

SEQ ID NO: 1776558 - RNA, 15 nt, Human
ccaggccccugccac

SEQ ID NO: 1776559 - RNA, 16 nt, Human
ccaggccccugccacc

SEQ ID NO: 1776560 - RNA, 23 nt, Human
ccagugcccacaggaucagucug

SEQ ID NO: 1776561 - RNA, 14 nt, Human
ccagggccugagcc

SEQ ID NO: 1776562 - RNA, 16 nt, Human
ccagggccugagccug

SEQ ID NO: 1776563 - RNA, 17 nt, Human
ccagggccugagccugg

SEQ ID NO: 1776564 - RNA, 18 nt, Human
ccagggccugagccuggc

SEQ ID NO: 1776565 - RNA, 19 nt, Human
ccagggccugagccuggcc

SEQ ID NO: 1776566 - RNA, 23 nt, Human
ccagggccugcaggaccugccug

SEQ ID NO: 1776567 - RNA, 20 nt, Human
ccagggaugauucaagccau

SEQ ID NO: 1776568 - RNA, 21 nt, Human
ccagggaugauucaagccauu

SEQ ID NO: 1776569 - RNA, 22 nt, Human
ccagggcaagcuccgcaggacu

SEQ ID NO: 1776570 - RNA, 21 nt, Human
ccagggcaaggguuaaggccu

SEQ ID NO: 1776571 - RNA, 22 nt, Human
ccagggcaaggguuaaggccug

SEQ ID NO: 1776572 - RNA, 23 nt, Human
ccagggcaaggguuaaggccuga

SEQ ID NO: 1776573 - RNA, 17 nt, Human
ccagggcaagcuccgca

SEQ ID NO: 1776574 - RNA, 20 nt, Human
ccagggcaagcuccgcagga

SEQ ID NO: 1776575 - RNA, 16 nt, Human
ccagguuucuaugugu

SEQ ID NO: 1776576 - RNA, 13 nt, Human
ccaggugggagcg

SEQ ID NO: 1776577 - RNA, 16 nt, Human
ccaggugcagccagag

SEQ ID NO: 1776578 - RNA, 14 nt, Human
ccaggugcagccag

SEQ ID NO: 1776579 - RNA, 15 nt, Human
ccaggugcagccaga

SEQ ID NO: 1776580 - RNA, 12 nt, Human
ccagugaauuuu

SEQ ID NO: 1776581 - RNA, 17 nt, Human
ccagugaauuuuugcaa

SEQ ID NO: 1776582 - RNA, 18 nt, Human
ccagugaauuuuugcaau

SEQ ID NO: 1776583 - RNA, 19 nt, Human
ccagugaauuuuugcaaua

SEQ ID NO: 1776584 - RNA, 20 nt, Human
ccagugaauuuuugcaauaa

SEQ ID NO: 1776585 - RNA, 21 nt, Human
ccagugaauuuuugcaauaau

SEQ ID NO: 1776586 - RNA, 22 nt, Human
ccagugaauuuuugcaauaaug

SEQ ID NO: 1776587 - RNA, 12 nt, Human
ccaucaugucug

SEQ ID NO: 1776588 - RNA, 13 nt, Human
ccaucaucuccug

SEQ ID NO: 1776589 - RNA, 13 nt, Human
ccaucaugucugg

SEQ ID NO: 1776590 - RNA, 14 nt, Human
ccagugugacaagg

SEQ ID NO: 1776591 - RNA, 23 nt, Human
ccagugugacaaggauugcuacu

SEQ ID NO: 1776592 - RNA, 13 nt, Human
ccaccuuggcuca

SEQ ID NO: 1776593 - RNA, 14 nt, Human
ccacccuccuuuca

SEQ ID NO: 1776594 - RNA, 14 nt, Human
ccaccccuccccau

SEQ ID NO: 1776595 - RNA, 14 nt, Human
ccaccccuggaaga

SEQ ID NO: 1776596 - RNA, 21 nt, Human
ccaccccuggaagagcccagu

SEQ ID NO: 1776597 - RNA, 22 nt, Human
ccaccccuggaagagcccaguc

SEQ ID NO: 1776598 - RNA, 11 nt, Human
ccacccugcuc

SEQ ID NO: 1776599 - RNA, 12 nt, Human
ccacccugcucu

SEQ ID NO: 1776600 - RNA, 19 nt, Human
ccacugugccaugugccag

SEQ ID NO: 1776601 - RNA, 15 nt, Human
ccacugugccaugug

SEQ ID NO: 1776602 - RNA, 16 nt, Human
ccacugugccaugugc

SEQ ID NO: 1776603 - RNA, 22 nt, Human
ccacugcuuuuggucuguguga

SEQ ID NO: 1776604 - RNA, 13 nt, Human
ccacuggacugac

SEQ ID NO: 1776605 - RNA, 18 nt, Human
ccacuggacugaccuggu

SEQ ID NO: 1776606 - RNA, 20 nt, Human
ccacugcuuuuggucugugu

SEQ ID NO: 1776607 - RNA, 12 nt, Human
ccacugcucugg

SEQ ID NO: 1776608 - RNA, 13 nt, Human
ccacugcucuggu

SEQ ID NO: 1776609 - RNA, 15 nt, Human
ccacugcucugguua

SEQ ID NO: 1776610 - RNA, 16 nt, Human
ccagacccggcugcgu

SEQ ID NO: 1776611 - RNA, 14 nt, Human
ccagacccggcugc

SEQ ID NO: 1776612 - RNA, 15 nt, Human
ccagacccggcugcg

SEQ ID NO: 1776613 - RNA, 22 nt, Human
ccagacauucucgcuucccuga

SEQ ID NO: 1776614 - RNA, 14 nt, Human
ccagaaggagacag

SEQ ID NO: 1776615 - RNA, 17 nt, Human
ccagaaggagacaggca

SEQ ID NO: 1776616 - RNA, 18 nt, Human
ccagaaggagacaggcag

SEQ ID NO: 1776617 - RNA, 16 nt, Human
ccagcccacuucugcc

SEQ ID NO: 1776618 - RNA, 17 nt, Human
ccagcccacuucugcca

SEQ ID NO: 1776619 - RNA, 21 nt, Human
ccagcccagauuccccugugu

SEQ ID NO: 1776620 - RNA, 23 nt, Human
ccagcccagauuccccuguguca

SEQ ID NO: 1776621 - RNA, 13 nt, Human
ccagccggggccu

SEQ ID NO: 1776622 - RNA, 13 nt, Human
ccagcgagcccug

SEQ ID NO: 1776623 - RNA, 18 nt, Human
ccagcuccucacucaccu

SEQ ID NO: 1776624 - RNA, 21 nt, Human
ccagccugcgccugcugcaug

SEQ ID NO: 1776625 - RNA, 10 nt, Human
ccagccugcu

SEQ ID NO: 1776626 - RNA, 12 nt, Human
ccagccugcuag

SEQ ID NO: 1776627 - RNA, 13 nt, Human
ccagccugcuagc

SEQ ID NO: 1776628 - RNA, 14 nt, Human
ccagccugcuagcu

SEQ ID NO: 1776629 - RNA, 15 nt, Human
ccagccugcuagcua

SEQ ID NO: 1776630 - RNA, 19 nt, Human
ccagccugcuagcuagcuc

SEQ ID NO: 1776631 - RNA, 21 nt, Human
ccagccugcuagcuagcucaa

SEQ ID NO: 1776632 - RNA, 13 nt, Human
ccagccugcgccu

SEQ ID NO: 1776633 - RNA, 14 nt, Human
ccagccugcgccug

SEQ ID NO: 1776634 - RNA, 15 nt, Human
ccagccugcgccugc

SEQ ID NO: 1776635 - RNA, 16 nt, Human
ccagccugcgccugcu

SEQ ID NO: 1776636 - RNA, 17 nt, Human
ccagccugcgccugcug

SEQ ID NO: 1776637 - RNA, 19 nt, Human
ccagccugcgccugcugca

SEQ ID NO: 1776638 - RNA, 14 nt, Human
ccagagcccaccuu

SEQ ID NO: 1776639 - RNA, 14 nt, Human
ccagauugcaacag

SEQ ID NO: 1776640 - RNA, 16 nt, Human
ccagauugcaacaggc

SEQ ID NO: 1776641 - RNA, 23 nt, Human
ccagauugcaacaggcugggcuu

SEQ ID NO: 1776642 - RNA, 18 nt, Human
ccagauugcaacaggcug

SEQ ID NO: 1776643 - RNA, 22 nt, Human
ccagauugcaacaggcugggcu

SEQ ID NO: 1776644 - RNA, 17 nt, Human
ccagcaagugagagcug

SEQ ID NO: 1776645 - RNA, 18 nt, Human
ccagcaagugagagcugg

SEQ ID NO: 1776646 - RNA, 19 nt, Human
ccagcaagugagagcuggg

SEQ ID NO: 1776647 - RNA, 22 nt, Human
ccagcaccggccccauuuaccc

SEQ ID NO: 1776648 - RNA, 11 nt, Human
ccccugugcag

SEQ ID NO: 1776649 - RNA, 14 nt, Human
ccccuuccacugag

SEQ ID NO: 1776650 - RNA, 19 nt, Human
ccccugugcagccgcugag

SEQ ID NO: 1776651 - RNA, 20 nt, Human
ccccugugcagccgcugagc

SEQ ID NO: 1776652 - RNA, 13 nt, Human
cccgcagagcgcg

SEQ ID NO: 1776653 - RNA, 22 nt, Human
cccgcagagcgcgccccuagcc

SEQ ID NO: 1776654 - RNA, 12 nt, Human
ccccugcccugu

SEQ ID NO: 1776655 - RNA, 14 nt, Human
ccccugcccugugg

SEQ ID NO: 1776656 - RNA, 15 nt, Human
ccccugcccuguggg

SEQ ID NO: 1776657 - RNA, 17 nt, Human
ccccugcccggcugcgg

SEQ ID NO: 1776658 - RNA, 19 nt, Human
ccccugcccggcugcggaa

SEQ ID NO: 1776659 - RNA, 11 nt, Human
ccccugcuggu

SEQ ID NO: 1776660 - RNA, 13 nt, Human
ccccugcugguuc

SEQ ID NO: 1776661 - RNA, 15 nt, Human
ccccugcugguucag

SEQ ID NO: 1776662 - RNA, 20 nt, Human
ccccugcugguucaggguug

SEQ ID NO: 1776663 - RNA, 17 nt, Human
ccccuggaagagcccag

SEQ ID NO: 1776664 - RNA, 18 nt, Human
ccccuggaagagcccagu

SEQ ID NO: 1776665 - RNA, 20 nt, Human
ccccuggaagagcccagucu

SEQ ID NO: 1776666 - RNA, 22 nt, Human
ccccuggaagagcccagucugu

SEQ ID NO: 1776667 - RNA, 17 nt, Human
ccccuggaggcugccuc

SEQ ID NO: 1776668 - RNA, 20 nt, Human
ccccuggaggcugccuccca

SEQ ID NO: 1776669 - RNA, 21 nt, Human
ccccuggaggcugccucccaa

SEQ ID NO: 1776670 - RNA, 13 nt, Human
ccccaucagugcu

SEQ ID NO: 1776671 - RNA, 14 nt, Human
ccccaucagugcuc

SEQ ID NO: 1776672 - RNA, 20 nt, Human
ccccaucagugcucccucac

SEQ ID NO: 1776673 - RNA, 14 nt, Human
ccccagugcccaca

SEQ ID NO: 1776674 - RNA, 15 nt, Human
ccccagugcccacag

SEQ ID NO: 1776675 - RNA, 16 nt, Human
ccccagugcccacagg

SEQ ID NO: 1776676 - RNA, 20 nt, Human
ccccagugcccacaggauca

SEQ ID NO: 1776677 - RNA, 17 nt, Human
ccccaguaaaauugcca

SEQ ID NO: 1776678 - RNA, 14 nt, Human
ccccaguaaaauug

SEQ ID NO: 1776679 - RNA, 13 nt, Human
ccccaguaaaauu

SEQ ID NO: 1776680 - RNA, 17 nt, Human
ccccuagccgguuccug

SEQ ID NO: 1776681 - RNA, 19 nt, Human
ccccuagccgguuccuguc

SEQ ID NO: 1776682 - RNA, 21 nt, Human
ccccuagccgguuccuguccc

SEQ ID NO: 1776683 - RNA, 15 nt, Human
ccccgguggcugggc

SEQ ID NO: 1776684 - RNA, 17 nt, Human
ccccgguggcugggcag

SEQ ID NO: 1776685 - RNA, 11 nt, Human
ccccucaaccc

SEQ ID NO: 1776686 - RNA, 21 nt, Human
cccccugugcagccgcugagc

SEQ ID NO: 1776687 - RNA, 12 nt, Human
cccccugugcag

SEQ ID NO: 1776688 - RNA, 12 nt, Human
cccccagccugc

SEQ ID NO: 1776689 - RNA, 17 nt, Human
cccccuccgccuccagg

SEQ ID NO: 1776690 - RNA, 12 nt, Human
cccccucugucc

SEQ ID NO: 1776691 - RNA, 18 nt, Human
ccccucagcucggcucag

SEQ ID NO: 1776692 - RNA, 14 nt, Human
ccccucagcucggc

SEQ ID NO: 1776693 - RNA, 15 nt, Human
ccccucagcucggcu

SEQ ID NO: 1776694 - RNA, 12 nt, Human
ccccuccaugug

SEQ ID NO: 1776695 - RNA, 13 nt, Human
ccccucaccuacu

SEQ ID NO: 1776696 - RNA, 12 nt, Human
ccccucccagag

SEQ ID NO: 1776697 - RNA, 13 nt, Human
ccccuccgccucc

SEQ ID NO: 1776698 - RNA, 17 nt, Human
ccccuccggacuggugc

SEQ ID NO: 1776699 - RNA, 18 nt, Human
ccccuccggacuggugcc

SEQ ID NO: 1776700 - RNA, 18 nt, Human
ccccuccucugaaacagc

SEQ ID NO: 1776701 - RNA, 22 nt, Human
ccccuccucugaaacagcugcc

SEQ ID NO: 1776702 - RNA, 23 nt, Human
ccccuccucugaaacagcugccu

SEQ ID NO: 1776703 - RNA, 14 nt, Human
ccccucuccuuccu

SEQ ID NO: 1776704 - RNA, 19 nt, Human
ccccucuccuuccugugug

SEQ ID NO: 1776705 - RNA, 23 nt, Human
cccaucucgcucccucccaggac

SEQ ID NO: 1776706 - RNA, 14 nt, Human
cccaguugggugga

SEQ ID NO: 1776707 - RNA, 16 nt, Human
cccaucuccccucagc

SEQ ID NO: 1776708 - RNA, 20 nt, Human
cccaucucgcucccucccag

SEQ ID NO: 1776709 - RNA, 21 nt, Human
cccaucucgcucccucccagg

SEQ ID NO: 1776710 - RNA, 22 nt, Human
cccaucucgcucccucccagga

SEQ ID NO: 1776711 - RNA, 16 nt, Human
cccaucuggucauuug

SEQ ID NO: 1776712 - RNA, 14 nt, Human
cccaugagccucag

SEQ ID NO: 1776713 - RNA, 19 nt, Human
ccgacucuuucugagugcc

SEQ ID NO: 1776714 - RNA, 21 nt, Human
ccgacucuuucugagugccuu

SEQ ID NO: 1776715 - RNA, 12 nt, Human
ccgccuccagga

SEQ ID NO: 1776716 - RNA, 14 nt, Human
ccgaguagcuggga

SEQ ID NO: 1776717 - RNA, 16 nt, Human
ccgaguagcugggacu

SEQ ID NO: 1776718 - RNA, 19 nt, Human
ccggggccuuaucgggcuc

SEQ ID NO: 1776719 - RNA, 16 nt, Human
ccggcuccaggcuccu

SEQ ID NO: 1776720 - RNA, 21 nt, Human
ccggcuccaggcuccuuuagc

SEQ ID NO: 1776721 - RNA, 14 nt, Human
ccggcucccagccu

SEQ ID NO: 1776722 - RNA, 15 nt, Human
ccggcucccagccuc

SEQ ID NO: 1776723 - RNA, 13 nt, Human
ccggagggcugcg

SEQ ID NO: 1776724 - RNA, 13 nt, Human
ccggcucccagcc

SEQ ID NO: 1776725 - RNA, 22 nt, Human
ccgggcacucagaagacacuga

SEQ ID NO: 1776726 - RNA, 13 nt, Human
ccgggccacagag

SEQ ID NO: 1776727 - RNA, 18 nt, Human
ccuaggugacagagugag

SEQ ID NO: 1776728 - RNA, 23 nt, Human
ccuaggccucaacuccucccaua

SEQ ID NO: 1776729 - RNA, 16 nt, Human
ccuaccgacccagggu

SEQ ID NO: 1776730 - RNA, 15 nt, Human
ccuacccugccuccc

SEQ ID NO: 1776731 - RNA, 23 nt, Human
ccuacccugccucccuugacuuu

SEQ ID NO: 1776732 - RNA, 14 nt, Human
cccucccaggacuc

SEQ ID NO: 1776733 - RNA, 14 nt, Human
cccucuucugagca

SEQ ID NO: 1776734 - RNA, 15 nt, Human
cccucuucugagcac

SEQ ID NO: 1776735 - RNA, 17 nt, Human
cccucuccuuccugugu

SEQ ID NO: 1776736 - RNA, 14 nt, Human
cccucuccuuccug

SEQ ID NO: 1776737 - RNA, 19 nt, Human
cccucuaaccucgcccucu

SEQ ID NO: 1776738 - RNA, 15 nt, Human
cccugcccugugggg

SEQ ID NO: 1776739 - RNA, 21 nt, Human
cccugaggaugggucagagcu

SEQ ID NO: 1776740 - RNA, 22 nt, Human
cccugaggaugggucagagcua

SEQ ID NO: 1776741 - RNA, 14 nt, Human
cccucuuugcugca

SEQ ID NO: 1776742 - RNA, 15 nt, Human
cccucuuugcugcag

SEQ ID NO: 1776743 - RNA, 19 nt, Human
cccucuuugcugcagagaa

SEQ ID NO: 1776744 - RNA, 20 nt, Human
cccucuuccuacccugccuc

SEQ ID NO: 1776745 - RNA, 18 nt, Human
cccugcgccuuuccuuuu

SEQ ID NO: 1776746 - RNA, 14 nt, Human
cccugcgccuuucc

SEQ ID NO: 1776747 - RNA, 15 nt, Human
cccugcgccuuuccu

SEQ ID NO: 1776748 - RNA, 18 nt, Human
cccugcugagucaucugu

SEQ ID NO: 1776749 - RNA, 22 nt, Human
cccugcucuccgaccagacacc

SEQ ID NO: 1776750 - RNA, 21 nt, Human
cccugcucuccgaccagacac

SEQ ID NO: 1776751 - RNA, 16 nt, Human
cccuuaucugugcuca

SEQ ID NO: 1776752 - RNA, 20 nt, Human
cccuuaucugugcucaggac

SEQ ID NO: 1776753 - RNA, 16 nt, Human
cccuuccacugagggc

SEQ ID NO: 1776754 - RNA, 13 nt, Human
cccuuccacugag

SEQ ID NO: 1776755 - RNA, 23 nt, Human
cccuuagcagggaaacagcuaau

SEQ ID NO: 1776756 - RNA, 14 nt, Human
cccuuagcagggaa

SEQ ID NO: 1776757 - RNA, 17 nt, Human
cccuugacuuugcuccu

SEQ ID NO: 1776758 - RNA, 19 nt, Human
cccuugacuuugcuccuca

SEQ ID NO: 1776759 - RNA, 20 nt, Human
cccuugccuuucgaggccug

SEQ ID NO: 1776760 - RNA, 21 nt, Human
cccuugccuuucgaggccuga

SEQ ID NO: 1776761 - RNA, 14 nt, Human
cccuggggccugac

SEQ ID NO: 1776762 - RNA, 20 nt, Human
cccuggggccugacugcuca

SEQ ID NO: 1776763 - RNA, 21 nt, Human
cccuggggccugacugcucag

SEQ ID NO: 1776764 - RNA, 13 nt, Human
cccugguggcagu

SEQ ID NO: 1776765 - RNA, 14 nt, Human
cccugguggcagug

SEQ ID NO: 1776766 - RNA, 15 nt, Human
cccugguggcagugg

SEQ ID NO: 1776767 - RNA, 18 nt, Human
cccuggggaaggagccag

SEQ ID NO: 1776768 - RNA, 19 nt, Human
cccuggggaaggagccagu

SEQ ID NO: 1776769 - RNA, 22 nt, Human
cccugucaaauaucaguuaccc

SEQ ID NO: 1776770 - RNA, 13 nt, Human
cccugucaccucu

SEQ ID NO: 1776771 - RNA, 14 nt, Human
cccugucaccucuu

SEQ ID NO: 1776772 - RNA, 14 nt, Human
cccuguuccuggag

SEQ ID NO: 1776773 - RNA, 15 nt, Human
cccuguuccuggagg

SEQ ID NO: 1776774 - RNA, 22 nt, Human
cccuguugaauuuuguucucug

SEQ ID NO: 1776775 - RNA, 12 nt, Human
cuaaccucaucu

SEQ ID NO: 1776776 - RNA, 15 nt, Human
cuaaccucaucuucu

SEQ ID NO: 1776777 - RNA, 17 nt, Human
cuaaccucgcccucucc

SEQ ID NO: 1776778 - RNA, 13 nt, Human
cuaaccucgcccu

SEQ ID NO: 1776779 - RNA, 16 nt, Human
cuaaccucgcccucuc

SEQ ID NO: 1776780 - RNA, 12 nt, Human
cuaaccacgcug

SEQ ID NO: 1776781 - RNA, 14 nt, Human
cuaaccacgcugga

SEQ ID NO: 1776782 - RNA, 12 nt, Human
cuaaaaagcaac

SEQ ID NO: 1776783 - RNA, 18 nt, Human
cuaaaaaaaaaaaaguau

SEQ ID NO: 1776784 - RNA, 20 nt, Human
cuaaaaaaaaaaaaguauua

SEQ ID NO: 1776785 - RNA, 23 nt, Human
cgggaggauguucugggacacag

SEQ ID NO: 1776786 - RNA, 13 nt, Human
cgggaccuggugc

SEQ ID NO: 1776787 - RNA, 18 nt, Human
cgggacagugcugcagcu

SEQ ID NO: 1776788 - RNA, 22 nt, Human
cuaaaugaaaaucgugacaaca

SEQ ID NO: 1776789 - RNA, 14 nt, Human
cuaaacuccuuccu

SEQ ID NO: 1776790 - RNA, 15 nt, Human
cuaaacuccuuccug

SEQ ID NO: 1776791 - RNA, 16 nt, Human
cuaaacuccuuccugg

SEQ ID NO: 1776792 - RNA, 17 nt, Human
cuaaacuccuuccuggc

SEQ ID NO: 1776793 - RNA, 22 nt, Human
cuaaacuccuuccuggccugag

SEQ ID NO: 1776794 - RNA, 21 nt, Human
cuaagcuucacuguaaaauaa

SEQ ID NO: 1776795 - RNA, 19 nt, Human
cuaauggguauuuaaacaa

SEQ ID NO: 1776796 - RNA, 12 nt, Human
cuaaugggacac

SEQ ID NO: 1776797 - RNA, 13 nt, Human
cuaaugggacacu

SEQ ID NO: 1776798 - RNA, 18 nt, Human
cuaauauguaacaagcca

SEQ ID NO: 1776799 - RNA, 23 nt, Human
cuaauaugauagcgggaaaagga

SEQ ID NO: 1776800 - RNA, 23 nt, Human
cuacacgagauacagaauuuuau

SEQ ID NO: 1776801 - RNA, 16 nt, Human
cuacacccuuuuccag

SEQ ID NO: 1776802 - RNA, 18 nt, Human
cuacacccuuuuccagcu

SEQ ID NO: 1776803 - RNA, 20 nt, Human
cuacaccuugcuuuuuuacu

SEQ ID NO: 1776804 - RNA, 15 nt, Human
cuacaggcacccacc

SEQ ID NO: 1776805 - RNA, 17 nt, Human
cuacaggcacccaccau

SEQ ID NO: 1776806 - RNA, 12 nt, Human
cuacagggccaa

SEQ ID NO: 1776807 - RNA, 14 nt, Human
cuacaggagugagc

SEQ ID NO: 1776808 - RNA, 15 nt, Human
cuacaggagugagca

SEQ ID NO: 1776809 - RNA, 16 nt, Human
cuacaggagugagcac

SEQ ID NO: 1776810 - RNA, 14 nt, Human
cuacaggugugagu

SEQ ID NO: 1776811 - RNA, 16 nt, Human
cuacaggugugaguca

SEQ ID NO: 1776812 - RNA, 14 nt, Human
cuacagucaggaaa

SEQ ID NO: 1776813 - RNA, 15 nt, Human
cuacagucaggaaag

SEQ ID NO: 1776814 - RNA, 18 nt, Human
cuacagucaggaaaggaa

SEQ ID NO: 1776815 - RNA, 21 nt, Human
cuacagucaggaaaggaauca

SEQ ID NO: 1776816 - RNA, 18 nt, Human
cuacagccuugucccccu

SEQ ID NO: 1776817 - RNA, 19 nt, Human
cuacagccuugucccccuc

SEQ ID NO: 1776818 - RNA, 22 nt, Human
cuacagaggccaugggccuccu

SEQ ID NO: 1776819 - RNA, 18 nt, Human
cuacagaggccaugggcc

SEQ ID NO: 1776820 - RNA, 20 nt, Human
cuacagaggccaugggccuc

SEQ ID NO: 1776821 - RNA, 13 nt, Human
cuacccugccucc

SEQ ID NO: 1776822 - RNA, 18 nt, Human
cuacccugagcugaggca

SEQ ID NO: 1776823 - RNA, 12 nt, Human
cuacccugagcu

SEQ ID NO: 1776824 - RNA, 17 nt, Human
cuacccugagcugaggc

SEQ ID NO: 1776825 - RNA, 18 nt, Human
cuacccagcgagcccugg

SEQ ID NO: 1776826 - RNA, 13 nt, Human
cuacccacccucc

SEQ ID NO: 1776827 - RNA, 15 nt, Human
cuacccagcgagccc

SEQ ID NO: 1776828 - RNA, 17 nt, Human
cuacccagcgagcccug

SEQ ID NO: 1776829 - RNA, 22 nt, Human
cuacauuauaaaugucucuuua

SEQ ID NO: 1776830 - RNA, 20 nt, Human
cuaccaacuuguauccaggc

SEQ ID NO: 1776831 - RNA, 12 nt, Human
cuaccacuccug

SEQ ID NO: 1776832 - RNA, 21 nt, Human
cuagccuuagaagucacacag

SEQ ID NO: 1776833 - RNA, 22 nt, Human
cuagccuuagaagucacacagu

SEQ ID NO: 1776834 - RNA, 23 nt, Human
cuagccuuagaagucacacagua

SEQ ID NO: 1776835 - RNA, 16 nt, Human
cuagcuagcucaacua

SEQ ID NO: 1776836 - RNA, 12 nt, Human
cuagcuagcuca

SEQ ID NO: 1776837 - RNA, 12 nt, Human
cuacucuguguc

SEQ ID NO: 1776838 - RNA, 13 nt, Human
cuacucuguguca

SEQ ID NO: 1776839 - RNA, 19 nt, Human
cuacuguccuacccacccu

SEQ ID NO: 1776840 - RNA, 11 nt, Human
cuacugccuuu

SEQ ID NO: 1776841 - RNA, 15 nt, Human
cuacugccuuuagaa

SEQ ID NO: 1776842 - RNA, 16 nt, Human
cuacugccuuuagaaa

SEQ ID NO: 1776843 - RNA, 11 nt, Human
cuacugcugug

SEQ ID NO: 1776844 - RNA, 20 nt, Human
cuacugcugugaacccuggg

SEQ ID NO: 1776845 - RNA, 21 nt, Human
cuaccgacccaggguucccgc

SEQ ID NO: 1776846 - RNA, 15 nt, Human
cuaccgacccagggu

SEQ ID NO: 1776847 - RNA, 15 nt, Human
cuaccucccuugccu

SEQ ID NO: 1776848 - RNA, 16 nt, Human
cuaccucccuugccuu

SEQ ID NO: 1776849 - RNA, 14 nt, Human
cuagauacaauaaa

SEQ ID NO: 1776850 - RNA, 15 nt, Human
cuagauacaauaaau

SEQ ID NO: 1776851 - RNA, 16 nt, Human
cuagauacaauaaauu

SEQ ID NO: 1776852 - RNA, 17 nt, Human
cuagauacaauaaauug

SEQ ID NO: 1776853 - RNA, 23 nt, Human
cuagauacaauaaauugcuaaug

SEQ ID NO: 1776854 - RNA, 20 nt, Human
cuagaggcccuuugcugucc

SEQ ID NO: 1776855 - RNA, 20 nt, Human
cuacuguccuacccacccuc

SEQ ID NO: 1776856 - RNA, 17 nt, Human
cuacuuacccagguggg

SEQ ID NO: 1776857 - RNA, 20 nt, Human
cuacuuacccaggugggucc

SEQ ID NO: 1776858 - RNA, 13 nt, Human
cuagacucggggu

SEQ ID NO: 1776859 - RNA, 16 nt, Human
cuagacucggggugcu

SEQ ID NO: 1776860 - RNA, 22 nt, Human
cuagacucggggugcuuccuug

SEQ ID NO: 1776861 - RNA, 14 nt, Human
cuagaaacuuccaa

SEQ ID NO: 1776862 - RNA, 16 nt, Human
cuagaaacuuccaaau

SEQ ID NO: 1776863 - RNA, 19 nt, Human
cuauuuauugacucugggu

SEQ ID NO: 1776864 - RNA, 14 nt, Human
cucaaguccucuuu

SEQ ID NO: 1776865 - RNA, 15 nt, Human
cucaagaugggggca

SEQ ID NO: 1776866 - RNA, 20 nt, Human
cucaagaugggggcagggcu

SEQ ID NO: 1776867 - RNA, 21 nt, Human
cucaagaugggggcagggcug

SEQ ID NO: 1776868 - RNA, 15 nt, Human
cuauuucuccuccau

SEQ ID NO: 1776869 - RNA, 16 nt, Human
cuauuucuccuccaug

SEQ ID NO: 1776870 - RNA, 14 nt, Human
cucaacuccuccca

SEQ ID NO: 1776871 - RNA, 15 nt, Human
cucaacuccucccau

SEQ ID NO: 1776872 - RNA, 21 nt, Human
cucaaccccaccauaugaauu

SEQ ID NO: 1776873 - RNA, 22 nt, Human
cucaaccccaccauaugaauug

SEQ ID NO: 1776874 - RNA, 21 nt, Human
cuauucuugauuuauuugcuu

SEQ ID NO: 1776875 - RNA, 23 nt, Human
cuauucuugauuuauuugcuucu

SEQ ID NO: 1776876 - RNA, 21 nt, Human
cuauucuuucgaaagaagaaa

SEQ ID NO: 1776877 - RNA, 20 nt, Human
cuauugaauucggaacuguc

SEQ ID NO: 1776878 - RNA, 12 nt, Human
cuauugacaaua

SEQ ID NO: 1776879 - RNA, 14 nt, Human
cuauugacaauaaa

SEQ ID NO: 1776880 - RNA, 15 nt, Human
cuauugacaauaaaa

SEQ ID NO: 1776881 - RNA, 16 nt, Human
cuauugacaauaaaau

SEQ ID NO: 1776882 - RNA, 17 nt, Human
cuauugacaauaaaaua

SEQ ID NO: 1776883 - RNA, 18 nt, Human
cuauugacaauaaaauau

SEQ ID NO: 1776884 - RNA, 22 nt, Human
cuauguaacauguaggaaguag

SEQ ID NO: 1776885 - RNA, 13 nt, Human
cuaugggccugcc

SEQ ID NO: 1776886 - RNA, 19 nt, Human
cuaugggccugccgggcug

SEQ ID NO: 1776887 - RNA, 23 nt, Human
cuaugggccugccgggcugaggg

SEQ ID NO: 1776888 - RNA, 16 nt, Human
cuaugcuauugacaau

SEQ ID NO: 1776889 - RNA, 17 nt, Human
cuaugcuauugacaaua

SEQ ID NO: 1776890 - RNA, 19 nt, Human
cuaugcuauugacaauaaa

SEQ ID NO: 1776891 - RNA, 20 nt, Human
cuaugcuauugacaauaaaa

SEQ ID NO: 1776892 - RNA, 21 nt, Human
cuaugcuauugacaauaaaau

SEQ ID NO: 1776893 - RNA, 14 nt, Human
cuaugccugugucu

SEQ ID NO: 1776894 - RNA, 14 nt, Human
cuauagguccagaa

SEQ ID NO: 1776895 - RNA, 15 nt, Human
cuauagguccagaag

SEQ ID NO: 1776896 - RNA, 19 nt, Human
cuauagccuaggugacaga

SEQ ID NO: 1776897 - RNA, 18 nt, Human
cuauagccuaggugacag

SEQ ID NO: 1776898 - RNA, 20 nt, Human
cuauagccuaggugacagag

SEQ ID NO: 1776899 - RNA, 21 nt, Human
cuauagccuaggugacagagu

SEQ ID NO: 1776900 - RNA, 14 nt, Human
cuauaccugugccu

SEQ ID NO: 1776901 - RNA, 15 nt, Human
cuauaccugugccuc

SEQ ID NO: 1776902 - RNA, 19 nt, Human
cuauacgcagcgugcuuua

SEQ ID NO: 1776903 - RNA, 19 nt, Human
cuauaccugugccucggcu

SEQ ID NO: 1776904 - RNA, 13 nt, Human
cuauaauuuaaau

SEQ ID NO: 1776905 - RNA, 12 nt, Human
cuauaauuuaaa

SEQ ID NO: 1776906 - RNA, 20 nt, Human
cuccacguucugcucaucau

SEQ ID NO: 1776907 - RNA, 15 nt, Human
cuccagcucaccagc

SEQ ID NO: 1776908 - RNA, 16 nt, Human
cuccagcucaccagcc

SEQ ID NO: 1776909 - RNA, 18 nt, Human
cuccagcucaccagcccc

SEQ ID NO: 1776910 - RNA, 13 nt, Human
cuccagagggcac

SEQ ID NO: 1776911 - RNA, 20 nt, Human
cuccagagggcacucugcuu

SEQ ID NO: 1776912 - RNA, 21 nt, Human
cuccagagggcacucugcuug

SEQ ID NO: 1776913 - RNA, 21 nt, Human
cuccagauagcucauuucauu

SEQ ID NO: 1776914 - RNA, 12 nt, Human
cucauucuucug

SEQ ID NO: 1776915 - RNA, 17 nt, Human
cucauucugaaggagcc

SEQ ID NO: 1776916 - RNA, 19 nt, Human
cucauucugaaggagcccc

SEQ ID NO: 1776917 - RNA, 21 nt, Human
cucauuugucacacacuuugg

SEQ ID NO: 1776918 - RNA, 15 nt, Human
cuccccugccagggc

SEQ ID NO: 1776919 - RNA, 16 nt, Human
cuccccugccagggca

SEQ ID NO: 1776920 - RNA, 16 nt, Human
cuccccucuccuuccu

SEQ ID NO: 1776921 - RNA, 20 nt, Human
cucccgaauagcugggacua

SEQ ID NO: 1776922 - RNA, 23 nt, Human
cucccgaauagcugggacuacag

SEQ ID NO: 1776923 - RNA, 21 nt, Human
cuccccugccagggcagggcc

SEQ ID NO: 1776924 - RNA, 18 nt, Human
cucccucacccccuccuu

SEQ ID NO: 1776925 - RNA, 19 nt, Human
cucccucacccccuccuuc

SEQ ID NO: 1776926 - RNA, 16 nt, Human
cucccaaagugcuggg

SEQ ID NO: 1776927 - RNA, 23 nt, Human
cucccaaagugcugggauuacag

SEQ ID NO: 1776928 - RNA, 14 nt, Human
cucccaacaguggg

SEQ ID NO: 1776929 - RNA, 15 nt, Human
cucccacacucccaa

SEQ ID NO: 1776930 - RNA, 23 nt, Human
cucaggugauccacccaccucag

SEQ ID NO: 1776931 - RNA, 14 nt, Human
cucaggugcugucc

SEQ ID NO: 1776932 - RNA, 16 nt, Human
cucaggaggcaggacc

SEQ ID NO: 1776933 - RNA, 17 nt, Human
cucaggaggcaggaccu

SEQ ID NO: 1776934 - RNA, 18 nt, Human
cucaggaggcaggaccuu

SEQ ID NO: 1776935 - RNA, 20 nt, Human
cucaggaccaaagcuuucau

SEQ ID NO: 1776936 - RNA, 21 nt, Human
cucaggaccaaagcuuucaug

SEQ ID NO: 1776937 - RNA, 22 nt, Human
cucaggaccaaagcuuucaugu

SEQ ID NO: 1776938 - RNA, 14 nt, Human
cucaggacucagaa

SEQ ID NO: 1776939 - RNA, 16 nt, Human
cucaggacucagaagc

SEQ ID NO: 1776940 - RNA, 21 nt, Human
cucaggacucagaagccucug

SEQ ID NO: 1776941 - RNA, 17 nt, Human
cucagcuuccccaacac

SEQ ID NO: 1776942 - RNA, 22 nt, Human
cucagcuuccccaacacgcagg

SEQ ID NO: 1776943 - RNA, 23 nt, Human
cucagcuggaugauggucuucag

SEQ ID NO: 1776944 - RNA, 18 nt, Human
cucagcucggcucagcuc

SEQ ID NO: 1776945 - RNA, 13 nt, Human
cucagcucggcuc

SEQ ID NO: 1776946 - RNA, 14 nt, Human
cucagcucggcuca

SEQ ID NO: 1776947 - RNA, 15 nt, Human
cucagcucggcucag

SEQ ID NO: 1776948 - RNA, 16 nt, Human
cucagcucggcucagc

SEQ ID NO: 1776949 - RNA, 17 nt, Human
cucagcucggcucagcu

SEQ ID NO: 1776950 - RNA, 14 nt, Human
cucacuguugccca

SEQ ID NO: 1776951 - RNA, 15 nt, Human
cucacuguugcccag

SEQ ID NO: 1776952 - RNA, 15 nt, Human
cucacugcagccuca

SEQ ID NO: 1776953 - RNA, 16 nt, Human
cucacugcagccucaa

SEQ ID NO: 1776954 - RNA, 16 nt, Human
cucacuguugcccagg

SEQ ID NO: 1776955 - RNA, 17 nt, Human
cucacuguugcccaggc

SEQ ID NO: 1776956 - RNA, 18 nt, Human
cucacuguugcccaggcu

SEQ ID NO: 1776957 - RNA, 19 nt, Human
cucacuguugcccaggcug

SEQ ID NO: 1776958 - RNA, 15 nt, Human
cucagcauccuggca

SEQ ID NO: 1776959 - RNA, 13 nt, Human
cucagcauccugg

SEQ ID NO: 1776960 - RNA, 21 nt, Human
cucagcauccuggcacccggc

SEQ ID NO: 1776961 - RNA, 22 nt, Human
cucagcauccuggcacccggcc

SEQ ID NO: 1776962 - RNA, 14 nt, Human
cucagcggggacag

SEQ ID NO: 1776963 - RNA, 15 nt, Human
cucagcggggacagc

SEQ ID NO: 1776964 - RNA, 16 nt, Human
cucagcggggacagcu

SEQ ID NO: 1776965 - RNA, 18 nt, Human
cucagcggggacagcucc

SEQ ID NO: 1776966 - RNA, 19 nt, Human
cucagcggggacagcuccu

SEQ ID NO: 1776967 - RNA, 20 nt, Human
cucagcggggacagcuccuu

SEQ ID NO: 1776968 - RNA, 21 nt, Human
cucagcggggacagcuccuuc

SEQ ID NO: 1776969 - RNA, 23 nt, Human
cucagcggggacagcuccuucug

SEQ ID NO: 1776970 - RNA, 23 nt, Human
cucagcguuuuuuuguuuuuaau

SEQ ID NO: 1776971 - RNA, 12 nt, Human
cgaugggucagg

SEQ ID NO: 1776972 - RNA, 16 nt, Human
cgcagagcuuuucaga

SEQ ID NO: 1776973 - RNA, 18 nt, Human
cgcagagcuuuucagauu

SEQ ID NO: 1776974 - RNA, 16 nt, Human
cgcagcaggaggccag

SEQ ID NO: 1776975 - RNA, 17 nt, Human
cgcagcaggaggccagg

SEQ ID NO: 1776976 - RNA, 18 nt, Human
cgcagcaggaggccaggc

SEQ ID NO: 1776977 - RNA, 23 nt, Human
cgagcccuguggaugagcccuca

SEQ ID NO: 1776978 - RNA, 19 nt, Human
cgagcccugguggcagugg

SEQ ID NO: 1776979 - RNA, 16 nt, Human
cgaggacagggaggug

SEQ ID NO: 1776980 - RNA, 19 nt, Human
cgaggaggcuccagagggc

SEQ ID NO: 1776981 - RNA, 20 nt, Human
cgaggaggcuccagagggca

SEQ ID NO: 1776982 - RNA, 16 nt, Human
cggcuuuucucagcug

SEQ ID NO: 1776983 - RNA, 20 nt, Human
cgggaaaaggagaggaaacu

SEQ ID NO: 1776984 - RNA, 16 nt, Human
cgggaaccuccccagc

SEQ ID NO: 1776985 - RNA, 17 nt, Human
cgggaaccuccccagcc

SEQ ID NO: 1776986 - RNA, 18 nt, Human
cgggaaccuccccagccu

SEQ ID NO: 1776987 - RNA, 19 nt, Human
cgggaaccuccccagccug

SEQ ID NO: 1776988 - RNA, 20 nt, Human
cgggaaccuccccagccugc

SEQ ID NO: 1776989 - RNA, 21 nt, Human
cgggaaccuccccagccugcg

SEQ ID NO: 1776990 - RNA, 22 nt, Human
cgggaaccuccccagccugcgc

SEQ ID NO: 1776991 - RNA, 11 nt, Human
cggccaggcca

SEQ ID NO: 1776992 - RNA, 12 nt, Human
cggccaggccag

SEQ ID NO: 1776993 - RNA, 20 nt, Human
cggccaggccagagggagug

SEQ ID NO: 1776994 - RNA, 21 nt, Human
cggacagccacggccaggcca

SEQ ID NO: 1776995 - RNA, 22 nt, Human
cggacagccacggccaggccag

SEQ ID NO: 1776996 - RNA, 16 nt, Human
cgcuuucuacccagcg

SEQ ID NO: 1776997 - RNA, 14 nt, Human
cgcuuucuacccag

SEQ ID NO: 1776998 - RNA, 16 nt, Human
cggaauaguuggcuag

SEQ ID NO: 1776999 - RNA, 17 nt, Human
cggaauaguuggcuagg

SEQ ID NO: 1777000 - RNA, 13 nt, Human
cgcucccucccag

SEQ ID NO: 1777001 - RNA, 15 nt, Human
cgcucccucccagga

SEQ ID NO: 1777002 - RNA, 20 nt, Human
cgcucccucccaggacucug

SEQ ID NO: 1777003 - RNA, 21 nt, Human
cgcucccucccaggacucuga

SEQ ID NO: 1777004 - RNA, 17 nt, Human
cgcuguugcugaauagg

SEQ ID NO: 1777005 - RNA, 14 nt, Human
cgcuguugcugaau

SEQ ID NO: 1777006 - RNA, 13 nt, Human
cgcuguugcugaa

SEQ ID NO: 1777007 - RNA, 13 nt, Human
cgcccagucugga

SEQ ID NO: 1777008 - RNA, 19 nt, Human
cgcccagucuggaaugcag

SEQ ID NO: 1777009 - RNA, 21 nt, Human
cgcccagucuggaaugcagug

SEQ ID NO: 1777010 - RNA, 23 nt, Human
cgccuuuccuuuucgccuuuccu

SEQ ID NO: 1777011 - RNA, 13 nt, Human
cgccuuucccagg

SEQ ID NO: 1777012 - RNA, 13 nt, Human
cgccuuuccucuc

SEQ ID NO: 1777013 - RNA, 19 nt, Human
cgccuuuccucucuauauu

SEQ ID NO: 1777014 - RNA, 22 nt, Human
cgcggugccaugucugcagugu

SEQ ID NO: 1777015 - RNA, 20 nt, Human
cgcggggcugucggcgcugc

SEQ ID NO: 1777016 - RNA, 16 nt, Human
ccuugguucccccacu

SEQ ID NO: 1777017 - RNA, 13 nt, Human
ccuugggcucccu

SEQ ID NO: 1777018 - RNA, 12 nt, Human
ccuugggcuccc

SEQ ID NO: 1777019 - RNA, 18 nt, Human
ccuuggcuugcccacgug

SEQ ID NO: 1777020 - RNA, 16 nt, Human
ccuuggcugcagggag

SEQ ID NO: 1777021 - RNA, 13 nt, Human
ccuuggcuugccc

SEQ ID NO: 1777022 - RNA, 15 nt, Human
ccuuggcuugcccac

SEQ ID NO: 1777023 - RNA, 16 nt, Human
ccuuggcuugcccacg

SEQ ID NO: 1777024 - RNA, 18 nt, Human
ccuugacagggcacaccg

SEQ ID NO: 1777025 - RNA, 21 nt, Human
ccuugacagggcacaccgggc

SEQ ID NO: 1777026 - RNA, 22 nt, Human
ccuuggcucaaguccucuuuuc

SEQ ID NO: 1777027 - RNA, 13 nt, Human
ccuuggccugggc

SEQ ID NO: 1777028 - RNA, 20 nt, Human
ccuguggaugagcccucaga

SEQ ID NO: 1777029 - RNA, 13 nt, Human
ccugucccugcgc

SEQ ID NO: 1777030 - RNA, 23 nt, Human
ccugucccugcgccuuuccuuuu

SEQ ID NO: 1777031 - RNA, 14 nt, Human
ccuuccagcccaga

SEQ ID NO: 1777032 - RNA, 12 nt, Human
ccuuccagaucc

SEQ ID NO: 1777033 - RNA, 19 nt, Human
ccuuccagauccucucugg

SEQ ID NO: 1777034 - RNA, 13 nt, Human
ccuuccagcccag

SEQ ID NO: 1777035 - RNA, 20 nt, Human
ccuucaucuuccuguguccu

SEQ ID NO: 1777036 - RNA, 22 nt, Human
ccuucaucuuccuguguccuga

SEQ ID NO: 1777037 - RNA, 23 nt, Human
ccuguggggucaacccuucugga

SEQ ID NO: 1777038 - RNA, 21 nt, Human
ccuguggggucaacccuucug

SEQ ID NO: 1777039 - RNA, 11 nt, Human
ccuucuccauc

SEQ ID NO: 1777040 - RNA, 13 nt, Human
ccuucuccaucca

SEQ ID NO: 1777041 - RNA, 16 nt, Human
ccuucuccauccacau

SEQ ID NO: 1777042 - RNA, 22 nt, Human
ccuucuccauccacaugggagc

SEQ ID NO: 1777043 - RNA, 11 nt, Human
ccuucucacca

SEQ ID NO: 1777044 - RNA, 12 nt, Human
ccuucucaccag

SEQ ID NO: 1777045 - RNA, 14 nt, Human
ccuucucaccagcu

SEQ ID NO: 1777046 - RNA, 15 nt, Human
ccuucucaccagcug

SEQ ID NO: 1777047 - RNA, 16 nt, Human
ccuucucaccagcugc

SEQ ID NO: 1777048 - RNA, 17 nt, Human
ccuucucaccagcugca

SEQ ID NO: 1777049 - RNA, 18 nt, Human
ccuucucaccagcugcaa

SEQ ID NO: 1777050 - RNA, 19 nt, Human
ccuucucaccagcugcaaa

SEQ ID NO: 1777051 - RNA, 20 nt, Human
ccuucucaccagcugcaaag

SEQ ID NO: 1777052 - RNA, 21 nt, Human
ccuucucaccagcugcaaagu

SEQ ID NO: 1777053 - RNA, 22 nt, Human
ccuucucaccagcugcaaagug

SEQ ID NO: 1777054 - RNA, 17 nt, Human
ccuucguuuacuaugcc

SEQ ID NO: 1777055 - RNA, 19 nt, Human
ccuucguuuacuaugccug

SEQ ID NO: 1777056 - RNA, 20 nt, Human
ccuucguuuacuaugccugu

SEQ ID NO: 1777057 - RNA, 22 nt, Human
ccuucguuuacuaugccugugu

SEQ ID NO: 1777058 - RNA, 23 nt, Human
ccuucguuuacuaugccuguguc

SEQ ID NO: 1777059 - RNA, 23 nt, Human
ccuuccauggugugaucgucuga

SEQ ID NO: 1777060 - RNA, 13 nt, Human
ccuuccuggccug

SEQ ID NO: 1777061 - RNA, 16 nt, Human
ccuuccuggccugaga

SEQ ID NO: 1777062 - RNA, 20 nt, Human
ccuuccuggagacugcccag

SEQ ID NO: 1777063 - RNA, 15 nt, Human
ccuucgggcugugcc

SEQ ID NO: 1777064 - RNA, 16 nt, Human
ccuucgggcugugccc

SEQ ID NO: 1777065 - RNA, 18 nt, Human
cgaaucagcuauuuacug

SEQ ID NO: 1777066 - RNA, 22 nt, Human
cgaaucucuuuuugcuuucgaa

SEQ ID NO: 1777067 - RNA, 16 nt, Human
cgaauagcugggacua

SEQ ID NO: 1777068 - RNA, 15 nt, Human
cgaauagcugggacu

SEQ ID NO: 1777069 - RNA, 23 nt, Human
cgaaagggacuuggaagcuccgc

SEQ ID NO: 1777070 - RNA, 20 nt, Human
ccuuuuuucugccuccuuua

SEQ ID NO: 1777071 - RNA, 12 nt, Human
ccuugucucugg

SEQ ID NO: 1777072 - RNA, 11 nt, Human
ccuuuuuuccc

SEQ ID NO: 1777073 - RNA, 21 nt, Human
ccuuuuuucccauaagacaau

SEQ ID NO: 1777074 - RNA, 16 nt, Human
ccuuuguguguguguc

SEQ ID NO: 1777075 - RNA, 21 nt, Human
ccuuugugugugugucagcug

SEQ ID NO: 1777076 - RNA, 14 nt, Human
ccuuuguucccggc

SEQ ID NO: 1777077 - RNA, 15 nt, Human
ccuuuguucccggcu

SEQ ID NO: 1777078 - RNA, 20 nt, Human
ccugcccuuuuuucugccuc

SEQ ID NO: 1777079 - RNA, 22 nt, Human
ccugcccuuuuuucugccuccu

SEQ ID NO: 1777080 - RNA, 13 nt, Human
ccugcccuuggca

SEQ ID NO: 1777081 - RNA, 12 nt, Human
ccugccucagcc

SEQ ID NO: 1777082 - RNA, 13 nt, Human
ccugccucagccu

SEQ ID NO: 1777083 - RNA, 14 nt, Human
ccugccucagccuc

SEQ ID NO: 1777084 - RNA, 16 nt, Human
ccugccuguagcccac

SEQ ID NO: 1777085 - RNA, 13 nt, Human
ccugccugucugc

SEQ ID NO: 1777086 - RNA, 14 nt, Human
ccugccugucugcc

SEQ ID NO: 1777087 - RNA, 15 nt, Human
ccugccugucugccc

SEQ ID NO: 1777088 - RNA, 16 nt, Human
ccugccugucugcccc

SEQ ID NO: 1777089 - RNA, 21 nt, Human
ccugccacgaauuucugugcc

SEQ ID NO: 1777090 - RNA, 13 nt, Human
ccugccagggcag

SEQ ID NO: 1777091 - RNA, 17 nt, Human
ccugccagggcagggcc

SEQ ID NO: 1777092 - RNA, 19 nt, Human
ccugccagggcagggcccc

SEQ ID NO: 1777093 - RNA, 14 nt, Human
ccugcccggcugcg

SEQ ID NO: 1777094 - RNA, 16 nt, Human
ccugcccggcugcgga

SEQ ID NO: 1777095 - RNA, 15 nt, Human
ccugcccguaaacac

SEQ ID NO: 1777096 - RNA, 20 nt, Human
ccugcccguaaacacgccug

SEQ ID NO: 1777097 - RNA, 21 nt, Human
ccugcccguaaacacgccugc

SEQ ID NO: 1777098 - RNA, 22 nt, Human
ccugcccguaaacacgccugca

SEQ ID NO: 1777099 - RNA, 23 nt, Human
ccugcccguaaacacgccugcaa

SEQ ID NO: 1777100 - RNA, 13 nt, Human
ccugaucagagcc

SEQ ID NO: 1777101 - RNA, 16 nt, Human
ccugccacccugggga

SEQ ID NO: 1777102 - RNA, 22 nt, Human
ccugccacccuggggagaaagu

SEQ ID NO: 1777103 - RNA, 24 nt, Human
ccugccacccugggccuggcagcu

SEQ ID NO: 1777104 - RNA, 14 nt, Human
ccugccacccuggg

SEQ ID NO: 1777105 - RNA, 15 nt, Human
ccugccacccugggc

SEQ ID NO: 1777106 - RNA, 21 nt, Human
ccugccacccugggccuggca

SEQ ID NO: 1777107 - RNA, 12 nt, Human
ccugccacccug

SEQ ID NO: 1777108 - RNA, 13 nt, Human
ccugccacccugg

SEQ ID NO: 1777109 - RNA, 14 nt, Human
ccugcauuguaaau

SEQ ID NO: 1777110 - RNA, 12 nt, Human
ccugccacagcc

SEQ ID NO: 1777111 - RNA, 12 nt, Human
ccugagccuggc

SEQ ID NO: 1777112 - RNA, 13 nt, Human
ccugagccuggcc

SEQ ID NO: 1777113 - RNA, 14 nt, Human
ccugagccuggcca

SEQ ID NO: 1777114 - RNA, 15 nt, Human
ccugagccuggccag

SEQ ID NO: 1777115 - RNA, 16 nt, Human
ccugagccuggccagc

SEQ ID NO: 1777116 - RNA, 20 nt, Human
ccugaagucacacagugagu

SEQ ID NO: 1777117 - RNA, 14 nt, Human
ccugaaucaugagc

SEQ ID NO: 1777118 - RNA, 16 nt, Human
ccugaaucaugagccu

SEQ ID NO: 1777119 - RNA, 17 nt, Human
ccugaaucaugagccug

SEQ ID NO: 1777120 - RNA, 19 nt, Human
ccugaaucaugagccugcu

SEQ ID NO: 1777121 - RNA, 21 nt, Human
ccugaaucaugagccugcugg

SEQ ID NO: 1777122 - RNA, 22 nt, Human
ccugaaucaugagccugcugga

SEQ ID NO: 1777123 - RNA, 15 nt, Human
ccugagcugaggcag

SEQ ID NO: 1777124 - RNA, 16 nt, Human
ccugagcugaggcagc

SEQ ID NO: 1777125 - RNA, 18 nt, Human
ccugagcugaggcagcag

SEQ ID NO: 1777126 - RNA, 14 nt, Human
ccugaagccagcug

SEQ ID NO: 1777127 - RNA, 18 nt, Human
ccugaagccagcugcccu

SEQ ID NO: 1777128 - RNA, 17 nt, Human
ccugaaacgcuccuuug

SEQ ID NO: 1777129 - RNA, 19 nt, Human
ccugaaacgcuccuuugug

SEQ ID NO: 1777130 - RNA, 20 nt, Human
ccugaaacgcuccuuugugu

SEQ ID NO: 1777131 - RNA, 21 nt, Human
ccugaaacgcuccuuugugug

SEQ ID NO: 1777132 - RNA, 14 nt, Human
ccugaaacuauauu

SEQ ID NO: 1777133 - RNA, 19 nt, Human
ccugaaacuauauuuuguc

SEQ ID NO: 1777134 - RNA, 15 nt, Human
ccucuuccugccuag

SEQ ID NO: 1777135 - RNA, 18 nt, Human
ccugaaaacacugugcac

SEQ ID NO: 1777136 - RNA, 13 nt, Human
ccucuucagaggc

SEQ ID NO: 1777137 - RNA, 14 nt, Human
ccucuucagaggcc

SEQ ID NO: 1777138 - RNA, 16 nt, Human
ccucuucagaggcccu

SEQ ID NO: 1777139 - RNA, 21 nt, Human
ccugcuaauuccccagauugc

SEQ ID NO: 1777140 - RNA, 15 nt, Human
ccugcuagcuagcuc

SEQ ID NO: 1777141 - RNA, 23 nt, Human
ccugcuagcuagcucaacuagug

SEQ ID NO: 1777142 - RNA, 19 nt, Human
ccuggcacccggccccugc

SEQ ID NO: 1777143 - RNA, 20 nt, Human
ccuggcacccggccccugcu

SEQ ID NO: 1777144 - RNA, 21 nt, Human
ccuggcacccggccccugcug

SEQ ID NO: 1777145 - RNA, 15 nt, Human
ccuggccagccuaca

SEQ ID NO: 1777146 - RNA, 21 nt, Human
ccuggccagaugcaccagccc

SEQ ID NO: 1777147 - RNA, 23 nt, Human
ccuggccagaugcaccagcccuu

SEQ ID NO: 1777148 - RNA, 20 nt, Human
ccuggccagaugcaccagcc

SEQ ID NO: 1777149 - RNA, 17 nt, Human
ccugggaaauauucccu

SEQ ID NO: 1777150 - RNA, 18 nt, Human
ccugggaaauauucccua

SEQ ID NO: 1777151 - RNA, 13 nt, Human
ccuggcuucugug

SEQ ID NO: 1777152 - RNA, 14 nt, Human
ccuggcuucugugg

SEQ ID NO: 1777153 - RNA, 16 nt, Human
ccuggcuucugugggg

SEQ ID NO: 1777154 - RNA, 22 nt, Human
ccuggcuucuguggggccccuc

SEQ ID NO: 1777155 - RNA, 16 nt, Human
ccugggagugagcugg

SEQ ID NO: 1777156 - RNA, 14 nt, Human
ccugggacuuccau

SEQ ID NO: 1777157 - RNA, 18 nt, Human
ccugggacuuccaugccu

SEQ ID NO: 1777158 - RNA, 20 nt, Human
ccugggacuuccaugccuua

SEQ ID NO: 1777159 - RNA, 18 nt, Human
ccugggagugagcugguu

SEQ ID NO: 1777160 - RNA, 14 nt, Human
ccugguggcagcug

SEQ ID NO: 1777161 - RNA, 15 nt, Human
ccugguggcagcugc

SEQ ID NO: 1777162 - RNA, 16 nt, Human
ccugguggcagcugcg

SEQ ID NO: 1777163 - RNA, 17 nt, Human
ccugguggcagcugcgg

SEQ ID NO: 1777164 - RNA, 18 nt, Human
ccugguggcagcugcggu

SEQ ID NO: 1777165 - RNA, 12 nt, Human
ccugucaccucu

SEQ ID NO: 1777166 - RNA, 14 nt, Human
ccugucaccucuuc

SEQ ID NO: 1777167 - RNA, 16 nt, Human
ccugucaccucuuccg

SEQ ID NO: 1777168 - RNA, 17 nt, Human
ccugucaccucuuccga

SEQ ID NO: 1777169 - RNA, 15 nt, Human
ccugguggcaguggg

SEQ ID NO: 1777170 - RNA, 13 nt, Human
ccugguggcagug

SEQ ID NO: 1777171 - RNA, 14 nt, Human
ccugguggcagugg

SEQ ID NO: 1777172 - RNA, 12 nt, Human
ccuguagcccac

SEQ ID NO: 1777173 - RNA, 16 nt, Human
ccuguagcccacucug

SEQ ID NO: 1777174 - RNA, 19 nt, Human
ccuguagcccacucugcuc

SEQ ID NO: 1777175 - RNA, 22 nt, Human
ccuguagcccacucugcucgcc

SEQ ID NO: 1777176 - RNA, 23 nt, Human
ccuguagcccacucugcucgccu

SEQ ID NO: 1777177 - RNA, 24 nt, Human
ccuguagcccacucugcucgccuu

SEQ ID NO: 1777178 - RNA, 19 nt, Human
gaaagcugguggcagaguc

SEQ ID NO: 1777179 - RNA, 14 nt, Human
gaaacccuggacca

SEQ ID NO: 1777180 - RNA, 21 nt, Human
gaaacccuggaccaguggucu

SEQ ID NO: 1777181 - RNA, 14 nt, Human
gaaacccugagcag

SEQ ID NO: 1777182 - RNA, 15 nt, Human
gaaacccugagcaga

SEQ ID NO: 1777183 - RNA, 19 nt, Human
gaaacuacugccuuuagaa

SEQ ID NO: 1777184 - RNA, 20 nt, Human
gaaacuacugccuuuagaaa

SEQ ID NO: 1777185 - RNA, 22 nt, Human
gaaacuacugccuuuagaaaau

SEQ ID NO: 1777186 - RNA, 23 nt, Human
gaaacuacugccuuuagaaaaua

SEQ ID NO: 1777187 - RNA, 19 nt, Human
gaaaagcugcugacagugu

SEQ ID NO: 1777188 - RNA, 12 nt, Human
gaaaaggaauca

SEQ ID NO: 1777189 - RNA, 23 nt, Human
gaaaaggaaucacguuagaggaa

SEQ ID NO: 1777190 - RNA, 17 nt, Human
gaaaaggagaggaaacu

SEQ ID NO: 1777191 - RNA, 15 nt, Human
gaaaaucaucaagaa

SEQ ID NO: 1777192 - RNA, 16 nt, Human
gaaaaucaucaagaag

SEQ ID NO: 1777193 - RNA, 20 nt, Human
gaaaaucaucaagaagggcu

SEQ ID NO: 1777194 - RNA, 21 nt, Human
gaaaaucaucaagaagggcug

SEQ ID NO: 1777195 - RNA, 22 nt, Human
gaaaaucaucaagaagggcugc

SEQ ID NO: 1777196 - RNA, 23 nt, Human
gaaaaucaucaagaagggcugca

SEQ ID NO: 1777197 - RNA, 18 nt, Human
gaaaaucuuauaauuuaa

SEQ ID NO: 1777198 - RNA, 21 nt, Human
gaaaaucuagaggaaaagaaa

SEQ ID NO: 1777199 - RNA, 22 nt, Human
gaaaaucuagaggaaaagaaag

SEQ ID NO: 1777200 - RNA, 14 nt, Human
gaaaacacugugca

SEQ ID NO: 1777201 - RNA, 21 nt, Human
gaaaacacugugcacaucugu

SEQ ID NO: 1777202 - RNA, 15 nt, Human
cuuuguguguguguc

SEQ ID NO: 1777203 - RNA, 20 nt, Human
cuuugugugugugucagcug

SEQ ID NO: 1777204 - RNA, 11 nt, Human
cuuuuuauugc

SEQ ID NO: 1777205 - RNA, 13 nt, Human
cuuuuuauugccu

SEQ ID NO: 1777206 - RNA, 14 nt, Human
cuuuuuauugccuu

SEQ ID NO: 1777207 - RNA, 15 nt, Human
cuuuuuauugccuuc

SEQ ID NO: 1777208 - RNA, 16 nt, Human
cuuuuuauugccuucu

SEQ ID NO: 1777209 - RNA, 23 nt, Human
cuuuuuauugccuucucaccagc

SEQ ID NO: 1777210 - RNA, 16 nt, Human
cuuuauccucuuuaga

SEQ ID NO: 1777211 - RNA, 14 nt, Human
cuuuauccucuuua

SEQ ID NO: 1777212 - RNA, 22 nt, Human
cuuuaugaaugaaaaaacaguc

SEQ ID NO: 1777213 - RNA, 14 nt, Human
cuuuagcgcccagu

SEQ ID NO: 1777214 - RNA, 15 nt, Human
cuuuagcgcccaguu

SEQ ID NO: 1777215 - RNA, 18 nt, Human
cuuuaaaauuuuuuuaga

SEQ ID NO: 1777216 - RNA, 23 nt, Human
cuuuaaaauuuuuuuagaaagca

SEQ ID NO: 1777217 - RNA, 21 nt, Human
cuuuaaaauuuuuuuagaaag

SEQ ID NO: 1777218 - RNA, 15 nt, Human
cuuuacgcccaucuc

SEQ ID NO: 1777219 - RNA, 16 nt, Human
cuuuacgcccaucuca

SEQ ID NO: 1777220 - RNA, 22 nt, Human
cuuuacgcccaucucaggacac

SEQ ID NO: 1777221 - RNA, 16 nt, Human
cuuguucugagauuca

SEQ ID NO: 1777222 - RNA, 17 nt, Human
cuuguacuuuauuuucu

SEQ ID NO: 1777223 - RNA, 15 nt, Human
cuugucccagaggcu

SEQ ID NO: 1777224 - RNA, 19 nt, Human
cuugucccagaggcugccc

SEQ ID NO: 1777225 - RNA, 14 nt, Human
cuuguccccaaauc

SEQ ID NO: 1777226 - RNA, 17 nt, Human
cuuguaaauagcucagg

SEQ ID NO: 1777227 - RNA, 18 nt, Human
cuuguaaauagcucaggu

SEQ ID NO: 1777228 - RNA, 21 nt, Human
cuuguaaauagcucagguguc

SEQ ID NO: 1777229 - RNA, 16 nt, Human
cuuguaaauagcucag

SEQ ID NO: 1777230 - RNA, 19 nt, Human
cuugaguuuaaauuguaau

SEQ ID NO: 1777231 - RNA, 18 nt, Human
cuuucuggcagguccucc

SEQ ID NO: 1777232 - RNA, 12 nt, Human
cuuuaugucuuu

SEQ ID NO: 1777233 - RNA, 18 nt, Human
cuuuccauuggaucucau

SEQ ID NO: 1777234 - RNA, 20 nt, Human
cuuugcagacaggcaagcac

SEQ ID NO: 1777235 - RNA, 19 nt, Human
cuuuggcuauuagagauca

SEQ ID NO: 1777236 - RNA, 13 nt, Human
cuucucugaagga

SEQ ID NO: 1777237 - RNA, 13 nt, Human
cuucucucugugg

SEQ ID NO: 1777238 - RNA, 16 nt, Human
cuucucucugugggau

SEQ ID NO: 1777239 - RNA, 12 nt, Human
cuucuccaggcu

SEQ ID NO: 1777240 - RNA, 13 nt, Human
cuucuccaggcug

SEQ ID NO: 1777241 - RNA, 14 nt, Human
cuucuccaggcugu

SEQ ID NO: 1777242 - RNA, 12 nt, Human
cuuccuggccug

SEQ ID NO: 1777243 - RNA, 14 nt, Human
cuuccuggccugag

SEQ ID NO: 1777244 - RNA, 15 nt, Human
cuuccuggccugaga

SEQ ID NO: 1777245 - RNA, 19 nt, Human
cuuccuggccugagaguca

SEQ ID NO: 1777246 - RNA, 22 nt, Human
cuucugggagggcagcagggcu

SEQ ID NO: 1777247 - RNA, 19 nt, Human
cuucugggagggcagcagg

SEQ ID NO: 1777248 - RNA, 23 nt, Human
cuucugggagggcagcagggcua

SEQ ID NO: 1777249 - RNA, 13 nt, Human
cuucugcuucagc

SEQ ID NO: 1777250 - RNA, 21 nt, Human
cuucuguacgucugacaggca

SEQ ID NO: 1777251 - RNA, 14 nt, Human
cuucugucccucac

SEQ ID NO: 1777252 - RNA, 15 nt, Human
cuucugucccucaca

SEQ ID NO: 1777253 - RNA, 14 nt, Human
cuucuguacgucug

SEQ ID NO: 1777254 - RNA, 15 nt, Human
cuucuguacgucuga

SEQ ID NO: 1777255 - RNA, 18 nt, Human
cuucuguacgucugacag

SEQ ID NO: 1777256 - RNA, 20 nt, Human
cuucuguacgucugacaggc

SEQ ID NO: 1777257 - RNA, 16 nt, Human
cuucuguccuacucug

SEQ ID NO: 1777258 - RNA, 17 nt, Human
cuucuguccuacucugu

SEQ ID NO: 1777259 - RNA, 18 nt, Human
cuucuguccuacucugug

SEQ ID NO: 1777260 - RNA, 19 nt, Human
cuucuguccuacucugugu

SEQ ID NO: 1777261 - RNA, 21 nt, Human
cuucuguccuacucuguguca

SEQ ID NO: 1777262 - RNA, 18 nt, Human
cuugaccugcauuguaaa

SEQ ID NO: 1777263 - RNA, 19 nt, Human
cuugaccugcauuguaaau

SEQ ID NO: 1777264 - RNA, 20 nt, Human
cuugaccugcauuguaaaua

SEQ ID NO: 1777265 - RNA, 13 nt, Human
cuugacuuugcuc

SEQ ID NO: 1777266 - RNA, 19 nt, Human
cuugacuuugcuccucaca

SEQ ID NO: 1777267 - RNA, 21 nt, Human
cuugaggguugggcugguguc

SEQ ID NO: 1777268 - RNA, 19 nt, Human
cuugaggguugggcuggug

SEQ ID NO: 1777269 - RNA, 20 nt, Human
cuugaggguugggcuggugu

SEQ ID NO: 1777270 - RNA, 13 nt, Human
cuugaccucaggu

SEQ ID NO: 1777271 - RNA, 13 nt, Human
cuugaacuccugg

SEQ ID NO: 1777272 - RNA, 16 nt, Human
cuucuuuuuuuucauu

SEQ ID NO: 1777273 - RNA, 10 nt, Human
cuucugucuc

SEQ ID NO: 1777274 - RNA, 11 nt, Human
cuucugucucc

SEQ ID NO: 1777275 - RNA, 14 nt, Human
cuucugucuccagc

SEQ ID NO: 1777276 - RNA, 19 nt, Human
cuucuguggggacuccggc

SEQ ID NO: 1777277 - RNA, 16 nt, Human
cuucuguggggccccu

SEQ ID NO: 1777278 - RNA, 20 nt, Human
cuucuguggggccccucacc

SEQ ID NO: 1777279 - RNA, 15 nt, Human
cuucuuguucugaga

SEQ ID NO: 1777280 - RNA, 16 nt, Human
cuucuuguucugagau

SEQ ID NO: 1777281 - RNA, 21 nt, Human
cuucuuguucugagauucaau

SEQ ID NO: 1777282 - RNA, 22 nt, Human
cuucuuguucugagauucaaua

SEQ ID NO: 1777283 - RNA, 15 nt, Human
cuucuuguuuccuug

SEQ ID NO: 1777284 - RNA, 16 nt, Human
cuucuuguuuccuugu

SEQ ID NO: 1777285 - RNA, 17 nt, Human
cuucuuguuuccuuguu

SEQ ID NO: 1777286 - RNA, 14 nt, Human
cuuccacugagggc

SEQ ID NO: 1777287 - RNA, 17 nt, Human
cuuccaccauuguccua

SEQ ID NO: 1777288 - RNA, 17 nt, Human
cuucaguggcagcugcu

SEQ ID NO: 1777289 - RNA, 15 nt, Human
cuucauucuuugcag

SEQ ID NO: 1777290 - RNA, 21 nt, Human
cuucaccauuuggcaaugcca

SEQ ID NO: 1777291 - RNA, 13 nt, Human
cuucaguggcagc

SEQ ID NO: 1777292 - RNA, 14 nt, Human
cuucaguggcagcu

SEQ ID NO: 1777293 - RNA, 15 nt, Human
cuucaguggcagcug

SEQ ID NO: 1777294 - RNA, 16 nt, Human
cuucaguggcagcugc

SEQ ID NO: 1777295 - RNA, 18 nt, Human
cuuccccggagggcugcg

SEQ ID NO: 1777296 - RNA, 17 nt, Human
cuucccgggccagggcu

SEQ ID NO: 1777297 - RNA, 18 nt, Human
cuucccgggccagggcug

SEQ ID NO: 1777298 - RNA, 19 nt, Human
cuucccgggccagggcugc

SEQ ID NO: 1777299 - RNA, 20 nt, Human
cuuauauuaauaguaauuug

SEQ ID NO: 1777300 - RNA, 21 nt, Human
cuuauauuaauaguaauuugu

SEQ ID NO: 1777301 - RNA, 21 nt, Human
cuuauccuaaaacaaauaguu

SEQ ID NO: 1777302 - RNA, 13 nt, Human
cuguucuggagga

SEQ ID NO: 1777303 - RNA, 14 nt, Human
cuguucuggaggaa

SEQ ID NO: 1777304 - RNA, 22 nt, Human
cuguucuggaggaaagggagga

SEQ ID NO: 1777305 - RNA, 23 nt, Human
cuguucuggaggaaagggaggag

SEQ ID NO: 1777306 - RNA, 23 nt, Human
cuucaaacuagggccaagcccag

SEQ ID NO: 1777307 - RNA, 16 nt, Human
cuuaucgggcuccagc

SEQ ID NO: 1777308 - RNA, 18 nt, Human
cuuaucgggcuccagcca

SEQ ID NO: 1777309 - RNA, 17 nt, Human
cuucaccauuuggcaau

SEQ ID NO: 1777310 - RNA, 15 nt, Human
cuguauaaguuauuu

SEQ ID NO: 1777311 - RNA, 22 nt, Human
cuguauaaguuauuuuuguaca

SEQ ID NO: 1777312 - RNA, 23 nt, Human
cuguauaaguuauuuuuguacau

SEQ ID NO: 1777313 - RNA, 16 nt, Human
cuguaucaggacccag

SEQ ID NO: 1777314 - RNA, 22 nt, Human
cuguaucaggacccagaggaag

SEQ ID NO: 1777315 - RNA, 23 nt, Human
cuguaucaggacccagaggaagg

SEQ ID NO: 1777316 - RNA, 16 nt, Human
cuguccaggcacugag

SEQ ID NO: 1777317 - RNA, 23 nt, Human
cuguaucccaugagccucagcau

SEQ ID NO: 1777318 - RNA, 19 nt, Human
cuguccaggcacugagaua

SEQ ID NO: 1777319 - RNA, 12 nt, Human
cuguccaggcuc

SEQ ID NO: 1777320 - RNA, 13 nt, Human
cuguccaggcucg

SEQ ID NO: 1777321 - RNA, 17 nt, Human
cugucccuccgggaccu

SEQ ID NO: 1777322 - RNA, 21 nt, Human
cugucccuccgggaccuggug

SEQ ID NO: 1777323 - RNA, 11 nt, Human
cugucccugcg

SEQ ID NO: 1777324 - RNA, 13 nt, Human
cugucccugcgcc

SEQ ID NO: 1777325 - RNA, 23 nt, Human
cugucucaaaaaaacacaaaagu

SEQ ID NO: 1777326 - RNA, 14 nt, Human
cuguccuacccacc

SEQ ID NO: 1777327 - RNA, 20 nt, Human
cuguccggaaugccacccac

SEQ ID NO: 1777328 - RNA, 21 nt, Human
cuguccggaaugccacccaca

SEQ ID NO: 1777329 - RNA, 18 nt, Human
cugucccugcgccuuucc

SEQ ID NO: 1777330 - RNA, 24 nt, Human
cugggcuucaguggcagcugcuuu

SEQ ID NO: 1777331 - RNA, 16 nt, Human
cuggggcuguguuuug

SEQ ID NO: 1777332 - RNA, 14 nt, Human
cugggggagagccg

SEQ ID NO: 1777333 - RNA, 14 nt, Human
cuggugcugccucu

SEQ ID NO: 1777334 - RNA, 19 nt, Human
cuggugcugccucuaccug

SEQ ID NO: 1777335 - RNA, 13 nt, Human
cugguggcagcug

SEQ ID NO: 1777336 - RNA, 14 nt, Human
cugguggcagcugc

SEQ ID NO: 1777337 - RNA, 12 nt, Human
cuguucccccug

SEQ ID NO: 1777338 - RNA, 15 nt, Human
cuguucccccugugc

SEQ ID NO: 1777339 - RNA, 16 nt, Human
cuguucccccugugca

SEQ ID NO: 1777340 - RNA, 17 nt, Human
cuguucccccugugcag

SEQ ID NO: 1777341 - RNA, 15 nt, Human
cugugugcuuggucu

SEQ ID NO: 1777342 - RNA, 13 nt, Human
cuguggggacucc

SEQ ID NO: 1777343 - RNA, 19 nt, Human
cuguggggacuccggcugu

SEQ ID NO: 1777344 - RNA, 22 nt, Human
cuguggggacuccggcugugcu

SEQ ID NO: 1777345 - RNA, 23 nt, Human
cuguggggacuccggcugugcug

SEQ ID NO: 1777346 - RNA, 21 nt, Human
cugugucuugcaauggcagcc

SEQ ID NO: 1777347 - RNA, 22 nt, Human
cugugucuugcaauggcagccu

SEQ ID NO: 1777348 - RNA, 23 nt, Human
cugugucuugcaauggcagccuu

SEQ ID NO: 1777349 - RNA, 20 nt, Human
cugugugugcgccuacagga

SEQ ID NO: 1777350 - RNA, 20 nt, Human
cugucuccauggcccugcaa

SEQ ID NO: 1777351 - RNA, 15 nt, Human
cugucuccagcuucc

SEQ ID NO: 1777352 - RNA, 17 nt, Human
cugugaguuuaaagcaa

SEQ ID NO: 1777353 - RNA, 15 nt, Human
cugugccuccaucag

SEQ ID NO: 1777354 - RNA, 16 nt, Human
cugugccuccaucagc

SEQ ID NO: 1777355 - RNA, 16 nt, Human
cugugccaugugccag

SEQ ID NO: 1777356 - RNA, 18 nt, Human
cugugccaugugccaggu

SEQ ID NO: 1777357 - RNA, 18 nt, Human
cugugcacaucugugucu

SEQ ID NO: 1777358 - RNA, 19 nt, Human
cugugcacaucugugucuu

SEQ ID NO: 1777359 - RNA, 20 nt, Human
cugugcacaucugugucuug

SEQ ID NO: 1777360 - RNA, 21 nt, Human
cugugcacaucugugucuugu

SEQ ID NO: 1777361 - RNA, 20 nt, Human
cuguggaugagcccucagaa

SEQ ID NO: 1777362 - RNA, 22 nt, Human
cugugccucggcuuuucucagc

SEQ ID NO: 1777363 - RNA, 23 nt, Human
cugugccucggcuuuucucagcu

SEQ ID NO: 1777364 - RNA, 13 nt, Human
cugugccucggcu

SEQ ID NO: 1777365 - RNA, 17 nt, Human
cugugcuucgggcccuu

SEQ ID NO: 1777366 - RNA, 19 nt, Human
cugugcuucgggcccuucc

SEQ ID NO: 1777367 - RNA, 14 nt, Human
cugugcugggagaa

SEQ ID NO: 1777368 - RNA, 20 nt, Human
cugugcuucgggcccuuccc

SEQ ID NO: 1777369 - RNA, 21 nt, Human
cugugcuucgggcccuuccca

SEQ ID NO: 1777370 - RNA, 15 nt, Human
cugugcuugaaggcc

SEQ ID NO: 1777371 - RNA, 16 nt, Human
cugugcuugaaggccc

SEQ ID NO: 1777372 - RNA, 17 nt, Human
cugugcuugaaggcccu

SEQ ID NO: 1777373 - RNA, 18 nt, Human
cugugcuugaaggcccug

SEQ ID NO: 1777374 - RNA, 20 nt, Human
cugugcuugaaggcccugcu

SEQ ID NO: 1777375 - RNA, 22 nt, Human
cugugcuugaaggcccugcuga

SEQ ID NO: 1777376 - RNA, 13 nt, Human
cuggacaaagaau

SEQ ID NO: 1777377 - RNA, 14 nt, Human
cuggacaaagaauu

SEQ ID NO: 1777378 - RNA, 15 nt, Human
cuggacaaagaauuc

SEQ ID NO: 1777379 - RNA, 13 nt, Human
cuggacacaggcc

SEQ ID NO: 1777380 - RNA, 14 nt, Human
cuggacacaggccu

SEQ ID NO: 1777381 - RNA, 15 nt, Human
cuggacacaggccug

SEQ ID NO: 1777382 - RNA, 23 nt, Human
cuggacaggcauguucucugagg

SEQ ID NO: 1777383 - RNA, 14 nt, Human
cuggacaggcaugu

SEQ ID NO: 1777384 - RNA, 17 nt, Human
cuggacaggcauguucu

SEQ ID NO: 1777385 - RNA, 21 nt, Human
cuggaccaguggucucacaug

SEQ ID NO: 1777386 - RNA, 12 nt, Human
cuggaccccagc

SEQ ID NO: 1777387 - RNA, 16 nt, Human
cuggaccuugaacugg

SEQ ID NO: 1777388 - RNA, 18 nt, Human
cuggacccuguugcuaag

SEQ ID NO: 1777389 - RNA, 17 nt, Human
cuggacccuguugcuaa

SEQ ID NO: 1777390 - RNA, 16 nt, Human
cuggacccuguugcua

SEQ ID NO: 1777391 - RNA, 15 nt, Human
cuggacccuguugcu

SEQ ID NO: 1777392 - RNA, 14 nt, Human
cuggacccuguugc

SEQ ID NO: 1777393 - RNA, 17 nt, Human
cuggaccuugaacuggg

SEQ ID NO: 1777394 - RNA, 20 nt, Human
cuggaccuugaacuggguac

SEQ ID NO: 1777395 - RNA, 21 nt, Human
cuggaccuugaacuggguacu

SEQ ID NO: 1777396 - RNA, 14 nt, Human
cuggaggucagcau

SEQ ID NO: 1777397 - RNA, 14 nt, Human
cuggagugcaguga

SEQ ID NO: 1777398 - RNA, 15 nt, Human
cuggagugcagugag

SEQ ID NO: 1777399 - RNA, 16 nt, Human
cuggagugcagugagc

SEQ ID NO: 1777400 - RNA, 17 nt, Human
cuggagugcagugagcc

SEQ ID NO: 1777401 - RNA, 18 nt, Human
cuggagucccaaauguca

SEQ ID NO: 1777402 - RNA, 14 nt, Human
cuggccagaugcac

SEQ ID NO: 1777403 - RNA, 12 nt, Human
cuggcagguccu

SEQ ID NO: 1777404 - RNA, 22 nt, Human
cuggccaucugguuaggauggc

SEQ ID NO: 1777405 - RNA, 17 nt, Human
cuggcacuggaccccag

SEQ ID NO: 1777406 - RNA, 18 nt, Human
cuggcacuggaccccagc

SEQ ID NO: 1777407 - RNA, 19 nt, Human
cuggcacuggaccccagca

SEQ ID NO: 1777408 - RNA, 22 nt, Human
cuggcacccggccccugcuggu

SEQ ID NO: 1777409 - RNA, 20 nt, Human
cuggcacccggccccugcug

SEQ ID NO: 1777410 - RNA, 21 nt, Human
cuggcacccggccccugcugg

SEQ ID NO: 1777411 - RNA, 19 nt, Human
cuggcacccggccccugcu

SEQ ID NO: 1777412 - RNA, 20 nt, Human
cuggagugcagugagccgag

SEQ ID NO: 1777413 - RNA, 14 nt, Human
cuggcgugcagugg

SEQ ID NO: 1777414 - RNA, 15 nt, Human
cuggcgugcaguggu

SEQ ID NO: 1777415 - RNA, 16 nt, Human
cugcugcuucuccaaa

SEQ ID NO: 1777416 - RNA, 13 nt, Human
cugcuggaagccc

SEQ ID NO: 1777417 - RNA, 14 nt, Human
cugcuggaagccca

SEQ ID NO: 1777418 - RNA, 15 nt, Human
cugcuggaagcccag

SEQ ID NO: 1777419 - RNA, 16 nt, Human
cugcuggaagcccagc

SEQ ID NO: 1777420 - RNA, 14 nt, Human
cugcuggaggccuc

SEQ ID NO: 1777421 - RNA, 15 nt, Human
cugcuggaggccuca

SEQ ID NO: 1777422 - RNA, 16 nt, Human
cugcuggaggccucag

SEQ ID NO: 1777423 - RNA, 17 nt, Human
cugcuggaggccucagg

SEQ ID NO: 1777424 - RNA, 18 nt, Human
cugcuggaggccucaggu

SEQ ID NO: 1777425 - RNA, 21 nt, Human
cugcuggaggccucaggugcu

SEQ ID NO: 1777426 - RNA, 12 nt, Human
cugcuggccaaa

SEQ ID NO: 1777427 - RNA, 20 nt, Human
cugcuggccaaauagcaaag

SEQ ID NO: 1777428 - RNA, 13 nt, Human
cugcugguucagg

SEQ ID NO: 1777429 - RNA, 15 nt, Human
cugcugguucagggu

SEQ ID NO: 1777430 - RNA, 23 nt, Human
cugcugguucaggguuggccccu

SEQ ID NO: 1777431 - RNA, 23 nt, Human
cugcugcccuaguuuucuuuccu

SEQ ID NO: 1777432 - RNA, 17 nt, Human
cugcugcaugcccucuc

SEQ ID NO: 1777433 - RNA, 21 nt, Human
cugcugcaugcccucucaggc

SEQ ID NO: 1777434 - RNA, 14 nt, Human
cugcugcaugcccu

SEQ ID NO: 1777435 - RNA, 15 nt, Human
cugcugcaugcccuc

SEQ ID NO: 1777436 - RNA, 16 nt, Human
cugcugcaugcccucu

SEQ ID NO: 1777437 - RNA, 12 nt, Human
cugccuuuauug

SEQ ID NO: 1777438 - RNA, 15 nt, Human
cugccuuuagaaaau

SEQ ID NO: 1777439 - RNA, 16 nt, Human
cugccuuuagaaaaua

SEQ ID NO: 1777440 - RNA, 17 nt, Human
cugccuuuagaaaauau

SEQ ID NO: 1777441 - RNA, 18 nt, Human
cugccuuuauuguguuug

SEQ ID NO: 1777442 - RNA, 17 nt, Human
cugccuuuauuguguuu

SEQ ID NO: 1777443 - RNA, 15 nt, Human
cugccuuuauugugu

SEQ ID NO: 1777444 - RNA, 16 nt, Human
cugcgacgcuugcucu

SEQ ID NO: 1777445 - RNA, 23 nt, Human
cugcgacgcuugcucuguuugug

SEQ ID NO: 1777446 - RNA, 15 nt, Human
cugcccuuuuuucug

SEQ ID NO: 1777447 - RNA, 18 nt, Human
cugcccuuuuuucugccu

SEQ ID NO: 1777448 - RNA, 19 nt, Human
cugcccuuuuuucugccuc

SEQ ID NO: 1777449 - RNA, 20 nt, Human
cugcccuuuuuucugccucc

SEQ ID NO: 1777450 - RNA, 21 nt, Human
cugcccuuuuuucugccuccu

SEQ ID NO: 1777451 - RNA, 15 nt, Human
cugccgggcugaggg

SEQ ID NO: 1777452 - RNA, 18 nt, Human
cugccgggcugagggccu

SEQ ID NO: 1777453 - RNA, 19 nt, Human
cugccgggcugagggccug

SEQ ID NO: 1777454 - RNA, 21 nt, Human
cugccgggcugagggccugcu

SEQ ID NO: 1777455 - RNA, 22 nt, Human
cugccgggcugagggccugcug

SEQ ID NO: 1777456 - RNA, 23 nt, Human
cugccgggcugagggccugcugg

SEQ ID NO: 1777457 - RNA, 18 nt, Human
cugccgguaaacacgccu

SEQ ID NO: 1777458 - RNA, 21 nt, Human
cugccgguaaacacgccugca

SEQ ID NO: 1777459 - RNA, 23 nt, Human
cugcccuaguuuucuuuccuccu

SEQ ID NO: 1777460 - RNA, 16 nt, Human
cugcccuaugggccug

SEQ ID NO: 1777461 - RNA, 17 nt, Human
cugcccuaugggccugc

SEQ ID NO: 1777462 - RNA, 20 nt, Human
cugcccuaugggccugccgg

SEQ ID NO: 1777463 - RNA, 21 nt, Human
cugcccuaugggccugccggg

SEQ ID NO: 1777464 - RNA, 15 nt, Human
cugcccuggcuccag

SEQ ID NO: 1777465 - RNA, 15 nt, Human
cugccucugacacac

SEQ ID NO: 1777466 - RNA, 22 nt, Human
cugccucugacacacagcucug

SEQ ID NO: 1777467 - RNA, 23 nt, Human
cugccucugacacacagcucugu

SEQ ID NO: 1777468 - RNA, 11 nt, Human
cugccucccaa

SEQ ID NO: 1777469 - RNA, 21 nt, Human
cugccucccaacaguggggaa

SEQ ID NO: 1777470 - RNA, 20 nt, Human
cugccugcccaggccccugc

SEQ ID NO: 1777471 - RNA, 15 nt, Human
cugccugaagucaca

SEQ ID NO: 1777472 - RNA, 22 nt, Human
cugccucuucugggagggcagc

SEQ ID NO: 1777473 - RNA, 16 nt, Human
cugccugcccaggccc

SEQ ID NO: 1777474 - RNA, 17 nt, Human
cugccugcccaggcccc

SEQ ID NO: 1777475 - RNA, 16 nt, Human
cugccucuucugggag

SEQ ID NO: 1777476 - RNA, 17 nt, Human
cugccucuucugggagg

SEQ ID NO: 1777477 - RNA, 18 nt, Human
gagaucacgccacugcac

SEQ ID NO: 1777478 - RNA, 19 nt, Human
gagaucacgccacugcacu

SEQ ID NO: 1777479 - RNA, 23 nt, Human
gagaucaaccccuucgcuccugu

SEQ ID NO: 1777480 - RNA, 21 nt, Human
gagcacuaaggugugcucuga

SEQ ID NO: 1777481 - RNA, 15 nt, Human
gagcacuaaggugug

SEQ ID NO: 1777482 - RNA, 19 nt, Human
gagccaauuuaaagaaaac

SEQ ID NO: 1777483 - RNA, 22 nt, Human
gagcaggaccucugaaacccug

SEQ ID NO: 1777484 - RNA, 14 nt, Human
gagccagggucuca

SEQ ID NO: 1777485 - RNA, 14 nt, Human
gagccacaguggga

SEQ ID NO: 1777486 - RNA, 17 nt, Human
gagccaguuugccggau

SEQ ID NO: 1777487 - RNA, 19 nt, Human
gagccagggucucacuaug

SEQ ID NO: 1777488 - RNA, 12 nt, Human
gagcccagcucu

SEQ ID NO: 1777489 - RNA, 14 nt, Human
gagcccagcucuga

SEQ ID NO: 1777490 - RNA, 21 nt, Human
gagcccagcucugaaaccagu

SEQ ID NO: 1777491 - RNA, 13 nt, Human
gagacucugucuc

SEQ ID NO: 1777492 - RNA, 15 nt, Human
gagacugggcugagg

SEQ ID NO: 1777493 - RNA, 17 nt, Human
gagacugggcugaggga

SEQ ID NO: 1777494 - RNA, 20 nt, Human
gagacugggcugagggagcc

SEQ ID NO: 1777495 - RNA, 21 nt, Human
gagacugggcugagggagccu

SEQ ID NO: 1777496 - RNA, 13 nt, Human
gagacugggcuga

SEQ ID NO: 1777497 - RNA, 14 nt, Human
gagacugggcugag

SEQ ID NO: 1777498 - RNA, 22 nt, Human
gagacaggguuuugccauguug

SEQ ID NO: 1777499 - RNA, 12 nt, Human
gagacaggcaga

SEQ ID NO: 1777500 - RNA, 14 nt, Human
gagacaggcagagc

SEQ ID NO: 1777501 - RNA, 16 nt, Human
gagacaggcagagcug

SEQ ID NO: 1777502 - RNA, 19 nt, Human
gagacaggcagagcugcuc

SEQ ID NO: 1777503 - RNA, 14 nt, Human
gagaaugagaaaug

SEQ ID NO: 1777504 - RNA, 17 nt, Human
gagagccguggucccug

SEQ ID NO: 1777505 - RNA, 19 nt, Human
gagagccguggucccugag

SEQ ID NO: 1777506 - RNA, 20 nt, Human
gagagccguggucccugagg

SEQ ID NO: 1777507 - RNA, 21 nt, Human
gagagccguggucccugagga

SEQ ID NO: 1777508 - RNA, 19 nt, Human
gagaggggaacagacugga

SEQ ID NO: 1777509 - RNA, 19 nt, Human
gagagggggccugggacuu

SEQ ID NO: 1777510 - RNA, 23 nt, Human
gagagggggccugggacuuccau

SEQ ID NO: 1777511 - RNA, 13 nt, Human
gagagucuggccc

SEQ ID NO: 1777512 - RNA, 14 nt, Human
gagagucuggcccu

SEQ ID NO: 1777513 - RNA, 20 nt, Human
gagagucagcucucugcccu

SEQ ID NO: 1777514 - RNA, 21 nt, Human
gagagucagcucucugcccug

SEQ ID NO: 1777515 - RNA, 23 nt, Human
gagagucagcucucugcccugug

SEQ ID NO: 1777516 - RNA, 15 nt, Human
gagagucuggcccua

SEQ ID NO: 1777517 - RNA, 18 nt, Human
gagagucuggcccuagac

SEQ ID NO: 1777518 - RNA, 15 nt, Human
gagauaccagcgagg

SEQ ID NO: 1777519 - RNA, 14 nt, Human
gacucauucuucug

SEQ ID NO: 1777520 - RNA, 15 nt, Human
gacucauucuucugu

SEQ ID NO: 1777521 - RNA, 19 nt, Human
gacucagaagccucugggu

SEQ ID NO: 1777522 - RNA, 18 nt, Human
gacuacaggugugaguca

SEQ ID NO: 1777523 - RNA, 21 nt, Human
gacuacaggugugagucacca

SEQ ID NO: 1777524 - RNA, 18 nt, Human
gacuacagucaggaaagg

SEQ ID NO: 1777525 - RNA, 13 nt, Human
gacuacaggugug

SEQ ID NO: 1777526 - RNA, 15 nt, Human
gacuccggcugugcu

SEQ ID NO: 1777527 - RNA, 16 nt, Human
gacuccggcugugcug

SEQ ID NO: 1777528 - RNA, 17 nt, Human
gacuccggcugugcugg

SEQ ID NO: 1777529 - RNA, 18 nt, Human
gacuccggcugugcuggg

SEQ ID NO: 1777530 - RNA, 21 nt, Human
gacuccggcugugcugggaga

SEQ ID NO: 1777531 - RNA, 14 nt, Human
gacuggaagcacag

SEQ ID NO: 1777532 - RNA, 15 nt, Human
gacuggaagcacagc

SEQ ID NO: 1777533 - RNA, 16 nt, Human
gacuggaagcacagcu

SEQ ID NO: 1777534 - RNA, 18 nt, Human
gacuggaagcacagcuuc

SEQ ID NO: 1777535 - RNA, 14 nt, Human
gacugggcugaggg

SEQ ID NO: 1777536 - RNA, 15 nt, Human
gacugggcugaggga

SEQ ID NO: 1777537 - RNA, 16 nt, Human
gacugggcugagggag

SEQ ID NO: 1777538 - RNA, 21 nt, Human
gacugggcugagggagccugg

SEQ ID NO: 1777539 - RNA, 14 nt, Human
gacucucagucucu

SEQ ID NO: 1777540 - RNA, 16 nt, Human
gacucucagucucuga

SEQ ID NO: 1777541 - RNA, 18 nt, Human
gacucucagucucugagc

SEQ ID NO: 1777542 - RNA, 20 nt, Human
gacucucagucucugagcag

SEQ ID NO: 1777543 - RNA, 12 nt, Human
gacucuccaggg

SEQ ID NO: 1777544 - RNA, 24 nt, Human
gacucuccagggguccuaggccuc

SEQ ID NO: 1777545 - RNA, 22 nt, Human
gagaaaguacuucuccacccug

SEQ ID NO: 1777546 - RNA, 16 nt, Human
gagaaagguugaagca

SEQ ID NO: 1777547 - RNA, 16 nt, Human
gacugcccggcacaga

SEQ ID NO: 1777548 - RNA, 13 nt, Human
gacuuggaagcuc

SEQ ID NO: 1777549 - RNA, 16 nt, Human
gacuugcacagggauu

SEQ ID NO: 1777550 - RNA, 17 nt, Human
gacuugcacagggauuc

SEQ ID NO: 1777551 - RNA, 18 nt, Human
gacuugcacagggauucu

SEQ ID NO: 1777552 - RNA, 20 nt, Human
gacagccacggccaggccag

SEQ ID NO: 1777553 - RNA, 21 nt, Human
gacagccacggccaggccaga

SEQ ID NO: 1777554 - RNA, 20 nt, Human
gacagagugagacucugucu

SEQ ID NO: 1777555 - RNA, 22 nt, Human
gacagagugagacucugucuca

SEQ ID NO: 1777556 - RNA, 14 nt, Human
gacagccacggcca

SEQ ID NO: 1777557 - RNA, 17 nt, Human
gacagccacggccaggc

SEQ ID NO: 1777558 - RNA, 18 nt, Human
gacagccacggccaggcc

SEQ ID NO: 1777559 - RNA, 19 nt, Human
gacagccacggccaggcca

SEQ ID NO: 1777560 - RNA, 14 nt, Human
gacagaggcagccc

SEQ ID NO: 1777561 - RNA, 16 nt, Human
gacagaggcagcccca

SEQ ID NO: 1777562 - RNA, 17 nt, Human
gacagaggcagccccau

SEQ ID NO: 1777563 - RNA, 14 nt, Human
gacagagucucacu

SEQ ID NO: 1777564 - RNA, 24 nt, Human
gacagggcacaccgggcacucaga

SEQ ID NO: 1777565 - RNA, 20 nt, Human
gacaguggauugcauuucuu

SEQ ID NO: 1777566 - RNA, 23 nt, Human
gacagggcacaccgggcacucag

SEQ ID NO: 1777567 - RNA, 16 nt, Human
gacagggaggugaccc

SEQ ID NO: 1777568 - RNA, 14 nt, Human
gaccccuccaugug

SEQ ID NO: 1777569 - RNA, 18 nt, Human
gaccccuccaugugggcu

SEQ ID NO: 1777570 - RNA, 21 nt, Human
gaccccuccaugugggcuagu

SEQ ID NO: 1777571 - RNA, 21 nt, Human
gaccagacaccuugacagggc

SEQ ID NO: 1777572 - RNA, 14 nt, Human
gaauguuaaauaaa

SEQ ID NO: 1777573 - RNA, 13 nt, Human
gaauguuaaauaa

SEQ ID NO: 1777574 - RNA, 14 nt, Human
gaauguacucuguu

SEQ ID NO: 1777575 - RNA, 15 nt, Human
gaauguuugccucug

SEQ ID NO: 1777576 - RNA, 18 nt, Human
gaauguuaaauaaauugu

SEQ ID NO: 1777577 - RNA, 16 nt, Human
gaauguuaaauaaauu

SEQ ID NO: 1777578 - RNA, 21 nt, Human
gaauguuaaauaaauuguaua

SEQ ID NO: 1777579 - RNA, 16 nt, Human
gaauguuacugccuua

SEQ ID NO: 1777580 - RNA, 14 nt, Human
gaauguuggauaag

SEQ ID NO: 1777581 - RNA, 20 nt, Human
gaauguuggauaaggaauua

SEQ ID NO: 1777582 - RNA, 18 nt, Human
gaaaggccuuuaaaauuu

SEQ ID NO: 1777583 - RNA, 15 nt, Human
gaaaggccuuuaaaa

SEQ ID NO: 1777584 - RNA, 14 nt, Human
gaaaggccuuuaaa

SEQ ID NO: 1777585 - RNA, 15 nt, Human
gaaucaugagccugc

SEQ ID NO: 1777586 - RNA, 16 nt, Human
gaaucaugagccugcu

SEQ ID NO: 1777587 - RNA, 17 nt, Human
gaaucaugagccugcug

SEQ ID NO: 1777588 - RNA, 18 nt, Human
gaaucaugagccugcugg

SEQ ID NO: 1777589 - RNA, 19 nt, Human
gaaucaugagccugcugga

SEQ ID NO: 1777590 - RNA, 20 nt, Human
gaaucaugagccugcuggaa

SEQ ID NO: 1777591 - RNA, 20 nt, Human
gaauccagacccggcugcgu

SEQ ID NO: 1777592 - RNA, 18 nt, Human
gaaucucuuuuugcuuuc

SEQ ID NO: 1777593 - RNA, 20 nt, Human
gaaugcagucuguccaggcu

SEQ ID NO: 1777594 - RNA, 22 nt, Human
gaaugcagucuguccaggcucg

SEQ ID NO: 1777595 - RNA, 17 nt, Human
gaauuugagugcucuga

SEQ ID NO: 1777596 - RNA, 11 nt, Human
gaauuugcaaa

SEQ ID NO: 1777597 - RNA, 13 nt, Human
gaauuugcaaagu

SEQ ID NO: 1777598 - RNA, 14 nt, Human
gaauuugcaaagua

SEQ ID NO: 1777599 - RNA, 15 nt, Human
gaauuugcaaaguac

SEQ ID NO: 1777600 - RNA, 17 nt, Human
gaauuugcaaaguacug

SEQ ID NO: 1777601 - RNA, 18 nt, Human
gaauuugcaaaguacugu

SEQ ID NO: 1777602 - RNA, 19 nt, Human
gaauuucugugcccuccug

SEQ ID NO: 1777603 - RNA, 16 nt, Human
gaauuguaacuguucu

SEQ ID NO: 1777604 - RNA, 12 nt, Human
gacaaccaugac

SEQ ID NO: 1777605 - RNA, 20 nt, Human
gacacaggcccggcuccagg

SEQ ID NO: 1777606 - RNA, 21 nt, Human
gacacaggcccggcuccaggc

SEQ ID NO: 1777607 - RNA, 19 nt, Human
gacacaggcccggcuccag

SEQ ID NO: 1777608 - RNA, 18 nt, Human
gacaaggauugcuacugu

SEQ ID NO: 1777609 - RNA, 19 nt, Human
gacaaggauugcuacuguc

SEQ ID NO: 1777610 - RNA, 21 nt, Human
gacaaggauugcuacuguccu

SEQ ID NO: 1777611 - RNA, 16 nt, Human
gacaaggaaaaaauaa

SEQ ID NO: 1777612 - RNA, 18 nt, Human
gauuuugauagcaaagcg

SEQ ID NO: 1777613 - RNA, 19 nt, Human
gauuuugauccaagcuggu

SEQ ID NO: 1777614 - RNA, 14 nt, Human
gauuuuaacucugu

SEQ ID NO: 1777615 - RNA, 16 nt, Human
gauuuuaacucugucu

SEQ ID NO: 1777616 - RNA, 14 nt, Human
gcaaagcgacguua

SEQ ID NO: 1777617 - RNA, 14 nt, Human
gauucuccugccuc

SEQ ID NO: 1777618 - RNA, 16 nt, Human
gauugagucugugcca

SEQ ID NO: 1777619 - RNA, 15 nt, Human
gauugcaacaggcug

SEQ ID NO: 1777620 - RNA, 17 nt, Human
gauugcaugugacucug

SEQ ID NO: 1777621 - RNA, 15 nt, Human
gaugguaagaaacaa

SEQ ID NO: 1777622 - RNA, 15 nt, Human
gaugggucagagcua

SEQ ID NO: 1777623 - RNA, 20 nt, Human
gaugggucagguagggggga

SEQ ID NO: 1777624 - RNA, 16 nt, Human
gaugggugaaggcugg

SEQ ID NO: 1777625 - RNA, 21 nt, Human
gaugggugaaggcuggcauga

SEQ ID NO: 1777626 - RNA, 19 nt, Human
gaugggaugguggagggcc

SEQ ID NO: 1777627 - RNA, 20 nt, Human
gaugggaugguggagggcca

SEQ ID NO: 1777628 - RNA, 20 nt, Human
gaugggcaacccccagccug

SEQ ID NO: 1777629 - RNA, 21 nt, Human
gaugggcaacccccagccugc

SEQ ID NO: 1777630 - RNA, 16 nt, Human
gaucagagccgugguc

SEQ ID NO: 1777631 - RNA, 23 nt, Human
gaucagagccgugguccuuuggg

SEQ ID NO: 1777632 - RNA, 13 nt, Human
gaugcuccuuggg

SEQ ID NO: 1777633 - RNA, 14 nt, Human
gaugcuccuugggc

SEQ ID NO: 1777634 - RNA, 16 nt, Human
gaugcuccuugggccc

SEQ ID NO: 1777635 - RNA, 21 nt, Human
gaugcuccuugggcccuuuga

SEQ ID NO: 1777636 - RNA, 20 nt, Human
gauguuauguaaaaggccaa

SEQ ID NO: 1777637 - RNA, 23 nt, Human
gauuacaagcgugagccacugca

SEQ ID NO: 1777638 - RNA, 14 nt, Human
gauuaaaaauuaua

SEQ ID NO: 1777639 - RNA, 22 nt, Human
gauuacaagcgugagccacugc

SEQ ID NO: 1777640 - RNA, 17 nt, Human
gaugguguggguguccu

SEQ ID NO: 1777641 - RNA, 18 nt, Human
gaugguguggguguccug

SEQ ID NO: 1777642 - RNA, 22 nt, Human
gcacacuuugccauauuuucac

SEQ ID NO: 1777643 - RNA, 13 nt, Human
gcacacuuugcca

SEQ ID NO: 1777644 - RNA, 14 nt, Human
gcacacuuugccau

SEQ ID NO: 1777645 - RNA, 17 nt, Human
gcacagaagcacaugca

SEQ ID NO: 1777646 - RNA, 15 nt, Human
gcaauggcagccuug

SEQ ID NO: 1777647 - RNA, 15 nt, Human
gcaauuccgcauuua

SEQ ID NO: 1777648 - RNA, 23 nt, Human
gcacaaagaugggugaaggcugg

SEQ ID NO: 1777649 - RNA, 17 nt, Human
gcaauuccgcauuuaau

SEQ ID NO: 1777650 - RNA, 15 nt, Human
gcaauugaaaugcau

SEQ ID NO: 1777651 - RNA, 16 nt, Human
gcaauuucccccuaaa

SEQ ID NO: 1777652 - RNA, 16 nt, Human
gcaauuuauacaauau

SEQ ID NO: 1777653 - RNA, 19 nt, Human
gcaauuuauacaauaucau

SEQ ID NO: 1777654 - RNA, 16 nt, Human
gcacugcuugaggaaa

SEQ ID NO: 1777655 - RNA, 17 nt, Human
gcacugcuugaggaaaa

SEQ ID NO: 1777656 - RNA, 21 nt, Human
gcacugagauaccagcgagga

SEQ ID NO: 1777657 - RNA, 12 nt, Human
gcagacaggcaa

SEQ ID NO: 1777658 - RNA, 13 nt, Human
gcagacaggcaag

SEQ ID NO: 1777659 - RNA, 14 nt, Human
gcagacaggcaagc

SEQ ID NO: 1777660 - RNA, 15 nt, Human
gcagaaguaagccuc

SEQ ID NO: 1777661 - RNA, 17 nt, Human
gcagaaguaagccucau

SEQ ID NO: 1777662 - RNA, 17 nt, Human
gcacagaugcuccaggg

SEQ ID NO: 1777663 - RNA, 14 nt, Human
gcaccagucccugu

SEQ ID NO: 1777664 - RNA, 23 nt, Human
gcaccaggguugaccccagagga

SEQ ID NO: 1777665 - RNA, 17 nt, Human
gaggcugggggagagcc

SEQ ID NO: 1777666 - RNA, 20 nt, Human
gaggcugggggagagccgug

SEQ ID NO: 1777667 - RNA, 23 nt, Human
gagggagcuccaacucagaaggg

SEQ ID NO: 1777668 - RNA, 21 nt, Human
gagggagugacagaggcagcc

SEQ ID NO: 1777669 - RNA, 22 nt, Human
gagggagugacagaggcagccc

SEQ ID NO: 1777670 - RNA, 21 nt, Human
gagggaggggaagcuucuguc

SEQ ID NO: 1777671 - RNA, 18 nt, Human
gagggagugacagaggca

SEQ ID NO: 1777672 - RNA, 16 nt, Human
gagggccacaugggag

SEQ ID NO: 1777673 - RNA, 16 nt, Human
gagggcagcagggcua

SEQ ID NO: 1777674 - RNA, 19 nt, Human
gagggcagcagggcuaccc

SEQ ID NO: 1777675 - RNA, 12 nt, Human
gagggcagcagg

SEQ ID NO: 1777676 - RNA, 14 nt, Human
gagggcagcagggc

SEQ ID NO: 1777677 - RNA, 15 nt, Human
gagggcagcagggcu

SEQ ID NO: 1777678 - RNA, 21 nt, Human
gaggggucgacuucgggcugg

SEQ ID NO: 1777679 - RNA, 14 nt, Human
gaggguugggcugg

SEQ ID NO: 1777680 - RNA, 15 nt, Human
gaggguugggcuggu

SEQ ID NO: 1777681 - RNA, 12 nt, Human
gaggucagagcc

SEQ ID NO: 1777682 - RNA, 13 nt, Human
gaggucagagccu

SEQ ID NO: 1777683 - RNA, 14 nt, Human
gaggguggugaccu

SEQ ID NO: 1777684 - RNA, 21 nt, Human
gaggguggugaccucugccug

SEQ ID NO: 1777685 - RNA, 22 nt, Human
gagggugucccaaaaagaaagg

SEQ ID NO: 1777686 - RNA, 13 nt, Human
gagggucugagga

SEQ ID NO: 1777687 - RNA, 14 nt, Human
gagggucugaggaa

SEQ ID NO: 1777688 - RNA, 18 nt, Human
gaggcuggccucuacauc

SEQ ID NO: 1777689 - RNA, 16 nt, Human
gaggccuucucugaag

SEQ ID NO: 1777690 - RNA, 12 nt, Human
gaggccucaggu

SEQ ID NO: 1777691 - RNA, 14 nt, Human
gaggccucaggugc

SEQ ID NO: 1777692 - RNA, 15 nt, Human
gaggccucaggugcu

SEQ ID NO: 1777693 - RNA, 16 nt, Human
gaggccucaggugcug

SEQ ID NO: 1777694 - RNA, 20 nt, Human
gaggccucaggugcugucca

SEQ ID NO: 1777695 - RNA, 22 nt, Human
gaggccucaggugcuguccaug

SEQ ID NO: 1777696 - RNA, 18 nt, Human
gaggccuucucugaagga

SEQ ID NO: 1777697 - RNA, 19 nt, Human
gaggccuucucugaaggac

SEQ ID NO: 1777698 - RNA, 9 nt, Human
gaggccuga

SEQ ID NO: 1777699 - RNA, 13 nt, Human
gaggccugaagcc

SEQ ID NO: 1777700 - RNA, 18 nt, Human
gaggccugaagccagcug

SEQ ID NO: 1777701 - RNA, 20 nt, Human
gaggccugaagccagcugcc

SEQ ID NO: 1777702 - RNA, 22 nt, Human
gaggccugaagccagcugcccu

SEQ ID NO: 1777703 - RNA, 23 nt, Human
gaggccugaagccagcugcccua

SEQ ID NO: 1777704 - RNA, 22 nt, Human
gaggaugagcucuacccagggc

SEQ ID NO: 1777705 - RNA, 21 nt, Human
gaggcaauccuaccuugcuuu

SEQ ID NO: 1777706 - RNA, 18 nt, Human
gagcccuguggaugagcc

SEQ ID NO: 1777707 - RNA, 21 nt, Human
gagcccuguggaugagcccuc

SEQ ID NO: 1777708 - RNA, 22 nt, Human
gagcccuguggaugagcccuca

SEQ ID NO: 1777709 - RNA, 18 nt, Human
gagcccuuaucugugcuc

SEQ ID NO: 1777710 - RNA, 19 nt, Human
gagcccuuaucugugcuca

SEQ ID NO: 1777711 - RNA, 14 nt, Human
gaggccaugggccu

SEQ ID NO: 1777712 - RNA, 17 nt, Human
gaggccaugggccuccu

SEQ ID NO: 1777713 - RNA, 16 nt, Human
gaggccagugagccac

SEQ ID NO: 1777714 - RNA, 18 nt, Human
gaggccaugggccuccug

SEQ ID NO: 1777715 - RNA, 20 nt, Human
gaggccaugggccuccugug

SEQ ID NO: 1777716 - RNA, 21 nt, Human
gaggccaugggccuccugugu

SEQ ID NO: 1777717 - RNA, 23 nt, Human
gaggccaugggccuccugugugu

SEQ ID NO: 1777718 - RNA, 21 nt, Human
gaggcagccccauucugccug

SEQ ID NO: 1777719 - RNA, 20 nt, Human
gaggcagccccauucugccu

SEQ ID NO: 1777720 - RNA, 9 nt, Human
gaggcaggg

SEQ ID NO: 1777721 - RNA, 19 nt, Human
gaggcagccccauucugcc

SEQ ID NO: 1777722 - RNA, 18 nt, Human
gagucuggcccuagacuc

SEQ ID NO: 1777723 - RNA, 21 nt, Human
gagugaacuggucuuccuuuu

SEQ ID NO: 1777724 - RNA, 12 nt, Human
gagugaaauacu

SEQ ID NO: 1777725 - RNA, 14 nt, Human
gagugacagaggca

SEQ ID NO: 1777726 - RNA, 15 nt, Human
gagugacagaggcag

SEQ ID NO: 1777727 - RNA, 16 nt, Human
gagugacagaggcagc

SEQ ID NO: 1777728 - RNA, 21 nt, Human
gaguaguugauguugcauuuu

SEQ ID NO: 1777729 - RNA, 20 nt, Human
gaguaguugauguugcauuu

SEQ ID NO: 1777730 - RNA, 12 nt, Human
gaguauaugcac

SEQ ID NO: 1777731 - RNA, 14 nt, Human
gaguauaugcacuu

SEQ ID NO: 1777732 - RNA, 15 nt, Human
gagucgaggacaggg

SEQ ID NO: 1777733 - RNA, 16 nt, Human
gagucgaggacaggga

SEQ ID NO: 1777734 - RNA, 19 nt, Human
gaguccgaaagggacuugg

SEQ ID NO: 1777735 - RNA, 17 nt, Human
gaguccuagagcuacag

SEQ ID NO: 1777736 - RNA, 14 nt, Human
gagucgaggacagg

SEQ ID NO: 1777737 - RNA, 19 nt, Human
gaguagaaacugcagggaa

SEQ ID NO: 1777738 - RNA, 13 nt, Human
gaguacugugggc

SEQ ID NO: 1777739 - RNA, 14 nt, Human
gaguacugugggca

SEQ ID NO: 1777740 - RNA, 15 nt, Human
gaguacugugggcaa

SEQ ID NO: 1777741 - RNA, 17 nt, Human
gaguacugugggcaauu

SEQ ID NO: 1777742 - RNA, 18 nt, Human
gaguacugugggcaauuu

SEQ ID NO: 1777743 - RNA, 22 nt, Human
gaguacugugggcaauuuagaa

SEQ ID NO: 1777744 - RNA, 23 nt, Human
gaguacugugggcaauuuagaaa

SEQ ID NO: 1777745 - RNA, 19 nt, Human
gaguagcugggacuacagg

SEQ ID NO: 1777746 - RNA, 12 nt, Human
gaguagagaagu

SEQ ID NO: 1777747 - RNA, 15 nt, Human
gaguagaaaggccuu

SEQ ID NO: 1777748 - RNA, 23 nt, Human
gaguagaaaggccuuuaaaauuu

SEQ ID NO: 1777749 - RNA, 17 nt, Human
gaguagaaaggccuuua

SEQ ID NO: 1777750 - RNA, 22 nt, Human
gaguagcugggacuacaggcac

SEQ ID NO: 1777751 - RNA, 17 nt, Human
gaggucagagccugcag

SEQ ID NO: 1777752 - RNA, 20 nt, Human
gaggucagagccugcaguua

SEQ ID NO: 1777753 - RNA, 17 nt, Human
gaggucagcauuugauc

SEQ ID NO: 1777754 - RNA, 22 nt, Human
gauauaagugcuguauaaaauc

SEQ ID NO: 1777755 - RNA, 21 nt, Human
gauauaagugcuguauaaaau

SEQ ID NO: 1777756 - RNA, 19 nt, Human
gauauaagugcuguauaaa

SEQ ID NO: 1777757 - RNA, 18 nt, Human
gauauaagugcuguauaa

SEQ ID NO: 1777758 - RNA, 23 nt, Human
gauauaagugcuguauaaaauca

SEQ ID NO: 1777759 - RNA, 18 nt, Human
gaucacaacgugcauugu

SEQ ID NO: 1777760 - RNA, 17 nt, Human
gaucacaacgugcauug

SEQ ID NO: 1777761 - RNA, 16 nt, Human
gaucacaacgugcauu

SEQ ID NO: 1777762 - RNA, 15 nt, Human
gaucacaacgugcau

SEQ ID NO: 1777763 - RNA, 13 nt, Human
gaucacaaaaaca

SEQ ID NO: 1777764 - RNA, 18 nt, Human
gaucacggcucacugcag

SEQ ID NO: 1777765 - RNA, 15 nt, Human
gaucagaaauacaga

SEQ ID NO: 1777766 - RNA, 14 nt, Human
gaucagaaauacag

SEQ ID NO: 1777767 - RNA, 15 nt, Human
gaucacggcucacug

SEQ ID NO: 1777768 - RNA, 16 nt, Human
gaucacggcucacugc

SEQ ID NO: 1777769 - RNA, 23 nt, Human
gaucacaacgugcauugugcuuc

SEQ ID NO: 1777770 - RNA, 22 nt, Human
gaucacaacgugcauugugcuu

SEQ ID NO: 1777771 - RNA, 21 nt, Human
gaucacaacgugcauugugcu

SEQ ID NO: 1777772 - RNA, 20 nt, Human
gaucacaacgugcauugugc

SEQ ID NO: 1777773 - RNA, 23 nt, Human
gauagcaaagcgacguuagucgu

SEQ ID NO: 1777774 - RNA, 16 nt, Human
gauauaagugcuguau

SEQ ID NO: 1777775 - RNA, 14 nt, Human
gauauaagugcugu

SEQ ID NO: 1777776 - RNA, 17 nt, Human
gauagcgggaaaaggag

SEQ ID NO: 1777777 - RNA, 21 nt, Human
gauacaggaaaagcugcugac

SEQ ID NO: 1777778 - RNA, 23 nt, Human
gauacaggaaaagcugcugacag

SEQ ID NO: 1777779 - RNA, 20 nt, Human
gauacaggaaaagcugcuga

SEQ ID NO: 1777780 - RNA, 17 nt, Human
gagugacagaggcagcc

SEQ ID NO: 1777781 - RNA, 18 nt, Human
gaguguuucuaauaaacu

SEQ ID NO: 1777782 - RNA, 22 nt, Human
gaguguuucuaauaaacuugga

SEQ ID NO: 1777783 - RNA, 22 nt, Human
gaguuaaauagaguauaugcac

SEQ ID NO: 1777784 - RNA, 13 nt, Human
gaguuaagguggg

SEQ ID NO: 1777785 - RNA, 20 nt, Human
gaguucauacccuguuacca

SEQ ID NO: 1777786 - RNA, 20 nt, Human
gauaaaucagucaagcuguu

SEQ ID NO: 1777787 - RNA, 17 nt, Human
ggccugggacuuccaug

SEQ ID NO: 1777788 - RNA, 23 nt, Human
ggccucuuugucuaaaacaauaa

SEQ ID NO: 1777789 - RNA, 16 nt, Human
ggccugaaaggagccc

SEQ ID NO: 1777790 - RNA, 22 nt, Human
ggccugaaaggagcccuuaucu

SEQ ID NO: 1777791 - RNA, 15 nt, Human
ggccugaagccagcu

SEQ ID NO: 1777792 - RNA, 16 nt, Human
ggccugaagccagcug

SEQ ID NO: 1777793 - RNA, 17 nt, Human
ggccugaagccagcugc

SEQ ID NO: 1777794 - RNA, 18 nt, Human
ggccugaagccagcugcc

SEQ ID NO: 1777795 - RNA, 19 nt, Human
ggccugaagccagcugccc

SEQ ID NO: 1777796 - RNA, 20 nt, Human
ggccugaagccagcugcccu

SEQ ID NO: 1777797 - RNA, 17 nt, Human
ggccugaaucaugagcc

SEQ ID NO: 1777798 - RNA, 19 nt, Human
ggccugaaucaugagccug

SEQ ID NO: 1777799 - RNA, 21 nt, Human
ggccugaaucaugagccugcu

SEQ ID NO: 1777800 - RNA, 22 nt, Human
ggccugaaucaugagccugcug

SEQ ID NO: 1777801 - RNA, 23 nt, Human
ggccugaaucaugagccugcugg

SEQ ID NO: 1777802 - RNA, 22 nt, Human
ggcuaggaccccuccauguggg

SEQ ID NO: 1777803 - RNA, 16 nt, Human
ggcuaggaccccucca

SEQ ID NO: 1777804 - RNA, 16 nt, Human
ggcuaguugggcuucc

SEQ ID NO: 1777805 - RNA, 15 nt, Human
ggcuaguugggcuuc

SEQ ID NO: 1777806 - RNA, 15 nt, Human
ggcuccagccaucuc

SEQ ID NO: 1777807 - RNA, 18 nt, Human
ggcuccagccaucucaug

SEQ ID NO: 1777808 - RNA, 15 nt, Human
ggcucaaguccucuu

SEQ ID NO: 1777809 - RNA, 21 nt, Human
ggcucaaguccucuuuucuga

SEQ ID NO: 1777810 - RNA, 11 nt, Human
ggcuccaggcu

SEQ ID NO: 1777811 - RNA, 16 nt, Human
ggcuccaggcuccuuu

SEQ ID NO: 1777812 - RNA, 16 nt, Human
ggccguaucuccggcu

SEQ ID NO: 1777813 - RNA, 18 nt, Human
ggccguaucuccggcucc

SEQ ID NO: 1777814 - RNA, 19 nt, Human
ggccguaucuccggcuccc

SEQ ID NO: 1777815 - RNA, 20 nt, Human
ggccguaucuccggcuccca

SEQ ID NO: 1777816 - RNA, 21 nt, Human
ggccguaucuccggcucccag

SEQ ID NO: 1777817 - RNA, 22 nt, Human
ggccguaucuccggcucccagc

SEQ ID NO: 1777818 - RNA, 19 nt, Human
ggcccugcaaaaggacucu

SEQ ID NO: 1777819 - RNA, 22 nt, Human
ggcccugcaaaaggacucucag

SEQ ID NO: 1777820 - RNA, 20 nt, Human
ggcccugcugagucaucugu

SEQ ID NO: 1777821 - RNA, 11 nt, Human
ggcccagagag

SEQ ID NO: 1777822 - RNA, 12 nt, Human
ggcccagagagg

SEQ ID NO: 1777823 - RNA, 14 nt, Human
ggcccucucugcuc

SEQ ID NO: 1777824 - RNA, 15 nt, Human
ggcccucucugcucu

SEQ ID NO: 1777825 - RNA, 21 nt, Human
ggcccucucugcucugcgugu

SEQ ID NO: 1777826 - RNA, 12 nt, Human
ggcccucucuuc

SEQ ID NO: 1777827 - RNA, 18 nt, Human
ggcccucucuucucaccu

SEQ ID NO: 1777828 - RNA, 20 nt, Human
ggcccucucuucucaccuuu

SEQ ID NO: 1777829 - RNA, 19 nt, Human
ggcagggucucacucuguc

SEQ ID NO: 1777830 - RNA, 20 nt, Human
ggcagggucucacucugucg

SEQ ID NO: 1777831 - RNA, 13 nt, Human
ggcagugggagcu

SEQ ID NO: 1777832 - RNA, 14 nt, Human
ggcagugggagcug

SEQ ID NO: 1777833 - RNA, 16 nt, Human
ggcagugggagcugcc

SEQ ID NO: 1777834 - RNA, 22 nt, Human
ggcagcugcuuuugucuauggg

SEQ ID NO: 1777835 - RNA, 17 nt, Human
ggcagcuugaggguugg

SEQ ID NO: 1777836 - RNA, 16 nt, Human
ggccaugggccuccug

SEQ ID NO: 1777837 - RNA, 17 nt, Human
ggccauugugaaccaau

SEQ ID NO: 1777838 - RNA, 18 nt, Human
ggccacaugggaggcuca

SEQ ID NO: 1777839 - RNA, 19 nt, Human
ggccacaugggaggcucac

SEQ ID NO: 1777840 - RNA, 12 nt, Human
ggagugcaguga

SEQ ID NO: 1777841 - RNA, 14 nt, Human
ggagugcagugagc

SEQ ID NO: 1777842 - RNA, 19 nt, Human
ggauagagaauguuccaga

SEQ ID NO: 1777843 - RNA, 13 nt, Human
ggaucccucaucu

SEQ ID NO: 1777844 - RNA, 18 nt, Human
ggaucccucaucuguccc

SEQ ID NO: 1777845 - RNA, 22 nt, Human
ggaucccucaucugucccuccg

SEQ ID NO: 1777846 - RNA, 22 nt, Human
ggaugcagugcucgcuguugcu

SEQ ID NO: 1777847 - RNA, 14 nt, Human
ggaugcagugcucg

SEQ ID NO: 1777848 - RNA, 14 nt, Human
ggaugcgcagugcc

SEQ ID NO: 1777849 - RNA, 16 nt, Human
ggaugcgcagugccuu

SEQ ID NO: 1777850 - RNA, 19 nt, Human
ggauuacaagcgugagcca

SEQ ID NO: 1777851 - RNA, 18 nt, Human
ggcaacccccagccugcu

SEQ ID NO: 1777852 - RNA, 14 nt, Human
ggcaaugcuggcug

SEQ ID NO: 1777853 - RNA, 15 nt, Human
ggcaaugcuggcugu

SEQ ID NO: 1777854 - RNA, 23 nt, Human
ggcaaugcuggcuguuggcuggg

SEQ ID NO: 1777855 - RNA, 22 nt, Human
ggcacccggccccugcugguuc

SEQ ID NO: 1777856 - RNA, 23 nt, Human
ggcacccaccaucaugucuggcu

SEQ ID NO: 1777857 - RNA, 17 nt, Human
ggauugcuacuguccua

SEQ ID NO: 1777858 - RNA, 16 nt, Human
ggcaacccccagccug

SEQ ID NO: 1777859 - RNA, 17 nt, Human
ggcaacccccagccugc

SEQ ID NO: 1777860 - RNA, 19 nt, Human
ggauggaagguuggaugga

SEQ ID NO: 1777861 - RNA, 18 nt, Human
ggauuacuucucuauaaa

SEQ ID NO: 1777862 - RNA, 23 nt, Human
ggauuacaagcgugagccacugc

SEQ ID NO: 1777863 - RNA, 16 nt, Human
gcuucaguggcagcug

SEQ ID NO: 1777864 - RNA, 17 nt, Human
gcuucaguggcagcugc

SEQ ID NO: 1777865 - RNA, 18 nt, Human
gcuucaguggcagcugcu

SEQ ID NO: 1777866 - RNA, 13 nt, Human
gcuucauuuccug

SEQ ID NO: 1777867 - RNA, 16 nt, Human
gcuucauuuccugugu

SEQ ID NO: 1777868 - RNA, 20 nt, Human
gcuucuccaaaaaucugccu

SEQ ID NO: 1777869 - RNA, 22 nt, Human
gcuucuccaaaaaucugccugg

SEQ ID NO: 1777870 - RNA, 23 nt, Human
gcuucuccaaaaaucugccuggg

SEQ ID NO: 1777871 - RNA, 17 nt, Human
gcuucauuuccuguguc

SEQ ID NO: 1777872 - RNA, 18 nt, Human
gcuucauuuccugugucu

SEQ ID NO: 1777873 - RNA, 17 nt, Human
gcuucauucuuugcagg

SEQ ID NO: 1777874 - RNA, 16 nt, Human
gcuugaggguugggcu

SEQ ID NO: 1777875 - RNA, 13 nt, Human
gcuguugcugaau

SEQ ID NO: 1777876 - RNA, 12 nt, Human
gcuguugcugaa

SEQ ID NO: 1777877 - RNA, 16 nt, Human
gcuguugaagucucag

SEQ ID NO: 1777878 - RNA, 23 nt, Human
gcuguggugugucccccucuguc

SEQ ID NO: 1777879 - RNA, 15 nt, Human
gcugucggcgcugcc

SEQ ID NO: 1777880 - RNA, 18 nt, Human
gcugucggcgcugcccca

SEQ ID NO: 1777881 - RNA, 14 nt, Human
ggaaccaggcuugg

SEQ ID NO: 1777882 - RNA, 12 nt, Human
ggaaagggagga

SEQ ID NO: 1777883 - RNA, 12 nt, Human
ggaaaauuauuu

SEQ ID NO: 1777884 - RNA, 14 nt, Human
ggaaaaugcauugu

SEQ ID NO: 1777885 - RNA, 16 nt, Human
ggaaaaugcauuguau

SEQ ID NO: 1777886 - RNA, 14 nt, Human
ggaaaagcugcuga

SEQ ID NO: 1777887 - RNA, 18 nt, Human
ggaaaagcugcugacagu

SEQ ID NO: 1777888 - RNA, 20 nt, Human
ggaaaagcugcugacagugu

SEQ ID NO: 1777889 - RNA, 23 nt, Human
gcuuuucagauuguggaauguug

SEQ ID NO: 1777890 - RNA, 14 nt, Human
gcuuuguuuugcac

SEQ ID NO: 1777891 - RNA, 23 nt, Human
gcuuuguuuugcacacuuugcca

SEQ ID NO: 1777892 - RNA, 22 nt, Human
gcuugaggguugggcugguguc

SEQ ID NO: 1777893 - RNA, 20 nt, Human
gcuuuagaaagguuuugagc

SEQ ID NO: 1777894 - RNA, 18 nt, Human
gcuugaggguugggcugg

SEQ ID NO: 1777895 - RNA, 20 nt, Human
gcuugaggguugggcuggug

SEQ ID NO: 1777896 - RNA, 21 nt, Human
gcuuucaauuccguagccagc

SEQ ID NO: 1777897 - RNA, 16 nt, Human
gcuuucaauuccguag

SEQ ID NO: 1777898 - RNA, 20 nt, Human
ggacgccugggggugccagg

SEQ ID NO: 1777899 - RNA, 11 nt, Human
ggagaggagac

SEQ ID NO: 1777900 - RNA, 14 nt, Human
ggacgccugggggu

SEQ ID NO: 1777901 - RNA, 19 nt, Human
ggacgccugggggugccag

SEQ ID NO: 1777902 - RNA, 15 nt, Human
ggaccuugaacuggg

SEQ ID NO: 1777903 - RNA, 17 nt, Human
ggaccuugaacugggua

SEQ ID NO: 1777904 - RNA, 17 nt, Human
ggaccuucgggcugugc

SEQ ID NO: 1777905 - RNA, 18 nt, Human
ggaccuucgggcugugcc

SEQ ID NO: 1777906 - RNA, 19 nt, Human
ggaccuucgggcugugccc

SEQ ID NO: 1777907 - RNA, 20 nt, Human
ggaccuucgggcugugcccg

SEQ ID NO: 1777908 - RNA, 15 nt, Human
ggacagccacggcca

SEQ ID NO: 1777909 - RNA, 19 nt, Human
ggacagccacggccaggcc

SEQ ID NO: 1777910 - RNA, 20 nt, Human
ggacagccacggccaggcca

SEQ ID NO: 1777911 - RNA, 21 nt, Human
ggacagccacggccaggccag

SEQ ID NO: 1777912 - RNA, 22 nt, Human
ggacagccacggccaggccaga

SEQ ID NO: 1777913 - RNA, 20 nt, Human
ggacauugcggacagccacg

SEQ ID NO: 1777914 - RNA, 14 nt, Human
ggacauuucucuaa

SEQ ID NO: 1777915 - RNA, 16 nt, Human
ggaccaacccugggga

SEQ ID NO: 1777916 - RNA, 17 nt, Human
ggaccaacccuggggaa

SEQ ID NO: 1777917 - RNA, 20 nt, Human
ggaccaacccuggggaagga

SEQ ID NO: 1777918 - RNA, 12 nt, Human
ggaaugcagugg

SEQ ID NO: 1777919 - RNA, 19 nt, Human
ggaauguuugccucugccu

SEQ ID NO: 1777920 - RNA, 15 nt, Human
ggaauguuggauaag

SEQ ID NO: 1777921 - RNA, 20 nt, Human
ggaauguuggauaaggaauu

SEQ ID NO: 1777922 - RNA, 19 nt, Human
ggaauuacauguaaaacau

SEQ ID NO: 1777923 - RNA, 22 nt, Human
ggacaaagaauuccaaagcaaa

SEQ ID NO: 1777924 - RNA, 21 nt, Human
ggaaccuccccagccugcgcc

SEQ ID NO: 1777925 - RNA, 16 nt, Human
ggaaccuccccagccu

SEQ ID NO: 1777926 - RNA, 17 nt, Human
ggaaccuccccagccug

SEQ ID NO: 1777927 - RNA, 18 nt, Human
ggaaccuccccagccugc

SEQ ID NO: 1777928 - RNA, 19 nt, Human
ggaaccuccccagccugcg

SEQ ID NO: 1777929 - RNA, 16 nt, Human
ggaaccucgaguacug

SEQ ID NO: 1777930 - RNA, 17 nt, Human
ggaaccucgaguacugu

SEQ ID NO: 1777931 - RNA, 18 nt, Human
ggaaccucgaguacugug

SEQ ID NO: 1777932 - RNA, 19 nt, Human
ggaaccucgaguacugugg

SEQ ID NO: 1777933 - RNA, 22 nt, Human
ggaaccucgaguacugugggca

SEQ ID NO: 1777934 - RNA, 13 nt, Human
ggaagucaaagca

SEQ ID NO: 1777935 - RNA, 16 nt, Human
ggaaguaggaaguaaa

SEQ ID NO: 1777936 - RNA, 15 nt, Human
ggaaggggccagagg

SEQ ID NO: 1777937 - RNA, 17 nt, Human
ggaaggggccagaggcu

SEQ ID NO: 1777938 - RNA, 14 nt, Human
gcccugguggcagu

SEQ ID NO: 1777939 - RNA, 17 nt, Human
gcccugguggcaguggg

SEQ ID NO: 1777940 - RNA, 18 nt, Human
gcccugguggcaguggga

SEQ ID NO: 1777941 - RNA, 19 nt, Human
gcccugguggcagugggag

SEQ ID NO: 1777942 - RNA, 20 nt, Human
gcccugguggcagugggagc

SEQ ID NO: 1777943 - RNA, 21 nt, Human
gcccugguggcagugggagcu

SEQ ID NO: 1777944 - RNA, 22 nt, Human
gcccugguggcagugggagcug

SEQ ID NO: 1777945 - RNA, 23 nt, Human
gcccugguggcagugggagcugc

SEQ ID NO: 1777946 - RNA, 16 nt, Human
gccgagaucacgccac

SEQ ID NO: 1777947 - RNA, 18 nt, Human
gcccuuugagugcagucc

SEQ ID NO: 1777948 - RNA, 13 nt, Human
gcccuuugcuguc

SEQ ID NO: 1777949 - RNA, 14 nt, Human
gcccuuugcugucc

SEQ ID NO: 1777950 - RNA, 18 nt, Human
gccgagaucacgccacug

SEQ ID NO: 1777951 - RNA, 19 nt, Human
gccgagaucacgccacugc

SEQ ID NO: 1777952 - RNA, 19 nt, Human
gcccuggcuccagugaaac

SEQ ID NO: 1777953 - RNA, 15 nt, Human
gcagacucuacagag

SEQ ID NO: 1777954 - RNA, 13 nt, Human
gccccugccaccc

SEQ ID NO: 1777955 - RNA, 14 nt, Human
gccccugccacccu

SEQ ID NO: 1777956 - RNA, 15 nt, Human
gccccugccacccug

SEQ ID NO: 1777957 - RNA, 12 nt, Human
gcccggcuccag

SEQ ID NO: 1777958 - RNA, 16 nt, Human
gcccggcuccaggcuc

SEQ ID NO: 1777959 - RNA, 15 nt, Human
gcccgcgccacagga

SEQ ID NO: 1777960 - RNA, 16 nt, Human
gcccgcgccacaggac

SEQ ID NO: 1777961 - RNA, 21 nt, Human
gcccugcaaaaggacucucag

SEQ ID NO: 1777962 - RNA, 14 nt, Human
gcccugcaaaagga

SEQ ID NO: 1777963 - RNA, 18 nt, Human
gcccugcaaaaggacucu

SEQ ID NO: 1777964 - RNA, 17 nt, Human
gcccggcuccaggcucc

SEQ ID NO: 1777965 - RNA, 18 nt, Human
gcccggcuccaggcuccu

SEQ ID NO: 1777966 - RNA, 14 nt, Human
gcccucgcugccag

SEQ ID NO: 1777967 - RNA, 15 nt, Human
gcccucgcugccagc

SEQ ID NO: 1777968 - RNA, 17 nt, Human
gcccucgcugccagcuc

SEQ ID NO: 1777969 - RNA, 19 nt, Human
gcccucuaucauggugaaa

SEQ ID NO: 1777970 - RNA, 19 nt, Human
gcccucucaggccggcagc

SEQ ID NO: 1777971 - RNA, 16 nt, Human
gcccucucugcucugc

SEQ ID NO: 1777972 - RNA, 11 nt, Human
gcccucucuuc

SEQ ID NO: 1777973 - RNA, 16 nt, Human
gcccucuccuuuguuc

SEQ ID NO: 1777974 - RNA, 22 nt, Human
gcccucuccuuuguucccggcu

SEQ ID NO: 1777975 - RNA, 23 nt, Human
gccucuaccugacacucccuugg

SEQ ID NO: 1777976 - RNA, 17 nt, Human
gccucccgaguagcugg

SEQ ID NO: 1777977 - RNA, 23 nt, Human
gccucccgaauagcugggacuac

SEQ ID NO: 1777978 - RNA, 15 nt, Human
gccucccgaguagcu

SEQ ID NO: 1777979 - RNA, 18 nt, Human
gccucggcuuuucucagc

SEQ ID NO: 1777980 - RNA, 19 nt, Human
gccucggcuuuucucagcu

SEQ ID NO: 1777981 - RNA, 20 nt, Human
gccucggcuuuucucagcug

SEQ ID NO: 1777982 - RNA, 21 nt, Human
gccucaucaucagagccuuuc

SEQ ID NO: 1777983 - RNA, 15 nt, Human
gccucagugccacua

SEQ ID NO: 1777984 - RNA, 21 nt, Human
gccucccgaauagcugggacu

SEQ ID NO: 1777985 - RNA, 14 nt, Human
gccuccccugccag

SEQ ID NO: 1777986 - RNA, 15 nt, Human
gccuccccugccagg

SEQ ID NO: 1777987 - RNA, 17 nt, Human
gccuccccugccagggc

SEQ ID NO: 1777988 - RNA, 18 nt, Human
gccuccccugccagggca

SEQ ID NO: 1777989 - RNA, 19 nt, Human
gccuccccucuccuuccug

SEQ ID NO: 1777990 - RNA, 21 nt, Human
gccuccccucuccuuccugug

SEQ ID NO: 1777991 - RNA, 18 nt, Human
gccuccccucuccuuccu

SEQ ID NO: 1777992 - RNA, 18 nt, Human
gccucagcgcggcccucc

SEQ ID NO: 1777993 - RNA, 23 nt, Human
gccucagccucccaaagugcugg

SEQ ID NO: 1777994 - RNA, 12 nt, Human
gccucagugcca

SEQ ID NO: 1777995 - RNA, 14 nt, Human
gccucagugccacu

SEQ ID NO: 1777996 - RNA, 16 nt, Human
gccucagcgcggcccu

SEQ ID NO: 1777997 - RNA, 12 nt, Human
gccucaggugcu

SEQ ID NO: 1777998 - RNA, 15 nt, Human
gccucaggugcuguc

SEQ ID NO: 1777999 - RNA, 17 nt, Human
gccucaggugcugucca

SEQ ID NO: 1778000 - RNA, 20 nt, Human
gccucaggugcuguccaugg

SEQ ID NO: 1778001 - RNA, 14 nt, Human
gccucaaccuccug

SEQ ID NO: 1778002 - RNA, 16 nt, Human
gccucaaccuccuggg

SEQ ID NO: 1778003 - RNA, 17 nt, Human
gccucaaccuccugggc

SEQ ID NO: 1778004 - RNA, 19 nt, Human
gccucaagugauucuccug

SEQ ID NO: 1778005 - RNA, 20 nt, Human
gccucaagugauucuccugc

SEQ ID NO: 1778006 - RNA, 21 nt, Human
gccucaagugauucuccugcc

SEQ ID NO: 1778007 - RNA, 19 nt, Human
gccuguagcccacucugcu

SEQ ID NO: 1778008 - RNA, 22 nt, Human
gccuguagcccacucugcucgc

SEQ ID NO: 1778009 - RNA, 13 nt, Human
gccuguagcccac

SEQ ID NO: 1778010 - RNA, 13 nt, Human
gccuggcagcuca

SEQ ID NO: 1778011 - RNA, 20 nt, Human
gccuggcagcucagcuuccc

SEQ ID NO: 1778012 - RNA, 16 nt, Human
gccuggccagccuaca

SEQ ID NO: 1778013 - RNA, 21 nt, Human
gccuggccagccuacaauggg

SEQ ID NO: 1778014 - RNA, 16 nt, Human
gccuggccagaugcac

SEQ ID NO: 1778015 - RNA, 14 nt, Human
gccuggccagaugc

SEQ ID NO: 1778016 - RNA, 15 nt, Human
gccuggccagaugca

SEQ ID NO: 1778017 - RNA, 22 nt, Human
gccugaagucacacagugaguc

SEQ ID NO: 1778018 - RNA, 17 nt, Human
gccugaaucaugagccu

SEQ ID NO: 1778019 - RNA, 18 nt, Human
gccugaaucaugagccug

SEQ ID NO: 1778020 - RNA, 19 nt, Human
gccugaaucaugagccugc

SEQ ID NO: 1778021 - RNA, 21 nt, Human
gccugaaucaugagccugcug

SEQ ID NO: 1778022 - RNA, 23 nt, Human
gccugaaucaugagccugcugga

SEQ ID NO: 1778023 - RNA, 22 nt, Human
gccugacauuuggaguguuccc

SEQ ID NO: 1778024 - RNA, 23 nt, Human
gccugcugguuuuaucugaguga

SEQ ID NO: 1778025 - RNA, 19 nt, Human
gccugcagaaguaagccuc

SEQ ID NO: 1778026 - RNA, 21 nt, Human
gccugcagaaguaagccucau

SEQ ID NO: 1778027 - RNA, 16 nt, Human
gccugcaaacgcugcc

SEQ ID NO: 1778028 - RNA, 17 nt, Human
gccugcaaacgcugccu

SEQ ID NO: 1778029 - RNA, 18 nt, Human
gccugcaaacgcugccug

SEQ ID NO: 1778030 - RNA, 13 nt, Human
gcugcaugauguu

SEQ ID NO: 1778031 - RNA, 19 nt, Human
gcugcaugauguuugccca

SEQ ID NO: 1778032 - RNA, 15 nt, Human
gcugcaugcccucuc

SEQ ID NO: 1778033 - RNA, 16 nt, Human
gcugcaugcccucuca

SEQ ID NO: 1778034 - RNA, 17 nt, Human
gcugcaugcccucucag

SEQ ID NO: 1778035 - RNA, 18 nt, Human
gcugcaugcccucucagg

SEQ ID NO: 1778036 - RNA, 19 nt, Human
gcugcaugcccucucaggc

SEQ ID NO: 1778037 - RNA, 20 nt, Human
gcugcaugcccucucaggcc

SEQ ID NO: 1778038 - RNA, 21 nt, Human
gcugcaugcccucucaggccg

SEQ ID NO: 1778039 - RNA, 22 nt, Human
gcugcaugcccucucaggccgg

SEQ ID NO: 1778040 - RNA, 18 nt, Human
gcucccuggcuucugugg

SEQ ID NO: 1778041 - RNA, 16 nt, Human
gcucuugugaggaaag

SEQ ID NO: 1778042 - RNA, 20 nt, Human
gcucuugugaggaaagucau

SEQ ID NO: 1778043 - RNA, 19 nt, Human
gcucuugugaggaaaguca

SEQ ID NO: 1778044 - RNA, 17 nt, Human
gcucuugugaggaaagu

SEQ ID NO: 1778045 - RNA, 21 nt, Human
gcucuuuaugaaugaaaaaac

SEQ ID NO: 1778046 - RNA, 21 nt, Human
gcugacagacacaggcccggc

SEQ ID NO: 1778047 - RNA, 14 nt, Human
gcucuucuccaggc

SEQ ID NO: 1778048 - RNA, 16 nt, Human
gcucuucuccaggcug

SEQ ID NO: 1778049 - RNA, 12 nt, Human
gcucuucuccag

SEQ ID NO: 1778050 - RNA, 22 nt, Human
gcucugcgugucaccugugcuu

SEQ ID NO: 1778051 - RNA, 14 nt, Human
gcucuggacaggca

SEQ ID NO: 1778052 - RNA, 15 nt, Human
gcucuggacaggcau

SEQ ID NO: 1778053 - RNA, 16 nt, Human
gcucuggacaggcaug

SEQ ID NO: 1778054 - RNA, 21 nt, Human
gcucuggacaggcauguucuc

SEQ ID NO: 1778055 - RNA, 22 nt, Human
gcucuggacaggcauguucucu

SEQ ID NO: 1778056 - RNA, 19 nt, Human
gcucugcuccucuccccag

SEQ ID NO: 1778057 - RNA, 21 nt, Human
gcucugcuccucuccccagca

SEQ ID NO: 1778058 - RNA, 13 nt, Human
gcucugcugacag

SEQ ID NO: 1778059 - RNA, 14 nt, Human
gcucugcugacaga

SEQ ID NO: 1778060 - RNA, 18 nt, Human
gcucugcugacagacaca

SEQ ID NO: 1778061 - RNA, 19 nt, Human
gcucugcugacagacacag

SEQ ID NO: 1778062 - RNA, 20 nt, Human
gcucugcugacagacacagg

SEQ ID NO: 1778063 - RNA, 23 nt, Human
gcucugcugacagacacaggccc

SEQ ID NO: 1778064 - RNA, 13 nt, Human
gcucugcuccucu

SEQ ID NO: 1778065 - RNA, 14 nt, Human
gcucugcuccucuc

SEQ ID NO: 1778066 - RNA, 17 nt, Human
gcucugcgugucaccug

SEQ ID NO: 1778067 - RNA, 12 nt, Human
gcucucugcccu

SEQ ID NO: 1778068 - RNA, 14 nt, Human
gcucucugcccugu

SEQ ID NO: 1778069 - RNA, 15 nt, Human
gcucucugcccugug

SEQ ID NO: 1778070 - RNA, 18 nt, Human
gcucucugcccuguguac

SEQ ID NO: 1778071 - RNA, 21 nt, Human
gcucccuguaaccucuucaga

SEQ ID NO: 1778072 - RNA, 21 nt, Human
gcuccuucuguccuacucugu

SEQ ID NO: 1778073 - RNA, 11 nt, Human
gcuccuugggc

SEQ ID NO: 1778074 - RNA, 19 nt, Human
gcuccuuuguguguguguc

SEQ ID NO: 1778075 - RNA, 20 nt, Human
gcuccuuuguguguguguca

SEQ ID NO: 1778076 - RNA, 22 nt, Human
gcuccuuugugugugugucagc

SEQ ID NO: 1778077 - RNA, 19 nt, Human
gcucuccgaccagacaccu

SEQ ID NO: 1778078 - RNA, 13 nt, Human
gcucuccgaccag

SEQ ID NO: 1778079 - RNA, 17 nt, Human
gcucuccgaccagacac

SEQ ID NO: 1778080 - RNA, 20 nt, Human
gcucaccagccccagugccc

SEQ ID NO: 1778081 - RNA, 23 nt, Human
gcucaccagccccagugcccaca

SEQ ID NO: 1778082 - RNA, 19 nt, Human
gcucaccagccccagugcc

SEQ ID NO: 1778083 - RNA, 22 nt, Human
gcucacccccuucuccauccac

SEQ ID NO: 1778084 - RNA, 18 nt, Human
gcucacccccuucuccau

SEQ ID NO: 1778085 - RNA, 20 nt, Human
gcucacccccuucuccaucc

SEQ ID NO: 1778086 - RNA, 16 nt, Human
gcucacccccuucucc

SEQ ID NO: 1778087 - RNA, 18 nt, Human
gcucauaacggaucagaa

SEQ ID NO: 1778088 - RNA, 19 nt, Human
gcucaggugucccugcacu

SEQ ID NO: 1778089 - RNA, 15 nt, Human
gcucagcggggacag

SEQ ID NO: 1778090 - RNA, 16 nt, Human
gcucagcggggacagc

SEQ ID NO: 1778091 - RNA, 20 nt, Human
gcucagcggggacagcuccu

SEQ ID NO: 1778092 - RNA, 21 nt, Human
gcucagcggggacagcuccuu

SEQ ID NO: 1778093 - RNA, 22 nt, Human
gcucagcggggacagcuccuuc

SEQ ID NO: 1778094 - RNA, 18 nt, Human
gcucaggugucccugcac

SEQ ID NO: 1778095 - RNA, 20 nt, Human
gcuccauuuuuagugaaaua

SEQ ID NO: 1778096 - RNA, 14 nt, Human
gcucccucccagga

SEQ ID NO: 1778097 - RNA, 15 nt, Human
gcucccucccaggac

SEQ ID NO: 1778098 - RNA, 18 nt, Human
gcucccucccaggacucu

SEQ ID NO: 1778099 - RNA, 19 nt, Human
gcucccucccaggacucug

SEQ ID NO: 1778100 - RNA, 21 nt, Human
gcucccucccaggacucugac

SEQ ID NO: 1778101 - RNA, 16 nt, Human
gcucccugacugggag

SEQ ID NO: 1778102 - RNA, 18 nt, Human
gcucccugacugggaguu

SEQ ID NO: 1778103 - RNA, 13 nt, Human
gcuccaggcuccu

SEQ ID NO: 1778104 - RNA, 16 nt, Human
gcuccaggcuccuuua

SEQ ID NO: 1778105 - RNA, 23 nt, Human
gcuccaggcuccuuuagcgccca

SEQ ID NO: 1778106 - RNA, 24 nt, Human
gcuccaggcuccuuuagcgcccag

SEQ ID NO: 1778107 - RNA, 14 nt, Human
gcuccaucaaugag

SEQ ID NO: 1778108 - RNA, 12 nt, Human
gcggggacagcu

SEQ ID NO: 1778109 - RNA, 13 nt, Human
gcggggacagcuc

SEQ ID NO: 1778110 - RNA, 16 nt, Human
gcgguccacccaggag

SEQ ID NO: 1778111 - RNA, 20 nt, Human
gcgguccacccaggagcccc

SEQ ID NO: 1778112 - RNA, 18 nt, Human
gcgguccacccaggagcc

SEQ ID NO: 1778113 - RNA, 19 nt, Human
gcgguccacccaggagccc

SEQ ID NO: 1778114 - RNA, 18 nt, Human
gcgugagccacugcaccg

SEQ ID NO: 1778115 - RNA, 23 nt, Human
gcgugagccacugcaccgggcca

SEQ ID NO: 1778116 - RNA, 14 nt, Human
gcuagcuagcucaa

SEQ ID NO: 1778117 - RNA, 17 nt, Human
gcuagcuagcucaacua

SEQ ID NO: 1778118 - RNA, 12 nt, Human
gcuagcucaacu

SEQ ID NO: 1778119 - RNA, 12 nt, Human
gcuagccagagg

SEQ ID NO: 1778120 - RNA, 13 nt, Human
gcuagccagagga

SEQ ID NO: 1778121 - RNA, 15 nt, Human
gcuagccagaggacu

SEQ ID NO: 1778122 - RNA, 18 nt, Human
gcuagccagaggacugug

SEQ ID NO: 1778123 - RNA, 12 nt, Human
gcuacgccucuu

SEQ ID NO: 1778124 - RNA, 15 nt, Human
gcuacgccucuucug

SEQ ID NO: 1778125 - RNA, 17 nt, Human
gcuacgccucuucuguc

SEQ ID NO: 1778126 - RNA, 12 nt, Human
gcuacgccugca

SEQ ID NO: 1778127 - RNA, 20 nt, Human
gcuaagccccagcaagcaau

SEQ ID NO: 1778128 - RNA, 18 nt, Human
gcuaagccccagcaagca

SEQ ID NO: 1778129 - RNA, 17 nt, Human
gcuaagccccagcaagc

SEQ ID NO: 1778130 - RNA, 14 nt, Human
guacuucuccaccc

SEQ ID NO: 1778131 - RNA, 15 nt, Human
guacuucuccacccu

SEQ ID NO: 1778132 - RNA, 17 nt, Human
guacgucugacaggcaa

SEQ ID NO: 1778133 - RNA, 14 nt, Human
guacgucugacagg

SEQ ID NO: 1778134 - RNA, 15 nt, Human
guacgucugacaggc

SEQ ID NO: 1778135 - RNA, 17 nt, Human
guaccugcccccaaucc

SEQ ID NO: 1778136 - RNA, 16 nt, Human
guacccacugcucugg

SEQ ID NO: 1778137 - RNA, 18 nt, Human
guacccggggcccagggc

SEQ ID NO: 1778138 - RNA, 17 nt, Human
guacccggggcccaggg

SEQ ID NO: 1778139 - RNA, 16 nt, Human
guacuuguggacacag

SEQ ID NO: 1778140 - RNA, 20 nt, Human
guacuuguggacacagcucu

SEQ ID NO: 1778141 - RNA, 22 nt, Human
guacuugccuuauuagaguguc

SEQ ID NO: 1778142 - RNA, 13 nt, Human
guacuucccgggc

SEQ ID NO: 1778143 - RNA, 20 nt, Human
guacuucccgggccagggcu

SEQ ID NO: 1778144 - RNA, 21 nt, Human
guacuucccgggccagggcug

SEQ ID NO: 1778145 - RNA, 22 nt, Human
guacuucccgggccagggcugc

SEQ ID NO: 1778146 - RNA, 20 nt, Human
guacuucuccacccugcucu

SEQ ID NO: 1778147 - RNA, 21 nt, Human
guacuucuccacccugcucuc

SEQ ID NO: 1778148 - RNA, 16 nt, Human
guacuucuccacccug

SEQ ID NO: 1778149 - RNA, 17 nt, Human
guacuucuccacccugc

SEQ ID NO: 1778150 - RNA, 18 nt, Human
guacuucuccacccugcu

SEQ ID NO: 1778151 - RNA, 19 nt, Human
guacuucuccacccugcuc

SEQ ID NO: 1778152 - RNA, 17 nt, Human
guagaaaggccuuuaaa

SEQ ID NO: 1778153 - RNA, 16 nt, Human
guagaaaggccuuuaa

SEQ ID NO: 1778154 - RNA, 14 nt, Human
guagaaaggccuuu

SEQ ID NO: 1778155 - RNA, 15 nt, Human
guagaaacugcaggg

SEQ ID NO: 1778156 - RNA, 19 nt, Human
guagaaacugcagggaaaa

SEQ ID NO: 1778157 - RNA, 21 nt, Human
guacuuguggacacagcucuu

SEQ ID NO: 1778158 - RNA, 17 nt, Human
guacuugucauauguag

SEQ ID NO: 1778159 - RNA, 19 nt, Human
guacuugucauauguagcc

SEQ ID NO: 1778160 - RNA, 23 nt, Human
guacuuuauuuucuauaauuuaa

SEQ ID NO: 1778161 - RNA, 15 nt, Human
guaauugaacuuauc

SEQ ID NO: 1778162 - RNA, 15 nt, Human
guaauuaguaacaug

SEQ ID NO: 1778163 - RNA, 23 nt, Human
guaauuaguaacauguguuaagu

SEQ ID NO: 1778164 - RNA, 20 nt, Human
guaaugaguuuaaaaaucaa

SEQ ID NO: 1778165 - RNA, 14 nt, Human
guaauggagcauca

SEQ ID NO: 1778166 - RNA, 14 nt, Human
guacagaauauuuc

SEQ ID NO: 1778167 - RNA, 17 nt, Human
guacagaauauuucuau

SEQ ID NO: 1778168 - RNA, 13 nt, Human
guacaggcuggcg

SEQ ID NO: 1778169 - RNA, 15 nt, Human
guacccacugcucug

SEQ ID NO: 1778170 - RNA, 13 nt, Human
guaacuguucuug

SEQ ID NO: 1778171 - RNA, 15 nt, Human
guaagcaucuacuuc

SEQ ID NO: 1778172 - RNA, 18 nt, Human
guaagcaucuacuucagg

SEQ ID NO: 1778173 - RNA, 13 nt, Human
guaagccucauca

SEQ ID NO: 1778174 - RNA, 20 nt, Human
guaaaaggccaaaccucugu

SEQ ID NO: 1778175 - RNA, 22 nt, Human
guaaaaggccaaaccucuguuc

SEQ ID NO: 1778176 - RNA, 18 nt, Human
guaaaguugguuggauaa

SEQ ID NO: 1778177 - RNA, 17 nt, Human
guaaauagguucuucuu

SEQ ID NO: 1778178 - RNA, 20 nt, Human
guaaauaguuacuccagugc

SEQ ID NO: 1778179 - RNA, 14 nt, Human
gguugggcuggugu

SEQ ID NO: 1778180 - RNA, 15 nt, Human
gguugggaugggaua

SEQ ID NO: 1778181 - RNA, 11 nt, Human
gguuggagccc

SEQ ID NO: 1778182 - RNA, 14 nt, Human
gguuggagcccagg

SEQ ID NO: 1778183 - RNA, 17 nt, Human
gguuggagcccagggca

SEQ ID NO: 1778184 - RNA, 21 nt, Human
gguuggagcccagggcaucuu

SEQ ID NO: 1778185 - RNA, 14 nt, Human
gguuggauggaugg

SEQ ID NO: 1778186 - RNA, 15 nt, Human
gguugaccccagagg

SEQ ID NO: 1778187 - RNA, 16 nt, Human
gguugaccccagagga

SEQ ID NO: 1778188 - RNA, 19 nt, Human
gguuguauuagauguucuc

SEQ ID NO: 1778189 - RNA, 18 nt, Human
gguuguauuagauguucu

SEQ ID NO: 1778190 - RNA, 20 nt, Human
gguucacugcaaccuccgcc

SEQ ID NO: 1778191 - RNA, 22 nt, Human
gguucaagcgauucuucugcuu

SEQ ID NO: 1778192 - RNA, 23 nt, Human
gguucaagcgauucuucugcuuc

SEQ ID NO: 1778193 - RNA, 12 nt, Human
gguucagcuugu

SEQ ID NO: 1778194 - RNA, 14 nt, Human
gguugaagcaccaa

SEQ ID NO: 1778195 - RNA, 21 nt, Human
gguucaagcgauucuucugcu

SEQ ID NO: 1778196 - RNA, 22 nt, Human
gguuuaauccccaguaaaauug

SEQ ID NO: 1778197 - RNA, 19 nt, Human
gguuuaauccccaguaaaa

SEQ ID NO: 1778198 - RNA, 23 nt, Human
gguuuugccauguuggccaggcu

SEQ ID NO: 1778199 - RNA, 16 nt, Human
gguuuuuaaaacccag

SEQ ID NO: 1778200 - RNA, 19 nt, Human
gguuuuguauucucugagc

SEQ ID NO: 1778201 - RNA, 17 nt, Human
gguuuuguauucucuga

SEQ ID NO: 1778202 - RNA, 18 nt, Human
gguuuuguauucucugag

SEQ ID NO: 1778203 - RNA, 17 nt, Human
gguuuuuacuuaacugu

SEQ ID NO: 1778204 - RNA, 19 nt, Human
gguuuuuacuuaacuguuu

SEQ ID NO: 1778205 - RNA, 16 nt, Human
ggucccggcucugugg

SEQ ID NO: 1778206 - RNA, 17 nt, Human
ggucccggcucuguggg

SEQ ID NO: 1778207 - RNA, 18 nt, Human
ggucccggcucugugggu

SEQ ID NO: 1778208 - RNA, 19 nt, Human
ggucccggcucugugggug

SEQ ID NO: 1778209 - RNA, 22 nt, Human
ggucucacuauguugcccaggc

SEQ ID NO: 1778210 - RNA, 12 nt, Human
ggucucacucug

SEQ ID NO: 1778211 - RNA, 16 nt, Human
ggucucacucugucgc

SEQ ID NO: 1778212 - RNA, 15 nt, Human
ggucugacccacugc

SEQ ID NO: 1778213 - RNA, 16 nt, Human
ggucugacccacugcu

SEQ ID NO: 1778214 - RNA, 19 nt, Human
ggucugaggaauccagacc

SEQ ID NO: 1778215 - RNA, 13 nt, Human
ggugaaggcuggc

SEQ ID NO: 1778216 - RNA, 21 nt, Human
ggugacagagugagacucugu

SEQ ID NO: 1778217 - RNA, 14 nt, Human
ggugaccucugccu

SEQ ID NO: 1778218 - RNA, 16 nt, Human
ggugaccucugccuga

SEQ ID NO: 1778219 - RNA, 21 nt, Human
ggugaccucugccugaaguca

SEQ ID NO: 1778220 - RNA, 22 nt, Human
ggugcccagcuauaccugugcc

SEQ ID NO: 1778221 - RNA, 22 nt, Human
ggugccccccaccccuggaaga

SEQ ID NO: 1778222 - RNA, 16 nt, Human
gguggcagugggagcu

SEQ ID NO: 1778223 - RNA, 15 nt, Human
gguggcagcugcggu

SEQ ID NO: 1778224 - RNA, 23 nt, Human
gguggcagcugcgguccacccag

SEQ ID NO: 1778225 - RNA, 11 nt, Human
gguggcagcug

SEQ ID NO: 1778226 - RNA, 12 nt, Human
gguggcagcugc

SEQ ID NO: 1778227 - RNA, 13 nt, Human
gguggcagcugcg

SEQ ID NO: 1778228 - RNA, 22 nt, Human
ggucccacucaguccauagcag

SEQ ID NO: 1778229 - RNA, 12 nt, Human
ggucccacucag

SEQ ID NO: 1778230 - RNA, 14 nt, Human
ggucccacucaguc

SEQ ID NO: 1778231 - RNA, 23 nt, Human
ggucccaguuuuguugccccaga

SEQ ID NO: 1778232 - RNA, 12 nt, Human
ggucagagccug

SEQ ID NO: 1778233 - RNA, 13 nt, Human
ggucagagccugc

SEQ ID NO: 1778234 - RNA, 14 nt, Human
ggucagagccugca

SEQ ID NO: 1778235 - RNA, 15 nt, Human
ggucagagccugcag

SEQ ID NO: 1778236 - RNA, 16 nt, Human
ggucagagccugcagu

SEQ ID NO: 1778237 - RNA, 22 nt, Human
ggucacaaauccuaaaagaagc

SEQ ID NO: 1778238 - RNA, 16 nt, Human
ggguuggccccugccc

SEQ ID NO: 1778239 - RNA, 13 nt, Human
ggguucugccucu

SEQ ID NO: 1778240 - RNA, 19 nt, Human
ggguuggccccugcccggc

SEQ ID NO: 1778241 - RNA, 17 nt, Human
gguacccacugcucugg

SEQ ID NO: 1778242 - RNA, 17 nt, Human
gguacccggggcccagg

SEQ ID NO: 1778243 - RNA, 19 nt, Human
gguacccggggcccagggc

SEQ ID NO: 1778244 - RNA, 15 nt, Human
ggguugggcuggugu

SEQ ID NO: 1778245 - RNA, 19 nt, Human
ggguuuaauccccaguaaa

SEQ ID NO: 1778246 - RNA, 23 nt, Human
ggguuuaauccccaguaaaauug

SEQ ID NO: 1778247 - RNA, 22 nt, Human
ggguuuaauccccaguaaaauu

SEQ ID NO: 1778248 - RNA, 22 nt, Human
gguacuuguggacacagcucuu

SEQ ID NO: 1778249 - RNA, 21 nt, Human
gguacuuguggacacagcucu

SEQ ID NO: 1778250 - RNA, 23 nt, Human
gguacuauaaaagcuuucugcca

SEQ ID NO: 1778251 - RNA, 14 nt, Human
gggcuucaguggca

SEQ ID NO: 1778252 - RNA, 16 nt, Human
gggcugucggcgcugc

SEQ ID NO: 1778253 - RNA, 23 nt, Human
gggcugugcuugaaggcccugcu

SEQ ID NO: 1778254 - RNA, 14 nt, Human
gggcugagggagcc

SEQ ID NO: 1778255 - RNA, 12 nt, Human
gggcugagggag

SEQ ID NO: 1778256 - RNA, 13 nt, Human
gggcugagggagc

SEQ ID NO: 1778257 - RNA, 13 nt, Human
gggcugagggccu

SEQ ID NO: 1778258 - RNA, 14 nt, Human
gggcugagggccug

SEQ ID NO: 1778259 - RNA, 16 nt, Human
gggcugagggccugcu

SEQ ID NO: 1778260 - RNA, 17 nt, Human
gggcugagggccugcug

SEQ ID NO: 1778261 - RNA, 18 nt, Human
gggcugagggccugcugg

SEQ ID NO: 1778262 - RNA, 14 nt, Human
gggcucccugacug

SEQ ID NO: 1778263 - RNA, 18 nt, Human
gggcucccugacugggag

SEQ ID NO: 1778264 - RNA, 21 nt, Human
gggcucccuguaaccucuuca

SEQ ID NO: 1778265 - RNA, 23 nt, Human
gggccuuaucgggcuccagccau

SEQ ID NO: 1778266 - RNA, 16 nt, Human
gggccuggcagcucag

SEQ ID NO: 1778267 - RNA, 13 nt, Human
ggcucccagccuc

SEQ ID NO: 1778268 - RNA, 15 nt, Human
ggcucccagccucag

SEQ ID NO: 1778269 - RNA, 16 nt, Human
ggcucccagccucagc

SEQ ID NO: 1778270 - RNA, 17 nt, Human
ggcucccagccucagcg

SEQ ID NO: 1778271 - RNA, 23 nt, Human
gggcccggcccgcgccacaggac

SEQ ID NO: 1778272 - RNA, 16 nt, Human
gggcccucucugcucu

SEQ ID NO: 1778273 - RNA, 14 nt, Human
gggccugcuggagg

SEQ ID NO: 1778274 - RNA, 15 nt, Human
gggccugcuggaggc

SEQ ID NO: 1778275 - RNA, 21 nt, Human
gggccugcuggaggccucagg

SEQ ID NO: 1778276 - RNA, 12 nt, Human
ggggcagggcug

SEQ ID NO: 1778277 - RNA, 21 nt, Human
gggggaaacagguugggaugg

SEQ ID NO: 1778278 - RNA, 18 nt, Human
ggguacccacugcucugg

SEQ ID NO: 1778279 - RNA, 13 nt, Human
ggguacccacugc

SEQ ID NO: 1778280 - RNA, 15 nt, Human
ggguacccacugcuc

SEQ ID NO: 1778281 - RNA, 19 nt, Human
ggguacuuguggacacagc

SEQ ID NO: 1778282 - RNA, 22 nt, Human
ggguacuuguggacacagcucu

SEQ ID NO: 1778283 - RNA, 23 nt, Human
ggguacuuguggacacagcucuu

SEQ ID NO: 1778284 - RNA, 19 nt, Human
gggcuucaguggcagcugc

SEQ ID NO: 1778285 - RNA, 20 nt, Human
gggcuucaguggcagcugcu

SEQ ID NO: 1778286 - RNA, 15 nt, Human
gggcuucaguggcag

SEQ ID NO: 1778287 - RNA, 16 nt, Human
gggcuucaguggcagc

SEQ ID NO: 1778288 - RNA, 17 nt, Human
gggcuucaguggcagcu

SEQ ID NO: 1778289 - RNA, 18 nt, Human
gggcuucaguggcagcug

SEQ ID NO: 1778290 - RNA, 14 nt, Human
ggggaguagagaag

SEQ ID NO: 1778291 - RNA, 17 nt, Human
ggggagacugggcugag

SEQ ID NO: 1778292 - RNA, 18 nt, Human
ggggagacugggcugagg

SEQ ID NO: 1778293 - RNA, 18 nt, Human
ggggcagcacccuauaaa

SEQ ID NO: 1778294 - RNA, 20 nt, Human
ggggcagaucuuggacucau

SEQ ID NO: 1778295 - RNA, 15 nt, Human
gucauaccaaugaaa

SEQ ID NO: 1778296 - RNA, 16 nt, Human
gucauaccaaugaaaa

SEQ ID NO: 1778297 - RNA, 14 nt, Human
gucagcauuugauc

SEQ ID NO: 1778298 - RNA, 13 nt, Human
gucagcccuaggg

SEQ ID NO: 1778299 - RNA, 22 nt, Human
gucagcccuaggguggagagcc

SEQ ID NO: 1778300 - RNA, 22 nt, Human
gucaccucuuccgacucuuucu

SEQ ID NO: 1778301 - RNA, 13 nt, Human
gucaccugugcuu

SEQ ID NO: 1778302 - RNA, 21 nt, Human
gucaucccaucauuuuccaua

SEQ ID NO: 1778303 - RNA, 14 nt, Human
gucauaucaaauaa

SEQ ID NO: 1778304 - RNA, 12 nt, Human
gucauagaaauu

SEQ ID NO: 1778305 - RNA, 19 nt, Human
gucauagauguuuccuugc

SEQ ID NO: 1778306 - RNA, 22 nt, Human
gucauaucaaauaaagagagaa

SEQ ID NO: 1778307 - RNA, 17 nt, Human
gucaucuguuagggccu

SEQ ID NO: 1778308 - RNA, 14 nt, Human
guccacccaggagc

SEQ ID NO: 1778309 - RNA, 15 nt, Human
guccacccaggagcc

SEQ ID NO: 1778310 - RNA, 16 nt, Human
guccacccaggagccc

SEQ ID NO: 1778311 - RNA, 11 nt, Human
guccagaagga

SEQ ID NO: 1778312 - RNA, 14 nt, Human
guccagaaggagac

SEQ ID NO: 1778313 - RNA, 16 nt, Human
guccagaaggagacag

SEQ ID NO: 1778314 - RNA, 17 nt, Human
guccagaaggagacagg

SEQ ID NO: 1778315 - RNA, 19 nt, Human
guccagaaggagacaggca

SEQ ID NO: 1778316 - RNA, 20 nt, Human
guccagaaggagacaggcag

SEQ ID NO: 1778317 - RNA, 14 nt, Human
gucccacucagucc

SEQ ID NO: 1778318 - RNA, 15 nt, Human
gucccacucagucca

SEQ ID NO: 1778319 - RNA, 15 nt, Human
guccaggcacugaga

SEQ ID NO: 1778320 - RNA, 13 nt, Human
guauuacuucugc

SEQ ID NO: 1778321 - RNA, 14 nt, Human
guauuacuucugcu

SEQ ID NO: 1778322 - RNA, 15 nt, Human
guauuacuucugcua

SEQ ID NO: 1778323 - RNA, 14 nt, Human
guauuauuuuccaa

SEQ ID NO: 1778324 - RNA, 22 nt, Human
guauuagauguucucuaucauu

SEQ ID NO: 1778325 - RNA, 21 nt, Human
guauuagauguucucuaucau

SEQ ID NO: 1778326 - RNA, 18 nt, Human
guauuagauguucucuau

SEQ ID NO: 1778327 - RNA, 17 nt, Human
guauuagauguucucua

SEQ ID NO: 1778328 - RNA, 15 nt, Human
guauuagauguucuc

SEQ ID NO: 1778329 - RNA, 14 nt, Human
guauuagauguucu

SEQ ID NO: 1778330 - RNA, 13 nt, Human
guauuagauguuc

SEQ ID NO: 1778331 - RNA, 12 nt, Human
guauuagauguu

SEQ ID NO: 1778332 - RNA, 23 nt, Human
guauuuauucaauaaaguauuua

SEQ ID NO: 1778333 - RNA, 22 nt, Human
guauuuauucaauaaaguauuu

SEQ ID NO: 1778334 - RNA, 20 nt, Human
guauuuauucaauaaaguau

SEQ ID NO: 1778335 - RNA, 19 nt, Human
guauuuauucaauaaagua

SEQ ID NO: 1778336 - RNA, 17 nt, Human
guauuuauucaauaaag

SEQ ID NO: 1778337 - RNA, 16 nt, Human
guauuuauucaauaaa

SEQ ID NO: 1778338 - RNA, 14 nt, Human
guauuuauucaaua

SEQ ID NO: 1778339 - RNA, 13 nt, Human
guauuuauucaau

SEQ ID NO: 1778340 - RNA, 13 nt, Human
guauuucaaauug

SEQ ID NO: 1778341 - RNA, 20 nt, Human
gucaccugaagacucauucu

SEQ ID NO: 1778342 - RNA, 18 nt, Human
gucaagagggucugagga

SEQ ID NO: 1778343 - RNA, 19 nt, Human
gucaagagggucugaggaa

SEQ ID NO: 1778344 - RNA, 17 nt, Human
gucaagugcguccacga

SEQ ID NO: 1778345 - RNA, 12 nt, Human
gucaagcugcuc

SEQ ID NO: 1778346 - RNA, 13 nt, Human
gucaagcugcucu

SEQ ID NO: 1778347 - RNA, 14 nt, Human
gucaagcugcucug

SEQ ID NO: 1778348 - RNA, 17 nt, Human
gucaagcugcucugagc

SEQ ID NO: 1778349 - RNA, 18 nt, Human
gucaagcugcucugagcc

SEQ ID NO: 1778350 - RNA, 19 nt, Human
gucaagcugcucugagcca

SEQ ID NO: 1778351 - RNA, 20 nt, Human
gucaagcugcucugagccac

SEQ ID NO: 1778352 - RNA, 22 nt, Human
gucaagcugcucugagccacag

SEQ ID NO: 1778353 - RNA, 23 nt, Human
gucaagcugcucugagccacagu

SEQ ID NO: 1778354 - RNA, 14 nt, Human
guccuccaggagcu

SEQ ID NO: 1778355 - RNA, 15 nt, Human
guccuccaggagcuu

SEQ ID NO: 1778356 - RNA, 15 nt, Human
guccucccagcuccu

SEQ ID NO: 1778357 - RNA, 14 nt, Human
guccuccccucucu

SEQ ID NO: 1778358 - RNA, 17 nt, Human
guccuccccucucuugu

SEQ ID NO: 1778359 - RNA, 15 nt, Human
guccugggagugagc

SEQ ID NO: 1778360 - RNA, 16 nt, Human
guccugggagugagcu

SEQ ID NO: 1778361 - RNA, 14 nt, Human
guccucccucaccc

SEQ ID NO: 1778362 - RNA, 20 nt, Human
guccucccucacccccuccu

SEQ ID NO: 1778363 - RNA, 12 nt, Human
guccucccugac

SEQ ID NO: 1778364 - RNA, 15 nt, Human
guccucccugacuuu

SEQ ID NO: 1778365 - RNA, 19 nt, Human
guccugggagugagcuggu

SEQ ID NO: 1778366 - RNA, 17 nt, Human
guccugggagugagcug

SEQ ID NO: 1778367 - RNA, 18 nt, Human
guccugggagugagcugg

SEQ ID NO: 1778368 - RNA, 19 nt, Human
guccuagaggcccuuugcu

SEQ ID NO: 1778369 - RNA, 20 nt, Human
guccuagaggcccuuugcug

SEQ ID NO: 1778370 - RNA, 15 nt, Human
guccuacucuguguc

SEQ ID NO: 1778371 - RNA, 23 nt, Human
guccuacucugugucaggugggg

SEQ ID NO: 1778372 - RNA, 13 nt, Human
guccuacucugug

SEQ ID NO: 1778373 - RNA, 16 nt, Human
gucccauagucccugc

SEQ ID NO: 1778374 - RNA, 21 nt, Human
gucccugcgccuuuccuuuuc

SEQ ID NO: 1778375 - RNA, 15 nt, Human
gucccaguuuuguug

SEQ ID NO: 1778376 - RNA, 23 nt, Human
gucccaguuuuguugccccagaa

SEQ ID NO: 1778377 - RNA, 22 nt, Human
guccuagaggcccuuugcuguc

SEQ ID NO: 1778378 - RNA, 14 nt, Human
guccuaggccucaa

SEQ ID NO: 1778379 - RNA, 13 nt, Human
gucugacccacug

SEQ ID NO: 1778380 - RNA, 14 nt, Human
gucugacccacugc

SEQ ID NO: 1778381 - RNA, 15 nt, Human
gucugacccacugcu

SEQ ID NO: 1778382 - RNA, 18 nt, Human
gucugaggaauccagacc

SEQ ID NO: 1778383 - RNA, 19 nt, Human
gucugaggaauccagaccc

SEQ ID NO: 1778384 - RNA, 20 nt, Human
gucugauucccaagcucugc

SEQ ID NO: 1778385 - RNA, 21 nt, Human
gucugauucccaagcucugcu

SEQ ID NO: 1778386 - RNA, 17 nt, Human
gucugauucccaagcuc

SEQ ID NO: 1778387 - RNA, 18 nt, Human
gucugauucccaagcucu

SEQ ID NO: 1778388 - RNA, 19 nt, Human
gucugauucccaagcucug

SEQ ID NO: 1778389 - RNA, 21 nt, Human
gucugaggaauccagacccgg

SEQ ID NO: 1778390 - RNA, 20 nt, Human
gucucacuauguugcccagg

SEQ ID NO: 1778391 - RNA, 21 nt, Human
gucucacuauguugcccaggc

SEQ ID NO: 1778392 - RNA, 13 nt, Human
gucucacuguugc

SEQ ID NO: 1778393 - RNA, 23 nt, Human
gucucacuauguugcccaggcag

SEQ ID NO: 1778394 - RNA, 16 nt, Human
gucucacuguugccca

SEQ ID NO: 1778395 - RNA, 17 nt, Human
gucucacuguugcccag

SEQ ID NO: 1778396 - RNA, 18 nt, Human
gucucacuguugcccagg

SEQ ID NO: 1778397 - RNA, 19 nt, Human
gucucacuguugcccaggc

SEQ ID NO: 1778398 - RNA, 20 nt, Human
gucucacuguugcccaggcu

SEQ ID NO: 1778399 - RNA, 21 nt, Human
gucucacuguugcccaggcug

SEQ ID NO: 1778400 - RNA, 22 nt, Human
gucucacuguugcccaggcugg

SEQ ID NO: 1778401 - RNA, 23 nt, Human
gucucacuguugcccaggcuggc

SEQ ID NO: 1778402 - RNA, 13 nt, Human
gucuaaaacaaua

SEQ ID NO: 1778403 - RNA, 14 nt, Human
gucuaaaacaauaa

SEQ ID NO: 1778404 - RNA, 14 nt, Human
gugauucuccugcc

SEQ ID NO: 1778405 - RNA, 16 nt, Human
gugauucuccugccuc

SEQ ID NO: 1778406 - RNA, 17 nt, Human
gugauucuccugccuca

SEQ ID NO: 1778407 - RNA, 18 nt, Human
gugauucuccugccucag

SEQ ID NO: 1778408 - RNA, 19 nt, Human
gugauucuccugccucagc

SEQ ID NO: 1778409 - RNA, 20 nt, Human
gugauucuccugccucagcc

SEQ ID NO: 1778410 - RNA, 22 nt, Human
gugauucuccugccucagccuc

SEQ ID NO: 1778411 - RNA, 23 nt, Human
gugauucuccugccucagccucc

SEQ ID NO: 1778412 - RNA, 23 nt, Human
gugauccucccaccucagccucc

SEQ ID NO: 1778413 - RNA, 20 nt, Human
gugauccucccaccucagcc

SEQ ID NO: 1778414 - RNA, 22 nt, Human
gugauccucccaccucagccuc

SEQ ID NO: 1778415 - RNA, 22 nt, Human
gugauccacccaccucagccuc

SEQ ID NO: 1778416 - RNA, 14 nt, Human
gugauccucccacc

SEQ ID NO: 1778417 - RNA, 15 nt, Human
gugauccucccaccu

SEQ ID NO: 1778418 - RNA, 18 nt, Human
gugauccucccaccucag

SEQ ID NO: 1778419 - RNA, 15 nt, Human
gugauccacccaccu

SEQ ID NO: 1778420 - RNA, 18 nt, Human
gugauccacccaccucag

SEQ ID NO: 1778421 - RNA, 20 nt, Human
gugauccacccaccucagcc

SEQ ID NO: 1778422 - RNA, 20 nt, Human
gugcccacaggaucagucug

SEQ ID NO: 1778423 - RNA, 20 nt, Human
gugcccagcuauaccugugc

SEQ ID NO: 1778424 - RNA, 21 nt, Human
gugcccagcuauaccugugcc

SEQ ID NO: 1778425 - RNA, 22 nt, Human
gugcccagcuauaccugugccu

SEQ ID NO: 1778426 - RNA, 21 nt, Human
gugccccccaccccuggaaga

SEQ ID NO: 1778427 - RNA, 23 nt, Human
gugcccagcuauaccugugccuc

SEQ ID NO: 1778428 - RNA, 20 nt, Human
gugccagguuuuuggucuga

SEQ ID NO: 1778429 - RNA, 22 nt, Human
gugccagguuuuuggucugacc

SEQ ID NO: 1778430 - RNA, 16 nt, Human
gugcaguccugaucag

SEQ ID NO: 1778431 - RNA, 15 nt, Human
gugcagguggggaga

SEQ ID NO: 1778432 - RNA, 14 nt, Human
gugaaaagcuccau

SEQ ID NO: 1778433 - RNA, 15 nt, Human
gugaaaaugguccag

SEQ ID NO: 1778434 - RNA, 17 nt, Human
gugaaaaugguccagga

SEQ ID NO: 1778435 - RNA, 24 nt, Human
gugaaacccagucacugugagcuc

SEQ ID NO: 1778436 - RNA, 19 nt, Human
gugaaagaaaauaacaaua

SEQ ID NO: 1778437 - RNA, 14 nt, Human
gugacucuccaggg

SEQ ID NO: 1778438 - RNA, 14 nt, Human
gugacucugaagcu

SEQ ID NO: 1778439 - RNA, 16 nt, Human
gugacaacacuugugu

SEQ ID NO: 1778440 - RNA, 13 nt, Human
gugaauuuuugca

SEQ ID NO: 1778441 - RNA, 14 nt, Human
gugaauuuuugcaa

SEQ ID NO: 1778442 - RNA, 15 nt, Human
gugaauuuuugcaau

SEQ ID NO: 1778443 - RNA, 16 nt, Human
gugaauuuuugcaaua

SEQ ID NO: 1778444 - RNA, 17 nt, Human
gugaauuuuugcaauaa

SEQ ID NO: 1778445 - RNA, 21 nt, Human
gugaauuuuugcaauaaugca

SEQ ID NO: 1778446 - RNA, 23 nt, Human
gugaauuuuugcaauaaugcagu

SEQ ID NO: 1778447 - RNA, 13 nt, Human
gugagccacugca

SEQ ID NO: 1778448 - RNA, 15 nt, Human
gugaggaaagucauu

SEQ ID NO: 1778449 - RNA, 22 nt, Human
gugagcucccaggugcagccag

SEQ ID NO: 1778450 - RNA, 14 nt, Human
gugagccacugcac

SEQ ID NO: 1778451 - RNA, 14 nt, Human
gugagcuacaaaug

SEQ ID NO: 1778452 - RNA, 19 nt, Human
guggcagugggagcugccu

SEQ ID NO: 1778453 - RNA, 21 nt, Human
guggcagugggagcugccugu

SEQ ID NO: 1778454 - RNA, 15 nt, Human
guggcagugggagcu

SEQ ID NO: 1778455 - RNA, 16 nt, Human
guggcagugggagcug

SEQ ID NO: 1778456 - RNA, 17 nt, Human
guggcagugggagcugc

SEQ ID NO: 1778457 - RNA, 20 nt, Human
guggaugccugguggcagcu

SEQ ID NO: 1778458 - RNA, 21 nt, Human
guggcagcugcgguccaccca

SEQ ID NO: 1778459 - RNA, 22 nt, Human
guggcagcugcgguccacccag

SEQ ID NO: 1778460 - RNA, 23 nt, Human
guggcagcugcgguccacccagg

SEQ ID NO: 1778461 - RNA, 12 nt, Human
guggcagcugcu

SEQ ID NO: 1778462 - RNA, 13 nt, Human
guggcagcugcuu

SEQ ID NO: 1778463 - RNA, 19 nt, Human
guggcagcugcuuuugucu

SEQ ID NO: 1778464 - RNA, 18 nt, Human
guggaacugcguuaugaa

SEQ ID NO: 1778465 - RNA, 16 nt, Human
guggaugccugguggc

SEQ ID NO: 1778466 - RNA, 18 nt, Human
guggaugccugguggcag

SEQ ID NO: 1778467 - RNA, 18 nt, Human
guggaugccgauuucugu

SEQ ID NO: 1778468 - RNA, 20 nt, Human
guggaugccgauuucuguaa

SEQ ID NO: 1778469 - RNA, 12 nt, Human
guggagggccac

SEQ ID NO: 1778470 - RNA, 18 nt, Human
guggaggugggcugggcc

SEQ ID NO: 1778471 - RNA, 14 nt, Human
gugcugcagcuccc

SEQ ID NO: 1778472 - RNA, 18 nt, Human
gugcugcagcucccuggc

SEQ ID NO: 1778473 - RNA, 19 nt, Human
gugcugcagcucccuggcu

SEQ ID NO: 1778474 - RNA, 15 nt, Human
gugcugccauccagg

SEQ ID NO: 1778475 - RNA, 18 nt, Human
gugcugccauccagguuc

SEQ ID NO: 1778476 - RNA, 19 nt, Human
gugcugccauccagguuca

SEQ ID NO: 1778477 - RNA, 17 nt, Human
gugcucuggacaggcau

SEQ ID NO: 1778478 - RNA, 18 nt, Human
gugcucuggacaggcaug

SEQ ID NO: 1778479 - RNA, 15 nt, Human
gugcucuggacaggc

SEQ ID NO: 1778480 - RNA, 16 nt, Human
gugcucuggacaggca

SEQ ID NO: 1778481 - RNA, 19 nt, Human
gugcuuuccuuuuuuaaaa

SEQ ID NO: 1778482 - RNA, 20 nt, Human
gugcuuuccuuuuuuaaaaa

SEQ ID NO: 1778483 - RNA, 14 nt, Human
gugcuucuuucuuu

SEQ ID NO: 1778484 - RNA, 13 nt, Human
gugcuugaaggcc

SEQ ID NO: 1778485 - RNA, 14 nt, Human
gugcuugaaggccc

SEQ ID NO: 1778486 - RNA, 15 nt, Human
gugcuugaaggcccu

SEQ ID NO: 1778487 - RNA, 18 nt, Human
gugcuugaaggcccugcu

SEQ ID NO: 1778488 - RNA, 19 nt, Human
gugcuugaaggcccugcug

SEQ ID NO: 1778489 - RNA, 20 nt, Human
gugcuugaaggcccugcuga

SEQ ID NO: 1778490 - RNA, 21 nt, Human
gugcuugaaggcccugcugag

SEQ ID NO: 1778491 - RNA, 14 nt, Human
gugcuucgggcccu

SEQ ID NO: 1778492 - RNA, 13 nt, Human
gugcuuccuugua

SEQ ID NO: 1778493 - RNA, 13 nt, Human
gugcuucuuucuu

SEQ ID NO: 1778494 - RNA, 17 nt, Human
gugcuucgggcccuucc

SEQ ID NO: 1778495 - RNA, 22 nt, Human
gugcugccauccagguucagcu

SEQ ID NO: 1778496 - RNA, 19 nt, Human
uauauguuuuaagaggcag

SEQ ID NO: 1778497 - RNA, 23 nt, Human
uauccucuuuagaguuagacugu

SEQ ID NO: 1778498 - RNA, 22 nt, Human
uauccucuuuagaguuagacug

SEQ ID NO: 1778499 - RNA, 17 nt, Human
uauccucuuuagaguua

SEQ ID NO: 1778500 - RNA, 16 nt, Human
uauccucuuuagaguu

SEQ ID NO: 1778501 - RNA, 14 nt, Human
uauccucuuuagag

SEQ ID NO: 1778502 - RNA, 24 nt, Human
uauccuuuccucauuaaauuaccu

SEQ ID NO: 1778503 - RNA, 19 nt, Human
uauccuugggggcucccag

SEQ ID NO: 1778504 - RNA, 23 nt, Human
uauccuugggggcucccagggca

SEQ ID NO: 1778505 - RNA, 21 nt, Human
uaucuaauauguaacaagcca

SEQ ID NO: 1778506 - RNA, 13 nt, Human
uaucugccuuuau

SEQ ID NO: 1778507 - RNA, 20 nt, Human
uaucugccuuuauuguguuu

SEQ ID NO: 1778508 - RNA, 18 nt, Human
uaucugccuuuauugugu

SEQ ID NO: 1778509 - RNA, 14 nt, Human
uaucugccuuuauu

SEQ ID NO: 1778510 - RNA, 16 nt, Human
uaugaaugauuugcau

SEQ ID NO: 1778511 - RNA, 23 nt, Human
uaugaaugauuugcauaugaaag

SEQ ID NO: 1778512 - RNA, 13 nt, Human
uaugaauuguaca

SEQ ID NO: 1778513 - RNA, 14 nt, Human
uaugaauuguacag

SEQ ID NO: 1778514 - RNA, 15 nt, Human
uaugaauuguacaga

SEQ ID NO: 1778515 - RNA, 22 nt, Human
uaugaauuguacagaauauuuc

SEQ ID NO: 1778516 - RNA, 20 nt, Human
uaucugucauuugagcaggg

SEQ ID NO: 1778517 - RNA, 21 nt, Human
uaucugucauuugagcagggc

SEQ ID NO: 1778518 - RNA, 23 nt, Human
uaucugucauuugagcagggcuc

SEQ ID NO: 1778519 - RNA, 14 nt, Human
uaucugugcucagg

SEQ ID NO: 1778520 - RNA, 22 nt, Human
uaucugugcucaggacucagaa

SEQ ID NO: 1778521 - RNA, 22 nt, Human
uauggaauuacauguaaaacau

SEQ ID NO: 1778522 - RNA, 14 nt, Human
uauggaauuacaug

SEQ ID NO: 1778523 - RNA, 18 nt, Human
uauggaauuacauguaaa

SEQ ID NO: 1778524 - RNA, 13 nt, Human
uaugcuucuuuca

SEQ ID NO: 1778525 - RNA, 21 nt, Human
uaugcuuuccaaaccuuaucu

SEQ ID NO: 1778526 - RNA, 13 nt, Human
uaugcuuuccuuc

SEQ ID NO: 1778527 - RNA, 14 nt, Human
uaugcuuuccuucu

SEQ ID NO: 1778528 - RNA, 21 nt, Human
uaugcuuuccuucuuugggau

SEQ ID NO: 1778529 - RNA, 19 nt, Human
uaugcacuuauaauuuucc

SEQ ID NO: 1778530 - RNA, 22 nt, Human
uaugcacuuauaauuuuccuaa

SEQ ID NO: 1778531 - RNA, 20 nt, Human
uaugcacuuauaauuuuccu

SEQ ID NO: 1778532 - RNA, 21 nt, Human
uaugacauuggauagaacaug

SEQ ID NO: 1778533 - RNA, 20 nt, Human
uauaauugggucauagaaau

SEQ ID NO: 1778534 - RNA, 19 nt, Human
uauaccugugccucggcuu

SEQ ID NO: 1778535 - RNA, 13 nt, Human
uauaaauucacuu

SEQ ID NO: 1778536 - RNA, 20 nt, Human
uauacgcagcgugcuuuaaa

SEQ ID NO: 1778537 - RNA, 14 nt, Human
uauaguguauagaa

SEQ ID NO: 1778538 - RNA, 17 nt, Human
uauaauguuuuuaauau

SEQ ID NO: 1778539 - RNA, 14 nt, Human
uauaugugugccua

SEQ ID NO: 1778540 - RNA, 23 nt, Human
uaggugacagagugagacucugu

SEQ ID NO: 1778541 - RNA, 13 nt, Human
uagugcuaagugu

SEQ ID NO: 1778542 - RNA, 15 nt, Human
uaggccuggccagau

SEQ ID NO: 1778543 - RNA, 18 nt, Human
uaggccuggccagaugca

SEQ ID NO: 1778544 - RNA, 14 nt, Human
uaggacccaagcag

SEQ ID NO: 1778545 - RNA, 16 nt, Human
uaggacccaagcagag

SEQ ID NO: 1778546 - RNA, 22 nt, Human
uaggaauaucaauauaauguuu

SEQ ID NO: 1778547 - RNA, 14 nt, Human
uagguaggguuuaa

SEQ ID NO: 1778548 - RNA, 16 nt, Human
uaggucagugcaaaua

SEQ ID NO: 1778549 - RNA, 21 nt, Human
ucaagcgauucuucugcuuca

SEQ ID NO: 1778550 - RNA, 18 nt, Human
ucaagcgauucuucugcu

SEQ ID NO: 1778551 - RNA, 19 nt, Human
ucaagcgauucuucugcuu

SEQ ID NO: 1778552 - RNA, 13 nt, Human
ucaaccugccuga

SEQ ID NO: 1778553 - RNA, 17 nt, Human
ucaaccugggcaaagcc

SEQ ID NO: 1778554 - RNA, 14 nt, Human
ucaacuccucccau

SEQ ID NO: 1778555 - RNA, 16 nt, Human
ucaaccuccugggcua

SEQ ID NO: 1778556 - RNA, 20 nt, Human
ucaaccccuucgcuccugug

SEQ ID NO: 1778557 - RNA, 15 nt, Human
ucaaccuccugggcu

SEQ ID NO: 1778558 - RNA, 18 nt, Human
ucaaccccuucgcuccug

SEQ ID NO: 1778559 - RNA, 19 nt, Human
ucaaccccuucgcuccugu

SEQ ID NO: 1778560 - RNA, 21 nt, Human
uauuugcauaacaauuccucu

SEQ ID NO: 1778561 - RNA, 22 nt, Human
uauuugcauaacaauuccucua

SEQ ID NO: 1778562 - RNA, 15 nt, Human
ucacacacuuuggcu

SEQ ID NO: 1778563 - RNA, 19 nt, Human
ucaauuccguagccagcug

SEQ ID NO: 1778564 - RNA, 22 nt, Human
ucaauuccguagccagcugcuc

SEQ ID NO: 1778565 - RNA, 13 nt, Human
ucaccaagcccag

SEQ ID NO: 1778566 - RNA, 14 nt, Human
ucacauuuauucug

SEQ ID NO: 1778567 - RNA, 12 nt, Human
ucacauuuaaau

SEQ ID NO: 1778568 - RNA, 12 nt, Human
uauuguuucaau

SEQ ID NO: 1778569 - RNA, 18 nt, Human
uauuguuucaauugcauc

SEQ ID NO: 1778570 - RNA, 20 nt, Human
uauuuauucaauaaaguauu

SEQ ID NO: 1778571 - RNA, 19 nt, Human
uauuuauucaauaaaguau

SEQ ID NO: 1778572 - RNA, 18 nt, Human
uauuuauucaauaaagua

SEQ ID NO: 1778573 - RNA, 16 nt, Human
uauuuauucaauaaag

SEQ ID NO: 1778574 - RNA, 14 nt, Human
uauuuauucaauaa

SEQ ID NO: 1778575 - RNA, 13 nt, Human
uauuuauucaaua

SEQ ID NO: 1778576 - RNA, 12 nt, Human
uauuuauucaau

SEQ ID NO: 1778577 - RNA, 18 nt, Human
uauuugaaucuugucuca

SEQ ID NO: 1778578 - RNA, 16 nt, Human
uauuugaaucuugucu

SEQ ID NO: 1778579 - RNA, 14 nt, Human
uauuugaaucuugu

SEQ ID NO: 1778580 - RNA, 12 nt, Human
uauuugaaucuu

SEQ ID NO: 1778581 - RNA, 20 nt, Human
uauuugaaucuugucucaau

SEQ ID NO: 1778582 - RNA, 19 nt, Human
uauuugaaucuugucucaa

SEQ ID NO: 1778583 - RNA, 13 nt, Human
uauugcccacgcu

SEQ ID NO: 1778584 - RNA, 14 nt, Human
uauugcccacgcug

SEQ ID NO: 1778585 - RNA, 15 nt, Human
uauugcccacgcugg

SEQ ID NO: 1778586 - RNA, 14 nt, Human
uauuauuuuccaaa

SEQ ID NO: 1778587 - RNA, 13 nt, Human
uauuauuuuccaa

SEQ ID NO: 1778588 - RNA, 17 nt, Human
uauucauuauuugucaa

SEQ ID NO: 1778589 - RNA, 18 nt, Human
uauucauuauuugucaaa

SEQ ID NO: 1778590 - RNA, 19 nt, Human
uauucauuauuugucaaau

SEQ ID NO: 1778591 - RNA, 22 nt, Human
uauucauuauuugucaaauugu

SEQ ID NO: 1778592 - RNA, 23 nt, Human
uauucauuauuugucaaauuguc

SEQ ID NO: 1778593 - RNA, 23 nt, Human
uauugcacaugucuuaaugaagu

SEQ ID NO: 1778594 - RNA, 14 nt, Human
uauugcacaugucu

SEQ ID NO: 1778595 - RNA, 12 nt, Human
uauugcacaugu

SEQ ID NO: 1778596 - RNA, 22 nt, Human
uauugcacaugucuuaaugaag

SEQ ID NO: 1778597 - RNA, 20 nt, Human
uauugcacaugucuuaauga

SEQ ID NO: 1778598 - RNA, 17 nt, Human
uauugcacaugucuuaa

SEQ ID NO: 1778599 - RNA, 16 nt, Human
uauugcacaugucuua

SEQ ID NO: 1778600 - RNA, 17 nt, Human
uauuaaauaguuaauau

SEQ ID NO: 1778601 - RNA, 21 nt, Human
uauguugcccaggcaggucuu

SEQ ID NO: 1778602 - RNA, 21 nt, Human
uauguuaaacuagcauaucug

SEQ ID NO: 1778603 - RNA, 20 nt, Human
uauguuaaacuagcauaucu

SEQ ID NO: 1778604 - RNA, 21 nt, Human
uauguuauagaacuucaugga

SEQ ID NO: 1778605 - RNA, 22 nt, Human
uauguuauagaacuucauggau

SEQ ID NO: 1778606 - RNA, 12 nt, Human
uauuauuuucca

SEQ ID NO: 1778607 - RNA, 16 nt, Human
uauuaucaauguuuac

SEQ ID NO: 1778608 - RNA, 20 nt, Human
uauuauagagaguuaugaac

SEQ ID NO: 1778609 - RNA, 15 nt, Human
uauuauauaaacuuu

SEQ ID NO: 1778610 - RNA, 17 nt, Human
uauuauauuuacaaaug

SEQ ID NO: 1778611 - RNA, 15 nt, Human
ucaucuccugccuuc

SEQ ID NO: 1778612 - RNA, 18 nt, Human
ucaucuccugccuuccuc

SEQ ID NO: 1778613 - RNA, 18 nt, Human
ucauccacugugccaugu

SEQ ID NO: 1778614 - RNA, 14 nt, Human
ucauccacugugcc

SEQ ID NO: 1778615 - RNA, 17 nt, Human
ucauccacugugccaug

SEQ ID NO: 1778616 - RNA, 18 nt, Human
ucaucaugaguucugcug

SEQ ID NO: 1778617 - RNA, 13 nt, Human
ucauagaaauucu

SEQ ID NO: 1778618 - RNA, 17 nt, Human
ucauagaaauucuuuau

SEQ ID NO: 1778619 - RNA, 15 nt, Human
ucauagauguuuccu

SEQ ID NO: 1778620 - RNA, 13 nt, Human
ucaucauucucug

SEQ ID NO: 1778621 - RNA, 14 nt, Human
ucaucauucucugu

SEQ ID NO: 1778622 - RNA, 18 nt, Human
ucaucauucucugucuca

SEQ ID NO: 1778623 - RNA, 19 nt, Human
ucaucauucucugucucau

SEQ ID NO: 1778624 - RNA, 19 nt, Human
ucauuagccugaguagaaa

SEQ ID NO: 1778625 - RNA, 18 nt, Human
ucauuagccugaguagaa

SEQ ID NO: 1778626 - RNA, 20 nt, Human
ucauuagccugaguagaaag

SEQ ID NO: 1778627 - RNA, 14 nt, Human
ucauuuaauaauau

SEQ ID NO: 1778628 - RNA, 11 nt, Human
ucauuuaauaa

SEQ ID NO: 1778629 - RNA, 20 nt, Human
ucauuuaauaauauacuugu

SEQ ID NO: 1778630 - RNA, 18 nt, Human
ucauuuaauaauauacuu

SEQ ID NO: 1778631 - RNA, 21 nt, Human
ucauuuaauaauauacuugug

SEQ ID NO: 1778632 - RNA, 19 nt, Human
ucauuuaguuugauuauuc

SEQ ID NO: 1778633 - RNA, 15 nt, Human
uccaaaccuuaucuc

SEQ ID NO: 1778634 - RNA, 12 nt, Human
uccaaaacugcc

SEQ ID NO: 1778635 - RNA, 13 nt, Human
uccaaaacugccu

SEQ ID NO: 1778636 - RNA, 15 nt, Human
uccaaaaaucugccu

SEQ ID NO: 1778637 - RNA, 18 nt, Human
uccaaaaaucugccuggg

SEQ ID NO: 1778638 - RNA, 16 nt, Human
ucaggugauccaccca

SEQ ID NO: 1778639 - RNA, 23 nt, Human
ucaggugauccacccaccucagc

SEQ ID NO: 1778640 - RNA, 18 nt, Human
ucagguggggcagcuuga

SEQ ID NO: 1778641 - RNA, 19 nt, Human
ucagguggggcagcuugag

SEQ ID NO: 1778642 - RNA, 21 nt, Human
ucagucugauucccaagcucu

SEQ ID NO: 1778643 - RNA, 22 nt, Human
ucagucugauucccaagcucug

SEQ ID NO: 1778644 - RNA, 23 nt, Human
ucagucugauucccaagcucugc

SEQ ID NO: 1778645 - RNA, 19 nt, Human
ucagugauguaccaugaaa

SEQ ID NO: 1778646 - RNA, 14 nt, Human
ucaguauuuuuccu

SEQ ID NO: 1778647 - RNA, 20 nt, Human
ucagguggggcagcuugagg

SEQ ID NO: 1778648 - RNA, 14 nt, Human
ucagcucucugccc

SEQ ID NO: 1778649 - RNA, 15 nt, Human
ucagcucucugcccu

SEQ ID NO: 1778650 - RNA, 19 nt, Human
ucagcucucugcccugugu

SEQ ID NO: 1778651 - RNA, 20 nt, Human
ucagcucucugcccugugua

SEQ ID NO: 1778652 - RNA, 21 nt, Human
ucagcucucugcccuguguac

SEQ ID NO: 1778653 - RNA, 23 nt, Human
ucagcuccagcucaccagcccca

SEQ ID NO: 1778654 - RNA, 24 nt, Human
ucagcuccagcucaccagccccag

SEQ ID NO: 1778655 - RNA, 13 nt, Human
ucaccgugggcuc

SEQ ID NO: 1778656 - RNA, 15 nt, Human
ucaccgugggcuccc

SEQ ID NO: 1778657 - RNA, 16 nt, Human
ucaccgugggcucccu

SEQ ID NO: 1778658 - RNA, 17 nt, Human
ucaccgugggcucccug

SEQ ID NO: 1778659 - RNA, 18 nt, Human
ucaccgugggcucccuga

SEQ ID NO: 1778660 - RNA, 19 nt, Human
ucaccgugggcucccugac

SEQ ID NO: 1778661 - RNA, 18 nt, Human
ucaggccggcagccccag

SEQ ID NO: 1778662 - RNA, 21 nt, Human
ucaggccggcagccccagccu

SEQ ID NO: 1778663 - RNA, 22 nt, Human
ucaggcuacuauagguccagaa

SEQ ID NO: 1778664 - RNA, 22 nt, Human
ucaggccggcagccccagccug

SEQ ID NO: 1778665 - RNA, 23 nt, Human
ucaggccggcagccccagccugc

SEQ ID NO: 1778666 - RNA, 23 nt, Human
ucccagcugugcucuggacaggc

SEQ ID NO: 1778667 - RNA, 21 nt, Human
ucccagcugugcucuggacag

SEQ ID NO: 1778668 - RNA, 22 nt, Human
ucccagcugugcucuggacagg

SEQ ID NO: 1778669 - RNA, 17 nt, Human
ucccaggccccuggagg

SEQ ID NO: 1778670 - RNA, 19 nt, Human
ucccaggccccuggaggcu

SEQ ID NO: 1778671 - RNA, 21 nt, Human
ucccaggccccuggaggcugc

SEQ ID NO: 1778672 - RNA, 22 nt, Human
ucccaggccccuggaggcugcc

SEQ ID NO: 1778673 - RNA, 18 nt, Human
ucccaugagccucagcau

SEQ ID NO: 1778674 - RNA, 19 nt, Human
ucccaugagccucagcauc

SEQ ID NO: 1778675 - RNA, 20 nt, Human
uccaugugggcuaguugggc

SEQ ID NO: 1778676 - RNA, 23 nt, Human
uccaugggcagagcccaagggaa

SEQ ID NO: 1778677 - RNA, 13 nt, Human
ucccaccuuggcu

SEQ ID NO: 1778678 - RNA, 19 nt, Human
ucccaccugcaucuggggc

SEQ ID NO: 1778679 - RNA, 20 nt, Human
ucccaccugcaucuggggcc

SEQ ID NO: 1778680 - RNA, 16 nt, Human
ucccaccuuggcugca

SEQ ID NO: 1778681 - RNA, 17 nt, Human
ucccaccuuggcugcag

SEQ ID NO: 1778682 - RNA, 20 nt, Human
ucccagcugugcucuggaca

SEQ ID NO: 1778683 - RNA, 18 nt, Human
ucccaccuuggcugcagg

SEQ ID NO: 1778684 - RNA, 19 nt, Human
uccccagauugcaacaggc

SEQ ID NO: 1778685 - RNA, 20 nt, Human
uccccagauugcaacaggcu

SEQ ID NO: 1778686 - RNA, 22 nt, Human
uccccagauugcaacaggcugg

SEQ ID NO: 1778687 - RNA, 23 nt, Human
uccccagauugcaacaggcuggg

SEQ ID NO: 1778688 - RNA, 20 nt, Human
uccccagcaagugagagcug

SEQ ID NO: 1778689 - RNA, 21 nt, Human
uccccagcaagugagagcugg

SEQ ID NO: 1778690 - RNA, 22 nt, Human
uccccagcaagugagagcuggg

SEQ ID NO: 1778691 - RNA, 20 nt, Human
ucccaugagccucagcaucc

SEQ ID NO: 1778692 - RNA, 17 nt, Human
uccaugggaaagauggu

SEQ ID NO: 1778693 - RNA, 13 nt, Human
uccccagauugca

SEQ ID NO: 1778694 - RNA, 18 nt, Human
uccccagauugcaacagg

SEQ ID NO: 1778695 - RNA, 14 nt, Human
uccagggguccuag

SEQ ID NO: 1778696 - RNA, 19 nt, Human
uccagggguccuaggccuc

SEQ ID NO: 1778697 - RNA, 13 nt, Human
uccagaucccagg

SEQ ID NO: 1778698 - RNA, 16 nt, Human
uccagaucccaggccc

SEQ ID NO: 1778699 - RNA, 19 nt, Human
uccagaucccaggccccug

SEQ ID NO: 1778700 - RNA, 23 nt, Human
uccagaucccaggccccuggagg

SEQ ID NO: 1778701 - RNA, 16 nt, Human
uccagauccucucugg

SEQ ID NO: 1778702 - RNA, 17 nt, Human
uccagauccucucuggg

SEQ ID NO: 1778703 - RNA, 20 nt, Human
uccagauccucucuggggcu

SEQ ID NO: 1778704 - RNA, 22 nt, Human
uccaguuaaaaaaaauuuuaau

SEQ ID NO: 1778705 - RNA, 20 nt, Human
uccaugggccauaugaaaag

SEQ ID NO: 1778706 - RNA, 18 nt, Human
uccaugggagaaaauaga

SEQ ID NO: 1778707 - RNA, 15 nt, Human
uccaugggcagagcc

SEQ ID NO: 1778708 - RNA, 16 nt, Human
uccaugggcagagccc

SEQ ID NO: 1778709 - RNA, 17 nt, Human
uccaugggcagagccca

SEQ ID NO: 1778710 - RNA, 18 nt, Human
uccaugggcagagcccaa

SEQ ID NO: 1778711 - RNA, 22 nt, Human
uccaugggcagagcccaaggga

SEQ ID NO: 1778712 - RNA, 13 nt, Human
uccaucaucaugu

SEQ ID NO: 1778713 - RNA, 11 nt, Human
uccugccaaaa

SEQ ID NO: 1778714 - RNA, 19 nt, Human
uccugagaaaaaagguucc

SEQ ID NO: 1778715 - RNA, 24 nt, Human
uccugagaaaaaagguuccgcuug

SEQ ID NO: 1778716 - RNA, 13 nt, Human
uccugacugcccg

SEQ ID NO: 1778717 - RNA, 11 nt, Human
uccuccucugu

SEQ ID NO: 1778718 - RNA, 14 nt, Human
uccuccucugacuu

SEQ ID NO: 1778719 - RNA, 13 nt, Human
uccuccucuguga

SEQ ID NO: 1778720 - RNA, 12 nt, Human
uccuccucugug

SEQ ID NO: 1778721 - RNA, 19 nt, Human
uccucugugaccaaugucu

SEQ ID NO: 1778722 - RNA, 21 nt, Human
uccucugugaccaaugucuug

SEQ ID NO: 1778723 - RNA, 20 nt, Human
uccucugugaccaaugucuu

SEQ ID NO: 1778724 - RNA, 12 nt, Human
uccucugugaag

SEQ ID NO: 1778725 - RNA, 21 nt, Human
uccuggacaugaagauucuuu

SEQ ID NO: 1778726 - RNA, 22 nt, Human
uccuggacaugaagauucuuuc

SEQ ID NO: 1778727 - RNA, 13 nt, Human
uccuggccugaga

SEQ ID NO: 1778728 - RNA, 17 nt, Human
uccuggccugagaguca

SEQ ID NO: 1778729 - RNA, 12 nt, Human
uccuggccucaa

SEQ ID NO: 1778730 - RNA, 23 nt, Human
uccuggcacccggccccugcugg

SEQ ID NO: 1778731 - RNA, 14 nt, Human
ucccuuccuauucc

SEQ ID NO: 1778732 - RNA, 20 nt, Human
ucccuugccuuucgaggccu

SEQ ID NO: 1778733 - RNA, 21 nt, Human
ucccuugccuuucgaggccug

SEQ ID NO: 1778734 - RNA, 22 nt, Human
ucccuugccuuucgaggccuga

SEQ ID NO: 1778735 - RNA, 14 nt, Human
uccgccucuugggu

SEQ ID NO: 1778736 - RNA, 13 nt, Human
uccgccuccagga

SEQ ID NO: 1778737 - RNA, 14 nt, Human
uccgcaucccuacc

SEQ ID NO: 1778738 - RNA, 21 nt, Human
uccgcaucccuaccgacccag

SEQ ID NO: 1778739 - RNA, 12 nt, Human
uccgcaggacuu

SEQ ID NO: 1778740 - RNA, 18 nt, Human
uccgcuuucuacccagcg

SEQ ID NO: 1778741 - RNA, 20 nt, Human
uccgcuuucuacccagcgag

SEQ ID NO: 1778742 - RNA, 16 nt, Human
uccgcuuucuacccag

SEQ ID NO: 1778743 - RNA, 12 nt, Human
uccucccaccuc

SEQ ID NO: 1778744 - RNA, 13 nt, Human
uccucccaccuca

SEQ ID NO: 1778745 - RNA, 12 nt, Human
uccuccauggga

SEQ ID NO: 1778746 - RNA, 13 nt, Human
uccuccaggagcu

SEQ ID NO: 1778747 - RNA, 17 nt, Human
uccuccaggagcuucuu

SEQ ID NO: 1778748 - RNA, 19 nt, Human
uccuccaggagcuucuugu

SEQ ID NO: 1778749 - RNA, 21 nt, Human
uccuccagggaugaucaacag

SEQ ID NO: 1778750 - RNA, 19 nt, Human
uccuccacguucugcucau

SEQ ID NO: 1778751 - RNA, 22 nt, Human
uccuagugcuuuccuuuuuuaa

SEQ ID NO: 1778752 - RNA, 15 nt, Human
uccuacccugccucc

SEQ ID NO: 1778753 - RNA, 19 nt, Human
uccuaguaagcaucuacuu

SEQ ID NO: 1778754 - RNA, 13 nt, Human
ucuccccucagcu

SEQ ID NO: 1778755 - RNA, 11 nt, Human
ucuccaggcug

SEQ ID NO: 1778756 - RNA, 13 nt, Human
ucuccagcuuccc

SEQ ID NO: 1778757 - RNA, 13 nt, Human
ucuccaggcauuu

SEQ ID NO: 1778758 - RNA, 14 nt, Human
ucuccccucagcuc

SEQ ID NO: 1778759 - RNA, 16 nt, Human
ucucaugaggggagag

SEQ ID NO: 1778760 - RNA, 20 nt, Human
ucucaugaggggagaggaga

SEQ ID NO: 1778761 - RNA, 22 nt, Human
ucucaugaggggagaggagacg

SEQ ID NO: 1778762 - RNA, 13 nt, Human
ucuccacccugcu

SEQ ID NO: 1778763 - RNA, 17 nt, Human
ucuccacccugcucucc

SEQ ID NO: 1778764 - RNA, 14 nt, Human
ucuccacccugcuc

SEQ ID NO: 1778765 - RNA, 16 nt, Human
ucuccacccugcucuc

SEQ ID NO: 1778766 - RNA, 23 nt, Human
ucuaugcuuuccaaaccuuaucu

SEQ ID NO: 1778767 - RNA, 19 nt, Human
ucuaugggacucaaugcac

SEQ ID NO: 1778768 - RNA, 12 nt, Human
ucuaugggacuc

SEQ ID NO: 1778769 - RNA, 13 nt, Human
ucuaugggacuca

SEQ ID NO: 1778770 - RNA, 11 nt, Human
ucucagucucu

SEQ ID NO: 1778771 - RNA, 13 nt, Human
ucucagucucuga

SEQ ID NO: 1778772 - RNA, 18 nt, Human
ucucagucucugagcagu

SEQ ID NO: 1778773 - RNA, 15 nt, Human
ucucagucucugagc

SEQ ID NO: 1778774 - RNA, 17 nt, Human
ucucagucucugagcag

SEQ ID NO: 1778775 - RNA, 20 nt, Human
ucuacuugccagaaccaaau

SEQ ID NO: 1778776 - RNA, 22 nt, Human
ucuacuugccagaaccaaauua

SEQ ID NO: 1778777 - RNA, 15 nt, Human
ucuacagaggccaug

SEQ ID NO: 1778778 - RNA, 16 nt, Human
ucuacagaggccaugg

SEQ ID NO: 1778779 - RNA, 16 nt, Human
ucuacaccuugcuuuu

SEQ ID NO: 1778780 - RNA, 21 nt, Human
ucuacaccuugcuuuuuuacu

SEQ ID NO: 1778781 - RNA, 16 nt, Human
ucuacagagcuucccu

SEQ ID NO: 1778782 - RNA, 17 nt, Human
ucuacagagcuucccug

SEQ ID NO: 1778783 - RNA, 18 nt, Human
ucuacagagcuucccuga

SEQ ID NO: 1778784 - RNA, 19 nt, Human
ucuacagagcuucccugac

SEQ ID NO: 1778785 - RNA, 14 nt, Human
ucuaucagagaaaa

SEQ ID NO: 1778786 - RNA, 22 nt, Human
ucuaucauuuaauaauauacuu

SEQ ID NO: 1778787 - RNA, 18 nt, Human
ucuaucauuuaauaauau

SEQ ID NO: 1778788 - RNA, 17 nt, Human
ucuaucauuuaauaaua

SEQ ID NO: 1778789 - RNA, 16 nt, Human
ucuaucauuuaauaau

SEQ ID NO: 1778790 - RNA, 15 nt, Human
ucuaucauuuaauaa

SEQ ID NO: 1778791 - RNA, 14 nt, Human
ucuaucauuuaaua

SEQ ID NO: 1778792 - RNA, 13 nt, Human
ucuaucauuuaau

SEQ ID NO: 1778793 - RNA, 12 nt, Human
ucuaucauuuaa

SEQ ID NO: 1778794 - RNA, 13 nt, Human
ucgugacaacacu

SEQ ID NO: 1778795 - RNA, 11 nt, Human
ugaauguuaaa

SEQ ID NO: 1778796 - RNA, 21 nt, Human
ugaauguuaaauaaauuguau

SEQ ID NO: 1778797 - RNA, 20 nt, Human
ugaauguuaaauaaauugua

SEQ ID NO: 1778798 - RNA, 18 nt, Human
ugaauguuaaauaaauug

SEQ ID NO: 1778799 - RNA, 16 nt, Human
ugaauguuaaauaaau

SEQ ID NO: 1778800 - RNA, 15 nt, Human
ugaauguuaaauaaa

SEQ ID NO: 1778801 - RNA, 13 nt, Human
ugaauguuaaaua

SEQ ID NO: 1778802 - RNA, 20 nt, Human
ugaauucuugguugaggaaa

SEQ ID NO: 1778803 - RNA, 23 nt, Human
ugaauucggaacuguccuuuccu

SEQ ID NO: 1778804 - RNA, 22 nt, Human
ugaauucuugguugaggaaaca

SEQ ID NO: 1778805 - RNA, 21 nt, Human
ugaauucuugguugaggaaac

SEQ ID NO: 1778806 - RNA, 15 nt, Human
ugaaggaacuugucu

SEQ ID NO: 1778807 - RNA, 20 nt, Human
ugaaggaacuugucucuuca

SEQ ID NO: 1778808 - RNA, 17 nt, Human
ugaacuccuggccucaa

SEQ ID NO: 1778809 - RNA, 13 nt, Human
ugaaccaaugcaa

SEQ ID NO: 1778810 - RNA, 14 nt, Human
ugaaccaaugcaag

SEQ ID NO: 1778811 - RNA, 22 nt, Human
ugaaggacauugcggacagcca

SEQ ID NO: 1778812 - RNA, 19 nt, Human
ugaaggacauugcggacag

SEQ ID NO: 1778813 - RNA, 20 nt, Human
ugaaggacauugcggacagc

SEQ ID NO: 1778814 - RNA, 11 nt, Human
ugaauaaagaa

SEQ ID NO: 1778815 - RNA, 15 nt, Human
ugaauaaagaauacu

SEQ ID NO: 1778816 - RNA, 16 nt, Human
ugaauaaagaauacuu

SEQ ID NO: 1778817 - RNA, 17 nt, Human
ugaauaaagaauacuug

SEQ ID NO: 1778818 - RNA, 18 nt, Human
ugaauaaagaauacuuga

SEQ ID NO: 1778819 - RNA, 19 nt, Human
ugaauaaagaauacuugaa

SEQ ID NO: 1778820 - RNA, 20 nt, Human
ugaauaaagaauacuugaac

SEQ ID NO: 1778821 - RNA, 22 nt, Human
ugaauaaagaauacuugaacuu

SEQ ID NO: 1778822 - RNA, 21 nt, Human
ugacauacgcuuuuaaugaaa

SEQ ID NO: 1778823 - RNA, 13 nt, Human
ugacagaggcagc

SEQ ID NO: 1778824 - RNA, 20 nt, Human
ugacagacacaggcccggcu

SEQ ID NO: 1778825 - RNA, 23 nt, Human
ugacagacacaggcccggcucca

SEQ ID NO: 1778826 - RNA, 14 nt, Human
ugacagaggcagcc

SEQ ID NO: 1778827 - RNA, 15 nt, Human
ugacagaggcagccc

SEQ ID NO: 1778828 - RNA, 16 nt, Human
ugacagaggcagcccc

SEQ ID NO: 1778829 - RNA, 17 nt, Human
ugacagaggcagcccca

SEQ ID NO: 1778830 - RNA, 18 nt, Human
ugacagaggcagccccau

SEQ ID NO: 1778831 - RNA, 23 nt, Human
ugacagaggcagccccauucugc

SEQ ID NO: 1778832 - RNA, 14 nt, Human
ugacagagugagac

SEQ ID NO: 1778833 - RNA, 17 nt, Human
ugacagagugagacucu

SEQ ID NO: 1778834 - RNA, 19 nt, Human
ugacagagugagacucugu

SEQ ID NO: 1778835 - RNA, 18 nt, Human
ugacaaggauugcuacug

SEQ ID NO: 1778836 - RNA, 18 nt, Human
ugaauuguaacuguucuu

SEQ ID NO: 1778837 - RNA, 15 nt, Human
ugacaauaaaauauu

SEQ ID NO: 1778838 - RNA, 20 nt, Human
ugacaauaaaauauuauuga

SEQ ID NO: 1778839 - RNA, 16 nt, Human
ucuuguucugagauuc

SEQ ID NO: 1778840 - RNA, 20 nt, Human
ucuuguucugagauucaaua

SEQ ID NO: 1778841 - RNA, 15 nt, Human
ucuuguuuccuuguu

SEQ ID NO: 1778842 - RNA, 11 nt, Human
ucuuucaaaac

SEQ ID NO: 1778843 - RNA, 20 nt, Human
ucuuucaaaaccuuuugaaa

SEQ ID NO: 1778844 - RNA, 21 nt, Human
ucuuucaaaaccuuuugaaau

SEQ ID NO: 1778845 - RNA, 23 nt, Human
ucuuucaaaaccuuuugaaauua

SEQ ID NO: 1778846 - RNA, 18 nt, Human
ucuuucaaaccagcuuca

SEQ ID NO: 1778847 - RNA, 11 nt, Human
ucuugcuggcu

SEQ ID NO: 1778848 - RNA, 23 nt, Human
ucuugcuggcuacgccucuucug

SEQ ID NO: 1778849 - RNA, 19 nt, Human
ucuuuccacggagccacuc

SEQ ID NO: 1778850 - RNA, 22 nt, Human
ucuuuccacggagccacuccuc

SEQ ID NO: 1778851 - RNA, 23 nt, Human
ucuuuccacggagccacuccucu

SEQ ID NO: 1778852 - RNA, 23 nt, Human
ucuuucuuugggaauauuugaau

SEQ ID NO: 1778853 - RNA, 22 nt, Human
ucuuucuuugggaauauuugaa

SEQ ID NO: 1778854 - RNA, 15 nt, Human
ucuuucuuucuuaga

SEQ ID NO: 1778855 - RNA, 20 nt, Human
ucuuuccauuggaucucauu

SEQ ID NO: 1778856 - RNA, 12 nt, Human
ucuuugccaagu

SEQ ID NO: 1778857 - RNA, 19 nt, Human
ugaaccacaucuugcucug

SEQ ID NO: 1778858 - RNA, 23 nt, Human
ugaaccacaucuugcucugcuga

SEQ ID NO: 1778859 - RNA, 17 nt, Human
ugaaccaccacacccag

SEQ ID NO: 1778860 - RNA, 20 nt, Human
ugaaccaccacacccagccc

SEQ ID NO: 1778861 - RNA, 16 nt, Human
ugaacuccuggccuca

SEQ ID NO: 1778862 - RNA, 23 nt, Human
ugaacaagcaaacccagacggcu

SEQ ID NO: 1778863 - RNA, 11 nt, Human
ugaaauucuga

SEQ ID NO: 1778864 - RNA, 12 nt, Human
ugaaauucugaa

SEQ ID NO: 1778865 - RNA, 13 nt, Human
ugaaauucugaau

SEQ ID NO: 1778866 - RNA, 14 nt, Human
ugaaauucugaauu

SEQ ID NO: 1778867 - RNA, 15 nt, Human
ugaaagguuuacauu

SEQ ID NO: 1778868 - RNA, 17 nt, Human
ugaaauuaaccucucac

SEQ ID NO: 1778869 - RNA, 14 nt, Human
ugaaauuaaccucu

SEQ ID NO: 1778870 - RNA, 15 nt, Human
ugaaacccuggacca

SEQ ID NO: 1778871 - RNA, 21 nt, Human
ugaaacccuggaccagugguc

SEQ ID NO: 1778872 - RNA, 13 nt, Human
ugaaagggcccag

SEQ ID NO: 1778873 - RNA, 15 nt, Human
ugaaagggcccagag

SEQ ID NO: 1778874 - RNA, 21 nt, Human
ugaaaggugccauggaagagg

SEQ ID NO: 1778875 - RNA, 20 nt, Human
ugaaaccaguguuagggaag

SEQ ID NO: 1778876 - RNA, 11 nt, Human
ugaaacccagu

SEQ ID NO: 1778877 - RNA, 20 nt, Human
ugaaacccagucacugugag

SEQ ID NO: 1778878 - RNA, 14 nt, Human
ugaaacaaagcugc

SEQ ID NO: 1778879 - RNA, 19 nt, Human
ugaaaagcuccaucaauga

SEQ ID NO: 1778880 - RNA, 20 nt, Human
ugaaaagcuccauuuuuagu

SEQ ID NO: 1778881 - RNA, 19 nt, Human
ugagucgaggacagggagg

SEQ ID NO: 1778882 - RNA, 21 nt, Human
ugagugaaauacuguacaggg

SEQ ID NO: 1778883 - RNA, 14 nt, Human
ugaguucugcugaa

SEQ ID NO: 1778884 - RNA, 14 nt, Human
ugagggagccuggc

SEQ ID NO: 1778885 - RNA, 20 nt, Human
ugaccucaggugauccaccc

SEQ ID NO: 1778886 - RNA, 21 nt, Human
ugaccucaggugauccaccca

SEQ ID NO: 1778887 - RNA, 18 nt, Human
ugagacccagcccucauc

SEQ ID NO: 1778888 - RNA, 20 nt, Human
ugagacccagcccucauccc

SEQ ID NO: 1778889 - RNA, 12 nt, Human
ugagcagggcuc

SEQ ID NO: 1778890 - RNA, 13 nt, Human
ugagcagggcuca

SEQ ID NO: 1778891 - RNA, 14 nt, Human
ugagcagggcucag

SEQ ID NO: 1778892 - RNA, 15 nt, Human
ugagcagggcucagc

SEQ ID NO: 1778893 - RNA, 17 nt, Human
ugagagucagcucucug

SEQ ID NO: 1778894 - RNA, 19 nt, Human
ugagagucagcucucugcc

SEQ ID NO: 1778895 - RNA, 21 nt, Human
ugagagucagcucucugcccu

SEQ ID NO: 1778896 - RNA, 22 nt, Human
ugagagucagcucucugcccug

SEQ ID NO: 1778897 - RNA, 19 nt, Human
ugagaguuuuggaugcagu

SEQ ID NO: 1778898 - RNA, 17 nt, Human
ugagaguuuuggaugca

SEQ ID NO: 1778899 - RNA, 15 nt, Human
ugagaguuuuggaug

SEQ ID NO: 1778900 - RNA, 22 nt, Human
ugagcccucagaacccuuggcu

SEQ ID NO: 1778901 - RNA, 19 nt, Human
ugagccgagaucacgccac

SEQ ID NO: 1778902 - RNA, 21 nt, Human
ugagccgagaucacgccacug

SEQ ID NO: 1778903 - RNA, 17 nt, Human
ugagccucagcauccug

SEQ ID NO: 1778904 - RNA, 22 nt, Human
ugagccucagcauccuggcacc

SEQ ID NO: 1778905 - RNA, 18 nt, Human
ugagccucagcauccugg

SEQ ID NO: 1778906 - RNA, 21 nt, Human
ugagccucagcauccuggcac

SEQ ID NO: 1778907 - RNA, 17 nt, Human
ugagcucuacccagggc

SEQ ID NO: 1778908 - RNA, 18 nt, Human
ugagcucuacccagggcc

SEQ ID NO: 1778909 - RNA, 19 nt, Human
ugagcucuacccagggccu

SEQ ID NO: 1778910 - RNA, 22 nt, Human
ugagcucuacccagggccugca

SEQ ID NO: 1778911 - RNA, 13 nt, Human
ugagccugcugga

SEQ ID NO: 1778912 - RNA, 17 nt, Human
ugagccugcuggaagcc

SEQ ID NO: 1778913 - RNA, 19 nt, Human
ugagcagggcucagcgggg

SEQ ID NO: 1778914 - RNA, 16 nt, Human
ugagcagggcucagcg

SEQ ID NO: 1778915 - RNA, 17 nt, Human
ugagcagggcucagcgg

SEQ ID NO: 1778916 - RNA, 13 nt, Human
ugauccaagcugg

SEQ ID NO: 1778917 - RNA, 14 nt, Human
ugauccaagcuggu

SEQ ID NO: 1778918 - RNA, 15 nt, Human
ugauccaagcugguc

SEQ ID NO: 1778919 - RNA, 17 nt, Human
ugauccaagcugguccc

SEQ ID NO: 1778920 - RNA, 18 nt, Human
ugauccaagcaagacuga

SEQ ID NO: 1778921 - RNA, 12 nt, Human
ugaucaggaccu

SEQ ID NO: 1778922 - RNA, 20 nt, Human
ugaucaggaccuccaagcca

SEQ ID NO: 1778923 - RNA, 13 nt, Human
ugauagcaaagcg

SEQ ID NO: 1778924 - RNA, 13 nt, Human
ugaucuguugcaa

SEQ ID NO: 1778925 - RNA, 17 nt, Human
ugauccacccaccucag

SEQ ID NO: 1778926 - RNA, 18 nt, Human
ugauccacccaccucagc

SEQ ID NO: 1778927 - RNA, 19 nt, Human
ugauccacccaccucagcc

SEQ ID NO: 1778928 - RNA, 18 nt, Human
ugaucuuugcagacaggc

SEQ ID NO: 1778929 - RNA, 16 nt, Human
ugaucuuugcagacag

SEQ ID NO: 1778930 - RNA, 23 nt, Human
ugaugcaugcacuguucccccug

SEQ ID NO: 1778931 - RNA, 17 nt, Human
ugaugcaugcacuguuc

SEQ ID NO: 1778932 - RNA, 18 nt, Human
ugaugcaugcacuguucc

SEQ ID NO: 1778933 - RNA, 20 nt, Human
ugaugcuacaggauuugaaa

SEQ ID NO: 1778934 - RNA, 23 nt, Human
ugaugcuacaggauuugaaauug

SEQ ID NO: 1778935 - RNA, 21 nt, Human
ugauucuccugccucagccuc

SEQ ID NO: 1778936 - RNA, 13 nt, Human
ugauuauauguca

SEQ ID NO: 1778937 - RNA, 12 nt, Human
ugauucaagcca

SEQ ID NO: 1778938 - RNA, 21 nt, Human
ugauucaagccauuccaaagu

SEQ ID NO: 1778939 - RNA, 14 nt, Human
ugauucaacuaaaa

SEQ ID NO: 1778940 - RNA, 23 nt, Human
ugauucaacuaaaaaaaaaaaag

SEQ ID NO: 1778941 - RNA, 14 nt, Human
ugauuauucagugu

SEQ ID NO: 1778942 - RNA, 16 nt, Human
ugauuauucaguguca

SEQ ID NO: 1778943 - RNA, 20 nt, Human
ugcugguuuuaucugaguga

SEQ ID NO: 1778944 - RNA, 15 nt, Human
ugcuguggugugucc

SEQ ID NO: 1778945 - RNA, 16 nt, Human
ugcugugguguguccc

SEQ ID NO: 1778946 - RNA, 17 nt, Human
ugcuguggugugucccc

SEQ ID NO: 1778947 - RNA, 23 nt, Human
ugcuguggugugucccccucugu

SEQ ID NO: 1778948 - RNA, 21 nt, Human
ugcugcuucugaauacaaauu

SEQ ID NO: 1778949 - RNA, 20 nt, Human
ugcugggauuacagguguga

SEQ ID NO: 1778950 - RNA, 23 nt, Human
ugccucuaccugacacucccuug

SEQ ID NO: 1778951 - RNA, 15 nt, Human
ugccucuaccugaca

SEQ ID NO: 1778952 - RNA, 17 nt, Human
ugccucuaccugacacu

SEQ ID NO: 1778953 - RNA, 24 nt, Human
ugccucggcuuuucucagcuggau

SEQ ID NO: 1778954 - RNA, 20 nt, Human
ugccucggcuuuucucagcu

SEQ ID NO: 1778955 - RNA, 21 nt, Human
ugccucggcuuuucucagcug

SEQ ID NO: 1778956 - RNA, 15 nt, Human
ugcgccaguccugcu

SEQ ID NO: 1778957 - RNA, 16 nt, Human
ugcgccaguccugcua

SEQ ID NO: 1778958 - RNA, 12 nt, Human
ugcgccugcugc

SEQ ID NO: 1778959 - RNA, 17 nt, Human
ugcgccaccgcccagag

SEQ ID NO: 1778960 - RNA, 14 nt, Human
ugcgcagugccuug

SEQ ID NO: 1778961 - RNA, 20 nt, Human
ugcgcauucuaaccuggagg

SEQ ID NO: 1778962 - RNA, 21 nt, Human
ugcgcauucuaaccuggaggu

SEQ ID NO: 1778963 - RNA, 21 nt, Human
ugcuacuguccuacccacccu

SEQ ID NO: 1778964 - RNA, 22 nt, Human
ugcuacuguccuacccacccuc

SEQ ID NO: 1778965 - RNA, 17 nt, Human
ugcggacagccacggcc

SEQ ID NO: 1778966 - RNA, 14 nt, Human
ugcggaaucagcuu

SEQ ID NO: 1778967 - RNA, 15 nt, Human
ugcggaaucagcuuc

SEQ ID NO: 1778968 - RNA, 17 nt, Human
ugcucacauaucuguca

SEQ ID NO: 1778969 - RNA, 16 nt, Human
ugcucagaacuugcug

SEQ ID NO: 1778970 - RNA, 17 nt, Human
ugcucagaacuugcugc

SEQ ID NO: 1778971 - RNA, 20 nt, Human
ugcucagaacuugcugcugu

SEQ ID NO: 1778972 - RNA, 21 nt, Human
ugcucagaacuugcugcuguc

SEQ ID NO: 1778973 - RNA, 22 nt, Human
ugcucagaacuugcugcugucu

SEQ ID NO: 1778974 - RNA, 16 nt, Human
ugcucacguuaccuug

SEQ ID NO: 1778975 - RNA, 21 nt, Human
ugcucacguuaccuugacaca

SEQ ID NO: 1778976 - RNA, 22 nt, Human
ugcucacguuaccuugacacau

SEQ ID NO: 1778977 - RNA, 23 nt, Human
ugcucuccgaccagacaccuuga

SEQ ID NO: 1778978 - RNA, 19 nt, Human
ugcucgcuguugcugaaua

SEQ ID NO: 1778979 - RNA, 16 nt, Human
ugcucauaacggauca

SEQ ID NO: 1778980 - RNA, 14 nt, Human
ugcucauaacggau

SEQ ID NO: 1778981 - RNA, 18 nt, Human
ugccaaagggaaauauca

SEQ ID NO: 1778982 - RNA, 14 nt, Human
ugccaaagggaaau

SEQ ID NO: 1778983 - RNA, 20 nt, Human
ugccaggaccagucaaccug

SEQ ID NO: 1778984 - RNA, 15 nt, Human
ugccacgaauuucug

SEQ ID NO: 1778985 - RNA, 16 nt, Human
ugccacgaauuucugu

SEQ ID NO: 1778986 - RNA, 23 nt, Human
ugccacgaauuucugugcccucc

SEQ ID NO: 1778987 - RNA, 15 nt, Human
ugccaacaauccuag

SEQ ID NO: 1778988 - RNA, 21 nt, Human
ugccaacaauccuagugcuuu

SEQ ID NO: 1778989 - RNA, 20 nt, Human
ugccaacaauccuagugcuu

SEQ ID NO: 1778990 - RNA, 11 nt, Human
ugcaguuugaa

SEQ ID NO: 1778991 - RNA, 12 nt, Human
ugcaguuugaaa

SEQ ID NO: 1778992 - RNA, 13 nt, Human
ugcaguuugaaau

SEQ ID NO: 1778993 - RNA, 14 nt, Human
ugcaguuugaaauu

SEQ ID NO: 1778994 - RNA, 15 nt, Human
ugcaguuugaaauuc

SEQ ID NO: 1778995 - RNA, 16 nt, Human
ugcaguuugaaauucu

SEQ ID NO: 1778996 - RNA, 17 nt, Human
ugcaguuugaaauucug

SEQ ID NO: 1778997 - RNA, 18 nt, Human
ugcaguuugaaauucuga

SEQ ID NO: 1778998 - RNA, 19 nt, Human
ugcaguuugaaauucugaa

SEQ ID NO: 1778999 - RNA, 20 nt, Human
ugcaguuugaaauucugaau

SEQ ID NO: 1779000 - RNA, 21 nt, Human
ugcaguuugaaauucugaauu

SEQ ID NO: 1779001 - RNA, 22 nt, Human
ugcaguuugaaauucugaauuu

SEQ ID NO: 1779002 - RNA, 23 nt, Human
ugcaguuugaaauucugaauuug

SEQ ID NO: 1779003 - RNA, 13 nt, Human
ugcagggaguccg

SEQ ID NO: 1779004 - RNA, 15 nt, Human
ugcagggaaaauuau

SEQ ID NO: 1779005 - RNA, 20 nt, Human
ugcagggaaaauuauuugca

SEQ ID NO: 1779006 - RNA, 21 nt, Human
ugcagggaaaauuauuugcau

SEQ ID NO: 1779007 - RNA, 22 nt, Human
ugcagggaaaauuauuugcaua

SEQ ID NO: 1779008 - RNA, 21 nt, Human
ugcaguggugcgaucuggguu

SEQ ID NO: 1779009 - RNA, 18 nt, Human
ugcccaggcuggcgugca

SEQ ID NO: 1779010 - RNA, 19 nt, Human
ugcccaggcuggcgugcag

SEQ ID NO: 1779011 - RNA, 20 nt, Human
ugcccaggcuggcgugcagu

SEQ ID NO: 1779012 - RNA, 14 nt, Human
ugccccaaacaaau

SEQ ID NO: 1779013 - RNA, 20 nt, Human
ugccccaaacaaauaugcaa

SEQ ID NO: 1779014 - RNA, 20 nt, Human
ugccccaccccuccccauua

SEQ ID NO: 1779015 - RNA, 12 nt, Human
ugcccggcugcg

SEQ ID NO: 1779016 - RNA, 14 nt, Human
ugcccggcugcgga

SEQ ID NO: 1779017 - RNA, 22 nt, Human
ugcccggcacagaugcuccagg

SEQ ID NO: 1779018 - RNA, 18 nt, Human
ugccccuuucucuuuucc

SEQ ID NO: 1779019 - RNA, 16 nt, Human
ugcccgagggagggga

SEQ ID NO: 1779020 - RNA, 13 nt, Human
ugccccagcccag

SEQ ID NO: 1779021 - RNA, 14 nt, Human
ugccccagcccaga

SEQ ID NO: 1779022 - RNA, 12 nt, Human
ugcccuggcucc

SEQ ID NO: 1779023 - RNA, 14 nt, Human
ugcccuggcuccag

SEQ ID NO: 1779024 - RNA, 21 nt, Human
ugcccuggcuccagugaaacu

SEQ ID NO: 1779025 - RNA, 14 nt, Human
ugccuauuugugug

SEQ ID NO: 1779026 - RNA, 17 nt, Human
ugccuauuuguguggac

SEQ ID NO: 1779027 - RNA, 15 nt, Human
uggggaugagaaagg

SEQ ID NO: 1779028 - RNA, 23 nt, Human
uggggaugagaaagguugaagca

SEQ ID NO: 1779029 - RNA, 14 nt, Human
ugggggagagccgu

SEQ ID NO: 1779030 - RNA, 11 nt, Human
ugggggagggc

SEQ ID NO: 1779031 - RNA, 16 nt, Human
ugggggagggcugcga

SEQ ID NO: 1779032 - RNA, 16 nt, Human
ugggcagagcugcauc

SEQ ID NO: 1779033 - RNA, 11 nt, Human
ugggggugggu

SEQ ID NO: 1779034 - RNA, 13 nt, Human
uggggguggguca

SEQ ID NO: 1779035 - RNA, 14 nt, Human
ugggggugggucag

SEQ ID NO: 1779036 - RNA, 15 nt, Human
ugggggugggucaga

SEQ ID NO: 1779037 - RNA, 10 nt, Human
uggggguggg

SEQ ID NO: 1779038 - RNA, 17 nt, Human
uggguacuuguggacac

SEQ ID NO: 1779039 - RNA, 18 nt, Human
uggguacuuguggacaca

SEQ ID NO: 1779040 - RNA, 17 nt, Human
uggguauaaaagauggg

SEQ ID NO: 1779041 - RNA, 15 nt, Human
uggguauaaaagaug

SEQ ID NO: 1779042 - RNA, 14 nt, Human
uggguauaaaagau

SEQ ID NO: 1779043 - RNA, 22 nt, Human
ugggauuacaagcgugagccac

SEQ ID NO: 1779044 - RNA, 16 nt, Human
uggcugggggccucag

SEQ ID NO: 1779045 - RNA, 17 nt, Human
uggcugggggccucagu

SEQ ID NO: 1779046 - RNA, 20 nt, Human
uggcugggggccucagugcc

SEQ ID NO: 1779047 - RNA, 13 nt, Human
ugggcccucucug

SEQ ID NO: 1779048 - RNA, 16 nt, Human
ugggcccucucugcuc

SEQ ID NO: 1779049 - RNA, 18 nt, Human
ugggcccucucugcucug

SEQ ID NO: 1779050 - RNA, 13 nt, Human
ugggcccucucuu

SEQ ID NO: 1779051 - RNA, 13 nt, Human
ugggcagagccca

SEQ ID NO: 1779052 - RNA, 14 nt, Human
ugggcagagcccaa

SEQ ID NO: 1779053 - RNA, 12 nt, Human
ugguccuuuggg

SEQ ID NO: 1779054 - RNA, 13 nt, Human
uggugaccucugc

SEQ ID NO: 1779055 - RNA, 14 nt, Human
uggugaccucugcc

SEQ ID NO: 1779056 - RNA, 19 nt, Human
uggugauccaaacaaaaug

SEQ ID NO: 1779057 - RNA, 15 nt, Human
uggugaccucugccu

SEQ ID NO: 1779058 - RNA, 16 nt, Human
uggugaccucugccug

SEQ ID NO: 1779059 - RNA, 17 nt, Human
uggugaccucugccuga

SEQ ID NO: 1779060 - RNA, 22 nt, Human
uggugaccucugccugaaguca

SEQ ID NO: 1779061 - RNA, 23 nt, Human
ugguauuguauuuauucaauaaa

SEQ ID NO: 1779062 - RNA, 13 nt, Human
ugguaugucugcc

SEQ ID NO: 1779063 - RNA, 17 nt, Human
ugguccuagaggcccuu

SEQ ID NO: 1779064 - RNA, 21 nt, Human
ugguccuagaggcccuuugcu

SEQ ID NO: 1779065 - RNA, 22 nt, Human
ugguccuagaggcccuuugcug

SEQ ID NO: 1779066 - RNA, 13 nt, Human
uggucccugagga

SEQ ID NO: 1779067 - RNA, 14 nt, Human
uggcuccucccagc

SEQ ID NO: 1779068 - RNA, 20 nt, Human
uggccccugcccggcugcgg

SEQ ID NO: 1779069 - RNA, 15 nt, Human
uggccccugcccggc

SEQ ID NO: 1779070 - RNA, 16 nt, Human
uggccccugcccggcu

SEQ ID NO: 1779071 - RNA, 13 nt, Human
uggccaggcuggu

SEQ ID NO: 1779072 - RNA, 17 nt, Human
uggcccaggugaguccu

SEQ ID NO: 1779073 - RNA, 15 nt, Human
uggcagaguccugga

SEQ ID NO: 1779074 - RNA, 13 nt, Human
uggccagccuaca

SEQ ID NO: 1779075 - RNA, 19 nt, Human
uggccagaugcaccagccc

SEQ ID NO: 1779076 - RNA, 13 nt, Human
uggcagagcuucu

SEQ ID NO: 1779077 - RNA, 17 nt, Human
uggccagaugcaccagc

SEQ ID NO: 1779078 - RNA, 18 nt, Human
uggccagaugcaccagcc

SEQ ID NO: 1779079 - RNA, 23 nt, Human
uggauaagcuauccguguugcag

SEQ ID NO: 1779080 - RNA, 14 nt, Human
uggaggcaauccua

SEQ ID NO: 1779081 - RNA, 20 nt, Human
uggaggcaauccuaccuugc

SEQ ID NO: 1779082 - RNA, 17 nt, Human
uggacugaccuggucca

SEQ ID NO: 1779083 - RNA, 19 nt, Human
uggacugaccugguccaca

SEQ ID NO: 1779084 - RNA, 18 nt, Human
ugcuguuguccaacuauu

SEQ ID NO: 1779085 - RNA, 23 nt, Human
ugcuguuguccaacuauuuauug

SEQ ID NO: 1779086 - RNA, 14 nt, Human
uuaauauaaauuca

SEQ ID NO: 1779087 - RNA, 21 nt, Human
uuacaagcgugagccacugca

SEQ ID NO: 1779088 - RNA, 14 nt, Human
uuacaauguuuuau

SEQ ID NO: 1779089 - RNA, 20 nt, Human
uuacaagcgugagccacugc

SEQ ID NO: 1779090 - RNA, 13 nt, Human
uuaacucugucuu

SEQ ID NO: 1779091 - RNA, 12 nt, Human
uuaacucugucu

SEQ ID NO: 1779092 - RNA, 15 nt, Human
uuaacccuucaucuu

SEQ ID NO: 1779093 - RNA, 21 nt, Human
uuaacccuucaucuuccugug

SEQ ID NO: 1779094 - RNA, 11 nt, Human
uuaaauuaccu

SEQ ID NO: 1779095 - RNA, 14 nt, Human
uguuuuguuuauua

SEQ ID NO: 1779096 - RNA, 22 nt, Human
uguuuuaagaggcagggucuca

SEQ ID NO: 1779097 - RNA, 12 nt, Human
uguuuuguacca

SEQ ID NO: 1779098 - RNA, 13 nt, Human
uguuuuguaccag

SEQ ID NO: 1779099 - RNA, 14 nt, Human
uguuuuguaccagu

SEQ ID NO: 1779100 - RNA, 15 nt, Human
uguuuuguaccagug

SEQ ID NO: 1779101 - RNA, 16 nt, Human
uguuuuguaccaguga

SEQ ID NO: 1779102 - RNA, 20 nt, Human
uguuuuguaccagugaauuu

SEQ ID NO: 1779103 - RNA, 17 nt, Human
uguuuuuuuucagccac

SEQ ID NO: 1779104 - RNA, 20 nt, Human
uguuuuaagaggcagggucu

SEQ ID NO: 1779105 - RNA, 13 nt, Human
uguuugugcugug

SEQ ID NO: 1779106 - RNA, 14 nt, Human
uguuugugcugugg

SEQ ID NO: 1779107 - RNA, 17 nt, Human
uguuugucauuagccug

SEQ ID NO: 1779108 - RNA, 15 nt, Human
uguuugucauuagcc

SEQ ID NO: 1779109 - RNA, 22 nt, Human
uguuugguauuguauuuauuca

SEQ ID NO: 1779110 - RNA, 17 nt, Human
uguuugguauuguauuu

SEQ ID NO: 1779111 - RNA, 16 nt, Human
uguuugguauuguauu

SEQ ID NO: 1779112 - RNA, 13 nt, Human
uguuuccuuuuuu

SEQ ID NO: 1779113 - RNA, 16 nt, Human
uguuuccuuuuuuccc

SEQ ID NO: 1779114 - RNA, 16 nt, Human
uggugccccccacccc

SEQ ID NO: 1779115 - RNA, 23 nt, Human
uggugccccccaccccuggaaga

SEQ ID NO: 1779116 - RNA, 17 nt, Human
uggugcccuccucacuc

SEQ ID NO: 1779117 - RNA, 16 nt, Human
uguuucaauugcaucu

SEQ ID NO: 1779118 - RNA, 18 nt, Human
uuagaguuagacuguugg

SEQ ID NO: 1779119 - RNA, 17 nt, Human
uuagaguuagacuguug

SEQ ID NO: 1779120 - RNA, 14 nt, Human
uuagaguuagacug

SEQ ID NO: 1779121 - RNA, 13 nt, Human
uuagaguuagacu

SEQ ID NO: 1779122 - RNA, 12 nt, Human
uuagaguuagac

SEQ ID NO: 1779123 - RNA, 16 nt, Human
uuagagugucuuucca

SEQ ID NO: 1779124 - RNA, 17 nt, Human
uuagagugucuuuccac

SEQ ID NO: 1779125 - RNA, 16 nt, Human
uuagaggaaaaauauu

SEQ ID NO: 1779126 - RNA, 20 nt, Human
uuagaguccuaguuuuccua

SEQ ID NO: 1779127 - RNA, 12 nt, Human
uuagcugcuucu

SEQ ID NO: 1779128 - RNA, 20 nt, Human
uuagcugcuucuauguuuca

SEQ ID NO: 1779129 - RNA, 12 nt, Human
uuagcuucagga

SEQ ID NO: 1779130 - RNA, 13 nt, Human
uuagcuucaggaa

SEQ ID NO: 1779131 - RNA, 14 nt, Human
uuagcuucaggaac

SEQ ID NO: 1779132 - RNA, 16 nt, Human
uuagcuucaggaaccu

SEQ ID NO: 1779133 - RNA, 15 nt, Human
uuaggauggcaggac

SEQ ID NO: 1779134 - RNA, 15 nt, Human
uuaguuacuuuagau

SEQ ID NO: 1779135 - RNA, 13 nt, Human
uuagucgugagcu

SEQ ID NO: 1779136 - RNA, 24 nt, Human
uuagucgugagcucuugugaggaa

SEQ ID NO: 1779137 - RNA, 21 nt, Human
uuagucgugagcucuugugag

SEQ ID NO: 1779138 - RNA, 19 nt, Human
uuagucgugagcucuugug

SEQ ID NO: 1779139 - RNA, 16 nt, Human
uuagucgugagcucuu

SEQ ID NO: 1779140 - RNA, 17 nt, Human
uuacuuuaaaaggagcc

SEQ ID NO: 1779141 - RNA, 18 nt, Human
uuacuuuaaaaggagcca

SEQ ID NO: 1779142 - RNA, 14 nt, Human
uuacuuuguguuca

SEQ ID NO: 1779143 - RNA, 14 nt, Human
uuagaaaaagaaca

SEQ ID NO: 1779144 - RNA, 20 nt, Human
uuagaaaaagaacaugcagu

SEQ ID NO: 1779145 - RNA, 21 nt, Human
uuagaaaaagaacaugcaguu

SEQ ID NO: 1779146 - RNA, 22 nt, Human
uuagaaaaagaacaugcaguuu

SEQ ID NO: 1779147 - RNA, 18 nt, Human
uuagacuaaggccauuau

SEQ ID NO: 1779148 - RNA, 16 nt, Human
uuagagaaugagaaau

SEQ ID NO: 1779149 - RNA, 20 nt, Human
uuagacuguuggggugggua

SEQ ID NO: 1779150 - RNA, 13 nt, Human
uuacuaugccugu

SEQ ID NO: 1779151 - RNA, 16 nt, Human
uuacuagggaucccuc

SEQ ID NO: 1779152 - RNA, 20 nt, Human
uuacuagggaucccucaucu

SEQ ID NO: 1779153 - RNA, 23 nt, Human
uuacuagggaucccucaucuguc

SEQ ID NO: 1779154 - RNA, 14 nt, Human
uuacuaugccugug

SEQ ID NO: 1779155 - RNA, 18 nt, Human
uuacuaugccugugucuu

SEQ ID NO: 1779156 - RNA, 11 nt, Human
uuacuucugcu

SEQ ID NO: 1779157 - RNA, 15 nt, Human
uuacuucucuauaaa

SEQ ID NO: 1779158 - RNA, 18 nt, Human
uuacuucucuauaaaaaa

SEQ ID NO: 1779159 - RNA, 24 nt, Human
uuacuucucuauaaaaaauaugua

SEQ ID NO: 1779160 - RNA, 12 nt, Human
uuacuucugcua

SEQ ID NO: 1779161 - RNA, 16 nt, Human
uuacuuaacuguuuca

SEQ ID NO: 1779162 - RNA, 12 nt, Human
uucccccuaaac

SEQ ID NO: 1779163 - RNA, 13 nt, Human
uucccugacucau

SEQ ID NO: 1779164 - RNA, 16 nt, Human
uucccugacucauucu

SEQ ID NO: 1779165 - RNA, 14 nt, Human
uuccucauuaaauu

SEQ ID NO: 1779166 - RNA, 17 nt, Human
uuccucauuaaauuacc

SEQ ID NO: 1779167 - RNA, 19 nt, Human
uuccuauuccaagcuucca

SEQ ID NO: 1779168 - RNA, 21 nt, Human
uuccuauuccaagcuuccaua

SEQ ID NO: 1779169 - RNA, 22 nt, Human
uuccuauuucaguguuaccugu

SEQ ID NO: 1779170 - RNA, 16 nt, Human
uuccuauuuuuaaaua

SEQ ID NO: 1779171 - RNA, 17 nt, Human
uuccuauuuuuaaauaa

SEQ ID NO: 1779172 - RNA, 22 nt, Human
uuccuauuuuuaaauaauuucc

SEQ ID NO: 1779173 - RNA, 18 nt, Human
uuccuaugcuauugacaa

SEQ ID NO: 1779174 - RNA, 11 nt, Human
uuccuauaagg

SEQ ID NO: 1779175 - RNA, 13 nt, Human
uuccuauacgcag

SEQ ID NO: 1779176 - RNA, 19 nt, Human
uuccuauacgcagcgugcu

SEQ ID NO: 1779177 - RNA, 14 nt, Human
uucgggcuggccau

SEQ ID NO: 1779178 - RNA, 12 nt, Human
uucgggcugugc

SEQ ID NO: 1779179 - RNA, 13 nt, Human
uucgggcugugcc

SEQ ID NO: 1779180 - RNA, 15 nt, Human
uuccuuggcuuuaug

SEQ ID NO: 1779181 - RNA, 14 nt, Human
uucgggcugugccc

SEQ ID NO: 1779182 - RNA, 17 nt, Human
uucguucgcagagcuuu

SEQ ID NO: 1779183 - RNA, 19 nt, Human
uuccuggaggucagcauuu

SEQ ID NO: 1779184 - RNA, 21 nt, Human
uuccuugaccugcauuguaaa

SEQ ID NO: 1779185 - RNA, 22 nt, Human
uuccuugaccugcauuguaaau

SEQ ID NO: 1779186 - RNA, 11 nt, Human
uucaggaaccu

SEQ ID NO: 1779187 - RNA, 20 nt, Human
uucaggaaccucgaguacug

SEQ ID NO: 1779188 - RNA, 21 nt, Human
uucaggaaccucgaguacugu

SEQ ID NO: 1779189 - RNA, 22 nt, Human
uucaggaaccucgaguacugug

SEQ ID NO: 1779190 - RNA, 15 nt, Human
uucauuuccuguguc

SEQ ID NO: 1779191 - RNA, 16 nt, Human
uucauuuccugugucu

SEQ ID NO: 1779192 - RNA, 20 nt, Human
uuccaaauaaaauguucccu

SEQ ID NO: 1779193 - RNA, 15 nt, Human
uuccaaaccuuaucu

SEQ ID NO: 1779194 - RNA, 20 nt, Human
uuccaaaccuuaucuccaca

SEQ ID NO: 1779195 - RNA, 15 nt, Human
uucccccacugauca

SEQ ID NO: 1779196 - RNA, 16 nt, Human
uuccauuggaucucau

SEQ ID NO: 1779197 - RNA, 17 nt, Human
uuccauuggaucucauu

SEQ ID NO: 1779198 - RNA, 11 nt, Human
uuauucugcuc

SEQ ID NO: 1779199 - RNA, 14 nt, Human
uuauugaaagaauu

SEQ ID NO: 1779200 - RNA, 16 nt, Human
uuauugacucuggguc

SEQ ID NO: 1779201 - RNA, 22 nt, Human
uuauugacucuggguccuuccu

SEQ ID NO: 1779202 - RNA, 15 nt, Human
uuauugcccacgcug

SEQ ID NO: 1779203 - RNA, 13 nt, Human
uuauugcauuaua

SEQ ID NO: 1779204 - RNA, 14 nt, Human
uuauuaaaauucug

SEQ ID NO: 1779205 - RNA, 15 nt, Human
uuauuaaaauucuga

SEQ ID NO: 1779206 - RNA, 16 nt, Human
uuauuaaaauucugaa

SEQ ID NO: 1779207 - RNA, 17 nt, Human
uuaugcauguuuguugu

SEQ ID NO: 1779208 - RNA, 18 nt, Human
uuaugcuguagucuuacc

SEQ ID NO: 1779209 - RNA, 22 nt, Human
uuauuuuauaagaaaaacuuuu

SEQ ID NO: 1779210 - RNA, 23 nt, Human
uucaaagccagcguccuccucug

SEQ ID NO: 1779211 - RNA, 12 nt, Human
uuauuguacuug

SEQ ID NO: 1779212 - RNA, 18 nt, Human
uuauuguguuugucauua

SEQ ID NO: 1779213 - RNA, 17 nt, Human
uuauuguguuugucauu

SEQ ID NO: 1779214 - RNA, 16 nt, Human
uuauuguguuugucau

SEQ ID NO: 1779215 - RNA, 15 nt, Human
uuauuguguuuguca

SEQ ID NO: 1779216 - RNA, 12 nt, Human
uuauugccuucu

SEQ ID NO: 1779217 - RNA, 14 nt, Human
uuauugccuucuca

SEQ ID NO: 1779218 - RNA, 17 nt, Human
uuauugccuucucacca

SEQ ID NO: 1779219 - RNA, 20 nt, Human
uuauugccuucucaccagcu

SEQ ID NO: 1779220 - RNA, 22 nt, Human
uuauugccuucucaccagcugc

SEQ ID NO: 1779221 - RNA, 23 nt, Human
uuauugccuucucaccagcugca

SEQ ID NO: 1779222 - RNA, 19 nt, Human
uucaauugcaucucccaga

SEQ ID NO: 1779223 - RNA, 15 nt, Human
uucaauugcaucucc

SEQ ID NO: 1779224 - RNA, 17 nt, Human
uucaauugcaucuccca

SEQ ID NO: 1779225 - RNA, 21 nt, Human
uucaccugauucaacuaaaaa

SEQ ID NO: 1779226 - RNA, 14 nt, Human
uucacuaaagcagu

SEQ ID NO: 1779227 - RNA, 14 nt, Human
uucacgugcagcuc

SEQ ID NO: 1779228 - RNA, 13 nt, Human
uucacuaaagcag

SEQ ID NO: 1779229 - RNA, 23 nt, Human
uucaccuucguuuacuaugccug

SEQ ID NO: 1779230 - RNA, 12 nt, Human
uucaccugagca

SEQ ID NO: 1779231 - RNA, 16 nt, Human
uucaccugauucaacu

SEQ ID NO: 1779232 - RNA, 14 nt, Human
uuugaauaaagaau

SEQ ID NO: 1779233 - RNA, 16 nt, Human
uuugaauaaagaauac

SEQ ID NO: 1779234 - RNA, 18 nt, Human
uuugaauaaagaauacuu

SEQ ID NO: 1779235 - RNA, 20 nt, Human
uuugaauaaagaauacuuga

SEQ ID NO: 1779236 - RNA, 21 nt, Human
uuugaauaaagaauacuugaa

SEQ ID NO: 1779237 - RNA, 22 nt, Human
uuugaagucauaccaaugaaaa

SEQ ID NO: 1779238 - RNA, 21 nt, Human
uuugaaauuguauuacaaauc

SEQ ID NO: 1779239 - RNA, 20 nt, Human
uuugaaauucugaauuugca

SEQ ID NO: 1779240 - RNA, 21 nt, Human
uuugaaauucugaauuugcaa

SEQ ID NO: 1779241 - RNA, 22 nt, Human
uuugaaauucugaauuugcaaa

SEQ ID NO: 1779242 - RNA, 21 nt, Human
uuuguaaaguugguuggauaa

SEQ ID NO: 1779243 - RNA, 22 nt, Human
uuuguaaaguugguuggauaag

SEQ ID NO: 1779244 - RNA, 13 nt, Human
uuugguucccuuc

SEQ ID NO: 1779245 - RNA, 14 nt, Human
uuugauccaagcug

SEQ ID NO: 1779246 - RNA, 14 nt, Human
uuugcuucuagagc

SEQ ID NO: 1779247 - RNA, 21 nt, Human
uuuccuggcacuggaccccag

SEQ ID NO: 1779248 - RNA, 23 nt, Human
uuuccuggcacuggaccccagca

SEQ ID NO: 1779249 - RNA, 17 nt, Human
uuuccucucuauauuuc

SEQ ID NO: 1779250 - RNA, 24 nt, Human
uuuccuaauaaaguucuguacuca

SEQ ID NO: 1779251 - RNA, 21 nt, Human
uuuccuaauaaaguucuguac

SEQ ID NO: 1779252 - RNA, 23 nt, Human
uuuccuaauaaaguucuguacuc

SEQ ID NO: 1779253 - RNA, 12 nt, Human
uuuccuccucug

SEQ ID NO: 1779254 - RNA, 12 nt, Human
uuuccuccuuuc

SEQ ID NO: 1779255 - RNA, 13 nt, Human
uuucuaaauguuu

SEQ ID NO: 1779256 - RNA, 22 nt, Human
uuucuacccagcgagcccuggu

SEQ ID NO: 1779257 - RNA, 15 nt, Human
uuucuacccagcgag

SEQ ID NO: 1779258 - RNA, 18 nt, Human
uuucuacccagcgagccc

SEQ ID NO: 1779259 - RNA, 17 nt, Human
uuucuaccuuaaaggga

SEQ ID NO: 1779260 - RNA, 15 nt, Human
uuucucuccuguccu

SEQ ID NO: 1779261 - RNA, 16 nt, Human
uuucucuccuguccuc

SEQ ID NO: 1779262 - RNA, 20 nt, Human
uuucucuuuuccccuuuccu

SEQ ID NO: 1779263 - RNA, 21 nt, Human
uuucucuuuuccccuuuccug

SEQ ID NO: 1779264 - RNA, 22 nt, Human
uuucucuuuuccccuuuccugu

SEQ ID NO: 1779265 - RNA, 20 nt, Human
uuucaauugcaucucccaga

SEQ ID NO: 1779266 - RNA, 18 nt, Human
uuucaauugcaucuccca

SEQ ID NO: 1779267 - RNA, 18 nt, Human
uuuccaaaaguggccucu

SEQ ID NO: 1779268 - RNA, 17 nt, Human
uuucauuuuuaaaugug

SEQ ID NO: 1779269 - RNA, 23 nt, Human
uuuccacggagccacuccucuga

SEQ ID NO: 1779270 - RNA, 18 nt, Human
uuuauccucuuuagaguu

SEQ ID NO: 1779271 - RNA, 20 nt, Human
uuuaugaaugaaaaaacagu

SEQ ID NO: 1779272 - RNA, 16 nt, Human
uuuauacaauaucauc

SEQ ID NO: 1779273 - RNA, 16 nt, Human
uuuacccucuuugcug

SEQ ID NO: 1779274 - RNA, 15 nt, Human
uuuaauauaaagccu

SEQ ID NO: 1779275 - RNA, 21 nt, Human
uuuacauacacuguauguuau

SEQ ID NO: 1779276 - RNA, 15 nt, Human
uuguuauuuugcaac

SEQ ID NO: 1779277 - RNA, 22 nt, Human
uuguuauuuugcaaccucgcug

SEQ ID NO: 1779278 - RNA, 15 nt, Human
uuguuugguauugua

SEQ ID NO: 1779279 - RNA, 20 nt, Human
uuguuuggggaugagaaagg

SEQ ID NO: 1779280 - RNA, 13 nt, Human
uuguuuagagaau

SEQ ID NO: 1779281 - RNA, 18 nt, Human
uuguuuauuaaauaguua

SEQ ID NO: 1779282 - RNA, 19 nt, Human
uuguuugguauuguauuua

SEQ ID NO: 1779283 - RNA, 16 nt, Human
uuguuugguauuguau

SEQ ID NO: 1779284 - RNA, 21 nt, Human
uuguuugguauuguauuuauu

SEQ ID NO: 1779285 - RNA, 15 nt, Human
uuuaaaaucugucac

SEQ ID NO: 1779286 - RNA, 12 nt, Human
uuuaaaaugucu

SEQ ID NO: 1779287 - RNA, 19 nt, Human
uuuaaaauuuuuuuagaaa

SEQ ID NO: 1779288 - RNA, 18 nt, Human
uuuaaaauuuuuuuagaa

SEQ ID NO: 1779289 - RNA, 20 nt, Human
uugucuaugggacucaaugc

SEQ ID NO: 1779290 - RNA, 14 nt, Human
uugucuaugggacu

SEQ ID NO: 1779291 - RNA, 12 nt, Human
uuguaccaguga

SEQ ID NO: 1779292 - RNA, 22 nt, Human
uuguaccagugaauuuuugcaa

SEQ ID NO: 1779293 - RNA, 23 nt, Human
uuguaccagugaauuuuugcaau

SEQ ID NO: 1779294 - RNA, 19 nt, Human
uugggaauauuugaaucuu

SEQ ID NO: 1779295 - RNA, 17 nt, Human
uugggaauauuugaauc

SEQ ID NO: 1779296 - RNA, 16 nt, Human
uugggaauauuugaau

SEQ ID NO: 1779297 - RNA, 15 nt, Human
uugggaauauuugaa

SEQ ID NO: 1779298 - RNA, 22 nt, Human
uuggcuuuauccucuuuagagu

SEQ ID NO: 1779299 - RNA, 21 nt, Human
uuggcuuuauccucuuuagag

SEQ ID NO: 1779300 - RNA, 17 nt, Human
uuggcuuuaugcacauu

SEQ ID NO: 1779301 - RNA, 20 nt, Human
uuggcuuuauccucuuuaga

SEQ ID NO: 1779302 - RNA, 14 nt, Human
uuggcuuuauccuc

SEQ ID NO: 1779303 - RNA, 19 nt, Human
uuggcaguggacucagaaa

SEQ ID NO: 1779304 - RNA, 20 nt, Human
uuggucugacccacugcuuu

SEQ ID NO: 1779305 - RNA, 17 nt, Human
uugcuggaucaggaagc

SEQ ID NO: 1779306 - RNA, 12 nt, Human
uugcugcugucu

SEQ ID NO: 1779307 - RNA, 21 nt, Human
uugcuaagccccagcaagcaa

SEQ ID NO: 1779308 - RNA, 20 nt, Human
uugccauguuggccaggcug

SEQ ID NO: 1779309 - RNA, 21 nt, Human
uugccauguuggccaggcugg

SEQ ID NO: 1779310 - RNA, 14 nt, Human
uugccuucucacca

SEQ ID NO: 1779311 - RNA, 17 nt, Human
uugccuucucaccagcu

SEQ ID NO: 1779312 - RNA, 20 nt, Human
uugccuucucaccagcugca

SEQ ID NO: 1779313 - RNA, 23 nt, Human
uugccuucucaccagcugcaaag

SEQ ID NO: 1779314 - RNA, 16 nt, Human
uugccuuucgaggccu

SEQ ID NO: 1779315 - RNA, 17 nt, Human
uugccuuucgaggccug

SEQ ID NO: 1779316 - RNA, 18 nt, Human
uugccuuucgaggccuga

SEQ ID NO: 1779317 - RNA, 15 nt, Human
uuggcagcaccuguc

SEQ ID NO: 1779318 - RNA, 17 nt, Human
uuggcaaugccaucauc

SEQ ID NO: 1779319 - RNA, 19 nt, Human
uuggaagcuccgcuuucua

SEQ ID NO: 1779320 - RNA, 19 nt, Human
uugcuguuguccaacuauu

SEQ ID NO: 1779321 - RNA, 14 nt, Human
uugcuguuguccaa

SEQ ID NO: 1779322 - RNA, 23 nt, Human
uuggacaaucaugaaauaugcau

SEQ ID NO: 1779323 - RNA, 23 nt, Human
uuggaauauuguccauuguccaa

SEQ ID NO: 1779324 - RNA, 23 nt, Human
uugcagacaggcaagcaccuccu

SEQ ID NO: 1779325 - RNA, 19 nt, Human
uugcauaacaauuccucua

SEQ ID NO: 1779326 - RNA, 13 nt, Human
uugcauaagguuu

SEQ ID NO: 1779327 - RNA, 19 nt, Human
uugccauauuuucaccauu

SEQ ID NO: 1779328 - RNA, 16 nt, Human
uugccauguuggccag

SEQ ID NO: 1779329 - RNA, 17 nt, Human
uugccauguuggccagg

SEQ ID NO: 1779330 - RNA, 18 nt, Human
uugccauguuggccaggc

SEQ ID NO: 1779331 - RNA, 19 nt, Human
uugccauguuggccaggcu

SEQ ID NO: 1779332 - RNA, 21 nt, Human
uugaauucuugguugaggaaa

SEQ ID NO: 1779333 - RNA, 15 nt, Human
uugaauuguaacugu

SEQ ID NO: 1779334 - RNA, 20 nt, Human
uugaauguuaaauaaauugu

SEQ ID NO: 1779335 - RNA, 18 nt, Human
uugaauuguaacuguucu

SEQ ID NO: 1779336 - RNA, 19 nt, Human
uugaucgccuuucccaggu

SEQ ID NO: 1779337 - RNA, 17 nt, Human
uugauauuuuuucucuc

SEQ ID NO: 1779338 - RNA, 17 nt, Human
uucuggcagguccuccc

SEQ ID NO: 1779339 - RNA, 19 nt, Human
uucuggcagguccuccccu

SEQ ID NO: 1779340 - RNA, 12 nt, Human
uucuaagucuuu

SEQ ID NO: 1779341 - RNA, 15 nt, Human
uucuaagucuuucca

SEQ ID NO: 1779342 - RNA, 17 nt, Human
uucuaagucuuuccauu

SEQ ID NO: 1779343 - RNA, 13 nt, Human
uucugugcccucc

SEQ ID NO: 1779344 - RNA, 18 nt, Human
uugaauguuaaauaaauu

SEQ ID NO: 1779345 - RNA, 15 nt, Human
uugaauguuaaauaa

SEQ ID NO: 1779346 - RNA, 13 nt, Human
uugaauguuaaau

SEQ ID NO: 1779347 - RNA, 21 nt, Human
uugaaaaucuuauaauuuaaa

SEQ ID NO: 1779348 - RNA, 22 nt, Human
uuugugguacgaccuuuagauu

SEQ ID NO: 1779349 - RNA, 14 nt, Human
aaaaacacaaaagu

SEQ ID NO: 1779350 - RNA, 16 nt, Human
aaaacaauaaaauuuu

SEQ ID NO: 1779351 - RNA, 22 nt, Human
aaaaauuuuauaaaauuaagca

SEQ ID NO: 1779352 - RNA, 21 nt, Human
aaaaauuuugugacauuccuu

SEQ ID NO: 1779353 - RNA, 23 nt, Human
aaaaauuuugugacauuccuucu

SEQ ID NO: 1779354 - RNA, 22 nt, Human
aauuagugcuaagugugaacug

SEQ ID NO: 1779355 - RNA, 18 nt, Human
aauguuugccucugccuc

SEQ ID NO: 1779356 - RNA, 20 nt, Human
aaugucuugaugcaugcacu

SEQ ID NO: 1779357 - RNA, 11 nt, Human
aaugucuugug

SEQ ID NO: 1779358 - RNA, 13 nt, Human
aaugucuuguguu

SEQ ID NO: 1779359 - RNA, 19 nt, Human
aauguuugccucugccucu

SEQ ID NO: 1779360 - RNA, 16 nt, Human
aaugguauaaauuuca

SEQ ID NO: 1779361 - RNA, 13 nt, Human
aauggcuucagug

SEQ ID NO: 1779362 - RNA, 22 nt, Human
aaugguggggaacuauaaagaa

SEQ ID NO: 1779363 - RNA, 20 nt, Human
aaugucucuuuaaugucaca

SEQ ID NO: 1779364 - RNA, 14 nt, Human
aauauaaguaaagu

SEQ ID NO: 1779365 - RNA, 16 nt, Human
aauauaaguaaaguga

SEQ ID NO: 1779366 - RNA, 17 nt, Human
aauauaaguaaagugau

SEQ ID NO: 1779367 - RNA, 14 nt, Human
aauauuauugaacu

SEQ ID NO: 1779368 - RNA, 17 nt, Human
aaucaacaccuuaauau

SEQ ID NO: 1779369 - RNA, 19 nt, Human
aauauucagacaaaaugga

SEQ ID NO: 1779370 - RNA, 10 nt, Human
aaucaacuuu

SEQ ID NO: 1779371 - RNA, 13 nt, Human
aaucaacuuuuua

SEQ ID NO: 1779372 - RNA, 18 nt, Human
aaucaacuuuuuauugcc

SEQ ID NO: 1779373 - RNA, 19 nt, Human
aaucaacuuuuuauugccu

SEQ ID NO: 1779374 - RNA, 20 nt, Human
aaucaacuuuuuauugccuu

SEQ ID NO: 1779375 - RNA, 21 nt, Human
aaucaacuuuuuauugccuuc

SEQ ID NO: 1779376 - RNA, 22 nt, Human
aaucaacuuuuuauugccuucu

SEQ ID NO: 1779377 - RNA, 23 nt, Human
aaucaacuuuuuauugccuucuc

SEQ ID NO: 1779378 - RNA, 16 nt, Human
aaugaaccacaucuug

SEQ ID NO: 1779379 - RNA, 17 nt, Human
aaugaaccacaucuugc

SEQ ID NO: 1779380 - RNA, 23 nt, Human
aaugaaccacaucuugcucugcu

SEQ ID NO: 1779381 - RNA, 10 nt, Human
aaucugccug

SEQ ID NO: 1779382 - RNA, 12 nt, Human
aaucugccuggg

SEQ ID NO: 1779383 - RNA, 19 nt, Human
aaucugcaauuucuacuac

SEQ ID NO: 1779384 - RNA, 11 nt, Human
aaugaagaaag

SEQ ID NO: 1779385 - RNA, 21 nt, Human
aagucucucauucuaggccuc

SEQ ID NO: 1779386 - RNA, 16 nt, Human
aagguuggagcccagg

SEQ ID NO: 1779387 - RNA, 17 nt, Human
aagguuggagcccaggg

SEQ ID NO: 1779388 - RNA, 18 nt, Human
aagguuggagcccagggc

SEQ ID NO: 1779389 - RNA, 14 nt, Human
aagguuggauggau

SEQ ID NO: 1779390 - RNA, 11 nt, Human
aaguacuucuu

SEQ ID NO: 1779391 - RNA, 11 nt, Human
aaguagaaaug

SEQ ID NO: 1779392 - RNA, 13 nt, Human
aaguagaaauggu

SEQ ID NO: 1779393 - RNA, 22 nt, Human
aagugguccuagaggcccuuug

SEQ ID NO: 1779394 - RNA, 19 nt, Human
aagugcuucauucuuugca

SEQ ID NO: 1779395 - RNA, 10 nt, Human
aauaaugcag

SEQ ID NO: 1779396 - RNA, 12 nt, Human
aauaaugcagua

SEQ ID NO: 1779397 - RNA, 15 nt, Human
aauaaugcaguaugg

SEQ ID NO: 1779398 - RNA, 17 nt, Human
aauaaugcaguauggua

SEQ ID NO: 1779399 - RNA, 19 nt, Human
aauaaugcaguaugguaca

SEQ ID NO: 1779400 - RNA, 22 nt, Human
aauaaugcaguaugguacauuu

SEQ ID NO: 1779401 - RNA, 23 nt, Human
aauaaugcaguaugguacauuuu

SEQ ID NO: 1779402 - RNA, 21 nt, Human
aauaauccuaaacauaugaau

SEQ ID NO: 1779403 - RNA, 17 nt, Human
aagugcuguauaaaauc

SEQ ID NO: 1779404 - RNA, 16 nt, Human
aagugcuguauaaaau

SEQ ID NO: 1779405 - RNA, 15 nt, Human
aagugcuguauaaaa

SEQ ID NO: 1779406 - RNA, 13 nt, Human
aagugcuguauaa

SEQ ID NO: 1779407 - RNA, 12 nt, Human
aagugcuguaua

SEQ ID NO: 1779408 - RNA, 22 nt, Human
aagugcuguauaaaaucagcca

SEQ ID NO: 1779409 - RNA, 19 nt, Human
aagugcuguauaaaaucag

SEQ ID NO: 1779410 - RNA, 23 nt, Human
aagugcuguauaaaaucagccaa

SEQ ID NO: 1779411 - RNA, 14 nt, Human
aagcagagaagcuc

SEQ ID NO: 1779412 - RNA, 16 nt, Human
aagcagagaagcucuc

SEQ ID NO: 1779413 - RNA, 21 nt, Human
aagcagaccacugauaaaacc

SEQ ID NO: 1779414 - RNA, 22 nt, Human
aagcaggaaaugaaaaugucuu

SEQ ID NO: 1779415 - RNA, 18 nt, Human
aagccacuuaaaauguuc

SEQ ID NO: 1779416 - RNA, 15 nt, Human
aagccagcugcccua

SEQ ID NO: 1779417 - RNA, 16 nt, Human
aagccagcugcccuau

SEQ ID NO: 1779418 - RNA, 22 nt, Human
aagccagcugcccuaugggccu

SEQ ID NO: 1779419 - RNA, 20 nt, Human
aagccagcguccuccucugu

SEQ ID NO: 1779420 - RNA, 14 nt, Human
aagaacaugcaguu

SEQ ID NO: 1779421 - RNA, 16 nt, Human
aagaacaugcaguuug

SEQ ID NO: 1779422 - RNA, 19 nt, Human
aagaacaugcaguuugaaa

SEQ ID NO: 1779423 - RNA, 20 nt, Human
aagaacaugcaguuugaaau

SEQ ID NO: 1779424 - RNA, 22 nt, Human
aagaacaugcaguuugaaauuc

SEQ ID NO: 1779425 - RNA, 17 nt, Human
aagauuuggaagcucuu

SEQ ID NO: 1779426 - RNA, 20 nt, Human
aagauuuggaagcucuucuu

SEQ ID NO: 1779427 - RNA, 17 nt, Human
aagauuuggaauaaagu

SEQ ID NO: 1779428 - RNA, 23 nt, Human
aagcugccuccccucuccuuccu

SEQ ID NO: 1779429 - RNA, 20 nt, Human
aaggacugagcacccucugg

SEQ ID NO: 1779430 - RNA, 21 nt, Human
aaggacugagcacccucugga

SEQ ID NO: 1779431 - RNA, 18 nt, Human
aaggacauugcggacagc

SEQ ID NO: 1779432 - RNA, 12 nt, Human
aagcugcucuga

SEQ ID NO: 1779433 - RNA, 16 nt, Human
aagcugcucugagcca

SEQ ID NO: 1779434 - RNA, 19 nt, Human
aagcugcucugagccacag

SEQ ID NO: 1779435 - RNA, 20 nt, Human
aagcugcucugagccacagu

SEQ ID NO: 1779436 - RNA, 20 nt, Human
aaaucuuucuuucuuagaaa

SEQ ID NO: 1779437 - RNA, 18 nt, Human
aaaucuuucuuucuuaga

SEQ ID NO: 1779438 - RNA, 16 nt, Human
aaaucuuucuuucuua

SEQ ID NO: 1779439 - RNA, 11 nt, Human
aaaucaacuuu

SEQ ID NO: 1779440 - RNA, 12 nt, Human
aaaucaacuuuu

SEQ ID NO: 1779441 - RNA, 21 nt, Human
aaaucaacuuuuuauugccuu

SEQ ID NO: 1779442 - RNA, 22 nt, Human
aaaucaacuuuuuauugccuuc

SEQ ID NO: 1779443 - RNA, 23 nt, Human
aaaucaacuuuuuauugccuucu

SEQ ID NO: 1779444 - RNA, 21 nt, Human
aaaucaacaccuuaauaugcu

SEQ ID NO: 1779445 - RNA, 22 nt, Human
aaagucucucauucuaggccuc

SEQ ID NO: 1779446 - RNA, 12 nt, Human
aaagucucuugu

SEQ ID NO: 1779447 - RNA, 11 nt, Human
aaagugcuggg

SEQ ID NO: 1779448 - RNA, 14 nt, Human
aaagugcugggauu

SEQ ID NO: 1779449 - RNA, 12 nt, Human
aaauaacaauga

SEQ ID NO: 1779450 - RNA, 14 nt, Human
aaauaaagagagaa

SEQ ID NO: 1779451 - RNA, 22 nt, Human
aaauaaagagagaacaggacua

SEQ ID NO: 1779452 - RNA, 19 nt, Human
aaagaacaugcaguuugaa

SEQ ID NO: 1779453 - RNA, 20 nt, Human
aaagaacaugcaguuugaaa

SEQ ID NO: 1779454 - RNA, 21 nt, Human
aaagaacaugcaguuugaaau

SEQ ID NO: 1779455 - RNA, 22 nt, Human
aaagauauaagugcuguauaaa

SEQ ID NO: 1779456 - RNA, 21 nt, Human
aaagauauaagugcuguauaa

SEQ ID NO: 1779457 - RNA, 20 nt, Human
aaagauauaagugcuguaua

SEQ ID NO: 1779458 - RNA, 18 nt, Human
aaagauauaagugcugua

SEQ ID NO: 1779459 - RNA, 17 nt, Human
aaagauauaagugcugu

SEQ ID NO: 1779460 - RNA, 16 nt, Human
aaagauauaagugcug

SEQ ID NO: 1779461 - RNA, 15 nt, Human
aaagauauaagugcu

SEQ ID NO: 1779462 - RNA, 13 nt, Human
aaaauucagugga

SEQ ID NO: 1779463 - RNA, 18 nt, Human
aaaauugccauauugcac

SEQ ID NO: 1779464 - RNA, 17 nt, Human
aaaauugccauauugca

SEQ ID NO: 1779465 - RNA, 16 nt, Human
aaaauugccauauugc

SEQ ID NO: 1779466 - RNA, 14 nt, Human
aaaauugccauauu

SEQ ID NO: 1779467 - RNA, 13 nt, Human
aaaauugccauau

SEQ ID NO: 1779468 - RNA, 22 nt, Human
aaaauucaugauacucauuucu

SEQ ID NO: 1779469 - RNA, 21 nt, Human
aaaauugccauauugcacaug

SEQ ID NO: 1779470 - RNA, 19 nt, Human
aaaauugccauauugcaca

SEQ ID NO: 1779471 - RNA, 18 nt, Human
aaacacuucguucgcaga

SEQ ID NO: 1779472 - RNA, 21 nt, Human
aaacacuucguucgcagagcu

SEQ ID NO: 1779473 - RNA, 18 nt, Human
aaacagaugugaauauuc

SEQ ID NO: 1779474 - RNA, 12 nt, Human
aacuuugaauaa

SEQ ID NO: 1779475 - RNA, 14 nt, Human
aacuuugaauaaag

SEQ ID NO: 1779476 - RNA, 15 nt, Human
aacuuugaauaaaga

SEQ ID NO: 1779477 - RNA, 17 nt, Human
aacuuugaauaaagaau

SEQ ID NO: 1779478 - RNA, 20 nt, Human
aacuuugaauaaagaauacu

SEQ ID NO: 1779479 - RNA, 23 nt, Human
aacuuugaauaaagaauacuuga

SEQ ID NO: 1779480 - RNA, 14 nt, Human
aacuuuuuauugcc

SEQ ID NO: 1779481 - RNA, 16 nt, Human
aacuuuuuauugccuu

SEQ ID NO: 1779482 - RNA, 20 nt, Human
aacuuuuuauugccuucuca

SEQ ID NO: 1779483 - RNA, 23 nt, Human
aacuuuuuauugccuucucacca

SEQ ID NO: 1779484 - RNA, 12 nt, Human
aacuuuuuuggu

SEQ ID NO: 1779485 - RNA, 21 nt, Human
aacuuagccauuuuucaaagc

SEQ ID NO: 1779486 - RNA, 22 nt, Human
aacuuagccauuuuucaaagca

SEQ ID NO: 1779487 - RNA, 23 nt, Human
aacuuauauuaauaguaauuugu

SEQ ID NO: 1779488 - RNA, 19 nt, Human
aacuuauccuaaaacaaau

SEQ ID NO: 1779489 - RNA, 14 nt, Human
aacuguuuccuuca

SEQ ID NO: 1779490 - RNA, 17 nt, Human
aacaaaauggcuucagu

SEQ ID NO: 1779491 - RNA, 14 nt, Human
aacaaaauguagaa

SEQ ID NO: 1779492 - RNA, 13 nt, Human
aacaaaaauuguc

SEQ ID NO: 1779493 - RNA, 14 nt, Human
aaauugccauauug

SEQ ID NO: 1779494 - RNA, 15 nt, Human
aacaacucuuugaga

SEQ ID NO: 1779495 - RNA, 14 nt, Human
aacaccuuaauaug

SEQ ID NO: 1779496 - RNA, 15 nt, Human
aacaccuuaauaugc

SEQ ID NO: 1779497 - RNA, 16 nt, Human
aacccuggggaaggag

SEQ ID NO: 1779498 - RNA, 19 nt, Human
aacccuggggaaggagcca

SEQ ID NO: 1779499 - RNA, 20 nt, Human
aacccuggggaaggagccag

SEQ ID NO: 1779500 - RNA, 21 nt, Human
aacccuggggaaggagccagu

SEQ ID NO: 1779501 - RNA, 18 nt, Human
aacccuggggccugacug

SEQ ID NO: 1779502 - RNA, 20 nt, Human
aacccuggggccugacugcu

SEQ ID NO: 1779503 - RNA, 13 nt, Human
aacccugccaugg

SEQ ID NO: 1779504 - RNA, 21 nt, Human
aacccugccauggaacuguuu

SEQ ID NO: 1779505 - RNA, 16 nt, Human
aaccaguauuuuugcu

SEQ ID NO: 1779506 - RNA, 21 nt, Human
aaccaguauuuuugcugcuuc

SEQ ID NO: 1779507 - RNA, 22 nt, Human
aaccaguauuuuugcugcuucu

SEQ ID NO: 1779508 - RNA, 23 nt, Human
aaccaguauuuuugcugcuucug

SEQ ID NO: 1779509 - RNA, 20 nt, Human
aaccagcuggucugggugua

SEQ ID NO: 1779510 - RNA, 14 nt, Human
aaccagccggggcc

SEQ ID NO: 1779511 - RNA, 10 nt, Human
aacagcugcc

SEQ ID NO: 1779512 - RNA, 11 nt, Human
aacagcugccu

SEQ ID NO: 1779513 - RNA, 12 nt, Human
aacagcugccuu

SEQ ID NO: 1779514 - RNA, 13 nt, Human
aacagcugccuua

SEQ ID NO: 1779515 - RNA, 14 nt, Human
aacagcugccuuag

SEQ ID NO: 1779516 - RNA, 15 nt, Human
aacagcugccuuagc

SEQ ID NO: 1779517 - RNA, 18 nt, Human
aacagcugccuuagcuuc

SEQ ID NO: 1779518 - RNA, 19 nt, Human
aacagcugccuuagcuuca

SEQ ID NO: 1779519 - RNA, 20 nt, Human
aacagcugccuuagcuucag

SEQ ID NO: 1779520 - RNA, 22 nt, Human
aacagcugccuuagcuucagga

SEQ ID NO: 1779521 - RNA, 23 nt, Human
aacagcugccuuagcuucaggaa

SEQ ID NO: 1779522 - RNA, 16 nt, Human
aacaucacaccugccc

SEQ ID NO: 1779523 - RNA, 18 nt, Human
aacaucacaccugcccua

SEQ ID NO: 1779524 - RNA, 13 nt, Human
aacaucacacaca

SEQ ID NO: 1779525 - RNA, 11 nt, Human
aacaugcaguu

SEQ ID NO: 1779526 - RNA, 13 nt, Human
aacaugcaguuug

SEQ ID NO: 1779527 - RNA, 15 nt, Human
aacaugcaguuugaa

SEQ ID NO: 1779528 - RNA, 17 nt, Human
aacaugcaguuugaaau

SEQ ID NO: 1779529 - RNA, 18 nt, Human
aacaugcaguuugaaauu

SEQ ID NO: 1779530 - RNA, 19 nt, Human
aacaugcaguuugaaauuc

SEQ ID NO: 1779531 - RNA, 21 nt, Human
aacaugcaguuugaaauucug

SEQ ID NO: 1779532 - RNA, 22 nt, Human
aacaugcaguuugaaauucuga

SEQ ID NO: 1779533 - RNA, 21 nt, Human
aacaugccugccccaaacaaa

SEQ ID NO: 1779534 - RNA, 22 nt, Human
aacaugccugccccaaacaaau

SEQ ID NO: 1779535 - RNA, 12 nt, Human
accucuuccgac

SEQ ID NO: 1779536 - RNA, 22 nt, Human
accucuuccgacucuuucugag

SEQ ID NO: 1779537 - RNA, 16 nt, Human
accugcccccaaucca

SEQ ID NO: 1779538 - RNA, 15 nt, Human
accucuucagaggcc

SEQ ID NO: 1779539 - RNA, 17 nt, Human
accucuucagaggcccu

SEQ ID NO: 1779540 - RNA, 18 nt, Human
accucuucagaggcccuc

SEQ ID NO: 1779541 - RNA, 14 nt, Human
accuuggcucaagu

SEQ ID NO: 1779542 - RNA, 12 nt, Human
accuuggcugca

SEQ ID NO: 1779543 - RNA, 17 nt, Human
accuuguuauuucucag

SEQ ID NO: 1779544 - RNA, 22 nt, Human
accuuguuauuucucagacuuu

SEQ ID NO: 1779545 - RNA, 14 nt, Human
accuuggcugcagg

SEQ ID NO: 1779546 - RNA, 18 nt, Human
acgccacugcacuauagc

SEQ ID NO: 1779547 - RNA, 16 nt, Human
acgugcauugugcuuc

SEQ ID NO: 1779548 - RNA, 15 nt, Human
acgugcauugugcuu

SEQ ID NO: 1779549 - RNA, 14 nt, Human
acgugcauugugcu

SEQ ID NO: 1779550 - RNA, 12 nt, Human
acgugcauugug

SEQ ID NO: 1779551 - RNA, 22 nt, Human
acgugcauugugcuucuuucuu

SEQ ID NO: 1779552 - RNA, 16 nt, Human
acucugugucaggugg

SEQ ID NO: 1779553 - RNA, 18 nt, Human
acucuauaagauuccaaa

SEQ ID NO: 1779554 - RNA, 19 nt, Human
acucuggguccuuccugaa

SEQ ID NO: 1779555 - RNA, 15 nt, Human
acucuggguccuucc

SEQ ID NO: 1779556 - RNA, 16 nt, Human
acucuggguccuuccu

SEQ ID NO: 1779557 - RNA, 18 nt, Human
acucuggguccuuccuga

SEQ ID NO: 1779558 - RNA, 14 nt, Human
acucccuugggcuc

SEQ ID NO: 1779559 - RNA, 13 nt, Human
acuauaaaagcuu

SEQ ID NO: 1779560 - RNA, 20 nt, Human
acuauaaagaaguaacaaaa

SEQ ID NO: 1779561 - RNA, 14 nt, Human
acucagcuccguga

SEQ ID NO: 1779562 - RNA, 20 nt, Human
acucaggcgggacagugcug

SEQ ID NO: 1779563 - RNA, 23 nt, Human
acucaggcgggacagugcugcag

SEQ ID NO: 1779564 - RNA, 16 nt, Human
acuagggccaagccca

SEQ ID NO: 1779565 - RNA, 18 nt, Human
acuagggaucccucaucu

SEQ ID NO: 1779566 - RNA, 19 nt, Human
acuagggaucccucaucug

SEQ ID NO: 1779567 - RNA, 20 nt, Human
acuagggaucccucaucugu

SEQ ID NO: 1779568 - RNA, 14 nt, Human
acuagcuauggugu

SEQ ID NO: 1779569 - RNA, 18 nt, Human
acuucugccauauucugu

SEQ ID NO: 1779570 - RNA, 19 nt, Human
acuucugccauauucuguu

SEQ ID NO: 1779571 - RNA, 15 nt, Human
acuucuuucagcaga

SEQ ID NO: 1779572 - RNA, 20 nt, Human
acuuguaaaggaauuuaaaa

SEQ ID NO: 1779573 - RNA, 19 nt, Human
acuuguaaaggaauuuaaa

SEQ ID NO: 1779574 - RNA, 20 nt, Human
acuguuuucuuuaugucuuu

SEQ ID NO: 1779575 - RNA, 20 nt, Human
acuguuuauugaaagaauua

SEQ ID NO: 1779576 - RNA, 14 nt, Human
acuguccuuuccuu

SEQ ID NO: 1779577 - RNA, 21 nt, Human
acuguccuuuccuuggcuuua

SEQ ID NO: 1779578 - RNA, 21 nt, Human
acugguguuaucaccgugggc

SEQ ID NO: 1779579 - RNA, 22 nt, Human
acugguguuaucaccgugggcu

SEQ ID NO: 1779580 - RNA, 16 nt, Human
acugugccaugugcca

SEQ ID NO: 1779581 - RNA, 12 nt, Human
acugugccacaa

SEQ ID NO: 1779582 - RNA, 23 nt, Human
acugugccacaaugcaguucuga

SEQ ID NO: 1779583 - RNA, 18 nt, Human
acugugcaccaagcagga

SEQ ID NO: 1779584 - RNA, 18 nt, Human
acugugaugcccugcccu

SEQ ID NO: 1779585 - RNA, 15 nt, Human
acugugcacaucugu

SEQ ID NO: 1779586 - RNA, 19 nt, Human
acugugcacaucugugucu

SEQ ID NO: 1779587 - RNA, 20 nt, Human
acugugcacaucugugucuu

SEQ ID NO: 1779588 - RNA, 21 nt, Human
acugugcacaucugugucuug

SEQ ID NO: 1779589 - RNA, 16 nt, Human
acuggaagcacagcuu

SEQ ID NO: 1779590 - RNA, 15 nt, Human
acuggaagcacagcu

SEQ ID NO: 1779591 - RNA, 14 nt, Human
acuggaagcacagc

SEQ ID NO: 1779592 - RNA, 16 nt, Human
acuggacccuguugcu

SEQ ID NO: 1779593 - RNA, 18 nt, Human
acuggacccuguugcuaa

SEQ ID NO: 1779594 - RNA, 17 nt, Human
acuggacccuguugcua

SEQ ID NO: 1779595 - RNA, 20 nt, Human
acuggacccuguugcuaagc

SEQ ID NO: 1779596 - RNA, 19 nt, Human
acuggacccuguugcuaag

SEQ ID NO: 1779597 - RNA, 19 nt, Human
acugaaggcuaaaaagcaa

SEQ ID NO: 1779598 - RNA, 20 nt, Human
acugaaggcuaaaaagcaac

SEQ ID NO: 1779599 - RNA, 21 nt, Human
acugccaaagggaaauaucau

SEQ ID NO: 1779600 - RNA, 20 nt, Human
agaaaggaggggauagagag

SEQ ID NO: 1779601 - RNA, 23 nt, Human
agaaaggaggggauagagagaga

SEQ ID NO: 1779602 - RNA, 17 nt, Human
agaaacaacucuuugag

SEQ ID NO: 1779603 - RNA, 18 nt, Human
agaaacaacaauuucuac

SEQ ID NO: 1779604 - RNA, 14 nt, Human
agaaaauuccuaua

SEQ ID NO: 1779605 - RNA, 15 nt, Human
agaaaauuccuauaa

SEQ ID NO: 1779606 - RNA, 16 nt, Human
agaaaauuccuauaag

SEQ ID NO: 1779607 - RNA, 19 nt, Human
agaaaauuccuauaaggaa

SEQ ID NO: 1779608 - RNA, 22 nt, Human
agaaaauuccuauaaggaagau

SEQ ID NO: 1779609 - RNA, 14 nt, Human
agaaaauaacaaua

SEQ ID NO: 1779610 - RNA, 14 nt, Human
acacuaaccacgcu

SEQ ID NO: 1779611 - RNA, 15 nt, Human
acacuaaccacgcug

SEQ ID NO: 1779612 - RNA, 14 nt, Human
acacagcucugucc

SEQ ID NO: 1779613 - RNA, 11 nt, Human
acacagcucug

SEQ ID NO: 1779614 - RNA, 12 nt, Human
acacagcucugu

SEQ ID NO: 1779615 - RNA, 14 nt, Human
acacagaaaugcug

SEQ ID NO: 1779616 - RNA, 16 nt, Human
acacagaaaugcugcu

SEQ ID NO: 1779617 - RNA, 17 nt, Human
acacagaaaugcugcug

SEQ ID NO: 1779618 - RNA, 18 nt, Human
acacagaaaugcugcugg

SEQ ID NO: 1779619 - RNA, 20 nt, Human
acacagaaaugcugcuggcc

SEQ ID NO: 1779620 - RNA, 21 nt, Human
acacagaaaugcugcuggcca

SEQ ID NO: 1779621 - RNA, 12 nt, Human
acaccagagccc

SEQ ID NO: 1779622 - RNA, 22 nt, Human
acaaaauggauacauaaagacu

SEQ ID NO: 1779623 - RNA, 16 nt, Human
acaaaauggcuucagu

SEQ ID NO: 1779624 - RNA, 16 nt, Human
acaaaauguagaauau

SEQ ID NO: 1779625 - RNA, 17 nt, Human
acaaaauguagaauauu

SEQ ID NO: 1779626 - RNA, 19 nt, Human
acaaaauguagaauauuca

SEQ ID NO: 1779627 - RNA, 21 nt, Human
acaaaauguagaauauucaga

SEQ ID NO: 1779628 - RNA, 22 nt, Human
acaaaauguagaauauucagac

SEQ ID NO: 1779629 - RNA, 23 nt, Human
acaaaauguagaauauucagaca

SEQ ID NO: 1779630 - RNA, 14 nt, Human
acaaagaauuccaa

SEQ ID NO: 1779631 - RNA, 20 nt, Human
aauuuugauauaaucuuuca

SEQ ID NO: 1779632 - RNA, 12 nt, Human
acagcuccuucu

SEQ ID NO: 1779633 - RNA, 13 nt, Human
acagcuccuucug

SEQ ID NO: 1779634 - RNA, 14 nt, Human
acagcuccuucugu

SEQ ID NO: 1779635 - RNA, 11 nt, Human
acagcugccuu

SEQ ID NO: 1779636 - RNA, 12 nt, Human
acagcugccuua

SEQ ID NO: 1779637 - RNA, 14 nt, Human
acagcugccuuagc

SEQ ID NO: 1779638 - RNA, 15 nt, Human
acagcugccuuagcu

SEQ ID NO: 1779639 - RNA, 16 nt, Human
acagcugccuuagcuu

SEQ ID NO: 1779640 - RNA, 17 nt, Human
acagcugccuuagcuuc

SEQ ID NO: 1779641 - RNA, 19 nt, Human
acagcugccuuagcuucag

SEQ ID NO: 1779642 - RNA, 20 nt, Human
acagcugccuuagcuucagg

SEQ ID NO: 1779643 - RNA, 21 nt, Human
acagcugccuuagcuucagga

SEQ ID NO: 1779644 - RNA, 13 nt, Human
acagcucuguccu

SEQ ID NO: 1779645 - RNA, 15 nt, Human
acagcuccuucuguc

SEQ ID NO: 1779646 - RNA, 20 nt, Human
acaggugugaaccaccacac

SEQ ID NO: 1779647 - RNA, 23 nt, Human
acaggugugaaccaccacaccca

SEQ ID NO: 1779648 - RNA, 19 nt, Human
acaggcaagcaccuccugc

SEQ ID NO: 1779649 - RNA, 18 nt, Human
acaggcaagcaccuccug

SEQ ID NO: 1779650 - RNA, 15 nt, Human
acaggcaagcaccuc

SEQ ID NO: 1779651 - RNA, 16 nt, Human
acaggcaagcaccucc

SEQ ID NO: 1779652 - RNA, 14 nt, Human
acagaagcacaugc

SEQ ID NO: 1779653 - RNA, 18 nt, Human
acagaagcacaugcaccu

SEQ ID NO: 1779654 - RNA, 20 nt, Human
acacugugcacaucuguguc

SEQ ID NO: 1779655 - RNA, 21 nt, Human
acacugugcacaucugugucu

SEQ ID NO: 1779656 - RNA, 18 nt, Human
acacuguauguuauagaa

SEQ ID NO: 1779657 - RNA, 20 nt, Human
acacuguauguuauagaacu

SEQ ID NO: 1779658 - RNA, 21 nt, Human
acacuguauguuauagaacuu

SEQ ID NO: 1779659 - RNA, 18 nt, Human
acacugugcacaucugug

SEQ ID NO: 1779660 - RNA, 20 nt, Human
acagccacuccccuccacuc

SEQ ID NO: 1779661 - RNA, 19 nt, Human
acagccacggccaggccag

SEQ ID NO: 1779662 - RNA, 16 nt, Human
acagccaaaggcuggc

SEQ ID NO: 1779663 - RNA, 12 nt, Human
acagagucucac

SEQ ID NO: 1779664 - RNA, 14 nt, Human
acagagucucacug

SEQ ID NO: 1779665 - RNA, 12 nt, Human
acagaauauuuc

SEQ ID NO: 1779666 - RNA, 19 nt, Human
acagaauauuucuauugaa

SEQ ID NO: 1779667 - RNA, 21 nt, Human
acagaauauuucuauugaauu

SEQ ID NO: 1779668 - RNA, 17 nt, Human
acagagucucacuguug

SEQ ID NO: 1779669 - RNA, 19 nt, Human
acagagucucacuguugcc

SEQ ID NO: 1779670 - RNA, 23 nt, Human
acagagucucacuguugcccagg

SEQ ID NO: 1779671 - RNA, 12 nt, Human
accaacuuacaa

SEQ ID NO: 1779672 - RNA, 20 nt, Human
accaacuuguauccaggccu

SEQ ID NO: 1779673 - RNA, 23 nt, Human
accaacugaaggcuaaaaagcaa

SEQ ID NO: 1779674 - RNA, 14 nt, Human
acauuuggagaggg

SEQ ID NO: 1779675 - RNA, 22 nt, Human
acauuuggaggcaauccuaccu

SEQ ID NO: 1779676 - RNA, 15 nt, Human
acauuuggaguguuc

SEQ ID NO: 1779677 - RNA, 20 nt, Human
acauuuggaguguuccccuu

SEQ ID NO: 1779678 - RNA, 20 nt, Human
acauaaagacuaaguagccc

SEQ ID NO: 1779679 - RNA, 11 nt, Human
acagguuggga

SEQ ID NO: 1779680 - RNA, 15 nt, Human
acagguugggauggg

SEQ ID NO: 1779681 - RNA, 16 nt, Human
acaucuaaccucaucu

SEQ ID NO: 1779682 - RNA, 17 nt, Human
acaucuaaccucaucuu

SEQ ID NO: 1779683 - RNA, 16 nt, Human
acauccugugccucca

SEQ ID NO: 1779684 - RNA, 14 nt, Human
accaucaugucugg

SEQ ID NO: 1779685 - RNA, 16 nt, Human
accaucaugucuggcu

SEQ ID NO: 1779686 - RNA, 17 nt, Human
accaucaugucuggcua

SEQ ID NO: 1779687 - RNA, 14 nt, Human
accccuaaacucca

SEQ ID NO: 1779688 - RNA, 16 nt, Human
accccuaaacuccagg

SEQ ID NO: 1779689 - RNA, 17 nt, Human
accccuaaacuccaggg

SEQ ID NO: 1779690 - RNA, 15 nt, Human
aguccugcuaccucc

SEQ ID NO: 1779691 - RNA, 19 nt, Human
aguccugcuaccucccuug

SEQ ID NO: 1779692 - RNA, 21 nt, Human
aguccugcuaccucccuugcc

SEQ ID NO: 1779693 - RNA, 22 nt, Human
aguccugcuaccucccuugccu

SEQ ID NO: 1779694 - RNA, 24 nt, Human
aguccugcuaccucccuugccuuu

SEQ ID NO: 1779695 - RNA, 14 nt, Human
agugaauuuuugca

SEQ ID NO: 1779696 - RNA, 15 nt, Human
agugaauuuuugcaa

SEQ ID NO: 1779697 - RNA, 16 nt, Human
agugaauuuuugcaau

SEQ ID NO: 1779698 - RNA, 18 nt, Human
agugaauuuuugcaauaa

SEQ ID NO: 1779699 - RNA, 22 nt, Human
agugaauuuuugcaauaaugca

SEQ ID NO: 1779700 - RNA, 23 nt, Human
agugaauuuuugcaauaaugcag

SEQ ID NO: 1779701 - RNA, 24 nt, Human
agugaauuuuugcaauaaugcagu

SEQ ID NO: 1779702 - RNA, 13 nt, Human
agugauccuccca

SEQ ID NO: 1779703 - RNA, 20 nt, Human
agucaagugcguccacgagc

SEQ ID NO: 1779704 - RNA, 22 nt, Human
agucaagcuguugaagucucag

SEQ ID NO: 1779705 - RNA, 15 nt, Human
agucaaccugccuga

SEQ ID NO: 1779706 - RNA, 14 nt, Human
agucaaccugggca

SEQ ID NO: 1779707 - RNA, 15 nt, Human
agucaaccugggcaa

SEQ ID NO: 1779708 - RNA, 22 nt, Human
agucauuggcuuuauccucuuu

SEQ ID NO: 1779709 - RNA, 21 nt, Human
agucauuggcuuuauccucuu

SEQ ID NO: 1779710 - RNA, 20 nt, Human
agucauuggcuuuauccucu

SEQ ID NO: 1779711 - RNA, 18 nt, Human
agucauuggcuuuauccu

SEQ ID NO: 1779712 - RNA, 15 nt, Human
agucauuggcuuuau

SEQ ID NO: 1779713 - RNA, 14 nt, Human
agucauuggcuuua

SEQ ID NO: 1779714 - RNA, 14 nt, Human
aguccacaaaauaa

SEQ ID NO: 1779715 - RNA, 23 nt, Human
agugugacaaggauugcuacugu

SEQ ID NO: 1779716 - RNA, 23 nt, Human
agugucuuuccacggagccacuc

SEQ ID NO: 1779717 - RNA, 13 nt, Human
agugucuuuccac

SEQ ID NO: 1779718 - RNA, 23 nt, Human
agugugaacuggacccuguugcu

SEQ ID NO: 1779719 - RNA, 22 nt, Human
agugugaacuggacccuguugc

SEQ ID NO: 1779720 - RNA, 14 nt, Human
agugugaacuggac

SEQ ID NO: 1779721 - RNA, 16 nt, Human
auauucagacaaaaug

SEQ ID NO: 1779722 - RNA, 18 nt, Human
auauucagacaaaaugga

SEQ ID NO: 1779723 - RNA, 19 nt, Human
auauucagacaaaauggau

SEQ ID NO: 1779724 - RNA, 22 nt, Human
auauucagacaaaauggauaca

SEQ ID NO: 1779725 - RNA, 17 nt, Human
auaucccgggggugggg

SEQ ID NO: 1779726 - RNA, 16 nt, Human
auaguaugguggcugg

SEQ ID NO: 1779727 - RNA, 15 nt, Human
auauaagugcuguau

SEQ ID NO: 1779728 - RNA, 13 nt, Human
auauaagugcugu

SEQ ID NO: 1779729 - RNA, 18 nt, Human
auauaagugcuguauaaa

SEQ ID NO: 1779730 - RNA, 17 nt, Human
auauaagugcuguauaa

SEQ ID NO: 1779731 - RNA, 20 nt, Human
auauaagugcuguauaaaau

SEQ ID NO: 1779732 - RNA, 21 nt, Human
auacuuccuuaugcuucuuuc

SEQ ID NO: 1779733 - RNA, 15 nt, Human
auaguaugguggcug

SEQ ID NO: 1779734 - RNA, 14 nt, Human
auauaccauuuauc

SEQ ID NO: 1779735 - RNA, 16 nt, Human
auaaguauuucaaauu

SEQ ID NO: 1779736 - RNA, 18 nt, Human
auaaguauuucaaauugg

SEQ ID NO: 1779737 - RNA, 19 nt, Human
auaaguauuucaaauugga

SEQ ID NO: 1779738 - RNA, 13 nt, Human
auaaugugaaaau

SEQ ID NO: 1779739 - RNA, 16 nt, Human
auaaugugaaaauggu

SEQ ID NO: 1779740 - RNA, 16 nt, Human
auaacaguaaaugugc

SEQ ID NO: 1779741 - RNA, 14 nt, Human
augcuucuuucaaa

SEQ ID NO: 1779742 - RNA, 19 nt, Human
auggauuacuucucuauaa

SEQ ID NO: 1779743 - RNA, 17 nt, Human
augcaugcacuguuccc

SEQ ID NO: 1779744 - RNA, 15 nt, Human
augccugguggcagc

SEQ ID NO: 1779745 - RNA, 16 nt, Human
augccugguggcagcu

SEQ ID NO: 1779746 - RNA, 17 nt, Human
augccugguggcagcug

SEQ ID NO: 1779747 - RNA, 15 nt, Human
auggucuucagccuc

SEQ ID NO: 1779748 - RNA, 17 nt, Human
auggucuucagccucuu

SEQ ID NO: 1779749 - RNA, 15 nt, Human
augucacaggcaggu

SEQ ID NO: 1779750 - RNA, 14 nt, Human
augucacaggcagg

SEQ ID NO: 1779751 - RNA, 16 nt, Human
augucacaggcagguc

SEQ ID NO: 1779752 - RNA, 17 nt, Human
augucacaggcaggucc

SEQ ID NO: 1779753 - RNA, 19 nt, Human
auguaaucuugaauuguaa

SEQ ID NO: 1779754 - RNA, 23 nt, Human
augucuugaugcaugcacuguuc

SEQ ID NO: 1779755 - RNA, 15 nt, Human
augugguuacacacu

SEQ ID NO: 1779756 - RNA, 18 nt, Human
auguucucugaggacacu

SEQ ID NO: 1779757 - RNA, 13 nt, Human
auuaaauaaaaug

SEQ ID NO: 1779758 - RNA, 16 nt, Human
auguuuuaagaggcag

SEQ ID NO: 1779759 - RNA, 18 nt, Human
auguuuuaagaggcaggg

SEQ ID NO: 1779760 - RNA, 13 nt, Human
auguuugcccaaa

SEQ ID NO: 1779761 - RNA, 15 nt, Human
auguuuuaacaaaaa

SEQ ID NO: 1779762 - RNA, 16 nt, Human
auguuuuaacaaaaac

SEQ ID NO: 1779763 - RNA, 22 nt, Human
aucuuauaauuuaaaauaugcu

SEQ ID NO: 1779764 - RNA, 17 nt, Human
augacucacaugaugca

SEQ ID NO: 1779765 - RNA, 23 nt, Human
aucuuuuuuucauuuuuaaaugu

SEQ ID NO: 1779766 - RNA, 12 nt, Human
augaaaaggaau

SEQ ID NO: 1779767 - RNA, 16 nt, Human
augaaaaugucuugug

SEQ ID NO: 1779768 - RNA, 20 nt, Human
aucaucuccugccuuccucc

SEQ ID NO: 1779769 - RNA, 23 nt, Human
aucaucuccugccuuccuccugg

SEQ ID NO: 1779770 - RNA, 15 nt, Human
aucauggugaaaagc

SEQ ID NO: 1779771 - RNA, 19 nt, Human
aucagccaauuauguuaaa

SEQ ID NO: 1779772 - RNA, 18 nt, Human
aucagccaauuauguuaa

SEQ ID NO: 1779773 - RNA, 16 nt, Human
aucagccaauuauguu

SEQ ID NO: 1779774 - RNA, 15 nt, Human
aucagccaauuaugu

SEQ ID NO: 1779775 - RNA, 18 nt, Human
auccacccaccucagccu

SEQ ID NO: 1779776 - RNA, 20 nt, Human
auccacccaccucagccucc

SEQ ID NO: 1779777 - RNA, 14 nt, Human
aucccgagcaccuc

SEQ ID NO: 1779778 - RNA, 17 nt, Human
aucccgagcaccuccac

SEQ ID NO: 1779779 - RNA, 19 nt, Human
aucccgagcaccuccacau

SEQ ID NO: 1779780 - RNA, 13 nt, Human
aucgauguuaugu

SEQ ID NO: 1779781 - RNA, 15 nt, Human
aucgauguuauguaa

SEQ ID NO: 1779782 - RNA, 20 nt, Human
auccuuuccucauuaaauua

SEQ ID NO: 1779783 - RNA, 22 nt, Human
auccuuuccucauuaaauuacc

SEQ ID NO: 1779784 - RNA, 19 nt, Human
agacggagucccaccuugg

SEQ ID NO: 1779785 - RNA, 22 nt, Human
agaccaguuagauuauugaaau

SEQ ID NO: 1779786 - RNA, 19 nt, Human
agacugaucaggaccucca

SEQ ID NO: 1779787 - RNA, 14 nt, Human
agacugaucaggac

SEQ ID NO: 1779788 - RNA, 16 nt, Human
agacugaucaggaccu

SEQ ID NO: 1779789 - RNA, 17 nt, Human
agacugaucaggaccuc

SEQ ID NO: 1779790 - RNA, 23 nt, Human
agagaggguggugaccucugccu

SEQ ID NO: 1779791 - RNA, 14 nt, Human
agagccuucagccu

SEQ ID NO: 1779792 - RNA, 16 nt, Human
agagccuucagccuua

SEQ ID NO: 1779793 - RNA, 18 nt, Human
agagaaaguacuucucca

SEQ ID NO: 1779794 - RNA, 22 nt, Human
agaggggaacagacuggaagca

SEQ ID NO: 1779795 - RNA, 20 nt, Human
agaggaugagcucuacccag

SEQ ID NO: 1779796 - RNA, 23 nt, Human
agaguuaaauagaguauaugcac

SEQ ID NO: 1779797 - RNA, 21 nt, Human
agaggggcugaauagcagaag

SEQ ID NO: 1779798 - RNA, 12 nt, Human
agaucuuaauau

SEQ ID NO: 1779799 - RNA, 13 nt, Human
agaucuuaauaua

SEQ ID NO: 1779800 - RNA, 15 nt, Human
agaucuuaauauaaa

SEQ ID NO: 1779801 - RNA, 19 nt, Human
agaucuuaauauaaauuca

SEQ ID NO: 1779802 - RNA, 21 nt, Human
agauaggucagugcaaauacu

SEQ ID NO: 1779803 - RNA, 14 nt, Human
agcccaagcuuccc

SEQ ID NO: 1779804 - RNA, 15 nt, Human
agcccaagcuucccu

SEQ ID NO: 1779805 - RNA, 16 nt, Human
agcccaagcuucccuc

SEQ ID NO: 1779806 - RNA, 19 nt, Human
agcccaagcuucccuccau

SEQ ID NO: 1779807 - RNA, 16 nt, Human
agccccagugcccaca

SEQ ID NO: 1779808 - RNA, 19 nt, Human
agccgagaucacgccacug

SEQ ID NO: 1779809 - RNA, 20 nt, Human
agccgagaucacgccacugc

SEQ ID NO: 1779810 - RNA, 16 nt, Human
agcccuaggguggaga

SEQ ID NO: 1779811 - RNA, 17 nt, Human
agcccuaggguggagag

SEQ ID NO: 1779812 - RNA, 20 nt, Human
agcccuaggguggagagcca

SEQ ID NO: 1779813 - RNA, 12 nt, Human
agccccagccug

SEQ ID NO: 1779814 - RNA, 13 nt, Human
agccccagccugc

SEQ ID NO: 1779815 - RNA, 14 nt, Human
agccccagccugcu

SEQ ID NO: 1779816 - RNA, 15 nt, Human
agccccagccugcua

SEQ ID NO: 1779817 - RNA, 17 nt, Human
agccccagccugcuagc

SEQ ID NO: 1779818 - RNA, 18 nt, Human
agccucccaaagugcugg

SEQ ID NO: 1779819 - RNA, 19 nt, Human
agccucccaaagugcuggg

SEQ ID NO: 1779820 - RNA, 20 nt, Human
agccgggucugccucuucug

SEQ ID NO: 1779821 - RNA, 21 nt, Human
agccgggucugccucuucugg

SEQ ID NO: 1779822 - RNA, 22 nt, Human
agccgggucugccucuucuggg

SEQ ID NO: 1779823 - RNA, 13 nt, Human
agccgguuccugu

SEQ ID NO: 1779824 - RNA, 14 nt, Human
agccgguuccuguc

SEQ ID NO: 1779825 - RNA, 21 nt, Human
agccgguuccugucccugcgc

SEQ ID NO: 1779826 - RNA, 13 nt, Human
agccggggccuua

SEQ ID NO: 1779827 - RNA, 23 nt, Human
agccggggccuuaucgggcucca

SEQ ID NO: 1779828 - RNA, 16 nt, Human
agccgggucugccucu

SEQ ID NO: 1779829 - RNA, 19 nt, Human
agccgauaucagaauuugu

SEQ ID NO: 1779830 - RNA, 18 nt, Human
agccgauucaccugagca

SEQ ID NO: 1779831 - RNA, 21 nt, Human
agccgagaucacgccacugca

SEQ ID NO: 1779832 - RNA, 20 nt, Human
agccucccaaagugcuggga

SEQ ID NO: 1779833 - RNA, 14 nt, Human
agccuccccugcca

SEQ ID NO: 1779834 - RNA, 15 nt, Human
agccuccccugccag

SEQ ID NO: 1779835 - RNA, 18 nt, Human
agccucccgaauagcugg

SEQ ID NO: 1779836 - RNA, 16 nt, Human
agccuccccugccagg

SEQ ID NO: 1779837 - RNA, 17 nt, Human
agccuccccugccaggg

SEQ ID NO: 1779838 - RNA, 18 nt, Human
agccuccccugccagggc

SEQ ID NO: 1779839 - RNA, 19 nt, Human
agccuccccugccagggca

SEQ ID NO: 1779840 - RNA, 19 nt, Human
agccucccgaauagcuggg

SEQ ID NO: 1779841 - RNA, 20 nt, Human
agccucccgaauagcuggga

SEQ ID NO: 1779842 - RNA, 22 nt, Human
agccucccgaauagcugggacu

SEQ ID NO: 1779843 - RNA, 17 nt, Human
agccucccgaguagcug

SEQ ID NO: 1779844 - RNA, 20 nt, Human
agccuccccugccagggcag

SEQ ID NO: 1779845 - RNA, 22 nt, Human
agccuccccugccagggcaggg

SEQ ID NO: 1779846 - RNA, 22 nt, Human
agccucccgaguagcugggacu

SEQ ID NO: 1779847 - RNA, 19 nt, Human
agccaaagcuaggccuggc

SEQ ID NO: 1779848 - RNA, 20 nt, Human
agccaaagcuaggccuggcc

SEQ ID NO: 1779849 - RNA, 23 nt, Human
agccaaagcuaggccuggccaga

SEQ ID NO: 1779850 - RNA, 17 nt, Human
agcacugcuugaggaaa

SEQ ID NO: 1779851 - RNA, 20 nt, Human
agcacuaaggugugcucuga

SEQ ID NO: 1779852 - RNA, 19 nt, Human
agcacuaaggugugcucug

SEQ ID NO: 1779853 - RNA, 21 nt, Human
agcagugaaugauucaguguu

SEQ ID NO: 1779854 - RNA, 22 nt, Human
agcagugaaugauucaguguua

SEQ ID NO: 1779855 - RNA, 20 nt, Human
agcagugaaugauucagugu

SEQ ID NO: 1779856 - RNA, 12 nt, Human
agcacugggcuc

SEQ ID NO: 1779857 - RNA, 15 nt, Human
agcacugggcucccg

SEQ ID NO: 1779858 - RNA, 16 nt, Human
agcacugggcucccgg

SEQ ID NO: 1779859 - RNA, 18 nt, Human
agcagcccaagcuucccu

SEQ ID NO: 1779860 - RNA, 19 nt, Human
agcagcccaagcuucccuc

SEQ ID NO: 1779861 - RNA, 21 nt, Human
agcagcccaagcuucccucca

SEQ ID NO: 1779862 - RNA, 21 nt, Human
agguaauccaagauauuuuaa

SEQ ID NO: 1779863 - RNA, 14 nt, Human
aggugcuguccaug

SEQ ID NO: 1779864 - RNA, 21 nt, Human
aggugcuggagcacugggcuc

SEQ ID NO: 1779865 - RNA, 22 nt, Human
aggugcuggagcacugggcucc

SEQ ID NO: 1779866 - RNA, 16 nt, Human
aggugcugccauccag

SEQ ID NO: 1779867 - RNA, 17 nt, Human
aggugcugccauccagg

SEQ ID NO: 1779868 - RNA, 16 nt, Human
aggugcuggagcacug

SEQ ID NO: 1779869 - RNA, 20 nt, Human
aggugcuggagcacugggcu

SEQ ID NO: 1779870 - RNA, 12 nt, Human
agguucauggau

SEQ ID NO: 1779871 - RNA, 13 nt, Human
agguucagcuugu

SEQ ID NO: 1779872 - RNA, 16 nt, Human
agguucacgugcagcu

SEQ ID NO: 1779873 - RNA, 16 nt, Human
agguucacuaaagcag

SEQ ID NO: 1779874 - RNA, 14 nt, Human
agguuccccuguca

SEQ ID NO: 1779875 - RNA, 21 nt, Human
aggggauagagagagaccacu

SEQ ID NO: 1779876 - RNA, 19 nt, Human
agggcgggaggauguucug

SEQ ID NO: 1779877 - RNA, 17 nt, Human
agggcacaccgggcacu

SEQ ID NO: 1779878 - RNA, 16 nt, Human
agggcacaaagauggg

SEQ ID NO: 1779879 - RNA, 20 nt, Human
agggcaaggguuaaggccug

SEQ ID NO: 1779880 - RNA, 21 nt, Human
agggcaaggguuaaggccuga

SEQ ID NO: 1779881 - RNA, 20 nt, Human
agggcacaccgggcacucag

SEQ ID NO: 1779882 - RNA, 21 nt, Human
agggcacaccgggcacucaga

SEQ ID NO: 1779883 - RNA, 13 nt, Human
aggcugccuccca

SEQ ID NO: 1779884 - RNA, 14 nt, Human
aggcugccucccaa

SEQ ID NO: 1779885 - RNA, 16 nt, Human
aggcugccucccaaca

SEQ ID NO: 1779886 - RNA, 23 nt, Human
aggaaaugucacagaagcagcua

SEQ ID NO: 1779887 - RNA, 20 nt, Human
aggaccccuccaugugggcu

SEQ ID NO: 1779888 - RNA, 22 nt, Human
aggagaggaaacuacugccuuu

SEQ ID NO: 1779889 - RNA, 15 nt, Human
aggaccuccaagcca

SEQ ID NO: 1779890 - RNA, 18 nt, Human
aggaccucugaaacccug

SEQ ID NO: 1779891 - RNA, 21 nt, Human
aggaccuccaagccacugagc

SEQ ID NO: 1779892 - RNA, 20 nt, Human
aggaccucugaaacccugga

SEQ ID NO: 1779893 - RNA, 17 nt, Human
aggaggggauagagaga

SEQ ID NO: 1779894 - RNA, 19 nt, Human
aggaggggccccccugccc

SEQ ID NO: 1779895 - RNA, 21 nt, Human
aggaggggccccccugcccug

SEQ ID NO: 1779896 - RNA, 23 nt, Human
aggaggggccccccugcccugug

SEQ ID NO: 1779897 - RNA, 20 nt, Human
aggauguucugggacacagu

SEQ ID NO: 1779898 - RNA, 19 nt, Human
aggaaaugaaaaugucuug

SEQ ID NO: 1779899 - RNA, 14 nt, Human
aggaaaaauauuua

SEQ ID NO: 1779900 - RNA, 13 nt, Human
agcuucaggaacc

SEQ ID NO: 1779901 - RNA, 16 nt, Human
agcuucaggaaccucg

SEQ ID NO: 1779902 - RNA, 23 nt, Human
agcuucaggaaccucgaguacug

SEQ ID NO: 1779903 - RNA, 17 nt, Human
agcugggugucaagagg

SEQ ID NO: 1779904 - RNA, 22 nt, Human
agcugggugucaagagggucug

SEQ ID NO: 1779905 - RNA, 15 nt, Human
agcugcucugagcca

SEQ ID NO: 1779906 - RNA, 16 nt, Human
agcugcucugagccac

SEQ ID NO: 1779907 - RNA, 18 nt, Human
agcugcucugagccacag

SEQ ID NO: 1779908 - RNA, 21 nt, Human
agcuggucccacucaguccau

SEQ ID NO: 1779909 - RNA, 17 nt, Human
agcugcuccccagcagc

SEQ ID NO: 1779910 - RNA, 20 nt, Human
agcugcuccccagcagcgga

SEQ ID NO: 1779911 - RNA, 16 nt, Human
agcuccucacucaccu

SEQ ID NO: 1779912 - RNA, 20 nt, Human
cucguugacuggcugugugu

SEQ ID NO: 1779913 - RNA, 21 nt, Human
cucuaucauggugaaaagcuc

SEQ ID NO: 1779914 - RNA, 23 nt, Human
cucuaucauuuaauaauauacuu

SEQ ID NO: 1779915 - RNA, 21 nt, Human
cucuaucauuuaauaauauac

SEQ ID NO: 1779916 - RNA, 15 nt, Human
cucuaucauuuaaua

SEQ ID NO: 1779917 - RNA, 14 nt, Human
cucuaucauuuaau

SEQ ID NO: 1779918 - RNA, 23 nt, Human
cucguugacuggcuguguguugg

SEQ ID NO: 1779919 - RNA, 17 nt, Human
cucucaggaccaaagcu

SEQ ID NO: 1779920 - RNA, 12 nt, Human
cuccugggcccu

SEQ ID NO: 1779921 - RNA, 14 nt, Human
cuccugggcccucu

SEQ ID NO: 1779922 - RNA, 21 nt, Human
cuccuggguuuuguauucucu

SEQ ID NO: 1779923 - RNA, 13 nt, Human
cucgaacuggcug

SEQ ID NO: 1779924 - RNA, 14 nt, Human
cucgaacuggcugc

SEQ ID NO: 1779925 - RNA, 15 nt, Human
cucgaacuggcugca

SEQ ID NO: 1779926 - RNA, 16 nt, Human
cucgaacuggcugcaa

SEQ ID NO: 1779927 - RNA, 11 nt, Human
cuccucugaaa

SEQ ID NO: 1779928 - RNA, 12 nt, Human
cuccucugaaac

SEQ ID NO: 1779929 - RNA, 13 nt, Human
cuccucugaaaca

SEQ ID NO: 1779930 - RNA, 14 nt, Human
cuccucugaaacag

SEQ ID NO: 1779931 - RNA, 15 nt, Human
cuccucugaaacagc

SEQ ID NO: 1779932 - RNA, 16 nt, Human
cuccucugaaacagcu

SEQ ID NO: 1779933 - RNA, 17 nt, Human
cuccucugaaacagcug

SEQ ID NO: 1779934 - RNA, 18 nt, Human
cuccucugaaacagcugc

SEQ ID NO: 1779935 - RNA, 23 nt, Human
cuccucugugaccaaugucuuga

SEQ ID NO: 1779936 - RNA, 22 nt, Human
cuccucugugaccaaugucuug

SEQ ID NO: 1779937 - RNA, 13 nt, Human
cuccucugugacc

SEQ ID NO: 1779938 - RNA, 12 nt, Human
cuccucugugaa

SEQ ID NO: 1779939 - RNA, 18 nt, Human
cuccucugugaagcauuc

SEQ ID NO: 1779940 - RNA, 13 nt, Human
cucaucugucccu

SEQ ID NO: 1779941 - RNA, 15 nt, Human
cucaucugucccucc

SEQ ID NO: 1779942 - RNA, 17 nt, Human
cucaucugucccuccgg

SEQ ID NO: 1779943 - RNA, 18 nt, Human
cucaucugucccuccggg

SEQ ID NO: 1779944 - RNA, 16 nt, Human
cuccaacucagaaggg

SEQ ID NO: 1779945 - RNA, 16 nt, Human
cuccccauuagcuuuc

SEQ ID NO: 1779946 - RNA, 14 nt, Human
cugacccauugcug

SEQ ID NO: 1779947 - RNA, 16 nt, Human
cugacccauugcuguu

SEQ ID NO: 1779948 - RNA, 21 nt, Human
cugaccugguccacagggcac

SEQ ID NO: 1779949 - RNA, 16 nt, Human
cugaccugguccacag

SEQ ID NO: 1779950 - RNA, 17 nt, Human
cugaccugguccacagg

SEQ ID NO: 1779951 - RNA, 18 nt, Human
cugaccugguccacaggg

SEQ ID NO: 1779952 - RNA, 20 nt, Human
cugaccugguccacagggca

SEQ ID NO: 1779953 - RNA, 14 nt, Human
cugagagucagcuc

SEQ ID NO: 1779954 - RNA, 17 nt, Human
cugagagucagcucucu

SEQ ID NO: 1779955 - RNA, 18 nt, Human
cugagagucagcucucug

SEQ ID NO: 1779956 - RNA, 22 nt, Human
cugagagucagcucucugcccu

SEQ ID NO: 1779957 - RNA, 18 nt, Human
cugagauaccagcgagga

SEQ ID NO: 1779958 - RNA, 21 nt, Human
cugagaggacuuuucuuugug

SEQ ID NO: 1779959 - RNA, 22 nt, Human
cugagaggacuuuucuuugugg

SEQ ID NO: 1779960 - RNA, 13 nt, Human
cugaggaggggag

SEQ ID NO: 1779961 - RNA, 20 nt, Human
cugaguagaaaggccuuuaa

SEQ ID NO: 1779962 - RNA, 19 nt, Human
cugaguagaaaggccuuua

SEQ ID NO: 1779963 - RNA, 14 nt, Human
cugaguagaaaggc

SEQ ID NO: 1779964 - RNA, 12 nt, Human
cugaguagaaag

SEQ ID NO: 1779965 - RNA, 23 nt, Human
cugaggacacuaaccacgcugga

SEQ ID NO: 1779966 - RNA, 21 nt, Human
cugaggaauccagacccggcu

SEQ ID NO: 1779967 - RNA, 20 nt, Human
cugaggacacuaaccacgcu

SEQ ID NO: 1779968 - RNA, 17 nt, Human
cugaggaauccagaccc

SEQ ID NO: 1779969 - RNA, 20 nt, Human
cugaggaauccagacccggc

SEQ ID NO: 1779970 - RNA, 19 nt, Human
cucuuuuccccuuuccugu

SEQ ID NO: 1779971 - RNA, 20 nt, Human
cucuuuuccccuuuccuguc

SEQ ID NO: 1779972 - RNA, 21 nt, Human
cucuuuuccccuuuccugucc

SEQ ID NO: 1779973 - RNA, 11 nt, Human
cucuuuuuaag

SEQ ID NO: 1779974 - RNA, 10 nt, Human
cugaaacagc

SEQ ID NO: 1779975 - RNA, 11 nt, Human
cugaaacagcu

SEQ ID NO: 1779976 - RNA, 12 nt, Human
cugaaacagcug

SEQ ID NO: 1779977 - RNA, 13 nt, Human
cugaaacagcugc

SEQ ID NO: 1779978 - RNA, 14 nt, Human
cugaaacagcugcc

SEQ ID NO: 1779979 - RNA, 15 nt, Human
cugaaacagcugccu

SEQ ID NO: 1779980 - RNA, 16 nt, Human
cugaaacagcugccuu

SEQ ID NO: 1779981 - RNA, 17 nt, Human
cugaaacagcugccuua

SEQ ID NO: 1779982 - RNA, 18 nt, Human
cugaaacagcugccuuag

SEQ ID NO: 1779983 - RNA, 19 nt, Human
cugaaacagcugccuuagc

SEQ ID NO: 1779984 - RNA, 20 nt, Human
cugaaacagcugccuuagcu

SEQ ID NO: 1779985 - RNA, 22 nt, Human
cugaaacagcugccuuagcuuc

SEQ ID NO: 1779986 - RNA, 23 nt, Human
cugaaacagcugccuuagcuuca

SEQ ID NO: 1779987 - RNA, 14 nt, Human
cugaaaccaguguu

SEQ ID NO: 1779988 - RNA, 16 nt, Human
cugaaacccuggacca

SEQ ID NO: 1779989 - RNA, 19 nt, Human
cugaaacgcuccuuugugu

SEQ ID NO: 1779990 - RNA, 20 nt, Human
cugaaacgcuccuuugugug

SEQ ID NO: 1779991 - RNA, 12 nt, Human
cugaaacuauau

SEQ ID NO: 1779992 - RNA, 20 nt, Human
cugaaacuauauuuugucau

SEQ ID NO: 1779993 - RNA, 23 nt, Human
cugaaggacauugcggacagcca

SEQ ID NO: 1779994 - RNA, 20 nt, Human
cugaagcugacgaacuucca

SEQ ID NO: 1779995 - RNA, 12 nt, Human
cugaaggagccc

SEQ ID NO: 1779996 - RNA, 13 nt, Human
cugaaggagcccc

SEQ ID NO: 1779997 - RNA, 21 nt, Human
cugaaggagccccauuccugg

SEQ ID NO: 1779998 - RNA, 21 nt, Human
cugaaagacugaagaaagugu

SEQ ID NO: 1779999 - RNA, 17 nt, Human
cugaaggcuaaaaagca

SEQ ID NO: 1780000 - RNA, 19 nt, Human
cugaaggcuaaaaagcaac

SEQ ID NO: 1780001 - RNA, 22 nt, Human
cugaaggcuaaaaagcaacagg

SEQ ID NO: 1780002 - RNA, 13 nt, Human
cucuucagaggcc

SEQ ID NO: 1780003 - RNA, 17 nt, Human
cucuucagaggcccucg

SEQ ID NO: 1780004 - RNA, 14 nt, Human
cucuuauugcccac

SEQ ID NO: 1780005 - RNA, 15 nt, Human
cucuuauugcccacg

SEQ ID NO: 1780006 - RNA, 19 nt, Human
cucuuauugcccacgcugg

SEQ ID NO: 1780007 - RNA, 20 nt, Human
cucuuauugcccacgcugga

SEQ ID NO: 1780008 - RNA, 13 nt, Human
cucuuauugccca

SEQ ID NO: 1780009 - RNA, 13 nt, Human
cucugcuccucuc

SEQ ID NO: 1780010 - RNA, 18 nt, Human
cucugcuccucuccccag

SEQ ID NO: 1780011 - RNA, 20 nt, Human
cucugcuccucuccccagca

SEQ ID NO: 1780012 - RNA, 16 nt, Human
cucuggguccuuccug

SEQ ID NO: 1780013 - RNA, 17 nt, Human
cucuggguccuuccuga

SEQ ID NO: 1780014 - RNA, 18 nt, Human
cucuggguccuuccugaa

SEQ ID NO: 1780015 - RNA, 21 nt, Human
cucuggguccuuccugaaacu

SEQ ID NO: 1780016 - RNA, 15 nt, Human
cucuggguccuuccu

SEQ ID NO: 1780017 - RNA, 20 nt, Human
cucugggucagugguccaca

SEQ ID NO: 1780018 - RNA, 17 nt, Human
cucugggucaguggucc

SEQ ID NO: 1780019 - RNA, 13 nt, Human
cucugcugacaga

SEQ ID NO: 1780020 - RNA, 13 nt, Human
cucugcucugcgu

SEQ ID NO: 1780021 - RNA, 14 nt, Human
cucugcugacagac

SEQ ID NO: 1780022 - RNA, 16 nt, Human
cucugcugacagacac

SEQ ID NO: 1780023 - RNA, 14 nt, Human
cucuguccaggcac

SEQ ID NO: 1780024 - RNA, 19 nt, Human
cucuguccaggcacugaga

SEQ ID NO: 1780025 - RNA, 15 nt, Human
cucugguuaucuaau

SEQ ID NO: 1780026 - RNA, 16 nt, Human
cggagucccaccuugg

SEQ ID NO: 1780027 - RNA, 24 nt, Human
cgcugccccaucuccccucagcuc

SEQ ID NO: 1780028 - RNA, 14 nt, Human
cgcugccccaucuc

SEQ ID NO: 1780029 - RNA, 21 nt, Human
cgcugccccaucuccccucag

SEQ ID NO: 1780030 - RNA, 23 nt, Human
cgcugccccaucuccccucagcu

SEQ ID NO: 1780031 - RNA, 15 nt, Human
cgcugccagcucugu

SEQ ID NO: 1780032 - RNA, 19 nt, Human
cgcugccagcucuguauca

SEQ ID NO: 1780033 - RNA, 14 nt, Human
cggggacagcuccu

SEQ ID NO: 1780034 - RNA, 14 nt, Human
cgggcugagggccu

SEQ ID NO: 1780035 - RNA, 15 nt, Human
cgggcugagggccug

SEQ ID NO: 1780036 - RNA, 16 nt, Human
cgggcugagggccugc

SEQ ID NO: 1780037 - RNA, 19 nt, Human
cgggcugagggccugcugg

SEQ ID NO: 1780038 - RNA, 15 nt, Human
cggggacagcuccuu

SEQ ID NO: 1780039 - RNA, 17 nt, Human
cgggccacagagaaagu

SEQ ID NO: 1780040 - RNA, 12 nt, Human
cgggccacagag

SEQ ID NO: 1780041 - RNA, 14 nt, Human
cgggccacagagaa

SEQ ID NO: 1780042 - RNA, 13 nt, Human
cggcucccagccu

SEQ ID NO: 1780043 - RNA, 14 nt, Human
cggcucccagccuc

SEQ ID NO: 1780044 - RNA, 15 nt, Human
cggcucccagccuca

SEQ ID NO: 1780045 - RNA, 17 nt, Human
cggcucccagccucagc

SEQ ID NO: 1780046 - RNA, 19 nt, Human
cggcucccagccucagcgc

SEQ ID NO: 1780047 - RNA, 13 nt, Human
cggcuccaggcuc

SEQ ID NO: 1780048 - RNA, 14 nt, Human
cggcuccaggcucc

SEQ ID NO: 1780049 - RNA, 15 nt, Human
cggcuccaggcuccu

SEQ ID NO: 1780050 - RNA, 16 nt, Human
cggcuccaggcuccuu

SEQ ID NO: 1780051 - RNA, 18 nt, Human
cggagucccaccuuggcu

SEQ ID NO: 1780052 - RNA, 20 nt, Human
cggagucccaccuuggcugc

SEQ ID NO: 1780053 - RNA, 15 nt, Human
cggcucacugcagcc

SEQ ID NO: 1780054 - RNA, 14 nt, Human
cggcucacugcagc

SEQ ID NO: 1780055 - RNA, 16 nt, Human
cggcucacugcagccu

SEQ ID NO: 1780056 - RNA, 17 nt, Human
cggcucacugcagccuc

SEQ ID NO: 1780057 - RNA, 12 nt, Human
cggcuccaggcu

SEQ ID NO: 1780058 - RNA, 15 nt, Human
cggcuccacuaggac

SEQ ID NO: 1780059 - RNA, 14 nt, Human
cgugcacacaccag

SEQ ID NO: 1780060 - RNA, 18 nt, Human
cgauaucagaauuugugu

SEQ ID NO: 1780061 - RNA, 18 nt, Human
cgaucacaacgugcauug

SEQ ID NO: 1780062 - RNA, 18 nt, Human
cgcauucuaaccuggagg

SEQ ID NO: 1780063 - RNA, 19 nt, Human
cgcauucuaaccuggaggu

SEQ ID NO: 1780064 - RNA, 24 nt, Human
cgaucacaacgugcauugugcuuc

SEQ ID NO: 1780065 - RNA, 18 nt, Human
cgcaggagcacacccagc

SEQ ID NO: 1780066 - RNA, 23 nt, Human
cgcaggagcacacccagccccca

SEQ ID NO: 1780067 - RNA, 23 nt, Human
cgaucacaacgugcauugugcuu

SEQ ID NO: 1780068 - RNA, 22 nt, Human
cgaucacaacgugcauugugcu

SEQ ID NO: 1780069 - RNA, 20 nt, Human
cgccugaggaacccuuacag

SEQ ID NO: 1780070 - RNA, 19 nt, Human
cgccugcaaacgcugccug

SEQ ID NO: 1780071 - RNA, 18 nt, Human
cgccugcaaacgcugccu

SEQ ID NO: 1780072 - RNA, 19 nt, Human
cgccuggcugcagccugcg

SEQ ID NO: 1780073 - RNA, 15 nt, Human
cgccugcugcaugcc

SEQ ID NO: 1780074 - RNA, 11 nt, Human
cgccuccagga

SEQ ID NO: 1780075 - RNA, 16 nt, Human
cgacgcuugcucuguu

SEQ ID NO: 1780076 - RNA, 19 nt, Human
cgacucuuucugagugccu

SEQ ID NO: 1780077 - RNA, 21 nt, Human
cgacucuuucugagugccuuc

SEQ ID NO: 1780078 - RNA, 22 nt, Human
cgacucuuucugagugccuucu

SEQ ID NO: 1780079 - RNA, 15 nt, Human
cgacuaaacuagauu

SEQ ID NO: 1780080 - RNA, 21 nt, Human
cgacuaaacuagauuuucacu

SEQ ID NO: 1780081 - RNA, 17 nt, Human
cgacacugggaggccag

SEQ ID NO: 1780082 - RNA, 16 nt, Human
cgaauuucugugcccu

SEQ ID NO: 1780083 - RNA, 20 nt, Human
cgaauuucugugcccuccug

SEQ ID NO: 1780084 - RNA, 13 nt, Human
ccuuuuuuaaaaa

SEQ ID NO: 1780085 - RNA, 16 nt, Human
ccuuuuuuaaaaaugc

SEQ ID NO: 1780086 - RNA, 17 nt, Human
ccuuuuuuaaaaaugca

SEQ ID NO: 1780087 - RNA, 17 nt, Human
ccuuucaccccagggcc

SEQ ID NO: 1780088 - RNA, 12 nt, Human
ccuuuagaaaau

SEQ ID NO: 1780089 - RNA, 14 nt, Human
ccuuuagaaaauau

SEQ ID NO: 1780090 - RNA, 16 nt, Human
ccuuuagaaaauauaa

SEQ ID NO: 1780091 - RNA, 19 nt, Human
ccuuucaccccagggccug

SEQ ID NO: 1780092 - RNA, 21 nt, Human
ccuuucaccccagggccugag

SEQ ID NO: 1780093 - RNA, 19 nt, Human
ccuuuacccucuuugcugc

SEQ ID NO: 1780094 - RNA, 21 nt, Human
ccuuuacccucuuugcugcag

SEQ ID NO: 1780095 - RNA, 22 nt, Human
ccuuuacccucuuugcugcaga

SEQ ID NO: 1780096 - RNA, 21 nt, Human
cuaucauuuaauaauauacuu

SEQ ID NO: 1780097 - RNA, 17 nt, Human
cuaucauuuaauaauau

SEQ ID NO: 1780098 - RNA, 15 nt, Human
cuaucauuuaauaau

SEQ ID NO: 1780099 - RNA, 13 nt, Human
cuaucauuuaaua

SEQ ID NO: 1780100 - RNA, 12 nt, Human
cuauuuuuguac

SEQ ID NO: 1780101 - RNA, 13 nt, Human
cucaaugcacuga

SEQ ID NO: 1780102 - RNA, 15 nt, Human
cucaaugcacugaca

SEQ ID NO: 1780103 - RNA, 13 nt, Human
cucaaugcucaua

SEQ ID NO: 1780104 - RNA, 12 nt, Human
cucaaugcucau

SEQ ID NO: 1780105 - RNA, 15 nt, Human
cucaaugcucauaac

SEQ ID NO: 1780106 - RNA, 20 nt, Human
cucaaacucuugaccucagg

SEQ ID NO: 1780107 - RNA, 14 nt, Human
cuaagugugaacug

SEQ ID NO: 1780108 - RNA, 23 nt, Human
cuaagugauccucccaccucagc

SEQ ID NO: 1780109 - RNA, 19 nt, Human
cuacgccucuucugucccu

SEQ ID NO: 1780110 - RNA, 14 nt, Human
cuacgccugcaugu

SEQ ID NO: 1780111 - RNA, 18 nt, Human
cuagcauaucugccuuua

SEQ ID NO: 1780112 - RNA, 17 nt, Human
cuagcauaucugccuuu

SEQ ID NO: 1780113 - RNA, 15 nt, Human
cuagcauaucugccu

SEQ ID NO: 1780114 - RNA, 14 nt, Human
cuagcauaucugcc

SEQ ID NO: 1780115 - RNA, 19 nt, Human
ccugccucgaacuggcugc

SEQ ID NO: 1780116 - RNA, 21 nt, Human
ccugccucgaacuggcugcaa

SEQ ID NO: 1780117 - RNA, 23 nt, Human
ccugccucgaacuggcugcaaag

SEQ ID NO: 1780118 - RNA, 17 nt, Human
ccugccucccuugacuu

SEQ ID NO: 1780119 - RNA, 13 nt, Human
ccugcccaggccc

SEQ ID NO: 1780120 - RNA, 16 nt, Human
ccugcccccaauccau

SEQ ID NO: 1780121 - RNA, 15 nt, Human
ccugcccccaaucca

SEQ ID NO: 1780122 - RNA, 16 nt, Human
ccugcacuugcagacu

SEQ ID NO: 1780123 - RNA, 17 nt, Human
ccugcacuugcagacuc

SEQ ID NO: 1780124 - RNA, 18 nt, Human
ccugcacuugcagacucu

SEQ ID NO: 1780125 - RNA, 19 nt, Human
ccugcacuugcagacucua

SEQ ID NO: 1780126 - RNA, 23 nt, Human
ccugcagcaggaauauaugugug

SEQ ID NO: 1780127 - RNA, 22 nt, Human
ccuggccucaagugauucuccu

SEQ ID NO: 1780128 - RNA, 11 nt, Human
ccugggcccuc

SEQ ID NO: 1780129 - RNA, 14 nt, Human
ccugggcccucucu

SEQ ID NO: 1780130 - RNA, 21 nt, Human
ccugguggcagugggagcugc

SEQ ID NO: 1780131 - RNA, 13 nt, Human
ccuggggccugac

SEQ ID NO: 1780132 - RNA, 14 nt, Human
ccuggggccugacu

SEQ ID NO: 1780133 - RNA, 16 nt, Human
ccuggggccugacugc

SEQ ID NO: 1780134 - RNA, 17 nt, Human
ccuggggccugacugcu

SEQ ID NO: 1780135 - RNA, 18 nt, Human
ccuggggccugacugcuc

SEQ ID NO: 1780136 - RNA, 15 nt, Human
ccugggcccucucug

SEQ ID NO: 1780137 - RNA, 18 nt, Human
ccugggcccucucugcuc

SEQ ID NO: 1780138 - RNA, 20 nt, Human
ccugggccguaucuccggcu

SEQ ID NO: 1780139 - RNA, 22 nt, Human
ccugggccguaucuccggcucc

SEQ ID NO: 1780140 - RNA, 12 nt, Human
ccugucugcccc

SEQ ID NO: 1780141 - RNA, 14 nt, Human
ccugucugccccag

SEQ ID NO: 1780142 - RNA, 17 nt, Human
ccugucugccccagccc

SEQ ID NO: 1780143 - RNA, 19 nt, Human
ccugucugccccagcccag

SEQ ID NO: 1780144 - RNA, 20 nt, Human
ccugucugccccagcccaga

SEQ ID NO: 1780145 - RNA, 13 nt, Human
cccuucgcuccug

SEQ ID NO: 1780146 - RNA, 13 nt, Human
ccggccccugcug

SEQ ID NO: 1780147 - RNA, 14 nt, Human
cccuucgcuccugu

SEQ ID NO: 1780148 - RNA, 15 nt, Human
cccuucgcuccugug

SEQ ID NO: 1780149 - RNA, 14 nt, Human
ccggccccugcugg

SEQ ID NO: 1780150 - RNA, 15 nt, Human
ccggcgagcccugug

SEQ ID NO: 1780151 - RNA, 17 nt, Human
ccggcgagcccugugga

SEQ ID NO: 1780152 - RNA, 15 nt, Human
ccucccaccucagcc

SEQ ID NO: 1780153 - RNA, 17 nt, Human
ccucccaccucagccuc

SEQ ID NO: 1780154 - RNA, 15 nt, Human
ccucaaaacuggagu

SEQ ID NO: 1780155 - RNA, 17 nt, Human
ccucaaaacuggagucc

SEQ ID NO: 1780156 - RNA, 17 nt, Human
cccucagaacccuuggc

SEQ ID NO: 1780157 - RNA, 18 nt, Human
cccucagaacccuuggcu

SEQ ID NO: 1780158 - RNA, 21 nt, Human
cccucagaacccuuggcuugc

SEQ ID NO: 1780159 - RNA, 22 nt, Human
cccucagaacccuuggcuugcc

SEQ ID NO: 1780160 - RNA, 23 nt, Human
cccucagaacccuuggcuugccc

SEQ ID NO: 1780161 - RNA, 20 nt, Human
cccgggaaccuccccagccu

SEQ ID NO: 1780162 - RNA, 22 nt, Human
cccgggaaccuccccagccugc

SEQ ID NO: 1780163 - RNA, 23 nt, Human
cccgggaaccuccccagccugcg

SEQ ID NO: 1780164 - RNA, 12 nt, Human
cccggcugcgga

SEQ ID NO: 1780165 - RNA, 14 nt, Human
cccuaugggccugc

SEQ ID NO: 1780166 - RNA, 21 nt, Human
cccuaugggccugccgggcug

SEQ ID NO: 1780167 - RNA, 15 nt, Human
ccccauucugccugc

SEQ ID NO: 1780168 - RNA, 13 nt, Human
ccccauucugccu

SEQ ID NO: 1780169 - RNA, 14 nt, Human
ccccauucugccug

SEQ ID NO: 1780170 - RNA, 19 nt, Human
ccccaucuucgggaccagg

SEQ ID NO: 1780171 - RNA, 16 nt, Human
ccccaucuucgggacc

SEQ ID NO: 1780172 - RNA, 18 nt, Human
ccccaucuucgggaccag

SEQ ID NO: 1780173 - RNA, 23 nt, Human
ccccauuccugggaaauauuccc

SEQ ID NO: 1780174 - RNA, 19 nt, Human
ccccuucgcuccugugucu

SEQ ID NO: 1780175 - RNA, 14 nt, Human
ccccuucgcuccug

SEQ ID NO: 1780176 - RNA, 15 nt, Human
ccccuucgcuccugu

SEQ ID NO: 1780177 - RNA, 17 nt, Human
ccccuucgcuccugugu

SEQ ID NO: 1780178 - RNA, 19 nt, Human
cccaguuuuguugccccag

SEQ ID NO: 1780179 - RNA, 23 nt, Human
cccauaaggggucaaaauuugcu

SEQ ID NO: 1780180 - RNA, 23 nt, Human
cccauucugccugcccaggcccc

SEQ ID NO: 1780181 - RNA, 21 nt, Human
ccccagauugcaacaggcugg

SEQ ID NO: 1780182 - RNA, 22 nt, Human
ccccagauugcaacaggcuggg

SEQ ID NO: 1780183 - RNA, 23 nt, Human
ccccagauugcaacaggcugggc

SEQ ID NO: 1780184 - RNA, 17 nt, Human
ccccagcaagugagagc

SEQ ID NO: 1780185 - RNA, 19 nt, Human
ccccagcaagugagagcug

SEQ ID NO: 1780186 - RNA, 20 nt, Human
ccccagcaagugagagcugg

SEQ ID NO: 1780187 - RNA, 21 nt, Human
ccccagcaagugagagcuggg

SEQ ID NO: 1780188 - RNA, 20 nt, Human
cccauucugccugcccaggc

SEQ ID NO: 1780189 - RNA, 21 nt, Human
cccauucugccugcccaggcc

SEQ ID NO: 1780190 - RNA, 22 nt, Human
cccauucugccugcccaggccc

SEQ ID NO: 1780191 - RNA, 17 nt, Human
cccagcccacuucugcc

SEQ ID NO: 1780192 - RNA, 14 nt, Human
cccagcccacuucu

SEQ ID NO: 1780193 - RNA, 21 nt, Human
cccagcacugcuugaggaaaa

SEQ ID NO: 1780194 - RNA, 21 nt, Human
cccagcugugcucuggacagg

SEQ ID NO: 1780195 - RNA, 23 nt, Human
cccagcugugcucuggacaggca

SEQ ID NO: 1780196 - RNA, 17 nt, Human
ccacucucuaccagaua

SEQ ID NO: 1780197 - RNA, 21 nt, Human
ccacucugcucgccuuagcac

SEQ ID NO: 1780198 - RNA, 13 nt, Human
ccagcuucccgag

SEQ ID NO: 1780199 - RNA, 19 nt, Human
ccagcuucauguggcuucc

SEQ ID NO: 1780200 - RNA, 17 nt, Human
ccaggauuugcacagaa

SEQ ID NO: 1780201 - RNA, 21 nt, Human
ccagucacugugagcucccag

SEQ ID NO: 1780202 - RNA, 17 nt, Human
ccaguauuuuugcugcu

SEQ ID NO: 1780203 - RNA, 19 nt, Human
ccaguauuuuugcugcuuc

SEQ ID NO: 1780204 - RNA, 20 nt, Human
ccaguauuuuugcugcuucu

SEQ ID NO: 1780205 - RNA, 14 nt, Human
ccagucaaccuggg

SEQ ID NO: 1780206 - RNA, 17 nt, Human
ccaugggccuccugugu

SEQ ID NO: 1780207 - RNA, 14 nt, Human
ccaugggccuccug

SEQ ID NO: 1780208 - RNA, 15 nt, Human
ccaugggccuccugu

SEQ ID NO: 1780209 - RNA, 13 nt, Human
ccauugaauucuu

SEQ ID NO: 1780210 - RNA, 22 nt, Human
ccauugaauucuugguugagga

SEQ ID NO: 1780211 - RNA, 14 nt, Human
ccaugagccucagc

SEQ ID NO: 1780212 - RNA, 18 nt, Human
ccaugagccucagcaucc

SEQ ID NO: 1780213 - RNA, 19 nt, Human
ccaugagccucagcauccu

SEQ ID NO: 1780214 - RNA, 13 nt, Human
ccaugggccuccu

SEQ ID NO: 1780215 - RNA, 14 nt, Human
ccauacacccccuc

SEQ ID NO: 1780216 - RNA, 19 nt, Human
ccauacacccccucuucug

SEQ ID NO: 1780217 - RNA, 20 nt, Human
auuucuccuccaugggagaa

SEQ ID NO: 1780218 - RNA, 18 nt, Human
auuucucagacuuuggaa

SEQ ID NO: 1780219 - RNA, 16 nt, Human
auuucucagacuuugg

SEQ ID NO: 1780220 - RNA, 21 nt, Human
auuucucagacuuuggaaaau

SEQ ID NO: 1780221 - RNA, 18 nt, Human
auuuaauuagugcuaagu

SEQ ID NO: 1780222 - RNA, 16 nt, Human
auuuaauuagugcuaa

SEQ ID NO: 1780223 - RNA, 15 nt, Human
auuuaauuagugcua

SEQ ID NO: 1780224 - RNA, 16 nt, Human
auuucagcagcugcag

SEQ ID NO: 1780225 - RNA, 13 nt, Human
auuuauaguaaug

SEQ ID NO: 1780226 - RNA, 21 nt, Human
auuuauaguaaugaguuuaaa

SEQ ID NO: 1780227 - RNA, 23 nt, Human
auuguaauaggcguaacuaauuu

SEQ ID NO: 1780228 - RNA, 17 nt, Human
auucuugguugaggaaa

SEQ ID NO: 1780229 - RNA, 18 nt, Human
auucuugguugaggaaac

SEQ ID NO: 1780230 - RNA, 17 nt, Human
auucuuucgaaagaaga

SEQ ID NO: 1780231 - RNA, 11 nt, Human
auucucugagc

SEQ ID NO: 1780232 - RNA, 17 nt, Human
auucuugccaaauauaa

SEQ ID NO: 1780233 - RNA, 13 nt, Human
auucauuuucuag

SEQ ID NO: 1780234 - RNA, 14 nt, Human
auucauuuucuaga

SEQ ID NO: 1780235 - RNA, 15 nt, Human
auucauuuucuagau

SEQ ID NO: 1780236 - RNA, 16 nt, Human
auucauuuucuagaua

SEQ ID NO: 1780237 - RNA, 21 nt, Human
auucauuuucuagauacaaua

SEQ ID NO: 1780238 - RNA, 22 nt, Human
auucauuuucuagauacaauaa

SEQ ID NO: 1780239 - RNA, 13 nt, Human
auuccaaagcaaa

SEQ ID NO: 1780240 - RNA, 16 nt, Human
auuccaaaaagcacau

SEQ ID NO: 1780241 - RNA, 17 nt, Human
auuccaaaaagcacaua

SEQ ID NO: 1780242 - RNA, 20 nt, Human
auuccucuacuaacaaucag

SEQ ID NO: 1780243 - RNA, 21 nt, Human
auucaagccauuccaaaguuc

SEQ ID NO: 1780244 - RNA, 11 nt, Human
auuauguuaaa

SEQ ID NO: 1780245 - RNA, 13 nt, Human
auucaacuaaaaa

SEQ ID NO: 1780246 - RNA, 14 nt, Human
auucaacuaaaaaa

SEQ ID NO: 1780247 - RNA, 23 nt, Human
auucaacuaaaaaaaaaaaagua

SEQ ID NO: 1780248 - RNA, 13 nt, Human
caacaauuucuac

SEQ ID NO: 1780249 - RNA, 18 nt, Human
caacaauuucuacuuuga

SEQ ID NO: 1780250 - RNA, 19 nt, Human
caacaauuucuacuuugaa

SEQ ID NO: 1780251 - RNA, 20 nt, Human
caacaauuucuacuuugaag

SEQ ID NO: 1780252 - RNA, 14 nt, Human
caagauuaaaugua

SEQ ID NO: 1780253 - RNA, 12 nt, Human
caagaagggcug

SEQ ID NO: 1780254 - RNA, 13 nt, Human
caagaagggcugc

SEQ ID NO: 1780255 - RNA, 14 nt, Human
caagaagggcugca

SEQ ID NO: 1780256 - RNA, 15 nt, Human
caagaagggcugcau

SEQ ID NO: 1780257 - RNA, 16 nt, Human
caagaagggcugcaug

SEQ ID NO: 1780258 - RNA, 17 nt, Human
caagaagggcugcauga

SEQ ID NO: 1780259 - RNA, 19 nt, Human
caagaagggcugcaugaug

SEQ ID NO: 1780260 - RNA, 20 nt, Human
caagaagggcugcaugaugu

SEQ ID NO: 1780261 - RNA, 15 nt, Human
caacccccagccugc

SEQ ID NO: 1780262 - RNA, 16 nt, Human
caacccccagccugcu

SEQ ID NO: 1780263 - RNA, 17 nt, Human
caacccccagccugcua

SEQ ID NO: 1780264 - RNA, 20 nt, Human
caaaagguucacuaaagcag

SEQ ID NO: 1780265 - RNA, 20 nt, Human
caaaaguggccucuuugucu

SEQ ID NO: 1780266 - RNA, 20 nt, Human
caaaccaacaggcuaccaac

SEQ ID NO: 1780267 - RNA, 14 nt, Human
caaaaguggccucu

SEQ ID NO: 1780268 - RNA, 16 nt, Human
caaaaguggccucuuu

SEQ ID NO: 1780269 - RNA, 17 nt, Human
caaaaguggccucuuug

SEQ ID NO: 1780270 - RNA, 18 nt, Human
caaaaguggccucuuugu

SEQ ID NO: 1780271 - RNA, 17 nt, Human
caaaagcgcuuuuccuu

SEQ ID NO: 1780272 - RNA, 22 nt, Human
caaaagcgcuuuuccuuggcau

SEQ ID NO: 1780273 - RNA, 12 nt, Human
auuuuuaaauaa

SEQ ID NO: 1780274 - RNA, 15 nt, Human
auuuuuaaauaauuu

SEQ ID NO: 1780275 - RNA, 19 nt, Human
auuuuuaaauguaaaacau

SEQ ID NO: 1780276 - RNA, 13 nt, Human
auuuuuaaaugug

SEQ ID NO: 1780277 - RNA, 15 nt, Human
auuuuuaaauguguu

SEQ ID NO: 1780278 - RNA, 21 nt, Human
auuuuuaagcaaaauauuauu

SEQ ID NO: 1780279 - RNA, 13 nt, Human
auuuuauaagaaa

SEQ ID NO: 1780280 - RNA, 14 nt, Human
auuuuauaagaaaa

SEQ ID NO: 1780281 - RNA, 15 nt, Human
auuuuauaagaaaaa

SEQ ID NO: 1780282 - RNA, 16 nt, Human
auuuuauaagaaaaac

SEQ ID NO: 1780283 - RNA, 17 nt, Human
auuuuauaagaaaaacu

SEQ ID NO: 1780284 - RNA, 20 nt, Human
auuuuauaagaaaaacuuuu

SEQ ID NO: 1780285 - RNA, 18 nt, Human
auuuugauccaagcuggu

SEQ ID NO: 1780286 - RNA, 20 nt, Human
auuuugauauaaucuuucaa

SEQ ID NO: 1780287 - RNA, 20 nt, Human
cacagcucuguccugggagu

SEQ ID NO: 1780288 - RNA, 23 nt, Human
cacagcucuguccugggagugag

SEQ ID NO: 1780289 - RNA, 10 nt, Human
cacagcucuu

SEQ ID NO: 1780290 - RNA, 20 nt, Human
cacagggauucucacaauag

SEQ ID NO: 1780291 - RNA, 16 nt, Human
cacaguauuacuucug

SEQ ID NO: 1780292 - RNA, 18 nt, Human
cacaguauuacuucugcu

SEQ ID NO: 1780293 - RNA, 19 nt, Human
cacaguauuacuucugcua

SEQ ID NO: 1780294 - RNA, 16 nt, Human
cacccagcccacuucu

SEQ ID NO: 1780295 - RNA, 17 nt, Human
cacccagcccacuucug

SEQ ID NO: 1780296 - RNA, 10 nt, Human
caccagcugc

SEQ ID NO: 1780297 - RNA, 11 nt, Human
caccagcugca

SEQ ID NO: 1780298 - RNA, 12 nt, Human
caccagcugcaa

SEQ ID NO: 1780299 - RNA, 13 nt, Human
caccagcugcaaa

SEQ ID NO: 1780300 - RNA, 14 nt, Human
caccagcugcaaag

SEQ ID NO: 1780301 - RNA, 15 nt, Human
caccagcugcaaagu

SEQ ID NO: 1780302 - RNA, 17 nt, Human
caccagcugcaaagugu

SEQ ID NO: 1780303 - RNA, 18 nt, Human
caccagcugcaaaguguu

SEQ ID NO: 1780304 - RNA, 21 nt, Human
caccagcccuuagcagggaaa

SEQ ID NO: 1780305 - RNA, 24 nt, Human
cacccaggagccccgaggccuucu

SEQ ID NO: 1780306 - RNA, 19 nt, Human
cacccagcccacuucugcc

SEQ ID NO: 1780307 - RNA, 20 nt, Human
cacccaggagccccgaggcc

SEQ ID NO: 1780308 - RNA, 23 nt, Human
cacccaggagccccgaggccuuc

SEQ ID NO: 1780309 - RNA, 19 nt, Human
cacaucuugcucugcugac

SEQ ID NO: 1780310 - RNA, 18 nt, Human
cacaucuugcucugcuga

SEQ ID NO: 1780311 - RNA, 16 nt, Human
cacaucuugcucugcu

SEQ ID NO: 1780312 - RNA, 17 nt, Human
cacaucuugcucugcug

SEQ ID NO: 1780313 - RNA, 17 nt, Human
cacaucuaaccucaucu

SEQ ID NO: 1780314 - RNA, 22 nt, Human
cacauccuccacguucugcuca

SEQ ID NO: 1780315 - RNA, 22 nt, Human
caaugcuggcuguuggcugggg

SEQ ID NO: 1780316 - RNA, 23 nt, Human
caaugcuggcuguuggcuggggg

SEQ ID NO: 1780317 - RNA, 20 nt, Human
caauuguuuguucuguuuuc

SEQ ID NO: 1780318 - RNA, 22 nt, Human
caauaaaauuuuuuuucauguu

SEQ ID NO: 1780319 - RNA, 18 nt, Human
caauaaaauuuuuuuuca

SEQ ID NO: 1780320 - RNA, 19 nt, Human
caauaaaauuuuuuuucau

SEQ ID NO: 1780321 - RNA, 19 nt, Human
caccuugcuuuuuuacuua

SEQ ID NO: 1780322 - RNA, 19 nt, Human
caccuugacagggcacacc

SEQ ID NO: 1780323 - RNA, 14 nt, Human
caccuuggcucaag

SEQ ID NO: 1780324 - RNA, 13 nt, Human
caccuuggcucaa

SEQ ID NO: 1780325 - RNA, 23 nt, Human
caccuacccauacacccccucuu

SEQ ID NO: 1780326 - RNA, 23 nt, Human
caccucaagaagaagaggggcau

SEQ ID NO: 1780327 - RNA, 18 nt, Human
caccuacauguuauucua

SEQ ID NO: 1780328 - RNA, 19 nt, Human
caccgugucaagcugcucu

SEQ ID NO: 1780329 - RNA, 20 nt, Human
caccgugucaagcugcucug

SEQ ID NO: 1780330 - RNA, 23 nt, Human
caccgugucaagcugcucugagc

SEQ ID NO: 1780331 - RNA, 17 nt, Human
cacucuuauugcccacg

SEQ ID NO: 1780332 - RNA, 16 nt, Human
cacuccccuccacucu

SEQ ID NO: 1780333 - RNA, 18 nt, Human
cacucuuauugcccacgc

SEQ ID NO: 1780334 - RNA, 19 nt, Human
cacucuuauugcccacgcu

SEQ ID NO: 1780335 - RNA, 18 nt, Human
cacucccaccugcaucug

SEQ ID NO: 1780336 - RNA, 22 nt, Human
cacucccaccugcaucuggggc

SEQ ID NO: 1780337 - RNA, 14 nt, Human
cacggccaggccag

SEQ ID NO: 1780338 - RNA, 15 nt, Human
cacggccaggccaga

SEQ ID NO: 1780339 - RNA, 16 nt, Human
cacggccaggccagag

SEQ ID NO: 1780340 - RNA, 19 nt, Human
cacggaucacgauguaaau

SEQ ID NO: 1780341 - RNA, 17 nt, Human
cacggccaggccagagg

SEQ ID NO: 1780342 - RNA, 23 nt, Human
cacuacggaauaguuggcuagga

SEQ ID NO: 1780343 - RNA, 15 nt, Human
cacuguugcccaggc

SEQ ID NO: 1780344 - RNA, 16 nt, Human
cacuguugcccaggcu

SEQ ID NO: 1780345 - RNA, 23 nt, Human
cacuuguccccaaauccgaaccu

SEQ ID NO: 1780346 - RNA, 12 nt, Human
cacuugucccca

SEQ ID NO: 1780347 - RNA, 20 nt, Human
cacuuguccccaaauccgaa

SEQ ID NO: 1780348 - RNA, 17 nt, Human
cacuguugcccaggcug

SEQ ID NO: 1780349 - RNA, 12 nt, Human
cacuuucauuuu

SEQ ID NO: 1780350 - RNA, 14 nt, Human
cacuuucauuuuug

SEQ ID NO: 1780351 - RNA, 18 nt, Human
caggcagauacaggaaaa

SEQ ID NO: 1780352 - RNA, 13 nt, Human
caggccagaggga

SEQ ID NO: 1780353 - RNA, 15 nt, Human
caggccagagggagu

SEQ ID NO: 1780354 - RNA, 18 nt, Human
caggcaccagucccuguc

SEQ ID NO: 1780355 - RNA, 16 nt, Human
caggcaccagucccug

SEQ ID NO: 1780356 - RNA, 16 nt, Human
caggccagagggagug

SEQ ID NO: 1780357 - RNA, 21 nt, Human
cagggcucagcggggacagcu

SEQ ID NO: 1780358 - RNA, 23 nt, Human
cagggcucagcggggacagcucc

SEQ ID NO: 1780359 - RNA, 20 nt, Human
cagggaugauucaagccauu

SEQ ID NO: 1780360 - RNA, 21 nt, Human
caggcugggcuucaguggcag

SEQ ID NO: 1780361 - RNA, 22 nt, Human
caggcugggcuucaguggcagc

SEQ ID NO: 1780362 - RNA, 20 nt, Human
caggcugggcuucaguggca

SEQ ID NO: 1780363 - RNA, 15 nt, Human
caguggggcagucau

SEQ ID NO: 1780364 - RNA, 21 nt, Human
caguggugcgaucuggguuca

SEQ ID NO: 1780365 - RNA, 21 nt, Human
cagugggaugaaccagccggg

SEQ ID NO: 1780366 - RNA, 13 nt, Human
cagugcccacagg

SEQ ID NO: 1780367 - RNA, 15 nt, Human
cagugcccacaggau

SEQ ID NO: 1780368 - RNA, 17 nt, Human
cagugcccacaggauca

SEQ ID NO: 1780369 - RNA, 20 nt, Human
cagugggagcugccuguuca

SEQ ID NO: 1780370 - RNA, 23 nt, Human
cagugggagcugccuguucagcu

SEQ ID NO: 1780371 - RNA, 18 nt, Human
cagugcccacaggaucag

SEQ ID NO: 1780372 - RNA, 15 nt, Human
cagucuggaaugcag

SEQ ID NO: 1780373 - RNA, 17 nt, Human
cagucuggaaugcagug

SEQ ID NO: 1780374 - RNA, 18 nt, Human
cagucuggaaugcagugg

SEQ ID NO: 1780375 - RNA, 12 nt, Human
cagucucugagc

SEQ ID NO: 1780376 - RNA, 14 nt, Human
cagucucugagcag

SEQ ID NO: 1780377 - RNA, 21 nt, Human
caggugauccacccaccucag

SEQ ID NO: 1780378 - RNA, 22 nt, Human
caggugauccacccaccucagc

SEQ ID NO: 1780379 - RNA, 23 nt, Human
caggugauccacccaccucagcc

SEQ ID NO: 1780380 - RNA, 21 nt, Human
caguaaaauugccauauugca

SEQ ID NO: 1780381 - RNA, 20 nt, Human
caguaaaauugccauauugc

SEQ ID NO: 1780382 - RNA, 20 nt, Human
cagguuuuguuuuuuuucag

SEQ ID NO: 1780383 - RNA, 23 nt, Human
cagguuuuguuuuuuuucagcca

SEQ ID NO: 1780384 - RNA, 22 nt, Human
caggugcccagcuauaccugug

SEQ ID NO: 1780385 - RNA, 23 nt, Human
caggugcccagcuauaccugugc

SEQ ID NO: 1780386 - RNA, 20 nt, Human
cagccgcugagcgaggagau

SEQ ID NO: 1780387 - RNA, 19 nt, Human
cagccgcugagcgaggaga

SEQ ID NO: 1780388 - RNA, 19 nt, Human
cagccugcuaauuccccag

SEQ ID NO: 1780389 - RNA, 21 nt, Human
cagccugcgccugcugcaugc

SEQ ID NO: 1780390 - RNA, 22 nt, Human
cagccugcgccugcugcaugcc

SEQ ID NO: 1780391 - RNA, 23 nt, Human
cagccugcgccugcugcaugccc

SEQ ID NO: 1780392 - RNA, 13 nt, Human
cagccugcuagcu

SEQ ID NO: 1780393 - RNA, 16 nt, Human
cagccugcuagcuagc

SEQ ID NO: 1780394 - RNA, 18 nt, Human
cagccugcuagcuagcuc

SEQ ID NO: 1780395 - RNA, 22 nt, Human
cagccugcuagcuagcucaacu

SEQ ID NO: 1780396 - RNA, 23 nt, Human
cagccugcuagcuagcucaacua

SEQ ID NO: 1780397 - RNA, 18 nt, Human
cagcggggacagcuccuu

SEQ ID NO: 1780398 - RNA, 19 nt, Human
cagcggggacagcuccuuc

SEQ ID NO: 1780399 - RNA, 21 nt, Human
cagcggggacagcuccuucug

SEQ ID NO: 1780400 - RNA, 18 nt, Human
caggaaaagcugcugaca

SEQ ID NO: 1780401 - RNA, 15 nt, Human
caggaaaagcugcug

SEQ ID NO: 1780402 - RNA, 16 nt, Human
caggaaaagcugcuga

SEQ ID NO: 1780403 - RNA, 24 nt, Human
cagcugugcucuggacaggcaugu

SEQ ID NO: 1780404 - RNA, 20 nt, Human
cagcugugcucuggacaggc

SEQ ID NO: 1780405 - RNA, 12 nt, Human
cagcucccuggc

SEQ ID NO: 1780406 - RNA, 14 nt, Human
cagcucccuggcuu

SEQ ID NO: 1780407 - RNA, 16 nt, Human
cagcucccuggcuucu

SEQ ID NO: 1780408 - RNA, 20 nt, Human
cagcucccuggcuucugugg

SEQ ID NO: 1780409 - RNA, 17 nt, Human
cagauugcaacaggcug

SEQ ID NO: 1780410 - RNA, 13 nt, Human
cagauugaacuua

SEQ ID NO: 1780411 - RNA, 17 nt, Human
cagcagugugaggccag

SEQ ID NO: 1780412 - RNA, 19 nt, Human
cagcagugugaggccaggg

SEQ ID NO: 1780413 - RNA, 20 nt, Human
cagcagugugaggccagggc

SEQ ID NO: 1780414 - RNA, 22 nt, Human
cagcagugugaggccagggcag

SEQ ID NO: 1780415 - RNA, 13 nt, Human
cagaauauuucua

SEQ ID NO: 1780416 - RNA, 17 nt, Human
cagaauauuucuauuga

SEQ ID NO: 1780417 - RNA, 19 nt, Human
cagaauauuucuauugaau

SEQ ID NO: 1780418 - RNA, 14 nt, Human
cagauccucucugg

SEQ ID NO: 1780419 - RNA, 19 nt, Human
cagauccucucuggggcug

SEQ ID NO: 1780420 - RNA, 16 nt, Human
cauguuggccaggcug

SEQ ID NO: 1780421 - RNA, 14 nt, Human
cauguuggccaggc

SEQ ID NO: 1780422 - RNA, 15 nt, Human
cauguuggccaggcu

SEQ ID NO: 1780423 - RNA, 15 nt, Human
cauguccccucccag

SEQ ID NO: 1780424 - RNA, 16 nt, Human
cauguccccucccaga

SEQ ID NO: 1780425 - RNA, 18 nt, Human
cauguccccucccagagc

SEQ ID NO: 1780426 - RNA, 20 nt, Human
cauguagaaaauuuguuauu

SEQ ID NO: 1780427 - RNA, 18 nt, Human
cauguaggaaguaggaag

SEQ ID NO: 1780428 - RNA, 21 nt, Human
cauucuagaugcaagucucuu

SEQ ID NO: 1780429 - RNA, 23 nt, Human
cauucuaggccuccuggcccagg

SEQ ID NO: 1780430 - RNA, 16 nt, Human
cauucuaaccuggagg

SEQ ID NO: 1780431 - RNA, 12 nt, Human
caugauguuugc

SEQ ID NO: 1780432 - RNA, 13 nt, Human
caugauguuugcc

SEQ ID NO: 1780433 - RNA, 15 nt, Human
caugauguuugccca

SEQ ID NO: 1780434 - RNA, 17 nt, Human
caugauguuugcccaaa

SEQ ID NO: 1780435 - RNA, 21 nt, Human
caugauguuugcccaaaauuu

SEQ ID NO: 1780436 - RNA, 23 nt, Human
cauccuggcacccggccccugcu

SEQ ID NO: 1780437 - RNA, 22 nt, Human
cauccuggcacccggccccugc

SEQ ID NO: 1780438 - RNA, 14 nt, Human
caucggccuagggc

SEQ ID NO: 1780439 - RNA, 16 nt, Human
caucggccuagggccc

SEQ ID NO: 1780440 - RNA, 17 nt, Human
caucggccuagggcccc

SEQ ID NO: 1780441 - RNA, 15 nt, Human
cauccuggcacccgg

SEQ ID NO: 1780442 - RNA, 17 nt, Human
caucccgagcaccucca

SEQ ID NO: 1780443 - RNA, 21 nt, Human
caucccgggacgcagcaggag

SEQ ID NO: 1780444 - RNA, 11 nt, Human
caucugugucu

SEQ ID NO: 1780445 - RNA, 13 nt, Human
caucugugucuug

SEQ ID NO: 1780446 - RNA, 14 nt, Human
caucugugucuugu

SEQ ID NO: 1780447 - RNA, 15 nt, Human
caucuguuagggccu

SEQ ID NO: 1780448 - RNA, 16 nt, Human
caucuguuagggccuu

SEQ ID NO: 1780449 - RNA, 17 nt, Human
cauauucuguuggccag

SEQ ID NO: 1780450 - RNA, 18 nt, Human
cauauucuguuggccagu

SEQ ID NO: 1780451 - RNA, 20 nt, Human
cauauggucuccauuuuaca

SEQ ID NO: 1780452 - RNA, 12 nt, Human
ccacuccucuga

SEQ ID NO: 1780453 - RNA, 17 nt, Human
ccaccacacccagccca

SEQ ID NO: 1780454 - RNA, 17 nt, Human
ccaccauaugaauugua

SEQ ID NO: 1780455 - RNA, 19 nt, Human
ccaccauaugaauuguaca

SEQ ID NO: 1780456 - RNA, 20 nt, Human
ccaccauaugaauuguacag

SEQ ID NO: 1780457 - RNA, 16 nt, Human
ccacagccuccccugc

SEQ ID NO: 1780458 - RNA, 19 nt, Human
ccacagccuccccugccag

SEQ ID NO: 1780459 - RNA, 20 nt, Human
ccacagccuccccugccagg

SEQ ID NO: 1780460 - RNA, 16 nt, Human
ccacgacugucuccau

SEQ ID NO: 1780461 - RNA, 15 nt, Human
ccacgacugucucca

SEQ ID NO: 1780462 - RNA, 17 nt, Human
ccacgaaacugcccugg

SEQ ID NO: 1780463 - RNA, 18 nt, Human
ccacgaauuucugugccc

SEQ ID NO: 1780464 - RNA, 21 nt, Human
ccacgaauuucugugcccucc

SEQ ID NO: 1780465 - RNA, 23 nt, Human
ccacgaauuucugugcccuccug

SEQ ID NO: 1780466 - RNA, 14 nt, Human
ccacgacugucucc

SEQ ID NO: 1780467 - RNA, 18 nt, Human
ccaccgaagccgccugug

SEQ ID NO: 1780468 - RNA, 17 nt, Human
ccaccgcccagagaccc

SEQ ID NO: 1780469 - RNA, 13 nt, Human
ccaccgcccagag

SEQ ID NO: 1780470 - RNA, 12 nt, Human
ccaaugucuuga

SEQ ID NO: 1780471 - RNA, 15 nt, Human
ccaaugcaagacgcc

SEQ ID NO: 1780472 - RNA, 18 nt, Human
ccaagcucugcuccucuc

SEQ ID NO: 1780473 - RNA, 23 nt, Human
ccaagcugccuccccucuccuuc

SEQ ID NO: 1780474 - RNA, 12 nt, Human
ccaagcucugcu

SEQ ID NO: 1780475 - RNA, 13 nt, Human
ccaagcucugcuc

SEQ ID NO: 1780476 - RNA, 12 nt, Human
ccaacugaaggc

SEQ ID NO: 1780477 - RNA, 23 nt, Human
ccaacugaaggcuaaaaagcaac

SEQ ID NO: 1780478 - RNA, 11 nt, Human
cugcccugugg

SEQ ID NO: 1780479 - RNA, 11 nt, Human
cugccugucug

SEQ ID NO: 1780480 - RNA, 20 nt, Human
cugccuguucagcuccagcu

SEQ ID NO: 1780481 - RNA, 23 nt, Human
cugccuguucagcuccagcucac

SEQ ID NO: 1780482 - RNA, 18 nt, Human
cugcuaccucccuugccu

SEQ ID NO: 1780483 - RNA, 19 nt, Human
cugcuaccucccuugccuu

SEQ ID NO: 1780484 - RNA, 16 nt, Human
cugcuauccugccaaa

SEQ ID NO: 1780485 - RNA, 14 nt, Human
cugcucacauaucu

SEQ ID NO: 1780486 - RNA, 20 nt, Human
cugccucgaacuggcugcaa

SEQ ID NO: 1780487 - RNA, 14 nt, Human
cugccucuccaggc

SEQ ID NO: 1780488 - RNA, 15 nt, Human
cugccucuccaggca

SEQ ID NO: 1780489 - RNA, 12 nt, Human
cugccugucugc

SEQ ID NO: 1780490 - RNA, 13 nt, Human
cugccugucugcc

SEQ ID NO: 1780491 - RNA, 14 nt, Human
cugccugucugccc

SEQ ID NO: 1780492 - RNA, 15 nt, Human
cugccugucugcccc

SEQ ID NO: 1780493 - RNA, 18 nt, Human
cugccugucugccccagc

SEQ ID NO: 1780494 - RNA, 23 nt, Human
cugccugucugccccagcccaga

SEQ ID NO: 1780495 - RNA, 14 nt, Human
cugccucgaacugg

SEQ ID NO: 1780496 - RNA, 12 nt, Human
cugccuccuuua

SEQ ID NO: 1780497 - RNA, 19 nt, Human
cuggaaacauucaggagcu

SEQ ID NO: 1780498 - RNA, 14 nt, Human
cuggacucucaguc

SEQ ID NO: 1780499 - RNA, 17 nt, Human
cuggacucucagucucu

SEQ ID NO: 1780500 - RNA, 18 nt, Human
cuggacucucagucucug

SEQ ID NO: 1780501 - RNA, 19 nt, Human
cuggacucucagucucuga

SEQ ID NO: 1780502 - RNA, 20 nt, Human
cuggacucucagucucugag

SEQ ID NO: 1780503 - RNA, 21 nt, Human
cuggacucucagucucugagc

SEQ ID NO: 1780504 - RNA, 23 nt, Human
cuggacucucagucucugagcag

SEQ ID NO: 1780505 - RNA, 17 nt, Human
cugggacuacaggcacc

SEQ ID NO: 1780506 - RNA, 21 nt, Human
cugggacuacaggcacccacc

SEQ ID NO: 1780507 - RNA, 17 nt, Human
cugggacuacaggugug

SEQ ID NO: 1780508 - RNA, 13 nt, Human
cuggcagcucagc

SEQ ID NO: 1780509 - RNA, 17 nt, Human
cuggcagcucagcuucc

SEQ ID NO: 1780510 - RNA, 13 nt, Human
cuggcccuagacu

SEQ ID NO: 1780511 - RNA, 19 nt, Human
cuggcccuagacucggggu

SEQ ID NO: 1780512 - RNA, 23 nt, Human
cuguugcuaagccccagcaagca

SEQ ID NO: 1780513 - RNA, 22 nt, Human
cuguugcuaagccccagcaagc

SEQ ID NO: 1780514 - RNA, 21 nt, Human
cuguugcuaagccccagcaag

SEQ ID NO: 1780515 - RNA, 12 nt, Human
cuguugcuaagc

SEQ ID NO: 1780516 - RNA, 12 nt, Human
cuguuggccagu

SEQ ID NO: 1780517 - RNA, 16 nt, Human
cuguugcugaauaggc

SEQ ID NO: 1780518 - RNA, 15 nt, Human
cuguugcugaauagg

SEQ ID NO: 1780519 - RNA, 15 nt, Human
cuguuggccagugug

SEQ ID NO: 1780520 - RNA, 17 nt, Human
cugugcucuggacaggc

SEQ ID NO: 1780521 - RNA, 16 nt, Human
cuguucagcuccagcu

SEQ ID NO: 1780522 - RNA, 18 nt, Human
cuguucagcuccagcuca

SEQ ID NO: 1780523 - RNA, 19 nt, Human
cuguucagcuccagcucac

SEQ ID NO: 1780524 - RNA, 22 nt, Human
cuguucagcuccagcucaccag

SEQ ID NO: 1780525 - RNA, 15 nt, Human
cuguucagcuccagc

SEQ ID NO: 1780526 - RNA, 22 nt, Human
cugugucagguggggcagcuug

SEQ ID NO: 1780527 - RNA, 18 nt, Human
cugugcucuggacaggca

SEQ ID NO: 1780528 - RNA, 19 nt, Human
cugugcucuggacaggcau

SEQ ID NO: 1780529 - RNA, 22 nt, Human
cugucggcgcugccccaucucc

SEQ ID NO: 1780530 - RNA, 20 nt, Human
cugucggcgcugccccaucu

SEQ ID NO: 1780531 - RNA, 23 nt, Human
cugucggcgcugccccaucuccc

SEQ ID NO: 1780532 - RNA, 12 nt, Human
cuguccuuuccu

SEQ ID NO: 1780533 - RNA, 13 nt, Human
cuguccuuuccuu

SEQ ID NO: 1780534 - RNA, 14 nt, Human
cugucauuugagca

SEQ ID NO: 1780535 - RNA, 13 nt, Human
cuguccugggagu

SEQ ID NO: 1780536 - RNA, 14 nt, Human
cuguccugggagug

SEQ ID NO: 1780537 - RNA, 20 nt, Human
cuguccugggagugagcugg

SEQ ID NO: 1780538 - RNA, 21 nt, Human
cuguccugggagugagcuggu

SEQ ID NO: 1780539 - RNA, 15 nt, Human
cuguagccucagaug

SEQ ID NO: 1780540 - RNA, 16 nt, Human
cuguagcccacucugc

SEQ ID NO: 1780541 - RNA, 20 nt, Human
cuguagcccacucugcucgc

SEQ ID NO: 1780542 - RNA, 21 nt, Human
cuguagcccacucugcucgcc

SEQ ID NO: 1780543 - RNA, 18 nt, Human
cuguaagaauaauuuaua

SEQ ID NO: 1780544 - RNA, 19 nt, Human
cuguaagaauaauuuauag

SEQ ID NO: 1780545 - RNA, 20 nt, Human
cuguaagaauaauuuauagu

SEQ ID NO: 1780546 - RNA, 21 nt, Human
cuguaagaauaauuuauagua

SEQ ID NO: 1780547 - RNA, 12 nt, Human
cuggucuuccuu

SEQ ID NO: 1780548 - RNA, 16 nt, Human
cuggucuuccuuuuug

SEQ ID NO: 1780549 - RNA, 17 nt, Human
cuggucuuccuuuuugg

SEQ ID NO: 1780550 - RNA, 14 nt, Human
cuuccauuugcaag

SEQ ID NO: 1780551 - RNA, 13 nt, Human
cuuccauuugcaa

SEQ ID NO: 1780552 - RNA, 12 nt, Human
cuuccauuuaua

SEQ ID NO: 1780553 - RNA, 16 nt, Human
cuuacaguaggagccc

SEQ ID NO: 1780554 - RNA, 23 nt, Human
cuuacaguaggagcccagcucug

SEQ ID NO: 1780555 - RNA, 13 nt, Human
cuugguuccccca

SEQ ID NO: 1780556 - RNA, 22 nt, Human
cuugguucaauaaagcacugag

SEQ ID NO: 1780557 - RNA, 23 nt, Human
cuugguucaauaaagcacugagc

SEQ ID NO: 1780558 - RNA, 19 nt, Human
cuugucucuucaucuaaua

SEQ ID NO: 1780559 - RNA, 16 nt, Human
cuugguugaggaaaca

SEQ ID NO: 1780560 - RNA, 14 nt, Human
cuugguugaggaaa

SEQ ID NO: 1780561 - RNA, 15 nt, Human
cuugguugaggaaac

SEQ ID NO: 1780562 - RNA, 16 nt, Human
cuugguucccccacug

SEQ ID NO: 1780563 - RNA, 19 nt, Human
cuugguucccccacugauc

SEQ ID NO: 1780564 - RNA, 16 nt, Human
cuuucaccccagggcc

SEQ ID NO: 1780565 - RNA, 21 nt, Human
cuuucaccccagggccugagc

SEQ ID NO: 1780566 - RNA, 15 nt, Human
cuuucaccccagggc

SEQ ID NO: 1780567 - RNA, 22 nt, Human
cuuuaaugucacaggcaggucc

SEQ ID NO: 1780568 - RNA, 17 nt, Human
cuuuaaugucacaggca

SEQ ID NO: 1780569 - RNA, 18 nt, Human
cuuuaaugucacaggcag

SEQ ID NO: 1780570 - RNA, 19 nt, Human
cuuuaaugucacaggcagg

SEQ ID NO: 1780571 - RNA, 20 nt, Human
cuuuaaugucacaggcaggu

SEQ ID NO: 1780572 - RNA, 18 nt, Human
cuugauuuauuugcuucu

SEQ ID NO: 1780573 - RNA, 22 nt, Human
gaaagaauguuacugccuuaau

SEQ ID NO: 1780574 - RNA, 14 nt, Human
gaaagguuuacauu

SEQ ID NO: 1780575 - RNA, 22 nt, Human
gaaaguacuucuccacccugcu

SEQ ID NO: 1780576 - RNA, 21 nt, Human
gaaaguacuucuccacccugc

SEQ ID NO: 1780577 - RNA, 16 nt, Human
gaaagguuuacauugu

SEQ ID NO: 1780578 - RNA, 13 nt, Human
gaaagguuuugag

SEQ ID NO: 1780579 - RNA, 16 nt, Human
gaacaagcaaacccag

SEQ ID NO: 1780580 - RNA, 21 nt, Human
gaacaagcaaacccagacggc

SEQ ID NO: 1780581 - RNA, 15 nt, Human
cuuuuggucugugug

SEQ ID NO: 1780582 - RNA, 16 nt, Human
cuuuuggucuguguga

SEQ ID NO: 1780583 - RNA, 14 nt, Human
cuuuugggggaggg

SEQ ID NO: 1780584 - RNA, 15 nt, Human
cuuuugggggagggc

SEQ ID NO: 1780585 - RNA, 17 nt, Human
cuuuugucuaugggacu

SEQ ID NO: 1780586 - RNA, 19 nt, Human
cuuuuggaaccaugccuuc

SEQ ID NO: 1780587 - RNA, 19 nt, Human
gaaaagcaguucuggaugg

SEQ ID NO: 1780588 - RNA, 16 nt, Human
gagacggagucccacc

SEQ ID NO: 1780589 - RNA, 19 nt, Human
gagacggagucccaccuug

SEQ ID NO: 1780590 - RNA, 14 nt, Human
gagacggaguccca

SEQ ID NO: 1780591 - RNA, 19 nt, Human
gagaccuggacacaggccu

SEQ ID NO: 1780592 - RNA, 20 nt, Human
gagaccuggacacaggccug

SEQ ID NO: 1780593 - RNA, 15 nt, Human
gagaaugaaagggcc

SEQ ID NO: 1780594 - RNA, 23 nt, Human
gagaaugaaagggcccagagagg

SEQ ID NO: 1780595 - RNA, 18 nt, Human
gagaauaggcagccccca

SEQ ID NO: 1780596 - RNA, 15 nt, Human
gagauuaccuccuga

SEQ ID NO: 1780597 - RNA, 14 nt, Human
gagauucaauauug

SEQ ID NO: 1780598 - RNA, 13 nt, Human
gagagcugggugu

SEQ ID NO: 1780599 - RNA, 17 nt, Human
gagaggagacggagggg

SEQ ID NO: 1780600 - RNA, 18 nt, Human
gagaggagacggagggga

SEQ ID NO: 1780601 - RNA, 20 nt, Human
gagagcugggugucaagagg

SEQ ID NO: 1780602 - RNA, 20 nt, Human
gagaggcaauggcuccuuca

SEQ ID NO: 1780603 - RNA, 15 nt, Human
gagaggcaauggcca

SEQ ID NO: 1780604 - RNA, 20 nt, Human
gagcaucggccuagggcccc

SEQ ID NO: 1780605 - RNA, 17 nt, Human
gagcaugacagccugca

SEQ ID NO: 1780606 - RNA, 22 nt, Human
gagcccagggcaucuugcuggc

SEQ ID NO: 1780607 - RNA, 16 nt, Human
gagcccagucuguuga

SEQ ID NO: 1780608 - RNA, 15 nt, Human
gagcccucagaaccc

SEQ ID NO: 1780609 - RNA, 14 nt, Human
gagccccgaggccu

SEQ ID NO: 1780610 - RNA, 17 nt, Human
gagccccgaggccuucu

SEQ ID NO: 1780611 - RNA, 17 nt, Human
gagcuguuuacuaggga

SEQ ID NO: 1780612 - RNA, 23 nt, Human
gagcuggcucuauaaggcagccu

SEQ ID NO: 1780613 - RNA, 13 nt, Human
gagcccugguggc

SEQ ID NO: 1780614 - RNA, 14 nt, Human
gagcccugguggca

SEQ ID NO: 1780615 - RNA, 14 nt, Human
gagggccugcugga

SEQ ID NO: 1780616 - RNA, 20 nt, Human
gagggccugcuggaggccuc

SEQ ID NO: 1780617 - RNA, 21 nt, Human
gagggccugcuggaggccuca

SEQ ID NO: 1780618 - RNA, 11 nt, Human
gaggggagagg

SEQ ID NO: 1780619 - RNA, 22 nt, Human
gaggcagggucucacucugucg

SEQ ID NO: 1780620 - RNA, 19 nt, Human
gaggcagggucucacucug

SEQ ID NO: 1780621 - RNA, 20 nt, Human
gaggcagggucucacucugu

SEQ ID NO: 1780622 - RNA, 17 nt, Human
gaggagaugcuccuugg

SEQ ID NO: 1780623 - RNA, 23 nt, Human
gaggagacggaggggaguagaga

SEQ ID NO: 1780624 - RNA, 16 nt, Human
gaggacuuuucuuugu

SEQ ID NO: 1780625 - RNA, 20 nt, Human
gaggacuuuucuuuguggcu

SEQ ID NO: 1780626 - RNA, 23 nt, Human
gaggacuuuucuuuguggcuucc

SEQ ID NO: 1780627 - RNA, 21 nt, Human
gacacagcucuucuccaggcu

SEQ ID NO: 1780628 - RNA, 12 nt, Human
gacacagcucuu

SEQ ID NO: 1780629 - RNA, 19 nt, Human
gacacagcucuucuccagg

SEQ ID NO: 1780630 - RNA, 20 nt, Human
gacacagcucuucuccaggc

SEQ ID NO: 1780631 - RNA, 15 nt, Human
gaauuagcugcuucu

SEQ ID NO: 1780632 - RNA, 16 nt, Human
gaauuuuugcaauaau

SEQ ID NO: 1780633 - RNA, 17 nt, Human
gaauuuuugcaauaaug

SEQ ID NO: 1780634 - RNA, 19 nt, Human
gaauuuuugcaauaaugca

SEQ ID NO: 1780635 - RNA, 20 nt, Human
gaauuuuugcaauaaugcag

SEQ ID NO: 1780636 - RNA, 21 nt, Human
gaauuuuugcaauaaugcagu

SEQ ID NO: 1780637 - RNA, 16 nt, Human
gacaaagaauuccaaa

SEQ ID NO: 1780638 - RNA, 19 nt, Human
gacaaagaauuccaaagca

SEQ ID NO: 1780639 - RNA, 21 nt, Human
gacaaagaauuccaaagcaaa

SEQ ID NO: 1780640 - RNA, 17 nt, Human
gacaaaggacauuuguu

SEQ ID NO: 1780641 - RNA, 13 nt, Human
gacaaaggcaagc

SEQ ID NO: 1780642 - RNA, 18 nt, Human
gaauguuugccucugccu

SEQ ID NO: 1780643 - RNA, 19 nt, Human
gaauguuugccucugccuc

SEQ ID NO: 1780644 - RNA, 21 nt, Human
gaauuacauguaaaacauuau

SEQ ID NO: 1780645 - RNA, 22 nt, Human
gaauuacauguaaaacauuauc

SEQ ID NO: 1780646 - RNA, 14 nt, Human
gaaugauuugcaua

SEQ ID NO: 1780647 - RNA, 16 nt, Human
gaauguuugccucugc

SEQ ID NO: 1780648 - RNA, 17 nt, Human
gaauguuugccucugcc

SEQ ID NO: 1780649 - RNA, 23 nt, Human
gaaugaugcucaaaaucuuucca

SEQ ID NO: 1780650 - RNA, 23 nt, Human
gaaugauucuaauuuuuaagcaa

SEQ ID NO: 1780651 - RNA, 15 nt, Human
gaaugauucaguguu

SEQ ID NO: 1780652 - RNA, 21 nt, Human
gaauauauaguguauagaagc

SEQ ID NO: 1780653 - RNA, 15 nt, Human
gaauauaugugugcc

SEQ ID NO: 1780654 - RNA, 13 nt, Human
gaauaucaauaua

SEQ ID NO: 1780655 - RNA, 15 nt, Human
gaauaucaauauaau

SEQ ID NO: 1780656 - RNA, 20 nt, Human
gaauaucaauauaauguuuu

SEQ ID NO: 1780657 - RNA, 13 nt, Human
gaccucagggcac

SEQ ID NO: 1780658 - RNA, 16 nt, Human
gaccuccaagccacug

SEQ ID NO: 1780659 - RNA, 13 nt, Human
gacgccugaggaa

SEQ ID NO: 1780660 - RNA, 14 nt, Human
gacgccugaggaac

SEQ ID NO: 1780661 - RNA, 13 nt, Human
gaccucugccuga

SEQ ID NO: 1780662 - RNA, 19 nt, Human
gaccucaggugauccaccc

SEQ ID NO: 1780663 - RNA, 20 nt, Human
gaccucaggugauccaccca

SEQ ID NO: 1780664 - RNA, 21 nt, Human
gaccucaggugauccacccac

SEQ ID NO: 1780665 - RNA, 16 nt, Human
gacacugggaggccag

SEQ ID NO: 1780666 - RNA, 17 nt, Human
gacacugggaggccagu

SEQ ID NO: 1780667 - RNA, 23 nt, Human
gacacugggaggccagugagcca

SEQ ID NO: 1780668 - RNA, 14 nt, Human
gacacuugucccca

SEQ ID NO: 1780669 - RNA, 17 nt, Human
gacagcuccuucugucc

SEQ ID NO: 1780670 - RNA, 18 nt, Human
gacagcuccuucuguccu

SEQ ID NO: 1780671 - RNA, 19 nt, Human
gacagcuccuucuguccua

SEQ ID NO: 1780672 - RNA, 16 nt, Human
gacauuuggagagggg

SEQ ID NO: 1780673 - RNA, 17 nt, Human
gacauugcggacagcca

SEQ ID NO: 1780674 - RNA, 23 nt, Human
gacauugcggacagccacggcca

SEQ ID NO: 1780675 - RNA, 18 nt, Human
gcaucccuaccgacccag

SEQ ID NO: 1780676 - RNA, 21 nt, Human
gcaucccuaccgacccagggu

SEQ ID NO: 1780677 - RNA, 15 nt, Human
gcauguaaacacgcc

SEQ ID NO: 1780678 - RNA, 17 nt, Human
gcauguaaacacgccug

SEQ ID NO: 1780679 - RNA, 19 nt, Human
gcauguaaacacgccugca

SEQ ID NO: 1780680 - RNA, 15 nt, Human
gcauuuacuuugugu

SEQ ID NO: 1780681 - RNA, 14 nt, Human
gcauccuggcaccc

SEQ ID NO: 1780682 - RNA, 16 nt, Human
gcaucggccuagggcc

SEQ ID NO: 1780683 - RNA, 20 nt, Human
gcaucggccuagggccccca

SEQ ID NO: 1780684 - RNA, 13 nt, Human
gcauccuggcacc

SEQ ID NO: 1780685 - RNA, 20 nt, Human
gcaucuagcaugucgucaaa

SEQ ID NO: 1780686 - RNA, 21 nt, Human
gcaucuacuugccagaaccaa

SEQ ID NO: 1780687 - RNA, 17 nt, Human
gcagucuguccaggcuc

SEQ ID NO: 1780688 - RNA, 20 nt, Human
gcagugaaugauucaguguu

SEQ ID NO: 1780689 - RNA, 18 nt, Human
gcaagugagagcugggug

SEQ ID NO: 1780690 - RNA, 19 nt, Human
gcaagugagagcugggugu

SEQ ID NO: 1780691 - RNA, 20 nt, Human
gcacucagaagacacugaug

SEQ ID NO: 1780692 - RNA, 18 nt, Human
gcagaaacccugagcaga

SEQ ID NO: 1780693 - RNA, 15 nt, Human
gcagcagugugaggc

SEQ ID NO: 1780694 - RNA, 19 nt, Human
gcagcagugugaggccagg

SEQ ID NO: 1780695 - RNA, 20 nt, Human
gcagcagugugaggccaggg

SEQ ID NO: 1780696 - RNA, 21 nt, Human
gcagcagugugaggccagggc

SEQ ID NO: 1780697 - RNA, 22 nt, Human
gcagcagugugaggccagggca

SEQ ID NO: 1780698 - RNA, 23 nt, Human
gcagcagugugaggccagggcag

SEQ ID NO: 1780699 - RNA, 17 nt, Human
gcagccaaguagccucu

SEQ ID NO: 1780700 - RNA, 20 nt, Human
gcagccaaguagccucuccu

SEQ ID NO: 1780701 - RNA, 16 nt, Human
gcagagcuucuuccag

SEQ ID NO: 1780702 - RNA, 22 nt, Human
gcagagcuucuuccaggugccc

SEQ ID NO: 1780703 - RNA, 15 nt, Human
gcagagcuuuucaga

SEQ ID NO: 1780704 - RNA, 16 nt, Human
gcagagcuuuucagau

SEQ ID NO: 1780705 - RNA, 21 nt, Human
gcagaacgaaccuuggccugg

SEQ ID NO: 1780706 - RNA, 22 nt, Human
gcagaacgaaccuuggccuggg

SEQ ID NO: 1780707 - RNA, 13 nt, Human
gcagcucccuggc

SEQ ID NO: 1780708 - RNA, 17 nt, Human
gcagcucccuggcuucu

SEQ ID NO: 1780709 - RNA, 21 nt, Human
gcagcucccuggcuucugugg

SEQ ID NO: 1780710 - RNA, 15 nt, Human
gcagcccaagcuucc

SEQ ID NO: 1780711 - RNA, 17 nt, Human
gcagcccaagcuucccu

SEQ ID NO: 1780712 - RNA, 21 nt, Human
gcagcccaagcuucccuccau

SEQ ID NO: 1780713 - RNA, 20 nt, Human
gcaaccuccgccucuugggu

SEQ ID NO: 1780714 - RNA, 14 nt, Human
gcaacccccagccu

SEQ ID NO: 1780715 - RNA, 15 nt, Human
gcaacccccagccug

SEQ ID NO: 1780716 - RNA, 16 nt, Human
gcaacccccagccugc

SEQ ID NO: 1780717 - RNA, 17 nt, Human
gcaacccccagccugcu

SEQ ID NO: 1780718 - RNA, 19 nt, Human
gcaaccuccgccucuuggg

SEQ ID NO: 1780719 - RNA, 16 nt, Human
gcaacaggcugggcuu

SEQ ID NO: 1780720 - RNA, 19 nt, Human
gcaacaggcugggcuucag

SEQ ID NO: 1780721 - RNA, 19 nt, Human
gcaacaggccauugugaac

SEQ ID NO: 1780722 - RNA, 14 nt, Human
gcaacaggcugggc

SEQ ID NO: 1780723 - RNA, 15 nt, Human
gcaacaggcugggcu

SEQ ID NO: 1780724 - RNA, 13 nt, Human
gcaacaggcuggg

SEQ ID NO: 1780725 - RNA, 20 nt, Human
gcaaaagguucacuaaagca

SEQ ID NO: 1780726 - RNA, 21 nt, Human
gcaaaagguucacuaaagcag

SEQ ID NO: 1780727 - RNA, 16 nt, Human
gcaagugagagcuggg

SEQ ID NO: 1780728 - RNA, 15 nt, Human
gcaagugagagcugg

SEQ ID NO: 1780729 - RNA, 13 nt, Human
gauucuucugcuu

SEQ ID NO: 1780730 - RNA, 15 nt, Human
gauucuucugcuuca

SEQ ID NO: 1780731 - RNA, 20 nt, Human
gauucuucugcuucagccuc

SEQ ID NO: 1780732 - RNA, 11 nt, Human
gauuuauuugc

SEQ ID NO: 1780733 - RNA, 13 nt, Human
gauuuauuugcuu

SEQ ID NO: 1780734 - RNA, 15 nt, Human
gauuuauuugcuucu

SEQ ID NO: 1780735 - RNA, 16 nt, Human
gauuuauuugcuucuu

SEQ ID NO: 1780736 - RNA, 17 nt, Human
gauuuauuugcuucuuc

SEQ ID NO: 1780737 - RNA, 20 nt, Human
gaucucugcagggccgccag

SEQ ID NO: 1780738 - RNA, 15 nt, Human
gaucucugcagggcc

SEQ ID NO: 1780739 - RNA, 16 nt, Human
gaucucugcagggccg

SEQ ID NO: 1780740 - RNA, 15 nt, Human
gaucccaggccccug

SEQ ID NO: 1780741 - RNA, 18 nt, Human
gaucccaggccccuggag

SEQ ID NO: 1780742 - RNA, 19 nt, Human
gaucccaggccccuggagg

SEQ ID NO: 1780743 - RNA, 15 nt, Human
gauaccagcgaggag

SEQ ID NO: 1780744 - RNA, 22 nt, Human
gauaccagcgaggaggcuccag

SEQ ID NO: 1780745 - RNA, 13 nt, Human
gauacuuuacaug

SEQ ID NO: 1780746 - RNA, 22 nt, Human
gauccacccaccucagccuccc

SEQ ID NO: 1780747 - RNA, 20 nt, Human
gauccacccaccucagccuc

SEQ ID NO: 1780748 - RNA, 21 nt, Human
gauccacccaccucagccucc

SEQ ID NO: 1780749 - RNA, 21 nt, Human
gauccaagcuggucccacuca

SEQ ID NO: 1780750 - RNA, 18 nt, Human
gauccacccaccucagcc

SEQ ID NO: 1780751 - RNA, 19 nt, Human
gauccacccaccucagccu

SEQ ID NO: 1780752 - RNA, 12 nt, Human
gauccaagcugg

SEQ ID NO: 1780753 - RNA, 16 nt, Human
gauccaagcugguccc

SEQ ID NO: 1780754 - RNA, 17 nt, Human
gauccaagcugguccca

SEQ ID NO: 1780755 - RNA, 19 nt, Human
gauccaagcuggucccacu

SEQ ID NO: 1780756 - RNA, 12 nt, Human
ggaguguucccc

SEQ ID NO: 1780757 - RNA, 20 nt, Human
ggaguguuccccuuccacug

SEQ ID NO: 1780758 - RNA, 15 nt, Human
ggaugggucagagcu

SEQ ID NO: 1780759 - RNA, 16 nt, Human
ggaugggucagagcua

SEQ ID NO: 1780760 - RNA, 16 nt, Human
ggauggguggauggcc

SEQ ID NO: 1780761 - RNA, 17 nt, Human
ggauggugugccuucca

SEQ ID NO: 1780762 - RNA, 18 nt, Human
ggauggugugccuuccag

SEQ ID NO: 1780763 - RNA, 19 nt, Human
ggaguguuucuaauaaacu

SEQ ID NO: 1780764 - RNA, 17 nt, Human
ggaucucauuggacccu

SEQ ID NO: 1780765 - RNA, 24 nt, Human
ggaucucauuggacccuuccaugg

SEQ ID NO: 1780766 - RNA, 15 nt, Human
ggaggcuccagaggg

SEQ ID NO: 1780767 - RNA, 16 nt, Human
ggaggcuccagagggc

SEQ ID NO: 1780768 - RNA, 18 nt, Human
ggaggcuccagagggcac

SEQ ID NO: 1780769 - RNA, 21 nt, Human
ggaggcucacccccuucucca

SEQ ID NO: 1780770 - RNA, 15 nt, Human
ggaggcugccuccca

SEQ ID NO: 1780771 - RNA, 16 nt, Human
ggaggcugccucccaa

SEQ ID NO: 1780772 - RNA, 17 nt, Human
ggccagagggagugaca

SEQ ID NO: 1780773 - RNA, 19 nt, Human
ggccagagggagugacaga

SEQ ID NO: 1780774 - RNA, 13 nt, Human
ggauuuuugaguc

SEQ ID NO: 1780775 - RNA, 18 nt, Human
ggcacaccgggcacucag

SEQ ID NO: 1780776 - RNA, 16 nt, Human
ggcagggccccaggca

SEQ ID NO: 1780777 - RNA, 22 nt, Human
ggcagcagugugaggccagggc

SEQ ID NO: 1780778 - RNA, 23 nt, Human
ggcagccccauucugccugccca

SEQ ID NO: 1780779 - RNA, 19 nt, Human
ggcagccccagccugcuag

SEQ ID NO: 1780780 - RNA, 17 nt, Human
ggcagccccagccugcu

SEQ ID NO: 1780781 - RNA, 18 nt, Human
ggcagccccagccugcua

SEQ ID NO: 1780782 - RNA, 22 nt, Human
ggcagccccauucugccugccc

SEQ ID NO: 1780783 - RNA, 16 nt, Human
ggcagccccauucugc

SEQ ID NO: 1780784 - RNA, 13 nt, Human
ggcagccccagcc

SEQ ID NO: 1780785 - RNA, 14 nt, Human
ggcagccccagccu

SEQ ID NO: 1780786 - RNA, 15 nt, Human
ggcagccccagccug

SEQ ID NO: 1780787 - RNA, 16 nt, Human
ggcagccccagccugc

SEQ ID NO: 1780788 - RNA, 20 nt, Human
ggcagccccauucugccugc

SEQ ID NO: 1780789 - RNA, 21 nt, Human
ggcagccccauucugccugcc

SEQ ID NO: 1780790 - RNA, 17 nt, Human
ggccugcaggaccugcc

SEQ ID NO: 1780791 - RNA, 20 nt, Human
ggccugcaggaccugccugu

SEQ ID NO: 1780792 - RNA, 21 nt, Human
ggccugcaggaccugccugua

SEQ ID NO: 1780793 - RNA, 21 nt, Human
ggccuuaucgggcuccagcca

SEQ ID NO: 1780794 - RNA, 22 nt, Human
ggccuuaucgggcuccagccau

SEQ ID NO: 1780795 - RNA, 16 nt, Human
ggccuggccagaugca

SEQ ID NO: 1780796 - RNA, 14 nt, Human
ggccuggcagcuca

SEQ ID NO: 1780797 - RNA, 16 nt, Human
ggccuggcagcucagc

SEQ ID NO: 1780798 - RNA, 12 nt, Human
ggccuggccaga

SEQ ID NO: 1780799 - RNA, 15 nt, Human
ggccuggccagaugc

SEQ ID NO: 1780800 - RNA, 14 nt, Human
ggccugccgggcug

SEQ ID NO: 1780801 - RNA, 21 nt, Human
ggccugccgggcugagggccu

SEQ ID NO: 1780802 - RNA, 18 nt, Human
ggccugcgccaguccugc

SEQ ID NO: 1780803 - RNA, 15 nt, Human
ggccugcuggaggcc

SEQ ID NO: 1780804 - RNA, 16 nt, Human
ggccugcuggaggccu

SEQ ID NO: 1780805 - RNA, 17 nt, Human
ggccugcuggaggccuc

SEQ ID NO: 1780806 - RNA, 18 nt, Human
ggccugcuggaggccuca

SEQ ID NO: 1780807 - RNA, 20 nt, Human
ggccugcuggaggccucagg

SEQ ID NO: 1780808 - RNA, 21 nt, Human
ggccugcuggaggccucaggu

SEQ ID NO: 1780809 - RNA, 19 nt, Human
ggcuacccugagcugaggc

SEQ ID NO: 1780810 - RNA, 13 nt, Human
ggcuacgccucuu

SEQ ID NO: 1780811 - RNA, 22 nt, Human
ggcuaccaacuuguauccaggc

SEQ ID NO: 1780812 - RNA, 20 nt, Human
ggcuaagugauccucccacc

SEQ ID NO: 1780813 - RNA, 20 nt, Human
ggcgaucacaacgugcauug

SEQ ID NO: 1780814 - RNA, 18 nt, Human
ggcgaucacaacgugcau

SEQ ID NO: 1780815 - RNA, 22 nt, Human
ggcgagagucuggcccuagacu

SEQ ID NO: 1780816 - RNA, 21 nt, Human
ggcgagcccuguggaugagcc

SEQ ID NO: 1780817 - RNA, 20 nt, Human
ggcuaagcuucacuguaaaa

SEQ ID NO: 1780818 - RNA, 22 nt, Human
ggcccuagacucggggugcuuc

SEQ ID NO: 1780819 - RNA, 17 nt, Human
ggccagaugcaccagcc

SEQ ID NO: 1780820 - RNA, 22 nt, Human
ggccagagggagugacagaggc

SEQ ID NO: 1780821 - RNA, 11 nt, Human
ggccagaggcu

SEQ ID NO: 1780822 - RNA, 15 nt, Human
ggccagaugcaccag

SEQ ID NO: 1780823 - RNA, 16 nt, Human
ggccagaugcaccagc

SEQ ID NO: 1780824 - RNA, 13 nt, Human
ggccucagugcca

SEQ ID NO: 1780825 - RNA, 13 nt, Human
ggccucaggugcu

SEQ ID NO: 1780826 - RNA, 16 nt, Human
ggccucaggugcuguc

SEQ ID NO: 1780827 - RNA, 17 nt, Human
ggccucaggugcugucc

SEQ ID NO: 1780828 - RNA, 18 nt, Human
ggccucaggugcugucca

SEQ ID NO: 1780829 - RNA, 19 nt, Human
ggccucaggugcuguccau

SEQ ID NO: 1780830 - RNA, 13 nt, Human
aaaaaaagaauaa

SEQ ID NO: 1780831 - RNA, 10 nt, Human
aaaaaaagaa

SEQ ID NO: 1780832 - RNA, 12 nt, Human
aaaaaaaguauu

SEQ ID NO: 1780833 - RNA, 14 nt, Human
aaaaaaaguauuau

SEQ ID NO: 1780834 - RNA, 14 nt, Human
ggcuggguuggagg

SEQ ID NO: 1780835 - RNA, 14 nt, Human
aaaaauaaacacua

SEQ ID NO: 1780836 - RNA, 14 nt, Human
aaaaauacaugcau

SEQ ID NO: 1780837 - RNA, 13 nt, Human
ggcucacugcagc

SEQ ID NO: 1780838 - RNA, 14 nt, Human
ggcucacugcagcc

SEQ ID NO: 1780839 - RNA, 15 nt, Human
ggcucacugcagccu

SEQ ID NO: 1780840 - RNA, 12 nt, Human
ggcuggcaugau

SEQ ID NO: 1780841 - RNA, 22 nt, Human
ggcuggcaugauccaagcaaga

SEQ ID NO: 1780842 - RNA, 17 nt, Human
ggcucccugacugggag

SEQ ID NO: 1780843 - RNA, 18 nt, Human
ggcucccugacugggagu

SEQ ID NO: 1780844 - RNA, 20 nt, Human
ggcucccuguaaccucuuca

SEQ ID NO: 1780845 - RNA, 21 nt, Human
ggcucccuguaaccucuucag

SEQ ID NO: 1780846 - RNA, 18 nt, Human
ggcucguugacuggcugu

SEQ ID NO: 1780847 - RNA, 12 nt, Human
gggccagaggcu

SEQ ID NO: 1780848 - RNA, 23 nt, Human
gggccgccagggagaccuggaca

SEQ ID NO: 1780849 - RNA, 15 nt, Human
gggccucagugccac

SEQ ID NO: 1780850 - RNA, 13 nt, Human
gggccucagugcc

SEQ ID NO: 1780851 - RNA, 14 nt, Human
gggccucagugcca

SEQ ID NO: 1780852 - RNA, 24 nt, Human
gggccugcaggaccugccuguagc

SEQ ID NO: 1780853 - RNA, 21 nt, Human
gggcggugagaggggaacaga

SEQ ID NO: 1780854 - RNA, 22 nt, Human
gggcuacccugagcugaggcag

SEQ ID NO: 1780855 - RNA, 21 nt, Human
gggcuacccugagcugaggca

SEQ ID NO: 1780856 - RNA, 14 nt, Human
gggccugccgggcu

SEQ ID NO: 1780857 - RNA, 15 nt, Human
gggccugccgggcug

SEQ ID NO: 1780858 - RNA, 20 nt, Human
gggccugccgggcugagggc

SEQ ID NO: 1780859 - RNA, 21 nt, Human
gggccugccgggcugagggcc

SEQ ID NO: 1780860 - RNA, 19 nt, Human
gggccugcgccaguccugc

SEQ ID NO: 1780861 - RNA, 15 nt, Human
gggcucccgggcccc

SEQ ID NO: 1780862 - RNA, 13 nt, Human
gggcuccagccau

SEQ ID NO: 1780863 - RNA, 13 nt, Human
gggcucccagggc

SEQ ID NO: 1780864 - RNA, 21 nt, Human
gggcucagcggggacagcucc

SEQ ID NO: 1780865 - RNA, 15 nt, Human
gggcuaguugggcuu

SEQ ID NO: 1780866 - RNA, 18 nt, Human
gggcuaguugggcuuccu

SEQ ID NO: 1780867 - RNA, 17 nt, Human
gggcucagcggggacag

SEQ ID NO: 1780868 - RNA, 19 nt, Human
gggcucagcggggacagcu

SEQ ID NO: 1780869 - RNA, 22 nt, Human
gggcugcgacgcuugcucuguu

SEQ ID NO: 1780870 - RNA, 20 nt, Human
gggcugcggcguacaggcug

SEQ ID NO: 1780871 - RNA, 22 nt, Human
gggcugcggcguacaggcuggc

SEQ ID NO: 1780872 - RNA, 12 nt, Human
gggcucccugac

SEQ ID NO: 1780873 - RNA, 18 nt, Human
gggcugggcccucucuuc

SEQ ID NO: 1780874 - RNA, 22 nt, Human
aaaaggagccaauuuaaagaaa

SEQ ID NO: 1780875 - RNA, 19 nt, Human
aaaagguucacuaaagcag

SEQ ID NO: 1780876 - RNA, 14 nt, Human
aaaaggccaaaccu

SEQ ID NO: 1780877 - RNA, 15 nt, Human
aaaaggccaaaccuc

SEQ ID NO: 1780878 - RNA, 19 nt, Human
aaaaggccaaaccucuguu

SEQ ID NO: 1780879 - RNA, 22 nt, Human
aaaaggccaaaccucuguucag

SEQ ID NO: 1780880 - RNA, 23 nt, Human
aaaaggccaaaccucuguucagu

SEQ ID NO: 1780881 - RNA, 16 nt, Human
aaaauaacuucaagca

SEQ ID NO: 1780882 - RNA, 20 nt, Human
aaaaucugucacguagaacu

SEQ ID NO: 1780883 - RNA, 13 nt, Human
aaaaucugccugg

SEQ ID NO: 1780884 - RNA, 17 nt, Human
aaaaugcccuuaaauca

SEQ ID NO: 1780885 - RNA, 16 nt, Human
aaaauggaaccaggcu

SEQ ID NO: 1780886 - RNA, 20 nt, Human
aaaaugcaaauccuauguga

SEQ ID NO: 1780887 - RNA, 22 nt, Human
aaaaugcaaauccuaugugauu

SEQ ID NO: 1780888 - RNA, 20 nt, Human
aaaaugcacaaacaaugcaa

SEQ ID NO: 1780889 - RNA, 14 nt, Human
aaaaugcauuguau

SEQ ID NO: 1780890 - RNA, 14 nt, Human
aaaaugcaaauccu

SEQ ID NO: 1780891 - RNA, 18 nt, Human
aaaaugcaaauccuaugu

SEQ ID NO: 1780892 - RNA, 22 nt, Human
gggggcagaucuuggacucaug

SEQ ID NO: 1780893 - RNA, 13 nt, Human
gggggcagggcug

SEQ ID NO: 1780894 - RNA, 14 nt, Human
gggggcaggugcug

SEQ ID NO: 1780895 - RNA, 15 nt, Human
gggguaguuggcaga

SEQ ID NO: 1780896 - RNA, 19 nt, Human
ggggcccagggcaagcucc

SEQ ID NO: 1780897 - RNA, 15 nt, Human
ggggccccccugccc

SEQ ID NO: 1780898 - RNA, 22 nt, Human
aaaccuuaucuccacaaccucu

SEQ ID NO: 1780899 - RNA, 15 nt, Human
aaaccuggaugucac

SEQ ID NO: 1780900 - RNA, 14 nt, Human
gggucauagaaauu

SEQ ID NO: 1780901 - RNA, 18 nt, Human
gggucauagauguuuccu

SEQ ID NO: 1780902 - RNA, 13 nt, Human
ggguccagaagga

SEQ ID NO: 1780903 - RNA, 17 nt, Human
ggguccagaaggagaca

SEQ ID NO: 1780904 - RNA, 19 nt, Human
gguaucaggugcugccauc

SEQ ID NO: 1780905 - RNA, 14 nt, Human
ggucagugcaaaua

SEQ ID NO: 1780906 - RNA, 11 nt, Human
gguccaggaga

SEQ ID NO: 1780907 - RNA, 23 nt, Human
gguaggggggaaacagguuggga

SEQ ID NO: 1780908 - RNA, 14 nt, Human
gguaucaggugcug

SEQ ID NO: 1780909 - RNA, 13 nt, Human
gguaacaggcaga

SEQ ID NO: 1780910 - RNA, 16 nt, Human
gguaaacacgccugca

SEQ ID NO: 1780911 - RNA, 20 nt, Human
ggguuuugccauguuggcca

SEQ ID NO: 1780912 - RNA, 23 nt, Human
ggguuuugccauguuggccaggc

SEQ ID NO: 1780913 - RNA, 18 nt, Human
ggguuuuguauucucuga

SEQ ID NO: 1780914 - RNA, 24 nt, Human
guaaacugugcaccaagcaggaaa

SEQ ID NO: 1780915 - RNA, 16 nt, Human
guaacaagccacccca

SEQ ID NO: 1780916 - RNA, 23 nt, Human
guaacauguguuaaguauuuuca

SEQ ID NO: 1780917 - RNA, 21 nt, Human
guaaaauugccauauugcaca

SEQ ID NO: 1780918 - RNA, 20 nt, Human
guaaaauugccauauugcac

SEQ ID NO: 1780919 - RNA, 19 nt, Human
guaaaauugccauauugca

SEQ ID NO: 1780920 - RNA, 22 nt, Human
guaaacacgccugcaaacgcug

SEQ ID NO: 1780921 - RNA, 18 nt, Human
guaaaauugccauauugc

SEQ ID NO: 1780922 - RNA, 16 nt, Human
guaaaauugccauauu

SEQ ID NO: 1780923 - RNA, 15 nt, Human
guaaaauugccauau

SEQ ID NO: 1780924 - RNA, 14 nt, Human
guaaaauugccaua

SEQ ID NO: 1780925 - RNA, 15 nt, Human
aaaguguuuuguacc

SEQ ID NO: 1780926 - RNA, 16 nt, Human
aaaguguuuuguacca

SEQ ID NO: 1780927 - RNA, 17 nt, Human
aaaguguuuuguaccag

SEQ ID NO: 1780928 - RNA, 20 nt, Human
aaaguguuuuguaccaguga

SEQ ID NO: 1780929 - RNA, 22 nt, Human
guacaauaaguguuuuuguauu

SEQ ID NO: 1780930 - RNA, 14 nt, Human
guaauaaacuauuu

SEQ ID NO: 1780931 - RNA, 12 nt, Human
guaauaaacuau

SEQ ID NO: 1780932 - RNA, 18 nt, Human
guaaccucuucagaggcc

SEQ ID NO: 1780933 - RNA, 20 nt, Human
guaaccucuucagaggcccu

SEQ ID NO: 1780934 - RNA, 19 nt, Human
aaauaucccgggggugggg

SEQ ID NO: 1780935 - RNA, 13 nt, Human
aaauauguauuua

SEQ ID NO: 1780936 - RNA, 21 nt, Human
aaauauguauuuaccaaaaau

SEQ ID NO: 1780937 - RNA, 10 nt, Human
aaauaugcaa

SEQ ID NO: 1780938 - RNA, 20 nt, Human
aaauauugguguugucagua

SEQ ID NO: 1780939 - RNA, 18 nt, Human
aaauaucauuuauuuuuu

SEQ ID NO: 1780940 - RNA, 18 nt, Human
aaauauaugcuaagucuu

SEQ ID NO: 1780941 - RNA, 16 nt, Human
guacacacacauacac

SEQ ID NO: 1780942 - RNA, 23 nt, Human
gguucuacagccuugucccccuc

SEQ ID NO: 1780943 - RNA, 20 nt, Human
gguuuccuggcacuggaccc

SEQ ID NO: 1780944 - RNA, 22 nt, Human
gguuuuaucugagugaaauacu

SEQ ID NO: 1780945 - RNA, 15 nt, Human
gguguggguguccug

SEQ ID NO: 1780946 - RNA, 19 nt, Human
gguguggguguccugccug

SEQ ID NO: 1780947 - RNA, 22 nt, Human
gguguggguguccugccugucu

SEQ ID NO: 1780948 - RNA, 21 nt, Human
gguguuaucaccgugggcucc

SEQ ID NO: 1780949 - RNA, 23 nt, Human
ggugugucccccucuguccaggc

SEQ ID NO: 1780950 - RNA, 15 nt, Human
gguuccgcuuggagc

SEQ ID NO: 1780951 - RNA, 21 nt, Human
gguuccgcuuggagcagaggg

SEQ ID NO: 1780952 - RNA, 22 nt, Human
gguuccgcuuggagcagagggg

SEQ ID NO: 1780953 - RNA, 23 nt, Human
gguuccgcuuggagcagaggggc

SEQ ID NO: 1780954 - RNA, 13 nt, Human
aaagguuuugagc

SEQ ID NO: 1780955 - RNA, 18 nt, Human
gguggcuggguuggaggg

SEQ ID NO: 1780956 - RNA, 12 nt, Human
gguggcuggguu

SEQ ID NO: 1780957 - RNA, 17 nt, Human
aaagguucacuaaagca

SEQ ID NO: 1780958 - RNA, 13 nt, Human
aaaggugccaugg

SEQ ID NO: 1780959 - RNA, 20 nt, Human
aaagggcccagagagggugg

SEQ ID NO: 1780960 - RNA, 17 nt, Human
ggugcugccucuaccug

SEQ ID NO: 1780961 - RNA, 18 nt, Human
ggugcuggagcacugggc

SEQ ID NO: 1780962 - RNA, 20 nt, Human
ggugcuggagcacugggcuc

SEQ ID NO: 1780963 - RNA, 22 nt, Human
ggugcuggagcacugggcuccc

SEQ ID NO: 1780964 - RNA, 13 nt, Human
gguggacccaggg

SEQ ID NO: 1780965 - RNA, 18 nt, Human
gguggacccagggaacag

SEQ ID NO: 1780966 - RNA, 15 nt, Human
aaagcuguauuuuga

SEQ ID NO: 1780967 - RNA, 17 nt, Human
aaagcuguauuuugaaa

SEQ ID NO: 1780968 - RNA, 17 nt, Human
aaagcuaggccuggcca

SEQ ID NO: 1780969 - RNA, 14 nt, Human
aaagcuaggccugg

SEQ ID NO: 1780970 - RNA, 16 nt, Human
aaagcuaggccuggcc

SEQ ID NO: 1780971 - RNA, 22 nt, Human
aaagcaguagaaauaauaugca

SEQ ID NO: 1780972 - RNA, 17 nt, Human
gcuguaucccaugagcc

SEQ ID NO: 1780973 - RNA, 19 nt, Human
gcuguaucccaugagccuc

SEQ ID NO: 1780974 - RNA, 18 nt, Human
gcuguauaaaaucagcca

SEQ ID NO: 1780975 - RNA, 14 nt, Human
gcuguauaaaauca

SEQ ID NO: 1780976 - RNA, 22 nt, Human
gcuguauaaaaucagccaauua

SEQ ID NO: 1780977 - RNA, 20 nt, Human
gcuguauaaaaucagccaau

SEQ ID NO: 1780978 - RNA, 14 nt, Human
gcuguauaaguuau

SEQ ID NO: 1780979 - RNA, 15 nt, Human
gcuguauaaguuauu

SEQ ID NO: 1780980 - RNA, 18 nt, Human
gcugugcucuggacaggc

SEQ ID NO: 1780981 - RNA, 15 nt, Human
gcugugcucuggaca

SEQ ID NO: 1780982 - RNA, 16 nt, Human
gcugugcucuggacag

SEQ ID NO: 1780983 - RNA, 13 nt, Human
gcugugcucugga

SEQ ID NO: 1780984 - RNA, 15 nt, Human
gcuguuggcuggggg

SEQ ID NO: 1780985 - RNA, 16 nt, Human
gcuguuggcugggggc

SEQ ID NO: 1780986 - RNA, 20 nt, Human
gcuguuggcugggggccuca

SEQ ID NO: 1780987 - RNA, 15 nt, Human
gcuggcgugcagugg

SEQ ID NO: 1780988 - RNA, 18 nt, Human
gcuggcgugcaguggugc

SEQ ID NO: 1780989 - RNA, 18 nt, Human
gcuggcuguuggcugggg

SEQ ID NO: 1780990 - RNA, 19 nt, Human
gcuggcuguuggcuggggg

SEQ ID NO: 1780991 - RNA, 14 nt, Human
gcuggcgugcagug

SEQ ID NO: 1780992 - RNA, 20 nt, Human
gcuggcuguuggcugggggc

SEQ ID NO: 1780993 - RNA, 23 nt, Human
gcuggcuguuggcugggggccuc

SEQ ID NO: 1780994 - RNA, 13 nt, Human
gcugagccaccug

SEQ ID NO: 1780995 - RNA, 15 nt, Human
gcugagccaccugcc

SEQ ID NO: 1780996 - RNA, 16 nt, Human
gcugagccaccugccc

SEQ ID NO: 1780997 - RNA, 20 nt, Human
gcugagccaccugcccuuuu

SEQ ID NO: 1780998 - RNA, 13 nt, Human
gcugaggcagcag

SEQ ID NO: 1780999 - RNA, 23 nt, Human
gcugaggcagcagugugaggcca

SEQ ID NO: 1781000 - RNA, 11 nt, Human
gcugcaaagug

SEQ ID NO: 1781001 - RNA, 12 nt, Human
gcugcaaagugu

SEQ ID NO: 1781002 - RNA, 13 nt, Human
gcugcaaaguguu

SEQ ID NO: 1781003 - RNA, 21 nt, Human
gcugcaaaguguuuuguacca

SEQ ID NO: 1781004 - RNA, 14 nt, Human
gcugcaacaaaaug

SEQ ID NO: 1781005 - RNA, 15 nt, Human
gcugcaacaaaaugu

SEQ ID NO: 1781006 - RNA, 20 nt, Human
gcugcccuaguuuucuuucc

SEQ ID NO: 1781007 - RNA, 16 nt, Human
gcugcccuaugggccu

SEQ ID NO: 1781008 - RNA, 17 nt, Human
gcugcccuaugggccug

SEQ ID NO: 1781009 - RNA, 18 nt, Human
gcugcccuaugggccugc

SEQ ID NO: 1781010 - RNA, 23 nt, Human
gcugcccuccccuccggacuggu

SEQ ID NO: 1781011 - RNA, 19 nt, Human
gcugccccuaaucucugua

SEQ ID NO: 1781012 - RNA, 22 nt, Human
gcugccccuaaucucuguagga

SEQ ID NO: 1781013 - RNA, 16 nt, Human
gcugcagccugcgcca

SEQ ID NO: 1781014 - RNA, 13 nt, Human
gcugccugcccac

SEQ ID NO: 1781015 - RNA, 17 nt, Human
gcugccuguucagcucc

SEQ ID NO: 1781016 - RNA, 12 nt, Human
gcugccuguuca

SEQ ID NO: 1781017 - RNA, 13 nt, Human
gcugccuguucag

SEQ ID NO: 1781018 - RNA, 21 nt, Human
gcugccucuaccugacacucc

SEQ ID NO: 1781019 - RNA, 12 nt, Human
gcugccucccaa

SEQ ID NO: 1781020 - RNA, 22 nt, Human
gcugccucccaacaguggggaa

SEQ ID NO: 1781021 - RNA, 21 nt, Human
gcugccuccccucuccuuccu

SEQ ID NO: 1781022 - RNA, 13 nt, Human
gcuuuugccauua

SEQ ID NO: 1781023 - RNA, 15 nt, Human
gcuuuuccuuggcau

SEQ ID NO: 1781024 - RNA, 21 nt, Human
gcuuuuccuuggcauuccgca

SEQ ID NO: 1781025 - RNA, 23 nt, Human
ggaaagaugguguggguguccug

SEQ ID NO: 1781026 - RNA, 15 nt, Human
ggaaacagguuggga

SEQ ID NO: 1781027 - RNA, 20 nt, Human
ggaaacagcuaaugggacac

SEQ ID NO: 1781028 - RNA, 16 nt, Human
ggaaaaaauaacaaug

SEQ ID NO: 1781029 - RNA, 13 nt, Human
gcuuuugcuucua

SEQ ID NO: 1781030 - RNA, 13 nt, Human
gcuuucuacccag

SEQ ID NO: 1781031 - RNA, 16 nt, Human
gcuuucgaacugcuag

SEQ ID NO: 1781032 - RNA, 19 nt, Human
gcuuucuacccagcgagcc

SEQ ID NO: 1781033 - RNA, 22 nt, Human
gcuuucuacccagcgagcccug

SEQ ID NO: 1781034 - RNA, 23 nt, Human
gcuuucuacccagcgagcccugg

SEQ ID NO: 1781035 - RNA, 17 nt, Human
gcuuuccuuuuuuaaaa

SEQ ID NO: 1781036 - RNA, 23 nt, Human
gcuuuccuuuuuuaaaaaugcaa

SEQ ID NO: 1781037 - RNA, 15 nt, Human
gcuguuuacuaggga

SEQ ID NO: 1781038 - RNA, 14 nt, Human
ggacagugcugcag

SEQ ID NO: 1781039 - RNA, 16 nt, Human
ggacagugcugcagcu

SEQ ID NO: 1781040 - RNA, 23 nt, Human
ggacagugcuugauacaggaaca

SEQ ID NO: 1781041 - RNA, 17 nt, Human
ggacagggaggugaccc

SEQ ID NO: 1781042 - RNA, 14 nt, Human
ggacacagcucuuc

SEQ ID NO: 1781043 - RNA, 13 nt, Human
ggacacagcucuu

SEQ ID NO: 1781044 - RNA, 13 nt, Human
ggacacaggccug

SEQ ID NO: 1781045 - RNA, 18 nt, Human
ggacacaggccugcucuc

SEQ ID NO: 1781046 - RNA, 20 nt, Human
ggaauauuugaaucuugucu

SEQ ID NO: 1781047 - RNA, 15 nt, Human
ggaauauuugaaucu

SEQ ID NO: 1781048 - RNA, 12 nt, Human
ggacacagcucu

SEQ ID NO: 1781049 - RNA, 18 nt, Human
ggaauauaugugugccua

SEQ ID NO: 1781050 - RNA, 14 nt, Human
ggaauaucaauaua

SEQ ID NO: 1781051 - RNA, 14 nt, Human
ggaauauuugaauc

SEQ ID NO: 1781052 - RNA, 13 nt, Human
ggaauauuugaau

SEQ ID NO: 1781053 - RNA, 11 nt, Human
ggaauauuuga

SEQ ID NO: 1781054 - RNA, 23 nt, Human
ggaagcccagccccuacugcugu

SEQ ID NO: 1781055 - RNA, 16 nt, Human
gcucagaacuugcugc

SEQ ID NO: 1781056 - RNA, 17 nt, Human
gcucagaacuugcugcu

SEQ ID NO: 1781057 - RNA, 19 nt, Human
gcucagaacuugcugcugu

SEQ ID NO: 1781058 - RNA, 20 nt, Human
gcucagaacuugcugcuguc

SEQ ID NO: 1781059 - RNA, 22 nt, Human
gcuaggaccccuccaugugggc

SEQ ID NO: 1781060 - RNA, 20 nt, Human
gcuaggaccccuccaugugg

SEQ ID NO: 1781061 - RNA, 14 nt, Human
gcuaguugggcuuc

SEQ ID NO: 1781062 - RNA, 16 nt, Human
gcuaguugggcuuccu

SEQ ID NO: 1781063 - RNA, 18 nt, Human
gcuaagugauccucccac

SEQ ID NO: 1781064 - RNA, 22 nt, Human
gcuaagugauccucccaccuca

SEQ ID NO: 1781065 - RNA, 15 nt, Human
gcggauggauggaag

SEQ ID NO: 1781066 - RNA, 21 nt, Human
gcggauggauggaagguugga

SEQ ID NO: 1781067 - RNA, 16 nt, Human
gcggcguacaggcugg

SEQ ID NO: 1781068 - RNA, 17 nt, Human
gcggcguacaggcuggc

SEQ ID NO: 1781069 - RNA, 16 nt, Human
gcgggacagugcugca

SEQ ID NO: 1781070 - RNA, 18 nt, Human
gcguuaugaagagcuaau

SEQ ID NO: 1781071 - RNA, 23 nt, Human
gcgauucuucugcuucagccucc

SEQ ID NO: 1781072 - RNA, 14 nt, Human
gccuugcauaccca

SEQ ID NO: 1781073 - RNA, 22 nt, Human
gcgauucuucugcuucagccuc

SEQ ID NO: 1781074 - RNA, 13 nt, Human
gccuucugugggg

SEQ ID NO: 1781075 - RNA, 14 nt, Human
gccuucugugggga

SEQ ID NO: 1781076 - RNA, 19 nt, Human
gccuucuguggggacuccg

SEQ ID NO: 1781077 - RNA, 15 nt, Human
gccuucucugaagga

SEQ ID NO: 1781078 - RNA, 16 nt, Human
gccuucucugaaggac

SEQ ID NO: 1781079 - RNA, 12 nt, Human
gccuucucacca

SEQ ID NO: 1781080 - RNA, 13 nt, Human
gccuucucaccag

SEQ ID NO: 1781081 - RNA, 15 nt, Human
gccuucucaccagcu

SEQ ID NO: 1781082 - RNA, 16 nt, Human
gccuucucaccagcug

SEQ ID NO: 1781083 - RNA, 17 nt, Human
gccuucucaccagcugc

SEQ ID NO: 1781084 - RNA, 18 nt, Human
gccuucucaccagcugca

SEQ ID NO: 1781085 - RNA, 19 nt, Human
gccuucucaccagcugcaa

SEQ ID NO: 1781086 - RNA, 21 nt, Human
gccuucucaccagcugcaaag

SEQ ID NO: 1781087 - RNA, 22 nt, Human
gccuucucaccagcugcaaagu

SEQ ID NO: 1781088 - RNA, 23 nt, Human
gccuucucaccagcugcaaagug

SEQ ID NO: 1781089 - RNA, 15 nt, Human
gccuguucagcucca

SEQ ID NO: 1781090 - RNA, 16 nt, Human
gccuguucagcuccag

SEQ ID NO: 1781091 - RNA, 17 nt, Human
gccuguucagcuccagc

SEQ ID NO: 1781092 - RNA, 12 nt, Human
gccucuggguca

SEQ ID NO: 1781093 - RNA, 13 nt, Human
gccucugggucag

SEQ ID NO: 1781094 - RNA, 22 nt, Human
gccucugggucagugguccaca

SEQ ID NO: 1781095 - RNA, 12 nt, Human
gcccaggcaggu

SEQ ID NO: 1781096 - RNA, 11 nt, Human
gcccaggcagg

SEQ ID NO: 1781097 - RNA, 11 nt, Human
gcccaggcccc

SEQ ID NO: 1781098 - RNA, 12 nt, Human
gcccaggccccu

SEQ ID NO: 1781099 - RNA, 20 nt, Human
gcccaggccccugccacccu

SEQ ID NO: 1781100 - RNA, 21 nt, Human
gcccaggccccugccacccug

SEQ ID NO: 1781101 - RNA, 22 nt, Human
gcccaggccccugccacccugg

SEQ ID NO: 1781102 - RNA, 23 nt, Human
gcccacgcuggagugcagugagc

SEQ ID NO: 1781103 - RNA, 19 nt, Human
gcccacgcuggagugcagu

SEQ ID NO: 1781104 - RNA, 21 nt, Human
gcccacgcuggagugcaguga

SEQ ID NO: 1781105 - RNA, 13 nt, Human
gcccacuucugcc

SEQ ID NO: 1781106 - RNA, 14 nt, Human
gccauuagccaagg

SEQ ID NO: 1781107 - RNA, 18 nt, Human
gcauuuacuuuguguuca

SEQ ID NO: 1781108 - RNA, 17 nt, Human
gccccaaacaaauaugc

SEQ ID NO: 1781109 - RNA, 18 nt, Human
gccccaaacaaauaugca

SEQ ID NO: 1781110 - RNA, 19 nt, Human
gccccaaacaaauaugcaa

SEQ ID NO: 1781111 - RNA, 12 nt, Human
gccccugcuggu

SEQ ID NO: 1781112 - RNA, 15 nt, Human
gccccugcugguuca

SEQ ID NO: 1781113 - RNA, 16 nt, Human
gccccugcugguucag

SEQ ID NO: 1781114 - RNA, 16 nt, Human
gccucgaacuggcugc

SEQ ID NO: 1781115 - RNA, 13 nt, Human
gccucgaacuggc

SEQ ID NO: 1781116 - RNA, 17 nt, Human
gccuacaggagugagca

SEQ ID NO: 1781117 - RNA, 21 nt, Human
gccccugcugguucaggguug

SEQ ID NO: 1781118 - RNA, 16 nt, Human
gccuacaggagugagc

SEQ ID NO: 1781119 - RNA, 14 nt, Human
gccggcagccccag

SEQ ID NO: 1781120 - RNA, 15 nt, Human
gccggcagccccagc

SEQ ID NO: 1781121 - RNA, 16 nt, Human
gccggcagccccagcc

SEQ ID NO: 1781122 - RNA, 17 nt, Human
gccggcagccccagccu

SEQ ID NO: 1781123 - RNA, 21 nt, Human
gcccuguggaugagcccucag

SEQ ID NO: 1781124 - RNA, 13 nt, Human
gcccugcugaguc

SEQ ID NO: 1781125 - RNA, 19 nt, Human
gcccuuagcagggaaacag

SEQ ID NO: 1781126 - RNA, 19 nt, Human
gcccuuaucugugcucagg

SEQ ID NO: 1781127 - RNA, 20 nt, Human
gcccuuaucugugcucagga

SEQ ID NO: 1781128 - RNA, 22 nt, Human
gcccuguggaugagcccucaga

SEQ ID NO: 1781129 - RNA, 14 nt, Human
gugucaccugaaga

SEQ ID NO: 1781130 - RNA, 22 nt, Human
gugucaccugaagacucauucu

SEQ ID NO: 1781131 - RNA, 14 nt, Human
gugucaccugugcu

SEQ ID NO: 1781132 - RNA, 14 nt, Human
gugucagguggggc

SEQ ID NO: 1781133 - RNA, 18 nt, Human
gugucagguggggcagcu

SEQ ID NO: 1781134 - RNA, 23 nt, Human
gugugaaccaccacacccagccc

SEQ ID NO: 1781135 - RNA, 16 nt, Human
gugucuguuuugagcu

SEQ ID NO: 1781136 - RNA, 22 nt, Human
gugugaacuggacccuguugcu

SEQ ID NO: 1781137 - RNA, 17 nt, Human
gugugaacuggacccug

SEQ ID NO: 1781138 - RNA, 14 nt, Human
gugugaacuggacc

SEQ ID NO: 1781139 - RNA, 20 nt, Human
gugucagguggggcagcuug

SEQ ID NO: 1781140 - RNA, 19 nt, Human
gugucagguggggcagcuu

SEQ ID NO: 1781141 - RNA, 13 nt, Human
aagcaaaauauua

SEQ ID NO: 1781142 - RNA, 14 nt, Human
aagcaaaauauuau

SEQ ID NO: 1781143 - RNA, 11 nt, Human
aagaggcaggg

SEQ ID NO: 1781144 - RNA, 14 nt, Human
aagaggcagggucu

SEQ ID NO: 1781145 - RNA, 16 nt, Human
aagagggacgccuggg

SEQ ID NO: 1781146 - RNA, 17 nt, Human
aagagggacgccugggg

SEQ ID NO: 1781147 - RNA, 17 nt, Human
aagauauaagugcugua

SEQ ID NO: 1781148 - RNA, 16 nt, Human
aagauauaagugcugu

SEQ ID NO: 1781149 - RNA, 15 nt, Human
aagauauaagugcug

SEQ ID NO: 1781150 - RNA, 11 nt, Human
gugcugccucu

SEQ ID NO: 1781151 - RNA, 12 nt, Human
gugcugccucua

SEQ ID NO: 1781152 - RNA, 19 nt, Human
gugcugccucuaccugaca

SEQ ID NO: 1781153 - RNA, 19 nt, Human
guguaaauaguuacuccag

SEQ ID NO: 1781154 - RNA, 19 nt, Human
aagcauguaacuuauauua

SEQ ID NO: 1781155 - RNA, 12 nt, Human
aagcacugagca

SEQ ID NO: 1781156 - RNA, 17 nt, Human
aagccaaagcuaggccu

SEQ ID NO: 1781157 - RNA, 18 nt, Human
aagccaaagcuaggccug

SEQ ID NO: 1781158 - RNA, 20 nt, Human
aagccaaagcuaggccuggc

SEQ ID NO: 1781159 - RNA, 21 nt, Human
aagcauuugaaugcauuuugu

SEQ ID NO: 1781160 - RNA, 18 nt, Human
aagcauuugaaugcauuu

SEQ ID NO: 1781161 - RNA, 21 nt, Human
aagcacauauuagugcagcca

SEQ ID NO: 1781162 - RNA, 23 nt, Human
aagcacauauuagugcagccaag

SEQ ID NO: 1781163 - RNA, 13 nt, Human
aagcaccuccugc

SEQ ID NO: 1781164 - RNA, 14 nt, Human
aagcaccuccugcc

SEQ ID NO: 1781165 - RNA, 15 nt, Human
aagcaccuccugccu

SEQ ID NO: 1781166 - RNA, 16 nt, Human
aagcaccuccugccuc

SEQ ID NO: 1781167 - RNA, 17 nt, Human
aagcaccuccugccucg

SEQ ID NO: 1781168 - RNA, 16 nt, Human
aagcacuaaacaaaga

SEQ ID NO: 1781169 - RNA, 17 nt, Human
guucagguaacaggcag

SEQ ID NO: 1781170 - RNA, 18 nt, Human
guucagguaacaggcaga

SEQ ID NO: 1781171 - RNA, 16 nt, Human
guucaguguaaauagu

SEQ ID NO: 1781172 - RNA, 20 nt, Human
guucaggguuggccccugcc

SEQ ID NO: 1781173 - RNA, 21 nt, Human
guucaggguuggccccugccc

SEQ ID NO: 1781174 - RNA, 22 nt, Human
guucaggguuggccccugcccg

SEQ ID NO: 1781175 - RNA, 13 nt, Human
guuauuuuccagg

SEQ ID NO: 1781176 - RNA, 23 nt, Human
guucagcuuguaaauagcucagg

SEQ ID NO: 1781177 - RNA, 21 nt, Human
aagccucaucaucagagccuu

SEQ ID NO: 1781178 - RNA, 14 nt, Human
guuacugccuuaau

SEQ ID NO: 1781179 - RNA, 21 nt, Human
guuacugccuuaauaaaaaau

SEQ ID NO: 1781180 - RNA, 19 nt, Human
aagcccagccccuacugcu

SEQ ID NO: 1781181 - RNA, 22 nt, Human
aagcccagccccuacugcugug

SEQ ID NO: 1781182 - RNA, 20 nt, Human
aagcccagcacugcuugagg

SEQ ID NO: 1781183 - RNA, 23 nt, Human
aagcccagcacugcuugaggaaa

SEQ ID NO: 1781184 - RNA, 13 nt, Human
guuaauaccagcu

SEQ ID NO: 1781185 - RNA, 14 nt, Human
aagccauuccaaag

SEQ ID NO: 1781186 - RNA, 15 nt, Human
aagccauuccaaagu

SEQ ID NO: 1781187 - RNA, 20 nt, Human
aagccauucuaaggaaauua

SEQ ID NO: 1781188 - RNA, 19 nt, Human
guuauuauauuuacaaaug

SEQ ID NO: 1781189 - RNA, 13 nt, Human
guuagacagccaa

SEQ ID NO: 1781190 - RNA, 20 nt, Human
guuauuauauuuacaaaugg

SEQ ID NO: 1781191 - RNA, 17 nt, Human
guuagaggaaaaauauu

SEQ ID NO: 1781192 - RNA, 12 nt, Human
guucccccaucu

SEQ ID NO: 1781193 - RNA, 17 nt, Human
aagcucugcuccucucc

SEQ ID NO: 1781194 - RNA, 20 nt, Human
aagcuucugucuccagcuuc

SEQ ID NO: 1781195 - RNA, 16 nt, Human
aagcucuuacucuuuc

SEQ ID NO: 1781196 - RNA, 11 nt, Human
aagcuucccuc

SEQ ID NO: 1781197 - RNA, 12 nt, Human
guucucugagga

SEQ ID NO: 1781198 - RNA, 14 nt, Human
guucucugaggaca

SEQ ID NO: 1781199 - RNA, 12 nt, Human
guucucugggag

SEQ ID NO: 1781200 - RNA, 13 nt, Human
guucucugggaga

SEQ ID NO: 1781201 - RNA, 14 nt, Human
guucucugggagaa

SEQ ID NO: 1781202 - RNA, 15 nt, Human
guucucugggagaaa

SEQ ID NO: 1781203 - RNA, 16 nt, Human
guucucugggagaaaa

SEQ ID NO: 1781204 - RNA, 19 nt, Human
guucucugggagaaaauca

SEQ ID NO: 1781205 - RNA, 20 nt, Human
guucucugggagaaaaucau

SEQ ID NO: 1781206 - RNA, 15 nt, Human
guugaccccagagga

SEQ ID NO: 1781207 - RNA, 14 nt, Human
guugaccccagagg

SEQ ID NO: 1781208 - RNA, 22 nt, Human
guucuucuuguucugagauuca

SEQ ID NO: 1781209 - RNA, 14 nt, Human
guuuuaacaaaaac

SEQ ID NO: 1781210 - RNA, 23 nt, Human
aaguacuguaagaauaauuuaua

SEQ ID NO: 1781211 - RNA, 18 nt, Human
aaguacuucuccacccug

SEQ ID NO: 1781212 - RNA, 19 nt, Human
aaguacuucuccacccugc

SEQ ID NO: 1781213 - RNA, 20 nt, Human
aaguacuucuccacccugcu

SEQ ID NO: 1781214 - RNA, 15 nt, Human
aaguauuauuuucca

SEQ ID NO: 1781215 - RNA, 20 nt, Human
aagucaaagcaaggaaacua

SEQ ID NO: 1781216 - RNA, 16 nt, Human
guuuaaaaaucaacuu

SEQ ID NO: 1781217 - RNA, 19 nt, Human
guuuaaaaaucaacuuuuu

SEQ ID NO: 1781218 - RNA, 22 nt, Human
guuucaaagccaagaccucaca

SEQ ID NO: 1781219 - RNA, 23 nt, Human
guuucaaccaagucaugugcauu

SEQ ID NO: 1781220 - RNA, 22 nt, Human
guuucaauugcaucucccagau

SEQ ID NO: 1781221 - RNA, 16 nt, Human
guuucaauugcaucuc

SEQ ID NO: 1781222 - RNA, 17 nt, Human
guuucaauugcaucucc

SEQ ID NO: 1781223 - RNA, 13 nt, Human
aagggcugcauga

SEQ ID NO: 1781224 - RNA, 14 nt, Human
aagggcugcaugau

SEQ ID NO: 1781225 - RNA, 15 nt, Human
aagggcugcaugaug

SEQ ID NO: 1781226 - RNA, 17 nt, Human
aagggcugcaugauguu

SEQ ID NO: 1781227 - RNA, 20 nt, Human
aagggcugcaugauguuugc

SEQ ID NO: 1781228 - RNA, 11 nt, Human
aaggggacagc

SEQ ID NO: 1781229 - RNA, 16 nt, Human
aaggggacagcugugu

SEQ ID NO: 1781230 - RNA, 15 nt, Human
aaguuacaauguuuu

SEQ ID NO: 1781231 - RNA, 19 nt, Human
aaguuacacagaaaugcug

SEQ ID NO: 1781232 - RNA, 21 nt, Human
aaguuacacagaaaugcugcu

SEQ ID NO: 1781233 - RNA, 22 nt, Human
aaguuacacagaaaugcugcug

SEQ ID NO: 1781234 - RNA, 23 nt, Human
aaguuacacagaaaugcugcugg

SEQ ID NO: 1781235 - RNA, 21 nt, Human
aagugugaacuggacccuguu

SEQ ID NO: 1781236 - RNA, 13 nt, Human
aagugugaacugg

SEQ ID NO: 1781237 - RNA, 10 nt, Human
aaguuauuuu

SEQ ID NO: 1781238 - RNA, 14 nt, Human
aaguuauuuuaccu

SEQ ID NO: 1781239 - RNA, 15 nt, Human
aaguuauuuuuguac

SEQ ID NO: 1781240 - RNA, 16 nt, Human
aaguuauuuuuguaca

SEQ ID NO: 1781241 - RNA, 17 nt, Human
aaguuauuuuuguacau

SEQ ID NO: 1781242 - RNA, 18 nt, Human
aaguuauuuuuguacaug

SEQ ID NO: 1781243 - RNA, 19 nt, Human
aaguuauuuuuguacaugu

SEQ ID NO: 1781244 - RNA, 22 nt, Human
aaguuugaauguuaaauaaauu

SEQ ID NO: 1781245 - RNA, 18 nt, Human
aaguuugaauguuaaaua

SEQ ID NO: 1781246 - RNA, 16 nt, Human
aaguuugaauguuaaa

SEQ ID NO: 1781247 - RNA, 15 nt, Human
aaguuugaauguuaa

SEQ ID NO: 1781248 - RNA, 14 nt, Human
aaguuugaauguua

SEQ ID NO: 1781249 - RNA, 13 nt, Human
aaguuugaauguu

SEQ ID NO: 1781250 - RNA, 18 nt, Human
aaguuuccuuccagccca

SEQ ID NO: 1781251 - RNA, 19 nt, Human
aaguuuccuuccagcccag

SEQ ID NO: 1781252 - RNA, 20 nt, Human
aaguuuccuuccagcccaga

SEQ ID NO: 1781253 - RNA, 21 nt, Human
aaguuuccuuccagcccagaa

SEQ ID NO: 1781254 - RNA, 15 nt, Human
uaaaauucugaauuu

SEQ ID NO: 1781255 - RNA, 19 nt, Human
uaaaauugccauauugcac

SEQ ID NO: 1781256 - RNA, 18 nt, Human
uaaaauugccauauugca

SEQ ID NO: 1781257 - RNA, 16 nt, Human
uaaaauugccauauug

SEQ ID NO: 1781258 - RNA, 15 nt, Human
uaaaauugccauauu

SEQ ID NO: 1781259 - RNA, 14 nt, Human
uaaaauugccauau

SEQ ID NO: 1781260 - RNA, 13 nt, Human
uaaaauugccaua

SEQ ID NO: 1781261 - RNA, 12 nt, Human
uaaaauugccau

SEQ ID NO: 1781262 - RNA, 13 nt, Human
aagugauccuccc

SEQ ID NO: 1781263 - RNA, 19 nt, Human
aagugauccucccaccuca

SEQ ID NO: 1781264 - RNA, 20 nt, Human
aagugauccucccaccucag

SEQ ID NO: 1781265 - RNA, 23 nt, Human
aagugauccucccaccucagccu

SEQ ID NO: 1781266 - RNA, 21 nt, Human
uaaaaccauguagaaaauuug

SEQ ID NO: 1781267 - RNA, 16 nt, Human
uaaaaaaaaaaaagua

SEQ ID NO: 1781268 - RNA, 16 nt, Human
gucgaggacagggagg

SEQ ID NO: 1781269 - RNA, 14 nt, Human
gucgauagagcugu

SEQ ID NO: 1781270 - RNA, 14 nt, Human
guccucuuuucuga

SEQ ID NO: 1781271 - RNA, 22 nt, Human
gucuaugggacucaaugcacug

SEQ ID NO: 1781272 - RNA, 16 nt, Human
aacauguggcuccucc

SEQ ID NO: 1781273 - RNA, 20 nt, Human
aacauguggcuccucccagc

SEQ ID NO: 1781274 - RNA, 15 nt, Human
aacauguaggaagua

SEQ ID NO: 1781275 - RNA, 13 nt, Human
aacauucaggagc

SEQ ID NO: 1781276 - RNA, 14 nt, Human
aacauucaggagcu

SEQ ID NO: 1781277 - RNA, 12 nt, Human
guccuccucugu

SEQ ID NO: 1781278 - RNA, 13 nt, Human
guccuccucugug

SEQ ID NO: 1781279 - RNA, 14 nt, Human
guccuccucuguga

SEQ ID NO: 1781280 - RNA, 14 nt, Human
gucccugucaccuc

SEQ ID NO: 1781281 - RNA, 15 nt, Human
gucccugucaccucu

SEQ ID NO: 1781282 - RNA, 17 nt, Human
gucccugucaccucuuc

SEQ ID NO: 1781283 - RNA, 12 nt, Human
gucccuguuaga

SEQ ID NO: 1781284 - RNA, 19 nt, Human
gucauuugagcagggcuca

SEQ ID NO: 1781285 - RNA, 21 nt, Human
guccauaucagaacugugcca

SEQ ID NO: 1781286 - RNA, 21 nt, Human
aacacucacauuuauucugcu

SEQ ID NO: 1781287 - RNA, 17 nt, Human
gucauuugagcagggcu

SEQ ID NO: 1781288 - RNA, 23 nt, Human
aacacugguggaggauggaaagg

SEQ ID NO: 1781289 - RNA, 22 nt, Human
gucagugguccacaucccggga

SEQ ID NO: 1781290 - RNA, 16 nt, Human
gucaguaccuucaaac

SEQ ID NO: 1781291 - RNA, 15 nt, Human
gucagguagggggga

SEQ ID NO: 1781292 - RNA, 18 nt, Human
gucagguaggggggaaac

SEQ ID NO: 1781293 - RNA, 16 nt, Human
gucagguggggcagcu

SEQ ID NO: 1781294 - RNA, 17 nt, Human
gucagguggggcagcuu

SEQ ID NO: 1781295 - RNA, 18 nt, Human
gucagguggggcagcuug

SEQ ID NO: 1781296 - RNA, 22 nt, Human
gucagguggggcagcuugaggg

SEQ ID NO: 1781297 - RNA, 15 nt, Human
gucagaaacaggacc

SEQ ID NO: 1781298 - RNA, 15 nt, Human
gucagaacccugcca

SEQ ID NO: 1781299 - RNA, 16 nt, Human
gucagaacccugccau

SEQ ID NO: 1781300 - RNA, 12 nt, Human
gucaccaagccc

SEQ ID NO: 1781301 - RNA, 15 nt, Human
gucaccaagcccagu

SEQ ID NO: 1781302 - RNA, 19 nt, Human
gucaccaaaagacacugca

SEQ ID NO: 1781303 - RNA, 22 nt, Human
gucaccaaaagacacugcagaa

SEQ ID NO: 1781304 - RNA, 17 nt, Human
gucaauuuaugaauaua

SEQ ID NO: 1781305 - RNA, 18 nt, Human
gucaauuuaugaauauaa

SEQ ID NO: 1781306 - RNA, 21 nt, Human
gucacaaauccuaaaagaagc

SEQ ID NO: 1781307 - RNA, 12 nt, Human
gucacaggcagg

SEQ ID NO: 1781308 - RNA, 11 nt, Human
aaaucaucaag

SEQ ID NO: 1781309 - RNA, 12 nt, Human
aaaucaucaaga

SEQ ID NO: 1781310 - RNA, 13 nt, Human
aaaucaucaagaa

SEQ ID NO: 1781311 - RNA, 14 nt, Human
aaaucaucaagaag

SEQ ID NO: 1781312 - RNA, 18 nt, Human
aaaucaucaagaagggcu

SEQ ID NO: 1781313 - RNA, 19 nt, Human
aaaucaucaagaagggcug

SEQ ID NO: 1781314 - RNA, 23 nt, Human
aaaucaucaagaagggcugcaug

SEQ ID NO: 1781315 - RNA, 22 nt, Human
guauuguauuuauucaauaaag

SEQ ID NO: 1781316 - RNA, 18 nt, Human
guauuguauuuauucaau

SEQ ID NO: 1781317 - RNA, 17 nt, Human
guauuguauuuauucaa

SEQ ID NO: 1781318 - RNA, 16 nt, Human
guauuguauuuauuca

SEQ ID NO: 1781319 - RNA, 15 nt, Human
guauuguauuuauuc

SEQ ID NO: 1781320 - RNA, 13 nt, Human
guauuguauuuau

SEQ ID NO: 1781321 - RNA, 12 nt, Human
guauuguauuua

SEQ ID NO: 1781322 - RNA, 11 nt, Human
guauuuauuca

SEQ ID NO: 1781323 - RNA, 15 nt, Human
guauuuaccaaaaau

SEQ ID NO: 1781324 - RNA, 20 nt, Human
guauuuaccaaaaauuuugu

SEQ ID NO: 1781325 - RNA, 16 nt, Human
guauuuaacaaaaagu

SEQ ID NO: 1781326 - RNA, 20 nt, Human
guauuuaacaaaaagugcuu

SEQ ID NO: 1781327 - RNA, 12 nt, Human
aaaugucuugug

SEQ ID NO: 1781328 - RNA, 21 nt, Human
aaaugucucuuuaaugucaca

SEQ ID NO: 1781329 - RNA, 14 nt, Human
aaauguauaugcac

SEQ ID NO: 1781330 - RNA, 15 nt, Human
aaauguauaugcacu

SEQ ID NO: 1781331 - RNA, 17 nt, Human
aaauuguauauucacuu

SEQ ID NO: 1781332 - RNA, 21 nt, Human
aaauugucccuuaaacaaaaa

SEQ ID NO: 1781333 - RNA, 17 nt, Human
aaauuguauuacaaauc

SEQ ID NO: 1781334 - RNA, 21 nt, Human
aaauucuauucugaucuuauu

SEQ ID NO: 1781335 - RNA, 14 nt, Human
aaauucuaaaugua

SEQ ID NO: 1781336 - RNA, 17 nt, Human
aaauuccaagugauuga

SEQ ID NO: 1781337 - RNA, 17 nt, Human
gugagucaccaagccca

SEQ ID NO: 1781338 - RNA, 19 nt, Human
gugagucaccaagcccagu

SEQ ID NO: 1781339 - RNA, 18 nt, Human
gugagacucugucucaaa

SEQ ID NO: 1781340 - RNA, 12 nt, Human
aacucuuucaaa

SEQ ID NO: 1781341 - RNA, 13 nt, Human
aacucuuucaaaa

SEQ ID NO: 1781342 - RNA, 14 nt, Human
aacucuuugagaaa

SEQ ID NO: 1781343 - RNA, 20 nt, Human
gugacagagugagacucugu

SEQ ID NO: 1781344 - RNA, 22 nt, Human
gugacagagugagacucugucu

SEQ ID NO: 1781345 - RNA, 18 nt, Human
gugacaguggauugcauu

SEQ ID NO: 1781346 - RNA, 12 nt, Human
aacuccucccau

SEQ ID NO: 1781347 - RNA, 17 nt, Human
aacuccgagugaacugg

SEQ ID NO: 1781348 - RNA, 20 nt, Human
gugagacccagcccucaucc

SEQ ID NO: 1781349 - RNA, 14 nt, Human
gugagacucugucu

SEQ ID NO: 1781350 - RNA, 16 nt, Human
gugagacucugucuca

SEQ ID NO: 1781351 - RNA, 14 nt, Human
gucucaaaaaaaca

SEQ ID NO: 1781352 - RNA, 20 nt, Human
gucugacaggcaaugcuggc

SEQ ID NO: 1781353 - RNA, 15 nt, Human
gucugacaggcaaug

SEQ ID NO: 1781354 - RNA, 18 nt, Human
gucugacaggcaaugcug

SEQ ID NO: 1781355 - RNA, 12 nt, Human
gucugacaggca

SEQ ID NO: 1781356 - RNA, 13 nt, Human
gucugacaggcaa

SEQ ID NO: 1781357 - RNA, 14 nt, Human
gucugacaggcaau

SEQ ID NO: 1781358 - RNA, 18 nt, Human
gucuggaaugcaguggua

SEQ ID NO: 1781359 - RNA, 15 nt, Human
gucuggaaugcagug

SEQ ID NO: 1781360 - RNA, 16 nt, Human
gucuggaaugcagugg

SEQ ID NO: 1781361 - RNA, 22 nt, Human
gucuuaaugaaguuugaauguu

SEQ ID NO: 1781362 - RNA, 20 nt, Human
gucuuaaugaaguuugaaug

SEQ ID NO: 1781363 - RNA, 19 nt, Human
gucuuaaugaaguuugaau

SEQ ID NO: 1781364 - RNA, 18 nt, Human
gucuuaaugaaguuugaa

SEQ ID NO: 1781365 - RNA, 17 nt, Human
gucuuaaugaaguuuga

SEQ ID NO: 1781366 - RNA, 16 nt, Human
gucuuaaugaaguuug

SEQ ID NO: 1781367 - RNA, 14 nt, Human
gucuuaaugaaguu

SEQ ID NO: 1781368 - RNA, 18 nt, Human
gucuuuccacggagccac

SEQ ID NO: 1781369 - RNA, 20 nt, Human
gucuuguugcggauggaugg

SEQ ID NO: 1781370 - RNA, 22 nt, Human
aaccuuaucuccacaaccucuu

SEQ ID NO: 1781371 - RNA, 11 nt, Human
aacgugcauug

SEQ ID NO: 1781372 - RNA, 16 nt, Human
aacgugcauugugcuu

SEQ ID NO: 1781373 - RNA, 14 nt, Human
aacgugcauugugc

SEQ ID NO: 1781374 - RNA, 23 nt, Human
aacgugcauugugcuucuuucuu

SEQ ID NO: 1781375 - RNA, 20 nt, Human
gucuuuccauuggaucucau

SEQ ID NO: 1781376 - RNA, 11 nt, Human
aaccuggaggu

SEQ ID NO: 1781377 - RNA, 19 nt, Human
aaccuggaggucaauguua

SEQ ID NO: 1781378 - RNA, 23 nt, Human
aacuagugggguuuccuggcacu

SEQ ID NO: 1781379 - RNA, 17 nt, Human
aacuagggccaagccca

SEQ ID NO: 1781380 - RNA, 19 nt, Human
gugcucgcuguugcugaau

SEQ ID NO: 1781381 - RNA, 18 nt, Human
gugcucgcuguugcugaa

SEQ ID NO: 1781382 - RNA, 15 nt, Human
gugcucgcuguugcu

SEQ ID NO: 1781383 - RNA, 16 nt, Human
gugcucugaucaucca

SEQ ID NO: 1781384 - RNA, 22 nt, Human
gugcucgcuguugcugaauagg

SEQ ID NO: 1781385 - RNA, 13 nt, Human
gugcucuggacag

SEQ ID NO: 1781386 - RNA, 14 nt, Human
gugcucuggacagg

SEQ ID NO: 1781387 - RNA, 13 nt, Human
aagaauaauuuau

SEQ ID NO: 1781388 - RNA, 18 nt, Human
aagaauaauuuauaguaa

SEQ ID NO: 1781389 - RNA, 20 nt, Human
aagaauaauuuauaguaaug

SEQ ID NO: 1781390 - RNA, 21 nt, Human
gugcuacacccuuuuccagcu

SEQ ID NO: 1781391 - RNA, 20 nt, Human
gugccaacaauccuagugcu

SEQ ID NO: 1781392 - RNA, 11 nt, Human
aagaaaaacuu

SEQ ID NO: 1781393 - RNA, 12 nt, Human
aagaaaaacuuu

SEQ ID NO: 1781394 - RNA, 19 nt, Human
aagaaacaacucuuugaga

SEQ ID NO: 1781395 - RNA, 14 nt, Human
aacuguccuuuccu

SEQ ID NO: 1781396 - RNA, 15 nt, Human
aacugugccacaaug

SEQ ID NO: 1781397 - RNA, 21 nt, Human
gugcacaugcacgugugugca

SEQ ID NO: 1781398 - RNA, 13 nt, Human
gugcauugugcuu

SEQ ID NO: 1781399 - RNA, 11 nt, Human
gugcauugugc

SEQ ID NO: 1781400 - RNA, 18 nt, Human
uagaggcccuuugcuguc

SEQ ID NO: 1781401 - RNA, 21 nt, Human
uagagauuaccuccugagaaa

SEQ ID NO: 1781402 - RNA, 17 nt, Human
uagagauuaccuccuga

SEQ ID NO: 1781403 - RNA, 18 nt, Human
uagagauuaccuccugag

SEQ ID NO: 1781404 - RNA, 19 nt, Human
uagagauuaccuccugaga

SEQ ID NO: 1781405 - RNA, 18 nt, Human
acaaaggcaaagggucca

SEQ ID NO: 1781406 - RNA, 11 nt, Human
acaaaggcaag

SEQ ID NO: 1781407 - RNA, 21 nt, Human
acaaagaugggugaaggcugg

SEQ ID NO: 1781408 - RNA, 22 nt, Human
acaaagaugggugaaggcuggc

SEQ ID NO: 1781409 - RNA, 18 nt, Human
acaaaaggauaaugaaua

SEQ ID NO: 1781410 - RNA, 15 nt, Human
uagccagaggacugu

SEQ ID NO: 1781411 - RNA, 20 nt, Human
uagauggcaagcauguaacu

SEQ ID NO: 1781412 - RNA, 14 nt, Human
uagggaagggccug

SEQ ID NO: 1781413 - RNA, 21 nt, Human
acaaugacauacgcuuuuaau

SEQ ID NO: 1781414 - RNA, 15 nt, Human
acaauccuagugcuu

SEQ ID NO: 1781415 - RNA, 16 nt, Human
acaauccuagugcuuu

SEQ ID NO: 1781416 - RNA, 17 nt, Human
acaauccuagugcuuuc

SEQ ID NO: 1781417 - RNA, 22 nt, Human
acaauccuagugcuuuccuuuu

SEQ ID NO: 1781418 - RNA, 23 nt, Human
acaauccuagugcuuuccuuuuu

SEQ ID NO: 1781419 - RNA, 18 nt, Human
acaaucaugaaauaugca

SEQ ID NO: 1781420 - RNA, 19 nt, Human
acaaucaugaaauaugcau

SEQ ID NO: 1781421 - RNA, 23 nt, Human
uagcuauaauugggucauagaaa

SEQ ID NO: 1781422 - RNA, 23 nt, Human
acaauaaaauuuuuuuucauguu

SEQ ID NO: 1781423 - RNA, 14 nt, Human
acaauaaaugugca

SEQ ID NO: 1781424 - RNA, 16 nt, Human
acaauaaauugcuaau

SEQ ID NO: 1781425 - RNA, 23 nt, Human
acaauaaauugcuaauguugcug

SEQ ID NO: 1781426 - RNA, 22 nt, Human
acaauaaaauuuuuuuucaugu

SEQ ID NO: 1781427 - RNA, 20 nt, Human
acacuaaccacgcuggaccu

SEQ ID NO: 1781428 - RNA, 16 nt, Human
acaccgggcacucaga

SEQ ID NO: 1781429 - RNA, 11 nt, Human
uauaagaaaaa

SEQ ID NO: 1781430 - RNA, 12 nt, Human
uauaagaaaaac

SEQ ID NO: 1781431 - RNA, 13 nt, Human
uauaagaaaaacu

SEQ ID NO: 1781432 - RNA, 15 nt, Human
uauaagaaaaacuuu

SEQ ID NO: 1781433 - RNA, 20 nt, Human
acacucacauuuauucugcu

SEQ ID NO: 1781434 - RNA, 22 nt, Human
acacucacauuuauucugcuca

SEQ ID NO: 1781435 - RNA, 15 nt, Human
uauaaaagcuuucug

SEQ ID NO: 1781436 - RNA, 14 nt, Human
acacauauaaacau

SEQ ID NO: 1781437 - RNA, 22 nt, Human
acacauauaaacaucacacaca

SEQ ID NO: 1781438 - RNA, 13 nt, Human
uauaaaaaauaug

SEQ ID NO: 1781439 - RNA, 14 nt, Human
uauaaaaaauaugu

SEQ ID NO: 1781440 - RNA, 15 nt, Human
uauaaaaaauaugua

SEQ ID NO: 1781441 - RNA, 16 nt, Human
uauaaaaaauauguau

SEQ ID NO: 1781442 - RNA, 17 nt, Human
uauaaaaaauauguauu

SEQ ID NO: 1781443 - RNA, 19 nt, Human
acacacagcucuguccugg

SEQ ID NO: 1781444 - RNA, 17 nt, Human
acacacagcucuguccu

SEQ ID NO: 1781445 - RNA, 13 nt, Human
acacacagcucug

SEQ ID NO: 1781446 - RNA, 14 nt, Human
acacacagcucugu

SEQ ID NO: 1781447 - RNA, 22 nt, Human
acacacacgcgugcacacacca

SEQ ID NO: 1781448 - RNA, 15 nt, Human
acacacacacacaca

SEQ ID NO: 1781449 - RNA, 14 nt, Human
acacaccagagccc

SEQ ID NO: 1781450 - RNA, 15 nt, Human
acacaccagagccca

SEQ ID NO: 1781451 - RNA, 20 nt, Human
acacaccagagcccaccuug

SEQ ID NO: 1781452 - RNA, 21 nt, Human
acacacgcgugcacacaccag

SEQ ID NO: 1781453 - RNA, 19 nt, Human
acacacaaaaaaugcacaa

SEQ ID NO: 1781454 - RNA, 14 nt, Human
acacacaacaauua

SEQ ID NO: 1781455 - RNA, 13 nt, Human
acacacacacaca

SEQ ID NO: 1781456 - RNA, 19 nt, Human
acacaguauuacuucugcu

SEQ ID NO: 1781457 - RNA, 22 nt, Human
acacaguauuacuucugcuaca

SEQ ID NO: 1781458 - RNA, 18 nt, Human
acacaguauuacuucugc

SEQ ID NO: 1781459 - RNA, 21 nt, Human
uagugaaggcuucucucugug

SEQ ID NO: 1781460 - RNA, 23 nt, Human
uaguuaauauugugaagaaaaau

SEQ ID NO: 1781461 - RNA, 19 nt, Human
uagugaaggcuucucucug

SEQ ID NO: 1781462 - RNA, 16 nt, Human
uagucccugccacgaa

SEQ ID NO: 1781463 - RNA, 15 nt, Human
uaguacuagaaacug

SEQ ID NO: 1781464 - RNA, 17 nt, Human
uaugaacacuuaaauua

SEQ ID NO: 1781465 - RNA, 17 nt, Human
uaucuuuuguuuccuuu

SEQ ID NO: 1781466 - RNA, 22 nt, Human
uaucuuuuguuuccuuuuuucc

SEQ ID NO: 1781467 - RNA, 10 nt, Human
uaugccugug

SEQ ID NO: 1781468 - RNA, 21 nt, Human
uaugcauuuaaauacagucuu

SEQ ID NO: 1781469 - RNA, 22 nt, Human
uaugcauuuaaauacagucuuc

SEQ ID NO: 1781470 - RNA, 19 nt, Human
uaugcugcaacaaaaugua

SEQ ID NO: 1781471 - RNA, 15 nt, Human
uaugcuauugacaau

SEQ ID NO: 1781472 - RNA, 22 nt, Human
uauggguuuaguuacuuuagau

SEQ ID NO: 1781473 - RNA, 21 nt, Human
uaugguacauuuuucaacuuu

SEQ ID NO: 1781474 - RNA, 11 nt, Human
acagagaaagu

SEQ ID NO: 1781475 - RNA, 18 nt, Human
acagagaaaguacuucuc

SEQ ID NO: 1781476 - RNA, 22 nt, Human
uaucauuuaauaauauacuugu

SEQ ID NO: 1781477 - RNA, 20 nt, Human
uaucauuuauuuuuuacauu

SEQ ID NO: 1781478 - RNA, 21 nt, Human
uaucauuuaauaauauacuug

SEQ ID NO: 1781479 - RNA, 20 nt, Human
uaucauuuaauaauauacuu

SEQ ID NO: 1781480 - RNA, 19 nt, Human
uaucauuuaauaauauacu

SEQ ID NO: 1781481 - RNA, 18 nt, Human
uaucauuuaauaauauac

SEQ ID NO: 1781482 - RNA, 21 nt, Human
uauccagguaauccaagauau

SEQ ID NO: 1781483 - RNA, 18 nt, Human
uauccagguaauccaaga

SEQ ID NO: 1781484 - RNA, 19 nt, Human
uauaaguuauuuuuguaca

SEQ ID NO: 1781485 - RNA, 20 nt, Human
uauaaguuauuuuuguacau

SEQ ID NO: 1781486 - RNA, 21 nt, Human
uauaaguuauuuuuguacaug

SEQ ID NO: 1781487 - RNA, 22 nt, Human
uauaaguuauuuuuguacaugu

SEQ ID NO: 1781488 - RNA, 13 nt, Human
uauauuaauagua

SEQ ID NO: 1781489 - RNA, 15 nt, Human
uauauuaauaguaau

SEQ ID NO: 1781490 - RNA, 22 nt, Human
uauauuaauaguaauuuguaaa

SEQ ID NO: 1781491 - RNA, 23 nt, Human
uauauuaauaguaauuuguaaag

SEQ ID NO: 1781492 - RNA, 14 nt, Human
acaggcauguucuc

SEQ ID NO: 1781493 - RNA, 14 nt, Human
acaggcagguccag

SEQ ID NO: 1781494 - RNA, 16 nt, Human
acaggcagguccaggg

SEQ ID NO: 1781495 - RNA, 16 nt, Human
acaggagugagcacua

SEQ ID NO: 1781496 - RNA, 14 nt, Human
acaggaucagucug

SEQ ID NO: 1781497 - RNA, 15 nt, Human
acaggaucagucuga

SEQ ID NO: 1781498 - RNA, 15 nt, Human
acaggaaaagcugcu

SEQ ID NO: 1781499 - RNA, 16 nt, Human
acaggaaaagcugcug

SEQ ID NO: 1781500 - RNA, 17 nt, Human
acaggaaaagcugcuga

SEQ ID NO: 1781501 - RNA, 18 nt, Human
acaggaaaagcugcugac

SEQ ID NO: 1781502 - RNA, 23 nt, Human
uaugucuuuugaugaauagaagu

SEQ ID NO: 1781503 - RNA, 22 nt, Human
acaggcauguucucugaggaca

SEQ ID NO: 1781504 - RNA, 15 nt, Human
acaggcauguucucu

SEQ ID NO: 1781505 - RNA, 18 nt, Human
acaggcauguucucugag

SEQ ID NO: 1781506 - RNA, 19 nt, Human
acaggcauguucucugagg

SEQ ID NO: 1781507 - RNA, 20 nt, Human
acaggcauguucucugagga

SEQ ID NO: 1781508 - RNA, 16 nt, Human
uauguuuuuguucaaa

SEQ ID NO: 1781509 - RNA, 15 nt, Human
uauguuuuuguucaa

SEQ ID NO: 1781510 - RNA, 14 nt, Human
uauuacuucugcua

SEQ ID NO: 1781511 - RNA, 13 nt, Human
uauuacuucugcu

SEQ ID NO: 1781512 - RNA, 14 nt, Human
uauuaaaauucuga

SEQ ID NO: 1781513 - RNA, 15 nt, Human
uauuaaaauucugaa

SEQ ID NO: 1781514 - RNA, 19 nt, Human
uauuaaaauucugaauuuu

SEQ ID NO: 1781515 - RNA, 15 nt, Human
uauucagugucacug

SEQ ID NO: 1781516 - RNA, 14 nt, Human
uauucaauaaagua

SEQ ID NO: 1781517 - RNA, 17 nt, Human
uauucaauaaaguauuu

SEQ ID NO: 1781518 - RNA, 15 nt, Human
uauucaauaaaguau

SEQ ID NO: 1781519 - RNA, 20 nt, Human
uauucaauaaaguauuuaau

SEQ ID NO: 1781520 - RNA, 19 nt, Human
uauucaauaaaguauuuaa

SEQ ID NO: 1781521 - RNA, 21 nt, Human
uauucaauaaaguauuuaauu

SEQ ID NO: 1781522 - RNA, 12 nt, Human
acagggcacacc

SEQ ID NO: 1781523 - RNA, 20 nt, Human
acagggcacaccgggcacuc

SEQ ID NO: 1781524 - RNA, 15 nt, Human
acagggauucucaca

SEQ ID NO: 1781525 - RNA, 16 nt, Human
acagggauucucacaa

SEQ ID NO: 1781526 - RNA, 13 nt, Human
acaguaggagccc

SEQ ID NO: 1781527 - RNA, 14 nt, Human
acaguaggagccca

SEQ ID NO: 1781528 - RNA, 22 nt, Human
acaguaggagcccagcucugaa

SEQ ID NO: 1781529 - RNA, 12 nt, Human
acaggcugggcu

SEQ ID NO: 1781530 - RNA, 22 nt, Human
acaggcugggcuucaguggcag

SEQ ID NO: 1781531 - RNA, 23 nt, Human
acaggcugggcuucaguggcagc

SEQ ID NO: 1781532 - RNA, 13 nt, Human
aauguauaugcac

SEQ ID NO: 1781533 - RNA, 14 nt, Human
aauguauaugcacu

SEQ ID NO: 1781534 - RNA, 22 nt, Human
aaugugaaaaugguccaggaga

SEQ ID NO: 1781535 - RNA, 16 nt, Human
uacaggugugagucac

SEQ ID NO: 1781536 - RNA, 23 nt, Human
aauguuaaauaaauuguauauuc

SEQ ID NO: 1781537 - RNA, 22 nt, Human
aauguuaaauaaauuguauauu

SEQ ID NO: 1781538 - RNA, 21 nt, Human
aauguuaaauaaauuguauau

SEQ ID NO: 1781539 - RNA, 20 nt, Human
aauguuaaauaaauuguaua

SEQ ID NO: 1781540 - RNA, 18 nt, Human
aauguuaaauaaauugua

SEQ ID NO: 1781541 - RNA, 22 nt, Human
aauguguuuuguuuauuaaaua

SEQ ID NO: 1781542 - RNA, 15 nt, Human
aauguuaaauaaauu

SEQ ID NO: 1781543 - RNA, 13 nt, Human
aauguuaaauaaa

SEQ ID NO: 1781544 - RNA, 17 nt, Human
aauuaacuuacuuccaa

SEQ ID NO: 1781545 - RNA, 15 nt, Human
aaugccaucaucucc

SEQ ID NO: 1781546 - RNA, 20 nt, Human
aaugcuuaucaucuaaagau

SEQ ID NO: 1781547 - RNA, 16 nt, Human
aauggcagccuuggca

SEQ ID NO: 1781548 - RNA, 12 nt, Human
aauggcagccuu

SEQ ID NO: 1781549 - RNA, 13 nt, Human
aauggcuccuuca

SEQ ID NO: 1781550 - RNA, 13 nt, Human
uacuaugccugug

SEQ ID NO: 1781551 - RNA, 14 nt, Human
uacuaugccugugu

SEQ ID NO: 1781552 - RNA, 22 nt, Human
uacgcagcgugcuuuaaaaaau

SEQ ID NO: 1781553 - RNA, 16 nt, Human
uacgcccaucucagga

SEQ ID NO: 1781554 - RNA, 17 nt, Human
uacgcccaucucaggac

SEQ ID NO: 1781555 - RNA, 13 nt, Human
uacgccucuucug

SEQ ID NO: 1781556 - RNA, 18 nt, Human
uacgccucuucugucccu

SEQ ID NO: 1781557 - RNA, 17 nt, Human
uacgccugcauguaaac

SEQ ID NO: 1781558 - RNA, 20 nt, Human
uacgagcaccuccagccuga

SEQ ID NO: 1781559 - RNA, 21 nt, Human
uacgagcaccuccagccugaa

SEQ ID NO: 1781560 - RNA, 22 nt, Human
uacgagcaccuccagccugaac

SEQ ID NO: 1781561 - RNA, 12 nt, Human
aauuccuauaag

SEQ ID NO: 1781562 - RNA, 15 nt, Human
aauuccuauaaggaa

SEQ ID NO: 1781563 - RNA, 22 nt, Human
aauuccuauacgcagcgugcuu

SEQ ID NO: 1781564 - RNA, 17 nt, Human
aauugaguuuucagugg

SEQ ID NO: 1781565 - RNA, 23 nt, Human
aauugccauauugcacaugucuu

SEQ ID NO: 1781566 - RNA, 19 nt, Human
aauugccauauugcacaug

SEQ ID NO: 1781567 - RNA, 17 nt, Human
aauugccauauugcaca

SEQ ID NO: 1781568 - RNA, 16 nt, Human
aauugccauauugcac

SEQ ID NO: 1781569 - RNA, 15 nt, Human
aauugccauauugca

SEQ ID NO: 1781570 - RNA, 13 nt, Human
aauugccauauug

SEQ ID NO: 1781571 - RNA, 12 nt, Human
aauugccauauu

SEQ ID NO: 1781572 - RNA, 12 nt, Human
uacuguaagaau

SEQ ID NO: 1781573 - RNA, 14 nt, Human
uacuguaagaauaa

SEQ ID NO: 1781574 - RNA, 18 nt, Human
uacuguaagaauaauuua

SEQ ID NO: 1781575 - RNA, 19 nt, Human
uacuguaagaauaauuuau

SEQ ID NO: 1781576 - RNA, 20 nt, Human
uacuguaagaauaauuuaua

SEQ ID NO: 1781577 - RNA, 21 nt, Human
uacucugugucagguggggca

SEQ ID NO: 1781578 - RNA, 12 nt, Human
uacucuguguca

SEQ ID NO: 1781579 - RNA, 14 nt, Human
uacucucuucuucu

SEQ ID NO: 1781580 - RNA, 16 nt, Human
uacucucuucuucuca

SEQ ID NO: 1781581 - RNA, 14 nt, Human
uacucugcccucua

SEQ ID NO: 1781582 - RNA, 16 nt, Human
uacucugcccucuaga

SEQ ID NO: 1781583 - RNA, 18 nt, Human
aauuagugcuaaguguga

SEQ ID NO: 1781584 - RNA, 14 nt, Human
aauuagugcuaagu

SEQ ID NO: 1781585 - RNA, 21 nt, Human
aauuagugcuaagugugaacu

SEQ ID NO: 1781586 - RNA, 20 nt, Human
aauuagugcuaagugugaac

SEQ ID NO: 1781587 - RNA, 17 nt, Human
aauuaguaacauguguu

SEQ ID NO: 1781588 - RNA, 20 nt, Human
aauuaguaaaaaaucaauua

SEQ ID NO: 1781589 - RNA, 12 nt, Human
aauuccccagau

SEQ ID NO: 1781590 - RNA, 14 nt, Human
aauuccacugucaa

SEQ ID NO: 1781591 - RNA, 22 nt, Human
aauuccacugucaagaaagagc

SEQ ID NO: 1781592 - RNA, 13 nt, Human
aauuccaaagcaa

SEQ ID NO: 1781593 - RNA, 14 nt, Human
aauuccaaagcaaa

SEQ ID NO: 1781594 - RNA, 15 nt, Human
aauuccaaagcaaaa

SEQ ID NO: 1781595 - RNA, 18 nt, Human
aauuccaagugauugaaa

SEQ ID NO: 1781596 - RNA, 16 nt, Human
aauucacuuucauuuu

SEQ ID NO: 1781597 - RNA, 21 nt, Human
aauucacuuucauuuuugaua

SEQ ID NO: 1781598 - RNA, 21 nt, Human
aauucacaucuaaccucaucu

SEQ ID NO: 1781599 - RNA, 22 nt, Human
aauucacaucuaaccucaucuu

SEQ ID NO: 1781600 - RNA, 10 nt, Human
uaccugcugc

SEQ ID NO: 1781601 - RNA, 11 nt, Human
uaccugcugcu

SEQ ID NO: 1781602 - RNA, 14 nt, Human
uaccugcugcuucu

SEQ ID NO: 1781603 - RNA, 19 nt, Human
uaccugcugcuucuccaaa

SEQ ID NO: 1781604 - RNA, 13 nt, Human
uaccacuccugcc

SEQ ID NO: 1781605 - RNA, 17 nt, Human
aauuaggaagugauuau

SEQ ID NO: 1781606 - RNA, 15 nt, Human
aauuagcugcuucua

SEQ ID NO: 1781607 - RNA, 14 nt, Human
aauuagcugcuucu

SEQ ID NO: 1781608 - RNA, 19 nt, Human
uaaugaaguuugaauguua

SEQ ID NO: 1781609 - RNA, 20 nt, Human
uaaugaaguuugaauguuaa

SEQ ID NO: 1781610 - RNA, 22 nt, Human
uaaugaaguuugaauguuaaau

SEQ ID NO: 1781611 - RNA, 21 nt, Human
uaaugaaguuugaauguuaaa

SEQ ID NO: 1781612 - RNA, 20 nt, Human
uaauccccaguaaaauugcc

SEQ ID NO: 1781613 - RNA, 18 nt, Human
uaauccccaguaaaauug

SEQ ID NO: 1781614 - RNA, 17 nt, Human
uaauccccaguaaaauu

SEQ ID NO: 1781615 - RNA, 16 nt, Human
uaauauuuuacauaca

SEQ ID NO: 1781616 - RNA, 21 nt, Human
aaucuuucaaaccagcuucau

SEQ ID NO: 1781617 - RNA, 13 nt, Human
aaucuuuccaaau

SEQ ID NO: 1781618 - RNA, 16 nt, Human
aaugaaaaugucuugu

SEQ ID NO: 1781619 - RNA, 15 nt, Human
aaugaaaaugucuug

SEQ ID NO: 1781620 - RNA, 13 nt, Human
aaugaaugucuuu

SEQ ID NO: 1781621 - RNA, 18 nt, Human
uaaugucacaggcagguc

SEQ ID NO: 1781622 - RNA, 12 nt, Human
uaaguaaaguga

SEQ ID NO: 1781623 - RNA, 17 nt, Human
aaucaugaaauaugcau

SEQ ID NO: 1781624 - RNA, 16 nt, Human
aaucaugaaauaugca

SEQ ID NO: 1781625 - RNA, 19 nt, Human
aaucuuauaauuuaaaaua

SEQ ID NO: 1781626 - RNA, 13 nt, Human
aauccgaaccucc

SEQ ID NO: 1781627 - RNA, 19 nt, Human
aauccgaaccuccucugug

SEQ ID NO: 1781628 - RNA, 21 nt, Human
aauccgaccacuaauugccaa

SEQ ID NO: 1781629 - RNA, 12 nt, Human
aauccgaaccuc

SEQ ID NO: 1781630 - RNA, 15 nt, Human
aauccuaaaagaagc

SEQ ID NO: 1781631 - RNA, 20 nt, Human
aauccgaaccuccucuguga

SEQ ID NO: 1781632 - RNA, 13 nt, Human
aauauuguccauu

SEQ ID NO: 1781633 - RNA, 23 nt, Human
aauauugugaagaaaaauaaagu

SEQ ID NO: 1781634 - RNA, 18 nt, Human
aauauugaauuuuuccua

SEQ ID NO: 1781635 - RNA, 13 nt, Human
aauauugaauuuu

SEQ ID NO: 1781636 - RNA, 16 nt, Human
aauauuugaaucuugu

SEQ ID NO: 1781637 - RNA, 15 nt, Human
aauauucccuagaaa

SEQ ID NO: 1781638 - RNA, 17 nt, Human
aauauucccuagaaacu

SEQ ID NO: 1781639 - RNA, 20 nt, Human
aauauucagacaaaauggau

SEQ ID NO: 1781640 - RNA, 21 nt, Human
aauauucagacaaaauggaua

SEQ ID NO: 1781641 - RNA, 23 nt, Human
aauauucagacaaaauggauaca

SEQ ID NO: 1781642 - RNA, 17 nt, Human
uaagcaaaggggacagc

SEQ ID NO: 1781643 - RNA, 19 nt, Human
uaagcaaaggggacagcug

SEQ ID NO: 1781644 - RNA, 22 nt, Human
uaagcaaaggggacagcugugu

SEQ ID NO: 1781645 - RNA, 17 nt, Human
uaagcagaccacugaua

SEQ ID NO: 1781646 - RNA, 20 nt, Human
uaagcagaccacugauaaaa

SEQ ID NO: 1781647 - RNA, 17 nt, Human
uaagauuccaaaaagca

SEQ ID NO: 1781648 - RNA, 20 nt, Human
aauauuugaaucuugucuca

SEQ ID NO: 1781649 - RNA, 13 nt, Human
aauaguuggcuag

SEQ ID NO: 1781650 - RNA, 21 nt, Human
uaacauaugcaguguucuaca

SEQ ID NO: 1781651 - RNA, 23 nt, Human
uaacaucuugaauacucugcccu

SEQ ID NO: 1781652 - RNA, 19 nt, Human
uaagacagucccaucaaaa

SEQ ID NO: 1781653 - RNA, 13 nt, Human
uaagaauaauuua

SEQ ID NO: 1781654 - RNA, 15 nt, Human
uaagaauaauuuaua

SEQ ID NO: 1781655 - RNA, 11 nt, Human
uaacuguuuca

SEQ ID NO: 1781656 - RNA, 17 nt, Human
uaacuguuucaaagcca

SEQ ID NO: 1781657 - RNA, 20 nt, Human
uaacgauaaaagacagugaa

SEQ ID NO: 1781658 - RNA, 15 nt, Human
accaccacacccagc

SEQ ID NO: 1781659 - RNA, 20 nt, Human
accaccacacccagcccacu

SEQ ID NO: 1781660 - RNA, 18 nt, Human
accacaugugcacaugca

SEQ ID NO: 1781661 - RNA, 17 nt, Human
accacaucuugcucugc

SEQ ID NO: 1781662 - RNA, 18 nt, Human
accacaucuugcucugcu

SEQ ID NO: 1781663 - RNA, 19 nt, Human
accacaucuugcucugcug

SEQ ID NO: 1781664 - RNA, 13 nt, Human
ucacccccuucuc

SEQ ID NO: 1781665 - RNA, 16 nt, Human
ucacccccuucuccau

SEQ ID NO: 1781666 - RNA, 22 nt, Human
ucacccccuucuccauccacau

SEQ ID NO: 1781667 - RNA, 18 nt, Human
ucacccccuucuccaucc

SEQ ID NO: 1781668 - RNA, 23 nt, Human
ucaccauuuggcaaugccaucau

SEQ ID NO: 1781669 - RNA, 17 nt, Human
ucaccauuugauuaugu

SEQ ID NO: 1781670 - RNA, 22 nt, Human
ucaccauuugauuauguagcaa

SEQ ID NO: 1781671 - RNA, 15 nt, Human
ucacccccuccuuca

SEQ ID NO: 1781672 - RNA, 21 nt, Human
ucacaacgugcauugugcuuc

SEQ ID NO: 1781673 - RNA, 20 nt, Human
ucacaacgugcauugugcuu

SEQ ID NO: 1781674 - RNA, 19 nt, Human
ucacaacgugcauugugcu

SEQ ID NO: 1781675 - RNA, 18 nt, Human
ucacaacgugcauugugc

SEQ ID NO: 1781676 - RNA, 17 nt, Human
ucacaacgugcauugug

SEQ ID NO: 1781677 - RNA, 16 nt, Human
ucacaacgugcauugu

SEQ ID NO: 1781678 - RNA, 16 nt, Human
ucaauucuugccaaau

SEQ ID NO: 1781679 - RNA, 16 nt, Human
ucaauugcaucuccca

SEQ ID NO: 1781680 - RNA, 17 nt, Human
ucaauugcaucucccag

SEQ ID NO: 1781681 - RNA, 18 nt, Human
ucaauugcaucucccaga

SEQ ID NO: 1781682 - RNA, 22 nt, Human
ucaauugcaucucccagauaau

SEQ ID NO: 1781683 - RNA, 13 nt, Human
ucaauuuaugaau

SEQ ID NO: 1781684 - RNA, 10 nt, Human
accagcugca

SEQ ID NO: 1781685 - RNA, 11 nt, Human
accagcugcaa

SEQ ID NO: 1781686 - RNA, 12 nt, Human
accagcugcaaa

SEQ ID NO: 1781687 - RNA, 13 nt, Human
accagcugcaaag

SEQ ID NO: 1781688 - RNA, 14 nt, Human
accagcugcaaagu

SEQ ID NO: 1781689 - RNA, 15 nt, Human
accagcugcaaagug

SEQ ID NO: 1781690 - RNA, 16 nt, Human
accagcugcaaagugu

SEQ ID NO: 1781691 - RNA, 17 nt, Human
accagcugcaaaguguu

SEQ ID NO: 1781692 - RNA, 18 nt, Human
accagcugcaaaguguuu

SEQ ID NO: 1781693 - RNA, 19 nt, Human
accagcugcaaaguguuuu

SEQ ID NO: 1781694 - RNA, 20 nt, Human
accagcugcaaaguguuuug

SEQ ID NO: 1781695 - RNA, 22 nt, Human
accagcugcaaaguguuuugua

SEQ ID NO: 1781696 - RNA, 17 nt, Human
accagcuuaaaggcagu

SEQ ID NO: 1781697 - RNA, 17 nt, Human
ucacgugcagcucaagg

SEQ ID NO: 1781698 - RNA, 20 nt, Human
ucacguuaccuugacacaua

SEQ ID NO: 1781699 - RNA, 17 nt, Human
ucacguuagaggaaaaa

SEQ ID NO: 1781700 - RNA, 18 nt, Human
ucacguuagaggaaaaau

SEQ ID NO: 1781701 - RNA, 13 nt, Human
ucacuacaacuga

SEQ ID NO: 1781702 - RNA, 23 nt, Human
ucacguuuuguuuugugccaacc

SEQ ID NO: 1781703 - RNA, 14 nt, Human
ucaccugugcuucg

SEQ ID NO: 1781704 - RNA, 12 nt, Human
accagucccugu

SEQ ID NO: 1781705 - RNA, 13 nt, Human
accagucccuguc

SEQ ID NO: 1781706 - RNA, 13 nt, Human
accagugaauuuu

SEQ ID NO: 1781707 - RNA, 16 nt, Human
accaguauuuuugcug

SEQ ID NO: 1781708 - RNA, 18 nt, Human
accaguauuuuugcugcu

SEQ ID NO: 1781709 - RNA, 21 nt, Human
accaguauuuuugcugcuucu

SEQ ID NO: 1781710 - RNA, 23 nt, Human
accaguauuuuugcugcuucuga

SEQ ID NO: 1781711 - RNA, 17 nt, Human
ucacuauguugcccagg

SEQ ID NO: 1781712 - RNA, 14 nt, Human
ucacugcagccuca

SEQ ID NO: 1781713 - RNA, 15 nt, Human
ucacugcagccucaa

SEQ ID NO: 1781714 - RNA, 16 nt, Human
ucacugugagcuccca

SEQ ID NO: 1781715 - RNA, 23 nt, Human
ucacuguugcccaggcuggcgug

SEQ ID NO: 1781716 - RNA, 14 nt, Human
accaaaagacacug

SEQ ID NO: 1781717 - RNA, 12 nt, Human
ucaauauugaau

SEQ ID NO: 1781718 - RNA, 15 nt, Human
ucaauauugaauuuu

SEQ ID NO: 1781719 - RNA, 19 nt, Human
ucaauauugaauuuuuccu

SEQ ID NO: 1781720 - RNA, 22 nt, Human
ucaauauugaauuuuuccuaug

SEQ ID NO: 1781721 - RNA, 22 nt, Human
ucaauauaauguuuuuaauauu

SEQ ID NO: 1781722 - RNA, 22 nt, Human
ucaaguccucuuuucugagagg

SEQ ID NO: 1781723 - RNA, 16 nt, Human
ucaacuuuuuauugcc

SEQ ID NO: 1781724 - RNA, 17 nt, Human
ucaacuuuuuauugccu

SEQ ID NO: 1781725 - RNA, 18 nt, Human
ucaacuuuuuauugccuu

SEQ ID NO: 1781726 - RNA, 19 nt, Human
ucaacuuuuuauugccuuc

SEQ ID NO: 1781727 - RNA, 20 nt, Human
ucaacuuuuuauugccuucu

SEQ ID NO: 1781728 - RNA, 21 nt, Human
ucaacuuuuuauugccuucuc

SEQ ID NO: 1781729 - RNA, 22 nt, Human
ucaacuuuuuauugccuucuca

SEQ ID NO: 1781730 - RNA, 23 nt, Human
ucaacuuuuuauugccuucucac

SEQ ID NO: 1781731 - RNA, 12 nt, Human
ucaacuuugaau

SEQ ID NO: 1781732 - RNA, 14 nt, Human
ucaacuuugaauaa

SEQ ID NO: 1781733 - RNA, 15 nt, Human
ucaacuuugaauaaa

SEQ ID NO: 1781734 - RNA, 16 nt, Human
ucaacuuugaauaaag

SEQ ID NO: 1781735 - RNA, 18 nt, Human
ucaacuuugaauaaagaa

SEQ ID NO: 1781736 - RNA, 14 nt, Human
acauggguuuaguu

SEQ ID NO: 1781737 - RNA, 23 nt, Human
acaugggagccgggucugccucu

SEQ ID NO: 1781738 - RNA, 20 nt, Human
acaugggagccgggucugcc

SEQ ID NO: 1781739 - RNA, 18 nt, Human
acaugucaguaccuucaa

SEQ ID NO: 1781740 - RNA, 19 nt, Human
acaugucaguaccuucaaa

SEQ ID NO: 1781741 - RNA, 21 nt, Human
acaugucaguaccuucaaacu

SEQ ID NO: 1781742 - RNA, 17 nt, Human
acauguaggaaguagga

SEQ ID NO: 1781743 - RNA, 22 nt, Human
acauucuagaugcaagucucuu

SEQ ID NO: 1781744 - RNA, 11 nt, Human
acauuccuucu

SEQ ID NO: 1781745 - RNA, 23 nt, Human
acauuccuucucccaucucuucc

SEQ ID NO: 1781746 - RNA, 19 nt, Human
acauucucgcuucccugaa

SEQ ID NO: 1781747 - RNA, 20 nt, Human
ucaaccccaccauaugaauu

SEQ ID NO: 1781748 - RNA, 22 nt, Human
ucaaccccaccauaugaauugu

SEQ ID NO: 1781749 - RNA, 18 nt, Human
ucaaauuuauuuuuuucu

SEQ ID NO: 1781750 - RNA, 15 nt, Human
ucaacaaaaauuguc

SEQ ID NO: 1781751 - RNA, 18 nt, Human
ucaacaaaaauugucccu

SEQ ID NO: 1781752 - RNA, 13 nt, Human
acccucgccggac

SEQ ID NO: 1781753 - RNA, 18 nt, Human
acccucgccggacccucu

SEQ ID NO: 1781754 - RNA, 14 nt, Human
acccggggcccagg

SEQ ID NO: 1781755 - RNA, 15 nt, Human
acccggggcccaggg

SEQ ID NO: 1781756 - RNA, 22 nt, Human
acccggggcccagggcaagcuc

SEQ ID NO: 1781757 - RNA, 15 nt, Human
acccucuaaccucgc

SEQ ID NO: 1781758 - RNA, 22 nt, Human
acccucuaaccucgcccucucc

SEQ ID NO: 1781759 - RNA, 23 nt, Human
acccucuaaccucgcccucuccu

SEQ ID NO: 1781760 - RNA, 18 nt, Human
acccuucuggaaacugug

SEQ ID NO: 1781761 - RNA, 11 nt, Human
acccugccucc

SEQ ID NO: 1781762 - RNA, 14 nt, Human
acccugccucccuu

SEQ ID NO: 1781763 - RNA, 20 nt, Human
acccugccucccuugacuuu

SEQ ID NO: 1781764 - RNA, 14 nt, Human
ucagcuccagcuca

SEQ ID NO: 1781765 - RNA, 15 nt, Human
ucagcuccagcucac

SEQ ID NO: 1781766 - RNA, 21 nt, Human
ucagcuuguaaauagcucagg

SEQ ID NO: 1781767 - RNA, 22 nt, Human
ucagcuuguaaauagcucaggu

SEQ ID NO: 1781768 - RNA, 16 nt, Human
ucaggguuggccccug

SEQ ID NO: 1781769 - RNA, 17 nt, Human
ucaggguuggccccugc

SEQ ID NO: 1781770 - RNA, 23 nt, Human
ucagguaacaggcagauacagga

SEQ ID NO: 1781771 - RNA, 21 nt, Human
ucagguaacaggcagauacag

SEQ ID NO: 1781772 - RNA, 22 nt, Human
ucagguaacaggcagauacagg

SEQ ID NO: 1781773 - RNA, 14 nt, Human
acccggccccugcu

SEQ ID NO: 1781774 - RNA, 15 nt, Human
acccggccccugcug

SEQ ID NO: 1781775 - RNA, 16 nt, Human
acccggccccugcugg

SEQ ID NO: 1781776 - RNA, 22 nt, Human
acccggccccugcugguucagg

SEQ ID NO: 1781777 - RNA, 17 nt, Human
acccggccccugcuggu

SEQ ID NO: 1781778 - RNA, 20 nt, Human
acccggccccugcugguuca

SEQ ID NO: 1781779 - RNA, 22 nt, Human
acccgggaaccuccccagccug

SEQ ID NO: 1781780 - RNA, 23 nt, Human
acccgggaaccuccccagccugc

SEQ ID NO: 1781781 - RNA, 12 nt, Human
ucagcuccagcu

SEQ ID NO: 1781782 - RNA, 19 nt, Human
ucagcggggacagcuccuu

SEQ ID NO: 1781783 - RNA, 20 nt, Human
ucagcggggacagcuccuuc

SEQ ID NO: 1781784 - RNA, 21 nt, Human
ucagcggggacagcuccuucu

SEQ ID NO: 1781785 - RNA, 23 nt, Human
ucagcggggacagcuccuucugu

SEQ ID NO: 1781786 - RNA, 20 nt, Human
acccccucuucugagcacag

SEQ ID NO: 1781787 - RNA, 21 nt, Human
acccccucuucugagcacaga

SEQ ID NO: 1781788 - RNA, 12 nt, Human
accccuggaaga

SEQ ID NO: 1781789 - RNA, 18 nt, Human
accccuggaagagcccag

SEQ ID NO: 1781790 - RNA, 19 nt, Human
accccuggaagagcccagu

SEQ ID NO: 1781791 - RNA, 23 nt, Human
accccuggaagagcccagucugu

SEQ ID NO: 1781792 - RNA, 19 nt, Human
acccaggagccccgaggcc

SEQ ID NO: 1781793 - RNA, 23 nt, Human
acccaggagccccgaggccuucu

SEQ ID NO: 1781794 - RNA, 19 nt, Human
accccaccauaugaauugu

SEQ ID NO: 1781795 - RNA, 22 nt, Human
accccagcauucucaggcacca

SEQ ID NO: 1781796 - RNA, 23 nt, Human
accccagcauucucaggcaccag

SEQ ID NO: 1781797 - RNA, 22 nt, Human
accaguguuagggaagggccug

SEQ ID NO: 1781798 - RNA, 17 nt, Human
ucagccaauuauguuaa

SEQ ID NO: 1781799 - RNA, 15 nt, Human
ucagccaauuauguu

SEQ ID NO: 1781800 - RNA, 13 nt, Human
ucagccaauuaug

SEQ ID NO: 1781801 - RNA, 18 nt, Human
ucagccaauuauguuaaa

SEQ ID NO: 1781802 - RNA, 21 nt, Human
ucagccacuaagaaccccucu

SEQ ID NO: 1781803 - RNA, 13 nt, Human
ucauguuuuaaca

SEQ ID NO: 1781804 - RNA, 15 nt, Human
ucauccaucaucaug

SEQ ID NO: 1781805 - RNA, 16 nt, Human
ucauccaucaucaugu

SEQ ID NO: 1781806 - RNA, 17 nt, Human
ucauccaucaucaugug

SEQ ID NO: 1781807 - RNA, 11 nt, Human
ucauccaucau

SEQ ID NO: 1781808 - RNA, 12 nt, Human
ucauccaucauc

SEQ ID NO: 1781809 - RNA, 14 nt, Human
ucauccaucaucau

SEQ ID NO: 1781810 - RNA, 13 nt, Human
accuccagccuga

SEQ ID NO: 1781811 - RNA, 14 nt, Human
ucaugaaauaugca

SEQ ID NO: 1781812 - RNA, 15 nt, Human
ucaugaaauaugcau

SEQ ID NO: 1781813 - RNA, 16 nt, Human
accucccacacuccca

SEQ ID NO: 1781814 - RNA, 16 nt, Human
accuccacauccucca

SEQ ID NO: 1781815 - RNA, 14 nt, Human
accuccacauccuc

SEQ ID NO: 1781816 - RNA, 11 nt, Human
accuccucugu

SEQ ID NO: 1781817 - RNA, 12 nt, Human
accuccucugug

SEQ ID NO: 1781818 - RNA, 13 nt, Human
accuccucuguga

SEQ ID NO: 1781819 - RNA, 14 nt, Human
accuccucugugaa

SEQ ID NO: 1781820 - RNA, 18 nt, Human
accuccucugugaagcau

SEQ ID NO: 1781821 - RNA, 13 nt, Human
accuccugagaaa

SEQ ID NO: 1781822 - RNA, 13 nt, Human
accuaccucccac

SEQ ID NO: 1781823 - RNA, 12 nt, Human
ucagugccacua

SEQ ID NO: 1781824 - RNA, 12 nt, Human
ucaguggcagcu

SEQ ID NO: 1781825 - RNA, 13 nt, Human
ucaguggcagcug

SEQ ID NO: 1781826 - RNA, 11 nt, Human
ucaguggcagc

SEQ ID NO: 1781827 - RNA, 15 nt, Human
ucaguuuuugugaaa

SEQ ID NO: 1781828 - RNA, 14 nt, Human
ucaguggggcaguc

SEQ ID NO: 1781829 - RNA, 17 nt, Human
ucaguuuuugugaaaag

SEQ ID NO: 1781830 - RNA, 14 nt, Human
ucauaaccuagccu

SEQ ID NO: 1781831 - RNA, 21 nt, Human
ucauaacggaucagaaauaca

SEQ ID NO: 1781832 - RNA, 19 nt, Human
ucauaacggaucagaaaua

SEQ ID NO: 1781833 - RNA, 18 nt, Human
ucauaacggaucagaaau

SEQ ID NO: 1781834 - RNA, 16 nt, Human
ucauaacggaucagaa

SEQ ID NO: 1781835 - RNA, 14 nt, Human
ucauaacggaucag

SEQ ID NO: 1781836 - RNA, 15 nt, Human
ucauaguaugguggc

SEQ ID NO: 1781837 - RNA, 23 nt, Human
ucauaacggaucagaaauacaga

SEQ ID NO: 1781838 - RNA, 22 nt, Human
ucauaacggaucagaaauacag

SEQ ID NO: 1781839 - RNA, 18 nt, Human
ucauaguaugguggcugg

SEQ ID NO: 1781840 - RNA, 19 nt, Human
ucauaguaugguggcuggg

SEQ ID NO: 1781841 - RNA, 21 nt, Human
ucauaguaugguggcuggguu

SEQ ID NO: 1781842 - RNA, 16 nt, Human
ucauaugaaaggugcc

SEQ ID NO: 1781843 - RNA, 20 nt, Human
ucauaugaaaggugccaugg

SEQ ID NO: 1781844 - RNA, 21 nt, Human
ucauaugaaaggugccaugga

SEQ ID NO: 1781845 - RNA, 19 nt, Human
uccagacauucucgcuucc

SEQ ID NO: 1781846 - RNA, 18 nt, Human
accuuuuuuuuuuuucca

SEQ ID NO: 1781847 - RNA, 19 nt, Human
accuuuuuuuuuuuuccaa

SEQ ID NO: 1781848 - RNA, 10 nt, Human
uccaggcucc

SEQ ID NO: 1781849 - RNA, 16 nt, Human
uccaggagcuucuugu

SEQ ID NO: 1781850 - RNA, 23 nt, Human
uccaggagcuucuuguuuccuug

SEQ ID NO: 1781851 - RNA, 12 nt, Human
uccaggcuccuu

SEQ ID NO: 1781852 - RNA, 22 nt, Human
uccaggcuccuuuagcgcccag

SEQ ID NO: 1781853 - RNA, 16 nt, Human
accuuuguuuuuuguu

SEQ ID NO: 1781854 - RNA, 20 nt, Human
accuugaacuggguacuugu

SEQ ID NO: 1781855 - RNA, 14 nt, Human
ucauguuuuaacaa

SEQ ID NO: 1781856 - RNA, 15 nt, Human
ucauguuuuaacaaa

SEQ ID NO: 1781857 - RNA, 21 nt, Human
uccacugugccaugugccagg

SEQ ID NO: 1781858 - RNA, 20 nt, Human
acgcgugcacacaccagagc

SEQ ID NO: 1781859 - RNA, 18 nt, Human
acgccugggggugccagg

SEQ ID NO: 1781860 - RNA, 22 nt, Human
acgccugcaaacgcugccugcc

SEQ ID NO: 1781861 - RNA, 23 nt, Human
acgccugcaaacgcugccugccc

SEQ ID NO: 1781862 - RNA, 19 nt, Human
acgaauuucugugcccucc

SEQ ID NO: 1781863 - RNA, 21 nt, Human
acgaauuucugugcccuccug

SEQ ID NO: 1781864 - RNA, 18 nt, Human
acgccucuucugucccug

SEQ ID NO: 1781865 - RNA, 23 nt, Human
acgccucuucugucccuguuaga

SEQ ID NO: 1781866 - RNA, 22 nt, Human
acgaauuucugugcccuccuga

SEQ ID NO: 1781867 - RNA, 13 nt, Human
acgccugaggaac

SEQ ID NO: 1781868 - RNA, 21 nt, Human
acgccugaggaacccuuacag

SEQ ID NO: 1781869 - RNA, 14 nt, Human
acgccugcaaacgc

SEQ ID NO: 1781870 - RNA, 17 nt, Human
acgccugcaaacgcugc

SEQ ID NO: 1781871 - RNA, 18 nt, Human
acgccugcaaacgcugcc

SEQ ID NO: 1781872 - RNA, 19 nt, Human
acgccugcaaacgcugccu

SEQ ID NO: 1781873 - RNA, 20 nt, Human
acgccugcaaacgcugccug

SEQ ID NO: 1781874 - RNA, 21 nt, Human
acgccugcaaacgcugccugc

SEQ ID NO: 1781875 - RNA, 23 nt, Human
acggagucccaccuuggcugcag

SEQ ID NO: 1781876 - RNA, 16 nt, Human
acggaucagaaauaca

SEQ ID NO: 1781877 - RNA, 17 nt, Human
acggaucagaaauacag

SEQ ID NO: 1781878 - RNA, 17 nt, Human
acgcuggagugcaguga

SEQ ID NO: 1781879 - RNA, 18 nt, Human
acgcuggagugcagugag

SEQ ID NO: 1781880 - RNA, 20 nt, Human
acgcuggaccuugaacuggg

SEQ ID NO: 1781881 - RNA, 23 nt, Human
acgcuggaccuugaacuggguac

SEQ ID NO: 1781882 - RNA, 15 nt, Human
acgcuggagugcagu

SEQ ID NO: 1781883 - RNA, 16 nt, Human
acgcuggagugcagug

SEQ ID NO: 1781884 - RNA, 13 nt, Human
acgcuggaccuug

SEQ ID NO: 1781885 - RNA, 13 nt, Human
acgcuccuuugug

SEQ ID NO: 1781886 - RNA, 21 nt, Human
acgcuccuuuguguguguguc

SEQ ID NO: 1781887 - RNA, 22 nt, Human
acgcuccuuuguguguguguca

SEQ ID NO: 1781888 - RNA, 18 nt, Human
uccagugccaacaauccu

SEQ ID NO: 1781889 - RNA, 19 nt, Human
uccagugccaacaauccua

SEQ ID NO: 1781890 - RNA, 22 nt, Human
acggcuccacuaggacuucaaa

SEQ ID NO: 1781891 - RNA, 13 nt, Human
acggccaggccag

SEQ ID NO: 1781892 - RNA, 16 nt, Human
acggcucacugcagcc

SEQ ID NO: 1781893 - RNA, 17 nt, Human
acggcucacugcagccu

SEQ ID NO: 1781894 - RNA, 18 nt, Human
acggcucacugcagccuc

SEQ ID NO: 1781895 - RNA, 12 nt, Human
acggccaggcca

SEQ ID NO: 1781896 - RNA, 22 nt, Human
acuagacugguggcaggggcuu

SEQ ID NO: 1781897 - RNA, 21 nt, Human
acuacugccuuuagaaaauau

SEQ ID NO: 1781898 - RNA, 22 nt, Human
acuacugccuuuagaaaauaua

SEQ ID NO: 1781899 - RNA, 15 nt, Human
ucccagccucagcgc

SEQ ID NO: 1781900 - RNA, 20 nt, Human
acuauagccuaggugacaga

SEQ ID NO: 1781901 - RNA, 22 nt, Human
acuauagccuaggugacagagu

SEQ ID NO: 1781902 - RNA, 15 nt, Human
acuauagguccagaa

SEQ ID NO: 1781903 - RNA, 15 nt, Human
acuauauuuugucau

SEQ ID NO: 1781904 - RNA, 16 nt, Human
acuauauuuugucaua

SEQ ID NO: 1781905 - RNA, 16 nt, Human
acuaugccugugucuu

SEQ ID NO: 1781906 - RNA, 17 nt, Human
acuauguugcccaggca

SEQ ID NO: 1781907 - RNA, 15 nt, Human
acuauguugcccagg

SEQ ID NO: 1781908 - RNA, 16 nt, Human
acuauguugcccaggc

SEQ ID NO: 1781909 - RNA, 14 nt, Human
acuauguugcccag

SEQ ID NO: 1781910 - RNA, 15 nt, Human
acuaugcuuuccuuc

SEQ ID NO: 1781911 - RNA, 18 nt, Human
acuaugccugugucuucu

SEQ ID NO: 1781912 - RNA, 19 nt, Human
acuaugccugugucuucuc

SEQ ID NO: 1781913 - RNA, 16 nt, Human
acucaaugcacugaca

SEQ ID NO: 1781914 - RNA, 16 nt, Human
acguguuugugcugug

SEQ ID NO: 1781915 - RNA, 17 nt, Human
acguuaccuugacacau

SEQ ID NO: 1781916 - RNA, 22 nt, Human
acguuagucgugagcucuugug

SEQ ID NO: 1781917 - RNA, 21 nt, Human
acguuagucgugagcucuugu

SEQ ID NO: 1781918 - RNA, 16 nt, Human
acguuagucgugagcu

SEQ ID NO: 1781919 - RNA, 19 nt, Human
uccaguuaaaaaaaauuuu

SEQ ID NO: 1781920 - RNA, 21 nt, Human
uccaguuaaaaaaaauuuuaa

SEQ ID NO: 1781921 - RNA, 16 nt, Human
ucccagaggcugcccc

SEQ ID NO: 1781922 - RNA, 17 nt, Human
ucccagaggcugcccca

SEQ ID NO: 1781923 - RNA, 19 nt, Human
ucccagagcugguggaccc

SEQ ID NO: 1781924 - RNA, 21 nt, Human
ucccagagcugguggacccag

SEQ ID NO: 1781925 - RNA, 22 nt, Human
ucccagagcugguggacccagg

SEQ ID NO: 1781926 - RNA, 16 nt, Human
ucccagauaaugugaa

SEQ ID NO: 1781927 - RNA, 20 nt, Human
acguuagaggaaaaauauuu

SEQ ID NO: 1781928 - RNA, 17 nt, Human
acuaaagcaguagaaau

SEQ ID NO: 1781929 - RNA, 15 nt, Human
acuaauuuuaaaaug

SEQ ID NO: 1781930 - RNA, 14 nt, Human
uccugccugucugc

SEQ ID NO: 1781931 - RNA, 16 nt, Human
uccugccugucugccc

SEQ ID NO: 1781932 - RNA, 17 nt, Human
uccugccugucugcccc

SEQ ID NO: 1781933 - RNA, 19 nt, Human
uccugccugucugccccag

SEQ ID NO: 1781934 - RNA, 20 nt, Human
uccugccugucugccccagc

SEQ ID NO: 1781935 - RNA, 14 nt, Human
uccugccuuccucc

SEQ ID NO: 1781936 - RNA, 16 nt, Human
uccugccuuccuccug

SEQ ID NO: 1781937 - RNA, 19 nt, Human
uccugccuuccuccugggc

SEQ ID NO: 1781938 - RNA, 22 nt, Human
uccugccuuccuccugggcccu

SEQ ID NO: 1781939 - RNA, 23 nt, Human
uccugccuuccuccugggcccuc

SEQ ID NO: 1781940 - RNA, 12 nt, Human
uccugggaguga

SEQ ID NO: 1781941 - RNA, 14 nt, Human
uccugggagugagc

SEQ ID NO: 1781942 - RNA, 17 nt, Human
uccugggagugagcugg

SEQ ID NO: 1781943 - RNA, 14 nt, Human
uccugggaaauauu

SEQ ID NO: 1781944 - RNA, 16 nt, Human
uccugggaaauauucc

SEQ ID NO: 1781945 - RNA, 20 nt, Human
uccugggaaauauucccuag

SEQ ID NO: 1781946 - RNA, 21 nt, Human
uccugggaaauauucccuaga

SEQ ID NO: 1781947 - RNA, 15 nt, Human
uccugcuuuggcagu

SEQ ID NO: 1781948 - RNA, 21 nt, Human
acugcacuauagccuagguga

SEQ ID NO: 1781949 - RNA, 15 nt, Human
uccugaucagagccg

SEQ ID NO: 1781950 - RNA, 14 nt, Human
uccugaucagagcc

SEQ ID NO: 1781951 - RNA, 16 nt, Human
acugcaccgggccaca

SEQ ID NO: 1781952 - RNA, 20 nt, Human
acugcacuauagccuaggug

SEQ ID NO: 1781953 - RNA, 14 nt, Human
acugcaccgggcca

SEQ ID NO: 1781954 - RNA, 11 nt, Human
acucuuucaaa

SEQ ID NO: 1781955 - RNA, 13 nt, Human
acucuuucaaaac

SEQ ID NO: 1781956 - RNA, 16 nt, Human
uccugaaacuauauuu

SEQ ID NO: 1781957 - RNA, 21 nt, Human
uccugaaacuauauuuuguca

SEQ ID NO: 1781958 - RNA, 23 nt, Human
uccugaaacuauauuuugucaua

SEQ ID NO: 1781959 - RNA, 16 nt, Human
uccugaaacgcuccuu

SEQ ID NO: 1781960 - RNA, 17 nt, Human
uccugaaacgcuccuuu

SEQ ID NO: 1781961 - RNA, 21 nt, Human
uccugaaacgcuccuuugugu

SEQ ID NO: 1781962 - RNA, 22 nt, Human
uccugaaacgcuccuuugugug

SEQ ID NO: 1781963 - RNA, 14 nt, Human
uccugaaacuauau

SEQ ID NO: 1781964 - RNA, 14 nt, Human
acugagcacccucu

SEQ ID NO: 1781965 - RNA, 21 nt, Human
acugagcacccucuggauucu

SEQ ID NO: 1781966 - RNA, 19 nt, Human
acugagauaccagcgagga

SEQ ID NO: 1781967 - RNA, 18 nt, Human
acugagauaccagcgagg

SEQ ID NO: 1781968 - RNA, 17 nt, Human
acugaccugguccacag

SEQ ID NO: 1781969 - RNA, 21 nt, Human
acugaccugguccacagggca

SEQ ID NO: 1781970 - RNA, 22 nt, Human
acugaccugguccacagggcac

SEQ ID NO: 1781971 - RNA, 14 nt, Human
acucucuaccagau

SEQ ID NO: 1781972 - RNA, 13 nt, Human
acucugcccucua

SEQ ID NO: 1781973 - RNA, 17 nt, Human
acucugcccucuagagc

SEQ ID NO: 1781974 - RNA, 13 nt, Human
acucugccccccc

SEQ ID NO: 1781975 - RNA, 20 nt, Human
acucugccccccccccccau

SEQ ID NO: 1781976 - RNA, 13 nt, Human
acuccuuccuggc

SEQ ID NO: 1781977 - RNA, 14 nt, Human
acuccuuccuggcc

SEQ ID NO: 1781978 - RNA, 15 nt, Human
acuccuuccuggccu

SEQ ID NO: 1781979 - RNA, 16 nt, Human
acuccuuccuggccug

SEQ ID NO: 1781980 - RNA, 17 nt, Human
acuccuuccuggccuga

SEQ ID NO: 1781981 - RNA, 19 nt, Human
acuccuuccuggccugaga

SEQ ID NO: 1781982 - RNA, 20 nt, Human
acuccuuccuggccugagag

SEQ ID NO: 1781983 - RNA, 23 nt, Human
acuccuuccuggccugagaguca

SEQ ID NO: 1781984 - RNA, 20 nt, Human
uccucccauagauacucucu

SEQ ID NO: 1781985 - RNA, 21 nt, Human
uccucccauagauacucucuu

SEQ ID NO: 1781986 - RNA, 22 nt, Human
uccucauaguaugguggcuggg

SEQ ID NO: 1781987 - RNA, 15 nt, Human
acucuugaccucagg

SEQ ID NO: 1781988 - RNA, 16 nt, Human
acucuugaccucaggu

SEQ ID NO: 1781989 - RNA, 14 nt, Human
acucuugaccucag

SEQ ID NO: 1781990 - RNA, 12 nt, Human
ucccuugggcuc

SEQ ID NO: 1781991 - RNA, 14 nt, Human
ucccuugggcuccc

SEQ ID NO: 1781992 - RNA, 13 nt, Human
uccuacucugugu

SEQ ID NO: 1781993 - RNA, 14 nt, Human
uccuacucuguguc

SEQ ID NO: 1781994 - RNA, 21 nt, Human
uccguagccagcugcucccca

SEQ ID NO: 1781995 - RNA, 15 nt, Human
uccuacucuguguca

SEQ ID NO: 1781996 - RNA, 20 nt, Human
uccguagccagcugcucccc

SEQ ID NO: 1781997 - RNA, 12 nt, Human
acuccuggccuc

SEQ ID NO: 1781998 - RNA, 13 nt, Human
acuccuggccuca

SEQ ID NO: 1781999 - RNA, 14 nt, Human
acuccuggccucaa

SEQ ID NO: 1782000 - RNA, 11 nt, Human
acuccucccau

SEQ ID NO: 1782001 - RNA, 17 nt, Human
acuccugccaaggagga

SEQ ID NO: 1782002 - RNA, 11 nt, Human
acuccuggccu

SEQ ID NO: 1782003 - RNA, 18 nt, Human
acuccaguuaaaaaaaau

SEQ ID NO: 1782004 - RNA, 20 nt, Human
acuccaguuaaaaaaaauuu

SEQ ID NO: 1782005 - RNA, 21 nt, Human
acuccagugccaacaauccua

SEQ ID NO: 1782006 - RNA, 19 nt, Human
ucugcccucuagagccuuc

SEQ ID NO: 1782007 - RNA, 21 nt, Human
ucugccugcccaggccccugc

SEQ ID NO: 1782008 - RNA, 22 nt, Human
ucugccugcccaggccccugcc

SEQ ID NO: 1782009 - RNA, 21 nt, Human
ucugccuggguuuuguucccu

SEQ ID NO: 1782010 - RNA, 19 nt, Human
ucugcucacauaucuguca

SEQ ID NO: 1782011 - RNA, 20 nt, Human
ucugcucacauaucugucau

SEQ ID NO: 1782012 - RNA, 15 nt, Human
ucugcgugucaccug

SEQ ID NO: 1782013 - RNA, 19 nt, Human
ucugcgugucaccugugcu

SEQ ID NO: 1782014 - RNA, 20 nt, Human
ucugcgugucaccugugcuu

SEQ ID NO: 1782015 - RNA, 23 nt, Human
ucugcucaucauucucugucuca

SEQ ID NO: 1782016 - RNA, 14 nt, Human
ucugcuucagccuc

SEQ ID NO: 1782017 - RNA, 15 nt, Human
ucugcuucagccucc

SEQ ID NO: 1782018 - RNA, 13 nt, Human
ucugcuucagccu

SEQ ID NO: 1782019 - RNA, 14 nt, Human
agaacuucauggau

SEQ ID NO: 1782020 - RNA, 13 nt, Human
agaacugugccac

SEQ ID NO: 1782021 - RNA, 16 nt, Human
agaacugugccacaau

SEQ ID NO: 1782022 - RNA, 23 nt, Human
ucuccuuucaccccagggccuga

SEQ ID NO: 1782023 - RNA, 22 nt, Human
agaaagcauuugaaugcauuuu

SEQ ID NO: 1782024 - RNA, 21 nt, Human
agaaagcauuugaaugcauuu

SEQ ID NO: 1782025 - RNA, 20 nt, Human
agaaagcauuugaaugcauu

SEQ ID NO: 1782026 - RNA, 18 nt, Human
agaaagcauuugaaugca

SEQ ID NO: 1782027 - RNA, 17 nt, Human
agaaagcauuugaaugc

SEQ ID NO: 1782028 - RNA, 16 nt, Human
agaaagcauuugaaug

SEQ ID NO: 1782029 - RNA, 15 nt, Human
agaaagcauuugaau

SEQ ID NO: 1782030 - RNA, 13 nt, Human
ucugacacacagc

SEQ ID NO: 1782031 - RNA, 14 nt, Human
ucugacacacagcu

SEQ ID NO: 1782032 - RNA, 15 nt, Human
ucugacacacagcuc

SEQ ID NO: 1782033 - RNA, 13 nt, Human
ucugacucagggc

SEQ ID NO: 1782034 - RNA, 14 nt, Human
ucugacucagggcu

SEQ ID NO: 1782035 - RNA, 15 nt, Human
ucugacucagggcuc

SEQ ID NO: 1782036 - RNA, 20 nt, Human
ucugacucagggcuccuggg

SEQ ID NO: 1782037 - RNA, 22 nt, Human
ucugaaggacauugcggacagc

SEQ ID NO: 1782038 - RNA, 21 nt, Human
ucugaaggacauugcggacag

SEQ ID NO: 1782039 - RNA, 20 nt, Human
ucugaagcugacgaacuucc

SEQ ID NO: 1782040 - RNA, 21 nt, Human
ucugaagcugacgaacuucca

SEQ ID NO: 1782041 - RNA, 20 nt, Human
ucugcagggccgccagggag

SEQ ID NO: 1782042 - RNA, 23 nt, Human
agaaaugguuguauuagauguuc

SEQ ID NO: 1782043 - RNA, 22 nt, Human
agaaaugguuguauuagauguu

SEQ ID NO: 1782044 - RNA, 21 nt, Human
agaaaugguuguauuagaugu

SEQ ID NO: 1782045 - RNA, 20 nt, Human
agaaaugguuguauuagaug

SEQ ID NO: 1782046 - RNA, 19 nt, Human
agaaaugguuguauuagau

SEQ ID NO: 1782047 - RNA, 18 nt, Human
agaaaugguuguauuaga

SEQ ID NO: 1782048 - RNA, 17 nt, Human
agaaaugguuguauuag

SEQ ID NO: 1782049 - RNA, 21 nt, Human
ucugaucccucuacagagcuu

SEQ ID NO: 1782050 - RNA, 17 nt, Human
ucugaucauccacugug

SEQ ID NO: 1782051 - RNA, 16 nt, Human
ucugagugccuucugu

SEQ ID NO: 1782052 - RNA, 19 nt, Human
ucugagugccuucuguggg

SEQ ID NO: 1782053 - RNA, 22 nt, Human
ucugagugccuucuguggggac

SEQ ID NO: 1782054 - RNA, 21 nt, Human
ucugaucauccacugugccau

SEQ ID NO: 1782055 - RNA, 19 nt, Human
agacaccuugacagggcac

SEQ ID NO: 1782056 - RNA, 18 nt, Human
agacaccuugacagggca

SEQ ID NO: 1782057 - RNA, 17 nt, Human
agacaccuugacagggc

SEQ ID NO: 1782058 - RNA, 12 nt, Human
agacacaggccc

SEQ ID NO: 1782059 - RNA, 13 nt, Human
agacacaggcccg

SEQ ID NO: 1782060 - RNA, 16 nt, Human
agacacaggcccggcu

SEQ ID NO: 1782061 - RNA, 13 nt, Human
agacacacacaca

SEQ ID NO: 1782062 - RNA, 15 nt, Human
agaauuuguguugaa

SEQ ID NO: 1782063 - RNA, 19 nt, Human
agaauuuguguugaaggaa

SEQ ID NO: 1782064 - RNA, 21 nt, Human
agaauuuguguugaaggaacu

SEQ ID NO: 1782065 - RNA, 23 nt, Human
agaauuuguguugaaggaacuug

SEQ ID NO: 1782066 - RNA, 18 nt, Human
ucuguugcaagccccucu

SEQ ID NO: 1782067 - RNA, 12 nt, Human
ucuguuggccag

SEQ ID NO: 1782068 - RNA, 17 nt, Human
ucuguuggccaguguga

SEQ ID NO: 1782069 - RNA, 12 nt, Human
agaauacuugaa

SEQ ID NO: 1782070 - RNA, 14 nt, Human
agaauacuugaacu

SEQ ID NO: 1782071 - RNA, 15 nt, Human
agaauacuugaacuu

SEQ ID NO: 1782072 - RNA, 16 nt, Human
agaauacuugaacuug

SEQ ID NO: 1782073 - RNA, 19 nt, Human
ucugcuuguuauuagagau

SEQ ID NO: 1782074 - RNA, 15 nt, Human
agaauuccaaagcaa

SEQ ID NO: 1782075 - RNA, 16 nt, Human
agaauuccaaagcaaa

SEQ ID NO: 1782076 - RNA, 19 nt, Human
ucugggaggaauggacaga

SEQ ID NO: 1782077 - RNA, 23 nt, Human
ucugggaggaauggacagacaga

SEQ ID NO: 1782078 - RNA, 13 nt, Human
ucugggagggcag

SEQ ID NO: 1782079 - RNA, 19 nt, Human
ucugggagggcagcagggc

SEQ ID NO: 1782080 - RNA, 21 nt, Human
ucugggagggcagcagggcua

SEQ ID NO: 1782081 - RNA, 20 nt, Human
agaauccagcaccggcccca

SEQ ID NO: 1782082 - RNA, 14 nt, Human
agaauauucagaca

SEQ ID NO: 1782083 - RNA, 23 nt, Human
agaauauucagacaaaauggaua

SEQ ID NO: 1782084 - RNA, 13 nt, Human
agaauauuucuau

SEQ ID NO: 1782085 - RNA, 16 nt, Human
agaauauuucuauuga

SEQ ID NO: 1782086 - RNA, 17 nt, Human
agaauauuucuauugaa

SEQ ID NO: 1782087 - RNA, 19 nt, Human
agaauauuucuauugaauu

SEQ ID NO: 1782088 - RNA, 17 nt, Human
ucucacuauguugccca

SEQ ID NO: 1782089 - RNA, 19 nt, Human
ucucacuauguugcccagg

SEQ ID NO: 1782090 - RNA, 15 nt, Human
ucuauggguuuaguu

SEQ ID NO: 1782091 - RNA, 21 nt, Human
ucuauggguuuaguuacuuua

SEQ ID NO: 1782092 - RNA, 23 nt, Human
ucuaugggacucaaugcacugac

SEQ ID NO: 1782093 - RNA, 15 nt, Human
acuucccgggccagg

SEQ ID NO: 1782094 - RNA, 18 nt, Human
acuucccgggccagggcu

SEQ ID NO: 1782095 - RNA, 19 nt, Human
acuucccgggccagggcug

SEQ ID NO: 1782096 - RNA, 20 nt, Human
acuucccgggccagggcugc

SEQ ID NO: 1782097 - RNA, 15 nt, Human
acuucaucaaacaug

SEQ ID NO: 1782098 - RNA, 20 nt, Human
acuucaucaaacauggguuu

SEQ ID NO: 1782099 - RNA, 15 nt, Human
ucuagauacaauaaa

SEQ ID NO: 1782100 - RNA, 16 nt, Human
ucuagauacaauaaau

SEQ ID NO: 1782101 - RNA, 20 nt, Human
ucuagauacaauaaauugcu

SEQ ID NO: 1782102 - RNA, 17 nt, Human
ucuagagcuuagcauau

SEQ ID NO: 1782103 - RNA, 12 nt, Human
ucuagagccuuc

SEQ ID NO: 1782104 - RNA, 13 nt, Human
ucuagagccuuca

SEQ ID NO: 1782105 - RNA, 18 nt, Human
ucuagagccuucagccuu

SEQ ID NO: 1782106 - RNA, 19 nt, Human
ucuacccagcgagcccugg

SEQ ID NO: 1782107 - RNA, 21 nt, Human
ucuacagaggccaugggccuc

SEQ ID NO: 1782108 - RNA, 11 nt, Human
ucuaauaaacu

SEQ ID NO: 1782109 - RNA, 16 nt, Human
ucuaauaaacuuggau

SEQ ID NO: 1782110 - RNA, 22 nt, Human
ucuaauaaacuuggauucucua

SEQ ID NO: 1782111 - RNA, 18 nt, Human
uccugggagugagcuggu

SEQ ID NO: 1782112 - RNA, 20 nt, Human
ucuacccagcgagcccuggu

SEQ ID NO: 1782113 - RNA, 16 nt, Human
ucuacccagggccugc

SEQ ID NO: 1782114 - RNA, 13 nt, Human
ucuacccagggcc

SEQ ID NO: 1782115 - RNA, 18 nt, Human
acuguucccccugugcag

SEQ ID NO: 1782116 - RNA, 13 nt, Human
acuguucuugaau

SEQ ID NO: 1782117 - RNA, 19 nt, Human
ucuacagccuugucccccu

SEQ ID NO: 1782118 - RNA, 15 nt, Human
acuguucccccugug

SEQ ID NO: 1782119 - RNA, 16 nt, Human
acuguucccccugugc

SEQ ID NO: 1782120 - RNA, 12 nt, Human
acuuaacuguuu

SEQ ID NO: 1782121 - RNA, 14 nt, Human
acuuaacuguuuca

SEQ ID NO: 1782122 - RNA, 16 nt, Human
acuuaacuguuucaaa

SEQ ID NO: 1782123 - RNA, 15 nt, Human
acuuaguagauuaaa

SEQ ID NO: 1782124 - RNA, 17 nt, Human
acuuaguagauuaaaaa

SEQ ID NO: 1782125 - RNA, 20 nt, Human
acuuaguagauuaaaaauua

SEQ ID NO: 1782126 - RNA, 17 nt, Human
acuuaggguuuggagcu

SEQ ID NO: 1782127 - RNA, 17 nt, Human
acuuaugaaugauuugc

SEQ ID NO: 1782128 - RNA, 20 nt, Human
acuuaugaaugauuugcaua

SEQ ID NO: 1782129 - RNA, 12 nt, Human
acuuugaauaaa

SEQ ID NO: 1782130 - RNA, 14 nt, Human
acuuugaauaaaga

SEQ ID NO: 1782131 - RNA, 15 nt, Human
acuuugaauaaagaa

SEQ ID NO: 1782132 - RNA, 18 nt, Human
acuuugaauaaagaauac

SEQ ID NO: 1782133 - RNA, 19 nt, Human
acuuugaauaaagaauacu

SEQ ID NO: 1782134 - RNA, 20 nt, Human
acuuugaauaaagaauacuu

SEQ ID NO: 1782135 - RNA, 21 nt, Human
acuuugaauaaagaauacuug

SEQ ID NO: 1782136 - RNA, 22 nt, Human
acuuugaauaaagaauacuuga

SEQ ID NO: 1782137 - RNA, 23 nt, Human
acuuugaauaaagaauacuugaa

SEQ ID NO: 1782138 - RNA, 16 nt, Human
ucuccuccaugggaga

SEQ ID NO: 1782139 - RNA, 23 nt, Human
ucuccccagcaagugagagcugg

SEQ ID NO: 1782140 - RNA, 12 nt, Human
ucuccacccugc

SEQ ID NO: 1782141 - RNA, 17 nt, Human
ucuccgaccagacaccu

SEQ ID NO: 1782142 - RNA, 23 nt, Human
ucuccgaccagacaccuugacag

SEQ ID NO: 1782143 - RNA, 18 nt, Human
agaaaaaauaacacacau

SEQ ID NO: 1782144 - RNA, 23 nt, Human
ucucaggccggcagccccagccu

SEQ ID NO: 1782145 - RNA, 20 nt, Human
ucucauuggacccuuccaug

SEQ ID NO: 1782146 - RNA, 20 nt, Human
ucucaggccggcagccccag

SEQ ID NO: 1782147 - RNA, 16 nt, Human
ucucauuugucacaca

SEQ ID NO: 1782148 - RNA, 19 nt, Human
ucuccaaaaaucugccugg

SEQ ID NO: 1782149 - RNA, 20 nt, Human
ucuccaaaaaucugccuggg

SEQ ID NO: 1782150 - RNA, 21 nt, Human
ucuccaaaaaucugccugggu

SEQ ID NO: 1782151 - RNA, 22 nt, Human
ucuccaaaaaucugccuggguu

SEQ ID NO: 1782152 - RNA, 14 nt, Human
ucucauuugucaca

SEQ ID NO: 1782153 - RNA, 16 nt, Human
ucucaggagucucugg

SEQ ID NO: 1782154 - RNA, 13 nt, Human
ucucaggcaccag

SEQ ID NO: 1782155 - RNA, 23 nt, Human
ucucaggaccaaagcuuucaugu

SEQ ID NO: 1782156 - RNA, 20 nt, Human
ucucaggcaccagucccugu

SEQ ID NO: 1782157 - RNA, 13 nt, Human
acuugcugcuguc

SEQ ID NO: 1782158 - RNA, 15 nt, Human
acuugcugcugucuu

SEQ ID NO: 1782159 - RNA, 20 nt, Human
acuugcugcugucuuguugc

SEQ ID NO: 1782160 - RNA, 19 nt, Human
acuuguggacacagcucuu

SEQ ID NO: 1782161 - RNA, 22 nt, Human
acuuguggacacagcucuucuc

SEQ ID NO: 1782162 - RNA, 20 nt, Human
acuuguggacuaaaagauau

SEQ ID NO: 1782163 - RNA, 19 nt, Human
acuuguggacuaaaagaua

SEQ ID NO: 1782164 - RNA, 18 nt, Human
acuuguggacuaaaagau

SEQ ID NO: 1782165 - RNA, 15 nt, Human
acuuguggacuaaaa

SEQ ID NO: 1782166 - RNA, 23 nt, Human
acuugcagacucuacagaggcca

SEQ ID NO: 1782167 - RNA, 19 nt, Human
acuugcagacucuacagag

SEQ ID NO: 1782168 - RNA, 22 nt, Human
acuugcagacucuacagaggcc

SEQ ID NO: 1782169 - RNA, 20 nt, Human
ucucacuauguugcccaggc

SEQ ID NO: 1782170 - RNA, 21 nt, Human
ucucacuauguugcccaggca

SEQ ID NO: 1782171 - RNA, 22 nt, Human
ucucacuauguugcccaggcag

SEQ ID NO: 1782172 - RNA, 23 nt, Human
ucucacuauguugcccaggcagg

SEQ ID NO: 1782173 - RNA, 21 nt, Human
acuugcacagggauucucaca

SEQ ID NO: 1782174 - RNA, 11 nt, Human
ugacucuccag

SEQ ID NO: 1782175 - RNA, 13 nt, Human
ugacucuccaggg

SEQ ID NO: 1782176 - RNA, 14 nt, Human
ugacucuccagggg

SEQ ID NO: 1782177 - RNA, 15 nt, Human
ugaccugguccacag

SEQ ID NO: 1782178 - RNA, 20 nt, Human
ugaccugguccacagggcac

SEQ ID NO: 1782179 - RNA, 12 nt, Human
ugaccugcauug

SEQ ID NO: 1782180 - RNA, 16 nt, Human
ugaccugcauuguaaa

SEQ ID NO: 1782181 - RNA, 17 nt, Human
ugaccugcauuguaaau

SEQ ID NO: 1782182 - RNA, 18 nt, Human
ugaccugcauuguaaaua

SEQ ID NO: 1782183 - RNA, 16 nt, Human
agauuguggaauguug

SEQ ID NO: 1782184 - RNA, 21 nt, Human
agauuguggaauguuggauaa

SEQ ID NO: 1782185 - RNA, 22 nt, Human
agauuguggaauguuggauaag

SEQ ID NO: 1782186 - RNA, 11 nt, Human
agauuaauauu

SEQ ID NO: 1782187 - RNA, 20 nt, Human
agauuaauauuguucucugu

SEQ ID NO: 1782188 - RNA, 14 nt, Human
agauuaccuccuga

SEQ ID NO: 1782189 - RNA, 16 nt, Human
agaucccaggccccug

SEQ ID NO: 1782190 - RNA, 20 nt, Human
agaucccaggccccuggagg

SEQ ID NO: 1782191 - RNA, 16 nt, Human
agaucucacucugccc

SEQ ID NO: 1782192 - RNA, 13 nt, Human
agauccucucugg

SEQ ID NO: 1782193 - RNA, 14 nt, Human
agauccucucuggg

SEQ ID NO: 1782194 - RNA, 16 nt, Human
agauccucucuggggc

SEQ ID NO: 1782195 - RNA, 17 nt, Human
agauccucucuggggcu

SEQ ID NO: 1782196 - RNA, 15 nt, Human
agaugcaagucucuu

SEQ ID NO: 1782197 - RNA, 16 nt, Human
agaugcaagucucuug

SEQ ID NO: 1782198 - RNA, 22 nt, Human
ugacagagugagacucugucuc

SEQ ID NO: 1782199 - RNA, 21 nt, Human
ugaaugccgcgaugggucagg

SEQ ID NO: 1782200 - RNA, 17 nt, Human
ugacaggcaaugcuggc

SEQ ID NO: 1782201 - RNA, 19 nt, Human
ugacaggcaaugcuggcug

SEQ ID NO: 1782202 - RNA, 22 nt, Human
ugacagggcacaccgggcacuc

SEQ ID NO: 1782203 - RNA, 18 nt, Human
ugacauuuauuuuucauu

SEQ ID NO: 1782204 - RNA, 21 nt, Human
ugacauuuauuuuucauuuag

SEQ ID NO: 1782205 - RNA, 21 nt, Human
ugacauuuggaguguuccccu

SEQ ID NO: 1782206 - RNA, 15 nt, Human
ugacauuuggagagg

SEQ ID NO: 1782207 - RNA, 13 nt, Human
agcaccuccugcc

SEQ ID NO: 1782208 - RNA, 14 nt, Human
agcaccuccagccu

SEQ ID NO: 1782209 - RNA, 16 nt, Human
agcaccuccagccuga

SEQ ID NO: 1782210 - RNA, 20 nt, Human
agcaccuccagccugaacag

SEQ ID NO: 1782211 - RNA, 14 nt, Human
agcaccuccugccu

SEQ ID NO: 1782212 - RNA, 16 nt, Human
agcaccuccugccucg

SEQ ID NO: 1782213 - RNA, 22 nt, Human
agcaccaaaagcuuaccaaggg

SEQ ID NO: 1782214 - RNA, 20 nt, Human
agcaccauuuuaagucccug

SEQ ID NO: 1782215 - RNA, 23 nt, Human
agcaccauuuuaagucccuguca

SEQ ID NO: 1782216 - RNA, 19 nt, Human
agcaccgugucaagcugcu

SEQ ID NO: 1782217 - RNA, 20 nt, Human
agcaccgugucaagcugcuc

SEQ ID NO: 1782218 - RNA, 21 nt, Human
agcaccgugucaagcugcucu

SEQ ID NO: 1782219 - RNA, 22 nt, Human
agcaccgugucaagcugcucug

SEQ ID NO: 1782220 - RNA, 18 nt, Human
agcaccccuacucacaua

SEQ ID NO: 1782221 - RNA, 24 nt, Human
agcacccuauaaaucaacaccuua

SEQ ID NO: 1782222 - RNA, 13 nt, Human
agcacccucugga

SEQ ID NO: 1782223 - RNA, 21 nt, Human
agcacagcuucauuuccugug

SEQ ID NO: 1782224 - RNA, 19 nt, Human
agcaauccuagguaggguu

SEQ ID NO: 1782225 - RNA, 12 nt, Human
agcaauaugcau

SEQ ID NO: 1782226 - RNA, 17 nt, Human
agcaagugagagcuggg

SEQ ID NO: 1782227 - RNA, 18 nt, Human
agcaagugagagcugggu

SEQ ID NO: 1782228 - RNA, 14 nt, Human
ugagccacugcacc

SEQ ID NO: 1782229 - RNA, 13 nt, Human
ugagccaccugcc

SEQ ID NO: 1782230 - RNA, 18 nt, Human
ugagccaccugcccuuuu

SEQ ID NO: 1782231 - RNA, 19 nt, Human
ugagccaccugcccuuuuu

SEQ ID NO: 1782232 - RNA, 23 nt, Human
ugagccaaucugcaauuucuacu

SEQ ID NO: 1782233 - RNA, 19 nt, Human
ugagcaugacagccugcag

SEQ ID NO: 1782234 - RNA, 21 nt, Human
ugagcaugacagccugcagca

SEQ ID NO: 1782235 - RNA, 12 nt, Human
ugagccacugca

SEQ ID NO: 1782236 - RNA, 13 nt, Human
ugagccacugcac

SEQ ID NO: 1782237 - RNA, 15 nt, Human
agcaagugagagcug

SEQ ID NO: 1782238 - RNA, 16 nt, Human
agcaagugagagcugg

SEQ ID NO: 1782239 - RNA, 23 nt, Human
ugagauuguuuucuuuuucuacc

SEQ ID NO: 1782240 - RNA, 17 nt, Human
ugagauucaauauugaa

SEQ ID NO: 1782241 - RNA, 18 nt, Human
ugagauucaauauugaau

SEQ ID NO: 1782242 - RNA, 23 nt, Human
ugagauucaauauugaauuuuuc

SEQ ID NO: 1782243 - RNA, 23 nt, Human
ugagaggacuuuucuuuguggcu

SEQ ID NO: 1782244 - RNA, 14 nt, Human
ugagagcugggugu

SEQ ID NO: 1782245 - RNA, 20 nt, Human
ugagacucugucucaaaaaa

SEQ ID NO: 1782246 - RNA, 11 nt, Human
ugagacagagu

SEQ ID NO: 1782247 - RNA, 21 nt, Human
ugagacagaguuuucacucuu

SEQ ID NO: 1782248 - RNA, 11 nt, Human
ugaacuccugg

SEQ ID NO: 1782249 - RNA, 20 nt, Human
ugaacuaccuugguuccccc

SEQ ID NO: 1782250 - RNA, 21 nt, Human
ugaaccaccacacccagccca

SEQ ID NO: 1782251 - RNA, 22 nt, Human
ugaaccaccacacccagcccac

SEQ ID NO: 1782252 - RNA, 14 nt, Human
ugaacccuggggcc

SEQ ID NO: 1782253 - RNA, 15 nt, Human
ugaacccuggggccu

SEQ ID NO: 1782254 - RNA, 21 nt, Human
ugaacccuggggccugacugc

SEQ ID NO: 1782255 - RNA, 15 nt, Human
ugaaauucugaauuu

SEQ ID NO: 1782256 - RNA, 18 nt, Human
ugaaauucugaauuugca

SEQ ID NO: 1782257 - RNA, 19 nt, Human
ugaaauucugaauuugcaa

SEQ ID NO: 1782258 - RNA, 20 nt, Human
ugaaauucugaauuugcaaa

SEQ ID NO: 1782259 - RNA, 21 nt, Human
ugaaauucugaauuugcaaag

SEQ ID NO: 1782260 - RNA, 22 nt, Human
ugaaauucugaauuugcaaagu

SEQ ID NO: 1782261 - RNA, 20 nt, Human
agagauuaccuccugagaaa

SEQ ID NO: 1782262 - RNA, 13 nt, Human
agagauucauuuu

SEQ ID NO: 1782263 - RNA, 15 nt, Human
agagauucauuuucu

SEQ ID NO: 1782264 - RNA, 16 nt, Human
agagauucauuuucua

SEQ ID NO: 1782265 - RNA, 18 nt, Human
agagauucauuuucuaga

SEQ ID NO: 1782266 - RNA, 16 nt, Human
agagauuaccuccuga

SEQ ID NO: 1782267 - RNA, 19 nt, Human
agagauuaccuccugagaa

SEQ ID NO: 1782268 - RNA, 24 nt, Human
agaggcagccccauucugccugcc

SEQ ID NO: 1782269 - RNA, 17 nt, Human
agaggcccuuugcuguc

SEQ ID NO: 1782270 - RNA, 21 nt, Human
agaggcagccccauucugccu

SEQ ID NO: 1782271 - RNA, 22 nt, Human
agaggcagccccauucugccug

SEQ ID NO: 1782272 - RNA, 21 nt, Human
agaggcagggucucacucugu

SEQ ID NO: 1782273 - RNA, 23 nt, Human
agaggcagccccauucugccugc

SEQ ID NO: 1782274 - RNA, 17 nt, Human
agagcuguauuaagcca

SEQ ID NO: 1782275 - RNA, 19 nt, Human
agagcuguauuaagccacu

SEQ ID NO: 1782276 - RNA, 20 nt, Human
agagggagugacagaggcag

SEQ ID NO: 1782277 - RNA, 15 nt, Human
agagggagugacaga

SEQ ID NO: 1782278 - RNA, 21 nt, Human
ugaagauucuuucccaauuca

SEQ ID NO: 1782279 - RNA, 13 nt, Human
ugaagucacacag

SEQ ID NO: 1782280 - RNA, 12 nt, Human
ugaaguaccacc

SEQ ID NO: 1782281 - RNA, 14 nt, Human
ucuuuccuccuuuc

SEQ ID NO: 1782282 - RNA, 14 nt, Human
ucuuuccuauuuca

SEQ ID NO: 1782283 - RNA, 16 nt, Human
ucuuuccuauuucagu

SEQ ID NO: 1782284 - RNA, 24 nt, Human
ucuuuccuauuucaguguuaccug

SEQ ID NO: 1782285 - RNA, 18 nt, Human
ucuuuaaugucacaggca

SEQ ID NO: 1782286 - RNA, 19 nt, Human
ucuuuaaugucacaggcag

SEQ ID NO: 1782287 - RNA, 20 nt, Human
agacaggcaagcaccuccug

SEQ ID NO: 1782288 - RNA, 22 nt, Human
agacaggcaagcaccuccugcc

SEQ ID NO: 1782289 - RNA, 15 nt, Human
ucuuuaaugucacag

SEQ ID NO: 1782290 - RNA, 13 nt, Human
agacucugucuca

SEQ ID NO: 1782291 - RNA, 20 nt, Human
agacugggcugagggagccu

SEQ ID NO: 1782292 - RNA, 15 nt, Human
agacugggcugaggg

SEQ ID NO: 1782293 - RNA, 16 nt, Human
agacugggcugaggga

SEQ ID NO: 1782294 - RNA, 12 nt, Human
agacugggcuga

SEQ ID NO: 1782295 - RNA, 14 nt, Human
agacugggcugagg

SEQ ID NO: 1782296 - RNA, 14 nt, Human
ucuuuguggcuucc

SEQ ID NO: 1782297 - RNA, 15 nt, Human
ucuuugucuaaaaca

SEQ ID NO: 1782298 - RNA, 19 nt, Human
ucuuugucuaaaacaauaa

SEQ ID NO: 1782299 - RNA, 20 nt, Human
ucuuugucuaaaacaauaaa

SEQ ID NO: 1782300 - RNA, 13 nt, Human
ucuuugucuaaaa

SEQ ID NO: 1782301 - RNA, 13 nt, Human
ugaaagaaaauaa

SEQ ID NO: 1782302 - RNA, 16 nt, Human
ugaaaaugucuugugu

SEQ ID NO: 1782303 - RNA, 14 nt, Human
ugucccugcacuug

SEQ ID NO: 1782304 - RNA, 18 nt, Human
ugucccuucugucccuca

SEQ ID NO: 1782305 - RNA, 20 nt, Human
ugucccuucugucccucaca

SEQ ID NO: 1782306 - RNA, 12 nt, Human
ugucccuccggg

SEQ ID NO: 1782307 - RNA, 16 nt, Human
uguccacgacugucuc

SEQ ID NO: 1782308 - RNA, 17 nt, Human
uguccacgacugucucc

SEQ ID NO: 1782309 - RNA, 18 nt, Human
uguccacgacugucucca

SEQ ID NO: 1782310 - RNA, 19 nt, Human
uguccacgacugucuccau

SEQ ID NO: 1782311 - RNA, 21 nt, Human
agucccaccuuggcugcaggg

SEQ ID NO: 1782312 - RNA, 23 nt, Human
agucccaccuuggcugcagggag

SEQ ID NO: 1782313 - RNA, 19 nt, Human
agucaucuguuagggccuu

SEQ ID NO: 1782314 - RNA, 21 nt, Human
aguauuuaauuagugcuaagu

SEQ ID NO: 1782315 - RNA, 19 nt, Human
aguauuuaauuagugcuaa

SEQ ID NO: 1782316 - RNA, 17 nt, Human
aguauuuaauuagugcu

SEQ ID NO: 1782317 - RNA, 16 nt, Human
aguauuuaauuagugc

SEQ ID NO: 1782318 - RNA, 15 nt, Human
aguauuuaauuagug

SEQ ID NO: 1782319 - RNA, 14 nt, Human
aguauuuaauuagu

SEQ ID NO: 1782320 - RNA, 13 nt, Human
aguauuuaauuag

SEQ ID NO: 1782321 - RNA, 11 nt, Human
aguauuuaauu

SEQ ID NO: 1782322 - RNA, 22 nt, Human
aguagcugggacuacaggcacc

SEQ ID NO: 1782323 - RNA, 19 nt, Human
aguagcugggacuacaggc

SEQ ID NO: 1782324 - RNA, 21 nt, Human
aguagcugggacuacaggcac

SEQ ID NO: 1782325 - RNA, 13 nt, Human
aguagcugggacu

SEQ ID NO: 1782326 - RNA, 14 nt, Human
aguagcugggacua

SEQ ID NO: 1782327 - RNA, 16 nt, Human
aguagcugaaaugcaa

SEQ ID NO: 1782328 - RNA, 17 nt, Human
ugucaacauuuggaggc

SEQ ID NO: 1782329 - RNA, 14 nt, Human
uguauuaagccacu

SEQ ID NO: 1782330 - RNA, 19 nt, Human
uguauuagauguucucuau

SEQ ID NO: 1782331 - RNA, 18 nt, Human
uguauuagauguucucua

SEQ ID NO: 1782332 - RNA, 16 nt, Human
uguauuagauguucuc

SEQ ID NO: 1782333 - RNA, 14 nt, Human
uguauuagauguuc

SEQ ID NO: 1782334 - RNA, 13 nt, Human
uguauuagauguu

SEQ ID NO: 1782335 - RNA, 15 nt, Human
uguaucccaugagcc

SEQ ID NO: 1782336 - RNA, 16 nt, Human
uguaucccaugagccu

SEQ ID NO: 1782337 - RNA, 12 nt, Human
uguagagccagg

SEQ ID NO: 1782338 - RNA, 15 nt, Human
uguagagccaggguc

SEQ ID NO: 1782339 - RNA, 16 nt, Human
ugucucugggccacuu

SEQ ID NO: 1782340 - RNA, 20 nt, Human
ugucucuucaucuaauauga

SEQ ID NO: 1782341 - RNA, 22 nt, Human
ugucucuuuaaugucacaggca

SEQ ID NO: 1782342 - RNA, 21 nt, Human
ugucucuuuaaugucacaggc

SEQ ID NO: 1782343 - RNA, 21 nt, Human
agucccugccacgaauuucug

SEQ ID NO: 1782344 - RNA, 22 nt, Human
agucccugccacgaauuucugu

SEQ ID NO: 1782345 - RNA, 22 nt, Human
ugucuccuuucaccccagggcc

SEQ ID NO: 1782346 - RNA, 21 nt, Human
ugucuccuuucaccccagggc

SEQ ID NO: 1782347 - RNA, 15 nt, Human
ugugaaccaccacac

SEQ ID NO: 1782348 - RNA, 16 nt, Human
ugugaaccaccacacc

SEQ ID NO: 1782349 - RNA, 17 nt, Human
ugugaaccaccacaccc

SEQ ID NO: 1782350 - RNA, 22 nt, Human
ugugaaccaccacacccagccc

SEQ ID NO: 1782351 - RNA, 23 nt, Human
ugugaaccaccacacccagccca

SEQ ID NO: 1782352 - RNA, 18 nt, Human
ugugaacccuggggccug

SEQ ID NO: 1782353 - RNA, 20 nt, Human
ugugaacccuggggccugac

SEQ ID NO: 1782354 - RNA, 22 nt, Human
ugugaacccuggggccugacug

SEQ ID NO: 1782355 - RNA, 23 nt, Human
ugugaacccuggggccugacugc

SEQ ID NO: 1782356 - RNA, 15 nt, Human
ugucuugcaauggca

SEQ ID NO: 1782357 - RNA, 22 nt, Human
ugucuugaugcaugcacuguuc

SEQ ID NO: 1782358 - RNA, 17 nt, Human
ugucuugcaauggcagc

SEQ ID NO: 1782359 - RNA, 18 nt, Human
ugucuugcaauggcagcc

SEQ ID NO: 1782360 - RNA, 20 nt, Human
ugucuugcaauggcagccuu

SEQ ID NO: 1782361 - RNA, 21 nt, Human
ugucuugcaauggcagccuug

SEQ ID NO: 1782362 - RNA, 24 nt, Human
ugucuucaccugauucaacuaaaa

SEQ ID NO: 1782363 - RNA, 13 nt, Human
ugucuucaccuga

SEQ ID NO: 1782364 - RNA, 16 nt, Human
agucuuacgaauacuu

SEQ ID NO: 1782365 - RNA, 19 nt, Human
agucuuccauuugcaaggg

SEQ ID NO: 1782366 - RNA, 15 nt, Human
agucuuccauuugca

SEQ ID NO: 1782367 - RNA, 16 nt, Human
agucuuccauuugcaa

SEQ ID NO: 1782368 - RNA, 17 nt, Human
agucuuccauuugcaag

SEQ ID NO: 1782369 - RNA, 12 nt, Human
ugugaagcauuc

SEQ ID NO: 1782370 - RNA, 19 nt, Human
ugugaacuggacccuguug

SEQ ID NO: 1782371 - RNA, 18 nt, Human
ugugaacuggacccuguu

SEQ ID NO: 1782372 - RNA, 11 nt, Human
agucucugagc

SEQ ID NO: 1782373 - RNA, 13 nt, Human
agucucugagcag

SEQ ID NO: 1782374 - RNA, 16 nt, Human
agucucugagcaguga

SEQ ID NO: 1782375 - RNA, 14 nt, Human
ugugaaccaaugca

SEQ ID NO: 1782376 - RNA, 14 nt, Human
ugugauuuuaacuc

SEQ ID NO: 1782377 - RNA, 16 nt, Human
ugugauuuuaacucug

SEQ ID NO: 1782378 - RNA, 17 nt, Human
ugugauuuuaacucugu

SEQ ID NO: 1782379 - RNA, 20 nt, Human
ugugauuuuaacucugucuu

SEQ ID NO: 1782380 - RNA, 18 nt, Human
ugugauuuuaacucuguc

SEQ ID NO: 1782381 - RNA, 19 nt, Human
ugugauuuuaacucugucu

SEQ ID NO: 1782382 - RNA, 15 nt, Human
agugagccacuccgg

SEQ ID NO: 1782383 - RNA, 14 nt, Human
agugagagcugggu

SEQ ID NO: 1782384 - RNA, 22 nt, Human
agugagacucugucucaaaaaa

SEQ ID NO: 1782385 - RNA, 21 nt, Human
agugagacccagcccucaucc

SEQ ID NO: 1782386 - RNA, 16 nt, Human
agugagacucugucuc

SEQ ID NO: 1782387 - RNA, 17 nt, Human
agugagacucugucuca

SEQ ID NO: 1782388 - RNA, 13 nt, Human
agugagacucugu

SEQ ID NO: 1782389 - RNA, 17 nt, Human
agugaaagaaaauaaca

SEQ ID NO: 1782390 - RNA, 16 nt, Human
agguggggcagcuuga

SEQ ID NO: 1782391 - RNA, 14 nt, Human
aggugggucccggc

SEQ ID NO: 1782392 - RNA, 16 nt, Human
aggugggucccggcuc

SEQ ID NO: 1782393 - RNA, 14 nt, Human
agguggggcagcuu

SEQ ID NO: 1782394 - RNA, 13 nt, Human
agguggggcagcu

SEQ ID NO: 1782395 - RNA, 19 nt, Human
agguggggagacugggcug

SEQ ID NO: 1782396 - RNA, 21 nt, Human
agguggggagacugggcugag

SEQ ID NO: 1782397 - RNA, 23 nt, Human
aggugugaaccaccacacccagc

SEQ ID NO: 1782398 - RNA, 22 nt, Human
aggugugaaccaccacacccag

SEQ ID NO: 1782399 - RNA, 14 nt, Human
aggugugagucacc

SEQ ID NO: 1782400 - RNA, 20 nt, Human
aggugugagucaccaagccc

SEQ ID NO: 1782401 - RNA, 21 nt, Human
uguacauguucgggugugggu

SEQ ID NO: 1782402 - RNA, 18 nt, Human
uguacuucccgggccagg

SEQ ID NO: 1782403 - RNA, 21 nt, Human
uguacuucccgggccagggcu

SEQ ID NO: 1782404 - RNA, 22 nt, Human
uguacuucccgggccagggcug

SEQ ID NO: 1782405 - RNA, 15 nt, Human
uguagaauauucaga

SEQ ID NO: 1782406 - RNA, 19 nt, Human
uggugugucccccucuguc

SEQ ID NO: 1782407 - RNA, 12 nt, Human
ugguggcagcug

SEQ ID NO: 1782408 - RNA, 18 nt, Human
uggugugaucgucugacu

SEQ ID NO: 1782409 - RNA, 17 nt, Human
ugguggcagaguccugg

SEQ ID NO: 1782410 - RNA, 16 nt, Human
uggugugaucgucuga

SEQ ID NO: 1782411 - RNA, 15 nt, Human
ugguguggguguccu

SEQ ID NO: 1782412 - RNA, 16 nt, Human
ugguguggguguccug

SEQ ID NO: 1782413 - RNA, 17 nt, Human
ugguguggguguccugc

SEQ ID NO: 1782414 - RNA, 22 nt, Human
ugguguggguguccugccuguc

SEQ ID NO: 1782415 - RNA, 23 nt, Human
ugguguggguguccugccugucu

SEQ ID NO: 1782416 - RNA, 20 nt, Human
ugguucaggguuggccccug

SEQ ID NO: 1782417 - RNA, 22 nt, Human
ugguucaggguuggccccugcc

SEQ ID NO: 1782418 - RNA, 23 nt, Human
ugguucaggguuggccccugccc

SEQ ID NO: 1782419 - RNA, 17 nt, Human
ugguuaaaaaaaagaau

SEQ ID NO: 1782420 - RNA, 20 nt, Human
ugguuaaaaaaaagaauaaa

SEQ ID NO: 1782421 - RNA, 23 nt, Human
aggugauccacccaccucagccu

SEQ ID NO: 1782422 - RNA, 16 nt, Human
uguaaaggaauuuaaa

SEQ ID NO: 1782423 - RNA, 18 nt, Human
uggucugacccacugcuu

SEQ ID NO: 1782424 - RNA, 22 nt, Human
uggucuggguguagcucuuaga

SEQ ID NO: 1782425 - RNA, 12 nt, Human
uggucuguguga

SEQ ID NO: 1782426 - RNA, 22 nt, Human
ugguccaugggccauaugaaaa

SEQ ID NO: 1782427 - RNA, 13 nt, Human
aggguuggccccu

SEQ ID NO: 1782428 - RNA, 14 nt, Human
aggguuggccccug

SEQ ID NO: 1782429 - RNA, 17 nt, Human
aggguuggccccugccc

SEQ ID NO: 1782430 - RNA, 15 nt, Human
aggguugggcuggug

SEQ ID NO: 1782431 - RNA, 16 nt, Human
aggguugaccccagag

SEQ ID NO: 1782432 - RNA, 17 nt, Human
aggguugaccccagagg

SEQ ID NO: 1782433 - RNA, 18 nt, Human
aggguugaccccagagga

SEQ ID NO: 1782434 - RNA, 17 nt, Human
aggguucccgcggggcu

SEQ ID NO: 1782435 - RNA, 19 nt, Human
aggguucccgcggggcugu

SEQ ID NO: 1782436 - RNA, 14 nt, Human
aggguucugccucu

SEQ ID NO: 1782437 - RNA, 16 nt, Human
aggguucugccucucc

SEQ ID NO: 1782438 - RNA, 19 nt, Human
aggguucugccucuccagg

SEQ ID NO: 1782439 - RNA, 20 nt, Human
aggguucugccucuccaggc

SEQ ID NO: 1782440 - RNA, 17 nt, Human
aggguggugaccucugc

SEQ ID NO: 1782441 - RNA, 18 nt, Human
aggguggugaccucugcc

SEQ ID NO: 1782442 - RNA, 19 nt, Human
aggguggugaccucugccu

SEQ ID NO: 1782443 - RNA, 21 nt, Human
aggguggugaccucugccuga

SEQ ID NO: 1782444 - RNA, 14 nt, Human
uggucuucagccuc

SEQ ID NO: 1782445 - RNA, 17 nt, Human
aggguugggcugguguc

SEQ ID NO: 1782446 - RNA, 21 nt, Human
aggguuuaauccccaguaaaa

SEQ ID NO: 1782447 - RNA, 22 nt, Human
aggguuuaauccccaguaaaau

SEQ ID NO: 1782448 - RNA, 15 nt, Human
agguagccugcuggu

SEQ ID NO: 1782449 - RNA, 22 nt, Human
aggucuugaacuccuggccuca

SEQ ID NO: 1782450 - RNA, 14 nt, Human
aggucuuuuuuuaa

SEQ ID NO: 1782451 - RNA, 20 nt, Human
aggucuugaacuccuggccu

SEQ ID NO: 1782452 - RNA, 21 nt, Human
aggucuugaacuccuggccuc

SEQ ID NO: 1782453 - RNA, 15 nt, Human
aggucagugcaaaua

SEQ ID NO: 1782454 - RNA, 16 nt, Human
aggggauagagagaga

SEQ ID NO: 1782455 - RNA, 12 nt, Human
aggggaguagag

SEQ ID NO: 1782456 - RNA, 22 nt, Human
ugggaauauuugaaucuugucu

SEQ ID NO: 1782457 - RNA, 20 nt, Human
ugggaauauuugaaucuugu

SEQ ID NO: 1782458 - RNA, 19 nt, Human
ugggaauauuugaaucuug

SEQ ID NO: 1782459 - RNA, 18 nt, Human
ugggaauauuugaaucuu

SEQ ID NO: 1782460 - RNA, 16 nt, Human
ugggaauauuugaauc

SEQ ID NO: 1782461 - RNA, 15 nt, Human
ugggaauauuugaau

SEQ ID NO: 1782462 - RNA, 14 nt, Human
ugggaauauuugaa

SEQ ID NO: 1782463 - RNA, 13 nt, Human
ugggaauauuuga

SEQ ID NO: 1782464 - RNA, 19 nt, Human
aggggucgacuucgggcug

SEQ ID NO: 1782465 - RNA, 21 nt, Human
aggggucgacuucgggcuggc

SEQ ID NO: 1782466 - RNA, 18 nt, Human
aggguaucaggugcugcc

SEQ ID NO: 1782467 - RNA, 16 nt, Human
aggguaucaggugcug

SEQ ID NO: 1782468 - RNA, 12 nt, Human
ugguccaggaga

SEQ ID NO: 1782469 - RNA, 16 nt, Human
ugguccaggagaaggc

SEQ ID NO: 1782470 - RNA, 13 nt, Human
ugguccacagggc

SEQ ID NO: 1782471 - RNA, 14 nt, Human
ugguccacagggca

SEQ ID NO: 1782472 - RNA, 15 nt, Human
ugguccacagggcac

SEQ ID NO: 1782473 - RNA, 21 nt, Human
ugguccacagggcaccugcca

SEQ ID NO: 1782474 - RNA, 14 nt, Human
ugggugaaggcugg

SEQ ID NO: 1782475 - RNA, 15 nt, Human
ugggugaaggcuggc

SEQ ID NO: 1782476 - RNA, 16 nt, Human
ugggugaaggcuggca

SEQ ID NO: 1782477 - RNA, 14 nt, Human
uggguggaugccug

SEQ ID NO: 1782478 - RNA, 19 nt, Human
ugggugaaggcuggcauga

SEQ ID NO: 1782479 - RNA, 23 nt, Human
uggguggaugccugguggcagcu

SEQ ID NO: 1782480 - RNA, 19 nt, Human
uggguuuuguauucucuga

SEQ ID NO: 1782481 - RNA, 21 nt, Human
uggguuuuguauucucugagc

SEQ ID NO: 1782482 - RNA, 15 nt, Human
uuaccugcugcuucu

SEQ ID NO: 1782483 - RNA, 18 nt, Human
uuaccugaaaacacugug

SEQ ID NO: 1782484 - RNA, 20 nt, Human
uuaccugaaaacacugugca

SEQ ID NO: 1782485 - RNA, 22 nt, Human
uuaccugaaaacacugugcaca

SEQ ID NO: 1782486 - RNA, 12 nt, Human
auaaguuauuuu

SEQ ID NO: 1782487 - RNA, 18 nt, Human
auaaguuauuuuuguaca

SEQ ID NO: 1782488 - RNA, 19 nt, Human
auaaguuauuuuuguacau

SEQ ID NO: 1782489 - RNA, 20 nt, Human
auaaguuauuuuuguacaug

SEQ ID NO: 1782490 - RNA, 22 nt, Human
auaaguuauuuuuguacauguu

SEQ ID NO: 1782491 - RNA, 14 nt, Human
uuagauuauugaaa

SEQ ID NO: 1782492 - RNA, 19 nt, Human
auaauugggucauagaaau

SEQ ID NO: 1782493 - RNA, 19 nt, Human
auaauugaguuuucagugg

SEQ ID NO: 1782494 - RNA, 14 nt, Human
auaaugaauacuuu

SEQ ID NO: 1782495 - RNA, 23 nt, Human
uuaccauuuugggguacccacug

SEQ ID NO: 1782496 - RNA, 17 nt, Human
auaaacuuggauucucu

SEQ ID NO: 1782497 - RNA, 22 nt, Human
auaacucuguggcauuauugca

SEQ ID NO: 1782498 - RNA, 12 nt, Human
auaacugaggag

SEQ ID NO: 1782499 - RNA, 17 nt, Human
auaaacaucacacacac

SEQ ID NO: 1782500 - RNA, 16 nt, Human
auaaacaucacacaca

SEQ ID NO: 1782501 - RNA, 21 nt, Human
auaaaguauuuaauuagugcu

SEQ ID NO: 1782502 - RNA, 19 nt, Human
auaaaguauuuaauuagug

SEQ ID NO: 1782503 - RNA, 17 nt, Human
auaaaguauuuaauuag

SEQ ID NO: 1782504 - RNA, 15 nt, Human
auaaaguauuuaauu

SEQ ID NO: 1782505 - RNA, 14 nt, Human
auaaaguauuuaau

SEQ ID NO: 1782506 - RNA, 12 nt, Human
auaaaguauuua

SEQ ID NO: 1782507 - RNA, 18 nt, Human
uuagccauuuuucaaagc

SEQ ID NO: 1782508 - RNA, 21 nt, Human
uuagcccucacauuagaucua

SEQ ID NO: 1782509 - RNA, 17 nt, Human
uuagccugaguagaaag

SEQ ID NO: 1782510 - RNA, 21 nt, Human
uuauagugauguaaucuugaa

SEQ ID NO: 1782511 - RNA, 13 nt, Human
uuauaguaaugag

SEQ ID NO: 1782512 - RNA, 18 nt, Human
uuauagaacuucauggau

SEQ ID NO: 1782513 - RNA, 17 nt, Human
auacaaacugguauucu

SEQ ID NO: 1782514 - RNA, 13 nt, Human
auacauucuagau

SEQ ID NO: 1782515 - RNA, 14 nt, Human
auacaggaaaagcu

SEQ ID NO: 1782516 - RNA, 19 nt, Human
auacaggaaaagcugcuga

SEQ ID NO: 1782517 - RNA, 20 nt, Human
auacaggaaaagcugcugac

SEQ ID NO: 1782518 - RNA, 22 nt, Human
auacaggaaaagcugcugacag

SEQ ID NO: 1782519 - RNA, 21 nt, Human
auacaguucggugagcuacaa

SEQ ID NO: 1782520 - RNA, 22 nt, Human
auacagauuuugauagcaaagc

SEQ ID NO: 1782521 - RNA, 19 nt, Human
auacagauuuugauagcaa

SEQ ID NO: 1782522 - RNA, 18 nt, Human
auacagauuuugauagca

SEQ ID NO: 1782523 - RNA, 17 nt, Human
auacagauuuugauagc

SEQ ID NO: 1782524 - RNA, 16 nt, Human
auacagauuuugauag

SEQ ID NO: 1782525 - RNA, 14 nt, Human
auacagauuuugau

SEQ ID NO: 1782526 - RNA, 23 nt, Human
auacaaauugguugguuuugacu

SEQ ID NO: 1782527 - RNA, 16 nt, Human
auaccagcgaggaggc

SEQ ID NO: 1782528 - RNA, 22 nt, Human
auaccagcgaggaggcuccaga

SEQ ID NO: 1782529 - RNA, 21 nt, Human
auaccaaugaaaaaauguaua

SEQ ID NO: 1782530 - RNA, 19 nt, Human
auaccaaugaaaaaaugua

SEQ ID NO: 1782531 - RNA, 21 nt, Human
uuaucaccgugggcucccuga

SEQ ID NO: 1782532 - RNA, 15 nt, Human
aguuauuuuuguaca

SEQ ID NO: 1782533 - RNA, 16 nt, Human
aguuauuuuuguacau

SEQ ID NO: 1782534 - RNA, 17 nt, Human
aguuauuuuuguacaug

SEQ ID NO: 1782535 - RNA, 18 nt, Human
aguuauuuuuguacaugu

SEQ ID NO: 1782536 - RNA, 13 nt, Human
aguucaaaauucu

SEQ ID NO: 1782537 - RNA, 20 nt, Human
aguucaaaauucuaaaugua

SEQ ID NO: 1782538 - RNA, 13 nt, Human
aguucaaacaaga

SEQ ID NO: 1782539 - RNA, 14 nt, Human
aguuauuuuccagg

SEQ ID NO: 1782540 - RNA, 17 nt, Human
aguguuucuaauaaacu

SEQ ID NO: 1782541 - RNA, 21 nt, Human
aguguuucuaauaaacuugga

SEQ ID NO: 1782542 - RNA, 20 nt, Human
aguuauuauauuuacaaaug

SEQ ID NO: 1782543 - RNA, 18 nt, Human
aguuauggccuauacacu

SEQ ID NO: 1782544 - RNA, 21 nt, Human
aguuauggccuauacacuauu

SEQ ID NO: 1782545 - RNA, 23 nt, Human
aguuaugaacacuuaaauuauga

SEQ ID NO: 1782546 - RNA, 16 nt, Human
aguuaguuaaguuggg

SEQ ID NO: 1782547 - RNA, 15 nt, Human
agugggguuuccugg

SEQ ID NO: 1782548 - RNA, 14 nt, Human
aguggcagcugcuu

SEQ ID NO: 1782549 - RNA, 20 nt, Human
aguggcagcugcuuuugucu

SEQ ID NO: 1782550 - RNA, 12 nt, Human
aguggcagcugc

SEQ ID NO: 1782551 - RNA, 13 nt, Human
aguggcagcugcu

SEQ ID NO: 1782552 - RNA, 16 nt, Human
aguggugcgaucuggg

SEQ ID NO: 1782553 - RNA, 14 nt, Human
uguucugggacaca

SEQ ID NO: 1782554 - RNA, 15 nt, Human
uguucugggacacag

SEQ ID NO: 1782555 - RNA, 13 nt, Human
uguucugggacac

SEQ ID NO: 1782556 - RNA, 16 nt, Human
uguucccccugugcag

SEQ ID NO: 1782557 - RNA, 15 nt, Human
uguucccccugugca

SEQ ID NO: 1782558 - RNA, 21 nt, Human
uguucaaagccagcguccucc

SEQ ID NO: 1782559 - RNA, 22 nt, Human
uguucaaagccagcguccuccu

SEQ ID NO: 1782560 - RNA, 14 nt, Human
uguuauuuugcaac

SEQ ID NO: 1782561 - RNA, 22 nt, Human
uguuauguaaaaggccaaaccu

SEQ ID NO: 1782562 - RNA, 15 nt, Human
aguucuguagaaaug

SEQ ID NO: 1782563 - RNA, 13 nt, Human
aguucuguagaaa

SEQ ID NO: 1782564 - RNA, 18 nt, Human
aguucuguagaaaugguu

SEQ ID NO: 1782565 - RNA, 17 nt, Human
aguucuguagaaauggu

SEQ ID NO: 1782566 - RNA, 16 nt, Human
aguucuguagaaaugg

SEQ ID NO: 1782567 - RNA, 15 nt, Human
aguugauguugcauu

SEQ ID NO: 1782568 - RNA, 15 nt, Human
aguugaugaaaugga

SEQ ID NO: 1782569 - RNA, 16 nt, Human
aguugauguugcauuu

SEQ ID NO: 1782570 - RNA, 21 nt, Human
aguugaucgccuuucccaggu

SEQ ID NO: 1782571 - RNA, 19 nt, Human
uguuuggggaugagaaagg

SEQ ID NO: 1782572 - RNA, 15 nt, Human
uguuuggggaugaga

SEQ ID NO: 1782573 - RNA, 12 nt, Human
uguuugcccaaa

SEQ ID NO: 1782574 - RNA, 14 nt, Human
uguuugccucugcc

SEQ ID NO: 1782575 - RNA, 16 nt, Human
uguuugccucugccuc

SEQ ID NO: 1782576 - RNA, 17 nt, Human
uguuguccaacuauuua

SEQ ID NO: 1782577 - RNA, 19 nt, Human
aguuuccuuccagcccaga

SEQ ID NO: 1782578 - RNA, 22 nt, Human
aguuuucacucuuauugcccac

SEQ ID NO: 1782579 - RNA, 12 nt, Human
aguuuucagugg

SEQ ID NO: 1782580 - RNA, 17 nt, Human
uuaaaacaacacucaca

SEQ ID NO: 1782581 - RNA, 22 nt, Human
aguugcauagguuuaauaauuu

SEQ ID NO: 1782582 - RNA, 17 nt, Human
agccagaggacugugau

SEQ ID NO: 1782583 - RNA, 20 nt, Human
agccacugcaccgggccaca

SEQ ID NO: 1782584 - RNA, 13 nt, Human
agccacuccucug

SEQ ID NO: 1782585 - RNA, 18 nt, Human
agccacugcaccgggcca

SEQ ID NO: 1782586 - RNA, 19 nt, Human
agccacugcaccgggccac

SEQ ID NO: 1782587 - RNA, 13 nt, Human
agccagaggacug

SEQ ID NO: 1782588 - RNA, 14 nt, Human
agccagaggacugu

SEQ ID NO: 1782589 - RNA, 16 nt, Human
agccacugcaccgggc

SEQ ID NO: 1782590 - RNA, 12 nt, Human
agccacuccucu

SEQ ID NO: 1782591 - RNA, 15 nt, Human
agccacuccccucca

SEQ ID NO: 1782592 - RNA, 19 nt, Human
agccacuccccuccacucu

SEQ ID NO: 1782593 - RNA, 14 nt, Human
agccacuccccucc

SEQ ID NO: 1782594 - RNA, 19 nt, Human
agccacuaagaaccccucu

SEQ ID NO: 1782595 - RNA, 22 nt, Human
agccacuaagaaccccucugcu

SEQ ID NO: 1782596 - RNA, 15 nt, Human
ugauccucccaccuc

SEQ ID NO: 1782597 - RNA, 22 nt, Human
ugauccucccaccucagccucc

SEQ ID NO: 1782598 - RNA, 16 nt, Human
ugauccucccaccuca

SEQ ID NO: 1782599 - RNA, 21 nt, Human
ugauccucccaccucagccuc

SEQ ID NO: 1782600 - RNA, 21 nt, Human
agccaucucaugaggggagag

SEQ ID NO: 1782601 - RNA, 23 nt, Human
agccaucucaugaggggagagga

SEQ ID NO: 1782602 - RNA, 13 nt, Human
agcccacuucugc

SEQ ID NO: 1782603 - RNA, 14 nt, Human
agcccacuucugcc

SEQ ID NO: 1782604 - RNA, 15 nt, Human
agcccacuucugcca

SEQ ID NO: 1782605 - RNA, 22 nt, Human
agcccacuucugccauauucug

SEQ ID NO: 1782606 - RNA, 15 nt, Human
agcccagcacugcuu

SEQ ID NO: 1782607 - RNA, 17 nt, Human
agcccagauuccccugu

SEQ ID NO: 1782608 - RNA, 18 nt, Human
agcccagauuccccugug

SEQ ID NO: 1782609 - RNA, 20 nt, Human
agcccagauuccccuguguc

SEQ ID NO: 1782610 - RNA, 21 nt, Human
agcccagauuccccuguguca

SEQ ID NO: 1782611 - RNA, 16 nt, Human
agccagcguccuccuc

SEQ ID NO: 1782612 - RNA, 17 nt, Human
agccagcguccuccucu

SEQ ID NO: 1782613 - RNA, 18 nt, Human
agccagcguccuccucug

SEQ ID NO: 1782614 - RNA, 19 nt, Human
agccagcguccuccucugu

SEQ ID NO: 1782615 - RNA, 21 nt, Human
agccagcguccuccucuguga

SEQ ID NO: 1782616 - RNA, 23 nt, Human
agccagcguccuccucugugacc

SEQ ID NO: 1782617 - RNA, 22 nt, Human
ugauucccaagcucugcuccuc

SEQ ID NO: 1782618 - RNA, 23 nt, Human
ugauucccaagcucugcuccucu

SEQ ID NO: 1782619 - RNA, 13 nt, Human
ugauucuccugcc

SEQ ID NO: 1782620 - RNA, 21 nt, Human
agcccagcacugcuugaggaa

SEQ ID NO: 1782621 - RNA, 15 nt, Human
agccucaucaucaga

SEQ ID NO: 1782622 - RNA, 17 nt, Human
agccucaucaucagagc

SEQ ID NO: 1782623 - RNA, 22 nt, Human
agccucagcgcggcccucccga

SEQ ID NO: 1782624 - RNA, 22 nt, Human
agccucagaugauuuccccccu

SEQ ID NO: 1782625 - RNA, 19 nt, Human
agccucagcgcggcccucc

SEQ ID NO: 1782626 - RNA, 20 nt, Human
agccucaaccuccugggcua

SEQ ID NO: 1782627 - RNA, 18 nt, Human
agccgagaucacgccacu

SEQ ID NO: 1782628 - RNA, 21 nt, Human
ugcagccucaaccuccugggc

SEQ ID NO: 1782629 - RNA, 22 nt, Human
ugcagccucaaccuccugggcu

SEQ ID NO: 1782630 - RNA, 23 nt, Human
ugcagccucaaccuccugggcua

SEQ ID NO: 1782631 - RNA, 22 nt, Human
ugcagcucaaggaaaggccuga

SEQ ID NO: 1782632 - RNA, 13 nt, Human
agccucuggguca

SEQ ID NO: 1782633 - RNA, 13 nt, Human
agccucuccugua

SEQ ID NO: 1782634 - RNA, 18 nt, Human
ugcagacucuacagaggc

SEQ ID NO: 1782635 - RNA, 16 nt, Human
ugcagacucuacagag

SEQ ID NO: 1782636 - RNA, 17 nt, Human
ugcagacucuacagagg

SEQ ID NO: 1782637 - RNA, 16 nt, Human
agcccuuagcagggaa

SEQ ID NO: 1782638 - RNA, 18 nt, Human
agcccuguggaugagccc

SEQ ID NO: 1782639 - RNA, 19 nt, Human
agcccuguggaugagcccu

SEQ ID NO: 1782640 - RNA, 22 nt, Human
agcccuguggaugagcccucag

SEQ ID NO: 1782641 - RNA, 23 nt, Human
agcccuguggaugagcccucaga

SEQ ID NO: 1782642 - RNA, 21 nt, Human
agcccuuagcagggaaacagc

SEQ ID NO: 1782643 - RNA, 15 nt, Human
agcccuuaucugugc

SEQ ID NO: 1782644 - RNA, 18 nt, Human
agcccuuaucugugcuca

SEQ ID NO: 1782645 - RNA, 17 nt, Human
agccgagaucacgccac

SEQ ID NO: 1782646 - RNA, 22 nt, Human
ugcagacaggcaagcaccuccu

SEQ ID NO: 1782647 - RNA, 11 nt, Human
agcccuggcag

SEQ ID NO: 1782648 - RNA, 22 nt, Human
ugcacacaccagagcccaccuu

SEQ ID NO: 1782649 - RNA, 21 nt, Human
ugcacacaccagagcccaccu

SEQ ID NO: 1782650 - RNA, 17 nt, Human
ugcacacaccagagccc

SEQ ID NO: 1782651 - RNA, 18 nt, Human
ugcacacaccagagccca

SEQ ID NO: 1782652 - RNA, 14 nt, Human
agcccugguggcag

SEQ ID NO: 1782653 - RNA, 15 nt, Human
agcccugguggcagu

SEQ ID NO: 1782654 - RNA, 16 nt, Human
agcccugguggcagug

SEQ ID NO: 1782655 - RNA, 23 nt, Human
agccccauucugccugcccaggc

SEQ ID NO: 1782656 - RNA, 22 nt, Human
agccccucuuucuguccccucu

SEQ ID NO: 1782657 - RNA, 21 nt, Human
agccccauucugccugcccag

SEQ ID NO: 1782658 - RNA, 22 nt, Human
agccccauucugccugcccagg

SEQ ID NO: 1782659 - RNA, 19 nt, Human
agcccagggcaucuugcug

SEQ ID NO: 1782660 - RNA, 22 nt, Human
agcccagggcaucuugcuggcu

SEQ ID NO: 1782661 - RNA, 23 nt, Human
agcccagggcaucuugcuggcua

SEQ ID NO: 1782662 - RNA, 14 nt, Human
ugcaaacgcugccu

SEQ ID NO: 1782663 - RNA, 15 nt, Human
ugcaaacgcugccug

SEQ ID NO: 1782664 - RNA, 16 nt, Human
ugcaaacgcugccugc

SEQ ID NO: 1782665 - RNA, 17 nt, Human
ugcaaacgcugccugcc

SEQ ID NO: 1782666 - RNA, 19 nt, Human
ugcaaacgcugccugccca

SEQ ID NO: 1782667 - RNA, 21 nt, Human
ugcaaacgcugccugcccgua

SEQ ID NO: 1782668 - RNA, 21 nt, Human
ugcaaacgcugccugccggua

SEQ ID NO: 1782669 - RNA, 12 nt, Human
ugcaauaaugca

SEQ ID NO: 1782670 - RNA, 14 nt, Human
ugcaauaaugcagu

SEQ ID NO: 1782671 - RNA, 15 nt, Human
ugcaauaaugcagua

SEQ ID NO: 1782672 - RNA, 16 nt, Human
ugcaauaaugcaguau

SEQ ID NO: 1782673 - RNA, 18 nt, Human
ugcaauaaugcaguaugg

SEQ ID NO: 1782674 - RNA, 20 nt, Human
ugcaauaaugcaguauggua

SEQ ID NO: 1782675 - RNA, 12 nt, Human
ugcaagucucuu

SEQ ID NO: 1782676 - RNA, 14 nt, Human
ugccucugacacac

SEQ ID NO: 1782677 - RNA, 16 nt, Human
ugccucugacacacag

SEQ ID NO: 1782678 - RNA, 11 nt, Human
ugccucugccu

SEQ ID NO: 1782679 - RNA, 12 nt, Human
ugccucugccuc

SEQ ID NO: 1782680 - RNA, 17 nt, Human
ugccugcccaggccccu

SEQ ID NO: 1782681 - RNA, 18 nt, Human
ugccugcccaggccccug

SEQ ID NO: 1782682 - RNA, 19 nt, Human
ugccugcccaggccccugc

SEQ ID NO: 1782683 - RNA, 23 nt, Human
agcugcuuuugucuaugggacuc

SEQ ID NO: 1782684 - RNA, 24 nt, Human
agcugcuuuugucuaugggacuca

SEQ ID NO: 1782685 - RNA, 13 nt, Human
agcugccuguuca

SEQ ID NO: 1782686 - RNA, 22 nt, Human
agcugcuuuugucuaugggacu

SEQ ID NO: 1782687 - RNA, 15 nt, Human
agcucuucuccaggc

SEQ ID NO: 1782688 - RNA, 16 nt, Human
agcucuucuccaggcu

SEQ ID NO: 1782689 - RNA, 17 nt, Human
agcucuucuccaggcug

SEQ ID NO: 1782690 - RNA, 13 nt, Human
ugcccuguguacu

SEQ ID NO: 1782691 - RNA, 15 nt, Human
ugcccuguguacuuc

SEQ ID NO: 1782692 - RNA, 20 nt, Human
ugcccuguguacuucccggg

SEQ ID NO: 1782693 - RNA, 18 nt, Human
ugccucaggaggcaggac

SEQ ID NO: 1782694 - RNA, 21 nt, Human
ugccucaggaggcaggaccuu

SEQ ID NO: 1782695 - RNA, 13 nt, Human
agcuccagcucac

SEQ ID NO: 1782696 - RNA, 17 nt, Human
agcuccagcucaccagc

SEQ ID NO: 1782697 - RNA, 22 nt, Human
ugcccuacuauagcaguuuuua

SEQ ID NO: 1782698 - RNA, 14 nt, Human
ugcccuccucacuc

SEQ ID NO: 1782699 - RNA, 23 nt, Human
ugcccuccugacccauugcuguu

SEQ ID NO: 1782700 - RNA, 14 nt, Human
ugcccucucaggcc

SEQ ID NO: 1782701 - RNA, 13 nt, Human
agcucuacccagg

SEQ ID NO: 1782702 - RNA, 15 nt, Human
agcucuacccagggc

SEQ ID NO: 1782703 - RNA, 17 nt, Human
agcucuacccagggccu

SEQ ID NO: 1782704 - RNA, 19 nt, Human
agcucuacccagggccugc

SEQ ID NO: 1782705 - RNA, 20 nt, Human
agcucuacccagggccugca

SEQ ID NO: 1782706 - RNA, 21 nt, Human
agcucuacccagggccugcag

SEQ ID NO: 1782707 - RNA, 17 nt, Human
agcucuuacucuuuccu

SEQ ID NO: 1782708 - RNA, 18 nt, Human
agcucuuacucuuuccua

SEQ ID NO: 1782709 - RNA, 19 nt, Human
agcucuuacucuuuccuau

SEQ ID NO: 1782710 - RNA, 22 nt, Human
agcuccuucuguccuacucugu

SEQ ID NO: 1782711 - RNA, 23 nt, Human
agcuccuucuguccuacucugug

SEQ ID NO: 1782712 - RNA, 21 nt, Human
agcuccagcucaccagcccca

SEQ ID NO: 1782713 - RNA, 18 nt, Human
agcuccagcucaccagcc

SEQ ID NO: 1782714 - RNA, 19 nt, Human
agcuccagcucaccagccc

SEQ ID NO: 1782715 - RNA, 18 nt, Human
agcuauguuauauugaaa

SEQ ID NO: 1782716 - RNA, 22 nt, Human
agcuauguuauauugaaaaaau

SEQ ID NO: 1782717 - RNA, 20 nt, Human
agcuauguuauauugaaaaa

SEQ ID NO: 1782718 - RNA, 21 nt, Human
agcuaggccuggccagaugca

SEQ ID NO: 1782719 - RNA, 13 nt, Human
agcgugagccacu

SEQ ID NO: 1782720 - RNA, 19 nt, Human
agcguccuccucugugacc

SEQ ID NO: 1782721 - RNA, 17 nt, Human
agcucaggugucccugc

SEQ ID NO: 1782722 - RNA, 15 nt, Human
ugcccaggccccugc

SEQ ID NO: 1782723 - RNA, 17 nt, Human
ugcccaggccccugcca

SEQ ID NO: 1782724 - RNA, 18 nt, Human
ugcccaggccccugccac

SEQ ID NO: 1782725 - RNA, 18 nt, Human
ugcccagcuauaccugug

SEQ ID NO: 1782726 - RNA, 20 nt, Human
ugcccagcuauaccugugcc

SEQ ID NO: 1782727 - RNA, 21 nt, Human
ugcccagcuauaccugugccu

SEQ ID NO: 1782728 - RNA, 22 nt, Human
ugcccagcuauaccugugccuc

SEQ ID NO: 1782729 - RNA, 16 nt, Human
ugccccaucuccccuc

SEQ ID NO: 1782730 - RNA, 19 nt, Human
ugccccaucuccccucagc

SEQ ID NO: 1782731 - RNA, 21 nt, Human
ugccccaucuccccucagcuc

SEQ ID NO: 1782732 - RNA, 23 nt, Human
ugccagcucuguaucaggaccca

SEQ ID NO: 1782733 - RNA, 22 nt, Human
agcggggacagcuccuucuguc

SEQ ID NO: 1782734 - RNA, 15 nt, Human
agcguccuccucugu

SEQ ID NO: 1782735 - RNA, 16 nt, Human
agcguccuccucugug

SEQ ID NO: 1782736 - RNA, 17 nt, Human
agcguccuccucuguga

SEQ ID NO: 1782737 - RNA, 14 nt, Human
agcgggaaaaggag

SEQ ID NO: 1782738 - RNA, 19 nt, Human
agcggggacagcuccuucu

SEQ ID NO: 1782739 - RNA, 20 nt, Human
agcggggacagcuccuucug

SEQ ID NO: 1782740 - RNA, 22 nt, Human
agcgauucuucugcuucagccu

SEQ ID NO: 1782741 - RNA, 14 nt, Human
ugcagcucccuggc

SEQ ID NO: 1782742 - RNA, 18 nt, Human
ugcagcucccuggcuucu

SEQ ID NO: 1782743 - RNA, 19 nt, Human
ugcagcucccuggcuucug

SEQ ID NO: 1782744 - RNA, 20 nt, Human
ugcagcucccuggcuucugu

SEQ ID NO: 1782745 - RNA, 16 nt, Human
ugcauuuaaauacagu

SEQ ID NO: 1782746 - RNA, 22 nt, Human
ugcauuuaaauacagucuucca

SEQ ID NO: 1782747 - RNA, 24 nt, Human
ugcauuuaaauacagucuuccauu

SEQ ID NO: 1782748 - RNA, 16 nt, Human
agcgcuuuuccuuggc

SEQ ID NO: 1782749 - RNA, 16 nt, Human
ugcuuuuaacucuaga

SEQ ID NO: 1782750 - RNA, 17 nt, Human
ugcuuuuaacucuagaa

SEQ ID NO: 1782751 - RNA, 19 nt, Human
aggacauugcggacagcca

SEQ ID NO: 1782752 - RNA, 23 nt, Human
aggacauugcggacagccacggc

SEQ ID NO: 1782753 - RNA, 15 nt, Human
aggacauugcggaca

SEQ ID NO: 1782754 - RNA, 17 nt, Human
aggacauugcggacagc

SEQ ID NO: 1782755 - RNA, 18 nt, Human
aggacauugcggacagcc

SEQ ID NO: 1782756 - RNA, 20 nt, Human
aggacuuccccggagggcug

SEQ ID NO: 1782757 - RNA, 21 nt, Human
aggacuuccccggagggcugc

SEQ ID NO: 1782758 - RNA, 14 nt, Human
aggacauuucucua

SEQ ID NO: 1782759 - RNA, 19 nt, Human
aggacugagcacccucugg

SEQ ID NO: 1782760 - RNA, 20 nt, Human
aggacugagcacccucugga

SEQ ID NO: 1782761 - RNA, 14 nt, Human
aggacugugaugcc

SEQ ID NO: 1782762 - RNA, 20 nt, Human
aggacugugaugcccugccc

SEQ ID NO: 1782763 - RNA, 21 nt, Human
aggacugugaugcccugcccu

SEQ ID NO: 1782764 - RNA, 23 nt, Human
aggagccaguuugccggauacaa

SEQ ID NO: 1782765 - RNA, 22 nt, Human
aggagccccgaggccuucucug

SEQ ID NO: 1782766 - RNA, 23 nt, Human
aggacuuuucuuuguggcuuccu

SEQ ID NO: 1782767 - RNA, 14 nt, Human
aggaggcaggaccu

SEQ ID NO: 1782768 - RNA, 20 nt, Human
aggaugagcucuacccaggg

SEQ ID NO: 1782769 - RNA, 15 nt, Human
uggacacagcucuuc

SEQ ID NO: 1782770 - RNA, 16 nt, Human
uggacacagcucuucu

SEQ ID NO: 1782771 - RNA, 18 nt, Human
uggacacagcucuucucc

SEQ ID NO: 1782772 - RNA, 21 nt, Human
uggacacagcucuucuccagg

SEQ ID NO: 1782773 - RNA, 13 nt, Human
uggaccagugguc

SEQ ID NO: 1782774 - RNA, 18 nt, Human
uggaccaguggucucaca

SEQ ID NO: 1782775 - RNA, 16 nt, Human
uggacccagggaacag

SEQ ID NO: 1782776 - RNA, 13 nt, Human
uggacccuuccau

SEQ ID NO: 1782777 - RNA, 19 nt, Human
aggauuuugauccaagcug

SEQ ID NO: 1782778 - RNA, 21 nt, Human
ugcucugcugacagacacagg

SEQ ID NO: 1782779 - RNA, 22 nt, Human
ugcucugcugacagacacaggc

SEQ ID NO: 1782780 - RNA, 12 nt, Human
ugcucugcuuca

SEQ ID NO: 1782781 - RNA, 19 nt, Human
agcugggacuacaggcacc

SEQ ID NO: 1782782 - RNA, 16 nt, Human
agcugggacuacaggc

SEQ ID NO: 1782783 - RNA, 18 nt, Human
agcugggacuacaggcac

SEQ ID NO: 1782784 - RNA, 11 nt, Human
aggaauuuaaa

SEQ ID NO: 1782785 - RNA, 18 nt, Human
ugcuggcuguuggcuggg

SEQ ID NO: 1782786 - RNA, 13 nt, Human
ugcuggaggccuc

SEQ ID NO: 1782787 - RNA, 16 nt, Human
ugcuggaggccucagg

SEQ ID NO: 1782788 - RNA, 17 nt, Human
ugcuggaggccucaggu

SEQ ID NO: 1782789 - RNA, 20 nt, Human
ugcuggaggccucaggugcu

SEQ ID NO: 1782790 - RNA, 21 nt, Human
ugcuggaggccucaggugcug

SEQ ID NO: 1782791 - RNA, 21 nt, Human
ugcugucccauagucccugcc

SEQ ID NO: 1782792 - RNA, 22 nt, Human
aggacagggaggugaccccagg

SEQ ID NO: 1782793 - RNA, 23 nt, Human
aggacacuaaccacgcuggaccu

SEQ ID NO: 1782794 - RNA, 19 nt, Human
aggacacuaaccacgcugg

SEQ ID NO: 1782795 - RNA, 13 nt, Human
ugcuucagccucc

SEQ ID NO: 1782796 - RNA, 14 nt, Human
ugcuucagccuccc

SEQ ID NO: 1782797 - RNA, 18 nt, Human
ugcugugaacccuggggc

SEQ ID NO: 1782798 - RNA, 21 nt, Human
ugcugugaacccuggggccug

SEQ ID NO: 1782799 - RNA, 22 nt, Human
ugcugugaacccuggggccuga

SEQ ID NO: 1782800 - RNA, 15 nt, Human
uggccaggcuggucu

SEQ ID NO: 1782801 - RNA, 17 nt, Human
uggccaggcuggucuca

SEQ ID NO: 1782802 - RNA, 15 nt, Human
aggccucaacuccuc

SEQ ID NO: 1782803 - RNA, 18 nt, Human
aggccucaacuccuccca

SEQ ID NO: 1782804 - RNA, 19 nt, Human
aggccucaacuccucccau

SEQ ID NO: 1782805 - RNA, 20 nt, Human
aggccucaacuccucccaua

SEQ ID NO: 1782806 - RNA, 17 nt, Human
aggcccucgcugccagc

SEQ ID NO: 1782807 - RNA, 22 nt, Human
aggcccucgcugccagcucugu

SEQ ID NO: 1782808 - RNA, 14 nt, Human
aggccauugugaac

SEQ ID NO: 1782809 - RNA, 17 nt, Human
aggccauugugaaccaa

SEQ ID NO: 1782810 - RNA, 18 nt, Human
aggccauugugaaccaau

SEQ ID NO: 1782811 - RNA, 19 nt, Human
aggccauugugaaccaaug

SEQ ID NO: 1782812 - RNA, 20 nt, Human
aggccauugugaaccaaugc

SEQ ID NO: 1782813 - RNA, 14 nt, Human
aggccuccuggccc

SEQ ID NO: 1782814 - RNA, 14 nt, Human
aggccucaggugcu

SEQ ID NO: 1782815 - RNA, 15 nt, Human
aggccucaggugcug

SEQ ID NO: 1782816 - RNA, 19 nt, Human
aggccucaggugcugucca

SEQ ID NO: 1782817 - RNA, 21 nt, Human
aggccucaggugcuguccaug

SEQ ID NO: 1782818 - RNA, 22 nt, Human
aggccuggccagaugcaccagc

SEQ ID NO: 1782819 - RNA, 23 nt, Human
aggccuggccagaugcaccagcc

SEQ ID NO: 1782820 - RNA, 15 nt, Human
aggccuggccagaug

SEQ ID NO: 1782821 - RNA, 16 nt, Human
aggccuggccagaugc

SEQ ID NO: 1782822 - RNA, 17 nt, Human
aggccuggccagaugca

SEQ ID NO: 1782823 - RNA, 21 nt, Human
aggccuggccagaugcaccag

SEQ ID NO: 1782824 - RNA, 13 nt, Human
uggcccuagacuc

SEQ ID NO: 1782825 - RNA, 21 nt, Human
uggccccugcccggcugcgga

SEQ ID NO: 1782826 - RNA, 13 nt, Human
uggcagccuuggc

SEQ ID NO: 1782827 - RNA, 14 nt, Human
uggcacccaagacc

SEQ ID NO: 1782828 - RNA, 15 nt, Human
uggcacccggccccu

SEQ ID NO: 1782829 - RNA, 16 nt, Human
uggcacccggccccug

SEQ ID NO: 1782830 - RNA, 23 nt, Human
uggcacccaagaccucagggcac

SEQ ID NO: 1782831 - RNA, 17 nt, Human
uggauggguggauggcc

SEQ ID NO: 1782832 - RNA, 14 nt, Human
uggauggugugccu

SEQ ID NO: 1782833 - RNA, 20 nt, Human
uggaugccugguggcagcug

SEQ ID NO: 1782834 - RNA, 18 nt, Human
uggaugccugguggcagc

SEQ ID NO: 1782835 - RNA, 19 nt, Human
uggaugccugguggcagcu

SEQ ID NO: 1782836 - RNA, 16 nt, Human
aggccaaaccucuguu

SEQ ID NO: 1782837 - RNA, 17 nt, Human
aggccaaaccucuguuc

SEQ ID NO: 1782838 - RNA, 18 nt, Human
aggccaaaccucuguuca

SEQ ID NO: 1782839 - RNA, 22 nt, Human
aggccaaaccucuguucagugu

SEQ ID NO: 1782840 - RNA, 14 nt, Human
aggccaaaccucug

SEQ ID NO: 1782841 - RNA, 15 nt, Human
aggccaaaccucugu

SEQ ID NO: 1782842 - RNA, 18 nt, Human
uggacgagaaaacaauaa

SEQ ID NO: 1782843 - RNA, 19 nt, Human
aggcuccuuuagcgcccag

SEQ ID NO: 1782844 - RNA, 17 nt, Human
aggcuggcgagagucug

SEQ ID NO: 1782845 - RNA, 18 nt, Human
aggcuggcgagagucugg

SEQ ID NO: 1782846 - RNA, 19 nt, Human
aggcuggcgagagucuggc

SEQ ID NO: 1782847 - RNA, 20 nt, Human
aggcuggcgagagucuggcc

SEQ ID NO: 1782848 - RNA, 22 nt, Human
aggcuggcgagagucuggcccu

SEQ ID NO: 1782849 - RNA, 13 nt, Human
aggcuggcgugca

SEQ ID NO: 1782850 - RNA, 17 nt, Human
aggcuggcgugcagugg

SEQ ID NO: 1782851 - RNA, 12 nt, Human
aggcuggcauga

SEQ ID NO: 1782852 - RNA, 13 nt, Human
uggcuguuggcug

SEQ ID NO: 1782853 - RNA, 15 nt, Human
uggcuguuggcuggg

SEQ ID NO: 1782854 - RNA, 17 nt, Human
uggcuuaaaacaacacu

SEQ ID NO: 1782855 - RNA, 13 nt, Human
uggcugcuaacaa

SEQ ID NO: 1782856 - RNA, 15 nt, Human
uggcugcagggaguc

SEQ ID NO: 1782857 - RNA, 13 nt, Human
uggcugcagggag

SEQ ID NO: 1782858 - RNA, 14 nt, Human
uggcugcagggagu

SEQ ID NO: 1782859 - RNA, 12 nt, Human
uggcugcaaagg

SEQ ID NO: 1782860 - RNA, 18 nt, Human
uggcucaaguccucuuuu

SEQ ID NO: 1782861 - RNA, 22 nt, Human
uggcuauuagagaucaaccccu

SEQ ID NO: 1782862 - RNA, 18 nt, Human
aggcuggcgugcaguggu

SEQ ID NO: 1782863 - RNA, 20 nt, Human
aggcuggcgugcaguggugc

SEQ ID NO: 1782864 - RNA, 12 nt, Human
uucuuagaaauu

SEQ ID NO: 1782865 - RNA, 22 nt, Human
uucuuagaaauuuauuuccuag

SEQ ID NO: 1782866 - RNA, 13 nt, Human
uucuuagaaauuu

SEQ ID NO: 1782867 - RNA, 16 nt, Human
aucccaugagccucag

SEQ ID NO: 1782868 - RNA, 17 nt, Human
aucccaugagccucagc

SEQ ID NO: 1782869 - RNA, 18 nt, Human
aucccaugagccucagca

SEQ ID NO: 1782870 - RNA, 18 nt, Human
auccaucaucaugugugu

SEQ ID NO: 1782871 - RNA, 17 nt, Human
auccagguucagcuugu

SEQ ID NO: 1782872 - RNA, 15 nt, Human
uucugccugcccagg

SEQ ID NO: 1782873 - RNA, 16 nt, Human
uucugccugcccaggc

SEQ ID NO: 1782874 - RNA, 19 nt, Human
auccaagauauuuuaaaau

SEQ ID NO: 1782875 - RNA, 24 nt, Human
aucauucucugucucauccaucau

SEQ ID NO: 1782876 - RNA, 23 nt, Human
uucuccuccaugggagaaaauag

SEQ ID NO: 1782877 - RNA, 13 nt, Human
uucucuaucauuu

SEQ ID NO: 1782878 - RNA, 16 nt, Human
uucucuauaaaaaaua

SEQ ID NO: 1782879 - RNA, 18 nt, Human
uucucuauaaaaaauaug

SEQ ID NO: 1782880 - RNA, 21 nt, Human
uucucuauaaaaaauauguau

SEQ ID NO: 1782881 - RNA, 16 nt, Human
uucucuaucauuuaau

SEQ ID NO: 1782882 - RNA, 13 nt, Human
uucugaauuugca

SEQ ID NO: 1782883 - RNA, 14 nt, Human
uucugaauuugcaa

SEQ ID NO: 1782884 - RNA, 15 nt, Human
uucugaauuugcaaa

SEQ ID NO: 1782885 - RNA, 16 nt, Human
uucugaauuugcaaag

SEQ ID NO: 1782886 - RNA, 17 nt, Human
uucugaauuugcaaagu

SEQ ID NO: 1782887 - RNA, 18 nt, Human
uucugaauuugcaaagua

SEQ ID NO: 1782888 - RNA, 19 nt, Human
uucugaauuugcaaaguac

SEQ ID NO: 1782889 - RNA, 20 nt, Human
uucugaauuugcaaaguacu

SEQ ID NO: 1782890 - RNA, 21 nt, Human
uucugaauuugcaaaguacug

SEQ ID NO: 1782891 - RNA, 17 nt, Human
aucaggugcugccaucc

SEQ ID NO: 1782892 - RNA, 19 nt, Human
aucaggugcugccauccag

SEQ ID NO: 1782893 - RNA, 15 nt, Human
aucaggugcugccau

SEQ ID NO: 1782894 - RNA, 15 nt, Human
aucagugcucccuca

SEQ ID NO: 1782895 - RNA, 19 nt, Human
aucagucugauucccaagc

SEQ ID NO: 1782896 - RNA, 20 nt, Human
aucaguuacccacucggucc

SEQ ID NO: 1782897 - RNA, 22 nt, Human
aucaguuacccacucgguccca

SEQ ID NO: 1782898 - RNA, 23 nt, Human
aucaguuacccacucggucccag

SEQ ID NO: 1782899 - RNA, 12 nt, Human
aucauucucugu

SEQ ID NO: 1782900 - RNA, 14 nt, Human
aucauucucugucu

SEQ ID NO: 1782901 - RNA, 16 nt, Human
aucauucucugucuca

SEQ ID NO: 1782902 - RNA, 21 nt, Human
aucauucucugucucauccau

SEQ ID NO: 1782903 - RNA, 21 nt, Human
aucauccacugugccaugugc

SEQ ID NO: 1782904 - RNA, 18 nt, Human
aucaucauguguguccac

SEQ ID NO: 1782905 - RNA, 23 nt, Human
aucauccacugugccaugugcca

SEQ ID NO: 1782906 - RNA, 14 nt, Human
aucgugacaacacu

SEQ ID NO: 1782907 - RNA, 15 nt, Human
aucgugacaacacuu

SEQ ID NO: 1782908 - RNA, 18 nt, Human
aucuaaccucaucuucuu

SEQ ID NO: 1782909 - RNA, 13 nt, Human
aucuaaccucauc

SEQ ID NO: 1782910 - RNA, 14 nt, Human
aucuaaccucaucu

SEQ ID NO: 1782911 - RNA, 15 nt, Human
aucuaaccucaucuu

SEQ ID NO: 1782912 - RNA, 17 nt, Human
uugaauaaaaaccuuuu

SEQ ID NO: 1782913 - RNA, 21 nt, Human
auccucuuuagaguuagacug

SEQ ID NO: 1782914 - RNA, 20 nt, Human
auccucuuuagaguuagacu

SEQ ID NO: 1782915 - RNA, 19 nt, Human
auccucuuuagaguuagac

SEQ ID NO: 1782916 - RNA, 16 nt, Human
auccucuuuagaguua

SEQ ID NO: 1782917 - RNA, 23 nt, Human
auccucuuuagaguuagacuguu

SEQ ID NO: 1782918 - RNA, 22 nt, Human
auccucuuuagaguuagacugu

SEQ ID NO: 1782919 - RNA, 15 nt, Human
auccucuuuagaguu

SEQ ID NO: 1782920 - RNA, 13 nt, Human
auccucuuuagag

SEQ ID NO: 1782921 - RNA, 22 nt, Human
auccuggacaugaagauucuuu

SEQ ID NO: 1782922 - RNA, 17 nt, Human
auccuggcacccggccc

SEQ ID NO: 1782923 - RNA, 19 nt, Human
auccuggcacccggccccu

SEQ ID NO: 1782924 - RNA, 20 nt, Human
auccuggcacccggccccug

SEQ ID NO: 1782925 - RNA, 21 nt, Human
auccuggcacccggccccugc

SEQ ID NO: 1782926 - RNA, 22 nt, Human
auccuggcacccggccccugcu

SEQ ID NO: 1782927 - RNA, 23 nt, Human
auccuggcacccggccccugcug

SEQ ID NO: 1782928 - RNA, 20 nt, Human
auccuggggcauuaaaaaaa

SEQ ID NO: 1782929 - RNA, 22 nt, Human
aucggccuagggcccccacagu

SEQ ID NO: 1782930 - RNA, 12 nt, Human
uucccaggugcu

SEQ ID NO: 1782931 - RNA, 16 nt, Human
uucccaggugcuacac

SEQ ID NO: 1782932 - RNA, 13 nt, Human
auauugaauuuuu

SEQ ID NO: 1782933 - RNA, 16 nt, Human
auauugaauuuuuccu

SEQ ID NO: 1782934 - RNA, 13 nt, Human
auauuuacaaaug

SEQ ID NO: 1782935 - RNA, 15 nt, Human
aucacgccacugcac

SEQ ID NO: 1782936 - RNA, 17 nt, Human
aucacgccacugcacua

SEQ ID NO: 1782937 - RNA, 12 nt, Human
aucaacuuuuua

SEQ ID NO: 1782938 - RNA, 13 nt, Human
aucaacuuuuuau

SEQ ID NO: 1782939 - RNA, 16 nt, Human
aucaacuuuuuauugc

SEQ ID NO: 1782940 - RNA, 18 nt, Human
aucaacuuuuuauugccu

SEQ ID NO: 1782941 - RNA, 19 nt, Human
aucaacuuuuuauugccuu

SEQ ID NO: 1782942 - RNA, 15 nt, Human
uuccucucuauauuu

SEQ ID NO: 1782943 - RNA, 16 nt, Human
uuccucucuauauuuc

SEQ ID NO: 1782944 - RNA, 15 nt, Human
uuccugaaaugcagu

SEQ ID NO: 1782945 - RNA, 17 nt, Human
uuccugaaacuauauuu

SEQ ID NO: 1782946 - RNA, 20 nt, Human
uuccugaaacuauauuuugu

SEQ ID NO: 1782947 - RNA, 17 nt, Human
uuccugggaaauauucc

SEQ ID NO: 1782948 - RNA, 14 nt, Human
uuccuggccugaga

SEQ ID NO: 1782949 - RNA, 21 nt, Human
uuccugggaaauauucccuag

SEQ ID NO: 1782950 - RNA, 21 nt, Human
uuccuggcacuggaccccagc

SEQ ID NO: 1782951 - RNA, 14 nt, Human
uuccccuuuccugu

SEQ ID NO: 1782952 - RNA, 15 nt, Human
uuccccuuuccuguc

SEQ ID NO: 1782953 - RNA, 19 nt, Human
uuccccuuuccugucccac

SEQ ID NO: 1782954 - RNA, 21 nt, Human
auauuugaaucuugucucaau

SEQ ID NO: 1782955 - RNA, 19 nt, Human
auauuugaaucuugucuca

SEQ ID NO: 1782956 - RNA, 18 nt, Human
auauuugaaucuugucuc

SEQ ID NO: 1782957 - RNA, 17 nt, Human
auauuugaaucuugucu

SEQ ID NO: 1782958 - RNA, 22 nt, Human
uuccgacucuuucugagugccu

SEQ ID NO: 1782959 - RNA, 13 nt, Human
uuccgcuuggagc

SEQ ID NO: 1782960 - RNA, 19 nt, Human
uuccgcuuggagcagaggg

SEQ ID NO: 1782961 - RNA, 18 nt, Human
auauguagccuucacaca

SEQ ID NO: 1782962 - RNA, 21 nt, Human
auaugugugccuauuugugug

SEQ ID NO: 1782963 - RNA, 20 nt, Human
auaugacucacaugaugcau

SEQ ID NO: 1782964 - RNA, 13 nt, Human
auaugacucacau

SEQ ID NO: 1782965 - RNA, 16 nt, Human
auaugaauauauagug

SEQ ID NO: 1782966 - RNA, 14 nt, Human
auaugaauuguaca

SEQ ID NO: 1782967 - RNA, 15 nt, Human
auaugaauuguacag

SEQ ID NO: 1782968 - RNA, 24 nt, Human
uuccacggagccacuccucugacu

SEQ ID NO: 1782969 - RNA, 15 nt, Human
uuccacggagccacu

SEQ ID NO: 1782970 - RNA, 21 nt, Human
uuccacggagccacuccucug

SEQ ID NO: 1782971 - RNA, 22 nt, Human
uuccacggagccacuccucuga

SEQ ID NO: 1782972 - RNA, 14 nt, Human
uuccacaaagaaaa

SEQ ID NO: 1782973 - RNA, 16 nt, Human
uuccacaaagaaaauu

SEQ ID NO: 1782974 - RNA, 19 nt, Human
uuccaauucuaucuuuugu

SEQ ID NO: 1782975 - RNA, 21 nt, Human
uuccaauucuaucuuuuguuu

SEQ ID NO: 1782976 - RNA, 15 nt, Human
uucauuauuugucaa

SEQ ID NO: 1782977 - RNA, 16 nt, Human
uucauuauuugucaaa

SEQ ID NO: 1782978 - RNA, 21 nt, Human
uucauuauuugucaaauuguc

SEQ ID NO: 1782979 - RNA, 14 nt, Human
uucaggguuggccc

SEQ ID NO: 1782980 - RNA, 16 nt, Human
uucaggguuggccccu

SEQ ID NO: 1782981 - RNA, 17 nt, Human
uucaggguuggccccug

SEQ ID NO: 1782982 - RNA, 19 nt, Human
uucaggguuggccccugcc

SEQ ID NO: 1782983 - RNA, 22 nt, Human
uucaggguuggccccugcccgg

SEQ ID NO: 1782984 - RNA, 15 nt, Human
uucagguaacaggca

SEQ ID NO: 1782985 - RNA, 16 nt, Human
uucagguaacaggcag

SEQ ID NO: 1782986 - RNA, 12 nt, Human
uucagccuuaau

SEQ ID NO: 1782987 - RNA, 20 nt, Human
uucagauuguggaauguugg

SEQ ID NO: 1782988 - RNA, 22 nt, Human
uucagauuguggaauguuggau

SEQ ID NO: 1782989 - RNA, 17 nt, Human
uucacuuuugacaaagg

SEQ ID NO: 1782990 - RNA, 20 nt, Human
uucacuuuugacaaaggcaa

SEQ ID NO: 1782991 - RNA, 14 nt, Human
uucacuuucauuuu

SEQ ID NO: 1782992 - RNA, 15 nt, Human
uucacuuucauuuuu

SEQ ID NO: 1782993 - RNA, 21 nt, Human
auauauguuuuaagaggcagg

SEQ ID NO: 1782994 - RNA, 22 nt, Human
auauauguuuuaagaggcaggg

SEQ ID NO: 1782995 - RNA, 13 nt, Human
auauaugcuaagu

SEQ ID NO: 1782996 - RNA, 17 nt, Human
uucagguaacaggcaga

SEQ ID NO: 1782997 - RNA, 21 nt, Human
uucaguaacccccacuggacu

SEQ ID NO: 1782998 - RNA, 21 nt, Human
uucauaugaaaggugccaugg

SEQ ID NO: 1782999 - RNA, 23 nt, Human
uucauaugaaaggugccauggaa

SEQ ID NO: 1783000 - RNA, 22 nt, Human
uuucaccauuugauuauguagc

SEQ ID NO: 1783001 - RNA, 24 nt, Human
uuucacucuuauugcccacgcugg

SEQ ID NO: 1783002 - RNA, 20 nt, Human
uuucauaguuggggucauag

SEQ ID NO: 1783003 - RNA, 14 nt, Human
uuucauaaguauuu

SEQ ID NO: 1783004 - RNA, 17 nt, Human
uuucauaaguauuucaa

SEQ ID NO: 1783005 - RNA, 18 nt, Human
uuucauaaguauuucaaa

SEQ ID NO: 1783006 - RNA, 19 nt, Human
uuucauaaguauuucaaau

SEQ ID NO: 1783007 - RNA, 22 nt, Human
augcuggcuguuggcugggggc

SEQ ID NO: 1783008 - RNA, 15 nt, Human
uuuauuuuuuacauu

SEQ ID NO: 1783009 - RNA, 16 nt, Human
auggaauaacucugug

SEQ ID NO: 1783010 - RNA, 16 nt, Human
auggaaccaggcuugg

SEQ ID NO: 1783011 - RNA, 17 nt, Human
auggaaccaggcuugga

SEQ ID NO: 1783012 - RNA, 19 nt, Human
augcuuaucaucuaaagau

SEQ ID NO: 1783013 - RNA, 15 nt, Human
augccgauuucugua

SEQ ID NO: 1783014 - RNA, 16 nt, Human
augccgauuucuguaa

SEQ ID NO: 1783015 - RNA, 19 nt, Human
augccgauuucuguaaacu

SEQ ID NO: 1783016 - RNA, 17 nt, Human
augccgcgaugggucag

SEQ ID NO: 1783017 - RNA, 18 nt, Human
augccgcgaugggucagg

SEQ ID NO: 1783018 - RNA, 14 nt, Human
augcgcagugccuu

SEQ ID NO: 1783019 - RNA, 16 nt, Human
augcgcauucuaaccu

SEQ ID NO: 1783020 - RNA, 21 nt, Human
augcgcauucuaaccuggagg

SEQ ID NO: 1783021 - RNA, 22 nt, Human
augcgcauucuaaccuggaggu

SEQ ID NO: 1783022 - RNA, 14 nt, Human
uuuaccugcugcuu

SEQ ID NO: 1783023 - RNA, 11 nt, Human
uuuauuaaaua

SEQ ID NO: 1783024 - RNA, 12 nt, Human
uuuauuaaauaa

SEQ ID NO: 1783025 - RNA, 12 nt, Human
uuuauuaaauag

SEQ ID NO: 1783026 - RNA, 19 nt, Human
uuuauuaaauaguuaauau

SEQ ID NO: 1783027 - RNA, 23 nt, Human
uuuacuagggaucccucaucugu

SEQ ID NO: 1783028 - RNA, 18 nt, Human
uuuacuagggaucccuca

SEQ ID NO: 1783029 - RNA, 15 nt, Human
uuuacuaugccugug

SEQ ID NO: 1783030 - RNA, 15 nt, Human
uuuaguagagacagg

SEQ ID NO: 1783031 - RNA, 17 nt, Human
uuuaggguucugccucu

SEQ ID NO: 1783032 - RNA, 17 nt, Human
augggccuccugugugu

SEQ ID NO: 1783033 - RNA, 12 nt, Human
uuuccugugucu

SEQ ID NO: 1783034 - RNA, 15 nt, Human
uuuccuuccagccca

SEQ ID NO: 1783035 - RNA, 16 nt, Human
uuuccuuccagcccag

SEQ ID NO: 1783036 - RNA, 20 nt, Human
uuuccuuuuuucccauaaga

SEQ ID NO: 1783037 - RNA, 22 nt, Human
uuuccuuuuuucccauaagaca

SEQ ID NO: 1783038 - RNA, 15 nt, Human
uuuccuuuuuuaaaa

SEQ ID NO: 1783039 - RNA, 16 nt, Human
uuuccuuuuuuaaaaa

SEQ ID NO: 1783040 - RNA, 21 nt, Human
uuuccuuuuuuaaaaaugcaa

SEQ ID NO: 1783041 - RNA, 12 nt, Human
uuuccuucuuug

SEQ ID NO: 1783042 - RNA, 13 nt, Human
uuucgccuuuccu

SEQ ID NO: 1783043 - RNA, 16 nt, Human
uuucgccuuuccucuc

SEQ ID NO: 1783044 - RNA, 13 nt, Human
uuucgaggccuga

SEQ ID NO: 1783045 - RNA, 17 nt, Human
augggagccgggucugc

SEQ ID NO: 1783046 - RNA, 20 nt, Human
augggagccgggucugccuc

SEQ ID NO: 1783047 - RNA, 19 nt, Human
augggcaacccccagccug

SEQ ID NO: 1783048 - RNA, 21 nt, Human
augggcaacccccagccugcu

SEQ ID NO: 1783049 - RNA, 14 nt, Human
augggcagagccca

SEQ ID NO: 1783050 - RNA, 15 nt, Human
augggccuccugugu

SEQ ID NO: 1783051 - RNA, 13 nt, Human
uuucuuuguggcu

SEQ ID NO: 1783052 - RNA, 14 nt, Human
uuucuuuuguaaua

SEQ ID NO: 1783053 - RNA, 19 nt, Human
uuucuuuuguaauaaacua

SEQ ID NO: 1783054 - RNA, 21 nt, Human
uuucuggcagguccuccccuc

SEQ ID NO: 1783055 - RNA, 23 nt, Human
uuucuggcagguccuccccucuc

SEQ ID NO: 1783056 - RNA, 15 nt, Human
uuucugccuccuuua

SEQ ID NO: 1783057 - RNA, 17 nt, Human
uuucuauuucuccucca

SEQ ID NO: 1783058 - RNA, 19 nt, Human
uuucucagacuuuggaaaa

SEQ ID NO: 1783059 - RNA, 15 nt, Human
uuucuccagggucag

SEQ ID NO: 1783060 - RNA, 12 nt, Human
augagccucagc

SEQ ID NO: 1783061 - RNA, 15 nt, Human
augagccucagcauc

SEQ ID NO: 1783062 - RNA, 16 nt, Human
augagccucagcaucc

SEQ ID NO: 1783063 - RNA, 17 nt, Human
augagaguuuuggaugc

SEQ ID NO: 1783064 - RNA, 15 nt, Human
augagaguuuuggau

SEQ ID NO: 1783065 - RNA, 21 nt, Human
augagaguuuuggaugcagug

SEQ ID NO: 1783066 - RNA, 20 nt, Human
augagaguuuuggaugcagu

SEQ ID NO: 1783067 - RNA, 18 nt, Human
augagaguuuuggaugca

SEQ ID NO: 1783068 - RNA, 23 nt, Human
augacauacgcuuuuaaugaaaa

SEQ ID NO: 1783069 - RNA, 17 nt, Human
augagccucagcauccu

SEQ ID NO: 1783070 - RNA, 18 nt, Human
augagccucagcauccug

SEQ ID NO: 1783071 - RNA, 19 nt, Human
augagccucagcauccugg

SEQ ID NO: 1783072 - RNA, 18 nt, Human
uugucacacacuuuggcu

SEQ ID NO: 1783073 - RNA, 15 nt, Human
uugucauuagccuga

SEQ ID NO: 1783074 - RNA, 14 nt, Human
uugucauuagccug

SEQ ID NO: 1783075 - RNA, 20 nt, Human
uugucauuagccugaguaga

SEQ ID NO: 1783076 - RNA, 19 nt, Human
uugucauuagccugaguag

SEQ ID NO: 1783077 - RNA, 18 nt, Human
uugucauuagccugagua

SEQ ID NO: 1783078 - RNA, 17 nt, Human
uugucauuagccugagu

SEQ ID NO: 1783079 - RNA, 15 nt, Human
augcaaagaaaauca

SEQ ID NO: 1783080 - RNA, 19 nt, Human
uuguuuuucauucagucuu

SEQ ID NO: 1783081 - RNA, 19 nt, Human
uugugaagaaaaauaaagu

SEQ ID NO: 1783082 - RNA, 13 nt, Human
uugugaaccaaug

SEQ ID NO: 1783083 - RNA, 17 nt, Human
uugugaaccaaugcaag

SEQ ID NO: 1783084 - RNA, 23 nt, Human
uuguucccuauuuuucucuccug

SEQ ID NO: 1783085 - RNA, 12 nt, Human
uuguucucuggg

SEQ ID NO: 1783086 - RNA, 13 nt, Human
uuguucucuggga

SEQ ID NO: 1783087 - RNA, 15 nt, Human
uuguucucugggaga

SEQ ID NO: 1783088 - RNA, 20 nt, Human
uuguucucugggagaaaauc

SEQ ID NO: 1783089 - RNA, 19 nt, Human
uugugugugcucugcuuca

SEQ ID NO: 1783090 - RNA, 23 nt, Human
augaucacggcucacugcagccu

SEQ ID NO: 1783091 - RNA, 18 nt, Human
augaucacggcucacugc

SEQ ID NO: 1783092 - RNA, 19 nt, Human
augaucacggcucacugca

SEQ ID NO: 1783093 - RNA, 15 nt, Human
augaucacggcucac

SEQ ID NO: 1783094 - RNA, 20 nt, Human
uuguuggaguguuucuaaua

SEQ ID NO: 1783095 - RNA, 14 nt, Human
uuguugcggaugga

SEQ ID NO: 1783096 - RNA, 17 nt, Human
uugggguacccacugcu

SEQ ID NO: 1783097 - RNA, 20 nt, Human
augaaccacaucuugcucug

SEQ ID NO: 1783098 - RNA, 13 nt, Human
augaaccacaucu

SEQ ID NO: 1783099 - RNA, 18 nt, Human
uugguuuuuaaaacccag

SEQ ID NO: 1783100 - RNA, 23 nt, Human
uugguuuuuacuuaacuguuuca

SEQ ID NO: 1783101 - RNA, 18 nt, Human
uugguucccccacugauc

SEQ ID NO: 1783102 - RNA, 21 nt, Human
uugguucaauaaagcacugag

SEQ ID NO: 1783103 - RNA, 22 nt, Human
uugggguacccacugcucuggu

SEQ ID NO: 1783104 - RNA, 22 nt, Human
augacacuuguccccaaauccg

SEQ ID NO: 1783105 - RNA, 15 nt, Human
augacagccugcagc

SEQ ID NO: 1783106 - RNA, 16 nt, Human
augacagccugcagca

SEQ ID NO: 1783107 - RNA, 14 nt, Human
uuguauauucacuu

SEQ ID NO: 1783108 - RNA, 13 nt, Human
uuguauauucacu

SEQ ID NO: 1783109 - RNA, 13 nt, Human
uuggacccuucca

SEQ ID NO: 1783110 - RNA, 14 nt, Human
uuggacccuuccau

SEQ ID NO: 1783111 - RNA, 16 nt, Human
uuggacccuuccaugg

SEQ ID NO: 1783112 - RNA, 12 nt, Human
uuggccugggcc

SEQ ID NO: 1783113 - RNA, 22 nt, Human
uuggcuaggaccccuccaugug

SEQ ID NO: 1783114 - RNA, 23 nt, Human
uuggcuauuagagaucaaccccu

SEQ ID NO: 1783115 - RNA, 14 nt, Human
uuggcugcagggag

SEQ ID NO: 1783116 - RNA, 17 nt, Human
aucuuucaaaccagcuu

SEQ ID NO: 1783117 - RNA, 18 nt, Human
aucuuucaaaccagcuuc

SEQ ID NO: 1783118 - RNA, 14 nt, Human
augaaaugagguca

SEQ ID NO: 1783119 - RNA, 13 nt, Human
uugcuaauguugc

SEQ ID NO: 1783120 - RNA, 14 nt, Human
uugcuaauguugcu

SEQ ID NO: 1783121 - RNA, 11 nt, Human
uugcugaauag

SEQ ID NO: 1783122 - RNA, 13 nt, Human
uugcuuuugcuuc

SEQ ID NO: 1783123 - RNA, 18 nt, Human
uugcugaauaggcgauca

SEQ ID NO: 1783124 - RNA, 14 nt, Human
auuugaaucuuguc

SEQ ID NO: 1783125 - RNA, 16 nt, Human
auuugaaucuugucuc

SEQ ID NO: 1783126 - RNA, 15 nt, Human
auuugaaucuugucu

SEQ ID NO: 1783127 - RNA, 22 nt, Human
auuugaaucuugucucaaugcu

SEQ ID NO: 1783128 - RNA, 20 nt, Human
auuugaaucuugucucaaug

SEQ ID NO: 1783129 - RNA, 18 nt, Human
auuugaaucuugucucaa

SEQ ID NO: 1783130 - RNA, 22 nt, Human
auuuuaccuguuuuuguuucuu

SEQ ID NO: 1783131 - RNA, 22 nt, Human
auuuucaguuauuauauuuaca

SEQ ID NO: 1783132 - RNA, 20 nt, Human
auuuucauaaguauuucaaa

SEQ ID NO: 1783133 - RNA, 21 nt, Human
auuuucauaaguauuucaaau

SEQ ID NO: 1783134 - RNA, 22 nt, Human
auuuucauaaguauuucaaauu

SEQ ID NO: 1783135 - RNA, 21 nt, Human
auuuuccuaauaaaguucugu

SEQ ID NO: 1783136 - RNA, 22 nt, Human
auuuuccaaaaguggccucuuu

SEQ ID NO: 1783137 - RNA, 13 nt, Human
auuuucaaaagau

SEQ ID NO: 1783138 - RNA, 15 nt, Human
auuuucaaaagauaa

SEQ ID NO: 1783139 - RNA, 19 nt, Human
auuuucaaaagauaauauu

SEQ ID NO: 1783140 - RNA, 24 nt, Human
auuuucaaaagauaauauuuuaca

SEQ ID NO: 1783141 - RNA, 16 nt, Human
auugaaauauuauaga

SEQ ID NO: 1783142 - RNA, 16 nt, Human
auugaaagaauuaucc

SEQ ID NO: 1783143 - RNA, 18 nt, Human
auugggucauagaaauuc

SEQ ID NO: 1783144 - RNA, 17 nt, Human
auucugcucuauuauau

SEQ ID NO: 1783145 - RNA, 18 nt, Human
auuguccaauccuauguu

SEQ ID NO: 1783146 - RNA, 14 nt, Human
auuguauuuauuca

SEQ ID NO: 1783147 - RNA, 11 nt, Human
auuguauuuau

SEQ ID NO: 1783148 - RNA, 23 nt, Human
auuguauuuauucaauaaaguau

SEQ ID NO: 1783149 - RNA, 20 nt, Human
auuguauuuauucaauaaag

SEQ ID NO: 1783150 - RNA, 19 nt, Human
auuguauuuauucaauaaa

SEQ ID NO: 1783151 - RNA, 18 nt, Human
auuguauuuauucaauaa

SEQ ID NO: 1783152 - RNA, 16 nt, Human
auuguauuuauucaau

SEQ ID NO: 1783153 - RNA, 15 nt, Human
auuguguauauucau

SEQ ID NO: 1783154 - RNA, 14 nt, Human
auuuauucugcuca

SEQ ID NO: 1783155 - RNA, 16 nt, Human
auuuaacaaaaagugc

SEQ ID NO: 1783156 - RNA, 20 nt, Human
auuuaacaaaaagugcuuca

SEQ ID NO: 1783157 - RNA, 15 nt, Human
auuuaguuugauuau

SEQ ID NO: 1783158 - RNA, 22 nt, Human
auuuaguuugauuauucagugu

SEQ ID NO: 1783159 - RNA, 13 nt, Human
auuuauucugcuc

SEQ ID NO: 1783160 - RNA, 21 nt, Human
auuuauucauuauuugucaaa

SEQ ID NO: 1783161 - RNA, 22 nt, Human
auuuauucauuauuugucaaau

SEQ ID NO: 1783162 - RNA, 22 nt, Human
auuuauucaauaaaguauuuaa

SEQ ID NO: 1783163 - RNA, 14 nt, Human
auuuauuuauuuaa

SEQ ID NO: 1783164 - RNA, 21 nt, Human
auuuauucaauaaaguauuua

SEQ ID NO: 1783165 - RNA, 18 nt, Human
auuuauucaauaaaguau

SEQ ID NO: 1783166 - RNA, 17 nt, Human
auuuauucaauaaagua

SEQ ID NO: 1783167 - RNA, 16 nt, Human
auuuauucaauaaagu

SEQ ID NO: 1783168 - RNA, 15 nt, Human
auuuauucaauaaag

SEQ ID NO: 1783169 - RNA, 14 nt, Human
auuuauucaauaaa

SEQ ID NO: 1783170 - RNA, 13 nt, Human
auuuauucaauaa

SEQ ID NO: 1783171 - RNA, 11 nt, Human
auuuauucaau

SEQ ID NO: 1783172 - RNA, 18 nt, Human
auuucuacuuugaaguca

SEQ ID NO: 1783173 - RNA, 21 nt, Human
auuucuuuuguaauaaacuau

SEQ ID NO: 1783174 - RNA, 22 nt, Human
auuucuuuuguaauaaacuauu

SEQ ID NO: 1783175 - RNA, 17 nt, Human
auuucaaauuggagcuu

SEQ ID NO: 1783176 - RNA, 17 nt, Human
auuuccccccuccgccu

SEQ ID NO: 1783177 - RNA, 18 nt, Human
auuuccccccuccgccuc

SEQ ID NO: 1783178 - RNA, 23 nt, Human
auuuccccccuccgccuccagga

SEQ ID NO: 1783179 - RNA, 13 nt, Human
auucucaggcacc

SEQ ID NO: 1783180 - RNA, 12 nt, Human
auucuaaaugua

SEQ ID NO: 1783181 - RNA, 20 nt, Human
auucuaucuuuuguuuccuu

SEQ ID NO: 1783182 - RNA, 21 nt, Human
auucuaucuuuuguuuccuuu

SEQ ID NO: 1783183 - RNA, 20 nt, Human
auucuccugccucagccucc

SEQ ID NO: 1783184 - RNA, 19 nt, Human
auucuccugccucagccuc

SEQ ID NO: 1783185 - RNA, 15 nt, Human
auucuccugccucag

SEQ ID NO: 1783186 - RNA, 17 nt, Human
auucuccugccucagcc

SEQ ID NO: 1783187 - RNA, 11 nt, Human
auucuccugcc

SEQ ID NO: 1783188 - RNA, 14 nt, Human
auucuccugccuca

SEQ ID NO: 1783189 - RNA, 13 nt, Human
auucuccugccuc

SEQ ID NO: 1783190 - RNA, 20 nt, Human
auuccaaagcaaaaccagaa

SEQ ID NO: 1783191 - RNA, 16 nt, Human
auucccaagcucugcu

SEQ ID NO: 1783192 - RNA, 14 nt, Human
auucccaagcucug

SEQ ID NO: 1783193 - RNA, 15 nt, Human
auucccaagcucugc

SEQ ID NO: 1783194 - RNA, 12 nt, Human
auucccucccca

SEQ ID NO: 1783195 - RNA, 12 nt, Human
auucucacaaua

SEQ ID NO: 1783196 - RNA, 13 nt, Human
auucucacaauag

SEQ ID NO: 1783197 - RNA, 13 nt, Human
auguggcuccucc

SEQ ID NO: 1783198 - RNA, 22 nt, Human
augugccagguuuuuggucuga

SEQ ID NO: 1783199 - RNA, 20 nt, Human
auguugcccaggcaggucuu

SEQ ID NO: 1783200 - RNA, 22 nt, Human
auguugccccuuucucuuuucc

SEQ ID NO: 1783201 - RNA, 23 nt, Human
uuuuagaaagcauuugaaugcau

SEQ ID NO: 1783202 - RNA, 22 nt, Human
uuuuagaaagcauuugaaugca

SEQ ID NO: 1783203 - RNA, 21 nt, Human
uuuuagaaagcauuugaaugc

SEQ ID NO: 1783204 - RNA, 20 nt, Human
uuuuagaaagcauuugaaug

SEQ ID NO: 1783205 - RNA, 19 nt, Human
uuuuagaaagcauuugaau

SEQ ID NO: 1783206 - RNA, 18 nt, Human
uuuuagaaagcauuugaa

SEQ ID NO: 1783207 - RNA, 16 nt, Human
uuuuagaaagcauuug

SEQ ID NO: 1783208 - RNA, 14 nt, Human
uuuuagaaagcauu

SEQ ID NO: 1783209 - RNA, 17 nt, Human
auguugcccaggcaggu

SEQ ID NO: 1783210 - RNA, 12 nt, Human
auguugcccagg

SEQ ID NO: 1783211 - RNA, 23 nt, Human
auguuaaacuagcauaucugccu

SEQ ID NO: 1783212 - RNA, 21 nt, Human
auguuaaacuagcauaucugc

SEQ ID NO: 1783213 - RNA, 24 nt, Human
auguuaaacuagcauaucugccuu

SEQ ID NO: 1783214 - RNA, 21 nt, Human
auguuaagcccuggcaggcag

SEQ ID NO: 1783215 - RNA, 19 nt, Human
auguuaaacuagcauaucu

SEQ ID NO: 1783216 - RNA, 15 nt, Human
auguuaaacuagcau

SEQ ID NO: 1783217 - RNA, 20 nt, Human
auguucacuuuugacaaagg

SEQ ID NO: 1783218 - RNA, 22 nt, Human
auguucacuuuugacaaaggca

SEQ ID NO: 1783219 - RNA, 14 nt, Human
auguuacugccuua

SEQ ID NO: 1783220 - RNA, 19 nt, Human
auguuaaguccucccugac

SEQ ID NO: 1783221 - RNA, 23 nt, Human
uuuuccaaaaguggccucuuugu

SEQ ID NO: 1783222 - RNA, 20 nt, Human
uuuuccaaaaguggccucuu

SEQ ID NO: 1783223 - RNA, 18 nt, Human
uuuucauacuuuuaccuu

SEQ ID NO: 1783224 - RNA, 22 nt, Human
auguuguguuucuguucaccuu

SEQ ID NO: 1783225 - RNA, 16 nt, Human
auuacauguaaaacau

SEQ ID NO: 1783226 - RNA, 19 nt, Human
auuacauguaaaacauuau

SEQ ID NO: 1783227 - RNA, 11 nt, Human
uuuuuguacau

SEQ ID NO: 1783228 - RNA, 12 nt, Human
uuuuuguacaug

SEQ ID NO: 1783229 - RNA, 13 nt, Human
uuuuuauugccuu

SEQ ID NO: 1783230 - RNA, 19 nt, Human
uuuuuguagagccaggguc

SEQ ID NO: 1783231 - RNA, 20 nt, Human
uuuuuguagagccagggucu

SEQ ID NO: 1783232 - RNA, 19 nt, Human
uuuuugugaaaagcuccau

SEQ ID NO: 1783233 - RNA, 12 nt, Human
auuacuucugcu

SEQ ID NO: 1783234 - RNA, 16 nt, Human
auuacuucucuauaaa

SEQ ID NO: 1783235 - RNA, 22 nt, Human
auuacuucucuauaaaaaauau

SEQ ID NO: 1783236 - RNA, 23 nt, Human
auuagugcagccaaguagccucu

SEQ ID NO: 1783237 - RNA, 13 nt, Human
auuagugcuaagu

SEQ ID NO: 1783238 - RNA, 23 nt, Human
auuauagugauguaaucuugaau

SEQ ID NO: 1783239 - RNA, 15 nt, Human
auuagugcuaagugu

SEQ ID NO: 1783240 - RNA, 17 nt, Human
uuuugcaauaaugcagu

SEQ ID NO: 1783241 - RNA, 18 nt, Human
uuuugcaauaaugcagua

SEQ ID NO: 1783242 - RNA, 17 nt, Human
uuuugcaaccucgcugg

SEQ ID NO: 1783243 - RNA, 21 nt, Human
uuuugcaaccucgcuggacuc

SEQ ID NO: 1783244 - RNA, 23 nt, Human
uuuugccauguuggccaggcugg

SEQ ID NO: 1783245 - RNA, 13 nt, Human
uuuugcccuuuga

SEQ ID NO: 1783246 - RNA, 21 nt, Human
uuuugcagcccagacaaaugu

SEQ ID NO: 1783247 - RNA, 14 nt, Human
uuuugagcaugggu

SEQ ID NO: 1783248 - RNA, 17 nt, Human
uuuugauccaagcuggu

SEQ ID NO: 1783249 - RNA, 15 nt, Human
uuuugauagcaaagc

SEQ ID NO: 1783250 - RNA, 20 nt, Human
uuuugauagcugucccaucu

SEQ ID NO: 1783251 - RNA, 15 nt, Human
auuaaagacuccagu

SEQ ID NO: 1783252 - RNA, 17 nt, Human
auuaagccacuuaaaau

SEQ ID NO: 1783253 - RNA, 20 nt, Human
auuaagccacuuaaaauguu

SEQ ID NO: 1783254 - RNA, 14 nt, Human
uuuugcugcuucug

SEQ ID NO: 1783255 - RNA, 13 nt, Human
uuuuguuuccuuu

SEQ ID NO: 1783256 - RNA, 22 nt, Human
uuuuguuuccuuuuuucccaua

SEQ ID NO: 1783257 - RNA, 16 nt, Human
uuuuguucaaagccag

SEQ ID NO: 1783258 - RNA, 14 nt, Human
uuuuguuugguauu

SEQ ID NO: 1783259 - RNA, 22 nt, Human
uuuuguuugguauuguauuuau

SEQ ID NO: 1783260 - RNA, 19 nt, Human
uuuuguuugguauuguauu

SEQ ID NO: 1783261 - RNA, 22 nt, Human
uuuuuagacagagucucacugu

SEQ ID NO: 1783262 - RNA, 20 nt, Human
uuuuuagaaagcauuugaau

SEQ ID NO: 1783263 - RNA, 19 nt, Human
cacaggcagguccaggguu

SEQ ID NO: 1783264 - RNA, 22 nt, Human
cacagugagucgaggacaggga

SEQ ID NO: 1783265 - RNA, 19 nt, Human
cacagugggaugaaccagc

SEQ ID NO: 1783266 - RNA, 20 nt, Human
cacagugggaugaaccagcc

SEQ ID NO: 1783267 - RNA, 11 nt, Human
cacaggcaggu

SEQ ID NO: 1783268 - RNA, 14 nt, Human
cacaggcaggucca

SEQ ID NO: 1783269 - RNA, 15 nt, Human
cacaggcagguccag

SEQ ID NO: 1783270 - RNA, 21 nt, Human
cacagcuucauuuccuguguc

SEQ ID NO: 1783271 - RNA, 22 nt, Human
cacagcuucauuuccugugucu

SEQ ID NO: 1783272 - RNA, 23 nt, Human
caauucuaucuuuuguuuccuuu

SEQ ID NO: 1783273 - RNA, 21 nt, Human
cacauauuagugcagccaagu

SEQ ID NO: 1783274 - RNA, 23 nt, Human
caauguagucagaauuagcugcu

SEQ ID NO: 1783275 - RNA, 22 nt, Human
caauggggauguuguguuucug

SEQ ID NO: 1783276 - RNA, 23 nt, Human
caauucucauuugucacacacuu

SEQ ID NO: 1783277 - RNA, 12 nt, Human
caauauugaauu

SEQ ID NO: 1783278 - RNA, 14 nt, Human
caauauugaauuuu

SEQ ID NO: 1783279 - RNA, 18 nt, Human
caauauugaauuuuuccu

SEQ ID NO: 1783280 - RNA, 21 nt, Human
caauauugaauuuuuccuaug

SEQ ID NO: 1783281 - RNA, 15 nt, Human
caauauaauguuuuu

SEQ ID NO: 1783282 - RNA, 21 nt, Human
caauauaauguuuuuaauauu

SEQ ID NO: 1783283 - RNA, 23 nt, Human
caauagccgauaucagaauuugu

SEQ ID NO: 1783284 - RNA, 11 nt, Human
caauaaugcag

SEQ ID NO: 1783285 - RNA, 13 nt, Human
caauaaugcagua

SEQ ID NO: 1783286 - RNA, 17 nt, Human
caauaaugcaguauggu

SEQ ID NO: 1783287 - RNA, 20 nt, Human
caauaaugcaguaugguaca

SEQ ID NO: 1783288 - RNA, 23 nt, Human
caauaaugcaguaugguacauuu

SEQ ID NO: 1783289 - RNA, 15 nt, Human
caaccuccugggcua

SEQ ID NO: 1783290 - RNA, 14 nt, Human
caaccuccugggcu

SEQ ID NO: 1783291 - RNA, 17 nt, Human
caaccuuagauguucua

SEQ ID NO: 1783292 - RNA, 18 nt, Human
caaccuuagauguucuaa

SEQ ID NO: 1783293 - RNA, 17 nt, Human
caacgugcauugugcuu

SEQ ID NO: 1783294 - RNA, 16 nt, Human
caacgugcauugugcu

SEQ ID NO: 1783295 - RNA, 13 nt, Human
caacgugcauugu

SEQ ID NO: 1783296 - RNA, 16 nt, Human
caacccuggggaagga

SEQ ID NO: 1783297 - RNA, 22 nt, Human
caaccccuucgcuccugugucu

SEQ ID NO: 1783298 - RNA, 22 nt, Human
caacacucacauuuauucugcu

SEQ ID NO: 1783299 - RNA, 14 nt, Human
caacuuuuuauugc

SEQ ID NO: 1783300 - RNA, 16 nt, Human
caacuuuuuauugccu

SEQ ID NO: 1783301 - RNA, 17 nt, Human
caacuuuuuauugccuu

SEQ ID NO: 1783302 - RNA, 18 nt, Human
caacuuuuuauugccuuc

SEQ ID NO: 1783303 - RNA, 19 nt, Human
caacuuuuuauugccuucu

SEQ ID NO: 1783304 - RNA, 20 nt, Human
caacuuuuuauugccuucuc

SEQ ID NO: 1783305 - RNA, 21 nt, Human
caacuuuuuauugccuucuca

SEQ ID NO: 1783306 - RNA, 23 nt, Human
caacuuuuuauugccuucucacc

SEQ ID NO: 1783307 - RNA, 17 nt, Human
caagagggacgccuggg

SEQ ID NO: 1783308 - RNA, 19 nt, Human
caagagggacgccuggggg

SEQ ID NO: 1783309 - RNA, 15 nt, Human
caagcaccuccugcc

SEQ ID NO: 1783310 - RNA, 16 nt, Human
caagcaccuccugccu

SEQ ID NO: 1783311 - RNA, 17 nt, Human
caagcaccuccugccuc

SEQ ID NO: 1783312 - RNA, 12 nt, Human
caaggaagucaa

SEQ ID NO: 1783313 - RNA, 17 nt, Human
caagcuggucccacuca

SEQ ID NO: 1783314 - RNA, 19 nt, Human
caagcuggucccacucagu

SEQ ID NO: 1783315 - RNA, 23 nt, Human
caaggaggguguaauggagcauc

SEQ ID NO: 1783316 - RNA, 19 nt, Human
caagcgauucuucugcuuc

SEQ ID NO: 1783317 - RNA, 20 nt, Human
caagcgauucuucugcuuca

SEQ ID NO: 1783318 - RNA, 22 nt, Human
caagcgauucuucugcuucagc

SEQ ID NO: 1783319 - RNA, 17 nt, Human
caagcaggacagugcuu

SEQ ID NO: 1783320 - RNA, 18 nt, Human
caagcaggacagugcuug

SEQ ID NO: 1783321 - RNA, 13 nt, Human
caagccagccaac

SEQ ID NO: 1783322 - RNA, 22 nt, Human
caagccacucggcggcagcaug

SEQ ID NO: 1783323 - RNA, 14 nt, Human
caaguccucuuuuc

SEQ ID NO: 1783324 - RNA, 18 nt, Human
caagugagagcugggugu

SEQ ID NO: 1783325 - RNA, 21 nt, Human
caaguccucuuuucugagagg

SEQ ID NO: 1783326 - RNA, 14 nt, Human
caagugagagcugg

SEQ ID NO: 1783327 - RNA, 15 nt, Human
caagugagagcuggg

SEQ ID NO: 1783328 - RNA, 17 nt, Human
caagugagagcugggug

SEQ ID NO: 1783329 - RNA, 22 nt, Human
auuuugggguacccacugcucu

SEQ ID NO: 1783330 - RNA, 23 nt, Human
auuuugggguacccacugcucug

SEQ ID NO: 1783331 - RNA, 21 nt, Human
auuuugggguacccacugcuc

SEQ ID NO: 1783332 - RNA, 18 nt, Human
auuuuggggauuuucaaa

SEQ ID NO: 1783333 - RNA, 14 nt, Human
caaaaauuuuguga

SEQ ID NO: 1783334 - RNA, 16 nt, Human
caaaaauuuugugaca

SEQ ID NO: 1783335 - RNA, 17 nt, Human
caaaaauuuugugacau

SEQ ID NO: 1783336 - RNA, 14 nt, Human
caaaaaucugccug

SEQ ID NO: 1783337 - RNA, 16 nt, Human
caaaaaucugccuggg

SEQ ID NO: 1783338 - RNA, 15 nt, Human
caaaaagugcuucau

SEQ ID NO: 1783339 - RNA, 12 nt, Human
caaaaagcacau

SEQ ID NO: 1783340 - RNA, 22 nt, Human
caaaacugccucaggaggcagg

SEQ ID NO: 1783341 - RNA, 23 nt, Human
caaagugcugggauuacaggugu

SEQ ID NO: 1783342 - RNA, 19 nt, Human
caaagugcugggauuacag

SEQ ID NO: 1783343 - RNA, 19 nt, Human
caaaggguaucaggugcug

SEQ ID NO: 1783344 - RNA, 21 nt, Human
caaauuuauuuuuuucuuuug

SEQ ID NO: 1783345 - RNA, 16 nt, Human
caaagccaagaccuca

SEQ ID NO: 1783346 - RNA, 20 nt, Human
caaagccagcguccuccucu

SEQ ID NO: 1783347 - RNA, 21 nt, Human
caaagccagcguccuccucug

SEQ ID NO: 1783348 - RNA, 23 nt, Human
caaagccagcguccuccucugug

SEQ ID NO: 1783349 - RNA, 22 nt, Human
caaagccagcguccuccucugu

SEQ ID NO: 1783350 - RNA, 19 nt, Human
caaacuagggccaagccca

SEQ ID NO: 1783351 - RNA, 13 nt, Human
caaacuagggcca

SEQ ID NO: 1783352 - RNA, 18 nt, Human
caaacgcugccugcccac

SEQ ID NO: 1783353 - RNA, 16 nt, Human
caaacugguauucugu

SEQ ID NO: 1783354 - RNA, 19 nt, Human
caaacugguauucuguucu

SEQ ID NO: 1783355 - RNA, 21 nt, Human
caaacugguauucuguucugg

SEQ ID NO: 1783356 - RNA, 16 nt, Human
caaaggguaucaggug

SEQ ID NO: 1783357 - RNA, 18 nt, Human
caaaggguaucaggugcu

SEQ ID NO: 1783358 - RNA, 13 nt, Human
caaagcuaggccu

SEQ ID NO: 1783359 - RNA, 14 nt, Human
caaagcuaggccug

SEQ ID NO: 1783360 - RNA, 19 nt, Human
caaagcuaggccuggccag

SEQ ID NO: 1783361 - RNA, 15 nt, Human
caaagcuaggccugg

SEQ ID NO: 1783362 - RNA, 11 nt, Human
caaaccucugu

SEQ ID NO: 1783363 - RNA, 12 nt, Human
caaaccucuguu

SEQ ID NO: 1783364 - RNA, 20 nt, Human
caaaccucuguucaguguaa

SEQ ID NO: 1783365 - RNA, 13 nt, Human
caaaccucuguuc

SEQ ID NO: 1783366 - RNA, 14 nt, Human
caaaccucuguuca

SEQ ID NO: 1783367 - RNA, 15 nt, Human
caaaccucuguucag

SEQ ID NO: 1783368 - RNA, 19 nt, Human
caaaccucuguucagugua

SEQ ID NO: 1783369 - RNA, 20 nt, Human
caaacgcugagccaccugcc

SEQ ID NO: 1783370 - RNA, 12 nt, Human
caaacgcugccu

SEQ ID NO: 1783371 - RNA, 13 nt, Human
caaacgcugccug

SEQ ID NO: 1783372 - RNA, 14 nt, Human
caaacgcugccugc

SEQ ID NO: 1783373 - RNA, 15 nt, Human
caaacgcugccugcc

SEQ ID NO: 1783374 - RNA, 16 nt, Human
caaacgcugccugccc

SEQ ID NO: 1783375 - RNA, 17 nt, Human
caaacgcugccugccca

SEQ ID NO: 1783376 - RNA, 19 nt, Human
caaaauuuauuuuauaaga

SEQ ID NO: 1783377 - RNA, 20 nt, Human
caaaauuuauuuuauaagaa

SEQ ID NO: 1783378 - RNA, 16 nt, Human
caaaauucuaaaugua

SEQ ID NO: 1783379 - RNA, 16 nt, Human
caaaauggauacauaa

SEQ ID NO: 1783380 - RNA, 17 nt, Human
caaaauggauacauaaa

SEQ ID NO: 1783381 - RNA, 19 nt, Human
caaaauggauacauaaaga

SEQ ID NO: 1783382 - RNA, 15 nt, Human
caaaauggcuucagu

SEQ ID NO: 1783383 - RNA, 18 nt, Human
caaaauguagaauauuca

SEQ ID NO: 1783384 - RNA, 15 nt, Human
cacuggaccccagca

SEQ ID NO: 1783385 - RNA, 17 nt, Human
cacuggaccccagcaag

SEQ ID NO: 1783386 - RNA, 17 nt, Human
cacuggacugaccuggu

SEQ ID NO: 1783387 - RNA, 16 nt, Human
cacuggacugaccugg

SEQ ID NO: 1783388 - RNA, 21 nt, Human
cacugcuuuuggucuguguga

SEQ ID NO: 1783389 - RNA, 15 nt, Human
cacugcuugaggaaa

SEQ ID NO: 1783390 - RNA, 19 nt, Human
cacuggaugcaaagaaaau

SEQ ID NO: 1783391 - RNA, 23 nt, Human
cacuggaugcaaagaaaaucaga

SEQ ID NO: 1783392 - RNA, 20 nt, Human
cacugcuuuuggucugugug

SEQ ID NO: 1783393 - RNA, 13 nt, Human
cacugcuugagga

SEQ ID NO: 1783394 - RNA, 14 nt, Human
cacugcuugaggaa

SEQ ID NO: 1783395 - RNA, 20 nt, Human
cacugcuugaggaaaacaag

SEQ ID NO: 1783396 - RNA, 14 nt, Human
cacugcaccgggcc

SEQ ID NO: 1783397 - RNA, 15 nt, Human
cacugcaccgggcca

SEQ ID NO: 1783398 - RNA, 16 nt, Human
cacugcaccgggccac

SEQ ID NO: 1783399 - RNA, 18 nt, Human
cacugcaccgggccacag

SEQ ID NO: 1783400 - RNA, 19 nt, Human
cacugcaccgggccacaga

SEQ ID NO: 1783401 - RNA, 18 nt, Human
cacugcacuauagccuag

SEQ ID NO: 1783402 - RNA, 12 nt, Human
cacugcucuggu

SEQ ID NO: 1783403 - RNA, 15 nt, Human
cacucugucgcccag

SEQ ID NO: 1783404 - RNA, 16 nt, Human
cacucugucgcccagu

SEQ ID NO: 1783405 - RNA, 19 nt, Human
cacucugucgcccagucug

SEQ ID NO: 1783406 - RNA, 23 nt, Human
cacugacauuguuggccaaagcc

SEQ ID NO: 1783407 - RNA, 20 nt, Human
cacucugucgcccagucugg

SEQ ID NO: 1783408 - RNA, 23 nt, Human
cacugcaaccuccgccucuuggg

SEQ ID NO: 1783409 - RNA, 14 nt, Human
cacugcaaccuccg

SEQ ID NO: 1783410 - RNA, 16 nt, Human
cacugcaaccuccgcc

SEQ ID NO: 1783411 - RNA, 13 nt, Human
cacugcaaccucc

SEQ ID NO: 1783412 - RNA, 14 nt, Human
cacugaugggcaac

SEQ ID NO: 1783413 - RNA, 18 nt, Human
cacugaugggcaaccccc

SEQ ID NO: 1783414 - RNA, 24 nt, Human
cacugaugggcaacccccagccug

SEQ ID NO: 1783415 - RNA, 14 nt, Human
cacugagggcaguc

SEQ ID NO: 1783416 - RNA, 18 nt, Human
cacugagauaccagcgag

SEQ ID NO: 1783417 - RNA, 19 nt, Human
cacugagauaccagcgagg

SEQ ID NO: 1783418 - RNA, 23 nt, Human
cacugagauaccagcgaggaggc

SEQ ID NO: 1783419 - RNA, 14 nt, Human
cacugugccaugug

SEQ ID NO: 1783420 - RNA, 16 nt, Human
cacugugagcucccag

SEQ ID NO: 1783421 - RNA, 17 nt, Human
cacugugagcucccagg

SEQ ID NO: 1783422 - RNA, 17 nt, Human
cacuguauguuauagaa

SEQ ID NO: 1783423 - RNA, 20 nt, Human
cacuguauguuauagaacuu

SEQ ID NO: 1783424 - RNA, 17 nt, Human
cacuguucccccugugc

SEQ ID NO: 1783425 - RNA, 19 nt, Human
cacuguucccccugugcag

SEQ ID NO: 1783426 - RNA, 18 nt, Human
cacugugccaugugccag

SEQ ID NO: 1783427 - RNA, 20 nt, Human
cacugugcacaucugugucu

SEQ ID NO: 1783428 - RNA, 22 nt, Human
cacugugagcucccaggugcag

SEQ ID NO: 1783429 - RNA, 22 nt, Human
cacugugcacaucugugucuug

SEQ ID NO: 1783430 - RNA, 15 nt, Human
cacugugccaugugc

SEQ ID NO: 1783431 - RNA, 16 nt, Human
cacugugccaugugcc

SEQ ID NO: 1783432 - RNA, 13 nt, Human
cacuugcagacuc

SEQ ID NO: 1783433 - RNA, 24 nt, Human
cacuugcagacucuacagaggcca

SEQ ID NO: 1783434 - RNA, 12 nt, Human
cacuugcauuuc

SEQ ID NO: 1783435 - RNA, 14 nt, Human
cacuugcagacucu

SEQ ID NO: 1783436 - RNA, 18 nt, Human
cacuugcagacucuacag

SEQ ID NO: 1783437 - RNA, 19 nt, Human
cacuugcagacucuacaga

SEQ ID NO: 1783438 - RNA, 22 nt, Human
cacuugcagacucuacagaggc

SEQ ID NO: 1783439 - RNA, 22 nt, Human
cacuucugccauauucuguugg

SEQ ID NO: 1783440 - RNA, 13 nt, Human
cacuucucuuccu

SEQ ID NO: 1783441 - RNA, 19 nt, Human
cacuucguucgcagagcuu

SEQ ID NO: 1783442 - RNA, 20 nt, Human
cacuucguucgcagagcuuu

SEQ ID NO: 1783443 - RNA, 14 nt, Human
cacuguugcccagg

SEQ ID NO: 1783444 - RNA, 13 nt, Human
cacgccacugcac

SEQ ID NO: 1783445 - RNA, 19 nt, Human
cacgcaggagcacacccag

SEQ ID NO: 1783446 - RNA, 20 nt, Human
cacgcaggagcacacccagc

SEQ ID NO: 1783447 - RNA, 12 nt, Human
cacgcaggagca

SEQ ID NO: 1783448 - RNA, 15 nt, Human
cacgccacugcacua

SEQ ID NO: 1783449 - RNA, 13 nt, Human
cacgcaccugggu

SEQ ID NO: 1783450 - RNA, 20 nt, Human
cacgagcuguuuacuaggga

SEQ ID NO: 1783451 - RNA, 18 nt, Human
caccuugacagggcacac

SEQ ID NO: 1783452 - RNA, 15 nt, Human
caccuugacagggca

SEQ ID NO: 1783453 - RNA, 16 nt, Human
caccuugacagggcac

SEQ ID NO: 1783454 - RNA, 13 nt, Human
caccuugacaggg

SEQ ID NO: 1783455 - RNA, 21 nt, Human
caccuucguuuacuaugccug

SEQ ID NO: 1783456 - RNA, 22 nt, Human
caccuucguuuacuaugccugu

SEQ ID NO: 1783457 - RNA, 23 nt, Human
caccuucguuuacuaugccugug

SEQ ID NO: 1783458 - RNA, 17 nt, Human
cacgaauuucugugccc

SEQ ID NO: 1783459 - RNA, 23 nt, Human
cacgaauuucugugcccuccuga

SEQ ID NO: 1783460 - RNA, 13 nt, Human
cacgacugucucc

SEQ ID NO: 1783461 - RNA, 16 nt, Human
cacgacugucuccaug

SEQ ID NO: 1783462 - RNA, 14 nt, Human
caccuuaauaugcu

SEQ ID NO: 1783463 - RNA, 23 nt, Human
caccuuaauaugcugcaacaaaa

SEQ ID NO: 1783464 - RNA, 23 nt, Human
caccuucaguaacccccacugga

SEQ ID NO: 1783465 - RNA, 19 nt, Human
caccugugaguuuaaagca

SEQ ID NO: 1783466 - RNA, 20 nt, Human
caccugugaguuuaaagcaa

SEQ ID NO: 1783467 - RNA, 19 nt, Human
caccugugcuucgggcccu

SEQ ID NO: 1783468 - RNA, 21 nt, Human
cacgccugcaaacgcugccug

SEQ ID NO: 1783469 - RNA, 22 nt, Human
cacgccugcaaacgcugccugc

SEQ ID NO: 1783470 - RNA, 23 nt, Human
cacgccugcaaacgcugccugcc

SEQ ID NO: 1783471 - RNA, 17 nt, Human
cacgccugcaaacgcug

SEQ ID NO: 1783472 - RNA, 23 nt, Human
cacgcgugcacacaccagagccc

SEQ ID NO: 1783473 - RNA, 15 nt, Human
cacgcgugcacacac

SEQ ID NO: 1783474 - RNA, 16 nt, Human
cacgcgugcacacacc

SEQ ID NO: 1783475 - RNA, 21 nt, Human
cacgcgugcacacaccagagc

SEQ ID NO: 1783476 - RNA, 20 nt, Human
cacgcuggaccuugaacugg

SEQ ID NO: 1783477 - RNA, 17 nt, Human
cacgcuggaccuugaac

SEQ ID NO: 1783478 - RNA, 16 nt, Human
cacggcucacugcagc

SEQ ID NO: 1783479 - RNA, 17 nt, Human
cacggcucacugcagcc

SEQ ID NO: 1783480 - RNA, 19 nt, Human
cacggcucacugcagccuc

SEQ ID NO: 1783481 - RNA, 20 nt, Human
cacggcucacugcagccuca

SEQ ID NO: 1783482 - RNA, 16 nt, Human
cacgugcagcucaagg

SEQ ID NO: 1783483 - RNA, 18 nt, Human
cacguacacacacauaca

SEQ ID NO: 1783484 - RNA, 19 nt, Human
cacguacacacacauacac

SEQ ID NO: 1783485 - RNA, 14 nt, Human
cacguacacacaca

SEQ ID NO: 1783486 - RNA, 16 nt, Human
cacguguuugugcugu

SEQ ID NO: 1783487 - RNA, 19 nt, Human
cacguuagaggaaaaauau

SEQ ID NO: 1783488 - RNA, 13 nt, Human
cacuaaacaaaga

SEQ ID NO: 1783489 - RNA, 18 nt, Human
cacguuuuguuuugugcc

SEQ ID NO: 1783490 - RNA, 15 nt, Human
cacguuuuguuuugu

SEQ ID NO: 1783491 - RNA, 12 nt, Human
cacuaaagcagu

SEQ ID NO: 1783492 - RNA, 22 nt, Human
cacucagaagacacugaugggc

SEQ ID NO: 1783493 - RNA, 18 nt, Human
cacucagaagacacugau

SEQ ID NO: 1783494 - RNA, 19 nt, Human
cacucagaagacacugaug

SEQ ID NO: 1783495 - RNA, 19 nt, Human
cacucacauuuauucugcu

SEQ ID NO: 1783496 - RNA, 20 nt, Human
cacucacauuuauucugcuc

SEQ ID NO: 1783497 - RNA, 12 nt, Human
cacucagaagac

SEQ ID NO: 1783498 - RNA, 16 nt, Human
cacucagaagacacug

SEQ ID NO: 1783499 - RNA, 17 nt, Human
cacucagaagacacuga

SEQ ID NO: 1783500 - RNA, 20 nt, Human
cacuauguugcccaggcagg

SEQ ID NO: 1783501 - RNA, 21 nt, Human
cacuauguugcccaggcaggu

SEQ ID NO: 1783502 - RNA, 15 nt, Human
cacuauguugcccag

SEQ ID NO: 1783503 - RNA, 15 nt, Human
cacuaugcuuuccuu

SEQ ID NO: 1783504 - RNA, 16 nt, Human
cacuauguugcccagg

SEQ ID NO: 1783505 - RNA, 17 nt, Human
cacuauguugcccaggc

SEQ ID NO: 1783506 - RNA, 18 nt, Human
cacuauguugcccaggca

SEQ ID NO: 1783507 - RNA, 19 nt, Human
cacuauguugcccaggcag

SEQ ID NO: 1783508 - RNA, 14 nt, Human
cacuauagccuagg

SEQ ID NO: 1783509 - RNA, 21 nt, Human
cacuauagccuaggugacaga

SEQ ID NO: 1783510 - RNA, 14 nt, Human
cacuaaccacgcug

SEQ ID NO: 1783511 - RNA, 15 nt, Human
cacuaaccacgcugg

SEQ ID NO: 1783512 - RNA, 16 nt, Human
cacuaaccacgcugga

SEQ ID NO: 1783513 - RNA, 17 nt, Human
cacuaaggugugcucug

SEQ ID NO: 1783514 - RNA, 18 nt, Human
cacuaaggugugcucuga

SEQ ID NO: 1783515 - RNA, 18 nt, Human
cacuaaccacgcuggacc

SEQ ID NO: 1783516 - RNA, 16 nt, Human
cacucaguccauagca

SEQ ID NO: 1783517 - RNA, 13 nt, Human
cacucccuugggc

SEQ ID NO: 1783518 - RNA, 16 nt, Human
cacucccuugggcucc

SEQ ID NO: 1783519 - RNA, 20 nt, Human
cacucccuugggcucccugu

SEQ ID NO: 1783520 - RNA, 13 nt, Human
cacuccugccaag

SEQ ID NO: 1783521 - RNA, 14 nt, Human
cacuccugccaagg

SEQ ID NO: 1783522 - RNA, 12 nt, Human
cacuccucugac

SEQ ID NO: 1783523 - RNA, 13 nt, Human
cacuccucugacu

SEQ ID NO: 1783524 - RNA, 20 nt, Human
cacuccucugacucagggcu

SEQ ID NO: 1783525 - RNA, 21 nt, Human
cacuccucugacucagggcuc

SEQ ID NO: 1783526 - RNA, 23 nt, Human
cacuccucugacucagggcuccu

SEQ ID NO: 1783527 - RNA, 15 nt, Human
cacucucuaccagau

SEQ ID NO: 1783528 - RNA, 11 nt, Human
cacucugcccc

SEQ ID NO: 1783529 - RNA, 18 nt, Human
cacucugcucgccuuagc

SEQ ID NO: 1783530 - RNA, 23 nt, Human
cacucugccccccccccccaucu

SEQ ID NO: 1783531 - RNA, 15 nt, Human
cacucugcucgccuu

SEQ ID NO: 1783532 - RNA, 16 nt, Human
cacucugcuuguuauu

SEQ ID NO: 1783533 - RNA, 22 nt, Human
cacucggcggcagcauggagcu

SEQ ID NO: 1783534 - RNA, 12 nt, Human
cacucgguccca

SEQ ID NO: 1783535 - RNA, 14 nt, Human
cacucggucccagu

SEQ ID NO: 1783536 - RNA, 20 nt, Human
cacucggucccaguuuuguu

SEQ ID NO: 1783537 - RNA, 15 nt, Human
cacccuuuuccagcu

SEQ ID NO: 1783538 - RNA, 17 nt, Human
cacccuuuuccagcugg

SEQ ID NO: 1783539 - RNA, 21 nt, Human
cacccuuuuccagcuggauga

SEQ ID NO: 1783540 - RNA, 12 nt, Human
cacccggccccu

SEQ ID NO: 1783541 - RNA, 13 nt, Human
cacccggccccug

SEQ ID NO: 1783542 - RNA, 14 nt, Human
cacccggccccugc

SEQ ID NO: 1783543 - RNA, 16 nt, Human
cacccggccccugcug

SEQ ID NO: 1783544 - RNA, 17 nt, Human
cacccggccccugcugg

SEQ ID NO: 1783545 - RNA, 18 nt, Human
cacccggccccugcuggu

SEQ ID NO: 1783546 - RNA, 21 nt, Human
cacccggccccugcugguuca

SEQ ID NO: 1783547 - RNA, 13 nt, Human
caccccuccccau

SEQ ID NO: 1783548 - RNA, 18 nt, Human
caccccuggaagagccca

SEQ ID NO: 1783549 - RNA, 19 nt, Human
caccccuggaagagcccag

SEQ ID NO: 1783550 - RNA, 20 nt, Human
caccccuggaagagcccagu

SEQ ID NO: 1783551 - RNA, 16 nt, Human
caccugcaucuggggc

SEQ ID NO: 1783552 - RNA, 17 nt, Human
caccugcaucuggggcc

SEQ ID NO: 1783553 - RNA, 15 nt, Human
caccugccacccugg

SEQ ID NO: 1783554 - RNA, 20 nt, Human
caccugccacccugggccug

SEQ ID NO: 1783555 - RNA, 23 nt, Human
caccugccacccugggccuggca

SEQ ID NO: 1783556 - RNA, 15 nt, Human
caccugauucaacua

SEQ ID NO: 1783557 - RNA, 16 nt, Human
caccugauucaacuaa

SEQ ID NO: 1783558 - RNA, 17 nt, Human
caccugauucaacuaaa

SEQ ID NO: 1783559 - RNA, 18 nt, Human
caccugauucaacuaaaa

SEQ ID NO: 1783560 - RNA, 19 nt, Human
caccugauucaacuaaaaa

SEQ ID NO: 1783561 - RNA, 21 nt, Human
caccugauucaacuaaaaaaa

SEQ ID NO: 1783562 - RNA, 16 nt, Human
caccugagcaggaccu

SEQ ID NO: 1783563 - RNA, 19 nt, Human
caccugagcaggaccucug

SEQ ID NO: 1783564 - RNA, 20 nt, Human
caccugagcaggaccucuga

SEQ ID NO: 1783565 - RNA, 21 nt, Human
caccugagcaggaccucugaa

SEQ ID NO: 1783566 - RNA, 23 nt, Human
caccugaagacucauucuucugu

SEQ ID NO: 1783567 - RNA, 14 nt, Human
caccugaagacuca

SEQ ID NO: 1783568 - RNA, 15 nt, Human
caccugaagacucau

SEQ ID NO: 1783569 - RNA, 13 nt, Human
caccucuuccgac

SEQ ID NO: 1783570 - RNA, 14 nt, Human
caccuccugccucg

SEQ ID NO: 1783571 - RNA, 13 nt, Human
caccuccugccuc

SEQ ID NO: 1783572 - RNA, 11 nt, Human
caccuccugcc

SEQ ID NO: 1783573 - RNA, 16 nt, Human
caccuccacauccucc

SEQ ID NO: 1783574 - RNA, 17 nt, Human
caccuccacauccucca

SEQ ID NO: 1783575 - RNA, 14 nt, Human
caccuccagccuga

SEQ ID NO: 1783576 - RNA, 13 nt, Human
caccgugggcucc

SEQ ID NO: 1783577 - RNA, 17 nt, Human
caccgugggcucccuga

SEQ ID NO: 1783578 - RNA, 18 nt, Human
caccgugggcucccugac

SEQ ID NO: 1783579 - RNA, 15 nt, Human
caccgggcacucaga

SEQ ID NO: 1783580 - RNA, 22 nt, Human
caccgggcacucagaagacacu

SEQ ID NO: 1783581 - RNA, 15 nt, Human
caccgggccacagag

SEQ ID NO: 1783582 - RNA, 18 nt, Human
caccgggccacagagaaa

SEQ ID NO: 1783583 - RNA, 14 nt, Human
caccgggcacucag

SEQ ID NO: 1783584 - RNA, 22 nt, Human
caccggccccauuuacccaacu

SEQ ID NO: 1783585 - RNA, 15 nt, Human
cagagcccaccuugg

SEQ ID NO: 1783586 - RNA, 17 nt, Human
cagagcccaccuuggcu

SEQ ID NO: 1783587 - RNA, 19 nt, Human
cagagcccaccuuggcuca

SEQ ID NO: 1783588 - RNA, 20 nt, Human
cagagcccaccuuggcucaa

SEQ ID NO: 1783589 - RNA, 12 nt, Human
cagagccugcag

SEQ ID NO: 1783590 - RNA, 20 nt, Human
cagagccgugguccuuuggg

SEQ ID NO: 1783591 - RNA, 19 nt, Human
cagagccgugguccuuugg

SEQ ID NO: 1783592 - RNA, 16 nt, Human
cagaggaaggggccag

SEQ ID NO: 1783593 - RNA, 13 nt, Human
cagagccugcagu

SEQ ID NO: 1783594 - RNA, 21 nt, Human
cagaggacugugaugcccugc

SEQ ID NO: 1783595 - RNA, 11 nt, Human
cagaggcagcc

SEQ ID NO: 1783596 - RNA, 23 nt, Human
cagaggaugagcucuacccaggg

SEQ ID NO: 1783597 - RNA, 15 nt, Human
cagaggaugagcucu

SEQ ID NO: 1783598 - RNA, 17 nt, Human
cagaggaugagcucuac

SEQ ID NO: 1783599 - RNA, 19 nt, Human
cagaggaugagcucuaccc

SEQ ID NO: 1783600 - RNA, 21 nt, Human
cagaggaugagcucuacccag

SEQ ID NO: 1783601 - RNA, 18 nt, Human
cagaggaaggggccagag

SEQ ID NO: 1783602 - RNA, 19 nt, Human
cagaggaaggggccagagg

SEQ ID NO: 1783603 - RNA, 20 nt, Human
cagaggaaggggccagaggc

SEQ ID NO: 1783604 - RNA, 21 nt, Human
cagaggaaggggccagaggcu

SEQ ID NO: 1783605 - RNA, 14 nt, Human
cagaggacugugau

SEQ ID NO: 1783606 - RNA, 19 nt, Human
cagagaaugaaagggccca

SEQ ID NO: 1783607 - RNA, 20 nt, Human
cagagaaugaaagggcccag

SEQ ID NO: 1783608 - RNA, 21 nt, Human
cagagaaugaaagggcccaga

SEQ ID NO: 1783609 - RNA, 19 nt, Human
cagagaagcucucgggcua

SEQ ID NO: 1783610 - RNA, 14 nt, Human
cagagauucauuuu

SEQ ID NO: 1783611 - RNA, 19 nt, Human
cagagauucauuuucuaga

SEQ ID NO: 1783612 - RNA, 21 nt, Human
cagagauucauuuucuagaua

SEQ ID NO: 1783613 - RNA, 19 nt, Human
cagaggcccucgcugccag

SEQ ID NO: 1783614 - RNA, 20 nt, Human
cagaggcccucgcugccagc

SEQ ID NO: 1783615 - RNA, 14 nt, Human
cagaggcugcccca

SEQ ID NO: 1783616 - RNA, 14 nt, Human
cagagggagugaca

SEQ ID NO: 1783617 - RNA, 16 nt, Human
cagagggagugacaga

SEQ ID NO: 1783618 - RNA, 18 nt, Human
cagagggagugacagagg

SEQ ID NO: 1783619 - RNA, 19 nt, Human
cagagggagugacagaggc

SEQ ID NO: 1783620 - RNA, 23 nt, Human
cagaggcagccccauucugccug

SEQ ID NO: 1783621 - RNA, 21 nt, Human
cagaggauugcugccccauca

SEQ ID NO: 1783622 - RNA, 19 nt, Human
cagaggccaugggccuccu

SEQ ID NO: 1783623 - RNA, 16 nt, Human
cagaggccaugggccu

SEQ ID NO: 1783624 - RNA, 20 nt, Human
cagaggccaugggccuccug

SEQ ID NO: 1783625 - RNA, 21 nt, Human
cagaggccaugggccuccugu

SEQ ID NO: 1783626 - RNA, 12 nt, Human
cagaggcagccc

SEQ ID NO: 1783627 - RNA, 13 nt, Human
cagaggcagcccc

SEQ ID NO: 1783628 - RNA, 14 nt, Human
cagaggcagcccca

SEQ ID NO: 1783629 - RNA, 15 nt, Human
cagaggcagccccau

SEQ ID NO: 1783630 - RNA, 18 nt, Human
cagaggcagccccauucu

SEQ ID NO: 1783631 - RNA, 19 nt, Human
cagaggcagccccauucug

SEQ ID NO: 1783632 - RNA, 20 nt, Human
cagaggcagccccauucugc

SEQ ID NO: 1783633 - RNA, 22 nt, Human
cagaggcagccccauucugccu

SEQ ID NO: 1783634 - RNA, 13 nt, Human
cagagucucacug

SEQ ID NO: 1783635 - RNA, 13 nt, Human
cagaguccuggag

SEQ ID NO: 1783636 - RNA, 17 nt, Human
cagagucucacuguugc

SEQ ID NO: 1783637 - RNA, 19 nt, Human
cagagucucacuguugccc

SEQ ID NO: 1783638 - RNA, 20 nt, Human
cagagucucacuguugccca

SEQ ID NO: 1783639 - RNA, 21 nt, Human
cagagucucacuguugcccag

SEQ ID NO: 1783640 - RNA, 14 nt, Human
cagagggcacucug

SEQ ID NO: 1783641 - RNA, 20 nt, Human
cagagggagugacagaggca

SEQ ID NO: 1783642 - RNA, 21 nt, Human
cagagggagugacagaggcag

SEQ ID NO: 1783643 - RNA, 22 nt, Human
cagagggagugacagaggcagc

SEQ ID NO: 1783644 - RNA, 23 nt, Human
cagagggagugacagaggcagcc

SEQ ID NO: 1783645 - RNA, 14 nt, Human
cagagugagaccca

SEQ ID NO: 1783646 - RNA, 15 nt, Human
cagagugagacccag

SEQ ID NO: 1783647 - RNA, 22 nt, Human
cagagucucacuguugcccagg

SEQ ID NO: 1783648 - RNA, 23 nt, Human
cagagucucacuguugcccaggc

SEQ ID NO: 1783649 - RNA, 16 nt, Human
cagagugagacucugu

SEQ ID NO: 1783650 - RNA, 17 nt, Human
cagagugagacccagcc

SEQ ID NO: 1783651 - RNA, 20 nt, Human
cagagugagacccagcccuc

SEQ ID NO: 1783652 - RNA, 17 nt, Human
cagagugagacucuguc

SEQ ID NO: 1783653 - RNA, 18 nt, Human
cagagugagacucugucu

SEQ ID NO: 1783654 - RNA, 19 nt, Human
cagagugagacucugucuc

SEQ ID NO: 1783655 - RNA, 20 nt, Human
cagagugagacucugucuca

SEQ ID NO: 1783656 - RNA, 14 nt, Human
cagauaacugagga

SEQ ID NO: 1783657 - RNA, 13 nt, Human
cagauaacugagg

SEQ ID NO: 1783658 - RNA, 20 nt, Human
cagauaacugaggaggggag

SEQ ID NO: 1783659 - RNA, 13 nt, Human
cagauaaugugaa

SEQ ID NO: 1783660 - RNA, 14 nt, Human
cagauaaugugaaa

SEQ ID NO: 1783661 - RNA, 16 nt, Human
cagauaaugugaaaau

SEQ ID NO: 1783662 - RNA, 20 nt, Human
cagauacaggaaaagcugcu

SEQ ID NO: 1783663 - RNA, 21 nt, Human
cagauacaggaaaagcugcug

SEQ ID NO: 1783664 - RNA, 22 nt, Human
cagauacaggaaaagcugcuga

SEQ ID NO: 1783665 - RNA, 23 nt, Human
cagaucuggggcagcacccuaua

SEQ ID NO: 1783666 - RNA, 17 nt, Human
cagaugcaccagcccuu

SEQ ID NO: 1783667 - RNA, 22 nt, Human
cagaugcaccagcccuuagcag

SEQ ID NO: 1783668 - RNA, 13 nt, Human
cagaugcaccagc

SEQ ID NO: 1783669 - RNA, 14 nt, Human
cagaugcaccagcc

SEQ ID NO: 1783670 - RNA, 16 nt, Human
cagaugcaccagcccu

SEQ ID NO: 1783671 - RNA, 16 nt, Human
cagaugauuucccccc

SEQ ID NO: 1783672 - RNA, 18 nt, Human
cagaugauuuccccccuc

SEQ ID NO: 1783673 - RNA, 15 nt, Human
cagaucuuaauauaa

SEQ ID NO: 1783674 - RNA, 18 nt, Human
cagaucuuaauauaaauu

SEQ ID NO: 1783675 - RNA, 14 nt, Human
cagaucuuggacuc

SEQ ID NO: 1783676 - RNA, 15 nt, Human
cagaucuuggacuca
